United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 60

SEQ ID NO: 2525917 - DNA, 11 bp, Homo sapiens
aagtgtaactg

SEQ ID NO: 2525918 - DNA, 12 bp, Homo sapiens
aagtgtaactgg

SEQ ID NO: 2525919 - DNA, 23 bp, Homo sapiens
aagtgtatatcagaaaagggaag

SEQ ID NO: 2525920 - DNA, 18 bp, Homo sapiens
aagtgtatgcacgtgtgc

SEQ ID NO: 2525921 - DNA, 23 bp, Homo sapiens
aagtgtatttttttactaataga

SEQ ID NO: 2525922 - DNA, 22 bp, Homo sapiens
aagtgtcatatgtaggtgtctg

SEQ ID NO: 2525923 - DNA, 13 bp, Homo sapiens
aagtgtgagcaaa

SEQ ID NO: 2525924 - DNA, 15 bp, Homo sapiens
aagtgtgagcagtga

SEQ ID NO: 2525925 - DNA, 11 bp, Homo sapiens
aagtgtgagta

SEQ ID NO: 2525926 - DNA, 19 bp, Homo sapiens
aagtgtgagtaagagctgg

SEQ ID NO: 2525927 - DNA, 20 bp, Homo sapiens
aagtgtgagtaagagctggt

SEQ ID NO: 2525928 - DNA, 11 bp, Homo sapiens
aagtgtgcata

SEQ ID NO: 2525929 - DNA, 19 bp, Homo sapiens
aagtgtgcatattgtacac

SEQ ID NO: 2525930 - DNA, 21 bp, Homo sapiens
aagtgtgcatattgtacactt

SEQ ID NO: 2525931 - DNA, 15 bp, Homo sapiens
aagtgtttatttttc

SEQ ID NO: 2525932 - DNA, 14 bp, Homo sapiens
aagtgtttctgtta

SEQ ID NO: 2525933 - DNA, 21 bp, Homo sapiens
aagtgtttctgttattaacaa

SEQ ID NO: 2525934 - DNA, 17 bp, Homo sapiens
aagttaaagtgaataac

SEQ ID NO: 2525935 - DNA, 14 bp, Homo sapiens
aagttaaattttat

SEQ ID NO: 2525936 - DNA, 14 bp, Homo sapiens
aagttactgaatgc

SEQ ID NO: 2525937 - DNA, 15 bp, Homo sapiens
aagttacttattcta

SEQ ID NO: 2525938 - DNA, 23 bp, Homo sapiens
aagttacttcactttaattctca

SEQ ID NO: 2525939 - DNA, 12 bp, Homo sapiens
aagttactttgt

SEQ ID NO: 2525940 - DNA, 14 bp, Homo sapiens
aagttagaattcct

SEQ ID NO: 2525941 - DNA, 17 bp, Homo sapiens
aagttagaattccttca

SEQ ID NO: 2525942 - DNA, 13 bp, Homo sapiens
aagttagctcagg

SEQ ID NO: 2525943 - DNA, 15 bp, Homo sapiens
aagttagctcaggag

SEQ ID NO: 2525944 - DNA, 21 bp, Homo sapiens
aagttagctgagcgtggtggc

SEQ ID NO: 2525945 - DNA, 17 bp, Homo sapiens
aagttatagtatatctg

SEQ ID NO: 2525946 - DNA, 14 bp, Homo sapiens
aagttattgacaaa

SEQ ID NO: 2525947 - DNA, 18 bp, Homo sapiens
aagttattgacaaactct

SEQ ID NO: 2525948 - DNA, 14 bp, Homo sapiens
aagttattgcagtt

SEQ ID NO: 2525949 - DNA, 23 bp, Homo sapiens
aagttattgcagtttatcattca

SEQ ID NO: 2525950 - DNA, 23 bp, Homo sapiens
aagttcaaattcttctgaactca

SEQ ID NO: 2525951 - DNA, 15 bp, Homo sapiens
aagttcatattccat

SEQ ID NO: 2525952 - DNA, 19 bp, Homo sapiens
aagttccaagttgctaata

SEQ ID NO: 2525953 - DNA, 15 bp, Homo sapiens
aagttccactgagct

SEQ ID NO: 2525954 - DNA, 20 bp, Homo sapiens
aagttccttatgtatattta

SEQ ID NO: 2525955 - DNA, 15 bp, Homo sapiens
aagttcttagttgct

SEQ ID NO: 2525956 - DNA, 17 bp, Homo sapiens
aagttgaaattaaccat

SEQ ID NO: 2525957 - DNA, 18 bp, Homo sapiens
aagttgatggtgatgaaa

SEQ ID NO: 2525958 - DNA, 20 bp, Homo sapiens
aagttgtgccttttatagct

SEQ ID NO: 2525959 - DNA, 15 bp, Homo sapiens
aagttgtgcttgttt

SEQ ID NO: 2525960 - DNA, 12 bp, Homo sapiens
aagttgtttgag

SEQ ID NO: 2525961 - DNA, 15 bp, Homo sapiens
aagttgtttgagaaa

SEQ ID NO: 2525962 - DNA, 14 bp, Homo sapiens
aagtttaattgact

SEQ ID NO: 2525963 - DNA, 23 bp, Homo sapiens
aagtttacaagtgtatatcagaa

SEQ ID NO: 2525964 - DNA, 19 bp, Homo sapiens
aagtttacaatcaaaggaa

SEQ ID NO: 2525965 - DNA, 19 bp, Homo sapiens
aagtttactcaaccctctc

SEQ ID NO: 2525966 - DNA, 11 bp, Homo sapiens
aagtttagaga

SEQ ID NO: 2525967 - DNA, 16 bp, Homo sapiens
aagtttcaatgtgatt

SEQ ID NO: 2525968 - DNA, 19 bp, Homo sapiens
aagtttcaggatacatgtg

SEQ ID NO: 2525969 - DNA, 16 bp, Homo sapiens
aagtttcaggtgacat

SEQ ID NO: 2525970 - DNA, 17 bp, Homo sapiens
aagtttcaggtgacatg

SEQ ID NO: 2525971 - DNA, 16 bp, Homo sapiens
aagtttccttggctgg

SEQ ID NO: 2525972 - DNA, 18 bp, Homo sapiens
aagtttccttggctggtg

SEQ ID NO: 2525973 - DNA, 18 bp, Homo sapiens
aagtttctcagctcccat

SEQ ID NO: 2525974 - DNA, 17 bp, Homo sapiens
aagtttgaaggaaacag

SEQ ID NO: 2525975 - DNA, 15 bp, Homo sapiens
aagtttgatttcatt

SEQ ID NO: 2525976 - DNA, 21 bp, Homo sapiens
aagtttgcactgtatgctgga

SEQ ID NO: 2525977 - DNA, 14 bp, Homo sapiens
aagttttaggacaa

SEQ ID NO: 2525978 - DNA, 22 bp, Homo sapiens
aagttttcccttgaggaaacaa

SEQ ID NO: 2525979 - DNA, 13 bp, Homo sapiens
aagttttcctgag

SEQ ID NO: 2525980 - DNA, 14 bp, Homo sapiens
aagttttgtacaga

SEQ ID NO: 2525981 - DNA, 12 bp, Homo sapiens
aagtttttgtac

SEQ ID NO: 2525982 - DNA, 14 bp, Homo sapiens
aagtttttgtactg

SEQ ID NO: 2525983 - DNA, 15 bp, Homo sapiens
aataaaaaaaagaaa

SEQ ID NO: 2525984 - DNA, 14 bp, Homo sapiens
aataaaaaccaaga

SEQ ID NO: 2525985 - DNA, 22 bp, Homo sapiens
aataaaaaccaagaagatgtct

SEQ ID NO: 2525986 - DNA, 17 bp, Homo sapiens
aataaaaagatcacttt

SEQ ID NO: 2525987 - DNA, 19 bp, Homo sapiens
aataaaaagtgacacagca

SEQ ID NO: 2525988 - DNA, 15 bp, Homo sapiens
aataaaaagttaaaa

SEQ ID NO: 2525989 - DNA, 14 bp, Homo sapiens
aataaaaatgttta

SEQ ID NO: 2525990 - DNA, 15 bp, Homo sapiens
aataaaacctttcaa

SEQ ID NO: 2525991 - DNA, 23 bp, Homo sapiens
aatgtctgtagctcctcaactca

SEQ ID NO: 2525992 - DNA, 11 bp, Homo sapiens
aatgtcttgtg

SEQ ID NO: 2525993 - DNA, 17 bp, Homo sapiens
aatgtcttttgaatatt

SEQ ID NO: 2525994 - DNA, 15 bp, Homo sapiens
aatgtgaaaagaaaa

SEQ ID NO: 2525995 - DNA, 22 bp, Homo sapiens
aatgtgaaaatggtccaggaga

SEQ ID NO: 2525996 - DNA, 13 bp, Homo sapiens
aatgtgaaagcac

SEQ ID NO: 2525997 - DNA, 17 bp, Homo sapiens
aatgtgaagtgttaata

SEQ ID NO: 2525998 - DNA, 16 bp, Homo sapiens
aatgtgatattataca

SEQ ID NO: 2525999 - DNA, 16 bp, Homo sapiens
aatgtgatgaatactg

SEQ ID NO: 2526000 - DNA, 22 bp, Homo sapiens
aatgtgcaggtttgttacatag

SEQ ID NO: 2526001 - DNA, 17 bp, Homo sapiens
aatgtgcctagttcttt

SEQ ID NO: 2526002 - DNA, 18 bp, Homo sapiens
aatgtgctatactgcata

SEQ ID NO: 2526003 - DNA, 17 bp, Homo sapiens
aatgtgctgtgtaaagt

SEQ ID NO: 2526004 - DNA, 21 bp, Homo sapiens
aatgtgctgtgtaaagttagt

SEQ ID NO: 2526005 - DNA, 18 bp, Homo sapiens
aatgtgggagcagcggtt

SEQ ID NO: 2526006 - DNA, 19 bp, Homo sapiens
aatgtggttatttctctga

SEQ ID NO: 2526007 - DNA, 15 bp, Homo sapiens
aatgttaaaatgtat

SEQ ID NO: 2526008 - DNA, 12 bp, Homo sapiens
aatgttaaattt

SEQ ID NO: 2526009 - DNA, 18 bp, Homo sapiens
aatgttaaatttgtaagt

SEQ ID NO: 2526010 - DNA, 21 bp, Homo sapiens
aatgttaaatttgtaagtttc

SEQ ID NO: 2526011 - DNA, 15 bp, Homo sapiens
aatgttacattgttt

SEQ ID NO: 2526012 - DNA, 18 bp, Homo sapiens
aatgttactgatcatgca

SEQ ID NO: 2526013 - DNA, 19 bp, Homo sapiens
aatgttattttttaattat

SEQ ID NO: 2526014 - DNA, 13 bp, Homo sapiens
aatgttcatcaat

SEQ ID NO: 2526015 - DNA, 20 bp, Homo sapiens
aatgttcatcaatgaatgaa

SEQ ID NO: 2526016 - DNA, 12 bp, Homo sapiens
aatgttcattgt

SEQ ID NO: 2526017 - DNA, 21 bp, Homo sapiens
aatgttcattgtaatgttact

SEQ ID NO: 2526018 - DNA, 20 bp, Homo sapiens
aatgttctgacattaacagt

SEQ ID NO: 2526019 - DNA, 15 bp, Homo sapiens
aatgtttatgagcca

SEQ ID NO: 2526020 - DNA, 16 bp, Homo sapiens
aatgtttatgagccag

SEQ ID NO: 2526021 - DNA, 17 bp, Homo sapiens
aatgtttatgagccaga

SEQ ID NO: 2526022 - DNA, 18 bp, Homo sapiens
aatgtttatgagccagac

SEQ ID NO: 2526023 - DNA, 20 bp, Homo sapiens
aatgtttattcctgataata

SEQ ID NO: 2526024 - DNA, 15 bp, Homo sapiens
aatgtttattccttg

SEQ ID NO: 2526025 - DNA, 20 bp, Homo sapiens
aatgtttccaacctggagta

SEQ ID NO: 2526026 - DNA, 22 bp, Homo sapiens
aatgtttcttctaggttctaaa

SEQ ID NO: 2526027 - DNA, 16 bp, Homo sapiens
aatgtttgcctctgcc

SEQ ID NO: 2526028 - DNA, 12 bp, Homo sapiens
aatgtttgctat

SEQ ID NO: 2526029 - DNA, 20 bp, Homo sapiens
aatgttttactgtgaaactg

SEQ ID NO: 2526030 - DNA, 15 bp, Homo sapiens
aatgtttttctgcca

SEQ ID NO: 2526031 - DNA, 17 bp, Homo sapiens
aattaaaaaatttccag

SEQ ID NO: 2526032 - DNA, 14 bp, Homo sapiens
aattaaacggatta

SEQ ID NO: 2526033 - DNA, 16 bp, Homo sapiens
aattaaacggattatt

SEQ ID NO: 2526034 - DNA, 17 bp, Homo sapiens
aattaaacggattattt

SEQ ID NO: 2526035 - DNA, 22 bp, Homo sapiens
aattaaacggattattttttca

SEQ ID NO: 2526036 - DNA, 11 bp, Homo sapiens
aattaaatgta

SEQ ID NO: 2526037 - DNA, 17 bp, Homo sapiens
aattaaccaaaaaagtt

SEQ ID NO: 2526038 - DNA, 16 bp, Homo sapiens
aattaacctggtgctg

SEQ ID NO: 2526039 - DNA, 11 bp, Homo sapiens
aattaacttga

SEQ ID NO: 2526040 - DNA, 16 bp, Homo sapiens
aattaacttttataaa

SEQ ID NO: 2526041 - DNA, 13 bp, Homo sapiens
aattaagtactat

SEQ ID NO: 2526042 - DNA, 16 bp, Homo sapiens
aattaagtactatgta

SEQ ID NO: 2526043 - DNA, 14 bp, Homo sapiens
aattaagtatctga

SEQ ID NO: 2526044 - DNA, 14 bp, Homo sapiens
aattaagttatctt

SEQ ID NO: 2526045 - DNA, 16 bp, Homo sapiens
aattaatcatgaatgt

SEQ ID NO: 2526046 - DNA, 17 bp, Homo sapiens
aattaatgaaatatctg

SEQ ID NO: 2526047 - DNA, 17 bp, Homo sapiens
aattacatgtaaaacat

SEQ ID NO: 2526048 - DNA, 21 bp, Homo sapiens
aattaccttgagccagtaatt

SEQ ID NO: 2526049 - DNA, 17 bp, Homo sapiens
aattactacaaaatttg

SEQ ID NO: 2526050 - DNA, 22 bp, Homo sapiens
aattacttatcatccacattgt

SEQ ID NO: 2526051 - DNA, 18 bp, Homo sapiens
aattagaaattggctgga

SEQ ID NO: 2526052 - DNA, 20 bp, Homo sapiens
aattaggaataaataaaaat

SEQ ID NO: 2526053 - DNA, 17 bp, Homo sapiens
aattaggggttgctaag

SEQ ID NO: 2526054 - DNA, 17 bp, Homo sapiens
aattagtaacatgtgtt

SEQ ID NO: 2526055 - DNA, 17 bp, Homo sapiens
aattagtatttatttaa

SEQ ID NO: 2526056 - DNA, 17 bp, Homo sapiens
aattataacttaaaata

SEQ ID NO: 2526057 - DNA, 20 bp, Homo sapiens
aattataagaggctgataat

SEQ ID NO: 2526058 - DNA, 15 bp, Homo sapiens
aattatagatgggaa

SEQ ID NO: 2526059 - DNA, 22 bp, Homo sapiens
aattatagtgatgtaatcttga

SEQ ID NO: 2526060 - DNA, 20 bp, Homo sapiens
aattatataggttgtgcaaa

SEQ ID NO: 2526061 - DNA, 15 bp, Homo sapiens
aattatccagagttt

SEQ ID NO: 2526062 - DNA, 15 bp, Homo sapiens
aattatcggaagcag

SEQ ID NO: 2526063 - DNA, 17 bp, Homo sapiens
aattatcggaagcagtg

SEQ ID NO: 2526064 - DNA, 21 bp, Homo sapiens
aattatcggaagcagtgcctt

SEQ ID NO: 2526065 - DNA, 17 bp, Homo sapiens
aattatcgggaacagtg

SEQ ID NO: 2526066 - DNA, 19 bp, Homo sapiens
aattatcgggaacagtgtt

SEQ ID NO: 2526067 - DNA, 23 bp, Homo sapiens
aattatcgggaacagtgtttccc

SEQ ID NO: 2526068 - DNA, 15 bp, Homo sapiens
aattatgacagttat

SEQ ID NO: 2526069 - DNA, 21 bp, Homo sapiens
aattatgtatgtttacatatc

SEQ ID NO: 2526070 - DNA, 21 bp, Homo sapiens
aattatgtttatataaatgct

SEQ ID NO: 2526071 - DNA, 20 bp, Homo sapiens
aattattagtttacatcatt

SEQ ID NO: 2526072 - DNA, 13 bp, Homo sapiens
aattattattctt

SEQ ID NO: 2526073 - DNA, 16 bp, Homo sapiens
aattattatttgtgtt

SEQ ID NO: 2526074 - DNA, 14 bp, Homo sapiens
aattatttaataaa

SEQ ID NO: 2526075 - DNA, 21 bp, Homo sapiens
aattatttattaaatgcccag

SEQ ID NO: 2526076 - DNA, 20 bp, Homo sapiens
aattatttatttatggagga

SEQ ID NO: 2526077 - DNA, 13 bp, Homo sapiens
aattatttcagaa

SEQ ID NO: 2526078 - DNA, 18 bp, Homo sapiens
aattatttgtgtaataga

SEQ ID NO: 2526079 - DNA, 19 bp, Homo sapiens
aattatttgtgtaatagaa

SEQ ID NO: 2526080 - DNA, 17 bp, Homo sapiens
aattatttttacagttc

SEQ ID NO: 2526081 - DNA, 15 bp, Homo sapiens
aattcaaaaagtgtt

SEQ ID NO: 2526082 - DNA, 21 bp, Homo sapiens
aattcacatctaacctcatct

SEQ ID NO: 2526083 - DNA, 22 bp, Homo sapiens
aattcacatctaacctcatctt

SEQ ID NO: 2526084 - DNA, 14 bp, Homo sapiens
aattcaccaaagta

SEQ ID NO: 2526085 - DNA, 17 bp, Homo sapiens
aattcaccaaagtattt

SEQ ID NO: 2526086 - DNA, 23 bp, Homo sapiens
aattcagcactgatttcacaaca

SEQ ID NO: 2526087 - DNA, 14 bp, Homo sapiens
aattcatgaacttc

SEQ ID NO: 2526088 - DNA, 18 bp, Homo sapiens
aattccatgaatcgcttc

SEQ ID NO: 2526089 - DNA, 16 bp, Homo sapiens
aattcccattttgcaa

SEQ ID NO: 2526090 - DNA, 17 bp, Homo sapiens
aattcccattttgcaaa

SEQ ID NO: 2526091 - DNA, 12 bp, Homo sapiens
aattccccagat

SEQ ID NO: 2526092 - DNA, 22 bp, Homo sapiens
aattcctatacgcagcgtgctt

SEQ ID NO: 2526093 - DNA, 12 bp, Homo sapiens
aattcctattgt

SEQ ID NO: 2526094 - DNA, 16 bp, Homo sapiens
aattcctattgtgatt

SEQ ID NO: 2526095 - DNA, 21 bp, Homo sapiens
aattcctctcactaaacttta

SEQ ID NO: 2526096 - DNA, 21 bp, Homo sapiens
aattccttggcatgccttcca

SEQ ID NO: 2526097 - DNA, 15 bp, Homo sapiens
aattcgaaccaggaa

SEQ ID NO: 2526098 - DNA, 13 bp, Homo sapiens
aattctaaatgaa

SEQ ID NO: 2526099 - DNA, 15 bp, Homo sapiens
aattctacattgtca

SEQ ID NO: 2526100 - DNA, 14 bp, Homo sapiens
aattctatttgctg

SEQ ID NO: 2526101 - DNA, 21 bp, Homo sapiens
aattctcatgtgatcctttta

SEQ ID NO: 2526102 - DNA, 21 bp, Homo sapiens
aattctcatttgtcacacact

SEQ ID NO: 2526103 - DNA, 14 bp, Homo sapiens
aattctctttcaaa

SEQ ID NO: 2526104 - DNA, 10 bp, Homo sapiens
aattctgaat

SEQ ID NO: 2526105 - DNA, 20 bp, Homo sapiens
aattctgcaatgttttcctt

SEQ ID NO: 2526106 - DNA, 19 bp, Homo sapiens
aattctgtacatagcctat

SEQ ID NO: 2526107 - DNA, 20 bp, Homo sapiens
aattctgtacatagcctata

SEQ ID NO: 2526108 - DNA, 14 bp, Homo sapiens
aattcttaaaatat

SEQ ID NO: 2526109 - DNA, 16 bp, Homo sapiens
aattcttaagtatgtt

SEQ ID NO: 2526110 - DNA, 13 bp, Homo sapiens
aattcttacatgt

SEQ ID NO: 2526111 - DNA, 11 bp, Homo sapiens
aattcttccct

SEQ ID NO: 2526112 - DNA, 14 bp, Homo sapiens
aattcttgcaaagt

SEQ ID NO: 2526113 - DNA, 20 bp, Homo sapiens
aattcttgcaaagtatccct

SEQ ID NO: 2526114 - DNA, 18 bp, Homo sapiens
aattcttggttgaggaaa

SEQ ID NO: 2526115 - DNA, 20 bp, Homo sapiens
aattcttggttgaggaaaca

SEQ ID NO: 2526116 - DNA, 20 bp, Homo sapiens
aattcttgtatattatggaa

SEQ ID NO: 2526117 - DNA, 13 bp, Homo sapiens
aattctttataca

SEQ ID NO: 2526118 - DNA, 19 bp, Homo sapiens
aattctttatacaacagtg

SEQ ID NO: 2526119 - DNA, 21 bp, Homo sapiens
aattctttatacaacagtgct

SEQ ID NO: 2526120 - DNA, 22 bp, Homo sapiens
aattctttatacaacagtgcta

SEQ ID NO: 2526121 - DNA, 21 bp, Homo sapiens
aattgaataatggtaccagat

SEQ ID NO: 2526122 - DNA, 21 bp, Homo sapiens
aattgacagatcaagctgtga

SEQ ID NO: 2526123 - DNA, 14 bp, Homo sapiens
aattgacattgctt

SEQ ID NO: 2526124 - DNA, 21 bp, Homo sapiens
aattgacttatttatataaat

SEQ ID NO: 2526125 - DNA, 14 bp, Homo sapiens
aattgaggtctgct

SEQ ID NO: 2526126 - DNA, 22 bp, Homo sapiens
aattgatcataggtatttcaaa

SEQ ID NO: 2526127 - DNA, 14 bp, Homo sapiens
aattgcactctaaa

SEQ ID NO: 2526128 - DNA, 19 bp, Homo sapiens
aattgcctgcagagagaag

SEQ ID NO: 2526129 - DNA, 13 bp, Homo sapiens
aattgctgtgtat

SEQ ID NO: 2526130 - DNA, 20 bp, Homo sapiens
aattgcttacatttttacaa

SEQ ID NO: 2526131 - DNA, 21 bp, Homo sapiens
aattgcttacatttttacaat

SEQ ID NO: 2526132 - DNA, 18 bp, Homo sapiens
aattggcatgtgtatgtt

SEQ ID NO: 2526133 - DNA, 15 bp, Homo sapiens
aattggttctttatt

SEQ ID NO: 2526134 - DNA, 14 bp, Homo sapiens
aattgtaactgttc

SEQ ID NO: 2526135 - DNA, 14 bp, Homo sapiens
aattgtataacagg

SEQ ID NO: 2526136 - DNA, 18 bp, Homo sapiens
acaacagatttgtgaact

SEQ ID NO: 2526137 - DNA, 17 bp, Homo sapiens
acaacagtgctaaaaat

SEQ ID NO: 2526138 - DNA, 19 bp, Homo sapiens
acaaccctgcaaaggactg

SEQ ID NO: 2526139 - DNA, 19 bp, Homo sapiens
acaaccgatgctccagcca

SEQ ID NO: 2526140 - DNA, 20 bp, Homo sapiens
acaaccgatgctccagccaa

SEQ ID NO: 2526141 - DNA, 15 bp, Homo sapiens
acaacctcaactgcc

SEQ ID NO: 2526142 - DNA, 23 bp, Homo sapiens
acaacctgcttgggtggagaagc

SEQ ID NO: 2526143 - DNA, 12 bp, Homo sapiens
acaacctggaga

SEQ ID NO: 2526144 - DNA, 14 bp, Homo sapiens
acaacgaggaagcc

SEQ ID NO: 2526145 - DNA, 15 bp, Homo sapiens
acaacgaggaagccc

SEQ ID NO: 2526146 - DNA, 18 bp, Homo sapiens
acaactatgatttggaaa

SEQ ID NO: 2526147 - DNA, 14 bp, Homo sapiens
acaacttaaataat

SEQ ID NO: 2526148 - DNA, 16 bp, Homo sapiens
acaagaaatccctgtt

SEQ ID NO: 2526149 - DNA, 21 bp, Homo sapiens
acaagaaatccctgtttaata

SEQ ID NO: 2526150 - DNA, 18 bp, Homo sapiens
acaagaaatttgatttct

SEQ ID NO: 2526151 - DNA, 15 bp, Homo sapiens
acaagaactgaaacc

SEQ ID NO: 2526152 - DNA, 23 bp, Homo sapiens
acaagaagggttttccaccctgg

SEQ ID NO: 2526153 - DNA, 16 bp, Homo sapiens
acaagaccacgtttct

SEQ ID NO: 2526154 - DNA, 20 bp, Homo sapiens
acaagacccaaaaggcagaa

SEQ ID NO: 2526155 - DNA, 15 bp, Homo sapiens
acaagagcagcctgt

SEQ ID NO: 2526156 - DNA, 18 bp, Homo sapiens
acaagagcagcctgtggc

SEQ ID NO: 2526157 - DNA, 19 bp, Homo sapiens
acaagagcagcctgtggca

SEQ ID NO: 2526158 - DNA, 22 bp, Homo sapiens
acaagagtttatttccaaataa

SEQ ID NO: 2526159 - DNA, 13 bp, Homo sapiens
acaagcaagctcc

SEQ ID NO: 2526160 - DNA, 18 bp, Homo sapiens
acaagccacagaagccag

SEQ ID NO: 2526161 - DNA, 18 bp, Homo sapiens
acaagccacgaatgaatg

SEQ ID NO: 2526162 - DNA, 15 bp, Homo sapiens
acaagccccaggcag

SEQ ID NO: 2526163 - DNA, 16 bp, Homo sapiens
acaagccccaggcagg

SEQ ID NO: 2526164 - DNA, 19 bp, Homo sapiens
acaagccccaggcaggctg

SEQ ID NO: 2526165 - DNA, 18 bp, Homo sapiens
acaagcgtgagccactgc

SEQ ID NO: 2526166 - DNA, 13 bp, Homo sapiens
acaagctccaagc

SEQ ID NO: 2526167 - DNA, 22 bp, Homo sapiens
acaagctgcaaatcagccatgt

SEQ ID NO: 2526168 - DNA, 17 bp, Homo sapiens
acaaggaaggtggtggg

SEQ ID NO: 2526169 - DNA, 17 bp, Homo sapiens
acaaggctagatcatga

SEQ ID NO: 2526170 - DNA, 20 bp, Homo sapiens
acaaggttccctctgagaat

SEQ ID NO: 2526171 - DNA, 13 bp, Homo sapiens
acaaggttcttcc

SEQ ID NO: 2526172 - DNA, 17 bp, Homo sapiens
acaagtcctgtgaattt

SEQ ID NO: 2526173 - DNA, 18 bp, Homo sapiens
acaagtgaaaaacatcca

SEQ ID NO: 2526174 - DNA, 22 bp, Homo sapiens
acaagtgagttgttgccctggg

SEQ ID NO: 2526175 - DNA, 12 bp, Homo sapiens
acaagtgctggc

SEQ ID NO: 2526176 - DNA, 19 bp, Homo sapiens
acaagtgtatatcagaaaa

SEQ ID NO: 2526177 - DNA, 12 bp, Homo sapiens
acaataaaacat

SEQ ID NO: 2526178 - DNA, 20 bp, Homo sapiens
acaataaaattttttttcat

SEQ ID NO: 2526179 - DNA, 22 bp, Homo sapiens
acaataaaattttttttcatgt

SEQ ID NO: 2526180 - DNA, 23 bp, Homo sapiens
acaataaaattttttttcatgtt

SEQ ID NO: 2526181 - DNA, 14 bp, Homo sapiens
acaataaatgtgca

SEQ ID NO: 2526182 - DNA, 16 bp, Homo sapiens
acaataactactgtgt

SEQ ID NO: 2526183 - DNA, 17 bp, Homo sapiens
acaataactactgtgtt

SEQ ID NO: 2526184 - DNA, 21 bp, Homo sapiens
acaataactactgtgttcctg

SEQ ID NO: 2526185 - DNA, 22 bp, Homo sapiens
acaataactactgtgttcctgg

SEQ ID NO: 2526186 - DNA, 13 bp, Homo sapiens
acaataatttcag

SEQ ID NO: 2526187 - DNA, 15 bp, Homo sapiens
acaatatgaatacag

SEQ ID NO: 2526188 - DNA, 15 bp, Homo sapiens
acaatattgtttcta

SEQ ID NO: 2526189 - DNA, 14 bp, Homo sapiens
acaatatttaaaat

SEQ ID NO: 2526190 - DNA, 23 bp, Homo sapiens
acaatcaactctaatagtgctta

SEQ ID NO: 2526191 - DNA, 18 bp, Homo sapiens
acaatcagctccttcctg

SEQ ID NO: 2526192 - DNA, 15 bp, Homo sapiens
acaatcagtcccctc

SEQ ID NO: 2526193 - DNA, 18 bp, Homo sapiens
acaatcatgaaatatgca

SEQ ID NO: 2526194 - DNA, 19 bp, Homo sapiens
acaatcatgaaatatgcat

SEQ ID NO: 2526195 - DNA, 18 bp, Homo sapiens
acaatcattgctgaaaat

SEQ ID NO: 2526196 - DNA, 17 bp, Homo sapiens
acaatcctagtgctttc

SEQ ID NO: 2526197 - DNA, 22 bp, Homo sapiens
acaatcctagtgctttcctttt

SEQ ID NO: 2526198 - DNA, 23 bp, Homo sapiens
acaatcctagtgctttccttttt

SEQ ID NO: 2526199 - DNA, 17 bp, Homo sapiens
acaatcgatggccttgc

SEQ ID NO: 2526200 - DNA, 12 bp, Homo sapiens
acaatctcaaat

SEQ ID NO: 2526201 - DNA, 18 bp, Homo sapiens
acaatcttaaggggcagc

SEQ ID NO: 2526202 - DNA, 12 bp, Homo sapiens
acaatgacttac

SEQ ID NO: 2526203 - DNA, 17 bp, Homo sapiens
acaatgacttactgtac

SEQ ID NO: 2526204 - DNA, 18 bp, Homo sapiens
acaatgacttactgtaca

SEQ ID NO: 2526205 - DNA, 19 bp, Homo sapiens
acaatgacttactgtacat

SEQ ID NO: 2526206 - DNA, 22 bp, Homo sapiens
acaatgacttactgtacatgaa

SEQ ID NO: 2526207 - DNA, 14 bp, Homo sapiens
acaatgactttatt

SEQ ID NO: 2526208 - DNA, 22 bp, Homo sapiens
acaatgctgtgccctaaagtgt

SEQ ID NO: 2526209 - DNA, 24 bp, Homo sapiens
acaatgctgtgccctaaagtgtat

SEQ ID NO: 2526210 - DNA, 16 bp, Homo sapiens
acaatggaaactgaat

SEQ ID NO: 2526211 - DNA, 21 bp, Homo sapiens
acaatggctaattcccagagt

SEQ ID NO: 2526212 - DNA, 19 bp, Homo sapiens
acaatgtatttatttaaaa

SEQ ID NO: 2526213 - DNA, 20 bp, Homo sapiens
acaatgtatttatttaaaag

SEQ ID NO: 2526214 - DNA, 23 bp, Homo sapiens
acaatgtatttatttaaaagatt

SEQ ID NO: 2526215 - DNA, 19 bp, Homo sapiens
acaatgttaaggaaactct

SEQ ID NO: 2526216 - DNA, 18 bp, Homo sapiens
acaattatttttacagtt

SEQ ID NO: 2526217 - DNA, 15 bp, Homo sapiens
acaattcatgaactt

SEQ ID NO: 2526218 - DNA, 23 bp, Homo sapiens
acaattcctctactaacaatcag

SEQ ID NO: 2526219 - DNA, 15 bp, Homo sapiens
acaattctttataca

SEQ ID NO: 2526220 - DNA, 17 bp, Homo sapiens
acaattctttatacaac

SEQ ID NO: 2526221 - DNA, 18 bp, Homo sapiens
acaattctttatacaaca

SEQ ID NO: 2526222 - DNA, 19 bp, Homo sapiens
acaattctttatacaacag

SEQ ID NO: 2526223 - DNA, 12 bp, Homo sapiens
acaattgaaatg

SEQ ID NO: 2526224 - DNA, 21 bp, Homo sapiens
acaattgtttggggttgaaaa

SEQ ID NO: 2526225 - DNA, 13 bp, Homo sapiens
acaatttattatg

SEQ ID NO: 2526226 - DNA, 19 bp, Homo sapiens
acaatttcaaaaaaataaa

SEQ ID NO: 2526227 - DNA, 20 bp, Homo sapiens
acaatttcctttatatttag

SEQ ID NO: 2526228 - DNA, 18 bp, Homo sapiens
acaatttttttaattttg

SEQ ID NO: 2526229 - DNA, 18 bp, Homo sapiens
acacaaacgggctcagca

SEQ ID NO: 2526230 - DNA, 14 bp, Homo sapiens
acacaaatgcaggg

SEQ ID NO: 2526231 - DNA, 15 bp, Homo sapiens
acacaagtcctgtga

SEQ ID NO: 2526232 - DNA, 14 bp, Homo sapiens
acacaatacaataa

SEQ ID NO: 2526233 - DNA, 15 bp, Homo sapiens
acacacacacacaca

SEQ ID NO: 2526234 - DNA, 13 bp, Homo sapiens
acacacacacagg

SEQ ID NO: 2526235 - DNA, 14 bp, Homo sapiens
acacacacacagga

SEQ ID NO: 2526236 - DNA, 12 bp, Homo sapiens
acacacacacat

SEQ ID NO: 2526237 - DNA, 13 bp, Homo sapiens
acacacacacatg

SEQ ID NO: 2526238 - DNA, 14 bp, Homo sapiens
acacacacacgcac

SEQ ID NO: 2526239 - DNA, 12 bp, Homo sapiens
acacacacagaa

SEQ ID NO: 2526240 - DNA, 14 bp, Homo sapiens
acacacacagaaaa

SEQ ID NO: 2526241 - DNA, 16 bp, Homo sapiens
acacacacagaaaata

SEQ ID NO: 2526242 - DNA, 12 bp, Homo sapiens
acacacacagcc

SEQ ID NO: 2526243 - DNA, 14 bp, Homo sapiens
acacacacagccac

SEQ ID NO: 2526244 - DNA, 11 bp, Homo sapiens
acacacacagg

SEQ ID NO: 2526245 - DNA, 14 bp, Homo sapiens
acacacacatacac

SEQ ID NO: 2526246 - DNA, 12 bp, Homo sapiens
acacacacatgc

SEQ ID NO: 2526247 - DNA, 17 bp, Homo sapiens
acacacaccacacatac

SEQ ID NO: 2526248 - DNA, 21 bp, Homo sapiens
acacacacgcacgcacacaca

SEQ ID NO: 2526249 - DNA, 14 bp, Homo sapiens
acacacagaaaata

SEQ ID NO: 2526250 - DNA, 22 bp, Homo sapiens
acacacagaaaatatactgtaa

SEQ ID NO: 2526251 - DNA, 13 bp, Homo sapiens
acacacagacaca

SEQ ID NO: 2526252 - DNA, 22 bp, Homo sapiens
acacacagaggaagagcaggca

SEQ ID NO: 2526253 - DNA, 18 bp, Homo sapiens
acacacagccacacacac

SEQ ID NO: 2526254 - DNA, 12 bp, Homo sapiens
acacacagctct

SEQ ID NO: 2526255 - DNA, 21 bp, Homo sapiens
acacacatgcatacacacaca

SEQ ID NO: 2526256 - DNA, 15 bp, Homo sapiens
acacaccacacatac

SEQ ID NO: 2526257 - DNA, 16 bp, Homo sapiens
acacaccaggctgtgg

SEQ ID NO: 2526258 - DNA, 21 bp, Homo sapiens
acacacctaagggacatgttt

SEQ ID NO: 2526259 - DNA, 17 bp, Homo sapiens
acacacgcacgcacaca

SEQ ID NO: 2526260 - DNA, 18 bp, Homo sapiens
acacacgcacgcacacac

SEQ ID NO: 2526261 - DNA, 13 bp, Homo sapiens
acacactaatcga

SEQ ID NO: 2526262 - DNA, 16 bp, Homo sapiens
acacactgaggcaggg

SEQ ID NO: 2526263 - DNA, 14 bp, Homo sapiens
acacactttttaag

SEQ ID NO: 2526264 - DNA, 19 bp, Homo sapiens
acacactttttaagaaata

SEQ ID NO: 2526265 - DNA, 13 bp, Homo sapiens
acacagaaaatat

SEQ ID NO: 2526266 - DNA, 16 bp, Homo sapiens
acacagaaaatatact

SEQ ID NO: 2526267 - DNA, 21 bp, Homo sapiens
acacagaaaatatactgtaaa

SEQ ID NO: 2526268 - DNA, 23 bp, Homo sapiens
acacagagtggtctttctggaga

SEQ ID NO: 2526269 - DNA, 21 bp, Homo sapiens
acacagatgaaacacaaacaa

SEQ ID NO: 2526270 - DNA, 14 bp, Homo sapiens
acacagcagcagtt

SEQ ID NO: 2526271 - DNA, 13 bp, Homo sapiens
acacagccacaca

SEQ ID NO: 2526272 - DNA, 20 bp, Homo sapiens
acacagccacacacacagaa

SEQ ID NO: 2526273 - DNA, 22 bp, Homo sapiens
acacagccacacacacagaaaa

SEQ ID NO: 2526274 - DNA, 14 bp, Homo sapiens
acacagctcttctc

SEQ ID NO: 2526275 - DNA, 22 bp, Homo sapiens
acacagctgagagacttttaat

SEQ ID NO: 2526276 - DNA, 20 bp, Homo sapiens
acacagctttatcaccagag

SEQ ID NO: 2526277 - DNA, 21 bp, Homo sapiens
acacagctttatcaccagaga

SEQ ID NO: 2526278 - DNA, 18 bp, Homo sapiens
acacaggacccccttccc

SEQ ID NO: 2526279 - DNA, 16 bp, Homo sapiens
acacaggcaactgagg

SEQ ID NO: 2526280 - DNA, 21 bp, Homo sapiens
acacaggcaactgaggcagac

SEQ ID NO: 2526281 - DNA, 16 bp, Homo sapiens
acatcactctgctgct

SEQ ID NO: 2526282 - DNA, 22 bp, Homo sapiens
acatcagcacgatttctgttta

SEQ ID NO: 2526283 - DNA, 18 bp, Homo sapiens
acatccccccgccaaaag

SEQ ID NO: 2526284 - DNA, 15 bp, Homo sapiens
acatccctgccagct

SEQ ID NO: 2526285 - DNA, 16 bp, Homo sapiens
acatccctgccagctc

SEQ ID NO: 2526286 - DNA, 17 bp, Homo sapiens
acatccctgccagctct

SEQ ID NO: 2526287 - DNA, 17 bp, Homo sapiens
acatcgtgaaaccctgt

SEQ ID NO: 2526288 - DNA, 17 bp, Homo sapiens
acatctaacctcatctt

SEQ ID NO: 2526289 - DNA, 12 bp, Homo sapiens
acatctcagacc

SEQ ID NO: 2526290 - DNA, 21 bp, Homo sapiens
acatctcctccatactcagga

SEQ ID NO: 2526291 - DNA, 23 bp, Homo sapiens
acatctctttgaattttctgtgt

SEQ ID NO: 2526292 - DNA, 15 bp, Homo sapiens
acatctgtgtcttgt

SEQ ID NO: 2526293 - DNA, 13 bp, Homo sapiens
acatcttcaaagc

SEQ ID NO: 2526294 - DNA, 16 bp, Homo sapiens
acatcttcagcaaata

SEQ ID NO: 2526295 - DNA, 15 bp, Homo sapiens
acatcttgctctgct

SEQ ID NO: 2526296 - DNA, 19 bp, Homo sapiens
acatcttgctctgctgaca

SEQ ID NO: 2526297 - DNA, 13 bp, Homo sapiens
acatcttggcaca

SEQ ID NO: 2526298 - DNA, 17 bp, Homo sapiens
acatctttatctgttct

SEQ ID NO: 2526299 - DNA, 14 bp, Homo sapiens
acatctttcacact

SEQ ID NO: 2526300 - DNA, 20 bp, Homo sapiens
acatctttcacacttccacc

SEQ ID NO: 2526301 - DNA, 15 bp, Homo sapiens
acatgaaaacacatt

SEQ ID NO: 2526302 - DNA, 16 bp, Homo sapiens
acatgaaaacacattt

SEQ ID NO: 2526303 - DNA, 18 bp, Homo sapiens
acatgaaaacacattttt

SEQ ID NO: 2526304 - DNA, 23 bp, Homo sapiens
acatgaaaacacatttttcttag

SEQ ID NO: 2526305 - DNA, 16 bp, Homo sapiens
acatgaagaagctaaa

SEQ ID NO: 2526306 - DNA, 18 bp, Homo sapiens
acatgaagattctttccc

SEQ ID NO: 2526307 - DNA, 19 bp, Homo sapiens
acatgaagtgtgtttcctt

SEQ ID NO: 2526308 - DNA, 23 bp, Homo sapiens
acatgaatcccacccacatgtga

SEQ ID NO: 2526309 - DNA, 15 bp, Homo sapiens
acatgaatgcacact

SEQ ID NO: 2526310 - DNA, 15 bp, Homo sapiens
acatgacaactttgc

SEQ ID NO: 2526311 - DNA, 14 bp, Homo sapiens
acatgacacagctt

SEQ ID NO: 2526312 - DNA, 21 bp, Homo sapiens
acatgaccctaaatcttgact

SEQ ID NO: 2526313 - DNA, 14 bp, Homo sapiens
acatgagatttata

SEQ ID NO: 2526314 - DNA, 17 bp, Homo sapiens
acatgagcatcaggcca

SEQ ID NO: 2526315 - DNA, 15 bp, Homo sapiens
acatgatcttcttta

SEQ ID NO: 2526316 - DNA, 18 bp, Homo sapiens
acatgcaaggtcattttt

SEQ ID NO: 2526317 - DNA, 18 bp, Homo sapiens
acatgcacacctccccct

SEQ ID NO: 2526318 - DNA, 18 bp, Homo sapiens
acatgcagcccatgccca

SEQ ID NO: 2526319 - DNA, 20 bp, Homo sapiens
acatgcagcccatgcccacc

SEQ ID NO: 2526320 - DNA, 23 bp, Homo sapiens
acatgcagctgcaccctccctcc

SEQ ID NO: 2526321 - DNA, 24 bp, Homo sapiens
acatgcatacacacacacacacag

SEQ ID NO: 2526322 - DNA, 16 bp, Homo sapiens
acatgcatacttcaaa

SEQ ID NO: 2526323 - DNA, 21 bp, Homo sapiens
acatgcatacttcaaaagtat

SEQ ID NO: 2526324 - DNA, 14 bp, Homo sapiens
acatgccaagcact

SEQ ID NO: 2526325 - DNA, 17 bp, Homo sapiens
acatgctgaagccaaag

SEQ ID NO: 2526326 - DNA, 17 bp, Homo sapiens
acatggaactcattcct

SEQ ID NO: 2526327 - DNA, 18 bp, Homo sapiens
acatggaataacatgtaa

SEQ ID NO: 2526328 - DNA, 15 bp, Homo sapiens
acatggacttgtata

SEQ ID NO: 2526329 - DNA, 18 bp, Homo sapiens
acatggacttgtatattt

SEQ ID NO: 2526330 - DNA, 17 bp, Homo sapiens
acatggagactcctgcc

SEQ ID NO: 2526331 - DNA, 22 bp, Homo sapiens
acatggagactcctgccctgtt

SEQ ID NO: 2526332 - DNA, 22 bp, Homo sapiens
acatggcccctccccctgccag

SEQ ID NO: 2526333 - DNA, 18 bp, Homo sapiens
acatggcctatgcacata

SEQ ID NO: 2526334 - DNA, 20 bp, Homo sapiens
acatggcctatgcacatatg

SEQ ID NO: 2526335 - DNA, 14 bp, Homo sapiens
acatggcttagttt

SEQ ID NO: 2526336 - DNA, 16 bp, Homo sapiens
acatggcttcctcctg

SEQ ID NO: 2526337 - DNA, 20 bp, Homo sapiens
acatggcttgccacagctct

SEQ ID NO: 2526338 - DNA, 16 bp, Homo sapiens
acatggggaggaagga

SEQ ID NO: 2526339 - DNA, 18 bp, Homo sapiens
acatggtgggtccatggg

SEQ ID NO: 2526340 - DNA, 22 bp, Homo sapiens
acatggttacaatcattgctga

SEQ ID NO: 2526341 - DNA, 23 bp, Homo sapiens
acatggttacaatcattgctgaa

SEQ ID NO: 2526342 - DNA, 18 bp, Homo sapiens
acatggttgtgacctgag

SEQ ID NO: 2526343 - DNA, 19 bp, Homo sapiens
acatgtaataaaaagtata

SEQ ID NO: 2526344 - DNA, 20 bp, Homo sapiens
acatgtaataaaaagtatat

SEQ ID NO: 2526345 - DNA, 21 bp, Homo sapiens
acatgtaattaagtactatgt

SEQ ID NO: 2526346 - DNA, 22 bp, Homo sapiens
acatgtaattaagtactatgta

SEQ ID NO: 2526347 - DNA, 15 bp, Homo sapiens
acatgtattatttca

SEQ ID NO: 2526348 - DNA, 19 bp, Homo sapiens
acatgtatttgtttgcata

SEQ ID NO: 2526349 - DNA, 18 bp, Homo sapiens
acatgtctgttctacata

SEQ ID NO: 2526350 - DNA, 14 bp, Homo sapiens
acatgtgaaacctt

SEQ ID NO: 2526351 - DNA, 15 bp, Homo sapiens
acatgtgaaaccttt

SEQ ID NO: 2526352 - DNA, 17 bp, Homo sapiens
acatgtgaaaccttttt

SEQ ID NO: 2526353 - DNA, 14 bp, Homo sapiens
acatgtgacacata

SEQ ID NO: 2526354 - DNA, 15 bp, Homo sapiens
acatgtggtgggaca

SEQ ID NO: 2526355 - DNA, 13 bp, Homo sapiens
acatgtggtttat

SEQ ID NO: 2526356 - DNA, 16 bp, Homo sapiens
acatgtggtttataga

SEQ ID NO: 2526357 - DNA, 17 bp, Homo sapiens
acatgtgtagcctgtgc

SEQ ID NO: 2526358 - DNA, 18 bp, Homo sapiens
acatgtgtagcctgtgca

SEQ ID NO: 2526359 - DNA, 20 bp, Homo sapiens
acatgtgtagcctgtgcatg

SEQ ID NO: 2526360 - DNA, 12 bp, Homo sapiens
acatgtgtttta

SEQ ID NO: 2526361 - DNA, 16 bp, Homo sapiens
acatgttactgaccag

SEQ ID NO: 2526362 - DNA, 18 bp, Homo sapiens
acatgtttagagttgcaa

SEQ ID NO: 2526363 - DNA, 17 bp, Homo sapiens
acatgttttagacaaat

SEQ ID NO: 2526364 - DNA, 23 bp, Homo sapiens
acatgttttagacaaatactcat

SEQ ID NO: 2526365 - DNA, 15 bp, Homo sapiens
acatgttttgataaa

SEQ ID NO: 2526366 - DNA, 20 bp, Homo sapiens
acatgttttgataaagtagt

SEQ ID NO: 2526367 - DNA, 22 bp, Homo sapiens
acattaaaacaatattgtttct

SEQ ID NO: 2526368 - DNA, 11 bp, Homo sapiens
acattaacagt

SEQ ID NO: 2526369 - DNA, 17 bp, Homo sapiens
acattaagccttccaca

SEQ ID NO: 2526370 - DNA, 21 bp, Homo sapiens
acattaatgttaattcagcac

SEQ ID NO: 2526371 - DNA, 18 bp, Homo sapiens
acattagaacactgcatt

SEQ ID NO: 2526372 - DNA, 19 bp, Homo sapiens
acattatcgggagcagtgt

SEQ ID NO: 2526373 - DNA, 22 bp, Homo sapiens
acattatcgggagcagtgtctt

SEQ ID NO: 2526374 - DNA, 13 bp, Homo sapiens
acattatttgcat

SEQ ID NO: 2526375 - DNA, 13 bp, Homo sapiens
acattcaaggcat

SEQ ID NO: 2526376 - DNA, 16 bp, Homo sapiens
acattcaggaagatga

SEQ ID NO: 2526377 - DNA, 11 bp, Homo sapiens
acattccaaga

SEQ ID NO: 2526378 - DNA, 13 bp, Homo sapiens
acattccaagaca

SEQ ID NO: 2526379 - DNA, 18 bp, Homo sapiens
acattccttgcctgcaca

SEQ ID NO: 2526380 - DNA, 20 bp, Homo sapiens
acattctgacatcttagtat

SEQ ID NO: 2526381 - DNA, 19 bp, Homo sapiens
acattctgatttggaaaaa

SEQ ID NO: 2526382 - DNA, 16 bp, Homo sapiens
acattctgccaggccc

SEQ ID NO: 2526383 - DNA, 10 bp, Homo sapiens
acattcttat

SEQ ID NO: 2526384 - DNA, 14 bp, Homo sapiens
acattcttataaat

SEQ ID NO: 2526385 - DNA, 15 bp, Homo sapiens
acattcttataaata

SEQ ID NO: 2526386 - DNA, 16 bp, Homo sapiens
acattcttataaatat

SEQ ID NO: 2526387 - DNA, 17 bp, Homo sapiens
acattcttataaatatg

SEQ ID NO: 2526388 - DNA, 12 bp, Homo sapiens
acattgaaagag

SEQ ID NO: 2526389 - DNA, 15 bp, Homo sapiens
acattgaagtaatga

SEQ ID NO: 2526390 - DNA, 19 bp, Homo sapiens
acattgcatataacttata

SEQ ID NO: 2526391 - DNA, 21 bp, Homo sapiens
acattgcggacagccacggcc

SEQ ID NO: 2526392 - DNA, 23 bp, Homo sapiens
acattgctttgaccactcttcct

SEQ ID NO: 2526393 - DNA, 15 bp, Homo sapiens
acattgggaagggga

SEQ ID NO: 2526394 - DNA, 23 bp, Homo sapiens
acattgggtcctgggtctttcat

SEQ ID NO: 2526395 - DNA, 12 bp, Homo sapiens
acattgtcaata

SEQ ID NO: 2526396 - DNA, 17 bp, Homo sapiens
acattgtcatttatata

SEQ ID NO: 2526397 - DNA, 12 bp, Homo sapiens
acattgtctgcg

SEQ ID NO: 2526398 - DNA, 17 bp, Homo sapiens
acatttaatacagcagt

SEQ ID NO: 2526399 - DNA, 14 bp, Homo sapiens
acatttacatgtat

SEQ ID NO: 2526400 - DNA, 20 bp, Homo sapiens
acatttataatgtttgctat

SEQ ID NO: 2526401 - DNA, 15 bp, Homo sapiens
acatttattctgctc

SEQ ID NO: 2526402 - DNA, 15 bp, Homo sapiens
acatttatttttata

SEQ ID NO: 2526403 - DNA, 23 bp, Homo sapiens
acatttcttagactacatttaga

SEQ ID NO: 2526404 - DNA, 21 bp, Homo sapiens
acatttgtagcatcctcttta

SEQ ID NO: 2526405 - DNA, 21 bp, Homo sapiens
acatttgtgtaaacagtgttt

SEQ ID NO: 2526406 - DNA, 18 bp, Homo sapiens
acattttactttttcctg

SEQ ID NO: 2526407 - DNA, 14 bp, Homo sapiens
acattttattttat

SEQ ID NO: 2526408 - DNA, 18 bp, Homo sapiens
acattttattttattatg

SEQ ID NO: 2526409 - DNA, 20 bp, Homo sapiens
acattttattttattatgca

SEQ ID NO: 2526410 - DNA, 12 bp, Homo sapiens
acattttccttt

SEQ ID NO: 2526411 - DNA, 19 bp, Homo sapiens
acattttgtataattgtat

SEQ ID NO: 2526412 - DNA, 15 bp, Homo sapiens
acatttttaagtgct

SEQ ID NO: 2526413 - DNA, 19 bp, Homo sapiens
acatttttaagtgctgcat

SEQ ID NO: 2526414 - DNA, 23 bp, Homo sapiens
acatttttaagtgctgcatttaa

SEQ ID NO: 2526415 - DNA, 14 bp, Homo sapiens
acatttttacaata

SEQ ID NO: 2526416 - DNA, 21 bp, Homo sapiens
acatttttcagatataaaaga

SEQ ID NO: 2526417 - DNA, 16 bp, Homo sapiens
acattttttaaatgca

SEQ ID NO: 2526418 - DNA, 21 bp, Homo sapiens
acattttttaaatgcacctgg

SEQ ID NO: 2526419 - DNA, 17 bp, Homo sapiens
accaaaactgtgcagag

SEQ ID NO: 2526420 - DNA, 17 bp, Homo sapiens
accaaaataagaaaaga

SEQ ID NO: 2526421 - DNA, 18 bp, Homo sapiens
accaaaataagaaaagat

SEQ ID NO: 2526422 - DNA, 22 bp, Homo sapiens
accaaagagactggagcatctg

SEQ ID NO: 2526423 - DNA, 15 bp, Homo sapiens
accaaagtatttttt

SEQ ID NO: 2526424 - DNA, 18 bp, Homo sapiens
accaaagtatttttttat

SEQ ID NO: 2526425 - DNA, 19 bp, Homo sapiens
accaacatactcccatctg

SEQ ID NO: 2526426 - DNA, 14 bp, Homo sapiens
actaaagagagaat

SEQ ID NO: 2526427 - DNA, 20 bp, Homo sapiens
actaaagcagtggacaccag

SEQ ID NO: 2526428 - DNA, 22 bp, Homo sapiens
actaaagtatgtaaagtatgta

SEQ ID NO: 2526429 - DNA, 15 bp, Homo sapiens
actaacatataatgt

SEQ ID NO: 2526430 - DNA, 12 bp, Homo sapiens
actaactagagc

SEQ ID NO: 2526431 - DNA, 23 bp, Homo sapiens
actaactagagcagccctggagt

SEQ ID NO: 2526432 - DNA, 16 bp, Homo sapiens
actaagccacaagaaa

SEQ ID NO: 2526433 - DNA, 18 bp, Homo sapiens
actaagcctacctgctct

SEQ ID NO: 2526434 - DNA, 20 bp, Homo sapiens
actaagctttgccagctgct

SEQ ID NO: 2526435 - DNA, 15 bp, Homo sapiens
actaatatgggcatt

SEQ ID NO: 2526436 - DNA, 19 bp, Homo sapiens
actaatgccttactcttct

SEQ ID NO: 2526437 - DNA, 20 bp, Homo sapiens
actaattggcctctttaaga

SEQ ID NO: 2526438 - DNA, 15 bp, Homo sapiens
actaattgtataaca

SEQ ID NO: 2526439 - DNA, 18 bp, Homo sapiens
actaattgtataacaggt

SEQ ID NO: 2526440 - DNA, 15 bp, Homo sapiens
actaatttaaaaaat

SEQ ID NO: 2526441 - DNA, 17 bp, Homo sapiens
actaatttgatgtttac

SEQ ID NO: 2526442 - DNA, 14 bp, Homo sapiens
actacaaaatttga

SEQ ID NO: 2526443 - DNA, 20 bp, Homo sapiens
actacacatccctaatgtgt

SEQ ID NO: 2526444 - DNA, 23 bp, Homo sapiens
actacacatccctaatgtgtgcc

SEQ ID NO: 2526445 - DNA, 19 bp, Homo sapiens
actacacattcaataagca

SEQ ID NO: 2526446 - DNA, 15 bp, Homo sapiens
actacactccagcct

SEQ ID NO: 2526447 - DNA, 11 bp, Homo sapiens
actacaggcac

SEQ ID NO: 2526448 - DNA, 23 bp, Homo sapiens
actacaggtgtgagtcaccaagc

SEQ ID NO: 2526449 - DNA, 13 bp, Homo sapiens
actacataaactg

SEQ ID NO: 2526450 - DNA, 13 bp, Homo sapiens
actacattctgtt

SEQ ID NO: 2526451 - DNA, 23 bp, Homo sapiens
actacccacgttctcacacccac

SEQ ID NO: 2526452 - DNA, 18 bp, Homo sapiens
actaccctattctctctt

SEQ ID NO: 2526453 - DNA, 19 bp, Homo sapiens
actactagatgtctttagg

SEQ ID NO: 2526454 - DNA, 17 bp, Homo sapiens
actactcagggaatgaa

SEQ ID NO: 2526455 - DNA, 14 bp, Homo sapiens
actactcctctgca

SEQ ID NO: 2526456 - DNA, 15 bp, Homo sapiens
actagaaatctgcca

SEQ ID NO: 2526457 - DNA, 15 bp, Homo sapiens
actagaacctggagg

SEQ ID NO: 2526458 - DNA, 15 bp, Homo sapiens
actagacattctgtc

SEQ ID NO: 2526459 - DNA, 18 bp, Homo sapiens
actagagggacctctccc

SEQ ID NO: 2526460 - DNA, 13 bp, Homo sapiens
actagattacatt

SEQ ID NO: 2526461 - DNA, 21 bp, Homo sapiens
actagccatgataactgcaat

SEQ ID NO: 2526462 - DNA, 15 bp, Homo sapiens
actagcctctccagg

SEQ ID NO: 2526463 - DNA, 17 bp, Homo sapiens
actagggaagataatat

SEQ ID NO: 2526464 - DNA, 20 bp, Homo sapiens
actagggatccctcatctgt

SEQ ID NO: 2526465 - DNA, 17 bp, Homo sapiens
actagggattcaggctg

SEQ ID NO: 2526466 - DNA, 18 bp, Homo sapiens
actagggattcaggctgc

SEQ ID NO: 2526467 - DNA, 21 bp, Homo sapiens
actagggattcaggctgcttg

SEQ ID NO: 2526468 - DNA, 17 bp, Homo sapiens
actatagcctaggtgac

SEQ ID NO: 2526469 - DNA, 20 bp, Homo sapiens
actatagcctaggtgacaga

SEQ ID NO: 2526470 - DNA, 22 bp, Homo sapiens
actatagcctaggtgacagagt

SEQ ID NO: 2526471 - DNA, 16 bp, Homo sapiens
actatatagagatgtt

SEQ ID NO: 2526472 - DNA, 17 bp, Homo sapiens
actatatagagatgttt

SEQ ID NO: 2526473 - DNA, 13 bp, Homo sapiens
actatatatgtga

SEQ ID NO: 2526474 - DNA, 22 bp, Homo sapiens
actatatctgtatataaaatat

SEQ ID NO: 2526475 - DNA, 14 bp, Homo sapiens
actatcaaactgaa

SEQ ID NO: 2526476 - DNA, 16 bp, Homo sapiens
actatctaaatgttga

SEQ ID NO: 2526477 - DNA, 21 bp, Homo sapiens
actatctaaatgttgaaagat

SEQ ID NO: 2526478 - DNA, 20 bp, Homo sapiens
actatctgaaccattaaagt

SEQ ID NO: 2526479 - DNA, 12 bp, Homo sapiens
actatctgcttt

SEQ ID NO: 2526480 - DNA, 13 bp, Homo sapiens
actatctgctttt

SEQ ID NO: 2526481 - DNA, 18 bp, Homo sapiens
actatgaacttctctcag

SEQ ID NO: 2526482 - DNA, 13 bp, Homo sapiens
actatgaatctat

SEQ ID NO: 2526483 - DNA, 15 bp, Homo sapiens
actatgactgctccc

SEQ ID NO: 2526484 - DNA, 16 bp, Homo sapiens
actatgatttggaaaa

SEQ ID NO: 2526485 - DNA, 16 bp, Homo sapiens
actatgcacaatttaa

SEQ ID NO: 2526486 - DNA, 22 bp, Homo sapiens
actatggccctggcctagcata

SEQ ID NO: 2526487 - DNA, 17 bp, Homo sapiens
actatgttgcccaggca

SEQ ID NO: 2526488 - DNA, 18 bp, Homo sapiens
actatgttgcccaggcag

SEQ ID NO: 2526489 - DNA, 20 bp, Homo sapiens
actatgttgcccaggcaggt

SEQ ID NO: 2526490 - DNA, 23 bp, Homo sapiens
actatgttgcccaggcaggtctt

SEQ ID NO: 2526491 - DNA, 21 bp, Homo sapiens
actattataatttaatgcatg

SEQ ID NO: 2526492 - DNA, 13 bp, Homo sapiens
actattcaaacag

SEQ ID NO: 2526493 - DNA, 21 bp, Homo sapiens
actattcaaacagtctcagga

SEQ ID NO: 2526494 - DNA, 20 bp, Homo sapiens
actattccccagcagggtct

SEQ ID NO: 2526495 - DNA, 21 bp, Homo sapiens
actattccccagcagggtctt

SEQ ID NO: 2526496 - DNA, 22 bp, Homo sapiens
actattctgattacacaaaaca

SEQ ID NO: 2526497 - DNA, 18 bp, Homo sapiens
actattgaagttgcagat

SEQ ID NO: 2526498 - DNA, 20 bp, Homo sapiens
actatttagtttttgtaatt

SEQ ID NO: 2526499 - DNA, 21 bp, Homo sapiens
actatttagtttttgtaattt

SEQ ID NO: 2526500 - DNA, 21 bp, Homo sapiens
actatttcttatatatgtgaa

SEQ ID NO: 2526501 - DNA, 13 bp, Homo sapiens
actatttttactg

SEQ ID NO: 2526502 - DNA, 18 bp, Homo sapiens
actatttttcagaatctc

SEQ ID NO: 2526503 - DNA, 20 bp, Homo sapiens
actcaaaacccatctgggct

SEQ ID NO: 2526504 - DNA, 18 bp, Homo sapiens
actcaaaagctgggcagg

SEQ ID NO: 2526505 - DNA, 20 bp, Homo sapiens
actcaaaatatttgtacata

SEQ ID NO: 2526506 - DNA, 19 bp, Homo sapiens
actcaaaccaaatcactga

SEQ ID NO: 2526507 - DNA, 14 bp, Homo sapiens
actcaaatcaagaa

SEQ ID NO: 2526508 - DNA, 23 bp, Homo sapiens
actcaaatgctcagaccagctct

SEQ ID NO: 2526509 - DNA, 20 bp, Homo sapiens
actcaacatgttactgacca

SEQ ID NO: 2526510 - DNA, 23 bp, Homo sapiens
actcaacatgttactgaccagca

SEQ ID NO: 2526511 - DNA, 13 bp, Homo sapiens
actcaagaagcag

SEQ ID NO: 2526512 - DNA, 11 bp, Homo sapiens
actcaagccaa

SEQ ID NO: 2526513 - DNA, 16 bp, Homo sapiens
actcaagccaagcagc

SEQ ID NO: 2526514 - DNA, 19 bp, Homo sapiens
actcaagccaagcagccaa

SEQ ID NO: 2526515 - DNA, 14 bp, Homo sapiens
actcaagcccgcgg

SEQ ID NO: 2526516 - DNA, 14 bp, Homo sapiens
actcaatgcactga

SEQ ID NO: 2526517 - DNA, 14 bp, Homo sapiens
actcaatttctccc

SEQ ID NO: 2526518 - DNA, 18 bp, Homo sapiens
actcacaagaagaccaga

SEQ ID NO: 2526519 - DNA, 14 bp, Homo sapiens
actcacacagccag

SEQ ID NO: 2526520 - DNA, 15 bp, Homo sapiens
actcacacagccagg

SEQ ID NO: 2526521 - DNA, 18 bp, Homo sapiens
actcacagacctggagcc

SEQ ID NO: 2526522 - DNA, 19 bp, Homo sapiens
actcacatttattctgctc

SEQ ID NO: 2526523 - DNA, 20 bp, Homo sapiens
actcacatttattctgctca

SEQ ID NO: 2526524 - DNA, 21 bp, Homo sapiens
actcacatttattctgctcac

SEQ ID NO: 2526525 - DNA, 17 bp, Homo sapiens
actcacccatgtgccaa

SEQ ID NO: 2526526 - DNA, 18 bp, Homo sapiens
actcacccatgtgccaag

SEQ ID NO: 2526527 - DNA, 21 bp, Homo sapiens
actcacccatgtgccaaggtg

SEQ ID NO: 2526528 - DNA, 12 bp, Homo sapiens
actcaccccagc

SEQ ID NO: 2526529 - DNA, 13 bp, Homo sapiens
actcaccccagcc

SEQ ID NO: 2526530 - DNA, 16 bp, Homo sapiens
actcaccccagcccca

SEQ ID NO: 2526531 - DNA, 17 bp, Homo sapiens
actcaccgaagccactt

SEQ ID NO: 2526532 - DNA, 17 bp, Homo sapiens
actcacctaatgtttat

SEQ ID NO: 2526533 - DNA, 16 bp, Homo sapiens
actcacctctaaaaca

SEQ ID NO: 2526534 - DNA, 20 bp, Homo sapiens
actcacctggggctgctggc

SEQ ID NO: 2526535 - DNA, 21 bp, Homo sapiens
actcactcctgagacccctgg

SEQ ID NO: 2526536 - DNA, 16 bp, Homo sapiens
actcagaagcctgagg

SEQ ID NO: 2526537 - DNA, 15 bp, Homo sapiens
actcagatcactact

SEQ ID NO: 2526538 - DNA, 19 bp, Homo sapiens
actcagatcactactgcag

SEQ ID NO: 2526539 - DNA, 21 bp, Homo sapiens
actcagatcactactgcagtc

SEQ ID NO: 2526540 - DNA, 23 bp, Homo sapiens
actcagatggaaccgcaggaagc

SEQ ID NO: 2526541 - DNA, 15 bp, Homo sapiens
actcagccaagcaca

SEQ ID NO: 2526542 - DNA, 18 bp, Homo sapiens
actcagccaagcacagtg

SEQ ID NO: 2526543 - DNA, 23 bp, Homo sapiens
actcagccaagcacagtggtggc

SEQ ID NO: 2526544 - DNA, 14 bp, Homo sapiens
actcagccctgagg

SEQ ID NO: 2526545 - DNA, 22 bp, Homo sapiens
actcagcctcaataagccttgt

SEQ ID NO: 2526546 - DNA, 14 bp, Homo sapiens
actcagctccccag

SEQ ID NO: 2526547 - DNA, 14 bp, Homo sapiens
actcaggaggctga

SEQ ID NO: 2526548 - DNA, 18 bp, Homo sapiens
actcaggaggctgagggg

SEQ ID NO: 2526549 - DNA, 14 bp, Homo sapiens
actcaggatgccca

SEQ ID NO: 2526550 - DNA, 16 bp, Homo sapiens
actcaggatgcccagg

SEQ ID NO: 2526551 - DNA, 18 bp, Homo sapiens
actcaggatgcccagggc

SEQ ID NO: 2526552 - DNA, 15 bp, Homo sapiens
actcagggacagagc

SEQ ID NO: 2526553 - DNA, 20 bp, Homo sapiens
actcagggacagagccatgc

SEQ ID NO: 2526554 - DNA, 14 bp, Homo sapiens
actcagggccccag

SEQ ID NO: 2526555 - DNA, 18 bp, Homo sapiens
actcagggccccagcact

SEQ ID NO: 2526556 - DNA, 13 bp, Homo sapiens
actcagtttgtca

SEQ ID NO: 2526557 - DNA, 22 bp, Homo sapiens
actcagtttgtcagactttaaa

SEQ ID NO: 2526558 - DNA, 15 bp, Homo sapiens
actcagttttaacta

SEQ ID NO: 2526559 - DNA, 15 bp, Homo sapiens
actcataatgtgaag

SEQ ID NO: 2526560 - DNA, 17 bp, Homo sapiens
actcatacctttaaagg

SEQ ID NO: 2526561 - DNA, 19 bp, Homo sapiens
actcatactgtgctggagc

SEQ ID NO: 2526562 - DNA, 22 bp, Homo sapiens
actcatatcccctatttaacag

SEQ ID NO: 2526563 - DNA, 12 bp, Homo sapiens
actcatcataaa

SEQ ID NO: 2526564 - DNA, 15 bp, Homo sapiens
actcatcataaaata

SEQ ID NO: 2526565 - DNA, 16 bp, Homo sapiens
actcatcataaaataa

SEQ ID NO: 2526566 - DNA, 17 bp, Homo sapiens
actcatcataaaataaa

SEQ ID NO: 2526567 - DNA, 15 bp, Homo sapiens
actcatgatcttgtg

SEQ ID NO: 2526568 - DNA, 12 bp, Homo sapiens
actcatgctgaa

SEQ ID NO: 2526569 - DNA, 11 bp, Homo sapiens
actcatgtgta

SEQ ID NO: 2526570 - DNA, 21 bp, Homo sapiens
actcatgtgtatgggcaaaaa

SEQ ID NO: 2526571 - DNA, 13 bp, Homo sapiens
agaaagaagagac

SEQ ID NO: 2526572 - DNA, 12 bp, Homo sapiens
agaaagaagccc

SEQ ID NO: 2526573 - DNA, 12 bp, Homo sapiens
agaaagaaggaa

SEQ ID NO: 2526574 - DNA, 15 bp, Homo sapiens
agaaagacagagctg

SEQ ID NO: 2526575 - DNA, 20 bp, Homo sapiens
agaaagactatctaaatgtt

SEQ ID NO: 2526576 - DNA, 22 bp, Homo sapiens
agaaagactatctaaatgttga

SEQ ID NO: 2526577 - DNA, 10 bp, Homo sapiens
agaaagagag

SEQ ID NO: 2526578 - DNA, 15 bp, Homo sapiens
agaaagagagaaaat

SEQ ID NO: 2526579 - DNA, 18 bp, Homo sapiens
agaaagatcattgaaatt

SEQ ID NO: 2526580 - DNA, 17 bp, Homo sapiens
agaaagcagaacagtga

SEQ ID NO: 2526581 - DNA, 21 bp, Homo sapiens
agaaagcctcagagaattgct

SEQ ID NO: 2526582 - DNA, 20 bp, Homo sapiens
agaaagcctgttcccctcac

SEQ ID NO: 2526583 - DNA, 11 bp, Homo sapiens
agaaaggagac

SEQ ID NO: 2526584 - DNA, 17 bp, Homo sapiens
agaaaggagtctgcaca

SEQ ID NO: 2526585 - DNA, 20 bp, Homo sapiens
agaaagggcaacaataaaat

SEQ ID NO: 2526586 - DNA, 20 bp, Homo sapiens
agaaagtcgaattaatagct

SEQ ID NO: 2526587 - DNA, 21 bp, Homo sapiens
agaaagtcgaattaatagctt

SEQ ID NO: 2526588 - DNA, 15 bp, Homo sapiens
agaaagtgaagcaaa

SEQ ID NO: 2526589 - DNA, 23 bp, Homo sapiens
agaaagtgaagcaaatcagaaac

SEQ ID NO: 2526590 - DNA, 23 bp, Homo sapiens
agaaagtggaaaacaaggaagtc

SEQ ID NO: 2526591 - DNA, 21 bp, Homo sapiens
agaaagtggccatgccaccct

SEQ ID NO: 2526592 - DNA, 21 bp, Homo sapiens
agaaagtggtgctcagttgta

SEQ ID NO: 2526593 - DNA, 17 bp, Homo sapiens
agaaagtgtgagcaaac

SEQ ID NO: 2526594 - DNA, 23 bp, Homo sapiens
agaaagtgtgagcaaactaactt

SEQ ID NO: 2526595 - DNA, 17 bp, Homo sapiens
agaaagttgcacggctg

SEQ ID NO: 2526596 - DNA, 21 bp, Homo sapiens
agaaataaagttggtgacaga

SEQ ID NO: 2526597 - DNA, 15 bp, Homo sapiens
agaaataaatagcta

SEQ ID NO: 2526598 - DNA, 19 bp, Homo sapiens
agaaataaatagctatatc

SEQ ID NO: 2526599 - DNA, 21 bp, Homo sapiens
agaaataagtggttatttctc

SEQ ID NO: 2526600 - DNA, 14 bp, Homo sapiens
agaaataatatgca

SEQ ID NO: 2526601 - DNA, 15 bp, Homo sapiens
agaaataatatgcat

SEQ ID NO: 2526602 - DNA, 23 bp, Homo sapiens
agaaataccaaaattatttcaga

SEQ ID NO: 2526603 - DNA, 13 bp, Homo sapiens
agaaatactgtac

SEQ ID NO: 2526604 - DNA, 18 bp, Homo sapiens
agaaatagacagtatatt

SEQ ID NO: 2526605 - DNA, 22 bp, Homo sapiens
agaaatatgattttatttgaca

SEQ ID NO: 2526606 - DNA, 22 bp, Homo sapiens
agaaatctatagaactgaatga

SEQ ID NO: 2526607 - DNA, 18 bp, Homo sapiens
agaaatctcacttttctc

SEQ ID NO: 2526608 - DNA, 14 bp, Homo sapiens
agaaatgaaagcag

SEQ ID NO: 2526609 - DNA, 17 bp, Homo sapiens
agaaatgagatcaggct

SEQ ID NO: 2526610 - DNA, 12 bp, Homo sapiens
agaaatgcagaa

SEQ ID NO: 2526611 - DNA, 15 bp, Homo sapiens
agaaatgcatattgt

SEQ ID NO: 2526612 - DNA, 16 bp, Homo sapiens
agaaatgcatattgta

SEQ ID NO: 2526613 - DNA, 22 bp, Homo sapiens
agaaatgctgcctgcctgtctg

SEQ ID NO: 2526614 - DNA, 21 bp, Homo sapiens
agaaatgctggtttttcagtt

SEQ ID NO: 2526615 - DNA, 14 bp, Homo sapiens
agaaatgtacagca

SEQ ID NO: 2526616 - DNA, 15 bp, Homo sapiens
agaaatgtacagcaa

SEQ ID NO: 2526617 - DNA, 11 bp, Homo sapiens
agaaatgtgtt

SEQ ID NO: 2526618 - DNA, 13 bp, Homo sapiens
agaaattcctgta

SEQ ID NO: 2526619 - DNA, 16 bp, Homo sapiens
agaaattcctgtagca

SEQ ID NO: 2526620 - DNA, 14 bp, Homo sapiens
agaaattggctgga

SEQ ID NO: 2526621 - DNA, 17 bp, Homo sapiens
agaaatttaattcatgt

SEQ ID NO: 2526622 - DNA, 22 bp, Homo sapiens
agaaatttttcagatgcttctg

SEQ ID NO: 2526623 - DNA, 22 bp, Homo sapiens
agaacaaaggacagagtatgaa

SEQ ID NO: 2526624 - DNA, 15 bp, Homo sapiens
agaacaatgtgctat

SEQ ID NO: 2526625 - DNA, 14 bp, Homo sapiens
agaacacgctttca

SEQ ID NO: 2526626 - DNA, 14 bp, Homo sapiens
agaacactgtgaaa

SEQ ID NO: 2526627 - DNA, 13 bp, Homo sapiens
agaacagcagagg

SEQ ID NO: 2526628 - DNA, 12 bp, Homo sapiens
agaacagcttca

SEQ ID NO: 2526629 - DNA, 22 bp, Homo sapiens
agaacagcttcaggttatcgaa

SEQ ID NO: 2526630 - DNA, 16 bp, Homo sapiens
agaacaggcaagtgaa

SEQ ID NO: 2526631 - DNA, 21 bp, Homo sapiens
agaacagtgcttgccacagag

SEQ ID NO: 2526632 - DNA, 15 bp, Homo sapiens
agaacagtttgtaca

SEQ ID NO: 2526633 - DNA, 11 bp, Homo sapiens
agaacatagaa

SEQ ID NO: 2526634 - DNA, 14 bp, Homo sapiens
agaacatcattaga

SEQ ID NO: 2526635 - DNA, 15 bp, Homo sapiens
agaacatccaaggag

SEQ ID NO: 2526636 - DNA, 16 bp, Homo sapiens
agaacatccctgccag

SEQ ID NO: 2526637 - DNA, 14 bp, Homo sapiens
agaaccgagcaaag

SEQ ID NO: 2526638 - DNA, 22 bp, Homo sapiens
agaacctcacgcacctcccatc

SEQ ID NO: 2526639 - DNA, 19 bp, Homo sapiens
agaacctcaggcttccttg

SEQ ID NO: 2526640 - DNA, 15 bp, Homo sapiens
agaacctggaagggc

SEQ ID NO: 2526641 - DNA, 16 bp, Homo sapiens
agaacctggaagggct

SEQ ID NO: 2526642 - DNA, 17 bp, Homo sapiens
agaacctgtagagctag

SEQ ID NO: 2526643 - DNA, 19 bp, Homo sapiens
agaactactcagggaatga

SEQ ID NO: 2526644 - DNA, 17 bp, Homo sapiens
agaactcagttttaact

SEQ ID NO: 2526645 - DNA, 23 bp, Homo sapiens
agaactcatccctaatgctgcag

SEQ ID NO: 2526646 - DNA, 21 bp, Homo sapiens
agaactcatgacggaagagtt

SEQ ID NO: 2526647 - DNA, 14 bp, Homo sapiens
agaactctttcaaa

SEQ ID NO: 2526648 - DNA, 23 bp, Homo sapiens
agaactgaaccggctttaccaaa

SEQ ID NO: 2526649 - DNA, 16 bp, Homo sapiens
agaactgagctcctct

SEQ ID NO: 2526650 - DNA, 22 bp, Homo sapiens
agaactgagctcctctgggcag

SEQ ID NO: 2526651 - DNA, 20 bp, Homo sapiens
agaactgcatatgtttcgct

SEQ ID NO: 2526652 - DNA, 21 bp, Homo sapiens
agaactgcatatgtttcgctg

SEQ ID NO: 2526653 - DNA, 22 bp, Homo sapiens
agaactgcctttggcagagttc

SEQ ID NO: 2526654 - DNA, 20 bp, Homo sapiens
agaactggactcaggatgcc

SEQ ID NO: 2526655 - DNA, 22 bp, Homo sapiens
agaactggactcaggatgccca

SEQ ID NO: 2526656 - DNA, 23 bp, Homo sapiens
agaacttggatgtacctgccccc

SEQ ID NO: 2526657 - DNA, 16 bp, Homo sapiens
agaactttgaaggaca

SEQ ID NO: 2526658 - DNA, 18 bp, Homo sapiens
agaagaaacgtctatgtg

SEQ ID NO: 2526659 - DNA, 13 bp, Homo sapiens
agaagaacatcca

SEQ ID NO: 2526660 - DNA, 19 bp, Homo sapiens
agaagaactatatgtgaat

SEQ ID NO: 2526661 - DNA, 21 bp, Homo sapiens
agaagaaggcagcaggtggca

SEQ ID NO: 2526662 - DNA, 16 bp, Homo sapiens
agaagaagtcagagag

SEQ ID NO: 2526663 - DNA, 17 bp, Homo sapiens
agaagaagtcagagagg

SEQ ID NO: 2526664 - DNA, 19 bp, Homo sapiens
agaagaatattcaggactt

SEQ ID NO: 2526665 - DNA, 21 bp, Homo sapiens
agaagacactgatgggcaacc

SEQ ID NO: 2526666 - DNA, 14 bp, Homo sapiens
agaagacatggaga

SEQ ID NO: 2526667 - DNA, 16 bp, Homo sapiens
agaagacatggagact

SEQ ID NO: 2526668 - DNA, 20 bp, Homo sapiens
agaagacatggagactcctg

SEQ ID NO: 2526669 - DNA, 22 bp, Homo sapiens
agaagacatggagactcctgcc

SEQ ID NO: 2526670 - DNA, 14 bp, Homo sapiens
agaagacatgtttt

SEQ ID NO: 2526671 - DNA, 19 bp, Homo sapiens
agaagactctaccagactg

SEQ ID NO: 2526672 - DNA, 12 bp, Homo sapiens
agaagagacagg

SEQ ID NO: 2526673 - DNA, 20 bp, Homo sapiens
agaagagatgggcttgtttt

SEQ ID NO: 2526674 - DNA, 21 bp, Homo sapiens
agaagagattgtggtttcatt

SEQ ID NO: 2526675 - DNA, 20 bp, Homo sapiens
agaagagctgttcacagcca

SEQ ID NO: 2526676 - DNA, 21 bp, Homo sapiens
agaagagctgttcacagccag

SEQ ID NO: 2526677 - DNA, 17 bp, Homo sapiens
agaagaggctggtgctg

SEQ ID NO: 2526678 - DNA, 24 bp, Homo sapiens
agaagagggcctgtgggagcctgc

SEQ ID NO: 2526679 - DNA, 15 bp, Homo sapiens
agaagaggggttttt

SEQ ID NO: 2526680 - DNA, 22 bp, Homo sapiens
agaagatattagtcttggggca

SEQ ID NO: 2526681 - DNA, 14 bp, Homo sapiens
agaagatcccctca

SEQ ID NO: 2526682 - DNA, 16 bp, Homo sapiens
agaagatgatcagacc

SEQ ID NO: 2526683 - DNA, 22 bp, Homo sapiens
agaagatttgatgctggagagg

SEQ ID NO: 2526684 - DNA, 23 bp, Homo sapiens
agaagatttgatgctggagaggt

SEQ ID NO: 2526685 - DNA, 18 bp, Homo sapiens
agaagattttgaaatttt

SEQ ID NO: 2526686 - DNA, 15 bp, Homo sapiens
agaagcaagaaagaa

SEQ ID NO: 2526687 - DNA, 13 bp, Homo sapiens
agaagcagctctt

SEQ ID NO: 2526688 - DNA, 14 bp, Homo sapiens
agaagcaggctgga

SEQ ID NO: 2526689 - DNA, 16 bp, Homo sapiens
agaagcatgaaaaagc

SEQ ID NO: 2526690 - DNA, 18 bp, Homo sapiens
agaagcattaacttctct

SEQ ID NO: 2526691 - DNA, 22 bp, Homo sapiens
agaagcattccttctttgataa

SEQ ID NO: 2526692 - DNA, 20 bp, Homo sapiens
agaagccaggagcaaatgtt

SEQ ID NO: 2526693 - DNA, 12 bp, Homo sapiens
agaagcccagga

SEQ ID NO: 2526694 - DNA, 16 bp, Homo sapiens
agaagcccaggaaagg

SEQ ID NO: 2526695 - DNA, 20 bp, Homo sapiens
agaagccccttccccatggg

SEQ ID NO: 2526696 - DNA, 14 bp, Homo sapiens
agaagccgggaaca

SEQ ID NO: 2526697 - DNA, 16 bp, Homo sapiens
agaagccgggaacaga

SEQ ID NO: 2526698 - DNA, 14 bp, Homo sapiens
agaagccgtgggtg

SEQ ID NO: 2526699 - DNA, 12 bp, Homo sapiens
agaagcctgagg

SEQ ID NO: 2526700 - DNA, 14 bp, Homo sapiens
agaagcctgaggct

SEQ ID NO: 2526701 - DNA, 19 bp, Homo sapiens
agaagcctttgggaagggg

SEQ ID NO: 2526702 - DNA, 16 bp, Homo sapiens
agaagcggctggcagc

SEQ ID NO: 2526703 - DNA, 18 bp, Homo sapiens
agaagctcccaggaacaa

SEQ ID NO: 2526704 - DNA, 21 bp, Homo sapiens
agaagctgaagtgcatccaaa

SEQ ID NO: 2526705 - DNA, 17 bp, Homo sapiens
agaagctgctctggaat

SEQ ID NO: 2526706 - DNA, 19 bp, Homo sapiens
agaagctgttgtacattta

SEQ ID NO: 2526707 - DNA, 20 bp, Homo sapiens
agaagctgttgtacatttat

SEQ ID NO: 2526708 - DNA, 17 bp, Homo sapiens
agaagcttcagaagttt

SEQ ID NO: 2526709 - DNA, 18 bp, Homo sapiens
agaagcttccattccaag

SEQ ID NO: 2526710 - DNA, 16 bp, Homo sapiens
agaaggaaaaggcagg

SEQ ID NO: 2526711 - DNA, 17 bp, Homo sapiens
agaaggaaattgagatt

SEQ ID NO: 2526712 - DNA, 14 bp, Homo sapiens
agaaggatgaatga

SEQ ID NO: 2526713 - DNA, 22 bp, Homo sapiens
agaaggcatatcagtctctgag

SEQ ID NO: 2526714 - DNA, 13 bp, Homo sapiens
agaaggccaagag

SEQ ID NO: 2526715 - DNA, 15 bp, Homo sapiens
agatggattctcaga

SEQ ID NO: 2526716 - DNA, 16 bp, Homo sapiens
agatggattctcagat

SEQ ID NO: 2526717 - DNA, 17 bp, Homo sapiens
agatggattctcagata

SEQ ID NO: 2526718 - DNA, 18 bp, Homo sapiens
agatggattctcagatat

SEQ ID NO: 2526719 - DNA, 18 bp, Homo sapiens
agatggattggtgtaaaa

SEQ ID NO: 2526720 - DNA, 15 bp, Homo sapiens
agatggatttgcctg

SEQ ID NO: 2526721 - DNA, 20 bp, Homo sapiens
agatggatttgcctgtgcca

SEQ ID NO: 2526722 - DNA, 20 bp, Homo sapiens
agatggcgagcatcctggcc

SEQ ID NO: 2526723 - DNA, 20 bp, Homo sapiens
agatggctgtgcctctgcct

SEQ ID NO: 2526724 - DNA, 21 bp, Homo sapiens
agatggctgtgcctctgcctg

SEQ ID NO: 2526725 - DNA, 17 bp, Homo sapiens
agatgggaatgaagctt

SEQ ID NO: 2526726 - DNA, 18 bp, Homo sapiens
agatgggaatgaagcttg

SEQ ID NO: 2526727 - DNA, 13 bp, Homo sapiens
agatgggagctcc

SEQ ID NO: 2526728 - DNA, 18 bp, Homo sapiens
agatgggagctcctctcc

SEQ ID NO: 2526729 - DNA, 17 bp, Homo sapiens
agatgggcttgttttct

SEQ ID NO: 2526730 - DNA, 19 bp, Homo sapiens
agatgggtctggctgagct

SEQ ID NO: 2526731 - DNA, 21 bp, Homo sapiens
agatgggtctggctgagctga

SEQ ID NO: 2526732 - DNA, 18 bp, Homo sapiens
agatggtttgagcctgag

SEQ ID NO: 2526733 - DNA, 16 bp, Homo sapiens
agatgtagaggagaaa

SEQ ID NO: 2526734 - DNA, 15 bp, Homo sapiens
agatgtagatttatt

SEQ ID NO: 2526735 - DNA, 21 bp, Homo sapiens
agatgtagcaaaacgcatgga

SEQ ID NO: 2526736 - DNA, 15 bp, Homo sapiens
agatgtcagactggc

SEQ ID NO: 2526737 - DNA, 21 bp, Homo sapiens
agatgtccctttcttggccag

SEQ ID NO: 2526738 - DNA, 13 bp, Homo sapiens
agatgtcttcgta

SEQ ID NO: 2526739 - DNA, 20 bp, Homo sapiens
agatgtcttcgtacagttct

SEQ ID NO: 2526740 - DNA, 16 bp, Homo sapiens
agatgtcttctgcctg

SEQ ID NO: 2526741 - DNA, 22 bp, Homo sapiens
agatgtgaacacatcagcttgc

SEQ ID NO: 2526742 - DNA, 17 bp, Homo sapiens
agatgtgataaggatca

SEQ ID NO: 2526743 - DNA, 12 bp, Homo sapiens
agatgtgattta

SEQ ID NO: 2526744 - DNA, 20 bp, Homo sapiens
agatgtgatttaatagtgtt

SEQ ID NO: 2526745 - DNA, 19 bp, Homo sapiens
agatgtgttgctatcctga

SEQ ID NO: 2526746 - DNA, 22 bp, Homo sapiens
agatgttttaccgtaataatta

SEQ ID NO: 2526747 - DNA, 20 bp, Homo sapiens
agatgtttttaaaagtttca

SEQ ID NO: 2526748 - DNA, 22 bp, Homo sapiens
agatgtttttaaaagtttcaat

SEQ ID NO: 2526749 - DNA, 21 bp, Homo sapiens
agattagaatgaaaattgtat

SEQ ID NO: 2526750 - DNA, 14 bp, Homo sapiens
agattagagggagg

SEQ ID NO: 2526751 - DNA, 18 bp, Homo sapiens
agattataacttgtctaa

SEQ ID NO: 2526752 - DNA, 22 bp, Homo sapiens
agattcacacctgactctgaaa

SEQ ID NO: 2526753 - DNA, 18 bp, Homo sapiens
agattcaggtatgttgcc

SEQ ID NO: 2526754 - DNA, 20 bp, Homo sapiens
agattcatttttaatcatga

SEQ ID NO: 2526755 - DNA, 16 bp, Homo sapiens
agattcccagagcaaa

SEQ ID NO: 2526756 - DNA, 16 bp, Homo sapiens
agattcgctttccatg

SEQ ID NO: 2526757 - DNA, 14 bp, Homo sapiens
agattctttcctga

SEQ ID NO: 2526758 - DNA, 20 bp, Homo sapiens
agattgaaaacttttctcag

SEQ ID NO: 2526759 - DNA, 22 bp, Homo sapiens
agattgagaagttttgtacaga

SEQ ID NO: 2526760 - DNA, 19 bp, Homo sapiens
agattgagagaagagacaa

SEQ ID NO: 2526761 - DNA, 13 bp, Homo sapiens
agattgaggcctg

SEQ ID NO: 2526762 - DNA, 19 bp, Homo sapiens
agattgaggcctgccctca

SEQ ID NO: 2526763 - DNA, 22 bp, Homo sapiens
agattgaggcctgccctcaggg

SEQ ID NO: 2526764 - DNA, 13 bp, Homo sapiens
agattgcatgtga

SEQ ID NO: 2526765 - DNA, 15 bp, Homo sapiens
agattgcttaaaata

SEQ ID NO: 2526766 - DNA, 16 bp, Homo sapiens
agattgcttaaaatag

SEQ ID NO: 2526767 - DNA, 23 bp, Homo sapiens
agattgctttgattaatccagaa

SEQ ID NO: 2526768 - DNA, 21 bp, Homo sapiens
agattgtgtaacaattttaat

SEQ ID NO: 2526769 - DNA, 22 bp, Homo sapiens
agattgttgtttgccatacttt

SEQ ID NO: 2526770 - DNA, 13 bp, Homo sapiens
agatttaattaat

SEQ ID NO: 2526771 - DNA, 17 bp, Homo sapiens
agatttatcaaatcagt

SEQ ID NO: 2526772 - DNA, 14 bp, Homo sapiens
agatttgggctgga

SEQ ID NO: 2526773 - DNA, 15 bp, Homo sapiens
agatttgtgaactca

SEQ ID NO: 2526774 - DNA, 13 bp, Homo sapiens
agattttaaattc

SEQ ID NO: 2526775 - DNA, 22 bp, Homo sapiens
agattttaaattcacaatagaa

SEQ ID NO: 2526776 - DNA, 17 bp, Homo sapiens
agattttaattttgaat

SEQ ID NO: 2526777 - DNA, 14 bp, Homo sapiens
agattttaggtgtt

SEQ ID NO: 2526778 - DNA, 18 bp, Homo sapiens
agattttctttaaaagaa

SEQ ID NO: 2526779 - DNA, 16 bp, Homo sapiens
agatttttaacgaatg

SEQ ID NO: 2526780 - DNA, 13 bp, Homo sapiens
agcaaacacatta

SEQ ID NO: 2526781 - DNA, 19 bp, Homo sapiens
agcaaactaacttgacttt

SEQ ID NO: 2526782 - DNA, 13 bp, Homo sapiens
agcaaacttggaa

SEQ ID NO: 2526783 - DNA, 12 bp, Homo sapiens
agcaaagatcaa

SEQ ID NO: 2526784 - DNA, 14 bp, Homo sapiens
agcaaagatcaaaa

SEQ ID NO: 2526785 - DNA, 14 bp, Homo sapiens
agcaaatgtttctg

SEQ ID NO: 2526786 - DNA, 18 bp, Homo sapiens
agcaaatgtttctgcagt

SEQ ID NO: 2526787 - DNA, 21 bp, Homo sapiens
agcaacaatttatgaattgaa

SEQ ID NO: 2526788 - DNA, 17 bp, Homo sapiens
agcaacacaagctggaa

SEQ ID NO: 2526789 - DNA, 20 bp, Homo sapiens
agcaacacaagctggaagca

SEQ ID NO: 2526790 - DNA, 21 bp, Homo sapiens
agcaacaggaatcaagagctg

SEQ ID NO: 2526791 - DNA, 21 bp, Homo sapiens
agcaacatctagcaaatgtta

SEQ ID NO: 2526792 - DNA, 13 bp, Homo sapiens
agcaactgaataa

SEQ ID NO: 2526793 - DNA, 15 bp, Homo sapiens
agcaactgaataaat

SEQ ID NO: 2526794 - DNA, 18 bp, Homo sapiens
agcaactgttatgaaata

SEQ ID NO: 2526795 - DNA, 20 bp, Homo sapiens
agcaacttgtctttttctgg

SEQ ID NO: 2526796 - DNA, 23 bp, Homo sapiens
agcaacttgtctttttctggact

SEQ ID NO: 2526797 - DNA, 15 bp, Homo sapiens
agcaagaaagaaacc

SEQ ID NO: 2526798 - DNA, 17 bp, Homo sapiens
agcaagacgctgtgctg

SEQ ID NO: 2526799 - DNA, 21 bp, Homo sapiens
agcaagacgctgtgctgccct

SEQ ID NO: 2526800 - DNA, 16 bp, Homo sapiens
agcaagactgttgctc

SEQ ID NO: 2526801 - DNA, 20 bp, Homo sapiens
agcaagctcccaagggatgg

SEQ ID NO: 2526802 - DNA, 16 bp, Homo sapiens
agcaagtgagaccctg

SEQ ID NO: 2526803 - DNA, 17 bp, Homo sapiens
agcaagtgagagagatg

SEQ ID NO: 2526804 - DNA, 13 bp, Homo sapiens
agcaagtgagagc

SEQ ID NO: 2526805 - DNA, 15 bp, Homo sapiens
agcaagtgagagctg

SEQ ID NO: 2526806 - DNA, 16 bp, Homo sapiens
agcaagtgagagctgg

SEQ ID NO: 2526807 - DNA, 17 bp, Homo sapiens
agcaagtgagagctggg

SEQ ID NO: 2526808 - DNA, 18 bp, Homo sapiens
agcaagtgagagctgggt

SEQ ID NO: 2526809 - DNA, 17 bp, Homo sapiens
agcaagttctagagaag

SEQ ID NO: 2526810 - DNA, 23 bp, Homo sapiens
agcaagttctagagaagaggctg

SEQ ID NO: 2526811 - DNA, 19 bp, Homo sapiens
agcaataatggtcccatcc

SEQ ID NO: 2526812 - DNA, 23 bp, Homo sapiens
agcaatccatgttagtttttact

SEQ ID NO: 2526813 - DNA, 18 bp, Homo sapiens
agcaatgatgtccagaag

SEQ ID NO: 2526814 - DNA, 20 bp, Homo sapiens
agcaatgatgtccagaagaa

SEQ ID NO: 2526815 - DNA, 23 bp, Homo sapiens
agcaatgatgtccagaagaatat

SEQ ID NO: 2526816 - DNA, 20 bp, Homo sapiens
agcaatgcccgtaatgctta

SEQ ID NO: 2526817 - DNA, 15 bp, Homo sapiens
agcaatgcctgccca

SEQ ID NO: 2526818 - DNA, 14 bp, Homo sapiens
agcacactcatccc

SEQ ID NO: 2526819 - DNA, 19 bp, Homo sapiens
agcacactgtagcattaca

SEQ ID NO: 2526820 - DNA, 19 bp, Homo sapiens
agcacagaaacagaggaga

SEQ ID NO: 2526821 - DNA, 16 bp, Homo sapiens
agcacagaaggaggag

SEQ ID NO: 2526822 - DNA, 17 bp, Homo sapiens
agcacagaccctgccct

SEQ ID NO: 2526823 - DNA, 12 bp, Homo sapiens
agcacaggcagc

SEQ ID NO: 2526824 - DNA, 13 bp, Homo sapiens
agcacaggcagct

SEQ ID NO: 2526825 - DNA, 21 bp, Homo sapiens
agcacaggtgggcttcccagt

SEQ ID NO: 2526826 - DNA, 18 bp, Homo sapiens
agcacagtggtggcaggg

SEQ ID NO: 2526827 - DNA, 19 bp, Homo sapiens
agcacagtggtggcagggc

SEQ ID NO: 2526828 - DNA, 18 bp, Homo sapiens
agcacagtgttaaatgaa

SEQ ID NO: 2526829 - DNA, 17 bp, Homo sapiens
agcaccaagctcaaagc

SEQ ID NO: 2526830 - DNA, 18 bp, Homo sapiens
agcaccaagctcaaagcg

SEQ ID NO: 2526831 - DNA, 17 bp, Homo sapiens
agcaccagcttctccag

SEQ ID NO: 2526832 - DNA, 19 bp, Homo sapiens
agcaccagcttctccaggc

SEQ ID NO: 2526833 - DNA, 14 bp, Homo sapiens
agcaccccaaggct

SEQ ID NO: 2526834 - DNA, 13 bp, Homo sapiens
agcacccctgtct

SEQ ID NO: 2526835 - DNA, 15 bp, Homo sapiens
agcacccctgtctct

SEQ ID NO: 2526836 - DNA, 18 bp, Homo sapiens
agcacctagtccagtgac

SEQ ID NO: 2526837 - DNA, 21 bp, Homo sapiens
agcacctgcttcatgctcagc

SEQ ID NO: 2526838 - DNA, 19 bp, Homo sapiens
agcaccttagacagtccct

SEQ ID NO: 2526839 - DNA, 23 bp, Homo sapiens
agcaccttagacagtccctgcca

SEQ ID NO: 2526840 - DNA, 20 bp, Homo sapiens
agcactaaagcagtggacac

SEQ ID NO: 2526841 - DNA, 19 bp, Homo sapiens
agcactaaggtgtgctctg

SEQ ID NO: 2526842 - DNA, 14 bp, Homo sapiens
agcactcccaagtc

SEQ ID NO: 2526843 - DNA, 17 bp, Homo sapiens
agcactgatttcacaac

SEQ ID NO: 2526844 - DNA, 18 bp, Homo sapiens
agcactgatttcacaaca

SEQ ID NO: 2526845 - DNA, 12 bp, Homo sapiens
agcactgcccaa

SEQ ID NO: 2526846 - DNA, 21 bp, Homo sapiens
agcactgctaggcgagtgcca

SEQ ID NO: 2526847 - DNA, 23 bp, Homo sapiens
agcactgctaggcgagtgccagg

SEQ ID NO: 2526848 - DNA, 17 bp, Homo sapiens
agcactggagtgcaggg

SEQ ID NO: 2526849 - DNA, 22 bp, Homo sapiens
agcactggagtgcagggaggag

SEQ ID NO: 2526850 - DNA, 12 bp, Homo sapiens
agcactggcctg

SEQ ID NO: 2526851 - DNA, 15 bp, Homo sapiens
agcactggcctgcac

SEQ ID NO: 2526852 - DNA, 17 bp, Homo sapiens
agcactggcctgcacgg

SEQ ID NO: 2526853 - DNA, 14 bp, Homo sapiens
agcactggctctct

SEQ ID NO: 2526854 - DNA, 17 bp, Homo sapiens
agcactgggttgacttt

SEQ ID NO: 2526855 - DNA, 14 bp, Homo sapiens
agcactgtgctaat

SEQ ID NO: 2526856 - DNA, 16 bp, Homo sapiens
agcactgttccagcct

SEQ ID NO: 2526857 - DNA, 13 bp, Homo sapiens
agcacttggactc

SEQ ID NO: 2526858 - DNA, 21 bp, Homo sapiens
agcacttggactcttgctctt

SEQ ID NO: 2526859 - DNA, 16 bp, Homo sapiens
agccttccaggggtgg

SEQ ID NO: 2526860 - DNA, 18 bp, Homo sapiens
agccttccaggggtggga

SEQ ID NO: 2526861 - DNA, 20 bp, Homo sapiens
agccttctgaggacattcca

SEQ ID NO: 2526862 - DNA, 15 bp, Homo sapiens
agccttctttgcttg

SEQ ID NO: 2526863 - DNA, 15 bp, Homo sapiens
agccttgaactttga

SEQ ID NO: 2526864 - DNA, 22 bp, Homo sapiens
agccttgaactttgacctctgc

SEQ ID NO: 2526865 - DNA, 21 bp, Homo sapiens
agccttgaccattctccacct

SEQ ID NO: 2526866 - DNA, 23 bp, Homo sapiens
agccttgaccattctccacctgc

SEQ ID NO: 2526867 - DNA, 16 bp, Homo sapiens
agccttggcatctaga

SEQ ID NO: 2526868 - DNA, 23 bp, Homo sapiens
agccttgggaacatgcgtgtgac

SEQ ID NO: 2526869 - DNA, 17 bp, Homo sapiens
agccttgtgtctacaga

SEQ ID NO: 2526870 - DNA, 16 bp, Homo sapiens
agcctttctcccaggc

SEQ ID NO: 2526871 - DNA, 16 bp, Homo sapiens
agcctttgcctccccg

SEQ ID NO: 2526872 - DNA, 13 bp, Homo sapiens
agcgacagtgaga

SEQ ID NO: 2526873 - DNA, 15 bp, Homo sapiens
agcgacagtgagact

SEQ ID NO: 2526874 - DNA, 16 bp, Homo sapiens
agcgaccgccccctcc

SEQ ID NO: 2526875 - DNA, 22 bp, Homo sapiens
agcgaccttcctcatccacccc

SEQ ID NO: 2526876 - DNA, 19 bp, Homo sapiens
agcgagccctggtggcagt

SEQ ID NO: 2526877 - DNA, 19 bp, Homo sapiens
agcgaggaggctccagagg

SEQ ID NO: 2526878 - DNA, 18 bp, Homo sapiens
agcgatgaatttggagac

SEQ ID NO: 2526879 - DNA, 18 bp, Homo sapiens
agcgatgtatgcagctat

SEQ ID NO: 2526880 - DNA, 17 bp, Homo sapiens
agcgattcttctgcttc

SEQ ID NO: 2526881 - DNA, 19 bp, Homo sapiens
agcgattcttctgcttcag

SEQ ID NO: 2526882 - DNA, 22 bp, Homo sapiens
agcgattcttctgcttcagcct

SEQ ID NO: 2526883 - DNA, 17 bp, Homo sapiens
agcgcacctgccccctg

SEQ ID NO: 2526884 - DNA, 19 bp, Homo sapiens
agcgcaggtttagtttact

SEQ ID NO: 2526885 - DNA, 18 bp, Homo sapiens
agcgccagcctgtcccat

SEQ ID NO: 2526886 - DNA, 22 bp, Homo sapiens
agcgcccagttgggtggatgcc

SEQ ID NO: 2526887 - DNA, 14 bp, Homo sapiens
agcgcccgctgggc

SEQ ID NO: 2526888 - DNA, 19 bp, Homo sapiens
agcgcccgctgggctgagc

SEQ ID NO: 2526889 - DNA, 17 bp, Homo sapiens
agcgccgtgagttctca

SEQ ID NO: 2526890 - DNA, 23 bp, Homo sapiens
agcgccgtgagttctcagggctc

SEQ ID NO: 2526891 - DNA, 12 bp, Homo sapiens
agcgcctgcccc

SEQ ID NO: 2526892 - DNA, 15 bp, Homo sapiens
agcgcctgcccctcc

SEQ ID NO: 2526893 - DNA, 19 bp, Homo sapiens
agcgcctgcccctcccaga

SEQ ID NO: 2526894 - DNA, 17 bp, Homo sapiens
agcgctttctggaaaag

SEQ ID NO: 2526895 - DNA, 21 bp, Homo sapiens
agcgctttctggaaaagagga

SEQ ID NO: 2526896 - DNA, 20 bp, Homo sapiens
agcgggaatggcagctgcca

SEQ ID NO: 2526897 - DNA, 15 bp, Homo sapiens
agcgggacctgtggc

SEQ ID NO: 2526898 - DNA, 15 bp, Homo sapiens
agcggggacagctcc

SEQ ID NO: 2526899 - DNA, 16 bp, Homo sapiens
agcggggacagctcct

SEQ ID NO: 2526900 - DNA, 20 bp, Homo sapiens
agcggggacagctccttctg

SEQ ID NO: 2526901 - DNA, 15 bp, Homo sapiens
agcgtcctcctctgt

SEQ ID NO: 2526902 - DNA, 16 bp, Homo sapiens
agcgtcctcctctgtg

SEQ ID NO: 2526903 - DNA, 13 bp, Homo sapiens
agcgtgagccact

SEQ ID NO: 2526904 - DNA, 19 bp, Homo sapiens
agcgtgagccactgcaccg

SEQ ID NO: 2526905 - DNA, 22 bp, Homo sapiens
agcgtgagccactgcaccgggc

SEQ ID NO: 2526906 - DNA, 15 bp, Homo sapiens
agcgtgcataagtta

SEQ ID NO: 2526907 - DNA, 20 bp, Homo sapiens
agcgtgctccagcctggctc

SEQ ID NO: 2526908 - DNA, 23 bp, Homo sapiens
agcgtgtctgtatttatgtgtga

SEQ ID NO: 2526909 - DNA, 15 bp, Homo sapiens
agctaaaacctgagc

SEQ ID NO: 2526910 - DNA, 15 bp, Homo sapiens
agctaaagaggctga

SEQ ID NO: 2526911 - DNA, 19 bp, Homo sapiens
agctaacacacagctccca

SEQ ID NO: 2526912 - DNA, 16 bp, Homo sapiens
agctaacactggcccc

SEQ ID NO: 2526913 - DNA, 18 bp, Homo sapiens
agctaagctaggaatgaa

SEQ ID NO: 2526914 - DNA, 13 bp, Homo sapiens
agctaatctgtag

SEQ ID NO: 2526915 - DNA, 20 bp, Homo sapiens
agctaatctgtagggctgga

SEQ ID NO: 2526916 - DNA, 14 bp, Homo sapiens
agctaatgggacac

SEQ ID NO: 2526917 - DNA, 19 bp, Homo sapiens
agctaattctttgacctgt

SEQ ID NO: 2526918 - DNA, 12 bp, Homo sapiens
agctacaggtta

SEQ ID NO: 2526919 - DNA, 18 bp, Homo sapiens
agctacaggttacaacag

SEQ ID NO: 2526920 - DNA, 21 bp, Homo sapiens
agctaccctttttctccagct

SEQ ID NO: 2526921 - DNA, 14 bp, Homo sapiens
agctacctcaacca

SEQ ID NO: 2526922 - DNA, 23 bp, Homo sapiens
agctacctcaaccaatgccaaaa

SEQ ID NO: 2526923 - DNA, 14 bp, Homo sapiens
agctactcagaagc

SEQ ID NO: 2526924 - DNA, 21 bp, Homo sapiens
agctactcagaagcctgaggc

SEQ ID NO: 2526925 - DNA, 18 bp, Homo sapiens
agctactgcggaaaagga

SEQ ID NO: 2526926 - DNA, 21 bp, Homo sapiens
agctacttcctcctccccact

SEQ ID NO: 2526927 - DNA, 16 bp, Homo sapiens
agctacttgggaggct

SEQ ID NO: 2526928 - DNA, 19 bp, Homo sapiens
agctacttgggccatagct

SEQ ID NO: 2526929 - DNA, 11 bp, Homo sapiens
agctagaaatg

SEQ ID NO: 2526930 - DNA, 15 bp, Homo sapiens
agctagaacctggag

SEQ ID NO: 2526931 - DNA, 18 bp, Homo sapiens
agctagaacctggagagc

SEQ ID NO: 2526932 - DNA, 16 bp, Homo sapiens
agctagaacctggagg

SEQ ID NO: 2526933 - DNA, 19 bp, Homo sapiens
agctagaactttgaaggac

SEQ ID NO: 2526934 - DNA, 14 bp, Homo sapiens
agctagaaggccac

SEQ ID NO: 2526935 - DNA, 16 bp, Homo sapiens
agctagctcccctcct

SEQ ID NO: 2526936 - DNA, 21 bp, Homo sapiens
agctagctcccctcctctccc

SEQ ID NO: 2526937 - DNA, 23 bp, Homo sapiens
agctagctcccctcctctcccct

SEQ ID NO: 2526938 - DNA, 17 bp, Homo sapiens
agctagttcgtagcttt

SEQ ID NO: 2526939 - DNA, 22 bp, Homo sapiens
agctatatccatgtactgtagt

SEQ ID NO: 2526940 - DNA, 14 bp, Homo sapiens
agctatcaggaaca

SEQ ID NO: 2526941 - DNA, 22 bp, Homo sapiens
agctatctggtcaacctcctgg

SEQ ID NO: 2526942 - DNA, 23 bp, Homo sapiens
agctatgctggtaggctcctgcc

SEQ ID NO: 2526943 - DNA, 17 bp, Homo sapiens
agctatgggagccccag

SEQ ID NO: 2526944 - DNA, 19 bp, Homo sapiens
agctatgggagccccaggg

SEQ ID NO: 2526945 - DNA, 22 bp, Homo sapiens
agctatgggagccccagggtct

SEQ ID NO: 2526946 - DNA, 15 bp, Homo sapiens
agctattactgtctg

SEQ ID NO: 2526947 - DNA, 14 bp, Homo sapiens
agctattagccagg

SEQ ID NO: 2526948 - DNA, 17 bp, Homo sapiens
agctatttcatctattt

SEQ ID NO: 2526949 - DNA, 20 bp, Homo sapiens
agctatttccattccagaat

SEQ ID NO: 2526950 - DNA, 18 bp, Homo sapiens
agctcaagtcttccctga

SEQ ID NO: 2526951 - DNA, 21 bp, Homo sapiens
agctcacaataaaaatggctc

SEQ ID NO: 2526952 - DNA, 17 bp, Homo sapiens
agctcacccaataaaca

SEQ ID NO: 2526953 - DNA, 15 bp, Homo sapiens
agctcaccccccaca

SEQ ID NO: 2526954 - DNA, 19 bp, Homo sapiens
agctcacctctcccttgga

SEQ ID NO: 2526955 - DNA, 18 bp, Homo sapiens
agctcacctgttgcttac

SEQ ID NO: 2526956 - DNA, 13 bp, Homo sapiens
agctcacgtcaca

SEQ ID NO: 2526957 - DNA, 13 bp, Homo sapiens
agctcactaccct

SEQ ID NO: 2526958 - DNA, 23 bp, Homo sapiens
agctcacttctgggcttcatctg

SEQ ID NO: 2526959 - DNA, 17 bp, Homo sapiens
agctcagagagggcagg

SEQ ID NO: 2526960 - DNA, 21 bp, Homo sapiens
agctcagagagggcaggcatg

SEQ ID NO: 2526961 - DNA, 11 bp, Homo sapiens
agctcagccca

SEQ ID NO: 2526962 - DNA, 21 bp, Homo sapiens
agctcagcccacccccctcat

SEQ ID NO: 2526963 - DNA, 22 bp, Homo sapiens
agctcagcccacccccctcatt

SEQ ID NO: 2526964 - DNA, 12 bp, Homo sapiens
agctcagcgcca

SEQ ID NO: 2526965 - DNA, 21 bp, Homo sapiens
agctcagctactgatttttgt

SEQ ID NO: 2526966 - DNA, 14 bp, Homo sapiens
agctcaggaccagg

SEQ ID NO: 2526967 - DNA, 18 bp, Homo sapiens
agctcaggacctgggacc

SEQ ID NO: 2526968 - DNA, 16 bp, Homo sapiens
agctcagggcctggct

SEQ ID NO: 2526969 - DNA, 18 bp, Homo sapiens
agctcagggcctggctca

SEQ ID NO: 2526970 - DNA, 19 bp, Homo sapiens
agctcagggcctggctcag

SEQ ID NO: 2526971 - DNA, 20 bp, Homo sapiens
agctcagggcctggctcagg

SEQ ID NO: 2526972 - DNA, 14 bp, Homo sapiens
agctcagggcttca

SEQ ID NO: 2526973 - DNA, 18 bp, Homo sapiens
agctcaggtgtccctgca

SEQ ID NO: 2526974 - DNA, 22 bp, Homo sapiens
agctcagttctagtctctctgg

SEQ ID NO: 2526975 - DNA, 15 bp, Homo sapiens
agctcatattttgta

SEQ ID NO: 2526976 - DNA, 13 bp, Homo sapiens
agctccagttcga

SEQ ID NO: 2526977 - DNA, 21 bp, Homo sapiens
agctccatctccactccagat

SEQ ID NO: 2526978 - DNA, 18 bp, Homo sapiens
agctcccaagggatggtg

SEQ ID NO: 2526979 - DNA, 20 bp, Homo sapiens
agctcccaagggatggtgcc

SEQ ID NO: 2526980 - DNA, 13 bp, Homo sapiens
agctcccaggaac

SEQ ID NO: 2526981 - DNA, 22 bp, Homo sapiens
agctccccaaaaacctcacccg

SEQ ID NO: 2526982 - DNA, 13 bp, Homo sapiens
agctccccagagt

SEQ ID NO: 2526983 - DNA, 20 bp, Homo sapiens
agctccccgcttctgcctgc

SEQ ID NO: 2526984 - DNA, 14 bp, Homo sapiens
agctcccctcctct

SEQ ID NO: 2526985 - DNA, 22 bp, Homo sapiens
agctcccctcggagaagagctg

SEQ ID NO: 2526986 - DNA, 13 bp, Homo sapiens
agctccctctgcc

SEQ ID NO: 2526987 - DNA, 14 bp, Homo sapiens
agctccctctgcct

SEQ ID NO: 2526988 - DNA, 13 bp, Homo sapiens
agctcccttctct

SEQ ID NO: 2526989 - DNA, 20 bp, Homo sapiens
agctccgctttctacccagc

SEQ ID NO: 2526990 - DNA, 21 bp, Homo sapiens
agctccgctttctacccagcg

SEQ ID NO: 2526991 - DNA, 23 bp, Homo sapiens
agctccgctttctacccagcgag

SEQ ID NO: 2526992 - DNA, 13 bp, Homo sapiens
agctcctctcctg

SEQ ID NO: 2526993 - DNA, 14 bp, Homo sapiens
agctcctctgggca

SEQ ID NO: 2526994 - DNA, 13 bp, Homo sapiens
agctcctcttcct

SEQ ID NO: 2526995 - DNA, 17 bp, Homo sapiens
agctcctgtcctcccat

SEQ ID NO: 2526996 - DNA, 15 bp, Homo sapiens
agctccttcctggag

SEQ ID NO: 2526997 - DNA, 16 bp, Homo sapiens
agctccttctgtccta

SEQ ID NO: 2526998 - DNA, 22 bp, Homo sapiens
agctccttctgtcctactctgt

SEQ ID NO: 2526999 - DNA, 19 bp, Homo sapiens
agctccttgggaggcccca

SEQ ID NO: 2527000 - DNA, 12 bp, Homo sapiens
agctcggtggac

SEQ ID NO: 2527001 - DNA, 17 bp, Homo sapiens
agctcggtggacccagg

SEQ ID NO: 2527002 - DNA, 19 bp, Homo sapiens
agctcgtgtatcctggggc

SEQ ID NO: 2527003 - DNA, 14 bp, Homo sapiens
aggcagacagcagc

SEQ ID NO: 2527004 - DNA, 15 bp, Homo sapiens
aggcagacagcagct

SEQ ID NO: 2527005 - DNA, 19 bp, Homo sapiens
aggcagagaaagaagagac

SEQ ID NO: 2527006 - DNA, 22 bp, Homo sapiens
aggcagagaaagaagagacagg

SEQ ID NO: 2527007 - DNA, 13 bp, Homo sapiens
aggcagaggacag

SEQ ID NO: 2527008 - DNA, 20 bp, Homo sapiens
aggcagatctgtgccccatg

SEQ ID NO: 2527009 - DNA, 16 bp, Homo sapiens
aggcagccaggccaca

SEQ ID NO: 2527010 - DNA, 18 bp, Homo sapiens
aggcagccaggccacaag

SEQ ID NO: 2527011 - DNA, 20 bp, Homo sapiens
aggcagccccattctgcctg

SEQ ID NO: 2527012 - DNA, 21 bp, Homo sapiens
aggcagccccattctgcctgc

SEQ ID NO: 2527013 - DNA, 18 bp, Homo sapiens
aggcagctggatgagact

SEQ ID NO: 2527014 - DNA, 15 bp, Homo sapiens
aggcagcttgaaact

SEQ ID NO: 2527015 - DNA, 17 bp, Homo sapiens
aggcaggaagggcagga

SEQ ID NO: 2527016 - DNA, 20 bp, Homo sapiens
aggcaggaagggcaggaagg

SEQ ID NO: 2527017 - DNA, 21 bp, Homo sapiens
aggcaggccaaggccttctcc

SEQ ID NO: 2527018 - DNA, 14 bp, Homo sapiens
aggcaggctttgtt

SEQ ID NO: 2527019 - DNA, 19 bp, Homo sapiens
aggcagggaagtccccagg

SEQ ID NO: 2527020 - DNA, 19 bp, Homo sapiens
aggcagggtctcactctgt

SEQ ID NO: 2527021 - DNA, 21 bp, Homo sapiens
aggcagggtctcactctgtcg

SEQ ID NO: 2527022 - DNA, 14 bp, Homo sapiens
aggcaggtccaggg

SEQ ID NO: 2527023 - DNA, 22 bp, Homo sapiens
aggcaggtcttgaactcctggc

SEQ ID NO: 2527024 - DNA, 17 bp, Homo sapiens
aggcaggtgcctccagg

SEQ ID NO: 2527025 - DNA, 13 bp, Homo sapiens
aggcaggtgcctg

SEQ ID NO: 2527026 - DNA, 19 bp, Homo sapiens
aggcagtgatgctggatgc

SEQ ID NO: 2527027 - DNA, 13 bp, Homo sapiens
aggcataggcctg

SEQ ID NO: 2527028 - DNA, 14 bp, Homo sapiens
aggcataggcctgg

SEQ ID NO: 2527029 - DNA, 17 bp, Homo sapiens
aggcataggcctgggtg

SEQ ID NO: 2527030 - DNA, 20 bp, Homo sapiens
aggcatatcagtctctgagg

SEQ ID NO: 2527031 - DNA, 18 bp, Homo sapiens
aggcatcccaggggacca

SEQ ID NO: 2527032 - DNA, 19 bp, Homo sapiens
aggcatctgtgggcatggt

SEQ ID NO: 2527033 - DNA, 20 bp, Homo sapiens
aggcatgagggatcacaggg

SEQ ID NO: 2527034 - DNA, 22 bp, Homo sapiens
aggcatgagggatcacagggcc

SEQ ID NO: 2527035 - DNA, 12 bp, Homo sapiens
aggcatggccct

SEQ ID NO: 2527036 - DNA, 14 bp, Homo sapiens
aggcatggccctgg

SEQ ID NO: 2527037 - DNA, 12 bp, Homo sapiens
aggcatgtcctg

SEQ ID NO: 2527038 - DNA, 12 bp, Homo sapiens
aggcatgttctc

SEQ ID NO: 2527039 - DNA, 17 bp, Homo sapiens
aggcattccccaggagg

SEQ ID NO: 2527040 - DNA, 23 bp, Homo sapiens
aggcattccccaggaggccagcc

SEQ ID NO: 2527041 - DNA, 18 bp, Homo sapiens
aggcattgtgggaagggg

SEQ ID NO: 2527042 - DNA, 20 bp, Homo sapiens
aggcatttctatcacatatt

SEQ ID NO: 2527043 - DNA, 20 bp, Homo sapiens
aggcatttgctgaatacaga

SEQ ID NO: 2527044 - DNA, 17 bp, Homo sapiens
aggccaaacctctgttc

SEQ ID NO: 2527045 - DNA, 14 bp, Homo sapiens
aggccaagaatcaa

SEQ ID NO: 2527046 - DNA, 18 bp, Homo sapiens
aggccaaggcgggtggat

SEQ ID NO: 2527047 - DNA, 15 bp, Homo sapiens
aggccaagtgcaggc

SEQ ID NO: 2527048 - DNA, 15 bp, Homo sapiens
aggccacaagaccct

SEQ ID NO: 2527049 - DNA, 18 bp, Homo sapiens
aggccacaagacccttgt

SEQ ID NO: 2527050 - DNA, 16 bp, Homo sapiens
aggccacatgagtccc

SEQ ID NO: 2527051 - DNA, 19 bp, Homo sapiens
aggccacatgagtcccagt

SEQ ID NO: 2527052 - DNA, 13 bp, Homo sapiens
aggccaccaggat

SEQ ID NO: 2527053 - DNA, 14 bp, Homo sapiens
aggccacctctcca

SEQ ID NO: 2527054 - DNA, 19 bp, Homo sapiens
aggccacctctccaagggc

SEQ ID NO: 2527055 - DNA, 23 bp, Homo sapiens
aggccacctctccaagggcttct

SEQ ID NO: 2527056 - DNA, 14 bp, Homo sapiens
aggccacctgcccc

SEQ ID NO: 2527057 - DNA, 19 bp, Homo sapiens
aggccacgtgatgtggagg

SEQ ID NO: 2527058 - DNA, 14 bp, Homo sapiens
aggccagccccacc

SEQ ID NO: 2527059 - DNA, 20 bp, Homo sapiens
aggccagctggcagcagagt

SEQ ID NO: 2527060 - DNA, 23 bp, Homo sapiens
aggccaggccctctgcccactcc

SEQ ID NO: 2527061 - DNA, 12 bp, Homo sapiens
aggccaggctcc

SEQ ID NO: 2527062 - DNA, 15 bp, Homo sapiens
aggccagggcagagt

SEQ ID NO: 2527063 - DNA, 13 bp, Homo sapiens
aggccatgaaaaa

SEQ ID NO: 2527064 - DNA, 19 bp, Homo sapiens
aggccatgaaaaaaatgat

SEQ ID NO: 2527065 - DNA, 16 bp, Homo sapiens
aggccatggagagctg

SEQ ID NO: 2527066 - DNA, 18 bp, Homo sapiens
aggccatggagagctgga

SEQ ID NO: 2527067 - DNA, 14 bp, Homo sapiens
aggccatgggcctc

SEQ ID NO: 2527068 - DNA, 17 bp, Homo sapiens
aggccatgggcctcctg

SEQ ID NO: 2527069 - DNA, 20 bp, Homo sapiens
aggcccagagggcctgcaag

SEQ ID NO: 2527070 - DNA, 13 bp, Homo sapiens
aggcccagtgaga

SEQ ID NO: 2527071 - DNA, 18 bp, Homo sapiens
aggcccatggttgagaaa

SEQ ID NO: 2527072 - DNA, 23 bp, Homo sapiens
aggccccaaaaccacagccctgt

SEQ ID NO: 2527073 - DNA, 15 bp, Homo sapiens
aggccccactgggga

SEQ ID NO: 2527074 - DNA, 17 bp, Homo sapiens
aggccccactggggaaa

SEQ ID NO: 2527075 - DNA, 17 bp, Homo sapiens
aggccccgaggacccag

SEQ ID NO: 2527076 - DNA, 18 bp, Homo sapiens
aggccccgaggacccaga

SEQ ID NO: 2527077 - DNA, 13 bp, Homo sapiens
aggcccctgccac

SEQ ID NO: 2527078 - DNA, 17 bp, Homo sapiens
aggcccctggacaagca

SEQ ID NO: 2527079 - DNA, 12 bp, Homo sapiens
aggcccctggcc

SEQ ID NO: 2527080 - DNA, 15 bp, Homo sapiens
aggcccctggcccag

SEQ ID NO: 2527081 - DNA, 20 bp, Homo sapiens
aggcccctggcccagcggcc

SEQ ID NO: 2527082 - DNA, 14 bp, Homo sapiens
aggcccggctccag

SEQ ID NO: 2527083 - DNA, 15 bp, Homo sapiens
aggcccggctccagg

SEQ ID NO: 2527084 - DNA, 18 bp, Homo sapiens
aggcccggctccaggctc

SEQ ID NO: 2527085 - DNA, 20 bp, Homo sapiens
aggcccggctccaggctcct

SEQ ID NO: 2527086 - DNA, 17 bp, Homo sapiens
aggccctcgctgccagc

SEQ ID NO: 2527087 - DNA, 22 bp, Homo sapiens
aggccctcgctgccagctctgt

SEQ ID NO: 2527088 - DNA, 15 bp, Homo sapiens
aggccctcgggccca

SEQ ID NO: 2527089 - DNA, 19 bp, Homo sapiens
aggccctcgggcccagccc

SEQ ID NO: 2527090 - DNA, 15 bp, Homo sapiens
aggccctctgcccac

SEQ ID NO: 2527091 - DNA, 20 bp, Homo sapiens
aggccctctgcccactccct

SEQ ID NO: 2527092 - DNA, 21 bp, Homo sapiens
aggccctctgcccactccctg

SEQ ID NO: 2527093 - DNA, 22 bp, Homo sapiens
aggccctctgcccactccctgc

SEQ ID NO: 2527094 - DNA, 23 bp, Homo sapiens
aggccctctgcccactccctgca

SEQ ID NO: 2527095 - DNA, 16 bp, Homo sapiens
aggcccttattttcaa

SEQ ID NO: 2527096 - DNA, 22 bp, Homo sapiens
aggcccttattttcaagaaact

SEQ ID NO: 2527097 - DNA, 12 bp, Homo sapiens
aggcccttctct

SEQ ID NO: 2527098 - DNA, 15 bp, Homo sapiens
aggcccttctctcca

SEQ ID NO: 2527099 - DNA, 19 bp, Homo sapiens
aggccgaagctctggctga

SEQ ID NO: 2527100 - DNA, 24 bp, Homo sapiens
aggccgaagctctggctgaaccct

SEQ ID NO: 2527101 - DNA, 21 bp, Homo sapiens
aggccgcagctcttgcccttc

SEQ ID NO: 2527102 - DNA, 17 bp, Homo sapiens
aggccgctagaggcctg

SEQ ID NO: 2527103 - DNA, 20 bp, Homo sapiens
aggccgctagaggcctgagg

SEQ ID NO: 2527104 - DNA, 15 bp, Homo sapiens
aggccggggccgggt

SEQ ID NO: 2527105 - DNA, 17 bp, Homo sapiens
aggccgtcctcccgggc

SEQ ID NO: 2527106 - DNA, 21 bp, Homo sapiens
aggccgtcctcccgggccctc

SEQ ID NO: 2527107 - DNA, 23 bp, Homo sapiens
aggcctacatgctttgtgaacaa

SEQ ID NO: 2527108 - DNA, 22 bp, Homo sapiens
aggcctataatgaagctttata

SEQ ID NO: 2527109 - DNA, 15 bp, Homo sapiens
aggcctcagtggact

SEQ ID NO: 2527110 - DNA, 14 bp, Homo sapiens
aggcctcccaagtt

SEQ ID NO: 2527111 - DNA, 15 bp, Homo sapiens
aggcctccctagcca

SEQ ID NO: 2527112 - DNA, 15 bp, Homo sapiens
aggcctccctctctc

SEQ ID NO: 2527113 - DNA, 14 bp, Homo sapiens
aggcctctgtgtcc

SEQ ID NO: 2527114 - DNA, 23 bp, Homo sapiens
aggcctctgtgtccttccctgca

SEQ ID NO: 2527115 - DNA, 17 bp, Homo sapiens
aggcctgaggatgagct

SEQ ID NO: 2527116 - DNA, 20 bp, Homo sapiens
aggcctgaggatgagctgga

SEQ ID NO: 2527117 - DNA, 17 bp, Homo sapiens
aggcctgccctcaggga

SEQ ID NO: 2527118 - DNA, 11 bp, Homo sapiens
aggcctggcca

SEQ ID NO: 2527119 - DNA, 15 bp, Homo sapiens
aggcctggccagatg

SEQ ID NO: 2527120 - DNA, 21 bp, Homo sapiens
aggcctggccagatgcaccag

SEQ ID NO: 2527121 - DNA, 23 bp, Homo sapiens
aggcctggccagatgcaccagcc

SEQ ID NO: 2527122 - DNA, 17 bp, Homo sapiens
aggcctgggggcaggga

SEQ ID NO: 2527123 - DNA, 21 bp, Homo sapiens
aggcctgggtctgtgtctctt

SEQ ID NO: 2527124 - DNA, 22 bp, Homo sapiens
aggcctgtcctgacctgtctca

SEQ ID NO: 2527125 - DNA, 17 bp, Homo sapiens
aggccttctctgaagga

SEQ ID NO: 2527126 - DNA, 18 bp, Homo sapiens
aggccttctctgaaggac

SEQ ID NO: 2527127 - DNA, 9 bp, Homo sapiens
aggccttgc

SEQ ID NO: 2527128 - DNA, 11 bp, Homo sapiens
aggccttgctc

SEQ ID NO: 2527129 - DNA, 15 bp, Homo sapiens
aggcgagtgccagga

SEQ ID NO: 2527130 - DNA, 15 bp, Homo sapiens
aggcggacgttccag

SEQ ID NO: 2527131 - DNA, 17 bp, Homo sapiens
aggcggacgttccagcc

SEQ ID NO: 2527132 - DNA, 18 bp, Homo sapiens
aggcggacgttccagccg

SEQ ID NO: 2527133 - DNA, 14 bp, Homo sapiens
aggcggcccctccc

SEQ ID NO: 2527134 - DNA, 15 bp, Homo sapiens
aggcgggaaggaggg

SEQ ID NO: 2527135 - DNA, 13 bp, Homo sapiens
aggcgggccagcc

SEQ ID NO: 2527136 - DNA, 15 bp, Homo sapiens
aggcgggccagccag

SEQ ID NO: 2527137 - DNA, 16 bp, Homo sapiens
aggcgggccagccagg

SEQ ID NO: 2527138 - DNA, 17 bp, Homo sapiens
aggcgggccagccaggc

SEQ ID NO: 2527139 - DNA, 23 bp, Homo sapiens
aggcgggccagccaggcgggctc

SEQ ID NO: 2527140 - DNA, 13 bp, Homo sapiens
aggcgtgaggatg

SEQ ID NO: 2527141 - DNA, 15 bp, Homo sapiens
aggcgtggagctgcc

SEQ ID NO: 2527142 - DNA, 17 bp, Homo sapiens
aggcgtggagctgcctg

SEQ ID NO: 2527143 - DNA, 15 bp, Homo sapiens
aggctaaggcgtgga

SEQ ID NO: 2527144 - DNA, 20 bp, Homo sapiens
aggctaaggcgtggagctgc

SEQ ID NO: 2527145 - DNA, 23 bp, Homo sapiens
aggctaaggcgtggagctgcctg

SEQ ID NO: 2527146 - DNA, 22 bp, Homo sapiens
aggctacaattttctcccagga

SEQ ID NO: 2527147 - DNA, 23 bp, Homo sapiens
aggctacaattttctcccaggaa

SEQ ID NO: 2527148 - DNA, 23 bp, Homo sapiens
agtcagtgcaaatgtcagataca

SEQ ID NO: 2527149 - DNA, 14 bp, Homo sapiens
agtcataaacctta

SEQ ID NO: 2527150 - DNA, 14 bp, Homo sapiens
agtcatctcaacca

SEQ ID NO: 2527151 - DNA, 15 bp, Homo sapiens
agtcatctcaaccat

SEQ ID NO: 2527152 - DNA, 19 bp, Homo sapiens
agtcatctccatcagctgt

SEQ ID NO: 2527153 - DNA, 14 bp, Homo sapiens
agtcatgaagccca

SEQ ID NO: 2527154 - DNA, 21 bp, Homo sapiens
agtcatgaagcccaagtgaaa

SEQ ID NO: 2527155 - DNA, 22 bp, Homo sapiens
agtcatgagctgagcagggaga

SEQ ID NO: 2527156 - DNA, 20 bp, Homo sapiens
agtcatgcaaaggctgggac

SEQ ID NO: 2527157 - DNA, 16 bp, Homo sapiens
agtcatgcataaatat

SEQ ID NO: 2527158 - DNA, 21 bp, Homo sapiens
agtcatgcataaatatgcagt

SEQ ID NO: 2527159 - DNA, 13 bp, Homo sapiens
agtcatggctgtg

SEQ ID NO: 2527160 - DNA, 20 bp, Homo sapiens
agtcatgtaagctgaaaata

SEQ ID NO: 2527161 - DNA, 15 bp, Homo sapiens
agtcatgttccttca

SEQ ID NO: 2527162 - DNA, 21 bp, Homo sapiens
agtcattatagatcccccaga

SEQ ID NO: 2527163 - DNA, 18 bp, Homo sapiens
agtcattatccttgctat

SEQ ID NO: 2527164 - DNA, 20 bp, Homo sapiens
agtcattatccttgctatga

SEQ ID NO: 2527165 - DNA, 19 bp, Homo sapiens
agtcatttgctgagcatgt

SEQ ID NO: 2527166 - DNA, 22 bp, Homo sapiens
agtcatttgctgagcatgtact

SEQ ID NO: 2527167 - DNA, 14 bp, Homo sapiens
agtcatttttgttt

SEQ ID NO: 2527168 - DNA, 19 bp, Homo sapiens
agtccaagagggtccttta

SEQ ID NO: 2527169 - DNA, 14 bp, Homo sapiens
agtccacaaaataa

SEQ ID NO: 2527170 - DNA, 20 bp, Homo sapiens
agtccagaaactgttcccac

SEQ ID NO: 2527171 - DNA, 15 bp, Homo sapiens
agtccagatttacac

SEQ ID NO: 2527172 - DNA, 16 bp, Homo sapiens
agtccagatttacact

SEQ ID NO: 2527173 - DNA, 23 bp, Homo sapiens
agtccagatttacactgggagag

SEQ ID NO: 2527174 - DNA, 20 bp, Homo sapiens
agtcccaccttggctgcagg

SEQ ID NO: 2527175 - DNA, 23 bp, Homo sapiens
agtcccaccttggctgcagggag

SEQ ID NO: 2527176 - DNA, 12 bp, Homo sapiens
agtcccactgcc

SEQ ID NO: 2527177 - DNA, 18 bp, Homo sapiens
agtcccactgcctcaggt

SEQ ID NO: 2527178 - DNA, 23 bp, Homo sapiens
agtcccagagcaggaggcccctg

SEQ ID NO: 2527179 - DNA, 13 bp, Homo sapiens
agtcccagtggga

SEQ ID NO: 2527180 - DNA, 13 bp, Homo sapiens
agtccccaggccc

SEQ ID NO: 2527181 - DNA, 21 bp, Homo sapiens
agtccccaggccccaggaagc

SEQ ID NO: 2527182 - DNA, 16 bp, Homo sapiens
agtccccctgccccag

SEQ ID NO: 2527183 - DNA, 13 bp, Homo sapiens
agtcccctcccat

SEQ ID NO: 2527184 - DNA, 21 bp, Homo sapiens
agtcccctcccatctgggagt

SEQ ID NO: 2527185 - DNA, 19 bp, Homo sapiens
agtcccctgtttgtttctg

SEQ ID NO: 2527186 - DNA, 13 bp, Homo sapiens
agtccctgccaat

SEQ ID NO: 2527187 - DNA, 13 bp, Homo sapiens
agtccctgttttc

SEQ ID NO: 2527188 - DNA, 20 bp, Homo sapiens
agtccctgttttctgagccc

SEQ ID NO: 2527189 - DNA, 21 bp, Homo sapiens
agtccctgttttctgagcccg

SEQ ID NO: 2527190 - DNA, 19 bp, Homo sapiens
agtcccttccacaccccca

SEQ ID NO: 2527191 - DNA, 13 bp, Homo sapiens
agtcccttcccct

SEQ ID NO: 2527192 - DNA, 23 bp, Homo sapiens
agtcccttcccctccctggctcc

SEQ ID NO: 2527193 - DNA, 20 bp, Homo sapiens
agtcctacaagctaaaatta

SEQ ID NO: 2527194 - DNA, 13 bp, Homo sapiens
agtcctagctgca

SEQ ID NO: 2527195 - DNA, 15 bp, Homo sapiens
agtcctagctgcaca

SEQ ID NO: 2527196 - DNA, 21 bp, Homo sapiens
agtcctagctgcacagggcag

SEQ ID NO: 2527197 - DNA, 15 bp, Homo sapiens
agtcctcactcccag

SEQ ID NO: 2527198 - DNA, 14 bp, Homo sapiens
agtcctcccatctc

SEQ ID NO: 2527199 - DNA, 15 bp, Homo sapiens
agtcctcgtagccat

SEQ ID NO: 2527200 - DNA, 17 bp, Homo sapiens
agtcctcgtagccatct

SEQ ID NO: 2527201 - DNA, 14 bp, Homo sapiens
agtcctctgaatga

SEQ ID NO: 2527202 - DNA, 22 bp, Homo sapiens
agtcctcttttctgagaggact

SEQ ID NO: 2527203 - DNA, 21 bp, Homo sapiens
agtcctgaagaggcgggccag

SEQ ID NO: 2527204 - DNA, 22 bp, Homo sapiens
agtcctgaagaggcgggccagc

SEQ ID NO: 2527205 - DNA, 18 bp, Homo sapiens
agtcctggcctggcttct

SEQ ID NO: 2527206 - DNA, 15 bp, Homo sapiens
agtcctgggatgtgg

SEQ ID NO: 2527207 - DNA, 14 bp, Homo sapiens
agtcctgtgaattt

SEQ ID NO: 2527208 - DNA, 18 bp, Homo sapiens
agtccttaaacagggcat

SEQ ID NO: 2527209 - DNA, 18 bp, Homo sapiens
agtccttaccagcagagc

SEQ ID NO: 2527210 - DNA, 15 bp, Homo sapiens
agtccttacctcttc

SEQ ID NO: 2527211 - DNA, 21 bp, Homo sapiens
agtccttacctcttccggaga

SEQ ID NO: 2527212 - DNA, 23 bp, Homo sapiens
agtccttacctcttccggagatg

SEQ ID NO: 2527213 - DNA, 17 bp, Homo sapiens
agtccttcacctcactg

SEQ ID NO: 2527214 - DNA, 16 bp, Homo sapiens
agtccttgaaaatatt

SEQ ID NO: 2527215 - DNA, 13 bp, Homo sapiens
agtccttgcttgg

SEQ ID NO: 2527216 - DNA, 19 bp, Homo sapiens
agtcgctgtggttgtttta

SEQ ID NO: 2527217 - DNA, 18 bp, Homo sapiens
agtcgtacagaaagctgc

SEQ ID NO: 2527218 - DNA, 22 bp, Homo sapiens
agtcgtcatcacttttcagtga

SEQ ID NO: 2527219 - DNA, 23 bp, Homo sapiens
agtctaaatatttccttaaactg

SEQ ID NO: 2527220 - DNA, 13 bp, Homo sapiens
agtctacccagag

SEQ ID NO: 2527221 - DNA, 14 bp, Homo sapiens
agtctacccagaga

SEQ ID NO: 2527222 - DNA, 20 bp, Homo sapiens
agtctactcttaagccatct

SEQ ID NO: 2527223 - DNA, 15 bp, Homo sapiens
agtctatccacagag

SEQ ID NO: 2527224 - DNA, 14 bp, Homo sapiens
agtctattcattat

SEQ ID NO: 2527225 - DNA, 17 bp, Homo sapiens
agtctattcattatatt

SEQ ID NO: 2527226 - DNA, 13 bp, Homo sapiens
agtctcaggaaat

SEQ ID NO: 2527227 - DNA, 10 bp, Homo sapiens
agtctcagtt

SEQ ID NO: 2527228 - DNA, 14 bp, Homo sapiens
agtctccttcccct

SEQ ID NO: 2527229 - DNA, 22 bp, Homo sapiens
agtctcctttgcactgagggcc

SEQ ID NO: 2527230 - DNA, 23 bp, Homo sapiens
agtctcctttgcactgagggcca

SEQ ID NO: 2527231 - DNA, 16 bp, Homo sapiens
agtctctgtgctttga

SEQ ID NO: 2527232 - DNA, 12 bp, Homo sapiens
agtctcttcaga

SEQ ID NO: 2527233 - DNA, 22 bp, Homo sapiens
agtctctttaatcttcagtttt

SEQ ID NO: 2527234 - DNA, 21 bp, Homo sapiens
agtctcttttctttagagcat

SEQ ID NO: 2527235 - DNA, 14 bp, Homo sapiens
agtctgaagcagat

SEQ ID NO: 2527236 - DNA, 12 bp, Homo sapiens
agtctgaaggct

SEQ ID NO: 2527237 - DNA, 16 bp, Homo sapiens
agtctgaatttttaaa

SEQ ID NO: 2527238 - DNA, 20 bp, Homo sapiens
agtctgatcgtgacgctgaa

SEQ ID NO: 2527239 - DNA, 21 bp, Homo sapiens
agtctgatcgtgacgctgaat

SEQ ID NO: 2527240 - DNA, 23 bp, Homo sapiens
agtctgatcgtgacgctgaataa

SEQ ID NO: 2527241 - DNA, 16 bp, Homo sapiens
agtctgattcccaagc

SEQ ID NO: 2527242 - DNA, 21 bp, Homo sapiens
agtctgattcccaagctctgc

SEQ ID NO: 2527243 - DNA, 22 bp, Homo sapiens
agtctgattcccaagctctgct

SEQ ID NO: 2527244 - DNA, 15 bp, Homo sapiens
agtctgcaagattct

SEQ ID NO: 2527245 - DNA, 13 bp, Homo sapiens
agtctgctgccct

SEQ ID NO: 2527246 - DNA, 15 bp, Homo sapiens
agtctgctgccctcc

SEQ ID NO: 2527247 - DNA, 17 bp, Homo sapiens
agtctgctgccctccat

SEQ ID NO: 2527248 - DNA, 15 bp, Homo sapiens
agtctggccaacatc

SEQ ID NO: 2527249 - DNA, 17 bp, Homo sapiens
agtctggtgggaggacg

SEQ ID NO: 2527250 - DNA, 15 bp, Homo sapiens
agtctggtttctaga

SEQ ID NO: 2527251 - DNA, 23 bp, Homo sapiens
agtctgtcatgaacatgttcctg

SEQ ID NO: 2527252 - DNA, 12 bp, Homo sapiens
agtctgttttat

SEQ ID NO: 2527253 - DNA, 14 bp, Homo sapiens
agtcttagatgtat

SEQ ID NO: 2527254 - DNA, 15 bp, Homo sapiens
agtcttccatttgca

SEQ ID NO: 2527255 - DNA, 15 bp, Homo sapiens
agtcttcctgacact

SEQ ID NO: 2527256 - DNA, 18 bp, Homo sapiens
agtcttcctgacacttta

SEQ ID NO: 2527257 - DNA, 20 bp, Homo sapiens
agtcttctcatagcattaac

SEQ ID NO: 2527258 - DNA, 16 bp, Homo sapiens
agtcttgcagcaggat

SEQ ID NO: 2527259 - DNA, 17 bp, Homo sapiens
agtcttggggcaggatg

SEQ ID NO: 2527260 - DNA, 16 bp, Homo sapiens
agtcttgtattaagtt

SEQ ID NO: 2527261 - DNA, 11 bp, Homo sapiens
agtgaaaaagg

SEQ ID NO: 2527262 - DNA, 20 bp, Homo sapiens
agtgaaaacaagtgctggca

SEQ ID NO: 2527263 - DNA, 15 bp, Homo sapiens
agtgaaaattgtctt

SEQ ID NO: 2527264 - DNA, 19 bp, Homo sapiens
agtgaaacctttagggcag

SEQ ID NO: 2527265 - DNA, 21 bp, Homo sapiens
agtgaaacctttagggcagct

SEQ ID NO: 2527266 - DNA, 17 bp, Homo sapiens
agtgaaagacaagctgc

SEQ ID NO: 2527267 - DNA, 14 bp, Homo sapiens
agtgaaagcatcac

SEQ ID NO: 2527268 - DNA, 20 bp, Homo sapiens
agtgaacaaatttacagaga

SEQ ID NO: 2527269 - DNA, 22 bp, Homo sapiens
agtgaacaaatttacagagaca

SEQ ID NO: 2527270 - DNA, 13 bp, Homo sapiens
agtgaaccatcat

SEQ ID NO: 2527271 - DNA, 21 bp, Homo sapiens
agtgaaccatcattataaacg

SEQ ID NO: 2527272 - DNA, 20 bp, Homo sapiens
agtgaacttgggccactgtg

SEQ ID NO: 2527273 - DNA, 23 bp, Homo sapiens
agtgaagaaaagtgaatgctcaa

SEQ ID NO: 2527274 - DNA, 14 bp, Homo sapiens
agtgaagacaatga

SEQ ID NO: 2527275 - DNA, 16 bp, Homo sapiens
agtgaagacaatgact

SEQ ID NO: 2527276 - DNA, 16 bp, Homo sapiens
agtgaagaggggcagc

SEQ ID NO: 2527277 - DNA, 20 bp, Homo sapiens
agtgaagaggggcagccctt

SEQ ID NO: 2527278 - DNA, 19 bp, Homo sapiens
agtgaatgattcagtgtta

SEQ ID NO: 2527279 - DNA, 19 bp, Homo sapiens
agtgaatttgaatgaaaaa

SEQ ID NO: 2527280 - DNA, 15 bp, Homo sapiens
agtgaatttttctct

SEQ ID NO: 2527281 - DNA, 23 bp, Homo sapiens
agtgaatttttctctaactcaga

SEQ ID NO: 2527282 - DNA, 20 bp, Homo sapiens
agtgacaaggccccagagac

SEQ ID NO: 2527283 - DNA, 16 bp, Homo sapiens
agtgacagaggcagcc

SEQ ID NO: 2527284 - DNA, 15 bp, Homo sapiens
agtgacagagttcac

SEQ ID NO: 2527285 - DNA, 23 bp, Homo sapiens
agtgacagggaagctacaggtta

SEQ ID NO: 2527286 - DNA, 22 bp, Homo sapiens
agtgacatctctttgatgtcat

SEQ ID NO: 2527287 - DNA, 15 bp, Homo sapiens
agtgacccggaggcc

SEQ ID NO: 2527288 - DNA, 17 bp, Homo sapiens
agtgacccggaggccac

SEQ ID NO: 2527289 - DNA, 14 bp, Homo sapiens
agtgacctgaggaa

SEQ ID NO: 2527290 - DNA, 15 bp, Homo sapiens
agtgacctgaggaag

SEQ ID NO: 2527291 - DNA, 16 bp, Homo sapiens
agtgacctgaggaagc

SEQ ID NO: 2527292 - DNA, 13 bp, Homo sapiens
ataaattcagata

SEQ ID NO: 2527293 - DNA, 15 bp, Homo sapiens
ataaattccactgga

SEQ ID NO: 2527294 - DNA, 16 bp, Homo sapiens
ataaattctataggaa

SEQ ID NO: 2527295 - DNA, 16 bp, Homo sapiens
ataaattgctccttga

SEQ ID NO: 2527296 - DNA, 18 bp, Homo sapiens
ataaattgctccttgaca

SEQ ID NO: 2527297 - DNA, 19 bp, Homo sapiens
ataaattgtaattgtaaag

SEQ ID NO: 2527298 - DNA, 22 bp, Homo sapiens
ataaattttttttgtttcatat

SEQ ID NO: 2527299 - DNA, 14 bp, Homo sapiens
ataacaacttcata

SEQ ID NO: 2527300 - DNA, 17 bp, Homo sapiens
ataacaaggtccaagat

SEQ ID NO: 2527301 - DNA, 15 bp, Homo sapiens
ataacaattgtttgg

SEQ ID NO: 2527302 - DNA, 14 bp, Homo sapiens
ataacacaatatga

SEQ ID NO: 2527303 - DNA, 14 bp, Homo sapiens
ataacacacagcta

SEQ ID NO: 2527304 - DNA, 23 bp, Homo sapiens
ataacactataaaggttgacaat

SEQ ID NO: 2527305 - DNA, 12 bp, Homo sapiens
ataacatgtaat

SEQ ID NO: 2527306 - DNA, 18 bp, Homo sapiens
ataacatgtaattaagta

SEQ ID NO: 2527307 - DNA, 20 bp, Homo sapiens
ataacatgtaattaagtact

SEQ ID NO: 2527308 - DNA, 20 bp, Homo sapiens
ataacattaccttactgtgg

SEQ ID NO: 2527309 - DNA, 22 bp, Homo sapiens
ataaccacttaaaaaatgtcca

SEQ ID NO: 2527310 - DNA, 19 bp, Homo sapiens
ataaccagctgtaacacag

SEQ ID NO: 2527311 - DNA, 18 bp, Homo sapiens
ataacctatatgatttat

SEQ ID NO: 2527312 - DNA, 13 bp, Homo sapiens
ataacgtttttcc

SEQ ID NO: 2527313 - DNA, 15 bp, Homo sapiens
ataacgtttttcctt

SEQ ID NO: 2527314 - DNA, 17 bp, Homo sapiens
ataacgtttttccttta

SEQ ID NO: 2527315 - DNA, 18 bp, Homo sapiens
ataacgtttttcctttaa

SEQ ID NO: 2527316 - DNA, 14 bp, Homo sapiens
ataactaaataaag

SEQ ID NO: 2527317 - DNA, 16 bp, Homo sapiens
ataactagtgttgctt

SEQ ID NO: 2527318 - DNA, 19 bp, Homo sapiens
ataactagtgttgcttgga

SEQ ID NO: 2527319 - DNA, 11 bp, Homo sapiens
ataactctgca

SEQ ID NO: 2527320 - DNA, 19 bp, Homo sapiens
ataactctgcactactcct

SEQ ID NO: 2527321 - DNA, 19 bp, Homo sapiens
ataacttaaaaaaatgaca

SEQ ID NO: 2527322 - DNA, 21 bp, Homo sapiens
ataacttatattgtaagaaat

SEQ ID NO: 2527323 - DNA, 23 bp, Homo sapiens
ataacttatattgtaagaaatac

SEQ ID NO: 2527324 - DNA, 14 bp, Homo sapiens
ataactttgcttgc

SEQ ID NO: 2527325 - DNA, 12 bp, Homo sapiens
ataagaaaagat

SEQ ID NO: 2527326 - DNA, 18 bp, Homo sapiens
ataagaaaagatgtagat

SEQ ID NO: 2527327 - DNA, 15 bp, Homo sapiens
ataagaaagtttcac

SEQ ID NO: 2527328 - DNA, 19 bp, Homo sapiens
ataagaatgctggttttcc

SEQ ID NO: 2527329 - DNA, 18 bp, Homo sapiens
ataagaatggttgcctta

SEQ ID NO: 2527330 - DNA, 17 bp, Homo sapiens
ataagacggatttattt

SEQ ID NO: 2527331 - DNA, 16 bp, Homo sapiens
ataagagtagaaactg

SEQ ID NO: 2527332 - DNA, 17 bp, Homo sapiens
ataagataaatgtgctg

SEQ ID NO: 2527333 - DNA, 15 bp, Homo sapiens
ataagatatttttca

SEQ ID NO: 2527334 - DNA, 17 bp, Homo sapiens
ataagattagaatgaaa

SEQ ID NO: 2527335 - DNA, 20 bp, Homo sapiens
ataagattagaatgaaaatt

SEQ ID NO: 2527336 - DNA, 14 bp, Homo sapiens
ataagattcatatt

SEQ ID NO: 2527337 - DNA, 17 bp, Homo sapiens
ataagcaagagagatgt

SEQ ID NO: 2527338 - DNA, 18 bp, Homo sapiens
ataagcactgtgctaata

SEQ ID NO: 2527339 - DNA, 17 bp, Homo sapiens
ataagcatcaaactctt

SEQ ID NO: 2527340 - DNA, 18 bp, Homo sapiens
ataagcggcgtaagttta

SEQ ID NO: 2527341 - DNA, 16 bp, Homo sapiens
ataagctaaagaggct

SEQ ID NO: 2527342 - DNA, 17 bp, Homo sapiens
ataagctaaagaggctg

SEQ ID NO: 2527343 - DNA, 18 bp, Homo sapiens
ataaggaaagcaataaat

SEQ ID NO: 2527344 - DNA, 20 bp, Homo sapiens
ataaggatcagaacagcaga

SEQ ID NO: 2527345 - DNA, 21 bp, Homo sapiens
ataaggtacctttcacataga

SEQ ID NO: 2527346 - DNA, 17 bp, Homo sapiens
ataaggtttaaaaagat

SEQ ID NO: 2527347 - DNA, 13 bp, Homo sapiens
ataagtactgtgt

SEQ ID NO: 2527348 - DNA, 18 bp, Homo sapiens
ataagtactgtgtacaga

SEQ ID NO: 2527349 - DNA, 14 bp, Homo sapiens
ataagtctaaataa

SEQ ID NO: 2527350 - DNA, 16 bp, Homo sapiens
ataagttattgcagtt

SEQ ID NO: 2527351 - DNA, 18 bp, Homo sapiens
ataagttcaaattcttct

SEQ ID NO: 2527352 - DNA, 20 bp, Homo sapiens
ataagttcaaattcttctga

SEQ ID NO: 2527353 - DNA, 21 bp, Homo sapiens
ataagttcaaattcttctgaa

SEQ ID NO: 2527354 - DNA, 21 bp, Homo sapiens
ataagtttctgggacctcagt

SEQ ID NO: 2527355 - DNA, 13 bp, Homo sapiens
ataagtttgaagg

SEQ ID NO: 2527356 - DNA, 19 bp, Homo sapiens
ataagtttgaaggaaacag

SEQ ID NO: 2527357 - DNA, 21 bp, Homo sapiens
ataagtttgaaggaaacagtt

SEQ ID NO: 2527358 - DNA, 14 bp, Homo sapiens
ataataaaaggaaa

SEQ ID NO: 2527359 - DNA, 19 bp, Homo sapiens
ataataaacttttttgaaa

SEQ ID NO: 2527360 - DNA, 16 bp, Homo sapiens
ataataaagctactga

SEQ ID NO: 2527361 - DNA, 15 bp, Homo sapiens
ataataaatgtacat

SEQ ID NO: 2527362 - DNA, 20 bp, Homo sapiens
ataatacaccactacattct

SEQ ID NO: 2527363 - DNA, 21 bp, Homo sapiens
ataatacaccactacattctg

SEQ ID NO: 2527364 - DNA, 12 bp, Homo sapiens
ataatagaagaa

SEQ ID NO: 2527365 - DNA, 14 bp, Homo sapiens
ataatagtttacat

SEQ ID NO: 2527366 - DNA, 19 bp, Homo sapiens
ataatatattttaaatatt

SEQ ID NO: 2527367 - DNA, 15 bp, Homo sapiens
ataatatgagaatca

SEQ ID NO: 2527368 - DNA, 18 bp, Homo sapiens
ataatatttttaatatat

SEQ ID NO: 2527369 - DNA, 18 bp, Homo sapiens
ataatcacaacccttcag

SEQ ID NO: 2527370 - DNA, 18 bp, Homo sapiens
ataatcacgctttcctga

SEQ ID NO: 2527371 - DNA, 19 bp, Homo sapiens
ataatcacttttttccaca

SEQ ID NO: 2527372 - DNA, 16 bp, Homo sapiens
ataatcagcctcttaa

SEQ ID NO: 2527373 - DNA, 15 bp, Homo sapiens
ataatcccagcactt

SEQ ID NO: 2527374 - DNA, 16 bp, Homo sapiens
ataatcccagcacttt

SEQ ID NO: 2527375 - DNA, 17 bp, Homo sapiens
ataatctatttctatga

SEQ ID NO: 2527376 - DNA, 13 bp, Homo sapiens
ataatctgatttg

SEQ ID NO: 2527377 - DNA, 18 bp, Homo sapiens
ataatctggactcctctg

SEQ ID NO: 2527378 - DNA, 19 bp, Homo sapiens
ataatctggactcctctgt

SEQ ID NO: 2527379 - DNA, 22 bp, Homo sapiens
ataatctggactcctctgtcca

SEQ ID NO: 2527380 - DNA, 14 bp, Homo sapiens
ataatcttctgcct

SEQ ID NO: 2527381 - DNA, 17 bp, Homo sapiens
ataatcttctgccttct

SEQ ID NO: 2527382 - DNA, 15 bp, Homo sapiens
ataatgaatgaaaca

SEQ ID NO: 2527383 - DNA, 18 bp, Homo sapiens
ataatgccggtgagaata

SEQ ID NO: 2527384 - DNA, 15 bp, Homo sapiens
ataatgcgtgcatac

SEQ ID NO: 2527385 - DNA, 20 bp, Homo sapiens
ataatgcgtgcataccactt

SEQ ID NO: 2527386 - DNA, 15 bp, Homo sapiens
ataatgctactgtct

SEQ ID NO: 2527387 - DNA, 18 bp, Homo sapiens
ataatggtaccagataaa

SEQ ID NO: 2527388 - DNA, 17 bp, Homo sapiens
ataatggtcccatccag

SEQ ID NO: 2527389 - DNA, 20 bp, Homo sapiens
ataatggtcccatccaggca

SEQ ID NO: 2527390 - DNA, 18 bp, Homo sapiens
ataatggttgactgggtt

SEQ ID NO: 2527391 - DNA, 14 bp, Homo sapiens
ataatggtttcaaa

SEQ ID NO: 2527392 - DNA, 16 bp, Homo sapiens
ataatgtgaaaatggt

SEQ ID NO: 2527393 - DNA, 22 bp, Homo sapiens
ataatgtttaatattgagaaag

SEQ ID NO: 2527394 - DNA, 19 bp, Homo sapiens
ataattatcggaagcagtg

SEQ ID NO: 2527395 - DNA, 18 bp, Homo sapiens
ataattatgacagttata

SEQ ID NO: 2527396 - DNA, 13 bp, Homo sapiens
ataattctgtaaa

SEQ ID NO: 2527397 - DNA, 14 bp, Homo sapiens
ataattctgtacat

SEQ ID NO: 2527398 - DNA, 19 bp, Homo sapiens
ataattcttgtatattatg

SEQ ID NO: 2527399 - DNA, 19 bp, Homo sapiens
ataattgagttttcagtgg

SEQ ID NO: 2527400 - DNA, 19 bp, Homo sapiens
ataattttatgaatgtctt

SEQ ID NO: 2527401 - DNA, 22 bp, Homo sapiens
ataattttcttcatgcaatgac

SEQ ID NO: 2527402 - DNA, 19 bp, Homo sapiens
ataatttttaaagtatata

SEQ ID NO: 2527403 - DNA, 21 bp, Homo sapiens
ataatttttaaagtatatatt

SEQ ID NO: 2527404 - DNA, 15 bp, Homo sapiens
ataattttttattca

SEQ ID NO: 2527405 - DNA, 23 bp, Homo sapiens
ataatttttttattactgatttt

SEQ ID NO: 2527406 - DNA, 20 bp, Homo sapiens
ataatttttttcaatattta

SEQ ID NO: 2527407 - DNA, 13 bp, Homo sapiens
atacaaaagcatg

SEQ ID NO: 2527408 - DNA, 22 bp, Homo sapiens
atacaaacaatggaaactgaat

SEQ ID NO: 2527409 - DNA, 21 bp, Homo sapiens
atacaacagtgctaaaaatgg

SEQ ID NO: 2527410 - DNA, 18 bp, Homo sapiens
atacaacctgcttgggtg

SEQ ID NO: 2527411 - DNA, 16 bp, Homo sapiens
atacaacttaaataat

SEQ ID NO: 2527412 - DNA, 14 bp, Homo sapiens
atacaataacataa

SEQ ID NO: 2527413 - DNA, 14 bp, Homo sapiens
atacaatgctgtgc

SEQ ID NO: 2527414 - DNA, 11 bp, Homo sapiens
atacacaaatt

SEQ ID NO: 2527415 - DNA, 14 bp, Homo sapiens
atacacacacacac

SEQ ID NO: 2527416 - DNA, 15 bp, Homo sapiens
atacacacacacaca

SEQ ID NO: 2527417 - DNA, 20 bp, Homo sapiens
atacacacacacacacagcc

SEQ ID NO: 2527418 - DNA, 14 bp, Homo sapiens
atacacacatatgt

SEQ ID NO: 2527419 - DNA, 18 bp, Homo sapiens
atacacactcaaatcaag

SEQ ID NO: 2527420 - DNA, 15 bp, Homo sapiens
atacaccactacatt

SEQ ID NO: 2527421 - DNA, 20 bp, Homo sapiens
atacaccactacattctgtt

SEQ ID NO: 2527422 - DNA, 19 bp, Homo sapiens
atacactaattcctttcta

SEQ ID NO: 2527423 - DNA, 21 bp, Homo sapiens
atacactatgaagatgtttca

SEQ ID NO: 2527424 - DNA, 22 bp, Homo sapiens
atacacttacactttatgcaca

SEQ ID NO: 2527425 - DNA, 14 bp, Homo sapiens
atacagaactcttt

SEQ ID NO: 2527426 - DNA, 15 bp, Homo sapiens
atacagaactctttc

SEQ ID NO: 2527427 - DNA, 20 bp, Homo sapiens
atacagaactctttcaaaac

SEQ ID NO: 2527428 - DNA, 12 bp, Homo sapiens
atacagacacta

SEQ ID NO: 2527429 - DNA, 23 bp, Homo sapiens
atacagatagatatatgctctgc

SEQ ID NO: 2527430 - DNA, 18 bp, Homo sapiens
atacagccaaagataatc

SEQ ID NO: 2527431 - DNA, 11 bp, Homo sapiens
atacagctcta

SEQ ID NO: 2527432 - DNA, 19 bp, Homo sapiens
atacaggaaaagctgctga

SEQ ID NO: 2527433 - DNA, 17 bp, Homo sapiens
atacaggaatgaagcct

SEQ ID NO: 2527434 - DNA, 16 bp, Homo sapiens
atacagtacaggcagc

SEQ ID NO: 2527435 - DNA, 14 bp, Homo sapiens
atacagtgttattt

SEQ ID NO: 2527436 - DNA, 15 bp, Homo sapiens
atacagtgttatttt

SEQ ID NO: 2527437 - DNA, 15 bp, Homo sapiens
atcagcacgatttct

SEQ ID NO: 2527438 - DNA, 16 bp, Homo sapiens
atcagcacgatttctg

SEQ ID NO: 2527439 - DNA, 15 bp, Homo sapiens
atcagccacattcta

SEQ ID NO: 2527440 - DNA, 17 bp, Homo sapiens
atcagcctgctccagct

SEQ ID NO: 2527441 - DNA, 18 bp, Homo sapiens
atcagcctgctccagctg

SEQ ID NO: 2527442 - DNA, 14 bp, Homo sapiens
atcagctatttact

SEQ ID NO: 2527443 - DNA, 17 bp, Homo sapiens
atcagctccttcctgga

SEQ ID NO: 2527444 - DNA, 21 bp, Homo sapiens
atcagctgctgaaacaacaaa

SEQ ID NO: 2527445 - DNA, 20 bp, Homo sapiens
atcaggaaatatatatgtgt

SEQ ID NO: 2527446 - DNA, 21 bp, Homo sapiens
atcaggaaatatatatgtgtg

SEQ ID NO: 2527447 - DNA, 16 bp, Homo sapiens
atcaggacccagagga

SEQ ID NO: 2527448 - DNA, 13 bp, Homo sapiens
atcaggagaaaaa

SEQ ID NO: 2527449 - DNA, 14 bp, Homo sapiens
atcaggccaggccc

SEQ ID NO: 2527450 - DNA, 16 bp, Homo sapiens
atcaggccaggccctc

SEQ ID NO: 2527451 - DNA, 21 bp, Homo sapiens
atcagggcaatcccaacacat

SEQ ID NO: 2527452 - DNA, 13 bp, Homo sapiens
atcagtctctgag

SEQ ID NO: 2527453 - DNA, 19 bp, Homo sapiens
atcagtctgattcccaagc

SEQ ID NO: 2527454 - DNA, 15 bp, Homo sapiens
atcagtgctccctca

SEQ ID NO: 2527455 - DNA, 13 bp, Homo sapiens
atcagtggagcca

SEQ ID NO: 2527456 - DNA, 18 bp, Homo sapiens
atcagttactctgaaggg

SEQ ID NO: 2527457 - DNA, 15 bp, Homo sapiens
atcagttagagctga

SEQ ID NO: 2527458 - DNA, 21 bp, Homo sapiens
atcagttgcaataatacttct

SEQ ID NO: 2527459 - DNA, 22 bp, Homo sapiens
atcagtttgctagcagaaatct

SEQ ID NO: 2527460 - DNA, 13 bp, Homo sapiens
atcataaaataaa

SEQ ID NO: 2527461 - DNA, 15 bp, Homo sapiens
atcatagaaatgtaa

SEQ ID NO: 2527462 - DNA, 16 bp, Homo sapiens
atcataggtatttcaa

SEQ ID NO: 2527463 - DNA, 16 bp, Homo sapiens
atcatataataaatgt

SEQ ID NO: 2527464 - DNA, 17 bp, Homo sapiens
atcatcagtattgaagc

SEQ ID NO: 2527465 - DNA, 16 bp, Homo sapiens
atcatccacattgttt

SEQ ID NO: 2527466 - DNA, 14 bp, Homo sapiens
atcatcccagctgc

SEQ ID NO: 2527467 - DNA, 15 bp, Homo sapiens
atcatcctaagctat

SEQ ID NO: 2527468 - DNA, 13 bp, Homo sapiens
atcatctgtgtga

SEQ ID NO: 2527469 - DNA, 18 bp, Homo sapiens
atcatgaagatatttttc

SEQ ID NO: 2527470 - DNA, 18 bp, Homo sapiens
atcatgaatgtgtaacac

SEQ ID NO: 2527471 - DNA, 20 bp, Homo sapiens
atcatgacaaagactgagta

SEQ ID NO: 2527472 - DNA, 18 bp, Homo sapiens
atcatgacatgttatata

SEQ ID NO: 2527473 - DNA, 13 bp, Homo sapiens
atcatgcattgtt

SEQ ID NO: 2527474 - DNA, 21 bp, Homo sapiens
atcatgcattgttgaggtggt

SEQ ID NO: 2527475 - DNA, 22 bp, Homo sapiens
atcatgcattgttgaggtggtc

SEQ ID NO: 2527476 - DNA, 12 bp, Homo sapiens
atcatggagtga

SEQ ID NO: 2527477 - DNA, 21 bp, Homo sapiens
atcatggattcattacagctt

SEQ ID NO: 2527478 - DNA, 18 bp, Homo sapiens
atcatggtgtaataagac

SEQ ID NO: 2527479 - DNA, 19 bp, Homo sapiens
atcatggtgtaataagaca

SEQ ID NO: 2527480 - DNA, 21 bp, Homo sapiens
atcatggtgtaataagacata

SEQ ID NO: 2527481 - DNA, 23 bp, Homo sapiens
atcatggtgtaataagacataac

SEQ ID NO: 2527482 - DNA, 14 bp, Homo sapiens
atcatgtacatttc

SEQ ID NO: 2527483 - DNA, 15 bp, Homo sapiens
atcatgtacatttct

SEQ ID NO: 2527484 - DNA, 19 bp, Homo sapiens
atcatgtcaggcctgtgtg

SEQ ID NO: 2527485 - DNA, 21 bp, Homo sapiens
atcatgtgaacccgggacgca

SEQ ID NO: 2527486 - DNA, 18 bp, Homo sapiens
atcatgtttacagaggac

SEQ ID NO: 2527487 - DNA, 23 bp, Homo sapiens
atcatgtttacagaggacagtat

SEQ ID NO: 2527488 - DNA, 16 bp, Homo sapiens
atcattataaacgtga

SEQ ID NO: 2527489 - DNA, 21 bp, Homo sapiens
atcattctctgtctcatccat

SEQ ID NO: 2527490 - DNA, 22 bp, Homo sapiens
atcattgcactctagcctgggc

SEQ ID NO: 2527491 - DNA, 18 bp, Homo sapiens
atcattgtatatatgtgt

SEQ ID NO: 2527492 - DNA, 15 bp, Homo sapiens
atcatttctatttct

SEQ ID NO: 2527493 - DNA, 15 bp, Homo sapiens
atcatttgcccttaa

SEQ ID NO: 2527494 - DNA, 17 bp, Homo sapiens
atcattttccccccact

SEQ ID NO: 2527495 - DNA, 14 bp, Homo sapiens
atcatttttccttc

SEQ ID NO: 2527496 - DNA, 15 bp, Homo sapiens
atcatttttgtacag

SEQ ID NO: 2527497 - DNA, 16 bp, Homo sapiens
atcatttttgtacagt

SEQ ID NO: 2527498 - DNA, 20 bp, Homo sapiens
atcatttttgtacagtttgc

SEQ ID NO: 2527499 - DNA, 22 bp, Homo sapiens
atcatttttgtacagtttgctg

SEQ ID NO: 2527500 - DNA, 18 bp, Homo sapiens
atccaaccccccacctgc

SEQ ID NO: 2527501 - DNA, 14 bp, Homo sapiens
atccaactccagga

SEQ ID NO: 2527502 - DNA, 22 bp, Homo sapiens
atccaagacagaataatgaatg

SEQ ID NO: 2527503 - DNA, 18 bp, Homo sapiens
atccaagctggtcccact

SEQ ID NO: 2527504 - DNA, 14 bp, Homo sapiens
atccaatcctcact

SEQ ID NO: 2527505 - DNA, 19 bp, Homo sapiens
atccaatcctcactgggtg

SEQ ID NO: 2527506 - DNA, 22 bp, Homo sapiens
atccaatgctcaagaaacaact

SEQ ID NO: 2527507 - DNA, 16 bp, Homo sapiens
atccacacacagagga

SEQ ID NO: 2527508 - DNA, 23 bp, Homo sapiens
atccacacacagaggaagagcag

SEQ ID NO: 2527509 - DNA, 13 bp, Homo sapiens
atccacattgttt

SEQ ID NO: 2527510 - DNA, 17 bp, Homo sapiens
atccacattgttttaaa

SEQ ID NO: 2527511 - DNA, 19 bp, Homo sapiens
atccacattgttttaaaaa

SEQ ID NO: 2527512 - DNA, 17 bp, Homo sapiens
atccaccacctccctca

SEQ ID NO: 2527513 - DNA, 15 bp, Homo sapiens
atccacccacctcag

SEQ ID NO: 2527514 - DNA, 16 bp, Homo sapiens
atccacccacctcagc

SEQ ID NO: 2527515 - DNA, 15 bp, Homo sapiens
atccacctccttctc

SEQ ID NO: 2527516 - DNA, 18 bp, Homo sapiens
atccactctaccctccca

SEQ ID NO: 2527517 - DNA, 20 bp, Homo sapiens
atccactctaccctcccacc

SEQ ID NO: 2527518 - DNA, 21 bp, Homo sapiens
atccactctaccctcccaccc

SEQ ID NO: 2527519 - DNA, 19 bp, Homo sapiens
atccagacccggctgcgtg

SEQ ID NO: 2527520 - DNA, 20 bp, Homo sapiens
atccagatcattcctcagaa

SEQ ID NO: 2527521 - DNA, 13 bp, Homo sapiens
atccaggactctg

SEQ ID NO: 2527522 - DNA, 15 bp, Homo sapiens
atccaggactctgtc

SEQ ID NO: 2527523 - DNA, 24 bp, Homo sapiens
atccaggcagtcgggggctggcct

SEQ ID NO: 2527524 - DNA, 19 bp, Homo sapiens
atccagggctctgaccagt

SEQ ID NO: 2527525 - DNA, 21 bp, Homo sapiens
atccagtgatccttacaagtt

SEQ ID NO: 2527526 - DNA, 20 bp, Homo sapiens
atccatgacctagttttcca

SEQ ID NO: 2527527 - DNA, 21 bp, Homo sapiens
atccatgacctagttttccat

SEQ ID NO: 2527528 - DNA, 22 bp, Homo sapiens
atccatgacctagttttccatg

SEQ ID NO: 2527529 - DNA, 20 bp, Homo sapiens
atccatggggctgattgtat

SEQ ID NO: 2527530 - DNA, 18 bp, Homo sapiens
atccatgtactgtagttt

SEQ ID NO: 2527531 - DNA, 16 bp, Homo sapiens
atccatgtttgtaaaa

SEQ ID NO: 2527532 - DNA, 22 bp, Homo sapiens
atcccaaagccttgtgtctaca

SEQ ID NO: 2527533 - DNA, 14 bp, Homo sapiens
atcccacaccctgg

SEQ ID NO: 2527534 - DNA, 18 bp, Homo sapiens
atcccacccacatgtgac

SEQ ID NO: 2527535 - DNA, 22 bp, Homo sapiens
atcccactttctatagcagatt

SEQ ID NO: 2527536 - DNA, 19 bp, Homo sapiens
atcccagcactttgggagg

SEQ ID NO: 2527537 - DNA, 11 bp, Homo sapiens
atcccagcccc

SEQ ID NO: 2527538 - DNA, 15 bp, Homo sapiens
atcccagccttggca

SEQ ID NO: 2527539 - DNA, 13 bp, Homo sapiens
atcccagctcacg

SEQ ID NO: 2527540 - DNA, 19 bp, Homo sapiens
atcccaggggcccaaggcg

SEQ ID NO: 2527541 - DNA, 17 bp, Homo sapiens
atcccatgagcctcagc

SEQ ID NO: 2527542 - DNA, 19 bp, Homo sapiens
atcccatgagcctcagcat

SEQ ID NO: 2527543 - DNA, 17 bp, Homo sapiens
atccccacctgtcttca

SEQ ID NO: 2527544 - DNA, 23 bp, Homo sapiens
atccccaggggtcccagccaccc

SEQ ID NO: 2527545 - DNA, 17 bp, Homo sapiens
atccccatcctccagct

SEQ ID NO: 2527546 - DNA, 12 bp, Homo sapiens
atccccctgccc

SEQ ID NO: 2527547 - DNA, 13 bp, Homo sapiens
atccccctgccct

SEQ ID NO: 2527548 - DNA, 15 bp, Homo sapiens
atccccctgccctcg

SEQ ID NO: 2527549 - DNA, 13 bp, Homo sapiens
atcccctcccagt

SEQ ID NO: 2527550 - DNA, 19 bp, Homo sapiens
atcccctccctgtcaaagc

SEQ ID NO: 2527551 - DNA, 18 bp, Homo sapiens
atcccctggactgggagg

SEQ ID NO: 2527552 - DNA, 15 bp, Homo sapiens
atcccctgtagagtg

SEQ ID NO: 2527553 - DNA, 17 bp, Homo sapiens
atcccgagcacctccac

SEQ ID NO: 2527554 - DNA, 22 bp, Homo sapiens
atcccgcctcttcttcttcaga

SEQ ID NO: 2527555 - DNA, 16 bp, Homo sapiens
atcccgtgttctcctt

SEQ ID NO: 2527556 - DNA, 19 bp, Homo sapiens
atccctagtcttcaagcag

SEQ ID NO: 2527557 - DNA, 15 bp, Homo sapiens
atccctccccagttc

SEQ ID NO: 2527558 - DNA, 16 bp, Homo sapiens
atccctccccagttca

SEQ ID NO: 2527559 - DNA, 23 bp, Homo sapiens
atccctctacagagcttccctga

SEQ ID NO: 2527560 - DNA, 14 bp, Homo sapiens
atccctctcctccc

SEQ ID NO: 2527561 - DNA, 14 bp, Homo sapiens
atccctgccagctc

SEQ ID NO: 2527562 - DNA, 17 bp, Homo sapiens
atccctgggcattgctt

SEQ ID NO: 2527563 - DNA, 18 bp, Homo sapiens
atccctgggcattgcttt

SEQ ID NO: 2527564 - DNA, 14 bp, Homo sapiens
atccctgtttaata

SEQ ID NO: 2527565 - DNA, 15 bp, Homo sapiens
atccctgtttaatat

SEQ ID NO: 2527566 - DNA, 17 bp, Homo sapiens
atccctgtttaatattt

SEQ ID NO: 2527567 - DNA, 18 bp, Homo sapiens
atcccttgaccaggcctg

SEQ ID NO: 2527568 - DNA, 16 bp, Homo sapiens
atccgaacctcctctg

SEQ ID NO: 2527569 - DNA, 13 bp, Homo sapiens
atccgaggcaggg

SEQ ID NO: 2527570 - DNA, 15 bp, Homo sapiens
atccggcagcctgga

SEQ ID NO: 2527571 - DNA, 20 bp, Homo sapiens
atccggcccccagagcgccc

SEQ ID NO: 2527572 - DNA, 21 bp, Homo sapiens
atccgtctttggcctcctcca

SEQ ID NO: 2527573 - DNA, 19 bp, Homo sapiens
atcctaaaacaaaagctca

SEQ ID NO: 2527574 - DNA, 12 bp, Homo sapiens
atcctaatgaat

SEQ ID NO: 2527575 - DNA, 22 bp, Homo sapiens
atcctacacacctaagggacat

SEQ ID NO: 2527576 - DNA, 15 bp, Homo sapiens
atcctaccaatgcat

SEQ ID NO: 2527577 - DNA, 18 bp, Homo sapiens
atcctaccaatgcatgca

SEQ ID NO: 2527578 - DNA, 21 bp, Homo sapiens
atcctaccctcgggcccacct

SEQ ID NO: 2527579 - DNA, 22 bp, Homo sapiens
atcctaccctcgggcccacctg

SEQ ID NO: 2527580 - DNA, 21 bp, Homo sapiens
atcctagccttatcctctgat

SEQ ID NO: 2527581 - DNA, 17 bp, Homo sapiens
atgcacacattttttaa

SEQ ID NO: 2527582 - DNA, 20 bp, Homo sapiens
atgcacactagcctctccag

SEQ ID NO: 2527583 - DNA, 22 bp, Homo sapiens
atgcacactagcctctccagga

SEQ ID NO: 2527584 - DNA, 21 bp, Homo sapiens
atgcacatatggactctgcac

SEQ ID NO: 2527585 - DNA, 13 bp, Homo sapiens
atgcaccagccct

SEQ ID NO: 2527586 - DNA, 22 bp, Homo sapiens
atgcaccagcccttagcaggga

SEQ ID NO: 2527587 - DNA, 13 bp, Homo sapiens
atgcactatgagg

SEQ ID NO: 2527588 - DNA, 21 bp, Homo sapiens
atgcactgttccccctgtgca

SEQ ID NO: 2527589 - DNA, 22 bp, Homo sapiens
atgcactgttccccctgtgcag

SEQ ID NO: 2527590 - DNA, 19 bp, Homo sapiens
atgcacttataattttcct

SEQ ID NO: 2527591 - DNA, 22 bp, Homo sapiens
atgcactttctatcctctgtaa

SEQ ID NO: 2527592 - DNA, 20 bp, Homo sapiens
atgcagaatgtttttaaaat

SEQ ID NO: 2527593 - DNA, 21 bp, Homo sapiens
atgcagagagccattttgtga

SEQ ID NO: 2527594 - DNA, 22 bp, Homo sapiens
atgcagagagccattttgtgaa

SEQ ID NO: 2527595 - DNA, 16 bp, Homo sapiens
atgcagagtcagcaga

SEQ ID NO: 2527596 - DNA, 19 bp, Homo sapiens
atgcagagttgacatgaga

SEQ ID NO: 2527597 - DNA, 22 bp, Homo sapiens
atgcagcccatgcccacctgcc

SEQ ID NO: 2527598 - DNA, 16 bp, Homo sapiens
atgcagccgtgatcaa

SEQ ID NO: 2527599 - DNA, 21 bp, Homo sapiens
atgcagccgtgatcaagggaa

SEQ ID NO: 2527600 - DNA, 13 bp, Homo sapiens
atgcagcctcaca

SEQ ID NO: 2527601 - DNA, 14 bp, Homo sapiens
atgcagcctcacag

SEQ ID NO: 2527602 - DNA, 18 bp, Homo sapiens
atgcagcctcacagtcct

SEQ ID NO: 2527603 - DNA, 13 bp, Homo sapiens
atgcagcgtgaag

SEQ ID NO: 2527604 - DNA, 14 bp, Homo sapiens
atgcagctatctgg

SEQ ID NO: 2527605 - DNA, 19 bp, Homo sapiens
atgcagggcctcacacggt

SEQ ID NO: 2527606 - DNA, 15 bp, Homo sapiens
atgcagtattgagca

SEQ ID NO: 2527607 - DNA, 18 bp, Homo sapiens
atgcagtgcccctagctt

SEQ ID NO: 2527608 - DNA, 23 bp, Homo sapiens
atgcagtggtatgatcacggctc

SEQ ID NO: 2527609 - DNA, 22 bp, Homo sapiens
atgcagtttttcagagtggaat

SEQ ID NO: 2527610 - DNA, 14 bp, Homo sapiens
atgcataaatatgc

SEQ ID NO: 2527611 - DNA, 15 bp, Homo sapiens
atgcataaatatgca

SEQ ID NO: 2527612 - DNA, 11 bp, Homo sapiens
atgcatacaca

SEQ ID NO: 2527613 - DNA, 13 bp, Homo sapiens
atgcatacacaca

SEQ ID NO: 2527614 - DNA, 22 bp, Homo sapiens
atgcatacacacacacacacag

SEQ ID NO: 2527615 - DNA, 15 bp, Homo sapiens
atgcatacttcaaaa

SEQ ID NO: 2527616 - DNA, 22 bp, Homo sapiens
atgcatacttcaaaagtatttt

SEQ ID NO: 2527617 - DNA, 18 bp, Homo sapiens
atgcatatcctgagccat

SEQ ID NO: 2527618 - DNA, 13 bp, Homo sapiens
atgcatattgtat

SEQ ID NO: 2527619 - DNA, 14 bp, Homo sapiens
atgcatctccacct

SEQ ID NO: 2527620 - DNA, 19 bp, Homo sapiens
atgcatctccacctgctcc

SEQ ID NO: 2527621 - DNA, 18 bp, Homo sapiens
atgcatcttactgaaggt

SEQ ID NO: 2527622 - DNA, 16 bp, Homo sapiens
atgcatgaagtaatat

SEQ ID NO: 2527623 - DNA, 20 bp, Homo sapiens
atgcatgaagtaatatgcac

SEQ ID NO: 2527624 - DNA, 23 bp, Homo sapiens
atgcatgaagtaatatgcacaca

SEQ ID NO: 2527625 - DNA, 20 bp, Homo sapiens
atgcatgcagccactgtgct

SEQ ID NO: 2527626 - DNA, 14 bp, Homo sapiens
atgcatgtgaagaa

SEQ ID NO: 2527627 - DNA, 20 bp, Homo sapiens
atgcatgttttccagctcct

SEQ ID NO: 2527628 - DNA, 16 bp, Homo sapiens
atgcattaaaagaaaa

SEQ ID NO: 2527629 - DNA, 17 bp, Homo sapiens
atgcattaaaagaaaat

SEQ ID NO: 2527630 - DNA, 22 bp, Homo sapiens
atgcattgttgttctgctcaat

SEQ ID NO: 2527631 - DNA, 17 bp, Homo sapiens
atgcatttgaggtcaag

SEQ ID NO: 2527632 - DNA, 23 bp, Homo sapiens
atgcatttgaggtcaagtaagaa

SEQ ID NO: 2527633 - DNA, 14 bp, Homo sapiens
atgcatttgcattt

SEQ ID NO: 2527634 - DNA, 13 bp, Homo sapiens
atgcattttgcag

SEQ ID NO: 2527635 - DNA, 22 bp, Homo sapiens
atgccaaagctagggtggccct

SEQ ID NO: 2527636 - DNA, 20 bp, Homo sapiens
atgccaaattgtagttcttg

SEQ ID NO: 2527637 - DNA, 14 bp, Homo sapiens
atgccaacttgtcc

SEQ ID NO: 2527638 - DNA, 17 bp, Homo sapiens
atgccaagcactgtgct

SEQ ID NO: 2527639 - DNA, 18 bp, Homo sapiens
atgccaagcactgtgctc

SEQ ID NO: 2527640 - DNA, 19 bp, Homo sapiens
atgccaagcactgtgctca

SEQ ID NO: 2527641 - DNA, 16 bp, Homo sapiens
atgccaagttgtttga

SEQ ID NO: 2527642 - DNA, 16 bp, Homo sapiens
atgccacacatcaccc

SEQ ID NO: 2527643 - DNA, 20 bp, Homo sapiens
atgccaccctgttttcagct

SEQ ID NO: 2527644 - DNA, 16 bp, Homo sapiens
atgccagctacttcct

SEQ ID NO: 2527645 - DNA, 19 bp, Homo sapiens
atgccagctcagtcccatc

SEQ ID NO: 2527646 - DNA, 20 bp, Homo sapiens
atgccagtaggctcaactag

SEQ ID NO: 2527647 - DNA, 18 bp, Homo sapiens
atgccatggacagaagaa

SEQ ID NO: 2527648 - DNA, 17 bp, Homo sapiens
atgccatttaaagctta

SEQ ID NO: 2527649 - DNA, 12 bp, Homo sapiens
atgcccaaggga

SEQ ID NO: 2527650 - DNA, 15 bp, Homo sapiens
atgcccaagggaaag

SEQ ID NO: 2527651 - DNA, 15 bp, Homo sapiens
atgcccacctgccca

SEQ ID NO: 2527652 - DNA, 19 bp, Homo sapiens
atgcccacctgcccatcac

SEQ ID NO: 2527653 - DNA, 21 bp, Homo sapiens
atgcccagagggcccaggcag

SEQ ID NO: 2527654 - DNA, 23 bp, Homo sapiens
atgcccagagggcccaggcaggc

SEQ ID NO: 2527655 - DNA, 15 bp, Homo sapiens
atgcccagccccttc

SEQ ID NO: 2527656 - DNA, 17 bp, Homo sapiens
atgcccagggccactct

SEQ ID NO: 2527657 - DNA, 17 bp, Homo sapiens
atgcccagtttctgcct

SEQ ID NO: 2527658 - DNA, 15 bp, Homo sapiens
atgccccagagctgt

SEQ ID NO: 2527659 - DNA, 14 bp, Homo sapiens
atgccctcagggga

SEQ ID NO: 2527660 - DNA, 15 bp, Homo sapiens
atgcccttaaatcat

SEQ ID NO: 2527661 - DNA, 20 bp, Homo sapiens
atgcctccaccccccagaac

SEQ ID NO: 2527662 - DNA, 17 bp, Homo sapiens
atgcctctcctttgtat

SEQ ID NO: 2527663 - DNA, 20 bp, Homo sapiens
atgcctctcctttgtatatt

SEQ ID NO: 2527664 - DNA, 21 bp, Homo sapiens
atgcctctcctttgtatatta

SEQ ID NO: 2527665 - DNA, 17 bp, Homo sapiens
atgcctgagggtggaga

SEQ ID NO: 2527666 - DNA, 19 bp, Homo sapiens
atgcctgccccaaacaaat

SEQ ID NO: 2527667 - DNA, 19 bp, Homo sapiens
atgcctggatggggctgca

SEQ ID NO: 2527668 - DNA, 21 bp, Homo sapiens
atgcctggatggggctgcacc

SEQ ID NO: 2527669 - DNA, 16 bp, Homo sapiens
atgcctggtctttcct

SEQ ID NO: 2527670 - DNA, 15 bp, Homo sapiens
atgcctggtggcagc

SEQ ID NO: 2527671 - DNA, 17 bp, Homo sapiens
atgcctggtggcagctg

SEQ ID NO: 2527672 - DNA, 18 bp, Homo sapiens
atgcctggtggcagctgc

SEQ ID NO: 2527673 - DNA, 16 bp, Homo sapiens
atgccttactcttctt

SEQ ID NO: 2527674 - DNA, 12 bp, Homo sapiens
atgcctttgaga

SEQ ID NO: 2527675 - DNA, 13 bp, Homo sapiens
atgcctttgagac

SEQ ID NO: 2527676 - DNA, 15 bp, Homo sapiens
atgcctttgagacag

SEQ ID NO: 2527677 - DNA, 22 bp, Homo sapiens
atgcctttgagacagtttctta

SEQ ID NO: 2527678 - DNA, 15 bp, Homo sapiens
atgcggtctagggaa

SEQ ID NO: 2527679 - DNA, 21 bp, Homo sapiens
atgcgtacgtttcctgagaag

SEQ ID NO: 2527680 - DNA, 22 bp, Homo sapiens
atgctacgtgtgatttttctgg

SEQ ID NO: 2527681 - DNA, 15 bp, Homo sapiens
atgctaggtctcgga

SEQ ID NO: 2527682 - DNA, 14 bp, Homo sapiens
atgctcagaccagc

SEQ ID NO: 2527683 - DNA, 12 bp, Homo sapiens
atgctccagcca

SEQ ID NO: 2527684 - DNA, 18 bp, Homo sapiens
atgctccagccaacccct

SEQ ID NO: 2527685 - DNA, 21 bp, Homo sapiens
atgctccagccaacccctgtg

SEQ ID NO: 2527686 - DNA, 21 bp, Homo sapiens
atgctcccccatcctcccctt

SEQ ID NO: 2527687 - DNA, 15 bp, Homo sapiens
atgctccttgggccc

SEQ ID NO: 2527688 - DNA, 19 bp, Homo sapiens
atgctctatcttgctctgt

SEQ ID NO: 2527689 - DNA, 21 bp, Homo sapiens
atgctgatgttcagtgtaatt

SEQ ID NO: 2527690 - DNA, 14 bp, Homo sapiens
atgctgccaaattt

SEQ ID NO: 2527691 - DNA, 16 bp, Homo sapiens
atgctgccctgtgagt

SEQ ID NO: 2527692 - DNA, 13 bp, Homo sapiens
atgctgcctgcct

SEQ ID NO: 2527693 - DNA, 15 bp, Homo sapiens
atgctgcctgcctgt

SEQ ID NO: 2527694 - DNA, 21 bp, Homo sapiens
atgctgctacttaattccttt

SEQ ID NO: 2527695 - DNA, 18 bp, Homo sapiens
atgctgctttcccctgtg

SEQ ID NO: 2527696 - DNA, 20 bp, Homo sapiens
atgctgctttcccctgtggg

SEQ ID NO: 2527697 - DNA, 12 bp, Homo sapiens
atgctggagagg

SEQ ID NO: 2527698 - DNA, 15 bp, Homo sapiens
atgctggagaggtta

SEQ ID NO: 2527699 - DNA, 22 bp, Homo sapiens
atgctggctgttggctgggggc

SEQ ID NO: 2527700 - DNA, 23 bp, Homo sapiens
atgctgggaagacgcctgagctc

SEQ ID NO: 2527701 - DNA, 11 bp, Homo sapiens
atgctgggttg

SEQ ID NO: 2527702 - DNA, 19 bp, Homo sapiens
atgctgggttggtgcacag

SEQ ID NO: 2527703 - DNA, 17 bp, Homo sapiens
atgctgttgattgctaa

SEQ ID NO: 2527704 - DNA, 21 bp, Homo sapiens
atgctgttgattgctaaatgt

SEQ ID NO: 2527705 - DNA, 23 bp, Homo sapiens
atgctgttgattgctaaatgtaa

SEQ ID NO: 2527706 - DNA, 15 bp, Homo sapiens
atgcttacaaaaaag

SEQ ID NO: 2527707 - DNA, 13 bp, Homo sapiens
atgcttactgata

SEQ ID NO: 2527708 - DNA, 15 bp, Homo sapiens
atgcttagtccctca

SEQ ID NO: 2527709 - DNA, 14 bp, Homo sapiens
atgcttattttaaa

SEQ ID NO: 2527710 - DNA, 16 bp, Homo sapiens
atgcttcctagaagtt

SEQ ID NO: 2527711 - DNA, 14 bp, Homo sapiens
atgcttctgggaga

SEQ ID NO: 2527712 - DNA, 17 bp, Homo sapiens
atgcttcttcagagact

SEQ ID NO: 2527713 - DNA, 20 bp, Homo sapiens
atgcttcttcagagactcct

SEQ ID NO: 2527714 - DNA, 16 bp, Homo sapiens
atgcttgcctagggcc

SEQ ID NO: 2527715 - DNA, 21 bp, Homo sapiens
atgcttgcctagggcctggtc

SEQ ID NO: 2527716 - DNA, 15 bp, Homo sapiens
atgcttggcttctca

SEQ ID NO: 2527717 - DNA, 12 bp, Homo sapiens
atgcttgtacat

SEQ ID NO: 2527718 - DNA, 13 bp, Homo sapiens
atgctttaaacat

SEQ ID NO: 2527719 - DNA, 21 bp, Homo sapiens
atgctttcagattaaaattgt

SEQ ID NO: 2527720 - DNA, 22 bp, Homo sapiens
atgctttttgaatgttatttgt

SEQ ID NO: 2527721 - DNA, 15 bp, Homo sapiens
atggaaactgaatgc

SEQ ID NO: 2527722 - DNA, 17 bp, Homo sapiens
atggaaagaatctaata

SEQ ID NO: 2527723 - DNA, 15 bp, Homo sapiens
atggaacaggctcag

SEQ ID NO: 2527724 - DNA, 16 bp, Homo sapiens
atggaaccgcaggaag

SEQ ID NO: 2527725 - DNA, 23 bp, Homo sapiens
attaatagcttttattgtataaa

SEQ ID NO: 2527726 - DNA, 17 bp, Homo sapiens
attaatattcattgtat

SEQ ID NO: 2527727 - DNA, 19 bp, Homo sapiens
attaatattcattgtataa

SEQ ID NO: 2527728 - DNA, 19 bp, Homo sapiens
attaatcatctataaagaa

SEQ ID NO: 2527729 - DNA, 17 bp, Homo sapiens
attaatgaaaataagaa

SEQ ID NO: 2527730 - DNA, 16 bp, Homo sapiens
attaatgacacttgtc

SEQ ID NO: 2527731 - DNA, 14 bp, Homo sapiens
attaatgcactttc

SEQ ID NO: 2527732 - DNA, 12 bp, Homo sapiens
attaatgttaat

SEQ ID NO: 2527733 - DNA, 14 bp, Homo sapiens
attaattaaatgca

SEQ ID NO: 2527734 - DNA, 18 bp, Homo sapiens
attaattgttttgcactt

SEQ ID NO: 2527735 - DNA, 19 bp, Homo sapiens
attaattgttttgcacttt

SEQ ID NO: 2527736 - DNA, 20 bp, Homo sapiens
attaattgttttgcactttt

SEQ ID NO: 2527737 - DNA, 22 bp, Homo sapiens
attacaaaatgacattttgcca

SEQ ID NO: 2527738 - DNA, 14 bp, Homo sapiens
attacaaattgctt

SEQ ID NO: 2527739 - DNA, 12 bp, Homo sapiens
attacagagagg

SEQ ID NO: 2527740 - DNA, 22 bp, Homo sapiens
attacagagaggagaaacacat

SEQ ID NO: 2527741 - DNA, 17 bp, Homo sapiens
attacagaggaagttat

SEQ ID NO: 2527742 - DNA, 15 bp, Homo sapiens
attacagctggagaa

SEQ ID NO: 2527743 - DNA, 21 bp, Homo sapiens
attacataatctgtacaatga

SEQ ID NO: 2527744 - DNA, 21 bp, Homo sapiens
attacatatttgcatatgtat

SEQ ID NO: 2527745 - DNA, 15 bp, Homo sapiens
attacatctttcaca

SEQ ID NO: 2527746 - DNA, 18 bp, Homo sapiens
attacatctttcacattg

SEQ ID NO: 2527747 - DNA, 22 bp, Homo sapiens
attacatctttcacattggcta

SEQ ID NO: 2527748 - DNA, 16 bp, Homo sapiens
attacatgtaaaacat

SEQ ID NO: 2527749 - DNA, 19 bp, Homo sapiens
attacatgtaaaacattat

SEQ ID NO: 2527750 - DNA, 15 bp, Homo sapiens
attacatttccaaat

SEQ ID NO: 2527751 - DNA, 16 bp, Homo sapiens
attaccaacctgttac

SEQ ID NO: 2527752 - DNA, 17 bp, Homo sapiens
attaccagagttgttct

SEQ ID NO: 2527753 - DNA, 15 bp, Homo sapiens
attacccaagcaaaa

SEQ ID NO: 2527754 - DNA, 21 bp, Homo sapiens
attacctagtagtcatttcat

SEQ ID NO: 2527755 - DNA, 21 bp, Homo sapiens
attaccttagattagctctgg

SEQ ID NO: 2527756 - DNA, 13 bp, Homo sapiens
attacgtgagcca

SEQ ID NO: 2527757 - DNA, 20 bp, Homo sapiens
attacgtgagccaggtaatg

SEQ ID NO: 2527758 - DNA, 15 bp, Homo sapiens
attactggtccaaaa

SEQ ID NO: 2527759 - DNA, 16 bp, Homo sapiens
attacttatttttgac

SEQ ID NO: 2527760 - DNA, 17 bp, Homo sapiens
attacttatttttgaca

SEQ ID NO: 2527761 - DNA, 12 bp, Homo sapiens
attactttacca

SEQ ID NO: 2527762 - DNA, 16 bp, Homo sapiens
attagaaatagacagt

SEQ ID NO: 2527763 - DNA, 22 bp, Homo sapiens
attagaaatagacagtatattt

SEQ ID NO: 2527764 - DNA, 11 bp, Homo sapiens
attagaaatga

SEQ ID NO: 2527765 - DNA, 15 bp, Homo sapiens
attagaaattagctg

SEQ ID NO: 2527766 - DNA, 20 bp, Homo sapiens
attagaaattagctgtgtga

SEQ ID NO: 2527767 - DNA, 23 bp, Homo sapiens
attagaacaggcaagtgaagaaa

SEQ ID NO: 2527768 - DNA, 14 bp, Homo sapiens
attagaagtgttaa

SEQ ID NO: 2527769 - DNA, 13 bp, Homo sapiens
attagactcctcc

SEQ ID NO: 2527770 - DNA, 13 bp, Homo sapiens
attagagcaggcg

SEQ ID NO: 2527771 - DNA, 14 bp, Homo sapiens
attagagcattgaa

SEQ ID NO: 2527772 - DNA, 22 bp, Homo sapiens
attagagggaggtgtttaaaga

SEQ ID NO: 2527773 - DNA, 19 bp, Homo sapiens
attagcatttgtcaacaaa

SEQ ID NO: 2527774 - DNA, 15 bp, Homo sapiens
attagccaggatcat

SEQ ID NO: 2527775 - DNA, 21 bp, Homo sapiens
attagccaggatcatggtgta

SEQ ID NO: 2527776 - DNA, 18 bp, Homo sapiens
attagccgggcatggtgg

SEQ ID NO: 2527777 - DNA, 19 bp, Homo sapiens
attagctcacttggtgata

SEQ ID NO: 2527778 - DNA, 13 bp, Homo sapiens
attagctctggac

SEQ ID NO: 2527779 - DNA, 15 bp, Homo sapiens
attaggaaaatatgg

SEQ ID NO: 2527780 - DNA, 21 bp, Homo sapiens
attaggaagtgtaacagctga

SEQ ID NO: 2527781 - DNA, 22 bp, Homo sapiens
attaggaagtgtaacagctgag

SEQ ID NO: 2527782 - DNA, 16 bp, Homo sapiens
attaggaataaataaa

SEQ ID NO: 2527783 - DNA, 14 bp, Homo sapiens
attaggatttcatg

SEQ ID NO: 2527784 - DNA, 19 bp, Homo sapiens
attaggatttgccccttcc

SEQ ID NO: 2527785 - DNA, 16 bp, Homo sapiens
attagggagagaagat

SEQ ID NO: 2527786 - DNA, 22 bp, Homo sapiens
attaggggttgctaagaagcga

SEQ ID NO: 2527787 - DNA, 14 bp, Homo sapiens
attagtaaagaaat

SEQ ID NO: 2527788 - DNA, 16 bp, Homo sapiens
attagtaacatgtgtt

SEQ ID NO: 2527789 - DNA, 17 bp, Homo sapiens
attagtaacatgtgtta

SEQ ID NO: 2527790 - DNA, 19 bp, Homo sapiens
attagtactgctcttgttt

SEQ ID NO: 2527791 - DNA, 23 bp, Homo sapiens
attagtatttatttaatgttatg

SEQ ID NO: 2527792 - DNA, 14 bp, Homo sapiens
attagtccttgctt

SEQ ID NO: 2527793 - DNA, 18 bp, Homo sapiens
attagtttacatcatttt

SEQ ID NO: 2527794 - DNA, 22 bp, Homo sapiens
attataacttgtctaaataagt

SEQ ID NO: 2527795 - DNA, 22 bp, Homo sapiens
attataatatactatatttatg

SEQ ID NO: 2527796 - DNA, 13 bp, Homo sapiens
attataatgaatt

SEQ ID NO: 2527797 - DNA, 13 bp, Homo sapiens
attataattgtat

SEQ ID NO: 2527798 - DNA, 15 bp, Homo sapiens
attataattgtatca

SEQ ID NO: 2527799 - DNA, 23 bp, Homo sapiens
attataatttttttcaatattta

SEQ ID NO: 2527800 - DNA, 22 bp, Homo sapiens
attatacagaccgaactgttgt

SEQ ID NO: 2527801 - DNA, 12 bp, Homo sapiens
attatactgtat

SEQ ID NO: 2527802 - DNA, 17 bp, Homo sapiens
attataggatcatttgt

SEQ ID NO: 2527803 - DNA, 23 bp, Homo sapiens
attatagtgatgtaatcttgaat

SEQ ID NO: 2527804 - DNA, 13 bp, Homo sapiens
attatatatatat

SEQ ID NO: 2527805 - DNA, 19 bp, Homo sapiens
attatatcaatttcctcat

SEQ ID NO: 2527806 - DNA, 13 bp, Homo sapiens
attatcatgtgta

SEQ ID NO: 2527807 - DNA, 22 bp, Homo sapiens
attatcatgtgtaatcaataaa

SEQ ID NO: 2527808 - DNA, 16 bp, Homo sapiens
attatcggaagcagtg

SEQ ID NO: 2527809 - DNA, 17 bp, Homo sapiens
attatcggaagcagtgc

SEQ ID NO: 2527810 - DNA, 16 bp, Homo sapiens
attatcgggaacagtg

SEQ ID NO: 2527811 - DNA, 18 bp, Homo sapiens
attatcgggaacagtgtt

SEQ ID NO: 2527812 - DNA, 17 bp, Homo sapiens
attatcgggagcagtgt

SEQ ID NO: 2527813 - DNA, 20 bp, Homo sapiens
attatcgggagcagtgtctt

SEQ ID NO: 2527814 - DNA, 19 bp, Homo sapiens
attatctaaaatctgctag

SEQ ID NO: 2527815 - DNA, 18 bp, Homo sapiens
attatctagatactgtat

SEQ ID NO: 2527816 - DNA, 18 bp, Homo sapiens
attatctcaaaactgcac

SEQ ID NO: 2527817 - DNA, 18 bp, Homo sapiens
attatcttggaaagaaac

SEQ ID NO: 2527818 - DNA, 16 bp, Homo sapiens
attatgacagttatac

SEQ ID NO: 2527819 - DNA, 21 bp, Homo sapiens
attatgatgtgggtcaaggaa

SEQ ID NO: 2527820 - DNA, 22 bp, Homo sapiens
attatgcccagtttctgcctct

SEQ ID NO: 2527821 - DNA, 19 bp, Homo sapiens
attatgccttttttgatca

SEQ ID NO: 2527822 - DNA, 17 bp, Homo sapiens
attatggaagattttaa

SEQ ID NO: 2527823 - DNA, 20 bp, Homo sapiens
attatggaagattttaaatt

SEQ ID NO: 2527824 - DNA, 15 bp, Homo sapiens
attatgtatgtttac

SEQ ID NO: 2527825 - DNA, 16 bp, Homo sapiens
attatgtttatataaa

SEQ ID NO: 2527826 - DNA, 13 bp, Homo sapiens
attattactgttt

SEQ ID NO: 2527827 - DNA, 20 bp, Homo sapiens
attattacttatttttgaca

SEQ ID NO: 2527828 - DNA, 22 bp, Homo sapiens
attattagccaggtaatgtgaa

SEQ ID NO: 2527829 - DNA, 22 bp, Homo sapiens
attattagtttacatcattttt

SEQ ID NO: 2527830 - DNA, 22 bp, Homo sapiens
attattagttttgatttaatgt

SEQ ID NO: 2527831 - DNA, 17 bp, Homo sapiens
attattattaaaaatat

SEQ ID NO: 2527832 - DNA, 16 bp, Homo sapiens
attattattcttcata

SEQ ID NO: 2527833 - DNA, 13 bp, Homo sapiens
attattcagtgtc

SEQ ID NO: 2527834 - DNA, 13 bp, Homo sapiens
attattcatttaa

SEQ ID NO: 2527835 - DNA, 16 bp, Homo sapiens
attattcatttaaaat

SEQ ID NO: 2527836 - DNA, 21 bp, Homo sapiens
attattcatttaaaatgatta

SEQ ID NO: 2527837 - DNA, 21 bp, Homo sapiens
attattccctgtacaatattt

SEQ ID NO: 2527838 - DNA, 22 bp, Homo sapiens
attattccctgtacaatattta

SEQ ID NO: 2527839 - DNA, 13 bp, Homo sapiens
attattctgcagc

SEQ ID NO: 2527840 - DNA, 12 bp, Homo sapiens
attattcttgta

SEQ ID NO: 2527841 - DNA, 14 bp, Homo sapiens
attattggaattaa

SEQ ID NO: 2527842 - DNA, 21 bp, Homo sapiens
attatttaataaaaaaacaat

SEQ ID NO: 2527843 - DNA, 18 bp, Homo sapiens
attatttaataacattac

SEQ ID NO: 2527844 - DNA, 21 bp, Homo sapiens
attatttaataacattacctt

SEQ ID NO: 2527845 - DNA, 16 bp, Homo sapiens
attatttatatatgta

SEQ ID NO: 2527846 - DNA, 23 bp, Homo sapiens
attatttattaaatgcccagccc

SEQ ID NO: 2527847 - DNA, 23 bp, Homo sapiens
attatttattcagcttcatttgt

SEQ ID NO: 2527848 - DNA, 18 bp, Homo sapiens
attatttcactttagatg

SEQ ID NO: 2527849 - DNA, 21 bp, Homo sapiens
attatttcactttagatgctg

SEQ ID NO: 2527850 - DNA, 20 bp, Homo sapiens
attatttgtgtaatagaaaa

SEQ ID NO: 2527851 - DNA, 12 bp, Homo sapiens
attatttgtgtt

SEQ ID NO: 2527852 - DNA, 15 bp, Homo sapiens
attattttaaacaaa

SEQ ID NO: 2527853 - DNA, 21 bp, Homo sapiens
attattttaaacaaaatagaa

SEQ ID NO: 2527854 - DNA, 13 bp, Homo sapiens
attattttccaaa

SEQ ID NO: 2527855 - DNA, 15 bp, Homo sapiens
attattttttcagac

SEQ ID NO: 2527856 - DNA, 21 bp, Homo sapiens
attattttttcagaccgaaaa

SEQ ID NO: 2527857 - DNA, 15 bp, Homo sapiens
attcaaacagtctca

SEQ ID NO: 2527858 - DNA, 19 bp, Homo sapiens
attcaaacagtctcaggaa

SEQ ID NO: 2527859 - DNA, 20 bp, Homo sapiens
attcaaacagtctcaggaaa

SEQ ID NO: 2527860 - DNA, 22 bp, Homo sapiens
attcaaacagtctcaggaaatc

SEQ ID NO: 2527861 - DNA, 22 bp, Homo sapiens
attcaacactcccttcccatga

SEQ ID NO: 2527862 - DNA, 19 bp, Homo sapiens
attcaaccactgtaaaatg

SEQ ID NO: 2527863 - DNA, 15 bp, Homo sapiens
attcaaccctggaga

SEQ ID NO: 2527864 - DNA, 16 bp, Homo sapiens
attcaaccctggagag

SEQ ID NO: 2527865 - DNA, 13 bp, Homo sapiens
attcaactaaaaa

SEQ ID NO: 2527866 - DNA, 16 bp, Homo sapiens
attcaatctgtaaact

SEQ ID NO: 2527867 - DNA, 17 bp, Homo sapiens
attcaatctgtaaactg

SEQ ID NO: 2527868 - DNA, 23 bp, Homo sapiens
attcaatgtttatgcaaggaagg

SEQ ID NO: 2527869 - DNA, 14 bp, Homo sapiens
atttaaaacagaca

SEQ ID NO: 2527870 - DNA, 16 bp, Homo sapiens
atttaaaacagacact

SEQ ID NO: 2527871 - DNA, 18 bp, Homo sapiens
atttaaaacagacactgg

SEQ ID NO: 2527872 - DNA, 15 bp, Homo sapiens
atttaaaacatgtaa

SEQ ID NO: 2527873 - DNA, 16 bp, Homo sapiens
atttaaaagattcatt

SEQ ID NO: 2527874 - DNA, 18 bp, Homo sapiens
atttaaaagattcatttt

SEQ ID NO: 2527875 - DNA, 13 bp, Homo sapiens
atttaaaatgatt

SEQ ID NO: 2527876 - DNA, 16 bp, Homo sapiens
atttaaaatgattaga

SEQ ID NO: 2527877 - DNA, 15 bp, Homo sapiens
atttaaaattgtgat

SEQ ID NO: 2527878 - DNA, 15 bp, Homo sapiens
atttaaacagcagtg

SEQ ID NO: 2527879 - DNA, 16 bp, Homo sapiens
atttaaacagcagtgt

SEQ ID NO: 2527880 - DNA, 17 bp, Homo sapiens
atttaaacaggcccagc

SEQ ID NO: 2527881 - DNA, 19 bp, Homo sapiens
atttaaacaggcccagcat

SEQ ID NO: 2527882 - DNA, 20 bp, Homo sapiens
atttaaacccattttagtca

SEQ ID NO: 2527883 - DNA, 13 bp, Homo sapiens
atttaaatataat

SEQ ID NO: 2527884 - DNA, 15 bp, Homo sapiens
atttaaatataattc

SEQ ID NO: 2527885 - DNA, 18 bp, Homo sapiens
atttaaatataattctgt

SEQ ID NO: 2527886 - DNA, 20 bp, Homo sapiens
atttaaatataattctgtaa

SEQ ID NO: 2527887 - DNA, 23 bp, Homo sapiens
atttaaatataattctgtaaatg

SEQ ID NO: 2527888 - DNA, 13 bp, Homo sapiens
atttaacaagatc

SEQ ID NO: 2527889 - DNA, 14 bp, Homo sapiens
atttaacagaaatg

SEQ ID NO: 2527890 - DNA, 15 bp, Homo sapiens
atttaacagaaatgt

SEQ ID NO: 2527891 - DNA, 17 bp, Homo sapiens
atttaacagaaatgtac

SEQ ID NO: 2527892 - DNA, 22 bp, Homo sapiens
atttaacagggtctctagtgct

SEQ ID NO: 2527893 - DNA, 16 bp, Homo sapiens
atttaagagacagtca

SEQ ID NO: 2527894 - DNA, 12 bp, Homo sapiens
atttaagcattg

SEQ ID NO: 2527895 - DNA, 22 bp, Homo sapiens
atttaagtgcgtgtgtagagtt

SEQ ID NO: 2527896 - DNA, 22 bp, Homo sapiens
atttaataaaataattctaaag

SEQ ID NO: 2527897 - DNA, 16 bp, Homo sapiens
atttaataacaattgt

SEQ ID NO: 2527898 - DNA, 13 bp, Homo sapiens
atttaataacatt

SEQ ID NO: 2527899 - DNA, 18 bp, Homo sapiens
atttaataacattacctt

SEQ ID NO: 2527900 - DNA, 14 bp, Homo sapiens
atttaatagtgtta

SEQ ID NO: 2527901 - DNA, 18 bp, Homo sapiens
atttaatagtgttaatca

SEQ ID NO: 2527902 - DNA, 21 bp, Homo sapiens
atttaatagtgttaatcaatt

SEQ ID NO: 2527903 - DNA, 22 bp, Homo sapiens
atttaatagtgttaatcaattt

SEQ ID NO: 2527904 - DNA, 23 bp, Homo sapiens
atttaatagtgttaatcaattta

SEQ ID NO: 2527905 - DNA, 16 bp, Homo sapiens
atttaatatagctatt

SEQ ID NO: 2527906 - DNA, 17 bp, Homo sapiens
atttaatatagctattt

SEQ ID NO: 2527907 - DNA, 14 bp, Homo sapiens
atttaatgaaagac

SEQ ID NO: 2527908 - DNA, 16 bp, Homo sapiens
atttaatgaaagactg

SEQ ID NO: 2527909 - DNA, 21 bp, Homo sapiens
atttaatgaaagactgtacaa

SEQ ID NO: 2527910 - DNA, 14 bp, Homo sapiens
atttaatgtagcca

SEQ ID NO: 2527911 - DNA, 17 bp, Homo sapiens
atttaattcatgtttct

SEQ ID NO: 2527912 - DNA, 13 bp, Homo sapiens
atttaattctctt

SEQ ID NO: 2527913 - DNA, 16 bp, Homo sapiens
atttaattttgacact

SEQ ID NO: 2527914 - DNA, 19 bp, Homo sapiens
atttacaaaaatataaaat

SEQ ID NO: 2527915 - DNA, 22 bp, Homo sapiens
atttacagtgaaaatgtaagct

SEQ ID NO: 2527916 - DNA, 23 bp, Homo sapiens
atttactaagccacaagaaattt

SEQ ID NO: 2527917 - DNA, 13 bp, Homo sapiens
atttactgagctt

SEQ ID NO: 2527918 - DNA, 20 bp, Homo sapiens
atttacttcttatacatttg

SEQ ID NO: 2527919 - DNA, 22 bp, Homo sapiens
atttagagatgaattaaattta

SEQ ID NO: 2527920 - DNA, 18 bp, Homo sapiens
atttagattgttaaaata

SEQ ID NO: 2527921 - DNA, 17 bp, Homo sapiens
atttagccaatgcttac

SEQ ID NO: 2527922 - DNA, 18 bp, Homo sapiens
atttagcgtagctaagtg

SEQ ID NO: 2527923 - DNA, 20 bp, Homo sapiens
atttagggagaaatgttgtt

SEQ ID NO: 2527924 - DNA, 23 bp, Homo sapiens
atttaggtttttgtttgtttcct

SEQ ID NO: 2527925 - DNA, 16 bp, Homo sapiens
atttagtttttgttct

SEQ ID NO: 2527926 - DNA, 13 bp, Homo sapiens
atttataaatgct

SEQ ID NO: 2527927 - DNA, 15 bp, Homo sapiens
atttataactcatca

SEQ ID NO: 2527928 - DNA, 16 bp, Homo sapiens
atttataactcatcat

SEQ ID NO: 2527929 - DNA, 23 bp, Homo sapiens
atttataactcatcataaaataa

SEQ ID NO: 2527930 - DNA, 14 bp, Homo sapiens
atttataagcagat

SEQ ID NO: 2527931 - DNA, 15 bp, Homo sapiens
atttataatcacttt

SEQ ID NO: 2527932 - DNA, 12 bp, Homo sapiens
atttatagtttg

SEQ ID NO: 2527933 - DNA, 15 bp, Homo sapiens
atttatataaatttt

SEQ ID NO: 2527934 - DNA, 15 bp, Homo sapiens
atttatatatgtatt

SEQ ID NO: 2527935 - DNA, 15 bp, Homo sapiens
atttatatattggta

SEQ ID NO: 2527936 - DNA, 14 bp, Homo sapiens
atttatatatttat

SEQ ID NO: 2527937 - DNA, 16 bp, Homo sapiens
atttatatatttataa

SEQ ID NO: 2527938 - DNA, 15 bp, Homo sapiens
atttatatcacatgt

SEQ ID NO: 2527939 - DNA, 19 bp, Homo sapiens
atttatatttttaaaatat

SEQ ID NO: 2527940 - DNA, 17 bp, Homo sapiens
atttatcaatcagtata

SEQ ID NO: 2527941 - DNA, 20 bp, Homo sapiens
atttatcctgaaatttcaga

SEQ ID NO: 2527942 - DNA, 21 bp, Homo sapiens
atttatcctgaaatttcagat

SEQ ID NO: 2527943 - DNA, 16 bp, Homo sapiens
atttatctctatttaa

SEQ ID NO: 2527944 - DNA, 16 bp, Homo sapiens
atttatctgtgcaaat

SEQ ID NO: 2527945 - DNA, 19 bp, Homo sapiens
atttatcttgtctctgggc

SEQ ID NO: 2527946 - DNA, 15 bp, Homo sapiens
atttatgagtttttg

SEQ ID NO: 2527947 - DNA, 13 bp, Homo sapiens
atttatgatttaa

SEQ ID NO: 2527948 - DNA, 19 bp, Homo sapiens
atttatgcatggaaacctg

SEQ ID NO: 2527949 - DNA, 20 bp, Homo sapiens
atttatgcctctgtatttaa

SEQ ID NO: 2527950 - DNA, 14 bp, Homo sapiens
atttatgtagatgt

SEQ ID NO: 2527951 - DNA, 19 bp, Homo sapiens
atttatgtgtgaggagctg

SEQ ID NO: 2527952 - DNA, 22 bp, Homo sapiens
atttattaaacagatttttaca

SEQ ID NO: 2527953 - DNA, 23 bp, Homo sapiens
atttattaaacagatttttacaa

SEQ ID NO: 2527954 - DNA, 17 bp, Homo sapiens
atttattattgaaattg

SEQ ID NO: 2527955 - DNA, 21 bp, Homo sapiens
atttattattttcacctgttt

SEQ ID NO: 2527956 - DNA, 17 bp, Homo sapiens
atttattcatattttct

SEQ ID NO: 2527957 - DNA, 20 bp, Homo sapiens
atttattccatattcatgta

SEQ ID NO: 2527958 - DNA, 23 bp, Homo sapiens
atttattccatattcatgtaaac

SEQ ID NO: 2527959 - DNA, 19 bp, Homo sapiens
atttattgcttgatacttt

SEQ ID NO: 2527960 - DNA, 20 bp, Homo sapiens
atttattgcttgatactttt

SEQ ID NO: 2527961 - DNA, 20 bp, Homo sapiens
atttattgtttatttatcag

SEQ ID NO: 2527962 - DNA, 22 bp, Homo sapiens
atttattgtttatttatcagtg

SEQ ID NO: 2527963 - DNA, 14 bp, Homo sapiens
atttatttaaaaga

SEQ ID NO: 2527964 - DNA, 15 bp, Homo sapiens
atttatttaatgtta

SEQ ID NO: 2527965 - DNA, 14 bp, Homo sapiens
atttatttcaaaaa

SEQ ID NO: 2527966 - DNA, 13 bp, Homo sapiens
atttattttcctc

SEQ ID NO: 2527967 - DNA, 17 bp, Homo sapiens
atttattttcctcccca

SEQ ID NO: 2527968 - DNA, 14 bp, Homo sapiens
atttcaaaaatata

SEQ ID NO: 2527969 - DNA, 18 bp, Homo sapiens
atttcaaaaatataactt

SEQ ID NO: 2527970 - DNA, 14 bp, Homo sapiens
atttcaaaactcat

SEQ ID NO: 2527971 - DNA, 13 bp, Homo sapiens
atttcaaaatata

SEQ ID NO: 2527972 - DNA, 17 bp, Homo sapiens
atttcaaattggagctt

SEQ ID NO: 2527973 - DNA, 22 bp, Homo sapiens
atttcaagttccaagttgctaa

SEQ ID NO: 2527974 - DNA, 23 bp, Homo sapiens
atttcaagttccaagttgctaat

SEQ ID NO: 2527975 - DNA, 20 bp, Homo sapiens
atttcacaacagatcaattt

SEQ ID NO: 2527976 - DNA, 14 bp, Homo sapiens
atttcacctgtaaa

SEQ ID NO: 2527977 - DNA, 18 bp, Homo sapiens
atttcacctgtaaacctg

SEQ ID NO: 2527978 - DNA, 19 bp, Homo sapiens
atttcactttagatgctga

SEQ ID NO: 2527979 - DNA, 16 bp, Homo sapiens
atttcagagaggcctt

SEQ ID NO: 2527980 - DNA, 15 bp, Homo sapiens
atttcagatttgtga

SEQ ID NO: 2527981 - DNA, 14 bp, Homo sapiens
atttcagtgccaat

SEQ ID NO: 2527982 - DNA, 20 bp, Homo sapiens
atttcatacctatcatctta

SEQ ID NO: 2527983 - DNA, 14 bp, Homo sapiens
atttcatctatttc

SEQ ID NO: 2527984 - DNA, 16 bp, Homo sapiens
atttcatctatttctg

SEQ ID NO: 2527985 - DNA, 19 bp, Homo sapiens
atttcatctatttctgaga

SEQ ID NO: 2527986 - DNA, 18 bp, Homo sapiens
atttcatgctatctctgt

SEQ ID NO: 2527987 - DNA, 14 bp, Homo sapiens
atttcattcttctc

SEQ ID NO: 2527988 - DNA, 17 bp, Homo sapiens
atttcattgtatgatgt

SEQ ID NO: 2527989 - DNA, 19 bp, Homo sapiens
atttcattgtatgatgtgt

SEQ ID NO: 2527990 - DNA, 20 bp, Homo sapiens
atttcattgtatgatgtgtt

SEQ ID NO: 2527991 - DNA, 13 bp, Homo sapiens
atttccaaataaa

SEQ ID NO: 2527992 - DNA, 18 bp, Homo sapiens
atttccaaataaaatgag

SEQ ID NO: 2527993 - DNA, 13 bp, Homo sapiens
atttccaaatgaa

SEQ ID NO: 2527994 - DNA, 17 bp, Homo sapiens
atttccaaatgaatgac

SEQ ID NO: 2527995 - DNA, 17 bp, Homo sapiens
atttccaaattcacaag

SEQ ID NO: 2527996 - DNA, 19 bp, Homo sapiens
atttccaacaccacagaca

SEQ ID NO: 2527997 - DNA, 22 bp, Homo sapiens
atttccaacaccacagacacac

SEQ ID NO: 2527998 - DNA, 14 bp, Homo sapiens
atttccacaccaag

SEQ ID NO: 2527999 - DNA, 17 bp, Homo sapiens
atttccagccaaagcct

SEQ ID NO: 2528000 - DNA, 18 bp, Homo sapiens
atttccagccagggctgc

SEQ ID NO: 2528001 - DNA, 22 bp, Homo sapiens
atttccatataaatattagaaa

SEQ ID NO: 2528002 - DNA, 15 bp, Homo sapiens
atttccatatggatt

SEQ ID NO: 2528003 - DNA, 17 bp, Homo sapiens
atttcccaattaggaag

SEQ ID NO: 2528004 - DNA, 22 bp, Homo sapiens
atttcctcaacgttgctcccca

SEQ ID NO: 2528005 - DNA, 21 bp, Homo sapiens
atttcctcatgtgatcacaat

SEQ ID NO: 2528006 - DNA, 22 bp, Homo sapiens
atttcctcatgtgatcacaatt

SEQ ID NO: 2528007 - DNA, 18 bp, Homo sapiens
atttcctctattgatgta

SEQ ID NO: 2528008 - DNA, 21 bp, Homo sapiens
atttcctggtgtgaaggtcct

SEQ ID NO: 2528009 - DNA, 23 bp, Homo sapiens
atttcctgttggatttgtttaaa

SEQ ID NO: 2528010 - DNA, 21 bp, Homo sapiens
atttcgtctgtttataaacat

SEQ ID NO: 2528011 - DNA, 13 bp, Homo sapiens
atttctaaatctc

SEQ ID NO: 2528012 - DNA, 20 bp, Homo sapiens
atttctactcttaagtttct

SEQ ID NO: 2528013 - DNA, 14 bp, Homo sapiens
caaagaaatgtaag

SEQ ID NO: 2528014 - DNA, 20 bp, Homo sapiens
caaagaagacatgttttaga

SEQ ID NO: 2528015 - DNA, 19 bp, Homo sapiens
caaagaaggaaaaggcagg

SEQ ID NO: 2528016 - DNA, 14 bp, Homo sapiens
caaagacagaagcc

SEQ ID NO: 2528017 - DNA, 14 bp, Homo sapiens
caaagagactggag

SEQ ID NO: 2528018 - DNA, 18 bp, Homo sapiens
caaagagactggagcatc

SEQ ID NO: 2528019 - DNA, 18 bp, Homo sapiens
caaagagcctggagaagc

SEQ ID NO: 2528020 - DNA, 16 bp, Homo sapiens
caaagaggtatttatc

SEQ ID NO: 2528021 - DNA, 18 bp, Homo sapiens
caaagaggtgactgggcc

SEQ ID NO: 2528022 - DNA, 21 bp, Homo sapiens
caaagaggttttaaaaaaatc

SEQ ID NO: 2528023 - DNA, 17 bp, Homo sapiens
caaagagtgtagatcag

SEQ ID NO: 2528024 - DNA, 20 bp, Homo sapiens
caaagataatctctcagctt

SEQ ID NO: 2528025 - DNA, 23 bp, Homo sapiens
caaagatatatacacaggatcct

SEQ ID NO: 2528026 - DNA, 20 bp, Homo sapiens
caaagatattttgctttgtg

SEQ ID NO: 2528027 - DNA, 18 bp, Homo sapiens
caaagatcaaaataaaaa

SEQ ID NO: 2528028 - DNA, 18 bp, Homo sapiens
caaagatgtttgtcagat

SEQ ID NO: 2528029 - DNA, 22 bp, Homo sapiens
caaagatgtttgtcagatatga

SEQ ID NO: 2528030 - DNA, 17 bp, Homo sapiens
caaagattcaaaattga

SEQ ID NO: 2528031 - DNA, 13 bp, Homo sapiens
caaagcaaggaaa

SEQ ID NO: 2528032 - DNA, 14 bp, Homo sapiens
caaagcaataatag

SEQ ID NO: 2528033 - DNA, 22 bp, Homo sapiens
caaagcacagtgttaaatgaaa

SEQ ID NO: 2528034 - DNA, 16 bp, Homo sapiens
caaagcacagtttgaa

SEQ ID NO: 2528035 - DNA, 12 bp, Homo sapiens
caaagcaccagc

SEQ ID NO: 2528036 - DNA, 21 bp, Homo sapiens
caaagcaccagcttctccagg

SEQ ID NO: 2528037 - DNA, 17 bp, Homo sapiens
caaagccaaactctgcc

SEQ ID NO: 2528038 - DNA, 21 bp, Homo sapiens
caaagccaaagctaggcctgg

SEQ ID NO: 2528039 - DNA, 22 bp, Homo sapiens
caaagccaaagctaggcctggc

SEQ ID NO: 2528040 - DNA, 22 bp, Homo sapiens
caaagccaacagtcaaaacaga

SEQ ID NO: 2528041 - DNA, 13 bp, Homo sapiens
caaagccagaagc

SEQ ID NO: 2528042 - DNA, 15 bp, Homo sapiens
caaagccagacagca

SEQ ID NO: 2528043 - DNA, 22 bp, Homo sapiens
caaagccagcgtcctcctctgt

SEQ ID NO: 2528044 - DNA, 23 bp, Homo sapiens
caaagccagcgtcctcctctgtg

SEQ ID NO: 2528045 - DNA, 17 bp, Homo sapiens
caaagcccaaagtggta

SEQ ID NO: 2528046 - DNA, 23 bp, Homo sapiens
caaagccccttgctctcccctgc

SEQ ID NO: 2528047 - DNA, 15 bp, Homo sapiens
caaagccctaaaatt

SEQ ID NO: 2528048 - DNA, 17 bp, Homo sapiens
caaagcctcctccagcc

SEQ ID NO: 2528049 - DNA, 18 bp, Homo sapiens
caaagccttatcaagtgt

SEQ ID NO: 2528050 - DNA, 17 bp, Homo sapiens
caaagccttgtgtctac

SEQ ID NO: 2528051 - DNA, 15 bp, Homo sapiens
caaagctaggcctgg

SEQ ID NO: 2528052 - DNA, 17 bp, Homo sapiens
caaagctaggcctggcc

SEQ ID NO: 2528053 - DNA, 23 bp, Homo sapiens
caaagctctattaagatttccaa

SEQ ID NO: 2528054 - DNA, 19 bp, Homo sapiens
caaagcttctatcccagga

SEQ ID NO: 2528055 - DNA, 21 bp, Homo sapiens
caaagcttctatcccaggagg

SEQ ID NO: 2528056 - DNA, 21 bp, Homo sapiens
caaaggaaggaccctgaggcc

SEQ ID NO: 2528057 - DNA, 23 bp, Homo sapiens
caaaggactgttttttcctgagc

SEQ ID NO: 2528058 - DNA, 16 bp, Homo sapiens
caaaggagtagaaaga

SEQ ID NO: 2528059 - DNA, 13 bp, Homo sapiens
caaaggccagggt

SEQ ID NO: 2528060 - DNA, 20 bp, Homo sapiens
caaaggccatggagagctgg

SEQ ID NO: 2528061 - DNA, 23 bp, Homo sapiens
caaaggcgcagtgcttctctaca

SEQ ID NO: 2528062 - DNA, 12 bp, Homo sapiens
caaaggctggga

SEQ ID NO: 2528063 - DNA, 18 bp, Homo sapiens
caaagggaaatatcattt

SEQ ID NO: 2528064 - DNA, 15 bp, Homo sapiens
caaagggagcagaac

SEQ ID NO: 2528065 - DNA, 18 bp, Homo sapiens
caaagggttttaatgtag

SEQ ID NO: 2528066 - DNA, 14 bp, Homo sapiens
caaaggtggctctc

SEQ ID NO: 2528067 - DNA, 21 bp, Homo sapiens
caaagtagaagtcttagatgt

SEQ ID NO: 2528068 - DNA, 19 bp, Homo sapiens
caaagtatcaggacgagaa

SEQ ID NO: 2528069 - DNA, 22 bp, Homo sapiens
caaagtatttttttatcttggg

SEQ ID NO: 2528070 - DNA, 23 bp, Homo sapiens
caaagtatttttttatcttggga

SEQ ID NO: 2528071 - DNA, 20 bp, Homo sapiens
caaagtctgatttgtgatga

SEQ ID NO: 2528072 - DNA, 13 bp, Homo sapiens
caaagtctgtgtg

SEQ ID NO: 2528073 - DNA, 14 bp, Homo sapiens
caaagtctgtgtga

SEQ ID NO: 2528074 - DNA, 15 bp, Homo sapiens
caaagttaacagatt

SEQ ID NO: 2528075 - DNA, 17 bp, Homo sapiens
caaagttggggcaggct

SEQ ID NO: 2528076 - DNA, 13 bp, Homo sapiens
caaagttttgaaa

SEQ ID NO: 2528077 - DNA, 17 bp, Homo sapiens
caaagttttgaaaagct

SEQ ID NO: 2528078 - DNA, 17 bp, Homo sapiens
caaataaaaactaaatt

SEQ ID NO: 2528079 - DNA, 19 bp, Homo sapiens
caaataaaaactaaattgt

SEQ ID NO: 2528080 - DNA, 21 bp, Homo sapiens
caaataaaaactaaattgtaa

SEQ ID NO: 2528081 - DNA, 22 bp, Homo sapiens
caaataaaaactaaattgtaaa

SEQ ID NO: 2528082 - DNA, 17 bp, Homo sapiens
caaataaagtcccaggt

SEQ ID NO: 2528083 - DNA, 19 bp, Homo sapiens
caaatactttaaaggaaaa

SEQ ID NO: 2528084 - DNA, 14 bp, Homo sapiens
caaatatgcaaagc

SEQ ID NO: 2528085 - DNA, 15 bp, Homo sapiens
caaatatttattttc

SEQ ID NO: 2528086 - DNA, 13 bp, Homo sapiens
caaatcaaagcag

SEQ ID NO: 2528087 - DNA, 16 bp, Homo sapiens
caaatcagctgctact

SEQ ID NO: 2528088 - DNA, 13 bp, Homo sapiens
caaatcagtcagt

SEQ ID NO: 2528089 - DNA, 16 bp, Homo sapiens
caaatcctatgtgatt

SEQ ID NO: 2528090 - DNA, 18 bp, Homo sapiens
caaatcctatgtgatttt

SEQ ID NO: 2528091 - DNA, 13 bp, Homo sapiens
caaatctattcag

SEQ ID NO: 2528092 - DNA, 16 bp, Homo sapiens
caaatctattcagaca

SEQ ID NO: 2528093 - DNA, 17 bp, Homo sapiens
caaatgacccaaagacc

SEQ ID NO: 2528094 - DNA, 18 bp, Homo sapiens
caaatgacccaaagacca

SEQ ID NO: 2528095 - DNA, 20 bp, Homo sapiens
caaatgagatctaagccttt

SEQ ID NO: 2528096 - DNA, 19 bp, Homo sapiens
caaatgcagggattgctgc

SEQ ID NO: 2528097 - DNA, 20 bp, Homo sapiens
caaatgcagggattgctgcc

SEQ ID NO: 2528098 - DNA, 22 bp, Homo sapiens
caaatgcagggattgctgccac

SEQ ID NO: 2528099 - DNA, 23 bp, Homo sapiens
caaatgcagggattgctgccact

SEQ ID NO: 2528100 - DNA, 18 bp, Homo sapiens
caaatgcatggtgcagtt

SEQ ID NO: 2528101 - DNA, 18 bp, Homo sapiens
caaatgcccaagggaaag

SEQ ID NO: 2528102 - DNA, 17 bp, Homo sapiens
caaatgcttggcttctc

SEQ ID NO: 2528103 - DNA, 18 bp, Homo sapiens
caaatgtaattgaataaa

SEQ ID NO: 2528104 - DNA, 16 bp, Homo sapiens
caaatgtcagatacaa

SEQ ID NO: 2528105 - DNA, 18 bp, Homo sapiens
caaatgtcatcagaactt

SEQ ID NO: 2528106 - DNA, 18 bp, Homo sapiens
caaatgtcctccagaagc

SEQ ID NO: 2528107 - DNA, 14 bp, Homo sapiens
caaatgtgacctgt

SEQ ID NO: 2528108 - DNA, 17 bp, Homo sapiens
caaatgtgacctgtgtc

SEQ ID NO: 2528109 - DNA, 20 bp, Homo sapiens
caaatgtgtacatggcagag

SEQ ID NO: 2528110 - DNA, 23 bp, Homo sapiens
caaatgtgtacatggcagagttt

SEQ ID NO: 2528111 - DNA, 13 bp, Homo sapiens
caaatgttatgca

SEQ ID NO: 2528112 - DNA, 21 bp, Homo sapiens
caaatgttcatcaatgaatga

SEQ ID NO: 2528113 - DNA, 22 bp, Homo sapiens
caaattaagggttaagaaaaga

SEQ ID NO: 2528114 - DNA, 21 bp, Homo sapiens
caaattactttgtgaatagaa

SEQ ID NO: 2528115 - DNA, 20 bp, Homo sapiens
caaattaggttttgtacaat

SEQ ID NO: 2528116 - DNA, 21 bp, Homo sapiens
caaattaggttttgtacaatt

SEQ ID NO: 2528117 - DNA, 15 bp, Homo sapiens
caaattattaatgaa

SEQ ID NO: 2528118 - DNA, 17 bp, Homo sapiens
caaattatttgtgtaat

SEQ ID NO: 2528119 - DNA, 20 bp, Homo sapiens
caaattatttgtgtaataga

SEQ ID NO: 2528120 - DNA, 22 bp, Homo sapiens
caaattctgcttgcttgctttt

SEQ ID NO: 2528121 - DNA, 14 bp, Homo sapiens
caaattctgtttct

SEQ ID NO: 2528122 - DNA, 17 bp, Homo sapiens
caaattgaactctttga

SEQ ID NO: 2528123 - DNA, 17 bp, Homo sapiens
caaattgcttgaaagaa

SEQ ID NO: 2528124 - DNA, 19 bp, Homo sapiens
caaattgcttgaaagaaaa

SEQ ID NO: 2528125 - DNA, 14 bp, Homo sapiens
caaatttacagaga

SEQ ID NO: 2528126 - DNA, 19 bp, Homo sapiens
caaatttgggggtttctca

SEQ ID NO: 2528127 - DNA, 22 bp, Homo sapiens
caaatttgtcttgccttattaa

SEQ ID NO: 2528128 - DNA, 13 bp, Homo sapiens
caaattttggcca

SEQ ID NO: 2528129 - DNA, 15 bp, Homo sapiens
caaattttggccaaa

SEQ ID NO: 2528130 - DNA, 17 bp, Homo sapiens
caacaaagcacagtgtt

SEQ ID NO: 2528131 - DNA, 19 bp, Homo sapiens
caacaacctcaactgccta

SEQ ID NO: 2528132 - DNA, 15 bp, Homo sapiens
caacaagggagagac

SEQ ID NO: 2528133 - DNA, 18 bp, Homo sapiens
caacaagggagagacctc

SEQ ID NO: 2528134 - DNA, 13 bp, Homo sapiens
caacaataaaata

SEQ ID NO: 2528135 - DNA, 15 bp, Homo sapiens
caacaatcctagtgc

SEQ ID NO: 2528136 - DNA, 18 bp, Homo sapiens
caacaatcctagtgcttt

SEQ ID NO: 2528137 - DNA, 13 bp, Homo sapiens
caacaatttctac

SEQ ID NO: 2528138 - DNA, 20 bp, Homo sapiens
caacaatttctactttgaag

SEQ ID NO: 2528139 - DNA, 14 bp, Homo sapiens
caacacacacactc

SEQ ID NO: 2528140 - DNA, 13 bp, Homo sapiens
caacaccacagac

SEQ ID NO: 2528141 - DNA, 18 bp, Homo sapiens
caacaccacagacacaca

SEQ ID NO: 2528142 - DNA, 20 bp, Homo sapiens
caacacctctgcacaagctg

SEQ ID NO: 2528143 - DNA, 20 bp, Homo sapiens
caacactgggaaacagaggc

SEQ ID NO: 2528144 - DNA, 19 bp, Homo sapiens
caacagagtgagaccctgt

SEQ ID NO: 2528145 - DNA, 14 bp, Homo sapiens
caacagatactgga

SEQ ID NO: 2528146 - DNA, 23 bp, Homo sapiens
caacagatgcttttctgtctctg

SEQ ID NO: 2528147 - DNA, 14 bp, Homo sapiens
caacagatttgtga

SEQ ID NO: 2528148 - DNA, 15 bp, Homo sapiens
caacagatttgtgaa

SEQ ID NO: 2528149 - DNA, 12 bp, Homo sapiens
caacagcactgg

SEQ ID NO: 2528150 - DNA, 15 bp, Homo sapiens
caacagcactggctc

SEQ ID NO: 2528151 - DNA, 23 bp, Homo sapiens
caacagctccccattaccctcag

SEQ ID NO: 2528152 - DNA, 19 bp, Homo sapiens
caacaggaatcaagagctg

SEQ ID NO: 2528153 - DNA, 21 bp, Homo sapiens
caacaggaatcaagagctgcc

SEQ ID NO: 2528154 - DNA, 23 bp, Homo sapiens
caacaggaatcaagagctgccct

SEQ ID NO: 2528155 - DNA, 22 bp, Homo sapiens
caacaggagctgggatcctaag

SEQ ID NO: 2528156 - DNA, 13 bp, Homo sapiens
cacagaccctgcc

SEQ ID NO: 2528157 - DNA, 14 bp, Homo sapiens
cacagaccctgccc

SEQ ID NO: 2528158 - DNA, 14 bp, Homo sapiens
cacagacctggagc

SEQ ID NO: 2528159 - DNA, 18 bp, Homo sapiens
cacagacctggagcccct

SEQ ID NO: 2528160 - DNA, 19 bp, Homo sapiens
cacagacctggagcccctg

SEQ ID NO: 2528161 - DNA, 23 bp, Homo sapiens
cacagacctggagcccctgggtg

SEQ ID NO: 2528162 - DNA, 12 bp, Homo sapiens
cacagagagtcc

SEQ ID NO: 2528163 - DNA, 16 bp, Homo sapiens
cacagagctctccagc

SEQ ID NO: 2528164 - DNA, 21 bp, Homo sapiens
cacagagctctccagctccaa

SEQ ID NO: 2528165 - DNA, 13 bp, Homo sapiens
cacagaggaagag

SEQ ID NO: 2528166 - DNA, 15 bp, Homo sapiens
cacagaggaagagca

SEQ ID NO: 2528167 - DNA, 13 bp, Homo sapiens
cacagaggctgcc

SEQ ID NO: 2528168 - DNA, 17 bp, Homo sapiens
cacagagttgttacatt

SEQ ID NO: 2528169 - DNA, 21 bp, Homo sapiens
cacagagttgttacattttta

SEQ ID NO: 2528170 - DNA, 22 bp, Homo sapiens
cacagagttgttacatttttaa

SEQ ID NO: 2528171 - DNA, 11 bp, Homo sapiens
cacagatgcct

SEQ ID NO: 2528172 - DNA, 12 bp, Homo sapiens
cacagatggatt

SEQ ID NO: 2528173 - DNA, 19 bp, Homo sapiens
cacagatggatttgcctgt

SEQ ID NO: 2528174 - DNA, 20 bp, Homo sapiens
cacagatgggtgcttggagg

SEQ ID NO: 2528175 - DNA, 23 bp, Homo sapiens
cacagatgggtgcttggaggaag

SEQ ID NO: 2528176 - DNA, 19 bp, Homo sapiens
cacagcagctgaacagcca

SEQ ID NO: 2528177 - DNA, 15 bp, Homo sapiens
cacagcagcttcacc

SEQ ID NO: 2528178 - DNA, 22 bp, Homo sapiens
cacagcagcttcaccagagcat

SEQ ID NO: 2528179 - DNA, 21 bp, Homo sapiens
cacagcagttgaaaagactcc

SEQ ID NO: 2528180 - DNA, 22 bp, Homo sapiens
cacagcagttgaaaagactcca

SEQ ID NO: 2528181 - DNA, 13 bp, Homo sapiens
cacagcatgtgta

SEQ ID NO: 2528182 - DNA, 10 bp, Homo sapiens
cacagccaca

SEQ ID NO: 2528183 - DNA, 13 bp, Homo sapiens
cacagccacacac

SEQ ID NO: 2528184 - DNA, 18 bp, Homo sapiens
cacagccacacacacaga

SEQ ID NO: 2528185 - DNA, 21 bp, Homo sapiens
cacagccacacacacagaaaa

SEQ ID NO: 2528186 - DNA, 15 bp, Homo sapiens
cacagccaggtgcct

SEQ ID NO: 2528187 - DNA, 20 bp, Homo sapiens
cacagccaggtgccttggag

SEQ ID NO: 2528188 - DNA, 12 bp, Homo sapiens
cacagccctgtc

SEQ ID NO: 2528189 - DNA, 14 bp, Homo sapiens
cacagccgcagcct

SEQ ID NO: 2528190 - DNA, 22 bp, Homo sapiens
cacagccgcagcctccctctga

SEQ ID NO: 2528191 - DNA, 17 bp, Homo sapiens
cacagcctcccctgcca

SEQ ID NO: 2528192 - DNA, 20 bp, Homo sapiens
cacagcctcccctgccaggg

SEQ ID NO: 2528193 - DNA, 23 bp, Homo sapiens
cacagcctcccctgccagggcag

SEQ ID NO: 2528194 - DNA, 19 bp, Homo sapiens
cacagcctcctctgtctgc

SEQ ID NO: 2528195 - DNA, 21 bp, Homo sapiens
cacagcctcctctgtctgccc

SEQ ID NO: 2528196 - DNA, 18 bp, Homo sapiens
cacagccttctccactgg

SEQ ID NO: 2528197 - DNA, 19 bp, Homo sapiens
cacagcgctggccgggacc

SEQ ID NO: 2528198 - DNA, 14 bp, Homo sapiens
cacagcggcccctg

SEQ ID NO: 2528199 - DNA, 20 bp, Homo sapiens
cacagctaacaattgtgaag

SEQ ID NO: 2528200 - DNA, 21 bp, Homo sapiens
cacagctaacaattgtgaagt

SEQ ID NO: 2528201 - DNA, 15 bp, Homo sapiens
cacagctcctcccac

SEQ ID NO: 2528202 - DNA, 21 bp, Homo sapiens
cacagctctccggtctctctc

SEQ ID NO: 2528203 - DNA, 15 bp, Homo sapiens
cacagctctgtcctg

SEQ ID NO: 2528204 - DNA, 16 bp, Homo sapiens
cacagctctgtcctgg

SEQ ID NO: 2528205 - DNA, 19 bp, Homo sapiens
cacagctgagagactttta

SEQ ID NO: 2528206 - DNA, 12 bp, Homo sapiens
cacagctgctgg

SEQ ID NO: 2528207 - DNA, 20 bp, Homo sapiens
cacagctgctggagactcct

SEQ ID NO: 2528208 - DNA, 22 bp, Homo sapiens
cacaggaagcctgcagtcctgg

SEQ ID NO: 2528209 - DNA, 16 bp, Homo sapiens
cacaggacccccttcc

SEQ ID NO: 2528210 - DNA, 19 bp, Homo sapiens
cacaggacccccttcccct

SEQ ID NO: 2528211 - DNA, 15 bp, Homo sapiens
cacaggagcatttgg

SEQ ID NO: 2528212 - DNA, 19 bp, Homo sapiens
cacaggatcctattctcac

SEQ ID NO: 2528213 - DNA, 23 bp, Homo sapiens
cacaggatcctattctcaccagg

SEQ ID NO: 2528214 - DNA, 13 bp, Homo sapiens
cacaggcaactga

SEQ ID NO: 2528215 - DNA, 18 bp, Homo sapiens
cacaggcaactgaggcag

SEQ ID NO: 2528216 - DNA, 20 bp, Homo sapiens
cacaggcaactgaggcagac

SEQ ID NO: 2528217 - DNA, 16 bp, Homo sapiens
cacaggcagctggatg

SEQ ID NO: 2528218 - DNA, 21 bp, Homo sapiens
cacaggcagctggatgagact

SEQ ID NO: 2528219 - DNA, 10 bp, Homo sapiens
cacaggcagg

SEQ ID NO: 2528220 - DNA, 15 bp, Homo sapiens
cacaggcaggtccag

SEQ ID NO: 2528221 - DNA, 19 bp, Homo sapiens
cacaggcaggtccagggtt

SEQ ID NO: 2528222 - DNA, 18 bp, Homo sapiens
cacaggcccggctccagg

SEQ ID NO: 2528223 - DNA, 23 bp, Homo sapiens
cacaggcccggctccaggctcct

SEQ ID NO: 2528224 - DNA, 17 bp, Homo sapiens
cacagggcagagccggg

SEQ ID NO: 2528225 - DNA, 21 bp, Homo sapiens
cacagggcctttggcaggtgc

SEQ ID NO: 2528226 - DNA, 23 bp, Homo sapiens
cacagggttgggcccagatctgg

SEQ ID NO: 2528227 - DNA, 23 bp, Homo sapiens
cacaggtatgaccttctaggaag

SEQ ID NO: 2528228 - DNA, 19 bp, Homo sapiens
cacaggttcatgccaccat

SEQ ID NO: 2528229 - DNA, 16 bp, Homo sapiens
cacagtattacttctg

SEQ ID NO: 2528230 - DNA, 15 bp, Homo sapiens
cacagtccttaccag

SEQ ID NO: 2528231 - DNA, 21 bp, Homo sapiens
cacagtccttaccagcagagc

SEQ ID NO: 2528232 - DNA, 22 bp, Homo sapiens
cacagtccttaccagcagagca

SEQ ID NO: 2528233 - DNA, 23 bp, Homo sapiens
cacagtccttaccagcagagcac

SEQ ID NO: 2528234 - DNA, 18 bp, Homo sapiens
cacagtgagtcgaggaca

SEQ ID NO: 2528235 - DNA, 20 bp, Homo sapiens
cacagtgagtcgaggacagg

SEQ ID NO: 2528236 - DNA, 14 bp, Homo sapiens
cacagtgatttttt

SEQ ID NO: 2528237 - DNA, 17 bp, Homo sapiens
cacagtgccttcaataa

SEQ ID NO: 2528238 - DNA, 18 bp, Homo sapiens
cacagtgggagccagggc

SEQ ID NO: 2528239 - DNA, 19 bp, Homo sapiens
cacagtggtggcagggcct

SEQ ID NO: 2528240 - DNA, 18 bp, Homo sapiens
cacagtgtctgtatcgga

SEQ ID NO: 2528241 - DNA, 22 bp, Homo sapiens
cacagttcagtggcagggctca

SEQ ID NO: 2528242 - DNA, 21 bp, Homo sapiens
cacagttttctgagaaagact

SEQ ID NO: 2528243 - DNA, 15 bp, Homo sapiens
cacatacacacatat

SEQ ID NO: 2528244 - DNA, 16 bp, Homo sapiens
cacatacttgagactg

SEQ ID NO: 2528245 - DNA, 18 bp, Homo sapiens
cacatagcatgtaatggt

SEQ ID NO: 2528246 - DNA, 22 bp, Homo sapiens
cacatatgcaccttgtgtctgt

SEQ ID NO: 2528247 - DNA, 15 bp, Homo sapiens
cacatatttgatagt

SEQ ID NO: 2528248 - DNA, 19 bp, Homo sapiens
cacatcagcacgatttctg

SEQ ID NO: 2528249 - DNA, 12 bp, Homo sapiens
cacatcccaggc

SEQ ID NO: 2528250 - DNA, 17 bp, Homo sapiens
cacatcctgtgtttcta

SEQ ID NO: 2528251 - DNA, 17 bp, Homo sapiens
cacatctgtgtcttgtt

SEQ ID NO: 2528252 - DNA, 18 bp, Homo sapiens
cacatctgtgtcttgttt

SEQ ID NO: 2528253 - DNA, 23 bp, Homo sapiens
cacatctgtgtcttgtttggaat

SEQ ID NO: 2528254 - DNA, 15 bp, Homo sapiens
cacatcttgctctgc

SEQ ID NO: 2528255 - DNA, 16 bp, Homo sapiens
cacatcttgctctgct

SEQ ID NO: 2528256 - DNA, 17 bp, Homo sapiens
cacatcttgctctgctg

SEQ ID NO: 2528257 - DNA, 19 bp, Homo sapiens
cacatcttgctctgctgac

SEQ ID NO: 2528258 - DNA, 22 bp, Homo sapiens
cacatctttatctgttcttgct

SEQ ID NO: 2528259 - DNA, 19 bp, Homo sapiens
cacatctttcacacttcca

SEQ ID NO: 2528260 - DNA, 21 bp, Homo sapiens
cacatctttcacacttccacc

SEQ ID NO: 2528261 - DNA, 14 bp, Homo sapiens
cacatctttcctgt

SEQ ID NO: 2528262 - DNA, 13 bp, Homo sapiens
cacatgagcatca

SEQ ID NO: 2528263 - DNA, 15 bp, Homo sapiens
cacatgagtcccagt

SEQ ID NO: 2528264 - DNA, 17 bp, Homo sapiens
cacatgagtcccagtgg

SEQ ID NO: 2528265 - DNA, 18 bp, Homo sapiens
cacatgagtcccagtggg

SEQ ID NO: 2528266 - DNA, 20 bp, Homo sapiens
cacatgcaaggtcatttttt

SEQ ID NO: 2528267 - DNA, 18 bp, Homo sapiens
cacatgcacgtgtgtgca

SEQ ID NO: 2528268 - DNA, 18 bp, Homo sapiens
cacatggcttcctcctgc

SEQ ID NO: 2528269 - DNA, 23 bp, Homo sapiens
cacatgtcaccgtggaccttcct

SEQ ID NO: 2528270 - DNA, 17 bp, Homo sapiens
cacatgtccttgtgtgt

SEQ ID NO: 2528271 - DNA, 14 bp, Homo sapiens
cacatgtgcacatg

SEQ ID NO: 2528272 - DNA, 17 bp, Homo sapiens
cacatgtgcacatgcac

SEQ ID NO: 2528273 - DNA, 11 bp, Homo sapiens
cacatgtgtgc

SEQ ID NO: 2528274 - DNA, 15 bp, Homo sapiens
cacatgttttctctg

SEQ ID NO: 2528275 - DNA, 23 bp, Homo sapiens
cacattaagccttccacactcac

SEQ ID NO: 2528276 - DNA, 13 bp, Homo sapiens
cacattatttgca

SEQ ID NO: 2528277 - DNA, 17 bp, Homo sapiens
cacattcaaccctggag

SEQ ID NO: 2528278 - DNA, 20 bp, Homo sapiens
cacattcaaccctggagagt

SEQ ID NO: 2528279 - DNA, 16 bp, Homo sapiens
cacattctggctcagg

SEQ ID NO: 2528280 - DNA, 16 bp, Homo sapiens
cacattcttataaata

SEQ ID NO: 2528281 - DNA, 22 bp, Homo sapiens
cacattttgtataattgtatcg

SEQ ID NO: 2528282 - DNA, 18 bp, Homo sapiens
cacatttttcagatataa

SEQ ID NO: 2528283 - DNA, 12 bp, Homo sapiens
caccaaaataag

SEQ ID NO: 2528284 - DNA, 18 bp, Homo sapiens
caccaaaataagaaaaga

SEQ ID NO: 2528285 - DNA, 16 bp, Homo sapiens
caccaaacatactaga

SEQ ID NO: 2528286 - DNA, 13 bp, Homo sapiens
caccaaaggccag

SEQ ID NO: 2528287 - DNA, 17 bp, Homo sapiens
caccaacatactcccat

SEQ ID NO: 2528288 - DNA, 21 bp, Homo sapiens
caccaacatactcccatctgt

SEQ ID NO: 2528289 - DNA, 16 bp, Homo sapiens
caccaacgtctgtgcc

SEQ ID NO: 2528290 - DNA, 18 bp, Homo sapiens
caccaactcttgcaggtc

SEQ ID NO: 2528291 - DNA, 15 bp, Homo sapiens
caccaagaaagcagg

SEQ ID NO: 2528292 - DNA, 22 bp, Homo sapiens
caccaagacttgttttatgctc

SEQ ID NO: 2528293 - DNA, 12 bp, Homo sapiens
caccaagcccag

SEQ ID NO: 2528294 - DNA, 16 bp, Homo sapiens
caccaagctcaaagcg

SEQ ID NO: 2528295 - DNA, 14 bp, Homo sapiens
caccaaggtcttca

SEQ ID NO: 2528296 - DNA, 15 bp, Homo sapiens
caccaaggtcttcag

SEQ ID NO: 2528297 - DNA, 20 bp, Homo sapiens
caccaaggtcttcagccatc

SEQ ID NO: 2528298 - DNA, 21 bp, Homo sapiens
caccaaggtcttcagccatca

SEQ ID NO: 2528299 - DNA, 17 bp, Homo sapiens
caccacacccagcccac

SEQ ID NO: 2528300 - DNA, 18 bp, Homo sapiens
cactgcctctccctggcc

SEQ ID NO: 2528301 - DNA, 16 bp, Homo sapiens
cactgcctcttcctcc

SEQ ID NO: 2528302 - DNA, 15 bp, Homo sapiens
cactgcctgcccacc

SEQ ID NO: 2528303 - DNA, 20 bp, Homo sapiens
cactgcggagaaccttgtgc

SEQ ID NO: 2528304 - DNA, 20 bp, Homo sapiens
cactgctaggcgagtgccag

SEQ ID NO: 2528305 - DNA, 22 bp, Homo sapiens
cactgctaggcgagtgccagga

SEQ ID NO: 2528306 - DNA, 17 bp, Homo sapiens
cactgctaggtgggcca

SEQ ID NO: 2528307 - DNA, 12 bp, Homo sapiens
cactgctctggt

SEQ ID NO: 2528308 - DNA, 17 bp, Homo sapiens
cactgctgcaaggcctt

SEQ ID NO: 2528309 - DNA, 19 bp, Homo sapiens
cactgctgcaaggcctttc

SEQ ID NO: 2528310 - DNA, 23 bp, Homo sapiens
cactgctgcttctccatggccac

SEQ ID NO: 2528311 - DNA, 11 bp, Homo sapiens
cactgctgtca

SEQ ID NO: 2528312 - DNA, 17 bp, Homo sapiens
cactgctgtgctgtgcc

SEQ ID NO: 2528313 - DNA, 21 bp, Homo sapiens
cactgcttccagtgaggctct

SEQ ID NO: 2528314 - DNA, 21 bp, Homo sapiens
cactgcttttggtctgtgtga

SEQ ID NO: 2528315 - DNA, 13 bp, Homo sapiens
cactggaactcag

SEQ ID NO: 2528316 - DNA, 15 bp, Homo sapiens
cactggagcccagga

SEQ ID NO: 2528317 - DNA, 16 bp, Homo sapiens
cactggaggagagaag

SEQ ID NO: 2528318 - DNA, 18 bp, Homo sapiens
cactggagtgcagggagg

SEQ ID NO: 2528319 - DNA, 20 bp, Homo sapiens
cactggagtgcagggaggag

SEQ ID NO: 2528320 - DNA, 23 bp, Homo sapiens
cactggatgcaaagaaaatcaga

SEQ ID NO: 2528321 - DNA, 15 bp, Homo sapiens
cactggatgcagaaa

SEQ ID NO: 2528322 - DNA, 16 bp, Homo sapiens
cactggcaatgaaaaa

SEQ ID NO: 2528323 - DNA, 22 bp, Homo sapiens
cactggcattgtccctgtgcct

SEQ ID NO: 2528324 - DNA, 17 bp, Homo sapiens
cactggccacagttgtt

SEQ ID NO: 2528325 - DNA, 17 bp, Homo sapiens
cactggccaccaggctg

SEQ ID NO: 2528326 - DNA, 13 bp, Homo sapiens
cactggcccctca

SEQ ID NO: 2528327 - DNA, 24 bp, Homo sapiens
cactggcccctcaaatcgtccagc

SEQ ID NO: 2528328 - DNA, 12 bp, Homo sapiens
cactggctctcc

SEQ ID NO: 2528329 - DNA, 14 bp, Homo sapiens
cactggctctccaa

SEQ ID NO: 2528330 - DNA, 15 bp, Homo sapiens
cactggctctccaag

SEQ ID NO: 2528331 - DNA, 17 bp, Homo sapiens
cactggctctctccagg

SEQ ID NO: 2528332 - DNA, 22 bp, Homo sapiens
cactgggatgagccgctgtgag

SEQ ID NO: 2528333 - DNA, 13 bp, Homo sapiens
cactgggcttcta

SEQ ID NO: 2528334 - DNA, 22 bp, Homo sapiens
cactggggagcccgtctcagtg

SEQ ID NO: 2528335 - DNA, 16 bp, Homo sapiens
cactggggctggcaca

SEQ ID NO: 2528336 - DNA, 21 bp, Homo sapiens
cactgggggaggggacattga

SEQ ID NO: 2528337 - DNA, 19 bp, Homo sapiens
cactggggtcctggggcct

SEQ ID NO: 2528338 - DNA, 15 bp, Homo sapiens
cactgggtggggtga

SEQ ID NO: 2528339 - DNA, 15 bp, Homo sapiens
cactgggttgacttt

SEQ ID NO: 2528340 - DNA, 20 bp, Homo sapiens
cactggtagaccaaaataaa

SEQ ID NO: 2528341 - DNA, 19 bp, Homo sapiens
cactggtattcctgcctcc

SEQ ID NO: 2528342 - DNA, 19 bp, Homo sapiens
cactggtgtgacctgaggg

SEQ ID NO: 2528343 - DNA, 16 bp, Homo sapiens
cactgtaaaatgaaat

SEQ ID NO: 2528344 - DNA, 18 bp, Homo sapiens
cactgtaaaatgaaatta

SEQ ID NO: 2528345 - DNA, 22 bp, Homo sapiens
cactgtagtaaatggcaattct

SEQ ID NO: 2528346 - DNA, 16 bp, Homo sapiens
cactgtataaatagga

SEQ ID NO: 2528347 - DNA, 17 bp, Homo sapiens
cactgtataaataggag

SEQ ID NO: 2528348 - DNA, 21 bp, Homo sapiens
cactgtataaataggagagga

SEQ ID NO: 2528349 - DNA, 20 bp, Homo sapiens
cactgtcaccctccacctct

SEQ ID NO: 2528350 - DNA, 22 bp, Homo sapiens
cactgtcactgtttctctgctg

SEQ ID NO: 2528351 - DNA, 13 bp, Homo sapiens
cactgtcactttg

SEQ ID NO: 2528352 - DNA, 18 bp, Homo sapiens
cactgtccctcaaatgac

SEQ ID NO: 2528353 - DNA, 23 bp, Homo sapiens
cactgtccctcaaatgacccaaa

SEQ ID NO: 2528354 - DNA, 18 bp, Homo sapiens
cactgtcctccaagccag

SEQ ID NO: 2528355 - DNA, 12 bp, Homo sapiens
cactgtcctggg

SEQ ID NO: 2528356 - DNA, 21 bp, Homo sapiens
cactgtcctgggcgccctgga

SEQ ID NO: 2528357 - DNA, 23 bp, Homo sapiens
cactgtcctgggcgccctggaag

SEQ ID NO: 2528358 - DNA, 11 bp, Homo sapiens
cactgtctgag

SEQ ID NO: 2528359 - DNA, 18 bp, Homo sapiens
cactgtctgagagtttag

SEQ ID NO: 2528360 - DNA, 23 bp, Homo sapiens
cactgtctgagagtttagttgta

SEQ ID NO: 2528361 - DNA, 13 bp, Homo sapiens
cactgtgaagaga

SEQ ID NO: 2528362 - DNA, 14 bp, Homo sapiens
cactgtgccatgtg

SEQ ID NO: 2528363 - DNA, 23 bp, Homo sapiens
cactgtggacttggtcaccagct

SEQ ID NO: 2528364 - DNA, 20 bp, Homo sapiens
cactgtgggaaggccagctg

SEQ ID NO: 2528365 - DNA, 16 bp, Homo sapiens
cactgtgggactcttc

SEQ ID NO: 2528366 - DNA, 15 bp, Homo sapiens
cactgtggtgtctgt

SEQ ID NO: 2528367 - DNA, 23 bp, Homo sapiens
cactgttactttcgtacattggc

SEQ ID NO: 2528368 - DNA, 15 bp, Homo sapiens
cactgttatcaaaac

SEQ ID NO: 2528369 - DNA, 17 bp, Homo sapiens
cactgttccccctgtgc

SEQ ID NO: 2528370 - DNA, 16 bp, Homo sapiens
cactgttccctctgct

SEQ ID NO: 2528371 - DNA, 16 bp, Homo sapiens
cactgttctctgccct

SEQ ID NO: 2528372 - DNA, 17 bp, Homo sapiens
cactgttgaaaattatt

SEQ ID NO: 2528373 - DNA, 17 bp, Homo sapiens
cactgttgaattttctc

SEQ ID NO: 2528374 - DNA, 11 bp, Homo sapiens
cactgtttaag

SEQ ID NO: 2528375 - DNA, 14 bp, Homo sapiens
cactgtttctctgc

SEQ ID NO: 2528376 - DNA, 18 bp, Homo sapiens
cactgtttctctgctgtt

SEQ ID NO: 2528377 - DNA, 18 bp, Homo sapiens
cacttacctagatttaca

SEQ ID NO: 2528378 - DNA, 22 bp, Homo sapiens
cacttatatgttctaattaata

SEQ ID NO: 2528379 - DNA, 20 bp, Homo sapiens
cacttattccccattcttcc

SEQ ID NO: 2528380 - DNA, 17 bp, Homo sapiens
cacttattctcaagaag

SEQ ID NO: 2528381 - DNA, 15 bp, Homo sapiens
cacttcataatccag

SEQ ID NO: 2528382 - DNA, 19 bp, Homo sapiens
cacttccaccagcctgcac

SEQ ID NO: 2528383 - DNA, 16 bp, Homo sapiens
cacttccctacatgga

SEQ ID NO: 2528384 - DNA, 23 bp, Homo sapiens
cacttcctacaagagcagcctgt

SEQ ID NO: 2528385 - DNA, 17 bp, Homo sapiens
cacttcctgtccagaga

SEQ ID NO: 2528386 - DNA, 23 bp, Homo sapiens
cacttcgggaggtcgaggcagga

SEQ ID NO: 2528387 - DNA, 22 bp, Homo sapiens
cacttctgccatattctgttgg

SEQ ID NO: 2528388 - DNA, 18 bp, Homo sapiens
cacttctgggcttcatct

SEQ ID NO: 2528389 - DNA, 16 bp, Homo sapiens
cacttgatgtgccatt

SEQ ID NO: 2528390 - DNA, 18 bp, Homo sapiens
cacttgcagactctacag

SEQ ID NO: 2528391 - DNA, 19 bp, Homo sapiens
cacttgcagactctacaga

SEQ ID NO: 2528392 - DNA, 13 bp, Homo sapiens
cacttgcatctgt

SEQ ID NO: 2528393 - DNA, 18 bp, Homo sapiens
cacttggactcttgctct

SEQ ID NO: 2528394 - DNA, 14 bp, Homo sapiens
cacttggcagcgcg

SEQ ID NO: 2528395 - DNA, 12 bp, Homo sapiens
cacttgtacaaa

SEQ ID NO: 2528396 - DNA, 16 bp, Homo sapiens
cacttgtatatacgca

SEQ ID NO: 2528397 - DNA, 22 bp, Homo sapiens
cacttgtgccaacactcaagaa

SEQ ID NO: 2528398 - DNA, 24 bp, Homo sapiens
cacttgtgccaacactcaagaagc

SEQ ID NO: 2528399 - DNA, 14 bp, Homo sapiens
cacttgtgtgtggg

SEQ ID NO: 2528400 - DNA, 17 bp, Homo sapiens
cacttgtgtgtgggctg

SEQ ID NO: 2528401 - DNA, 18 bp, Homo sapiens
cacttgtgttatgaagca

SEQ ID NO: 2528402 - DNA, 13 bp, Homo sapiens
cacttgttccagc

SEQ ID NO: 2528403 - DNA, 16 bp, Homo sapiens
cacttgttccagctct

SEQ ID NO: 2528404 - DNA, 20 bp, Homo sapiens
cactttaattctcatgtgat

SEQ ID NO: 2528405 - DNA, 22 bp, Homo sapiens
cactttaattctcatgtgatcc

SEQ ID NO: 2528406 - DNA, 17 bp, Homo sapiens
cactttcacatagatgt

SEQ ID NO: 2528407 - DNA, 17 bp, Homo sapiens
cactttcagtgaaagca

SEQ ID NO: 2528408 - DNA, 15 bp, Homo sapiens
cactttcctcctggc

SEQ ID NO: 2528409 - DNA, 16 bp, Homo sapiens
cactttctatagcaga

SEQ ID NO: 2528410 - DNA, 20 bp, Homo sapiens
cactttctatcctctgtaaa

SEQ ID NO: 2528411 - DNA, 19 bp, Homo sapiens
cactttctcagttttcata

SEQ ID NO: 2528412 - DNA, 13 bp, Homo sapiens
cactttgggaggc

SEQ ID NO: 2528413 - DNA, 19 bp, Homo sapiens
cactttgggaggccaagga

SEQ ID NO: 2528414 - DNA, 14 bp, Homo sapiens
cactttgttctggc

SEQ ID NO: 2528415 - DNA, 12 bp, Homo sapiens
cactttgttctt

SEQ ID NO: 2528416 - DNA, 16 bp, Homo sapiens
cacttttcctccctca

SEQ ID NO: 2528417 - DNA, 12 bp, Homo sapiens
cacttttctcca

SEQ ID NO: 2528418 - DNA, 22 bp, Homo sapiens
cacttttggttaagtctgtttt

SEQ ID NO: 2528419 - DNA, 19 bp, Homo sapiens
cactttttcatttgcctat

SEQ ID NO: 2528420 - DNA, 12 bp, Homo sapiens
cacttttttcca

SEQ ID NO: 2528421 - DNA, 14 bp, Homo sapiens
cactttttttttcc

SEQ ID NO: 2528422 - DNA, 19 bp, Homo sapiens
cagaaaaacgtgttgcctt

SEQ ID NO: 2528423 - DNA, 14 bp, Homo sapiens
cagaaaaggacaga

SEQ ID NO: 2528424 - DNA, 18 bp, Homo sapiens
cagaaaagggaagttgtg

SEQ ID NO: 2528425 - DNA, 12 bp, Homo sapiens
cagaaaatatac

SEQ ID NO: 2528426 - DNA, 13 bp, Homo sapiens
cagaaaatatact

SEQ ID NO: 2528427 - DNA, 19 bp, Homo sapiens
cagaaaatatactgtaaag

SEQ ID NO: 2528428 - DNA, 20 bp, Homo sapiens
cagaaaatatactgtaaaga

SEQ ID NO: 2528429 - DNA, 20 bp, Homo sapiens
cagaaacaccctcacactgg

SEQ ID NO: 2528430 - DNA, 15 bp, Homo sapiens
cagaaacagtgagtt

SEQ ID NO: 2528431 - DNA, 17 bp, Homo sapiens
cagaaacatcagttact

SEQ ID NO: 2528432 - DNA, 13 bp, Homo sapiens
cagaaaccagtta

SEQ ID NO: 2528433 - DNA, 15 bp, Homo sapiens
cagaaaggttctgcc

SEQ ID NO: 2528434 - DNA, 22 bp, Homo sapiens
cagaaagtggccatgccaccct

SEQ ID NO: 2528435 - DNA, 20 bp, Homo sapiens
cagaaataaagttggtgaca

SEQ ID NO: 2528436 - DNA, 19 bp, Homo sapiens
cagaaatacatatttccaa

SEQ ID NO: 2528437 - DNA, 23 bp, Homo sapiens
cagaaataccaaaattatttcag

SEQ ID NO: 2528438 - DNA, 15 bp, Homo sapiens
cagaaatatgtggtt

SEQ ID NO: 2528439 - DNA, 20 bp, Homo sapiens
cagaaatcagtaatatttat

SEQ ID NO: 2528440 - DNA, 14 bp, Homo sapiens
cagaaatccatcta

SEQ ID NO: 2528441 - DNA, 14 bp, Homo sapiens
cagaaatgctgcct

SEQ ID NO: 2528442 - DNA, 19 bp, Homo sapiens
cagaaatgctgcctgcctg

SEQ ID NO: 2528443 - DNA, 20 bp, Homo sapiens
cagaaatgctgcctgcctgt

SEQ ID NO: 2528444 - DNA, 23 bp, Homo sapiens
cagaaatgctgcctgcctgtctg

SEQ ID NO: 2528445 - DNA, 17 bp, Homo sapiens
cagaaatgtgttatcac

SEQ ID NO: 2528446 - DNA, 23 bp, Homo sapiens
cagaaattagaaaccttaatatg

SEQ ID NO: 2528447 - DNA, 20 bp, Homo sapiens
cagaaattggaacagaatgt

SEQ ID NO: 2528448 - DNA, 21 bp, Homo sapiens
cagaaattggaacagaatgtt

SEQ ID NO: 2528449 - DNA, 18 bp, Homo sapiens
cagaaatttttatttttc

SEQ ID NO: 2528450 - DNA, 21 bp, Homo sapiens
cagaacagcagaggttctttt

SEQ ID NO: 2528451 - DNA, 12 bp, Homo sapiens
cagaacagtgat

SEQ ID NO: 2528452 - DNA, 17 bp, Homo sapiens
cagaacagtgattacca

SEQ ID NO: 2528453 - DNA, 16 bp, Homo sapiens
cagaacagtttgtaca

SEQ ID NO: 2528454 - DNA, 12 bp, Homo sapiens
cagaacctcttc

SEQ ID NO: 2528455 - DNA, 12 bp, Homo sapiens
cagaacctggag

SEQ ID NO: 2528456 - DNA, 21 bp, Homo sapiens
cagaacctggagggctagaac

SEQ ID NO: 2528457 - DNA, 15 bp, Homo sapiens
cagaactgagctcct

SEQ ID NO: 2528458 - DNA, 24 bp, Homo sapiens
cagaactgagctcctctgggcagg

SEQ ID NO: 2528459 - DNA, 13 bp, Homo sapiens
cagaactggactc

SEQ ID NO: 2528460 - DNA, 11 bp, Homo sapiens
cagaagaaaga

SEQ ID NO: 2528461 - DNA, 15 bp, Homo sapiens
cagaagaatattcag

SEQ ID NO: 2528462 - DNA, 17 bp, Homo sapiens
cagaagacaccagagca

SEQ ID NO: 2528463 - DNA, 20 bp, Homo sapiens
cagaagacaccagagcagat

SEQ ID NO: 2528464 - DNA, 19 bp, Homo sapiens
cagaagatcccctcaggac

SEQ ID NO: 2528465 - DNA, 19 bp, Homo sapiens
cagaagcaacccaaatgtt

SEQ ID NO: 2528466 - DNA, 16 bp, Homo sapiens
cagaagcaggctggag

SEQ ID NO: 2528467 - DNA, 17 bp, Homo sapiens
cagaagccaggagcaaa

SEQ ID NO: 2528468 - DNA, 20 bp, Homo sapiens
cagaagcctcactgcaagca

SEQ ID NO: 2528469 - DNA, 15 bp, Homo sapiens
cagaagcctctggct

SEQ ID NO: 2528470 - DNA, 19 bp, Homo sapiens
cagaagctgagcaccaggg

SEQ ID NO: 2528471 - DNA, 16 bp, Homo sapiens
cagaagcttctgccca

SEQ ID NO: 2528472 - DNA, 13 bp, Homo sapiens
cagaaggccaaga

SEQ ID NO: 2528473 - DNA, 18 bp, Homo sapiens
cagaaggccaagaggctg

SEQ ID NO: 2528474 - DNA, 14 bp, Homo sapiens
cagaagggggccat

SEQ ID NO: 2528475 - DNA, 15 bp, Homo sapiens
cagaagggggccatg

SEQ ID NO: 2528476 - DNA, 16 bp, Homo sapiens
cagaaggttgtgatga

SEQ ID NO: 2528477 - DNA, 19 bp, Homo sapiens
cagaagtcatgaagcccaa

SEQ ID NO: 2528478 - DNA, 16 bp, Homo sapiens
cagaagtggagctggg

SEQ ID NO: 2528479 - DNA, 15 bp, Homo sapiens
cagaataagttattg

SEQ ID NO: 2528480 - DNA, 23 bp, Homo sapiens
cagaataagttattgcagtttat

SEQ ID NO: 2528481 - DNA, 23 bp, Homo sapiens
cagaataatgaatggactcaaac

SEQ ID NO: 2528482 - DNA, 15 bp, Homo sapiens
cagaatatctgggat

SEQ ID NO: 2528483 - DNA, 15 bp, Homo sapiens
cagaatcctggccct

SEQ ID NO: 2528484 - DNA, 16 bp, Homo sapiens
cagaatgagtgcttca

SEQ ID NO: 2528485 - DNA, 18 bp, Homo sapiens
cagaatggggtgcatgaa

SEQ ID NO: 2528486 - DNA, 20 bp, Homo sapiens
cagaatgttttactgtgaaa

SEQ ID NO: 2528487 - DNA, 17 bp, Homo sapiens
cagaatgtttttaaaat

SEQ ID NO: 2528488 - DNA, 11 bp, Homo sapiens
cagaattctca

SEQ ID NO: 2528489 - DNA, 21 bp, Homo sapiens
cagacaaagtaattcctctca

SEQ ID NO: 2528490 - DNA, 22 bp, Homo sapiens
cagacaaatgtggttacacact

SEQ ID NO: 2528491 - DNA, 13 bp, Homo sapiens
cagacaacagaag

SEQ ID NO: 2528492 - DNA, 17 bp, Homo sapiens
cagacaacagaagtcat

SEQ ID NO: 2528493 - DNA, 14 bp, Homo sapiens
cagacacacacaca

SEQ ID NO: 2528494 - DNA, 15 bp, Homo sapiens
cagacacacacacgc

SEQ ID NO: 2528495 - DNA, 21 bp, Homo sapiens
cagacacacacacgcacgcac

SEQ ID NO: 2528496 - DNA, 22 bp, Homo sapiens
cagacacacacacgcacgcaca

SEQ ID NO: 2528497 - DNA, 17 bp, Homo sapiens
cagacacaggcccggct

SEQ ID NO: 2528498 - DNA, 18 bp, Homo sapiens
cagacacaggcccggctc

SEQ ID NO: 2528499 - DNA, 14 bp, Homo sapiens
cagacacatgtcca

SEQ ID NO: 2528500 - DNA, 19 bp, Homo sapiens
cagacaccttgacagggca

SEQ ID NO: 2528501 - DNA, 12 bp, Homo sapiens
cagacactaagt

SEQ ID NO: 2528502 - DNA, 16 bp, Homo sapiens
cagacagacacacaca

SEQ ID NO: 2528503 - DNA, 21 bp, Homo sapiens
cagacagatggaaaagggaga

SEQ ID NO: 2528504 - DNA, 21 bp, Homo sapiens
cagacagcaacggggaggcca

SEQ ID NO: 2528505 - DNA, 18 bp, Homo sapiens
cagacagcagctcaggca

SEQ ID NO: 2528506 - DNA, 19 bp, Homo sapiens
cagacagcagctcaggcac

SEQ ID NO: 2528507 - DNA, 13 bp, Homo sapiens
cagacagctgcct

SEQ ID NO: 2528508 - DNA, 17 bp, Homo sapiens
cagacagctgcctggga

SEQ ID NO: 2528509 - DNA, 18 bp, Homo sapiens
cagacagctgcctgggat

SEQ ID NO: 2528510 - DNA, 16 bp, Homo sapiens
cagacaggaccaggga

SEQ ID NO: 2528511 - DNA, 17 bp, Homo sapiens
cagacatagaattaaca

SEQ ID NO: 2528512 - DNA, 22 bp, Homo sapiens
cagacatccatgtttgtaaaac

SEQ ID NO: 2528513 - DNA, 13 bp, Homo sapiens
cagaccaccccgc

SEQ ID NO: 2528514 - DNA, 15 bp, Homo sapiens
cagaccaccccgcct

SEQ ID NO: 2528515 - DNA, 19 bp, Homo sapiens
cagaccaccccgcctgccc

SEQ ID NO: 2528516 - DNA, 13 bp, Homo sapiens
cagaccagctctt

SEQ ID NO: 2528517 - DNA, 23 bp, Homo sapiens
cagacccccaccccttccccact

SEQ ID NO: 2528518 - DNA, 16 bp, Homo sapiens
cagacccctctggcca

SEQ ID NO: 2528519 - DNA, 18 bp, Homo sapiens
cagacccctctggccagg

SEQ ID NO: 2528520 - DNA, 16 bp, Homo sapiens
cagaccccttcagcca

SEQ ID NO: 2528521 - DNA, 12 bp, Homo sapiens
cagacccggctg

SEQ ID NO: 2528522 - DNA, 16 bp, Homo sapiens
cagacccggctgcgtg

SEQ ID NO: 2528523 - DNA, 15 bp, Homo sapiens
cagaccctgccctgt

SEQ ID NO: 2528524 - DNA, 17 bp, Homo sapiens
cagaccctgccctgtgg

SEQ ID NO: 2528525 - DNA, 21 bp, Homo sapiens
cagaccctgccctgtgggccc

SEQ ID NO: 2528526 - DNA, 22 bp, Homo sapiens
cagaccctgccctgtgggcccc

SEQ ID NO: 2528527 - DNA, 15 bp, Homo sapiens
cagacctggagcccc

SEQ ID NO: 2528528 - DNA, 19 bp, Homo sapiens
cagacctggagcccctggg

SEQ ID NO: 2528529 - DNA, 20 bp, Homo sapiens
cagacctggagcccctgggt

SEQ ID NO: 2528530 - DNA, 13 bp, Homo sapiens
cagacctgtcctc

SEQ ID NO: 2528531 - DNA, 20 bp, Homo sapiens
cagacgtatgcttattttaa

SEQ ID NO: 2528532 - DNA, 23 bp, Homo sapiens
cagactcaaatgctcagaccagc

SEQ ID NO: 2528533 - DNA, 14 bp, Homo sapiens
cagactcctgagga

SEQ ID NO: 2528534 - DNA, 21 bp, Homo sapiens
cagactcctgtgcaactttcc

SEQ ID NO: 2528535 - DNA, 22 bp, Homo sapiens
cagactcgattcatattgaata

SEQ ID NO: 2528536 - DNA, 20 bp, Homo sapiens
cagactgaacttaccgtgag

SEQ ID NO: 2528537 - DNA, 13 bp, Homo sapiens
cagactgctggga

SEQ ID NO: 2528538 - DNA, 15 bp, Homo sapiens
cagactgctgggact

SEQ ID NO: 2528539 - DNA, 14 bp, Homo sapiens
cagactggaagcac

SEQ ID NO: 2528540 - DNA, 20 bp, Homo sapiens
cagactggaagcacagcttc

SEQ ID NO: 2528541 - DNA, 18 bp, Homo sapiens
cagactggcacagttttc

SEQ ID NO: 2528542 - DNA, 23 bp, Homo sapiens
cagactggcacagttttctgaga

SEQ ID NO: 2528543 - DNA, 22 bp, Homo sapiens
cagactgtgtaaaaagagagct

SEQ ID NO: 2528544 - DNA, 21 bp, Homo sapiens
cagacttccctgaatgtattg

SEQ ID NO: 2528545 - DNA, 13 bp, Homo sapiens
cagacttctccag

SEQ ID NO: 2528546 - DNA, 14 bp, Homo sapiens
cagacttctccaga

SEQ ID NO: 2528547 - DNA, 20 bp, Homo sapiens
cagacttctccagacccacc

SEQ ID NO: 2528548 - DNA, 15 bp, Homo sapiens
cagactttaaagaat

SEQ ID NO: 2528549 - DNA, 22 bp, Homo sapiens
cagactttggaaaatgcattgt

SEQ ID NO: 2528550 - DNA, 19 bp, Homo sapiens
cagagaaagaagagacagg

SEQ ID NO: 2528551 - DNA, 22 bp, Homo sapiens
cagagaaagaagagacaggagg

SEQ ID NO: 2528552 - DNA, 23 bp, Homo sapiens
cagagaaagaagagacaggaggg

SEQ ID NO: 2528553 - DNA, 17 bp, Homo sapiens
cagagaaagaggaagct

SEQ ID NO: 2528554 - DNA, 18 bp, Homo sapiens
cagagaaagaggaagctt

SEQ ID NO: 2528555 - DNA, 17 bp, Homo sapiens
cagagaagccccttccc

SEQ ID NO: 2528556 - DNA, 24 bp, Homo sapiens
cagagaagccccttccccatggga

SEQ ID NO: 2528557 - DNA, 13 bp, Homo sapiens
cagagaagtgaca

SEQ ID NO: 2528558 - DNA, 17 bp, Homo sapiens
cagagaagtgacaggga

SEQ ID NO: 2528559 - DNA, 19 bp, Homo sapiens
cagagaagtgacagggaag

SEQ ID NO: 2528560 - DNA, 22 bp, Homo sapiens
cagagaagtgacagggaagcta

SEQ ID NO: 2528561 - DNA, 21 bp, Homo sapiens
cagagaatgaaagggcccaga

SEQ ID NO: 2528562 - DNA, 13 bp, Homo sapiens
cagagaatttcta

SEQ ID NO: 2528563 - DNA, 15 bp, Homo sapiens
cagagaatttctacc

SEQ ID NO: 2528564 - DNA, 16 bp, Homo sapiens
cagagaatttctacca

SEQ ID NO: 2528565 - DNA, 19 bp, Homo sapiens
cagagacaggcccaagaga

SEQ ID NO: 2528566 - DNA, 23 bp, Homo sapiens
cagagacaggcccaagagatgaa

SEQ ID NO: 2528567 - DNA, 13 bp, Homo sapiens
cagagaccatccc

SEQ ID NO: 2528568 - DNA, 16 bp, Homo sapiens
cagagaccatccctga

SEQ ID NO: 2528569 - DNA, 18 bp, Homo sapiens
cagagaccatccctgaag

SEQ ID NO: 2528570 - DNA, 19 bp, Homo sapiens
cagagactcagggccccag

SEQ ID NO: 2528571 - DNA, 21 bp, Homo sapiens
cagagactcagggccccagca

SEQ ID NO: 2528572 - DNA, 23 bp, Homo sapiens
cagagactcagggccccagcact

SEQ ID NO: 2528573 - DNA, 14 bp, Homo sapiens
cagagactcctgca

SEQ ID NO: 2528574 - DNA, 20 bp, Homo sapiens
cagagactcctgcaggcagc

SEQ ID NO: 2528575 - DNA, 23 bp, Homo sapiens
cagagactcctgcaggcagccag

SEQ ID NO: 2528576 - DNA, 15 bp, Homo sapiens
cagagacttgggaca

SEQ ID NO: 2528577 - DNA, 18 bp, Homo sapiens
cagagacttgggacattg

SEQ ID NO: 2528578 - DNA, 20 bp, Homo sapiens
cagagacttgggacattgcc

SEQ ID NO: 2528579 - DNA, 24 bp, Homo sapiens
cagagagagaagtgcccctgctgc

SEQ ID NO: 2528580 - DNA, 15 bp, Homo sapiens
cagagagccattttg

SEQ ID NO: 2528581 - DNA, 12 bp, Homo sapiens
cagagagctggt

SEQ ID NO: 2528582 - DNA, 17 bp, Homo sapiens
cagagaggagaaacaca

SEQ ID NO: 2528583 - DNA, 21 bp, Homo sapiens
cagagaggagaaacacatctt

SEQ ID NO: 2528584 - DNA, 17 bp, Homo sapiens
cagagaggagtcagaga

SEQ ID NO: 2528585 - DNA, 18 bp, Homo sapiens
cagagaggccaggtgcag

SEQ ID NO: 2528586 - DNA, 13 bp, Homo sapiens
cagagagggcagg

SEQ ID NO: 2528587 - DNA, 16 bp, Homo sapiens
cagagagggcaggcat

SEQ ID NO: 2528588 - DNA, 13 bp, Homo sapiens
cagctcaagtctt

SEQ ID NO: 2528589 - DNA, 13 bp, Homo sapiens
cagctcaccagcc

SEQ ID NO: 2528590 - DNA, 14 bp, Homo sapiens
cagctcaccagccc

SEQ ID NO: 2528591 - DNA, 15 bp, Homo sapiens
cagctcaccagcccc

SEQ ID NO: 2528592 - DNA, 20 bp, Homo sapiens
cagctcaccccccacactca

SEQ ID NO: 2528593 - DNA, 19 bp, Homo sapiens
cagctcacctctcccttgg

SEQ ID NO: 2528594 - DNA, 19 bp, Homo sapiens
cagctcagagagggtggga

SEQ ID NO: 2528595 - DNA, 12 bp, Homo sapiens
cagctcagtccc

SEQ ID NO: 2528596 - DNA, 18 bp, Homo sapiens
cagctcagtcccatcaga

SEQ ID NO: 2528597 - DNA, 17 bp, Homo sapiens
cagctcatgcccccttt

SEQ ID NO: 2528598 - DNA, 18 bp, Homo sapiens
cagctccaagacctgttg

SEQ ID NO: 2528599 - DNA, 20 bp, Homo sapiens
cagctccagctcaccagccc

SEQ ID NO: 2528600 - DNA, 21 bp, Homo sapiens
cagctcccaaggctctgagca

SEQ ID NO: 2528601 - DNA, 18 bp, Homo sapiens
cagctcccctcggagaag

SEQ ID NO: 2528602 - DNA, 20 bp, Homo sapiens
cagctcccctcggagaagag

SEQ ID NO: 2528603 - DNA, 21 bp, Homo sapiens
cagctcccctcggagaagagc

SEQ ID NO: 2528604 - DNA, 20 bp, Homo sapiens
cagctccctaggagaccaag

SEQ ID NO: 2528605 - DNA, 14 bp, Homo sapiens
cagctccctctgcc

SEQ ID NO: 2528606 - DNA, 19 bp, Homo sapiens
cagctcctaacccttatca

SEQ ID NO: 2528607 - DNA, 19 bp, Homo sapiens
cagctcctcatccagggct

SEQ ID NO: 2528608 - DNA, 20 bp, Homo sapiens
cagctcctcatccagggctc

SEQ ID NO: 2528609 - DNA, 16 bp, Homo sapiens
cagctccttcctggag

SEQ ID NO: 2528610 - DNA, 17 bp, Homo sapiens
cagctctagacaaccct

SEQ ID NO: 2528611 - DNA, 20 bp, Homo sapiens
cagctctagacaaccctgca

SEQ ID NO: 2528612 - DNA, 11 bp, Homo sapiens
cagctctccag

SEQ ID NO: 2528613 - DNA, 18 bp, Homo sapiens
cagctctgaaaccagtgt

SEQ ID NO: 2528614 - DNA, 15 bp, Homo sapiens
cagctctgcaagaat

SEQ ID NO: 2528615 - DNA, 14 bp, Homo sapiens
cagctctggcttcc

SEQ ID NO: 2528616 - DNA, 13 bp, Homo sapiens
cagctctggtcca

SEQ ID NO: 2528617 - DNA, 12 bp, Homo sapiens
cagctctgtcct

SEQ ID NO: 2528618 - DNA, 17 bp, Homo sapiens
cagctctgtcctgggag

SEQ ID NO: 2528619 - DNA, 18 bp, Homo sapiens
cagctcttctccccaggt

SEQ ID NO: 2528620 - DNA, 16 bp, Homo sapiens
cagctcttgcccttcc

SEQ ID NO: 2528621 - DNA, 20 bp, Homo sapiens
cagctcttgctaatcagtgt

SEQ ID NO: 2528622 - DNA, 21 bp, Homo sapiens
cagctcttgctaatcagtgtc

SEQ ID NO: 2528623 - DNA, 23 bp, Homo sapiens
cagctcttgctaatcagtgtctc

SEQ ID NO: 2528624 - DNA, 15 bp, Homo sapiens
cagctgaaatactga

SEQ ID NO: 2528625 - DNA, 15 bp, Homo sapiens
cagctgaacagccaa

SEQ ID NO: 2528626 - DNA, 17 bp, Homo sapiens
cagctgacctctgttgt

SEQ ID NO: 2528627 - DNA, 21 bp, Homo sapiens
cagctgacttttctgtccgag

SEQ ID NO: 2528628 - DNA, 19 bp, Homo sapiens
cagctgaggtctcttgagg

SEQ ID NO: 2528629 - DNA, 20 bp, Homo sapiens
cagctgaggtctcttgaggg

SEQ ID NO: 2528630 - DNA, 23 bp, Homo sapiens
cagctgatacaaattgcagactg

SEQ ID NO: 2528631 - DNA, 20 bp, Homo sapiens
cagctgattttaacaataac

SEQ ID NO: 2528632 - DNA, 16 bp, Homo sapiens
cagctgcacctgccag

SEQ ID NO: 2528633 - DNA, 17 bp, Homo sapiens
cagctgcacctgccagc

SEQ ID NO: 2528634 - DNA, 21 bp, Homo sapiens
cagctgcacctgccagcctgg

SEQ ID NO: 2528635 - DNA, 14 bp, Homo sapiens
cagctgcctcactt

SEQ ID NO: 2528636 - DNA, 13 bp, Homo sapiens
cagctgcctcttc

SEQ ID NO: 2528637 - DNA, 23 bp, Homo sapiens
cagctgcctgggatccctcatcc

SEQ ID NO: 2528638 - DNA, 21 bp, Homo sapiens
cagctgcggtccacccaggag

SEQ ID NO: 2528639 - DNA, 18 bp, Homo sapiens
cagctgctggagactcct

SEQ ID NO: 2528640 - DNA, 22 bp, Homo sapiens
cagctggaaaagggtcttggga

SEQ ID NO: 2528641 - DNA, 14 bp, Homo sapiens
cagctggcagcaga

SEQ ID NO: 2528642 - DNA, 18 bp, Homo sapiens
cagctggcagcagagtgt

SEQ ID NO: 2528643 - DNA, 18 bp, Homo sapiens
cagctggcccgtgacaga

SEQ ID NO: 2528644 - DNA, 22 bp, Homo sapiens
cagctgggaggcaagaggggtg

SEQ ID NO: 2528645 - DNA, 23 bp, Homo sapiens
cagctgggaggcaagaggggtgg

SEQ ID NO: 2528646 - DNA, 11 bp, Homo sapiens
cagctgggctc

SEQ ID NO: 2528647 - DNA, 14 bp, Homo sapiens
cagctgggctctgc

SEQ ID NO: 2528648 - DNA, 16 bp, Homo sapiens
cagctgggctctgcaa

SEQ ID NO: 2528649 - DNA, 18 bp, Homo sapiens
cagctgggctctgccacc

SEQ ID NO: 2528650 - DNA, 21 bp, Homo sapiens
cagctggggcgtggggagggc

SEQ ID NO: 2528651 - DNA, 17 bp, Homo sapiens
cagctgggtggcactgc

SEQ ID NO: 2528652 - DNA, 19 bp, Homo sapiens
cagctgggtggcactgcca

SEQ ID NO: 2528653 - DNA, 20 bp, Homo sapiens
cagctgggtggcactgccat

SEQ ID NO: 2528654 - DNA, 21 bp, Homo sapiens
cagctgggtggcactgccatg

SEQ ID NO: 2528655 - DNA, 22 bp, Homo sapiens
cagctgggtggcactgccatgc

SEQ ID NO: 2528656 - DNA, 18 bp, Homo sapiens
cagctgtaacacagctga

SEQ ID NO: 2528657 - DNA, 20 bp, Homo sapiens
cagctgtaagaagagactgg

SEQ ID NO: 2528658 - DNA, 24 bp, Homo sapiens
cagctgtgctctggacaggcatgt

SEQ ID NO: 2528659 - DNA, 15 bp, Homo sapiens
cagctgtttgtcata

SEQ ID NO: 2528660 - DNA, 17 bp, Homo sapiens
cagcttaggggctgctg

SEQ ID NO: 2528661 - DNA, 13 bp, Homo sapiens
cagcttcaccaga

SEQ ID NO: 2528662 - DNA, 15 bp, Homo sapiens
cagcttcagccagga

SEQ ID NO: 2528663 - DNA, 17 bp, Homo sapiens
cagcttcagccaggagc

SEQ ID NO: 2528664 - DNA, 18 bp, Homo sapiens
cagcttcccctctctcct

SEQ ID NO: 2528665 - DNA, 20 bp, Homo sapiens
cagcttcctacccacacctc

SEQ ID NO: 2528666 - DNA, 18 bp, Homo sapiens
cagcttctcatcctgcag

SEQ ID NO: 2528667 - DNA, 12 bp, Homo sapiens
cagcttctccag

SEQ ID NO: 2528668 - DNA, 13 bp, Homo sapiens
cagcttctccagg

SEQ ID NO: 2528669 - DNA, 14 bp, Homo sapiens
cagcttctccaggc

SEQ ID NO: 2528670 - DNA, 19 bp, Homo sapiens
cagcttgatcaaaggcaca

SEQ ID NO: 2528671 - DNA, 13 bp, Homo sapiens
cagcttgggccca

SEQ ID NO: 2528672 - DNA, 14 bp, Homo sapiens
cagcttgggcccag

SEQ ID NO: 2528673 - DNA, 16 bp, Homo sapiens
cagcttgggcccagct

SEQ ID NO: 2528674 - DNA, 18 bp, Homo sapiens
cagcttgggcccagctgg

SEQ ID NO: 2528675 - DNA, 22 bp, Homo sapiens
cagctttaaactcagggacaga

SEQ ID NO: 2528676 - DNA, 15 bp, Homo sapiens
cagctttacatgcaa

SEQ ID NO: 2528677 - DNA, 17 bp, Homo sapiens
cagctttcatgattagc

SEQ ID NO: 2528678 - DNA, 20 bp, Homo sapiens
cagctttcatgattagcaag

SEQ ID NO: 2528679 - DNA, 17 bp, Homo sapiens
cagctttccctgcctct

SEQ ID NO: 2528680 - DNA, 12 bp, Homo sapiens
cagctttgtttg

SEQ ID NO: 2528681 - DNA, 20 bp, Homo sapiens
cagcttttcccaaaagccca

SEQ ID NO: 2528682 - DNA, 13 bp, Homo sapiens
cagctttttgtct

SEQ ID NO: 2528683 - DNA, 19 bp, Homo sapiens
cagctttttgtcttttctg

SEQ ID NO: 2528684 - DNA, 15 bp, Homo sapiens
caggaaaagctgctg

SEQ ID NO: 2528685 - DNA, 23 bp, Homo sapiens
caggaaaattgtttgaacccagg

SEQ ID NO: 2528686 - DNA, 19 bp, Homo sapiens
caggaaaggaatcatttct

SEQ ID NO: 2528687 - DNA, 15 bp, Homo sapiens
caggaaaggctccag

SEQ ID NO: 2528688 - DNA, 16 bp, Homo sapiens
caggaaaggctccagg

SEQ ID NO: 2528689 - DNA, 19 bp, Homo sapiens
caggaaaggctccaggagc

SEQ ID NO: 2528690 - DNA, 23 bp, Homo sapiens
caggaaaggctccaggagcagcc

SEQ ID NO: 2528691 - DNA, 13 bp, Homo sapiens
caggaaataaagt

SEQ ID NO: 2528692 - DNA, 13 bp, Homo sapiens
caggaaatatata

SEQ ID NO: 2528693 - DNA, 21 bp, Homo sapiens
caggaaatgaaaatgtcttgt

SEQ ID NO: 2528694 - DNA, 12 bp, Homo sapiens
caggaacagaag

SEQ ID NO: 2528695 - DNA, 14 bp, Homo sapiens
caggaacagctatg

SEQ ID NO: 2528696 - DNA, 20 bp, Homo sapiens
caggaacagctatgggagcc

SEQ ID NO: 2528697 - DNA, 17 bp, Homo sapiens
caggaactcccagcaac

SEQ ID NO: 2528698 - DNA, 12 bp, Homo sapiens
caggaactgggc

SEQ ID NO: 2528699 - DNA, 21 bp, Homo sapiens
caggaagatgaaagaggaggt

SEQ ID NO: 2528700 - DNA, 23 bp, Homo sapiens
caggaagcaaactaagcccccgc

SEQ ID NO: 2528701 - DNA, 14 bp, Homo sapiens
caggaagcacccca

SEQ ID NO: 2528702 - DNA, 19 bp, Homo sapiens
caggaagcccccaagttga

SEQ ID NO: 2528703 - DNA, 12 bp, Homo sapiens
caggaagctcag

SEQ ID NO: 2528704 - DNA, 18 bp, Homo sapiens
caggaagctcagggcctg

SEQ ID NO: 2528705 - DNA, 21 bp, Homo sapiens
caggaagctcagggcctggct

SEQ ID NO: 2528706 - DNA, 22 bp, Homo sapiens
caggaagctcagggcctggctc

SEQ ID NO: 2528707 - DNA, 14 bp, Homo sapiens
caggaaggagagcc

SEQ ID NO: 2528708 - DNA, 16 bp, Homo sapiens
caggaaggagagcctg

SEQ ID NO: 2528709 - DNA, 21 bp, Homo sapiens
caggaagggcaggaaggagag

SEQ ID NO: 2528710 - DNA, 10 bp, Homo sapiens
caggaagtga

SEQ ID NO: 2528711 - DNA, 20 bp, Homo sapiens
caggaatgaagccttagcca

SEQ ID NO: 2528712 - DNA, 17 bp, Homo sapiens
caggacaatgtctgaac

SEQ ID NO: 2528713 - DNA, 16 bp, Homo sapiens
caggacagtgcttcag

SEQ ID NO: 2528714 - DNA, 17 bp, Homo sapiens
caggacatgctgaagcc

SEQ ID NO: 2528715 - DNA, 12 bp, Homo sapiens
caggacatttct

SEQ ID NO: 2528716 - DNA, 16 bp, Homo sapiens
caggaccagctggggc

SEQ ID NO: 2528717 - DNA, 13 bp, Homo sapiens
caggaccagggat

SEQ ID NO: 2528718 - DNA, 21 bp, Homo sapiens
caggaccagtcaacctgggca

SEQ ID NO: 2528719 - DNA, 20 bp, Homo sapiens
caggacccaccatgtctgcc

SEQ ID NO: 2528720 - DNA, 15 bp, Homo sapiens
caggacccagaggaa

SEQ ID NO: 2528721 - DNA, 14 bp, Homo sapiens
caggacccccttcc

SEQ ID NO: 2528722 - DNA, 16 bp, Homo sapiens
caggacccccttcccc

SEQ ID NO: 2528723 - DNA, 22 bp, Homo sapiens
caggacctcagagtccaggccc

SEQ ID NO: 2528724 - DNA, 17 bp, Homo sapiens
caggactatagcccagg

SEQ ID NO: 2528725 - DNA, 18 bp, Homo sapiens
caggactatagcccaggt

SEQ ID NO: 2528726 - DNA, 19 bp, Homo sapiens
caggactcagctccccaga

SEQ ID NO: 2528727 - DNA, 21 bp, Homo sapiens
caggactcagctccccagagt

SEQ ID NO: 2528728 - DNA, 20 bp, Homo sapiens
caggactccccaggccaggc

SEQ ID NO: 2528729 - DNA, 20 bp, Homo sapiens
caggactccctcctcacctc

SEQ ID NO: 2528730 - DNA, 22 bp, Homo sapiens
caggactccctcctcacctctg

SEQ ID NO: 2528731 - DNA, 12 bp, Homo sapiens
caggactctgcc

SEQ ID NO: 2528732 - DNA, 21 bp, Homo sapiens
cagtcttcctgacactttaat

SEQ ID NO: 2528733 - DNA, 22 bp, Homo sapiens
cagtctttaatctgagaggcca

SEQ ID NO: 2528734 - DNA, 18 bp, Homo sapiens
cagtgaaaacaagtgctg

SEQ ID NO: 2528735 - DNA, 21 bp, Homo sapiens
cagtgaaaacaagtgctggca

SEQ ID NO: 2528736 - DNA, 14 bp, Homo sapiens
cagtgaaccaaaga

SEQ ID NO: 2528737 - DNA, 20 bp, Homo sapiens
cagtgaaccaaagagactgg

SEQ ID NO: 2528738 - DNA, 23 bp, Homo sapiens
cagtgaaccaaagagactggagc

SEQ ID NO: 2528739 - DNA, 17 bp, Homo sapiens
cagtgacacttcagaga

SEQ ID NO: 2528740 - DNA, 19 bp, Homo sapiens
cagtgacacttcagagagc

SEQ ID NO: 2528741 - DNA, 22 bp, Homo sapiens
cagtgacacttcagagagctgg

SEQ ID NO: 2528742 - DNA, 16 bp, Homo sapiens
cagtgacagagttcac

SEQ ID NO: 2528743 - DNA, 18 bp, Homo sapiens
cagtgacagagttcacta

SEQ ID NO: 2528744 - DNA, 16 bp, Homo sapiens
cagtgacctgaggaag

SEQ ID NO: 2528745 - DNA, 22 bp, Homo sapiens
cagtgacgtgcacctgtactca

SEQ ID NO: 2528746 - DNA, 19 bp, Homo sapiens
cagtgagaaaaagctcctg

SEQ ID NO: 2528747 - DNA, 15 bp, Homo sapiens
cagtgagacagctct

SEQ ID NO: 2528748 - DNA, 18 bp, Homo sapiens
cagtgagattacagagga

SEQ ID NO: 2528749 - DNA, 16 bp, Homo sapiens
cagtgagcactcccaa

SEQ ID NO: 2528750 - DNA, 24 bp, Homo sapiens
cagtgagccgagattgcaccactg

SEQ ID NO: 2528751 - DNA, 12 bp, Homo sapiens
cagtgagcctga

SEQ ID NO: 2528752 - DNA, 16 bp, Homo sapiens
cagtgaggcccaggga

SEQ ID NO: 2528753 - DNA, 17 bp, Homo sapiens
cagtgaggcccagggag

SEQ ID NO: 2528754 - DNA, 13 bp, Homo sapiens
cagtgaggctctg

SEQ ID NO: 2528755 - DNA, 16 bp, Homo sapiens
cagtgaggctctgccc

SEQ ID NO: 2528756 - DNA, 17 bp, Homo sapiens
cagtgaggctctgccct

SEQ ID NO: 2528757 - DNA, 18 bp, Homo sapiens
cagtgaggctctgccctt

SEQ ID NO: 2528758 - DNA, 23 bp, Homo sapiens
cagtgagtcgaggacagggaggt

SEQ ID NO: 2528759 - DNA, 17 bp, Homo sapiens
cagtgagtctcttcaga

SEQ ID NO: 2528760 - DNA, 18 bp, Homo sapiens
cagtgagtctcttcagaa

SEQ ID NO: 2528761 - DNA, 22 bp, Homo sapiens
cagtgagttacagcgagaggca

SEQ ID NO: 2528762 - DNA, 13 bp, Homo sapiens
cagtgatctccat

SEQ ID NO: 2528763 - DNA, 21 bp, Homo sapiens
cagtgatctccatatgttaca

SEQ ID NO: 2528764 - DNA, 20 bp, Homo sapiens
cagtgatgctggatgctcct

SEQ ID NO: 2528765 - DNA, 22 bp, Homo sapiens
cagtgatttttttcttgtaatt

SEQ ID NO: 2528766 - DNA, 20 bp, Homo sapiens
cagtgcaaatgtcagataca

SEQ ID NO: 2528767 - DNA, 15 bp, Homo sapiens
cagtgcaacactgaa

SEQ ID NO: 2528768 - DNA, 17 bp, Homo sapiens
cagtgcaacagcactgg

SEQ ID NO: 2528769 - DNA, 23 bp, Homo sapiens
cagtgcaagagactctggcctcc

SEQ ID NO: 2528770 - DNA, 22 bp, Homo sapiens
cagtgcagcccgtgtggcccct

SEQ ID NO: 2528771 - DNA, 19 bp, Homo sapiens
cagtgccaagcacagtgcc

SEQ ID NO: 2528772 - DNA, 14 bp, Homo sapiens
cagtgccagcaatg

SEQ ID NO: 2528773 - DNA, 15 bp, Homo sapiens
cagtgccagcaatga

SEQ ID NO: 2528774 - DNA, 18 bp, Homo sapiens
cagtgccgagaaggaagc

SEQ ID NO: 2528775 - DNA, 15 bp, Homo sapiens
cagtgccttcaataa

SEQ ID NO: 2528776 - DNA, 16 bp, Homo sapiens
cagtgccttcaataaa

SEQ ID NO: 2528777 - DNA, 15 bp, Homo sapiens
cagtgccttccataa

SEQ ID NO: 2528778 - DNA, 16 bp, Homo sapiens
cagtgccttccataat

SEQ ID NO: 2528779 - DNA, 17 bp, Homo sapiens
cagtgctaaaaatggga

SEQ ID NO: 2528780 - DNA, 22 bp, Homo sapiens
cagtgctaaaaatgggacttct

SEQ ID NO: 2528781 - DNA, 15 bp, Homo sapiens
cagtgctgtacttga

SEQ ID NO: 2528782 - DNA, 13 bp, Homo sapiens
cagtgctgtggcc

SEQ ID NO: 2528783 - DNA, 16 bp, Homo sapiens
cagtgcttcagcctga

SEQ ID NO: 2528784 - DNA, 17 bp, Homo sapiens
cagtgcttcagcctgag

SEQ ID NO: 2528785 - DNA, 18 bp, Homo sapiens
cagtgcttcagcctgagg

SEQ ID NO: 2528786 - DNA, 20 bp, Homo sapiens
cagtgcttcagcctgaggct

SEQ ID NO: 2528787 - DNA, 12 bp, Homo sapiens
cagtgcttctca

SEQ ID NO: 2528788 - DNA, 15 bp, Homo sapiens
cagtgcttgccacag

SEQ ID NO: 2528789 - DNA, 17 bp, Homo sapiens
cagtgcttgccacagag

SEQ ID NO: 2528790 - DNA, 13 bp, Homo sapiens
cagtggaagaagc

SEQ ID NO: 2528791 - DNA, 23 bp, Homo sapiens
cagtggaatataaggaaagcaat

SEQ ID NO: 2528792 - DNA, 18 bp, Homo sapiens
cagtggactttccacccc

SEQ ID NO: 2528793 - DNA, 14 bp, Homo sapiens
cagtggattaatta

SEQ ID NO: 2528794 - DNA, 13 bp, Homo sapiens
cagtggcagctgc

SEQ ID NO: 2528795 - DNA, 15 bp, Homo sapiens
cagtggcagctgctt

SEQ ID NO: 2528796 - DNA, 17 bp, Homo sapiens
cagtggcagggctcagg

SEQ ID NO: 2528797 - DNA, 18 bp, Homo sapiens
cagtggcagggctcagga

SEQ ID NO: 2528798 - DNA, 15 bp, Homo sapiens
cagtggcatggctcc

SEQ ID NO: 2528799 - DNA, 17 bp, Homo sapiens
cagtggcatggctccag

SEQ ID NO: 2528800 - DNA, 14 bp, Homo sapiens
cagtggctgctgcc

SEQ ID NO: 2528801 - DNA, 15 bp, Homo sapiens
cagtggctgctgccc

SEQ ID NO: 2528802 - DNA, 17 bp, Homo sapiens
cagtggctgctgcccag

SEQ ID NO: 2528803 - DNA, 20 bp, Homo sapiens
cagtggctggatctgtgagg

SEQ ID NO: 2528804 - DNA, 19 bp, Homo sapiens
cagtggcttcatctgtcaa

SEQ ID NO: 2528805 - DNA, 21 bp, Homo sapiens
cagtggcttcatctgtcaagt

SEQ ID NO: 2528806 - DNA, 17 bp, Homo sapiens
cagtgggagccagggct

SEQ ID NO: 2528807 - DNA, 18 bp, Homo sapiens
cagtgggagccagggctg

SEQ ID NO: 2528808 - DNA, 17 bp, Homo sapiens
cagtgggagctgcctgt

SEQ ID NO: 2528809 - DNA, 20 bp, Homo sapiens
cagtgggagctgcctgttca

SEQ ID NO: 2528810 - DNA, 14 bp, Homo sapiens
cagtgggaggggca

SEQ ID NO: 2528811 - DNA, 17 bp, Homo sapiens
cagtgggaggggcaggc

SEQ ID NO: 2528812 - DNA, 20 bp, Homo sapiens
cagtgggaggggcaggctga

SEQ ID NO: 2528813 - DNA, 21 bp, Homo sapiens
cagtggtatgatcacggctca

SEQ ID NO: 2528814 - DNA, 23 bp, Homo sapiens
cagtggtgaagaaaactccttta

SEQ ID NO: 2528815 - DNA, 16 bp, Homo sapiens
cagtggtggcagggcc

SEQ ID NO: 2528816 - DNA, 18 bp, Homo sapiens
cagtggtggttttctgtt

SEQ ID NO: 2528817 - DNA, 14 bp, Homo sapiens
cagtggttgctgtt

SEQ ID NO: 2528818 - DNA, 15 bp, Homo sapiens
cagtgtaatttcttt

SEQ ID NO: 2528819 - DNA, 16 bp, Homo sapiens
cagtgtaatttctttg

SEQ ID NO: 2528820 - DNA, 17 bp, Homo sapiens
cagtgtaatttctttgc

SEQ ID NO: 2528821 - DNA, 20 bp, Homo sapiens
cagtgtaatttctttgcctg

SEQ ID NO: 2528822 - DNA, 18 bp, Homo sapiens
cagtgtacagtcttgtat

SEQ ID NO: 2528823 - DNA, 20 bp, Homo sapiens
cagtgtacatggaataacat

SEQ ID NO: 2528824 - DNA, 23 bp, Homo sapiens
cagtgtacatggaataacatgta

SEQ ID NO: 2528825 - DNA, 19 bp, Homo sapiens
cagtgtagccttgcccgga

SEQ ID NO: 2528826 - DNA, 18 bp, Homo sapiens
cagtgtcaagttgtgctt

SEQ ID NO: 2528827 - DNA, 20 bp, Homo sapiens
cagtgtcaagttgtgcttgt

SEQ ID NO: 2528828 - DNA, 20 bp, Homo sapiens
cagtgtcatttatgaaaaga

SEQ ID NO: 2528829 - DNA, 17 bp, Homo sapiens
cagtgtccaaagcaggg

SEQ ID NO: 2528830 - DNA, 22 bp, Homo sapiens
cagtgtccaaagcagggtctgg

SEQ ID NO: 2528831 - DNA, 16 bp, Homo sapiens
cagtgtcccctccact

SEQ ID NO: 2528832 - DNA, 14 bp, Homo sapiens
cagtgtcccgggcc

SEQ ID NO: 2528833 - DNA, 18 bp, Homo sapiens
cagtgtcctcttgctcaa

SEQ ID NO: 2528834 - DNA, 22 bp, Homo sapiens
cagtgtctgtatcggagacagt

SEQ ID NO: 2528835 - DNA, 13 bp, Homo sapiens
cagtgtctgtccc

SEQ ID NO: 2528836 - DNA, 16 bp, Homo sapiens
cagtgtctgtcccggg

SEQ ID NO: 2528837 - DNA, 14 bp, Homo sapiens
cagtgtcttccata

SEQ ID NO: 2528838 - DNA, 15 bp, Homo sapiens
cagtgtcttccataa

SEQ ID NO: 2528839 - DNA, 23 bp, Homo sapiens
cagtgtcttccataatgtataaa

SEQ ID NO: 2528840 - DNA, 18 bp, Homo sapiens
cagtgtgatcccaagtgc

SEQ ID NO: 2528841 - DNA, 22 bp, Homo sapiens
cagtgtgatcccaagtgccagt

SEQ ID NO: 2528842 - DNA, 23 bp, Homo sapiens
cagtgtgggaatgcggcaagaag

SEQ ID NO: 2528843 - DNA, 14 bp, Homo sapiens
cagtgttaaatgtg

SEQ ID NO: 2528844 - DNA, 19 bp, Homo sapiens
cagtgttagggaagggcct

SEQ ID NO: 2528845 - DNA, 14 bp, Homo sapiens
cagtgttattttct

SEQ ID NO: 2528846 - DNA, 19 bp, Homo sapiens
cagtgttccccatctgggt

SEQ ID NO: 2528847 - DNA, 18 bp, Homo sapiens
cagtgttgagccttttcc

SEQ ID NO: 2528848 - DNA, 15 bp, Homo sapiens
cagtgtttcccataa

SEQ ID NO: 2528849 - DNA, 14 bp, Homo sapiens
cagtgtttttgtaa

SEQ ID NO: 2528850 - DNA, 13 bp, Homo sapiens
cagttaattacat

SEQ ID NO: 2528851 - DNA, 22 bp, Homo sapiens
cagttacatgcatacttcaaaa

SEQ ID NO: 2528852 - DNA, 13 bp, Homo sapiens
cagttactctgaa

SEQ ID NO: 2528853 - DNA, 19 bp, Homo sapiens
cagttagggttgagttact

SEQ ID NO: 2528854 - DNA, 19 bp, Homo sapiens
cagttatggctataggtgc

SEQ ID NO: 2528855 - DNA, 23 bp, Homo sapiens
cagttcaatctcccgctgctgct

SEQ ID NO: 2528856 - DNA, 16 bp, Homo sapiens
cagttcagcaccaccc

SEQ ID NO: 2528857 - DNA, 17 bp, Homo sapiens
cagttcagcaccaccct

SEQ ID NO: 2528858 - DNA, 23 bp, Homo sapiens
cagttcaggagtcccaaggaaag

SEQ ID NO: 2528859 - DNA, 15 bp, Homo sapiens
cagttcagtacctgg

SEQ ID NO: 2528860 - DNA, 18 bp, Homo sapiens
cagttcagtacctggagg

SEQ ID NO: 2528861 - DNA, 21 bp, Homo sapiens
cagttcagtggcagggctcag

SEQ ID NO: 2528862 - DNA, 13 bp, Homo sapiens
cagttcccagaat

SEQ ID NO: 2528863 - DNA, 16 bp, Homo sapiens
cagttcccagaatcaa

SEQ ID NO: 2528864 - DNA, 23 bp, Homo sapiens
cagttcccagaatcaaagcaatg

SEQ ID NO: 2528865 - DNA, 15 bp, Homo sapiens
cagttcccttggcct

SEQ ID NO: 2528866 - DNA, 16 bp, Homo sapiens
cagttcccttggcctc

SEQ ID NO: 2528867 - DNA, 17 bp, Homo sapiens
cagttcccttggcctca

SEQ ID NO: 2528868 - DNA, 18 bp, Homo sapiens
cagttcccttggcctcag

SEQ ID NO: 2528869 - DNA, 20 bp, Homo sapiens
cagttcccttggcctcagaa

SEQ ID NO: 2528870 - DNA, 17 bp, Homo sapiens
cagttctagtttgcatt

SEQ ID NO: 2528871 - DNA, 14 bp, Homo sapiens
cagttctgaagaat

SEQ ID NO: 2528872 - DNA, 13 bp, Homo sapiens
cagttctgcagct

SEQ ID NO: 2528873 - DNA, 20 bp, Homo sapiens
cagttctgctcctctccagg

SEQ ID NO: 2528874 - DNA, 24 bp, Homo sapiens
cagttcttcgggaagagaggagtt

SEQ ID NO: 2528875 - DNA, 12 bp, Homo sapiens
cagttgaaaaac

SEQ ID NO: 2528876 - DNA, 13 bp, Homo sapiens
catctgtgtcttg

SEQ ID NO: 2528877 - DNA, 15 bp, Homo sapiens
catctgtgtgaaaat

SEQ ID NO: 2528878 - DNA, 12 bp, Homo sapiens
catctgttgttt

SEQ ID NO: 2528879 - DNA, 20 bp, Homo sapiens
catctgttgttttgttttaa

SEQ ID NO: 2528880 - DNA, 21 bp, Homo sapiens
catcttcacttctaaatgcat

SEQ ID NO: 2528881 - DNA, 22 bp, Homo sapiens
catcttccaagggtactaagga

SEQ ID NO: 2528882 - DNA, 18 bp, Homo sapiens
catcttccagaagtgtga

SEQ ID NO: 2528883 - DNA, 21 bp, Homo sapiens
catcttccagaagtgtgattg

SEQ ID NO: 2528884 - DNA, 22 bp, Homo sapiens
catcttccctagagggttcctg

SEQ ID NO: 2528885 - DNA, 17 bp, Homo sapiens
catcttctcagctccca

SEQ ID NO: 2528886 - DNA, 13 bp, Homo sapiens
catcttctgcctt

SEQ ID NO: 2528887 - DNA, 14 bp, Homo sapiens
catcttcttcacca

SEQ ID NO: 2528888 - DNA, 19 bp, Homo sapiens
catcttcttcaccatttgg

SEQ ID NO: 2528889 - DNA, 17 bp, Homo sapiens
catcttgaccaagcagg

SEQ ID NO: 2528890 - DNA, 24 bp, Homo sapiens
catcttgaccaagcaggaagctca

SEQ ID NO: 2528891 - DNA, 16 bp, Homo sapiens
catcttgctctgctga

SEQ ID NO: 2528892 - DNA, 16 bp, Homo sapiens
catcttggggacatct

SEQ ID NO: 2528893 - DNA, 20 bp, Homo sapiens
catcttggggacatctcttt

SEQ ID NO: 2528894 - DNA, 12 bp, Homo sapiens
catcttggtaaa

SEQ ID NO: 2528895 - DNA, 14 bp, Homo sapiens
catcttggtaaatt

SEQ ID NO: 2528896 - DNA, 12 bp, Homo sapiens
catctttcacat

SEQ ID NO: 2528897 - DNA, 21 bp, Homo sapiens
catctttcctgatggcaggat

SEQ ID NO: 2528898 - DNA, 16 bp, Homo sapiens
catctttcttctattt

SEQ ID NO: 2528899 - DNA, 13 bp, Homo sapiens
catcttttacatt

SEQ ID NO: 2528900 - DNA, 18 bp, Homo sapiens
catgaaaaaaggacaatt

SEQ ID NO: 2528901 - DNA, 13 bp, Homo sapiens
catgaaaaagcag

SEQ ID NO: 2528902 - DNA, 19 bp, Homo sapiens
catgaaaaagcagctacca

SEQ ID NO: 2528903 - DNA, 21 bp, Homo sapiens
catgaaaacacatttttctta

SEQ ID NO: 2528904 - DNA, 22 bp, Homo sapiens
catgaaaacgttttattgtgtt

SEQ ID NO: 2528905 - DNA, 13 bp, Homo sapiens
catgaaacaaagc

SEQ ID NO: 2528906 - DNA, 15 bp, Homo sapiens
catgaaacagaaaca

SEQ ID NO: 2528907 - DNA, 13 bp, Homo sapiens
catgaaatatgca

SEQ ID NO: 2528908 - DNA, 14 bp, Homo sapiens
catgaaatatgcat

SEQ ID NO: 2528909 - DNA, 15 bp, Homo sapiens
catgaaatatgcatc

SEQ ID NO: 2528910 - DNA, 14 bp, Homo sapiens
catgaaattactta

SEQ ID NO: 2528911 - DNA, 23 bp, Homo sapiens
catgaacagaaaacattctgatt

SEQ ID NO: 2528912 - DNA, 13 bp, Homo sapiens
catgaacatgtac

SEQ ID NO: 2528913 - DNA, 15 bp, Homo sapiens
catgaacatgtactg

SEQ ID NO: 2528914 - DNA, 12 bp, Homo sapiens
catgaagacaga

SEQ ID NO: 2528915 - DNA, 17 bp, Homo sapiens
catgaagacaggacagt

SEQ ID NO: 2528916 - DNA, 17 bp, Homo sapiens
catgaagatatttttcc

SEQ ID NO: 2528917 - DNA, 19 bp, Homo sapiens
catgaagatgtagaggaga

SEQ ID NO: 2528918 - DNA, 22 bp, Homo sapiens
catgaagtaatatgcacacatt

SEQ ID NO: 2528919 - DNA, 19 bp, Homo sapiens
catgaagtcgttgtgaggg

SEQ ID NO: 2528920 - DNA, 18 bp, Homo sapiens
catgaagtttccttggct

SEQ ID NO: 2528921 - DNA, 22 bp, Homo sapiens
catgaagtttccttggctggtg

SEQ ID NO: 2528922 - DNA, 16 bp, Homo sapiens
catgaatccagtccag

SEQ ID NO: 2528923 - DNA, 17 bp, Homo sapiens
catgaatcgcttctctt

SEQ ID NO: 2528924 - DNA, 18 bp, Homo sapiens
catgaatcgcttctcttt

SEQ ID NO: 2528925 - DNA, 20 bp, Homo sapiens
catgaatcgcttctcttttg

SEQ ID NO: 2528926 - DNA, 17 bp, Homo sapiens
catgaatgtatcaggaa

SEQ ID NO: 2528927 - DNA, 13 bp, Homo sapiens
catgacaaagact

SEQ ID NO: 2528928 - DNA, 21 bp, Homo sapiens
catgacaactttgccagcttt

SEQ ID NO: 2528929 - DNA, 17 bp, Homo sapiens
catgacaagccccaggc

SEQ ID NO: 2528930 - DNA, 20 bp, Homo sapiens
catgacaagccccaggcagg

SEQ ID NO: 2528931 - DNA, 12 bp, Homo sapiens
catgacacagct

SEQ ID NO: 2528932 - DNA, 22 bp, Homo sapiens
catgacacagctttatcaccag

SEQ ID NO: 2528933 - DNA, 12 bp, Homo sapiens
catgacccaccc

SEQ ID NO: 2528934 - DNA, 16 bp, Homo sapiens
catgacccacccctgt

SEQ ID NO: 2528935 - DNA, 18 bp, Homo sapiens
catgacccacccctgtgc

SEQ ID NO: 2528936 - DNA, 17 bp, Homo sapiens
catgacccaggctgggc

SEQ ID NO: 2528937 - DNA, 19 bp, Homo sapiens
catgacccaggctgggcaa

SEQ ID NO: 2528938 - DNA, 14 bp, Homo sapiens
catgacctgtgacc

SEQ ID NO: 2528939 - DNA, 17 bp, Homo sapiens
catgacctgtgaccagc

SEQ ID NO: 2528940 - DNA, 18 bp, Homo sapiens
catgacctgtgaccagca

SEQ ID NO: 2528941 - DNA, 15 bp, Homo sapiens
catgagaagagggcc

SEQ ID NO: 2528942 - DNA, 18 bp, Homo sapiens
catgagaagagggcctgt

SEQ ID NO: 2528943 - DNA, 19 bp, Homo sapiens
catgagacacatctcctcc

SEQ ID NO: 2528944 - DNA, 17 bp, Homo sapiens
catgagaccactgttat

SEQ ID NO: 2528945 - DNA, 16 bp, Homo sapiens
catgagcaccccaagg

SEQ ID NO: 2528946 - DNA, 17 bp, Homo sapiens
catgagcatcaggccag

SEQ ID NO: 2528947 - DNA, 22 bp, Homo sapiens
catgagcatcaggccaggccct

SEQ ID NO: 2528948 - DNA, 12 bp, Homo sapiens
catgagcctcag

SEQ ID NO: 2528949 - DNA, 17 bp, Homo sapiens
catgagcctcagcatcc

SEQ ID NO: 2528950 - DNA, 20 bp, Homo sapiens
catgagctacgcctgcctcc

SEQ ID NO: 2528951 - DNA, 16 bp, Homo sapiens
catgagctatttccat

SEQ ID NO: 2528952 - DNA, 14 bp, Homo sapiens
catgagctccagac

SEQ ID NO: 2528953 - DNA, 14 bp, Homo sapiens
catgagcttttata

SEQ ID NO: 2528954 - DNA, 12 bp, Homo sapiens
catgagtcccag

SEQ ID NO: 2528955 - DNA, 17 bp, Homo sapiens
catgagtcccagtggga

SEQ ID NO: 2528956 - DNA, 18 bp, Homo sapiens
catgagtcccagtgggag

SEQ ID NO: 2528957 - DNA, 14 bp, Homo sapiens
catgagtcccctgt

SEQ ID NO: 2528958 - DNA, 23 bp, Homo sapiens
catgagtcccctgtttgtttctg

SEQ ID NO: 2528959 - DNA, 17 bp, Homo sapiens
catgagtccttgaaaat

SEQ ID NO: 2528960 - DNA, 19 bp, Homo sapiens
catgagttggctgggaata

SEQ ID NO: 2528961 - DNA, 14 bp, Homo sapiens
catgatatgtcagg

SEQ ID NO: 2528962 - DNA, 12 bp, Homo sapiens
catgatggagtc

SEQ ID NO: 2528963 - DNA, 23 bp, Homo sapiens
catgatggagtcaggtttggggt

SEQ ID NO: 2528964 - DNA, 20 bp, Homo sapiens
catgatggtgctgacctctg

SEQ ID NO: 2528965 - DNA, 22 bp, Homo sapiens
catgatggttattttcttttct

SEQ ID NO: 2528966 - DNA, 20 bp, Homo sapiens
catgatgtggagtggggcag

SEQ ID NO: 2528967 - DNA, 22 bp, Homo sapiens
catgatgttaaccagaataaag

SEQ ID NO: 2528968 - DNA, 12 bp, Homo sapiens
catgattagcaa

SEQ ID NO: 2528969 - DNA, 24 bp, Homo sapiens
catgattttgaaatcatgaagata

SEQ ID NO: 2528970 - DNA, 16 bp, Homo sapiens
catgcaaaggctggga

SEQ ID NO: 2528971 - DNA, 12 bp, Homo sapiens
catgcaaggtca

SEQ ID NO: 2528972 - DNA, 15 bp, Homo sapiens
catgcactcagctct

SEQ ID NO: 2528973 - DNA, 16 bp, Homo sapiens
catgcactcagctctt

SEQ ID NO: 2528974 - DNA, 19 bp, Homo sapiens
catgcagacatgagtgcgt

SEQ ID NO: 2528975 - DNA, 21 bp, Homo sapiens
catgcagccgtgatcaaggga

SEQ ID NO: 2528976 - DNA, 21 bp, Homo sapiens
catgcagctgcaccctccctc

SEQ ID NO: 2528977 - DNA, 13 bp, Homo sapiens
catgcataaatat

SEQ ID NO: 2528978 - DNA, 15 bp, Homo sapiens
catgcataaatatgc

SEQ ID NO: 2528979 - DNA, 16 bp, Homo sapiens
catgcataaatatgca

SEQ ID NO: 2528980 - DNA, 17 bp, Homo sapiens
catgcataaatatgcag

SEQ ID NO: 2528981 - DNA, 18 bp, Homo sapiens
catgcataaatatgcagt

SEQ ID NO: 2528982 - DNA, 11 bp, Homo sapiens
catgcatacac

SEQ ID NO: 2528983 - DNA, 14 bp, Homo sapiens
catgcatacacaca

SEQ ID NO: 2528984 - DNA, 15 bp, Homo sapiens
catgcatacacacac

SEQ ID NO: 2528985 - DNA, 16 bp, Homo sapiens
catgcatacttcaaaa

SEQ ID NO: 2528986 - DNA, 17 bp, Homo sapiens
catgcatacttcaaaag

SEQ ID NO: 2528987 - DNA, 20 bp, Homo sapiens
catgcatacttcaaaagtat

SEQ ID NO: 2528988 - DNA, 17 bp, Homo sapiens
catgcatggaaattccc

SEQ ID NO: 2528989 - DNA, 17 bp, Homo sapiens
catgcatgtcctgtaaa

SEQ ID NO: 2528990 - DNA, 18 bp, Homo sapiens
catgccaagcactgtgct

SEQ ID NO: 2528991 - DNA, 19 bp, Homo sapiens
catgccagcttatctcagg

SEQ ID NO: 2528992 - DNA, 13 bp, Homo sapiens
catgcccccctca

SEQ ID NO: 2528993 - DNA, 21 bp, Homo sapiens
catgcccccctcaaacctcct

SEQ ID NO: 2528994 - DNA, 11 bp, Homo sapiens
catgcctgagg

SEQ ID NO: 2528995 - DNA, 15 bp, Homo sapiens
catgcctgagggtgg

SEQ ID NO: 2528996 - DNA, 20 bp, Homo sapiens
catgcctgcccccctcatct

SEQ ID NO: 2528997 - DNA, 21 bp, Homo sapiens
catgcctgtccagcctgggca

SEQ ID NO: 2528998 - DNA, 23 bp, Homo sapiens
catgcctgtgtgacatcagtggc

SEQ ID NO: 2528999 - DNA, 22 bp, Homo sapiens
catgcggcccagcccggctccc

SEQ ID NO: 2529000 - DNA, 16 bp, Homo sapiens
catgcggcccaggatg

SEQ ID NO: 2529001 - DNA, 23 bp, Homo sapiens
catgctcagccctgactggtgct

SEQ ID NO: 2529002 - DNA, 14 bp, Homo sapiens
catgctcctggccc

SEQ ID NO: 2529003 - DNA, 16 bp, Homo sapiens
catgctcctggcccac

SEQ ID NO: 2529004 - DNA, 17 bp, Homo sapiens
catgctcctggcccact

SEQ ID NO: 2529005 - DNA, 15 bp, Homo sapiens
catgctgaagccaaa

SEQ ID NO: 2529006 - DNA, 20 bp, Homo sapiens
catgctgaagccaaagccaa

SEQ ID NO: 2529007 - DNA, 18 bp, Homo sapiens
catgctgaagggaccttg

SEQ ID NO: 2529008 - DNA, 12 bp, Homo sapiens
catgctgccctg

SEQ ID NO: 2529009 - DNA, 20 bp, Homo sapiens
catgctggggcaagtccctg

SEQ ID NO: 2529010 - DNA, 21 bp, Homo sapiens
catgctgttgattgctaaatg

SEQ ID NO: 2529011 - DNA, 17 bp, Homo sapiens
catgctttgtgaacaag

SEQ ID NO: 2529012 - DNA, 19 bp, Homo sapiens
catggaactcattcctgcc

SEQ ID NO: 2529013 - DNA, 13 bp, Homo sapiens
catggaagattga

SEQ ID NO: 2529014 - DNA, 20 bp, Homo sapiens
catggaatgcttgaaaaatg

SEQ ID NO: 2529015 - DNA, 14 bp, Homo sapiens
catggaatggttat

SEQ ID NO: 2529016 - DNA, 21 bp, Homo sapiens
catggacaccccttatccagg

SEQ ID NO: 2529017 - DNA, 14 bp, Homo sapiens
catggacactccag

SEQ ID NO: 2529018 - DNA, 21 bp, Homo sapiens
catggacagaagaaggcagca

SEQ ID NO: 2529019 - DNA, 15 bp, Homo sapiens
catggacccggagct

SEQ ID NO: 2529020 - DNA, 22 bp, Homo sapiens
catggacttgtatatttgtaca

SEQ ID NO: 2529021 - DNA, 16 bp, Homo sapiens
ccaagctcagaaggct

SEQ ID NO: 2529022 - DNA, 14 bp, Homo sapiens
ccaagctccatctc

SEQ ID NO: 2529023 - DNA, 12 bp, Homo sapiens
ccaagctcccag

SEQ ID NO: 2529024 - DNA, 13 bp, Homo sapiens
ccaagctcccagg

SEQ ID NO: 2529025 - DNA, 14 bp, Homo sapiens
ccaagctcccaggc

SEQ ID NO: 2529026 - DNA, 15 bp, Homo sapiens
ccaagctcccaggca

SEQ ID NO: 2529027 - DNA, 22 bp, Homo sapiens
ccaagctcccaggcattcccca

SEQ ID NO: 2529028 - DNA, 19 bp, Homo sapiens
ccaagctccttgggaggcc

SEQ ID NO: 2529029 - DNA, 22 bp, Homo sapiens
ccaagctccttgggaggcccca

SEQ ID NO: 2529030 - DNA, 18 bp, Homo sapiens
ccaagctctagtgggaag

SEQ ID NO: 2529031 - DNA, 17 bp, Homo sapiens
ccaagctgggccccagc

SEQ ID NO: 2529032 - DNA, 17 bp, Homo sapiens
ccaagctgttttcttct

SEQ ID NO: 2529033 - DNA, 15 bp, Homo sapiens
ccaagcttggcagcc

SEQ ID NO: 2529034 - DNA, 23 bp, Homo sapiens
ccaagcttgtccaacccgaggcc

SEQ ID NO: 2529035 - DNA, 22 bp, Homo sapiens
ccaaggaaaccacagctgctgg

SEQ ID NO: 2529036 - DNA, 14 bp, Homo sapiens
ccaaggaccaggtt

SEQ ID NO: 2529037 - DNA, 14 bp, Homo sapiens
ccaaggacccctca

SEQ ID NO: 2529038 - DNA, 16 bp, Homo sapiens
ccaaggacccctcacc

SEQ ID NO: 2529039 - DNA, 19 bp, Homo sapiens
ccaaggagaaacagagaca

SEQ ID NO: 2529040 - DNA, 21 bp, Homo sapiens
ccaaggagaaacagagacagg

SEQ ID NO: 2529041 - DNA, 23 bp, Homo sapiens
ccaaggcaaggcaggtgcctcca

SEQ ID NO: 2529042 - DNA, 21 bp, Homo sapiens
ccaaggcagaagcagcagggg

SEQ ID NO: 2529043 - DNA, 18 bp, Homo sapiens
ccaaggccagagtggcct

SEQ ID NO: 2529044 - DNA, 16 bp, Homo sapiens
ccaaggccgaagctct

SEQ ID NO: 2529045 - DNA, 18 bp, Homo sapiens
ccaaggccgaagctctgg

SEQ ID NO: 2529046 - DNA, 20 bp, Homo sapiens
ccaaggccgaagctctggct

SEQ ID NO: 2529047 - DNA, 15 bp, Homo sapiens
ccaaggcggcccctc

SEQ ID NO: 2529048 - DNA, 21 bp, Homo sapiens
ccaagggaaagaaaaggaagg

SEQ ID NO: 2529049 - DNA, 19 bp, Homo sapiens
ccaagggatgaaagagaag

SEQ ID NO: 2529050 - DNA, 20 bp, Homo sapiens
ccaagggatgaaagagaagg

SEQ ID NO: 2529051 - DNA, 18 bp, Homo sapiens
ccaagggcctggcctgag

SEQ ID NO: 2529052 - DNA, 19 bp, Homo sapiens
ccaagggcctggcctgagc

SEQ ID NO: 2529053 - DNA, 19 bp, Homo sapiens
ccaagggcttctgcaccct

SEQ ID NO: 2529054 - DNA, 21 bp, Homo sapiens
ccaagggcttctgcaccctcc

SEQ ID NO: 2529055 - DNA, 19 bp, Homo sapiens
ccaaggtcttcagccatca

SEQ ID NO: 2529056 - DNA, 20 bp, Homo sapiens
ccaaggtgggctgagccctg

SEQ ID NO: 2529057 - DNA, 22 bp, Homo sapiens
ccaagtccctgttttctgagcc

SEQ ID NO: 2529058 - DNA, 20 bp, Homo sapiens
ccaagtcctgaagaggcggg

SEQ ID NO: 2529059 - DNA, 17 bp, Homo sapiens
ccaagtgccagaggtgg

SEQ ID NO: 2529060 - DNA, 18 bp, Homo sapiens
ccaagtgccagaggtggg

SEQ ID NO: 2529061 - DNA, 23 bp, Homo sapiens
ccaagtgccagaggtgggcaggt

SEQ ID NO: 2529062 - DNA, 16 bp, Homo sapiens
ccaagtgccagtcttg

SEQ ID NO: 2529063 - DNA, 17 bp, Homo sapiens
ccaagtggcagagcttg

SEQ ID NO: 2529064 - DNA, 14 bp, Homo sapiens
ccaagtggtgccta

SEQ ID NO: 2529065 - DNA, 10 bp, Homo sapiens
ccaagtgtgc

SEQ ID NO: 2529066 - DNA, 22 bp, Homo sapiens
ccaagtgtgcatattgtacact

SEQ ID NO: 2529067 - DNA, 12 bp, Homo sapiens
ccaagtgtgtgt

SEQ ID NO: 2529068 - DNA, 22 bp, Homo sapiens
ccaagttataaatcaatgtcac

SEQ ID NO: 2529069 - DNA, 15 bp, Homo sapiens
ccaagttctcacctc

SEQ ID NO: 2529070 - DNA, 18 bp, Homo sapiens
ccaagttgtggtgctgac

SEQ ID NO: 2529071 - DNA, 18 bp, Homo sapiens
ccaatagattccccattg

SEQ ID NO: 2529072 - DNA, 18 bp, Homo sapiens
ccaatagggctgagctct

SEQ ID NO: 2529073 - DNA, 22 bp, Homo sapiens
ccaatatgtattgtaaacatgt

SEQ ID NO: 2529074 - DNA, 13 bp, Homo sapiens
ccaatattataat

SEQ ID NO: 2529075 - DNA, 14 bp, Homo sapiens
ccaatattgtacag

SEQ ID NO: 2529076 - DNA, 18 bp, Homo sapiens
ccaatattgtacagtttt

SEQ ID NO: 2529077 - DNA, 12 bp, Homo sapiens
ccaatcatttta

SEQ ID NO: 2529078 - DNA, 22 bp, Homo sapiens
ccaatcattttaattattattc

SEQ ID NO: 2529079 - DNA, 13 bp, Homo sapiens
ccaatcctatgtt

SEQ ID NO: 2529080 - DNA, 18 bp, Homo sapiens
ccaatcctcactgggtgg

SEQ ID NO: 2529081 - DNA, 13 bp, Homo sapiens
ccaatcctgcccc

SEQ ID NO: 2529082 - DNA, 15 bp, Homo sapiens
ccaatgaaaaaatgt

SEQ ID NO: 2529083 - DNA, 12 bp, Homo sapiens
ccaatgaaatga

SEQ ID NO: 2529084 - DNA, 23 bp, Homo sapiens
ccaatgcactttgttctggctct

SEQ ID NO: 2529085 - DNA, 23 bp, Homo sapiens
ccaatgcatgcagccactgtgct

SEQ ID NO: 2529086 - DNA, 13 bp, Homo sapiens
ccaatgccaaaaa

SEQ ID NO: 2529087 - DNA, 17 bp, Homo sapiens
ccaatggaacctccttt

SEQ ID NO: 2529088 - DNA, 21 bp, Homo sapiens
ccaatgtattgataagagggc

SEQ ID NO: 2529089 - DNA, 20 bp, Homo sapiens
ccaatgttctctcttctcca

SEQ ID NO: 2529090 - DNA, 12 bp, Homo sapiens
ccaattccttgt

SEQ ID NO: 2529091 - DNA, 20 bp, Homo sapiens
ccaattgttgacagttctga

SEQ ID NO: 2529092 - DNA, 22 bp, Homo sapiens
ccaattgttgacagttctgaag

SEQ ID NO: 2529093 - DNA, 19 bp, Homo sapiens
ccaatttcaagttccaagt

SEQ ID NO: 2529094 - DNA, 15 bp, Homo sapiens
ccacaagaaatttga

SEQ ID NO: 2529095 - DNA, 17 bp, Homo sapiens
ccacaaggctgttgcat

SEQ ID NO: 2529096 - DNA, 15 bp, Homo sapiens
ccacaagttaaataa

SEQ ID NO: 2529097 - DNA, 20 bp, Homo sapiens
ccacaatcttaaggggcagc

SEQ ID NO: 2529098 - DNA, 11 bp, Homo sapiens
ccacacacaca

SEQ ID NO: 2529099 - DNA, 13 bp, Homo sapiens
ccacacacacaca

SEQ ID NO: 2529100 - DNA, 15 bp, Homo sapiens
ccacacacacacaca

SEQ ID NO: 2529101 - DNA, 24 bp, Homo sapiens
ccacacacacacacatgcatacac

SEQ ID NO: 2529102 - DNA, 12 bp, Homo sapiens
ccacacacacag

SEQ ID NO: 2529103 - DNA, 20 bp, Homo sapiens
ccacacacacagaaaatata

SEQ ID NO: 2529104 - DNA, 16 bp, Homo sapiens
ccacacacacccacac

SEQ ID NO: 2529105 - DNA, 23 bp, Homo sapiens
ccacacacacccacacactcgcc

SEQ ID NO: 2529106 - DNA, 22 bp, Homo sapiens
ccacacacgcaggaactcccag

SEQ ID NO: 2529107 - DNA, 23 bp, Homo sapiens
ccacacacgcaggaactcccagc

SEQ ID NO: 2529108 - DNA, 14 bp, Homo sapiens
ccacaccaagcagc

SEQ ID NO: 2529109 - DNA, 13 bp, Homo sapiens
ccacacccagccc

SEQ ID NO: 2529110 - DNA, 20 bp, Homo sapiens
ccacacccagcccacttctg

SEQ ID NO: 2529111 - DNA, 20 bp, Homo sapiens
ccacacccccaccccttgct

SEQ ID NO: 2529112 - DNA, 16 bp, Homo sapiens
ccacaccctcactgct

SEQ ID NO: 2529113 - DNA, 15 bp, Homo sapiens
ccacaccgcagaagc

SEQ ID NO: 2529114 - DNA, 20 bp, Homo sapiens
ccacaccgtgtaaaccaaag

SEQ ID NO: 2529115 - DNA, 16 bp, Homo sapiens
ccacacctctgccaga

SEQ ID NO: 2529116 - DNA, 19 bp, Homo sapiens
ccacacgctcctccctctg

SEQ ID NO: 2529117 - DNA, 18 bp, Homo sapiens
ccacactattaccatgag

SEQ ID NO: 2529118 - DNA, 21 bp, Homo sapiens
ccacactggactccggccctc

SEQ ID NO: 2529119 - DNA, 22 bp, Homo sapiens
ccacactggactccggccctcc

SEQ ID NO: 2529120 - DNA, 23 bp, Homo sapiens
ccacactggggtgccgcctgccc

SEQ ID NO: 2529121 - DNA, 13 bp, Homo sapiens
ccacactggtgac

SEQ ID NO: 2529122 - DNA, 13 bp, Homo sapiens
ccacacttcctgt

SEQ ID NO: 2529123 - DNA, 18 bp, Homo sapiens
ccacacttcctgtccaga

SEQ ID NO: 2529124 - DNA, 22 bp, Homo sapiens
ccacagaagccaggagcaaatg

SEQ ID NO: 2529125 - DNA, 12 bp, Homo sapiens
ccacagacacac

SEQ ID NO: 2529126 - DNA, 20 bp, Homo sapiens
ccacagacacacacacgcac

SEQ ID NO: 2529127 - DNA, 13 bp, Homo sapiens
ccacagagagtcc

SEQ ID NO: 2529128 - DNA, 18 bp, Homo sapiens
ccacagagagtcccactg

SEQ ID NO: 2529129 - DNA, 19 bp, Homo sapiens
ccacagagagtcccactgc

SEQ ID NO: 2529130 - DNA, 12 bp, Homo sapiens
ccacagcaggtg

SEQ ID NO: 2529131 - DNA, 23 bp, Homo sapiens
ccacagcagttgaaaagactcca

SEQ ID NO: 2529132 - DNA, 15 bp, Homo sapiens
ccacagccctgtcag

SEQ ID NO: 2529133 - DNA, 20 bp, Homo sapiens
ccacagccctgtcagtgcag

SEQ ID NO: 2529134 - DNA, 12 bp, Homo sapiens
ccacagccgcag

SEQ ID NO: 2529135 - DNA, 15 bp, Homo sapiens
ccacagccgcagcct

SEQ ID NO: 2529136 - DNA, 13 bp, Homo sapiens
ccacagctgctgg

SEQ ID NO: 2529137 - DNA, 14 bp, Homo sapiens
ccacagctgctgga

SEQ ID NO: 2529138 - DNA, 22 bp, Homo sapiens
ccacaggaagcctgcagtcctg

SEQ ID NO: 2529139 - DNA, 18 bp, Homo sapiens
ccacagggttcaaaatgt

SEQ ID NO: 2529140 - DNA, 22 bp, Homo sapiens
ccacagggttcaaaatgtctgt

SEQ ID NO: 2529141 - DNA, 14 bp, Homo sapiens
ccacagtcaaagaa

SEQ ID NO: 2529142 - DNA, 12 bp, Homo sapiens
ccacagtgctgt

SEQ ID NO: 2529143 - DNA, 20 bp, Homo sapiens
ccacagtttcctcatctgtc

SEQ ID NO: 2529144 - DNA, 22 bp, Homo sapiens
ccacatccacacacgcaggaac

SEQ ID NO: 2529145 - DNA, 12 bp, Homo sapiens
ccacatcccagg

SEQ ID NO: 2529146 - DNA, 14 bp, Homo sapiens
ccacatctacgttt

SEQ ID NO: 2529147 - DNA, 19 bp, Homo sapiens
ccacatctacgtttttggt

SEQ ID NO: 2529148 - DNA, 16 bp, Homo sapiens
ccacatcttgctctgc

SEQ ID NO: 2529149 - DNA, 19 bp, Homo sapiens
ccacatgagtcccagtggg

SEQ ID NO: 2529150 - DNA, 17 bp, Homo sapiens
ccacatgcggagaacaa

SEQ ID NO: 2529151 - DNA, 16 bp, Homo sapiens
ccacattcctgatgct

SEQ ID NO: 2529152 - DNA, 15 bp, Homo sapiens
ccaccaactcttgca

SEQ ID NO: 2529153 - DNA, 17 bp, Homo sapiens
ccaccaagacttgtttt

SEQ ID NO: 2529154 - DNA, 17 bp, Homo sapiens
ccaccaaggtcttcagc

SEQ ID NO: 2529155 - DNA, 17 bp, Homo sapiens
ccaccaccaattgccaa

SEQ ID NO: 2529156 - DNA, 15 bp, Homo sapiens
ccaccaccactggcc

SEQ ID NO: 2529157 - DNA, 16 bp, Homo sapiens
ccaccaccccccactc

SEQ ID NO: 2529158 - DNA, 13 bp, Homo sapiens
ccaccaccctgag

SEQ ID NO: 2529159 - DNA, 19 bp, Homo sapiens
ccaccacggccactggcca

SEQ ID NO: 2529160 - DNA, 14 bp, Homo sapiens
ccaccactggccac

SEQ ID NO: 2529161 - DNA, 15 bp, Homo sapiens
ccaccactggccacc

SEQ ID NO: 2529162 - DNA, 23 bp, Homo sapiens
ccaccactggccaccaggctggc

SEQ ID NO: 2529163 - DNA, 11 bp, Homo sapiens
ccaccagcctg

SEQ ID NO: 2529164 - DNA, 18 bp, Homo sapiens
ccaccaggatcccagggg

SEQ ID NO: 2529165 - DNA, 18 bp, Homo sapiens
ccaccaggctggcgcagc

SEQ ID NO: 2529166 - DNA, 19 bp, Homo sapiens
ccagcccctgtatggcact

SEQ ID NO: 2529167 - DNA, 16 bp, Homo sapiens
ccagccccttctgacc

SEQ ID NO: 2529168 - DNA, 18 bp, Homo sapiens
ccagccccttctgaccca

SEQ ID NO: 2529169 - DNA, 24 bp, Homo sapiens
ccagccccttctgacccatgctgc

SEQ ID NO: 2529170 - DNA, 15 bp, Homo sapiens
ccagcccggcctgct

SEQ ID NO: 2529171 - DNA, 11 bp, Homo sapiens
ccagccctgct

SEQ ID NO: 2529172 - DNA, 16 bp, Homo sapiens
ccagccctgctggccg

SEQ ID NO: 2529173 - DNA, 15 bp, Homo sapiens
ccagccctgtggaag

SEQ ID NO: 2529174 - DNA, 18 bp, Homo sapiens
ccagccgccatgctcctg

SEQ ID NO: 2529175 - DNA, 13 bp, Homo sapiens
ccagccggcatgg

SEQ ID NO: 2529176 - DNA, 22 bp, Homo sapiens
ccagccggcctctctggcctcc

SEQ ID NO: 2529177 - DNA, 22 bp, Homo sapiens
ccagccggtacctgggaagggg

SEQ ID NO: 2529178 - DNA, 15 bp, Homo sapiens
ccagcctctggcatt

SEQ ID NO: 2529179 - DNA, 15 bp, Homo sapiens
ccagcctctgttccc

SEQ ID NO: 2529180 - DNA, 19 bp, Homo sapiens
ccagcctctgttcccctag

SEQ ID NO: 2529181 - DNA, 12 bp, Homo sapiens
ccagcctgagca

SEQ ID NO: 2529182 - DNA, 19 bp, Homo sapiens
ccagcctgcctggcaggct

SEQ ID NO: 2529183 - DNA, 13 bp, Homo sapiens
ccagcctggagat

SEQ ID NO: 2529184 - DNA, 13 bp, Homo sapiens
ccagcctggcttc

SEQ ID NO: 2529185 - DNA, 17 bp, Homo sapiens
ccagcctggcttctgga

SEQ ID NO: 2529186 - DNA, 18 bp, Homo sapiens
ccagcctggcttctggag

SEQ ID NO: 2529187 - DNA, 20 bp, Homo sapiens
ccagcctggcttctggagcc

SEQ ID NO: 2529188 - DNA, 22 bp, Homo sapiens
ccagcctgggcagccaggctgc

SEQ ID NO: 2529189 - DNA, 16 bp, Homo sapiens
ccagcctgggcgacag

SEQ ID NO: 2529190 - DNA, 20 bp, Homo sapiens
ccagcctgttggacccgctc

SEQ ID NO: 2529191 - DNA, 16 bp, Homo sapiens
ccagccttcctctgca

SEQ ID NO: 2529192 - DNA, 19 bp, Homo sapiens
ccagccttgaccattctcc

SEQ ID NO: 2529193 - DNA, 23 bp, Homo sapiens
ccagccttgaccattctccacct

SEQ ID NO: 2529194 - DNA, 15 bp, Homo sapiens
ccagcctttctccca

SEQ ID NO: 2529195 - DNA, 13 bp, Homo sapiens
ccagcgagccctg

SEQ ID NO: 2529196 - DNA, 14 bp, Homo sapiens
ccagcgcccgctgg

SEQ ID NO: 2529197 - DNA, 16 bp, Homo sapiens
ccagcgcccgctgggc

SEQ ID NO: 2529198 - DNA, 23 bp, Homo sapiens
ccagcgggaatggcagctgccac

SEQ ID NO: 2529199 - DNA, 20 bp, Homo sapiens
ccagctaatctgtagggctg

SEQ ID NO: 2529200 - DNA, 21 bp, Homo sapiens
ccagctactcagaagcctgag

SEQ ID NO: 2529201 - DNA, 15 bp, Homo sapiens
ccagctactcaggag

SEQ ID NO: 2529202 - DNA, 14 bp, Homo sapiens
ccagctacttggga

SEQ ID NO: 2529203 - DNA, 22 bp, Homo sapiens
ccagctcaatggactggaaggg

SEQ ID NO: 2529204 - DNA, 16 bp, Homo sapiens
ccagctcaccagcccc

SEQ ID NO: 2529205 - DNA, 12 bp, Homo sapiens
ccagctcacccc

SEQ ID NO: 2529206 - DNA, 14 bp, Homo sapiens
ccagctcctccctt

SEQ ID NO: 2529207 - DNA, 15 bp, Homo sapiens
ccagctctcagccaa

SEQ ID NO: 2529208 - DNA, 12 bp, Homo sapiens
ccagctctggct

SEQ ID NO: 2529209 - DNA, 22 bp, Homo sapiens
ccagctctggtccatagagagc

SEQ ID NO: 2529210 - DNA, 14 bp, Homo sapiens
ccagctctgtatca

SEQ ID NO: 2529211 - DNA, 18 bp, Homo sapiens
ccagctgccccagccaga

SEQ ID NO: 2529212 - DNA, 12 bp, Homo sapiens
ccagctgcctcc

SEQ ID NO: 2529213 - DNA, 13 bp, Homo sapiens
ccagctgcctctt

SEQ ID NO: 2529214 - DNA, 19 bp, Homo sapiens
ccagctgggaggcaagagg

SEQ ID NO: 2529215 - DNA, 22 bp, Homo sapiens
ccagctgggaggcaagaggggt

SEQ ID NO: 2529216 - DNA, 15 bp, Homo sapiens
ccagctgggctctgc

SEQ ID NO: 2529217 - DNA, 19 bp, Homo sapiens
ccagctgggctctgcaatt

SEQ ID NO: 2529218 - DNA, 20 bp, Homo sapiens
ccagctggggcgtggggagg

SEQ ID NO: 2529219 - DNA, 16 bp, Homo sapiens
ccagctgttcagctgg

SEQ ID NO: 2529220 - DNA, 21 bp, Homo sapiens
ccagcttaaagtaaccggatg

SEQ ID NO: 2529221 - DNA, 21 bp, Homo sapiens
ccagcttctggtactctccta

SEQ ID NO: 2529222 - DNA, 17 bp, Homo sapiens
ccagcttgtggagcccc

SEQ ID NO: 2529223 - DNA, 16 bp, Homo sapiens
ccagcttgttatttat

SEQ ID NO: 2529224 - DNA, 14 bp, Homo sapiens
ccagctttccctgc

SEQ ID NO: 2529225 - DNA, 13 bp, Homo sapiens
ccagcttttccca

SEQ ID NO: 2529226 - DNA, 16 bp, Homo sapiens
ccagcttttcctccct

SEQ ID NO: 2529227 - DNA, 16 bp, Homo sapiens
ccaggaaaggctccag

SEQ ID NO: 2529228 - DNA, 18 bp, Homo sapiens
ccaggaaaggctccagga

SEQ ID NO: 2529229 - DNA, 14 bp, Homo sapiens
ccaggaacctcctc

SEQ ID NO: 2529230 - DNA, 20 bp, Homo sapiens
ccaggaagccgtgccctgcc

SEQ ID NO: 2529231 - DNA, 18 bp, Homo sapiens
ccaggaccagctggggcg

SEQ ID NO: 2529232 - DNA, 17 bp, Homo sapiens
ccaggacgcttctgaat

SEQ ID NO: 2529233 - DNA, 22 bp, Homo sapiens
ccaggactatagcccaggtcct

SEQ ID NO: 2529234 - DNA, 15 bp, Homo sapiens
ccaggactccccagg

SEQ ID NO: 2529235 - DNA, 21 bp, Homo sapiens
ccaggactccccaggccaggc

SEQ ID NO: 2529236 - DNA, 14 bp, Homo sapiens
ccaggactccctcc

SEQ ID NO: 2529237 - DNA, 23 bp, Homo sapiens
ccaggagaaccactacatgcagc

SEQ ID NO: 2529238 - DNA, 12 bp, Homo sapiens
ccaggagaactg

SEQ ID NO: 2529239 - DNA, 16 bp, Homo sapiens
ccaggagcctgtgcct

SEQ ID NO: 2529240 - DNA, 17 bp, Homo sapiens
ccaggagcctgtgcctc

SEQ ID NO: 2529241 - DNA, 21 bp, Homo sapiens
ccaggagctcttcaggcctcc

SEQ ID NO: 2529242 - DNA, 21 bp, Homo sapiens
ccaggagctgggcagaaggcc

SEQ ID NO: 2529243 - DNA, 12 bp, Homo sapiens
ccaggaggccag

SEQ ID NO: 2529244 - DNA, 13 bp, Homo sapiens
ccaggaggccagc

SEQ ID NO: 2529245 - DNA, 20 bp, Homo sapiens
ccaggaggccagccttgacc

SEQ ID NO: 2529246 - DNA, 20 bp, Homo sapiens
ccaggagttcgaggctgcag

SEQ ID NO: 2529247 - DNA, 14 bp, Homo sapiens
ccaggatcagattg

SEQ ID NO: 2529248 - DNA, 23 bp, Homo sapiens
ccaggatcatggtgtaataagac

SEQ ID NO: 2529249 - DNA, 17 bp, Homo sapiens
ccaggatcccaggggcc

SEQ ID NO: 2529250 - DNA, 18 bp, Homo sapiens
ccaggattgaagagcatt

SEQ ID NO: 2529251 - DNA, 17 bp, Homo sapiens
ccaggcaacttgggaac

SEQ ID NO: 2529252 - DNA, 17 bp, Homo sapiens
ccaggcaccccctggag

SEQ ID NO: 2529253 - DNA, 21 bp, Homo sapiens
ccaggcaccccctggagagaa

SEQ ID NO: 2529254 - DNA, 12 bp, Homo sapiens
ccaggcaggtct

SEQ ID NO: 2529255 - DNA, 21 bp, Homo sapiens
ccaggcagtcgggggctggcc

SEQ ID NO: 2529256 - DNA, 13 bp, Homo sapiens
ccaggcatggtgg

SEQ ID NO: 2529257 - DNA, 21 bp, Homo sapiens
ccaggccacaagacccttgtg

SEQ ID NO: 2529258 - DNA, 15 bp, Homo sapiens
ccaggccaccaggat

SEQ ID NO: 2529259 - DNA, 21 bp, Homo sapiens
ccaggccagagggagtgacag

SEQ ID NO: 2529260 - DNA, 15 bp, Homo sapiens
ccaggccagctgcct

SEQ ID NO: 2529261 - DNA, 16 bp, Homo sapiens
ccaggccatggaggca

SEQ ID NO: 2529262 - DNA, 20 bp, Homo sapiens
ccaggccccgaggacccaga

SEQ ID NO: 2529263 - DNA, 23 bp, Homo sapiens
ccaggcccctgccaccctgggga

SEQ ID NO: 2529264 - DNA, 14 bp, Homo sapiens
ccaggccctctgcc

SEQ ID NO: 2529265 - DNA, 17 bp, Homo sapiens
ccaggccgcagctcttg

SEQ ID NO: 2529266 - DNA, 21 bp, Homo sapiens
ccaggccggggtggagcatgg

SEQ ID NO: 2529267 - DNA, 22 bp, Homo sapiens
ccaggccggtgtgggctgtgtc

SEQ ID NO: 2529268 - DNA, 15 bp, Homo sapiens
ccaggccgtcctccc

SEQ ID NO: 2529269 - DNA, 18 bp, Homo sapiens
ccaggcctctgtgtcctt

SEQ ID NO: 2529270 - DNA, 16 bp, Homo sapiens
ccaggcctcttggcag

SEQ ID NO: 2529271 - DNA, 19 bp, Homo sapiens
ccaggcctcttggcagtca

SEQ ID NO: 2529272 - DNA, 17 bp, Homo sapiens
ccaggcctgggccagag

SEQ ID NO: 2529273 - DNA, 16 bp, Homo sapiens
ccaggcctgggtctgt

SEQ ID NO: 2529274 - DNA, 18 bp, Homo sapiens
ccaggcgatgtgcaagtg

SEQ ID NO: 2529275 - DNA, 15 bp, Homo sapiens
ccaggctccttcctg

SEQ ID NO: 2529276 - DNA, 23 bp, Homo sapiens
ccaggctctgtgctgaccctcct

SEQ ID NO: 2529277 - DNA, 13 bp, Homo sapiens
ccaggctggcgca

SEQ ID NO: 2529278 - DNA, 14 bp, Homo sapiens
ccaggctggcgcag

SEQ ID NO: 2529279 - DNA, 17 bp, Homo sapiens
ccaggctggcgcagcca

SEQ ID NO: 2529280 - DNA, 14 bp, Homo sapiens
ccaggctgggagag

SEQ ID NO: 2529281 - DNA, 17 bp, Homo sapiens
ccaggctgtgggcctca

SEQ ID NO: 2529282 - DNA, 22 bp, Homo sapiens
ccaggctgtgggcctcaaggac

SEQ ID NO: 2529283 - DNA, 18 bp, Homo sapiens
ccaggcttcaccctgaat

SEQ ID NO: 2529284 - DNA, 17 bp, Homo sapiens
ccagggaagctggccga

SEQ ID NO: 2529285 - DNA, 16 bp, Homo sapiens
ccagggaagtccccga

SEQ ID NO: 2529286 - DNA, 18 bp, Homo sapiens
ccagggaagtgctctgat

SEQ ID NO: 2529287 - DNA, 14 bp, Homo sapiens
ccagggacaccagc

SEQ ID NO: 2529288 - DNA, 16 bp, Homo sapiens
ccagggacaccagcca

SEQ ID NO: 2529289 - DNA, 23 bp, Homo sapiens
ccagggacaccagccaggctctg

SEQ ID NO: 2529290 - DNA, 14 bp, Homo sapiens
ccagggacagaggg

SEQ ID NO: 2529291 - DNA, 15 bp, Homo sapiens
ccagggacagagggg

SEQ ID NO: 2529292 - DNA, 13 bp, Homo sapiens
ccagggagaccga

SEQ ID NO: 2529293 - DNA, 19 bp, Homo sapiens
ccagggagcggaaagcagc

SEQ ID NO: 2529294 - DNA, 23 bp, Homo sapiens
ccagggagcggaaagcagctcaa

SEQ ID NO: 2529295 - DNA, 16 bp, Homo sapiens
ccagggagtcccctcc

SEQ ID NO: 2529296 - DNA, 13 bp, Homo sapiens
ccagggcagggcc

SEQ ID NO: 2529297 - DNA, 19 bp, Homo sapiens
ccagggccactctgcctct

SEQ ID NO: 2529298 - DNA, 21 bp, Homo sapiens
ccagggccactctgcctctgc

SEQ ID NO: 2529299 - DNA, 12 bp, Homo sapiens
ccagggccaggg

SEQ ID NO: 2529300 - DNA, 18 bp, Homo sapiens
ccagggccctgagctcgg

SEQ ID NO: 2529301 - DNA, 11 bp, Homo sapiens
ccagggctcag

SEQ ID NO: 2529302 - DNA, 15 bp, Homo sapiens
ccagggctcagcctg

SEQ ID NO: 2529303 - DNA, 20 bp, Homo sapiens
ccagggctcagcctggtggg

SEQ ID NO: 2529304 - DNA, 19 bp, Homo sapiens
ccaggggaaagatgagctt

SEQ ID NO: 2529305 - DNA, 21 bp, Homo sapiens
ccaggggaggcctgaggcttc

SEQ ID NO: 2529306 - DNA, 21 bp, Homo sapiens
ccaggggcatgtattggcctg

SEQ ID NO: 2529307 - DNA, 18 bp, Homo sapiens
ccaggggcccacagggaa

SEQ ID NO: 2529308 - DNA, 17 bp, Homo sapiens
ccaggggcccctccagc

SEQ ID NO: 2529309 - DNA, 22 bp, Homo sapiens
ccaggggcccctccagcttgtg

SEQ ID NO: 2529310 - DNA, 14 bp, Homo sapiens
ccaggggtcccagc

SEQ ID NO: 2529311 - DNA, 20 bp, Homo sapiens
cccaggggtcccagccaccc

SEQ ID NO: 2529312 - DNA, 17 bp, Homo sapiens
cccaggggtgccccctc

SEQ ID NO: 2529313 - DNA, 21 bp, Homo sapiens
cccaggggtgccccctcctct

SEQ ID NO: 2529314 - DNA, 21 bp, Homo sapiens
cccagggtagcccgcctgcca

SEQ ID NO: 2529315 - DNA, 14 bp, Homo sapiens
cccaggtcatggaa

SEQ ID NO: 2529316 - DNA, 13 bp, Homo sapiens
cccaggtcctcac

SEQ ID NO: 2529317 - DNA, 23 bp, Homo sapiens
cccaggtgctaggaacactcctt

SEQ ID NO: 2529318 - DNA, 19 bp, Homo sapiens
cccaggtttctggtctcta

SEQ ID NO: 2529319 - DNA, 22 bp, Homo sapiens
cccaggtttctggtctctaggc

SEQ ID NO: 2529320 - DNA, 20 bp, Homo sapiens
cccagtacctcctgtctctg

SEQ ID NO: 2529321 - DNA, 21 bp, Homo sapiens
cccagtacctcctgtctctgg

SEQ ID NO: 2529322 - DNA, 22 bp, Homo sapiens
cccagtacctcctgtctctggc

SEQ ID NO: 2529323 - DNA, 13 bp, Homo sapiens
cccagtcagcctc

SEQ ID NO: 2529324 - DNA, 20 bp, Homo sapiens
cccagtcagcctctctccca

SEQ ID NO: 2529325 - DNA, 19 bp, Homo sapiens
cccagtccaaatgtcctcc

SEQ ID NO: 2529326 - DNA, 14 bp, Homo sapiens
cccagtcctggcct

SEQ ID NO: 2529327 - DNA, 15 bp, Homo sapiens
cccagtcctggcctg

SEQ ID NO: 2529328 - DNA, 17 bp, Homo sapiens
cccagtcctggcctggc

SEQ ID NO: 2529329 - DNA, 20 bp, Homo sapiens
cccagtcctggcctggcttc

SEQ ID NO: 2529330 - DNA, 18 bp, Homo sapiens
cccagtctggaatgcagt

SEQ ID NO: 2529331 - DNA, 19 bp, Homo sapiens
cccagtgacacttcagaga

SEQ ID NO: 2529332 - DNA, 17 bp, Homo sapiens
cccagtgccgagaagga

SEQ ID NO: 2529333 - DNA, 17 bp, Homo sapiens
cccagtggccactcagc

SEQ ID NO: 2529334 - DNA, 19 bp, Homo sapiens
cccagtggcctcaaccctc

SEQ ID NO: 2529335 - DNA, 14 bp, Homo sapiens
cccagtggctgctg

SEQ ID NO: 2529336 - DNA, 18 bp, Homo sapiens
cccagtggctgctgccca

SEQ ID NO: 2529337 - DNA, 17 bp, Homo sapiens
cccagtgggaggggcag

SEQ ID NO: 2529338 - DNA, 22 bp, Homo sapiens
cccagtgggaggggcaggctga

SEQ ID NO: 2529339 - DNA, 22 bp, Homo sapiens
cccagttcaactcatggagatg

SEQ ID NO: 2529340 - DNA, 19 bp, Homo sapiens
cccagttcaggagtcccaa

SEQ ID NO: 2529341 - DNA, 13 bp, Homo sapiens
cccagttctgctc

SEQ ID NO: 2529342 - DNA, 20 bp, Homo sapiens
cccagttctgctcctctcca

SEQ ID NO: 2529343 - DNA, 21 bp, Homo sapiens
cccagttctgctcctctccag

SEQ ID NO: 2529344 - DNA, 22 bp, Homo sapiens
cccagttctgctcctctccagg

SEQ ID NO: 2529345 - DNA, 17 bp, Homo sapiens
cccagttgccatctgcg

SEQ ID NO: 2529346 - DNA, 13 bp, Homo sapiens
cccatagcttcca

SEQ ID NO: 2529347 - DNA, 16 bp, Homo sapiens
cccatcacgcctgtgc

SEQ ID NO: 2529348 - DNA, 17 bp, Homo sapiens
cccatcaggactcttgt

SEQ ID NO: 2529349 - DNA, 19 bp, Homo sapiens
cccatcaggactcttgtga

SEQ ID NO: 2529350 - DNA, 15 bp, Homo sapiens
cccatcattcatgct

SEQ ID NO: 2529351 - DNA, 19 bp, Homo sapiens
cccatccccatcctccagc

SEQ ID NO: 2529352 - DNA, 14 bp, Homo sapiens
cccatccccctgcc

SEQ ID NO: 2529353 - DNA, 15 bp, Homo sapiens
cccatccccctgccc

SEQ ID NO: 2529354 - DNA, 17 bp, Homo sapiens
cccatcctaccaatgca

SEQ ID NO: 2529355 - DNA, 21 bp, Homo sapiens
cccatcctaccaatgcatgca

SEQ ID NO: 2529356 - DNA, 17 bp, Homo sapiens
cccatcctaccctcggg

SEQ ID NO: 2529357 - DNA, 18 bp, Homo sapiens
cccatcctaccctcgggc

SEQ ID NO: 2529358 - DNA, 17 bp, Homo sapiens
cccatcctccagcttct

SEQ ID NO: 2529359 - DNA, 13 bp, Homo sapiens
cccatcctcccct

SEQ ID NO: 2529360 - DNA, 19 bp, Homo sapiens
cccatcctctgtacagagc

SEQ ID NO: 2529361 - DNA, 21 bp, Homo sapiens
cccatctatgtcccttgctgt

SEQ ID NO: 2529362 - DNA, 13 bp, Homo sapiens
cccatctctccct

SEQ ID NO: 2529363 - DNA, 18 bp, Homo sapiens
cccatctctccctcccct

SEQ ID NO: 2529364 - DNA, 21 bp, Homo sapiens
cccatctctccctcccctgcc

SEQ ID NO: 2529365 - DNA, 23 bp, Homo sapiens
cccatctctccctcccctgccat

SEQ ID NO: 2529366 - DNA, 21 bp, Homo sapiens
cccatctgcacccccctgggc

SEQ ID NO: 2529367 - DNA, 16 bp, Homo sapiens
cccatctgggagtccc

SEQ ID NO: 2529368 - DNA, 23 bp, Homo sapiens
cccatctgggagtccccttttct

SEQ ID NO: 2529369 - DNA, 18 bp, Homo sapiens
cccatctgggtccttgca

SEQ ID NO: 2529370 - DNA, 12 bp, Homo sapiens
cccatctgtgaa

SEQ ID NO: 2529371 - DNA, 13 bp, Homo sapiens
cccatctgtgaat

SEQ ID NO: 2529372 - DNA, 19 bp, Homo sapiens
cccatgaagacaggacagt

SEQ ID NO: 2529373 - DNA, 22 bp, Homo sapiens
cccatgaagacaggacagtgct

SEQ ID NO: 2529374 - DNA, 14 bp, Homo sapiens
cccatgacccaccc

SEQ ID NO: 2529375 - DNA, 17 bp, Homo sapiens
cccatgacccacccctg

SEQ ID NO: 2529376 - DNA, 20 bp, Homo sapiens
cccatgacccacccctgtgc

SEQ ID NO: 2529377 - DNA, 17 bp, Homo sapiens
cccatgacccaggctgg

SEQ ID NO: 2529378 - DNA, 19 bp, Homo sapiens
cccatgacccaggctgggc

SEQ ID NO: 2529379 - DNA, 22 bp, Homo sapiens
cccatgactttatatggatgat

SEQ ID NO: 2529380 - DNA, 14 bp, Homo sapiens
cccatgagcctcag

SEQ ID NO: 2529381 - DNA, 15 bp, Homo sapiens
cccatgagcctcagc

SEQ ID NO: 2529382 - DNA, 22 bp, Homo sapiens
cccatgagcctcagcatcctgg

SEQ ID NO: 2529383 - DNA, 21 bp, Homo sapiens
cccatgccaaagctagggtgg

SEQ ID NO: 2529384 - DNA, 19 bp, Homo sapiens
cccatgcctgtccagcctg

SEQ ID NO: 2529385 - DNA, 15 bp, Homo sapiens
cccatgctgccctgt

SEQ ID NO: 2529386 - DNA, 17 bp, Homo sapiens
cccatgctgccctgtga

SEQ ID NO: 2529387 - DNA, 18 bp, Homo sapiens
cccatgctgccctgtgag

SEQ ID NO: 2529388 - DNA, 20 bp, Homo sapiens
cccatggacactccagtgcc

SEQ ID NO: 2529389 - DNA, 22 bp, Homo sapiens
cccatggacactccagtgccag

SEQ ID NO: 2529390 - DNA, 13 bp, Homo sapiens
cccatggagcccc

SEQ ID NO: 2529391 - DNA, 16 bp, Homo sapiens
cccatggagccccagc

SEQ ID NO: 2529392 - DNA, 17 bp, Homo sapiens
cccatggccctcccagt

SEQ ID NO: 2529393 - DNA, 21 bp, Homo sapiens
cccatgggaagacgaggccct

SEQ ID NO: 2529394 - DNA, 18 bp, Homo sapiens
cccatgtcgcgctcagca

SEQ ID NO: 2529395 - DNA, 19 bp, Homo sapiens
cccatgtcgcgctcagcat

SEQ ID NO: 2529396 - DNA, 21 bp, Homo sapiens
cccatgtgtcctggttcccgt

SEQ ID NO: 2529397 - DNA, 16 bp, Homo sapiens
cccattaggacaatca

SEQ ID NO: 2529398 - DNA, 14 bp, Homo sapiens
cccattctgcctgc

SEQ ID NO: 2529399 - DNA, 23 bp, Homo sapiens
cccattctgcctgcccaggcccc

SEQ ID NO: 2529400 - DNA, 12 bp, Homo sapiens
cccattcttcct

SEQ ID NO: 2529401 - DNA, 20 bp, Homo sapiens
cccattcttcctagttttct

SEQ ID NO: 2529402 - DNA, 21 bp, Homo sapiens
cccattcttcctagttttctc

SEQ ID NO: 2529403 - DNA, 17 bp, Homo sapiens
cccattgcctcctcctt

SEQ ID NO: 2529404 - DNA, 20 bp, Homo sapiens
cccatttaaatttttttcct

SEQ ID NO: 2529405 - DNA, 12 bp, Homo sapiens
cccatttcagct

SEQ ID NO: 2529406 - DNA, 12 bp, Homo sapiens
cccatttctact

SEQ ID NO: 2529407 - DNA, 20 bp, Homo sapiens
cccatttctatttatttact

SEQ ID NO: 2529408 - DNA, 14 bp, Homo sapiens
cccattttagtcac

SEQ ID NO: 2529409 - DNA, 20 bp, Homo sapiens
cccattttagtcactttttt

SEQ ID NO: 2529410 - DNA, 22 bp, Homo sapiens
cccattttgcaaaatttccagt

SEQ ID NO: 2529411 - DNA, 20 bp, Homo sapiens
ccccaaaaacctcacccgag

SEQ ID NO: 2529412 - DNA, 19 bp, Homo sapiens
ccccaaaaccacagccctg

SEQ ID NO: 2529413 - DNA, 22 bp, Homo sapiens
ccccaaaactctcctctgctgc

SEQ ID NO: 2529414 - DNA, 19 bp, Homo sapiens
ccccaaagagcctggagaa

SEQ ID NO: 2529415 - DNA, 20 bp, Homo sapiens
ccccaaagagcctggagaag

SEQ ID NO: 2529416 - DNA, 20 bp, Homo sapiens
ccccaacactgtgccctggt

SEQ ID NO: 2529417 - DNA, 15 bp, Homo sapiens
ccccaaccctgcccc

SEQ ID NO: 2529418 - DNA, 14 bp, Homo sapiens
ccccaagctgtttt

SEQ ID NO: 2529419 - DNA, 16 bp, Homo sapiens
ccccaagctgttttct

SEQ ID NO: 2529420 - DNA, 12 bp, Homo sapiens
ccccacactcct

SEQ ID NO: 2529421 - DNA, 13 bp, Homo sapiens
ccccacactgggg

SEQ ID NO: 2529422 - DNA, 18 bp, Homo sapiens
ccccacactggggtgccg

SEQ ID NO: 2529423 - DNA, 23 bp, Homo sapiens
ccccacacttgttccagctcttt

SEQ ID NO: 2529424 - DNA, 12 bp, Homo sapiens
ccccacccagga

SEQ ID NO: 2529425 - DNA, 22 bp, Homo sapiens
ccccaccccttccccactgcct

SEQ ID NO: 2529426 - DNA, 20 bp, Homo sapiens
ccccaccctgggctctggga

SEQ ID NO: 2529427 - DNA, 15 bp, Homo sapiens
ccccaccgcagacag

SEQ ID NO: 2529428 - DNA, 18 bp, Homo sapiens
ccccacggccgctccagg

SEQ ID NO: 2529429 - DNA, 23 bp, Homo sapiens
ccccactccctggctctcagaag

SEQ ID NO: 2529430 - DNA, 18 bp, Homo sapiens
ccccactctccccacact

SEQ ID NO: 2529431 - DNA, 12 bp, Homo sapiens
ccccactgcctg

SEQ ID NO: 2529432 - DNA, 17 bp, Homo sapiens
ccccactgcctgcccac

SEQ ID NO: 2529433 - DNA, 14 bp, Homo sapiens
ccccactggggaaa

SEQ ID NO: 2529434 - DNA, 22 bp, Homo sapiens
ccccactggggaaataacagct

SEQ ID NO: 2529435 - DNA, 14 bp, Homo sapiens
ccccactggtgaca

SEQ ID NO: 2529436 - DNA, 15 bp, Homo sapiens
ccccagaacctgtcc

SEQ ID NO: 2529437 - DNA, 21 bp, Homo sapiens
ccccagaacctgtccttgcac

SEQ ID NO: 2529438 - DNA, 21 bp, Homo sapiens
ccccagagctgtttatggcct

SEQ ID NO: 2529439 - DNA, 15 bp, Homo sapiens
ccccagataccagcc

SEQ ID NO: 2529440 - DNA, 22 bp, Homo sapiens
ccccagcaagtgagagctgggt

SEQ ID NO: 2529441 - DNA, 11 bp, Homo sapiens
ccccagcacta

SEQ ID NO: 2529442 - DNA, 12 bp, Homo sapiens
ccccagcccacc

SEQ ID NO: 2529443 - DNA, 14 bp, Homo sapiens
ccccagcctctggc

SEQ ID NO: 2529444 - DNA, 19 bp, Homo sapiens
ccccagcgagagtccctgc

SEQ ID NO: 2529445 - DNA, 18 bp, Homo sapiens
ccccagcgtcccagtctc

SEQ ID NO: 2529446 - DNA, 23 bp, Homo sapiens
ccccagcgtcccagtctctggca

SEQ ID NO: 2529447 - DNA, 11 bp, Homo sapiens
ccccagctacc

SEQ ID NO: 2529448 - DNA, 14 bp, Homo sapiens
ccccagctcaatgg

SEQ ID NO: 2529449 - DNA, 22 bp, Homo sapiens
ccccagctctggtgagtcttgg

SEQ ID NO: 2529450 - DNA, 16 bp, Homo sapiens
ccccagctgacatgga

SEQ ID NO: 2529451 - DNA, 11 bp, Homo sapiens
ccccagctggc

SEQ ID NO: 2529452 - DNA, 12 bp, Homo sapiens
ccccagctggcc

SEQ ID NO: 2529453 - DNA, 13 bp, Homo sapiens
ccccagctggccc

SEQ ID NO: 2529454 - DNA, 21 bp, Homo sapiens
ccccagctggcccgtgacaga

SEQ ID NO: 2529455 - DNA, 19 bp, Homo sapiens
ccctgtttgtttctgaaag

SEQ ID NO: 2529456 - DNA, 14 bp, Homo sapiens
ccctgttttctgag

SEQ ID NO: 2529457 - DNA, 16 bp, Homo sapiens
ccctgttttctgagcc

SEQ ID NO: 2529458 - DNA, 17 bp, Homo sapiens
ccctgttttctgagccc

SEQ ID NO: 2529459 - DNA, 18 bp, Homo sapiens
ccctgttttctgagcccg

SEQ ID NO: 2529460 - DNA, 19 bp, Homo sapiens
cccttacctcggtgccttc

SEQ ID NO: 2529461 - DNA, 21 bp, Homo sapiens
cccttagcccccacccacttc

SEQ ID NO: 2529462 - DNA, 22 bp, Homo sapiens
cccttagcccccacccacttcc

SEQ ID NO: 2529463 - DNA, 14 bp, Homo sapiens
cccttagcctccct

SEQ ID NO: 2529464 - DNA, 16 bp, Homo sapiens
cccttattacacggaa

SEQ ID NO: 2529465 - DNA, 12 bp, Homo sapiens
cccttattttca

SEQ ID NO: 2529466 - DNA, 22 bp, Homo sapiens
cccttcacttctgaccacactt

SEQ ID NO: 2529467 - DNA, 21 bp, Homo sapiens
cccttcagtaccctctcagct

SEQ ID NO: 2529468 - DNA, 18 bp, Homo sapiens
cccttcatctccagggag

SEQ ID NO: 2529469 - DNA, 14 bp, Homo sapiens
cccttcatctggaa

SEQ ID NO: 2529470 - DNA, 16 bp, Homo sapiens
cccttccactgagggc

SEQ ID NO: 2529471 - DNA, 23 bp, Homo sapiens
cccttcccacaggacatttctct

SEQ ID NO: 2529472 - DNA, 12 bp, Homo sapiens
cccttcccacct

SEQ ID NO: 2529473 - DNA, 13 bp, Homo sapiens
cccttcccacctc

SEQ ID NO: 2529474 - DNA, 21 bp, Homo sapiens
cccttcccatgacccaggctg

SEQ ID NO: 2529475 - DNA, 21 bp, Homo sapiens
cccttccccactgcctgccca

SEQ ID NO: 2529476 - DNA, 16 bp, Homo sapiens
cccttcccctccctgg

SEQ ID NO: 2529477 - DNA, 19 bp, Homo sapiens
cccttcccctccctggctc

SEQ ID NO: 2529478 - DNA, 15 bp, Homo sapiens
cccttccctgcaaac

SEQ ID NO: 2529479 - DNA, 17 bp, Homo sapiens
cccttcccttgagccct

SEQ ID NO: 2529480 - DNA, 14 bp, Homo sapiens
cccttcgctcctgt

SEQ ID NO: 2529481 - DNA, 17 bp, Homo sapiens
cccttctacctgccact

SEQ ID NO: 2529482 - DNA, 23 bp, Homo sapiens
cccttctcattccaacagtgagt

SEQ ID NO: 2529483 - DNA, 13 bp, Homo sapiens
cccttctccatct

SEQ ID NO: 2529484 - DNA, 22 bp, Homo sapiens
cccttctccatctctctggccc

SEQ ID NO: 2529485 - DNA, 13 bp, Homo sapiens
cccttctcccaca

SEQ ID NO: 2529486 - DNA, 14 bp, Homo sapiens
cccttctcccatga

SEQ ID NO: 2529487 - DNA, 13 bp, Homo sapiens
cccttctctgctc

SEQ ID NO: 2529488 - DNA, 19 bp, Homo sapiens
cccttctttttcttctttt

SEQ ID NO: 2529489 - DNA, 22 bp, Homo sapiens
cccttgagaaaccttattgtac

SEQ ID NO: 2529490 - DNA, 20 bp, Homo sapiens
cccttgagctccccaaaaac

SEQ ID NO: 2529491 - DNA, 22 bp, Homo sapiens
cccttgaggaaacaacagcttt

SEQ ID NO: 2529492 - DNA, 22 bp, Homo sapiens
cccttgcactaaagtatgtaaa

SEQ ID NO: 2529493 - DNA, 16 bp, Homo sapiens
cccttgcagctagttt

SEQ ID NO: 2529494 - DNA, 19 bp, Homo sapiens
cccttgcagttcagcacca

SEQ ID NO: 2529495 - DNA, 13 bp, Homo sapiens
cccttgccacccc

SEQ ID NO: 2529496 - DNA, 18 bp, Homo sapiens
cccttgccaccccaccct

SEQ ID NO: 2529497 - DNA, 14 bp, Homo sapiens
cccttgcccagggc

SEQ ID NO: 2529498 - DNA, 19 bp, Homo sapiens
cccttgcccagggctcagc

SEQ ID NO: 2529499 - DNA, 15 bp, Homo sapiens
cccttgccctgacct

SEQ ID NO: 2529500 - DNA, 21 bp, Homo sapiens
cccttgccctgacctcccagc

SEQ ID NO: 2529501 - DNA, 17 bp, Homo sapiens
cccttgccgtctacctg

SEQ ID NO: 2529502 - DNA, 19 bp, Homo sapiens
cccttggaaacctgccctg

SEQ ID NO: 2529503 - DNA, 22 bp, Homo sapiens
cccttggaaacctgccctgcct

SEQ ID NO: 2529504 - DNA, 13 bp, Homo sapiens
cccttggaggcca

SEQ ID NO: 2529505 - DNA, 17 bp, Homo sapiens
cccttggaggccagcca

SEQ ID NO: 2529506 - DNA, 18 bp, Homo sapiens
cccttggaggccagccag

SEQ ID NO: 2529507 - DNA, 19 bp, Homo sapiens
cccttggcctgtctcatcc

SEQ ID NO: 2529508 - DNA, 23 bp, Homo sapiens
cccttggctgtgaggcccctgga

SEQ ID NO: 2529509 - DNA, 17 bp, Homo sapiens
cccttggtggcaagagc

SEQ ID NO: 2529510 - DNA, 17 bp, Homo sapiens
cccttgtgcgtgggtga

SEQ ID NO: 2529511 - DNA, 12 bp, Homo sapiens
cccttgtgtgtg

SEQ ID NO: 2529512 - DNA, 18 bp, Homo sapiens
ccctttccttccatccct

SEQ ID NO: 2529513 - DNA, 12 bp, Homo sapiens
ccctttgagtgc

SEQ ID NO: 2529514 - DNA, 14 bp, Homo sapiens
ccctttgagtgcag

SEQ ID NO: 2529515 - DNA, 15 bp, Homo sapiens
ccctttgggcccagg

SEQ ID NO: 2529516 - DNA, 17 bp, Homo sapiens
ccctttgggcccaggga

SEQ ID NO: 2529517 - DNA, 15 bp, Homo sapiens
ccctttgtgctgtgg

SEQ ID NO: 2529518 - DNA, 23 bp, Homo sapiens
ccctttttactccccttgagctg

SEQ ID NO: 2529519 - DNA, 16 bp, Homo sapiens
ccctttttccttgtcc

SEQ ID NO: 2529520 - DNA, 19 bp, Homo sapiens
cccttttttggctgctgaa

SEQ ID NO: 2529521 - DNA, 21 bp, Homo sapiens
cccttttttggctgctgaagg

SEQ ID NO: 2529522 - DNA, 13 bp, Homo sapiens
ccgaacctcctct

SEQ ID NO: 2529523 - DNA, 16 bp, Homo sapiens
ccgaagctctggctga

SEQ ID NO: 2529524 - DNA, 21 bp, Homo sapiens
ccgaagctctggctgaaccct

SEQ ID NO: 2529525 - DNA, 21 bp, Homo sapiens
ccgaagtggactggcccctgg

SEQ ID NO: 2529526 - DNA, 13 bp, Homo sapiens
ccgaatgtgcagg

SEQ ID NO: 2529527 - DNA, 18 bp, Homo sapiens
ccgacaaccgatgctcca

SEQ ID NO: 2529528 - DNA, 18 bp, Homo sapiens
ccgacagccccctctgcc

SEQ ID NO: 2529529 - DNA, 16 bp, Homo sapiens
ccgaccacaccagagc

SEQ ID NO: 2529530 - DNA, 17 bp, Homo sapiens
ccgaccagacaccttga

SEQ ID NO: 2529531 - DNA, 18 bp, Homo sapiens
ccgaccagacaccttgac

SEQ ID NO: 2529532 - DNA, 12 bp, Homo sapiens
ccgacctcagcc

SEQ ID NO: 2529533 - DNA, 16 bp, Homo sapiens
ccgacgcgtctcctgt

SEQ ID NO: 2529534 - DNA, 20 bp, Homo sapiens
ccgactcctgggttgagctg

SEQ ID NO: 2529535 - DNA, 23 bp, Homo sapiens
ccgacttgctgttttgttctgtg

SEQ ID NO: 2529536 - DNA, 21 bp, Homo sapiens
ccgagatcacgccactgcact

SEQ ID NO: 2529537 - DNA, 21 bp, Homo sapiens
ccgagcaaagatcaaaataaa

SEQ ID NO: 2529538 - DNA, 19 bp, Homo sapiens
ccgagcctggctccaaacc

SEQ ID NO: 2529539 - DNA, 19 bp, Homo sapiens
ccgagctcgtgtatcctgg

SEQ ID NO: 2529540 - DNA, 21 bp, Homo sapiens
ccgagctcgtgtatcctgggg

SEQ ID NO: 2529541 - DNA, 21 bp, Homo sapiens
ccgagctgggggccatgagct

SEQ ID NO: 2529542 - DNA, 20 bp, Homo sapiens
ccgagctggtgcattacaga

SEQ ID NO: 2529543 - DNA, 19 bp, Homo sapiens
ccgagctttgaaaattcag

SEQ ID NO: 2529544 - DNA, 19 bp, Homo sapiens
ccgaggacgctccctgctc

SEQ ID NO: 2529545 - DNA, 20 bp, Homo sapiens
ccgaggcagggtcaggagag

SEQ ID NO: 2529546 - DNA, 23 bp, Homo sapiens
ccgaggggcgggacccaggcacc

SEQ ID NO: 2529547 - DNA, 18 bp, Homo sapiens
ccgaggggctcaggaaaa

SEQ ID NO: 2529548 - DNA, 19 bp, Homo sapiens
ccgagggtcctggctcctg

SEQ ID NO: 2529549 - DNA, 21 bp, Homo sapiens
ccgagggtcctggctcctgag

SEQ ID NO: 2529550 - DNA, 16 bp, Homo sapiens
ccgagtagctgggact

SEQ ID NO: 2529551 - DNA, 17 bp, Homo sapiens
ccgagtctgtctctgtc

SEQ ID NO: 2529552 - DNA, 15 bp, Homo sapiens
ccgagtttccccaga

SEQ ID NO: 2529553 - DNA, 14 bp, Homo sapiens
ccgatgctccagcc

SEQ ID NO: 2529554 - DNA, 11 bp, Homo sapiens
ccgatgctgct

SEQ ID NO: 2529555 - DNA, 20 bp, Homo sapiens
ccgatgctgctttcccctgt

SEQ ID NO: 2529556 - DNA, 21 bp, Homo sapiens
ccgattcatctctcagaaggg

SEQ ID NO: 2529557 - DNA, 14 bp, Homo sapiens
ccgatttcccaggc

SEQ ID NO: 2529558 - DNA, 15 bp, Homo sapiens
ccgcaaaccacactg

SEQ ID NO: 2529559 - DNA, 21 bp, Homo sapiens
ccgcaaaccacactggactcc

SEQ ID NO: 2529560 - DNA, 14 bp, Homo sapiens
ccgcactaggggat

SEQ ID NO: 2529561 - DNA, 14 bp, Homo sapiens
ccgcagaagcagac

SEQ ID NO: 2529562 - DNA, 14 bp, Homo sapiens
ccgcagcctccctc

SEQ ID NO: 2529563 - DNA, 13 bp, Homo sapiens
ccgcaggaagctg

SEQ ID NO: 2529564 - DNA, 23 bp, Homo sapiens
ccgcaggatttgggctcttggaa

SEQ ID NO: 2529565 - DNA, 22 bp, Homo sapiens
ccgcagtcgtcgcacagtctct

SEQ ID NO: 2529566 - DNA, 17 bp, Homo sapiens
ccgcatgcggcccagga

SEQ ID NO: 2529567 - DNA, 21 bp, Homo sapiens
ccgccaaaagctgctcaggga

SEQ ID NO: 2529568 - DNA, 23 bp, Homo sapiens
ccgccacatggcttcctcctgcg

SEQ ID NO: 2529569 - DNA, 16 bp, Homo sapiens
ccgccagactgttaga

SEQ ID NO: 2529570 - DNA, 14 bp, Homo sapiens
ccgccattgccacc

SEQ ID NO: 2529571 - DNA, 15 bp, Homo sapiens
ccgcccactgtcctg

SEQ ID NO: 2529572 - DNA, 18 bp, Homo sapiens
ccgcccactgtcctgggc

SEQ ID NO: 2529573 - DNA, 17 bp, Homo sapiens
ccgcccagctgcacctg

SEQ ID NO: 2529574 - DNA, 12 bp, Homo sapiens
ccgcccaggctt

SEQ ID NO: 2529575 - DNA, 13 bp, Homo sapiens
ccgccccacattc

SEQ ID NO: 2529576 - DNA, 12 bp, Homo sapiens
ccgccccctcct

SEQ ID NO: 2529577 - DNA, 18 bp, Homo sapiens
ccgcctcaccccctcggg

SEQ ID NO: 2529578 - DNA, 23 bp, Homo sapiens
ccgcctccccacggccgctccag

SEQ ID NO: 2529579 - DNA, 16 bp, Homo sapiens
ccgcctgaatcattct

SEQ ID NO: 2529580 - DNA, 11 bp, Homo sapiens
ccgcctgccag

SEQ ID NO: 2529581 - DNA, 15 bp, Homo sapiens
ccgcctgccagtcct

SEQ ID NO: 2529582 - DNA, 17 bp, Homo sapiens
ccgcgtctggtgacaac

SEQ ID NO: 2529583 - DNA, 15 bp, Homo sapiens
ccgctagaggcctga

SEQ ID NO: 2529584 - DNA, 16 bp, Homo sapiens
ccgctagaggcctgag

SEQ ID NO: 2529585 - DNA, 14 bp, Homo sapiens
ccgctcctgtctgc

SEQ ID NO: 2529586 - DNA, 19 bp, Homo sapiens
ccgctctacatcttctgcc

SEQ ID NO: 2529587 - DNA, 20 bp, Homo sapiens
ccgctctacatcttctgcct

SEQ ID NO: 2529588 - DNA, 17 bp, Homo sapiens
ccgctgagtggactgga

SEQ ID NO: 2529589 - DNA, 15 bp, Homo sapiens
ccgctgtgagcccct

SEQ ID NO: 2529590 - DNA, 18 bp, Homo sapiens
ccgctgtgagcccctggt

SEQ ID NO: 2529591 - DNA, 18 bp, Homo sapiens
ccgcttggagcagagggg

SEQ ID NO: 2529592 - DNA, 19 bp, Homo sapiens
ccgctttctacccagcgag

SEQ ID NO: 2529593 - DNA, 20 bp, Homo sapiens
ccggactttcggagttgggg

SEQ ID NO: 2529594 - DNA, 17 bp, Homo sapiens
ccggagatgtagcaaaa

SEQ ID NO: 2529595 - DNA, 17 bp, Homo sapiens
ccggagattggacggcc

SEQ ID NO: 2529596 - DNA, 21 bp, Homo sapiens
ccggagattggacggcctgat

SEQ ID NO: 2529597 - DNA, 16 bp, Homo sapiens
ccggagctaacactgg

SEQ ID NO: 2529598 - DNA, 22 bp, Homo sapiens
ccggagctaacactggccccta

SEQ ID NO: 2529599 - DNA, 15 bp, Homo sapiens
cctgagtcacccatg

SEQ ID NO: 2529600 - DNA, 23 bp, Homo sapiens
cctgagtcaccctacctgtgcct

SEQ ID NO: 2529601 - DNA, 19 bp, Homo sapiens
cctgagtcgtacagaaagc

SEQ ID NO: 2529602 - DNA, 14 bp, Homo sapiens
cctgagtctcctgt

SEQ ID NO: 2529603 - DNA, 15 bp, Homo sapiens
cctgagtctcctgtg

SEQ ID NO: 2529604 - DNA, 14 bp, Homo sapiens
cctgagtgcctggc

SEQ ID NO: 2529605 - DNA, 20 bp, Homo sapiens
cctgagtggatctccaagga

SEQ ID NO: 2529606 - DNA, 17 bp, Homo sapiens
cctgataataattgatc

SEQ ID NO: 2529607 - DNA, 14 bp, Homo sapiens
cctgatcaatgaca

SEQ ID NO: 2529608 - DNA, 13 bp, Homo sapiens
cctgatgacagag

SEQ ID NO: 2529609 - DNA, 15 bp, Homo sapiens
cctgatgcagtcacg

SEQ ID NO: 2529610 - DNA, 14 bp, Homo sapiens
cctgatgctccctc

SEQ ID NO: 2529611 - DNA, 19 bp, Homo sapiens
cctgatgctccctcccctg

SEQ ID NO: 2529612 - DNA, 19 bp, Homo sapiens
cctgatgcttcttcagaga

SEQ ID NO: 2529613 - DNA, 17 bp, Homo sapiens
cctgatggacctgtcac

SEQ ID NO: 2529614 - DNA, 23 bp, Homo sapiens
cctgatggcaggatggcctggcc

SEQ ID NO: 2529615 - DNA, 17 bp, Homo sapiens
cctgatggccaggccag

SEQ ID NO: 2529616 - DNA, 18 bp, Homo sapiens
cctgatggtacaggaaag

SEQ ID NO: 2529617 - DNA, 18 bp, Homo sapiens
cctgatggtcagctccct

SEQ ID NO: 2529618 - DNA, 20 bp, Homo sapiens
cctgatggtcagctcccttc

SEQ ID NO: 2529619 - DNA, 17 bp, Homo sapiens
cctgatgttaaaattcc

SEQ ID NO: 2529620 - DNA, 17 bp, Homo sapiens
cctgattgccaagctca

SEQ ID NO: 2529621 - DNA, 19 bp, Homo sapiens
cctgcaaaaggactctcag

SEQ ID NO: 2529622 - DNA, 14 bp, Homo sapiens
cctgcaaactcact

SEQ ID NO: 2529623 - DNA, 15 bp, Homo sapiens
cctgcaaactcactg

SEQ ID NO: 2529624 - DNA, 22 bp, Homo sapiens
cctgcaaactcactgctcaaga

SEQ ID NO: 2529625 - DNA, 22 bp, Homo sapiens
cctgcaacctgattgtgtctct

SEQ ID NO: 2529626 - DNA, 13 bp, Homo sapiens
cctgcaaggacta

SEQ ID NO: 2529627 - DNA, 21 bp, Homo sapiens
cctgcaatgaagtctctgaag

SEQ ID NO: 2529628 - DNA, 20 bp, Homo sapiens
cctgcacaataaaaatgttt

SEQ ID NO: 2529629 - DNA, 18 bp, Homo sapiens
cctgcacggtgggccttg

SEQ ID NO: 2529630 - DNA, 14 bp, Homo sapiens
cctgcactggggag

SEQ ID NO: 2529631 - DNA, 16 bp, Homo sapiens
cctgcaggcagccagg

SEQ ID NO: 2529632 - DNA, 19 bp, Homo sapiens
cctgcaggcagccaggcca

SEQ ID NO: 2529633 - DNA, 20 bp, Homo sapiens
cctgcaggcagccaggccac

SEQ ID NO: 2529634 - DNA, 12 bp, Homo sapiens
cctgcaggccag

SEQ ID NO: 2529635 - DNA, 15 bp, Homo sapiens
cctgcagggccaagc

SEQ ID NO: 2529636 - DNA, 23 bp, Homo sapiens
cctgcagggtggtgctgggactg

SEQ ID NO: 2529637 - DNA, 18 bp, Homo sapiens
cctgcaggtgctgctgcg

SEQ ID NO: 2529638 - DNA, 18 bp, Homo sapiens
cctgcagtactttacctc

SEQ ID NO: 2529639 - DNA, 20 bp, Homo sapiens
cctgcagtactttacctcct

SEQ ID NO: 2529640 - DNA, 16 bp, Homo sapiens
cctgcagtctggctga

SEQ ID NO: 2529641 - DNA, 21 bp, Homo sapiens
cctgcagtctggctgagccct

SEQ ID NO: 2529642 - DNA, 23 bp, Homo sapiens
cctgcatccccttggctgtgagg

SEQ ID NO: 2529643 - DNA, 12 bp, Homo sapiens
cctgccactcac

SEQ ID NO: 2529644 - DNA, 16 bp, Homo sapiens
cctgccactcacacag

SEQ ID NO: 2529645 - DNA, 23 bp, Homo sapiens
cctgccactcacacagccaggtg

SEQ ID NO: 2529646 - DNA, 15 bp, Homo sapiens
cctgccagcctggct

SEQ ID NO: 2529647 - DNA, 13 bp, Homo sapiens
cctgccagggaca

SEQ ID NO: 2529648 - DNA, 22 bp, Homo sapiens
cctgccagggacagagggggtg

SEQ ID NO: 2529649 - DNA, 20 bp, Homo sapiens
cctgccagggagacagagct

SEQ ID NO: 2529650 - DNA, 12 bp, Homo sapiens
cctgccagtcct

SEQ ID NO: 2529651 - DNA, 15 bp, Homo sapiens
cctgccagtcctagc

SEQ ID NO: 2529652 - DNA, 16 bp, Homo sapiens
cctgccagtcctagct

SEQ ID NO: 2529653 - DNA, 19 bp, Homo sapiens
cctgccagtcctagctgca

SEQ ID NO: 2529654 - DNA, 22 bp, Homo sapiens
cctgccagtcctagctgcacag

SEQ ID NO: 2529655 - DNA, 22 bp, Homo sapiens
cctgcccacccgtggagatggg

SEQ ID NO: 2529656 - DNA, 13 bp, Homo sapiens
cctgcccacctgg

SEQ ID NO: 2529657 - DNA, 18 bp, Homo sapiens
cctgcccacctggcctct

SEQ ID NO: 2529658 - DNA, 13 bp, Homo sapiens
cctgcccacctgt

SEQ ID NO: 2529659 - DNA, 13 bp, Homo sapiens
cctgcccaggccc

SEQ ID NO: 2529660 - DNA, 15 bp, Homo sapiens
cctgcccaggcccct

SEQ ID NO: 2529661 - DNA, 16 bp, Homo sapiens
cctgcccatctgggaa

SEQ ID NO: 2529662 - DNA, 12 bp, Homo sapiens
cctgccccctgg

SEQ ID NO: 2529663 - DNA, 15 bp, Homo sapiens
cctgccccctggtgg

SEQ ID NO: 2529664 - DNA, 19 bp, Homo sapiens
cctgcccccttctcccaca

SEQ ID NO: 2529665 - DNA, 22 bp, Homo sapiens
cctgcccccttctcccacactg

SEQ ID NO: 2529666 - DNA, 22 bp, Homo sapiens
cctgccccgcccagctgcacct

SEQ ID NO: 2529667 - DNA, 14 bp, Homo sapiens
cctgcccctcccag

SEQ ID NO: 2529668 - DNA, 16 bp, Homo sapiens
cctgcccctctcccgc

SEQ ID NO: 2529669 - DNA, 17 bp, Homo sapiens
cctgcccctgccccgtc

SEQ ID NO: 2529670 - DNA, 10 bp, Homo sapiens
cctgcccggg

SEQ ID NO: 2529671 - DNA, 22 bp, Homo sapiens
cctgcccgggcgcggccagccc

SEQ ID NO: 2529672 - DNA, 12 bp, Homo sapiens
cctgcccgtctc

SEQ ID NO: 2529673 - DNA, 13 bp, Homo sapiens
cctgcccgtctct

SEQ ID NO: 2529674 - DNA, 19 bp, Homo sapiens
cctgcccgtctctctccca

SEQ ID NO: 2529675 - DNA, 22 bp, Homo sapiens
cctgcccgtctctctcccatgg

SEQ ID NO: 2529676 - DNA, 23 bp, Homo sapiens
cctgccctacagaggtctctgcc

SEQ ID NO: 2529677 - DNA, 22 bp, Homo sapiens
cctgccctagagcacactgtag

SEQ ID NO: 2529678 - DNA, 14 bp, Homo sapiens
cctgccctagctcc

SEQ ID NO: 2529679 - DNA, 14 bp, Homo sapiens
cctgccctccccag

SEQ ID NO: 2529680 - DNA, 16 bp, Homo sapiens
cctgccctccccagag

SEQ ID NO: 2529681 - DNA, 22 bp, Homo sapiens
cctgccctccccagagcactgg

SEQ ID NO: 2529682 - DNA, 13 bp, Homo sapiens
cctgccctcgtgg

SEQ ID NO: 2529683 - DNA, 14 bp, Homo sapiens
cctgccctcgtggc

SEQ ID NO: 2529684 - DNA, 18 bp, Homo sapiens
cctgccctcgtggccagc

SEQ ID NO: 2529685 - DNA, 22 bp, Homo sapiens
cctgccctcgtggccagcccgg

SEQ ID NO: 2529686 - DNA, 13 bp, Homo sapiens
cctgccctgcctg

SEQ ID NO: 2529687 - DNA, 14 bp, Homo sapiens
cctgccctgcctga

SEQ ID NO: 2529688 - DNA, 13 bp, Homo sapiens
cctgccctgctgc

SEQ ID NO: 2529689 - DNA, 12 bp, Homo sapiens
cctgccctggtc

SEQ ID NO: 2529690 - DNA, 12 bp, Homo sapiens
cctgccctgtgg

SEQ ID NO: 2529691 - DNA, 16 bp, Homo sapiens
cctgccgactcctggg

SEQ ID NO: 2529692 - DNA, 21 bp, Homo sapiens
cctgcctaggaattcccagcc

SEQ ID NO: 2529693 - DNA, 21 bp, Homo sapiens
cctgcctcacagctggccgtc

SEQ ID NO: 2529694 - DNA, 11 bp, Homo sapiens
cctgcctcagc

SEQ ID NO: 2529695 - DNA, 14 bp, Homo sapiens
cctgcctccaccct

SEQ ID NO: 2529696 - DNA, 19 bp, Homo sapiens
cctgcctccaccctctgag

SEQ ID NO: 2529697 - DNA, 20 bp, Homo sapiens
cctgcctccaccctctgagc

SEQ ID NO: 2529698 - DNA, 15 bp, Homo sapiens
cctgcctcccctgtg

SEQ ID NO: 2529699 - DNA, 13 bp, Homo sapiens
cctgcctcctgcc

SEQ ID NO: 2529700 - DNA, 15 bp, Homo sapiens
cctgcctcctttgtg

SEQ ID NO: 2529701 - DNA, 19 bp, Homo sapiens
cctgcctcctttgtgagga

SEQ ID NO: 2529702 - DNA, 19 bp, Homo sapiens
cctgcctcgaactggctgc

SEQ ID NO: 2529703 - DNA, 23 bp, Homo sapiens
cctgcctctcatcaactgaatga

SEQ ID NO: 2529704 - DNA, 14 bp, Homo sapiens
cctgcctctgtttg

SEQ ID NO: 2529705 - DNA, 18 bp, Homo sapiens
cctgcctgagggcccctc

SEQ ID NO: 2529706 - DNA, 22 bp, Homo sapiens
cctgcctgagggcccctctgcc

SEQ ID NO: 2529707 - DNA, 12 bp, Homo sapiens
cctgcctggagc

SEQ ID NO: 2529708 - DNA, 13 bp, Homo sapiens
cctgcctggagcg

SEQ ID NO: 2529709 - DNA, 13 bp, Homo sapiens
cctgcctggccag

SEQ ID NO: 2529710 - DNA, 22 bp, Homo sapiens
cctgcctggccaggcagatctg

SEQ ID NO: 2529711 - DNA, 23 bp, Homo sapiens
cctgcctggccaggcagatctgt

SEQ ID NO: 2529712 - DNA, 23 bp, Homo sapiens
cctgcctggggcgggcccctcat

SEQ ID NO: 2529713 - DNA, 13 bp, Homo sapiens
cctgcctgtctcc

SEQ ID NO: 2529714 - DNA, 12 bp, Homo sapiens
cctgcctgtctg

SEQ ID NO: 2529715 - DNA, 18 bp, Homo sapiens
cctgcctgtctgtctctc

SEQ ID NO: 2529716 - DNA, 22 bp, Homo sapiens
cctgcctgtctgtctctccatc

SEQ ID NO: 2529717 - DNA, 22 bp, Homo sapiens
cctgcctgttcccattcttgca

SEQ ID NO: 2529718 - DNA, 22 bp, Homo sapiens
cctgccttcctcctgggccctc

SEQ ID NO: 2529719 - DNA, 15 bp, Homo sapiens
cctgccttctgtcct

SEQ ID NO: 2529720 - DNA, 17 bp, Homo sapiens
cctgccttgaagccact

SEQ ID NO: 2529721 - DNA, 21 bp, Homo sapiens
cctgccttgaagccactgaag

SEQ ID NO: 2529722 - DNA, 22 bp, Homo sapiens
cctgccttgaagccactgaagc

SEQ ID NO: 2529723 - DNA, 20 bp, Homo sapiens
cctgcgcccaccccgctctg

SEQ ID NO: 2529724 - DNA, 21 bp, Homo sapiens
cctgcgcccaccccgctctgc

SEQ ID NO: 2529725 - DNA, 22 bp, Homo sapiens
cctgcgcccaccccgctctgca

SEQ ID NO: 2529726 - DNA, 20 bp, Homo sapiens
cctgcgcgcatgtgcgcaca

SEQ ID NO: 2529727 - DNA, 19 bp, Homo sapiens
cctgcggagtgaagagggg

SEQ ID NO: 2529728 - DNA, 20 bp, Homo sapiens
cctgcggagtgaagaggggc

SEQ ID NO: 2529729 - DNA, 16 bp, Homo sapiens
cctgcggcctgctgga

SEQ ID NO: 2529730 - DNA, 20 bp, Homo sapiens
cctgcggctgctgtgtgcct

SEQ ID NO: 2529731 - DNA, 21 bp, Homo sapiens
cctgcggctgctgtgtgcctt

SEQ ID NO: 2529732 - DNA, 16 bp, Homo sapiens
cctgcggtgctatctc

SEQ ID NO: 2529733 - DNA, 23 bp, Homo sapiens
cctgcgtcgaagctttgaaggcc

SEQ ID NO: 2529734 - DNA, 15 bp, Homo sapiens
cctgcgtggggacag

SEQ ID NO: 2529735 - DNA, 13 bp, Homo sapiens
cctgctactctgt

SEQ ID NO: 2529736 - DNA, 16 bp, Homo sapiens
cctgctactctgttcc

SEQ ID NO: 2529737 - DNA, 22 bp, Homo sapiens
cctgctattactaaggagtaat

SEQ ID NO: 2529738 - DNA, 14 bp, Homo sapiens
cctgctcccagcag

SEQ ID NO: 2529739 - DNA, 15 bp, Homo sapiens
cctgctcccagcagc

SEQ ID NO: 2529740 - DNA, 16 bp, Homo sapiens
cctgctcccagcagcc

SEQ ID NO: 2529741 - DNA, 15 bp, Homo sapiens
cctgctcctccctgg

SEQ ID NO: 2529742 - DNA, 17 bp, Homo sapiens
cctgctcctccctggct

SEQ ID NO: 2529743 - DNA, 18 bp, Homo sapiens
cctgctccttcccaggag

SEQ ID NO: 2529744 - DNA, 18 bp, Homo sapiens
ccttggaggctgtcttct

SEQ ID NO: 2529745 - DNA, 20 bp, Homo sapiens
ccttggcatgccttccagca

SEQ ID NO: 2529746 - DNA, 14 bp, Homo sapiens
ccttggcctcagaa

SEQ ID NO: 2529747 - DNA, 16 bp, Homo sapiens
ccttggctgcagggag

SEQ ID NO: 2529748 - DNA, 12 bp, Homo sapiens
ccttggctggtg

SEQ ID NO: 2529749 - DNA, 14 bp, Homo sapiens
ccttggctggtgca

SEQ ID NO: 2529750 - DNA, 15 bp, Homo sapiens
ccttgggaggcccca

SEQ ID NO: 2529751 - DNA, 19 bp, Homo sapiens
ccttgggaggccccactgg

SEQ ID NO: 2529752 - DNA, 14 bp, Homo sapiens
ccttgggcggctga

SEQ ID NO: 2529753 - DNA, 18 bp, Homo sapiens
ccttgggctgctcctcat

SEQ ID NO: 2529754 - DNA, 15 bp, Homo sapiens
ccttggtggcaagag

SEQ ID NO: 2529755 - DNA, 17 bp, Homo sapiens
ccttggttcccttgtgt

SEQ ID NO: 2529756 - DNA, 16 bp, Homo sapiens
ccttgtaattctaaat

SEQ ID NO: 2529757 - DNA, 16 bp, Homo sapiens
ccttgtcactggtaga

SEQ ID NO: 2529758 - DNA, 16 bp, Homo sapiens
ccttgtccacccacct

SEQ ID NO: 2529759 - DNA, 18 bp, Homo sapiens
ccttgtccccacactcct

SEQ ID NO: 2529760 - DNA, 19 bp, Homo sapiens
ccttgtccccacactccta

SEQ ID NO: 2529761 - DNA, 14 bp, Homo sapiens
ccttgtcccctgcc

SEQ ID NO: 2529762 - DNA, 21 bp, Homo sapiens
ccttgtcgttgactttaggga

SEQ ID NO: 2529763 - DNA, 16 bp, Homo sapiens
ccttgtgcctggctca

SEQ ID NO: 2529764 - DNA, 18 bp, Homo sapiens
ccttgtgcctggctcaga

SEQ ID NO: 2529765 - DNA, 16 bp, Homo sapiens
ccttgtggcctgggcc

SEQ ID NO: 2529766 - DNA, 16 bp, Homo sapiens
ccttgttggagcctgc

SEQ ID NO: 2529767 - DNA, 22 bp, Homo sapiens
ccttgtttcaaacacaaatgca

SEQ ID NO: 2529768 - DNA, 20 bp, Homo sapiens
cctttaaaaaaatttaagtg

SEQ ID NO: 2529769 - DNA, 14 bp, Homo sapiens
cctttacggacacc

SEQ ID NO: 2529770 - DNA, 18 bp, Homo sapiens
cctttactcatagcactt

SEQ ID NO: 2529771 - DNA, 14 bp, Homo sapiens
cctttagcgcccag

SEQ ID NO: 2529772 - DNA, 13 bp, Homo sapiens
cctttagggcagc

SEQ ID NO: 2529773 - DNA, 14 bp, Homo sapiens
cctttagggcagct

SEQ ID NO: 2529774 - DNA, 15 bp, Homo sapiens
cctttagggcagctt

SEQ ID NO: 2529775 - DNA, 19 bp, Homo sapiens
cctttagtacctgaaaagt

SEQ ID NO: 2529776 - DNA, 18 bp, Homo sapiens
cctttagtggtggccatt

SEQ ID NO: 2529777 - DNA, 16 bp, Homo sapiens
cctttcaaatttcaca

SEQ ID NO: 2529778 - DNA, 13 bp, Homo sapiens
cctttcagatgtc

SEQ ID NO: 2529779 - DNA, 14 bp, Homo sapiens
cctttcagatgtct

SEQ ID NO: 2529780 - DNA, 20 bp, Homo sapiens
cctttcagggaatttcagga

SEQ ID NO: 2529781 - DNA, 14 bp, Homo sapiens
cctttcatttactg

SEQ ID NO: 2529782 - DNA, 19 bp, Homo sapiens
cctttcccaggtgctacac

SEQ ID NO: 2529783 - DNA, 13 bp, Homo sapiens
cctttcctgtagc

SEQ ID NO: 2529784 - DNA, 18 bp, Homo sapiens
cctttccttccatcccta

SEQ ID NO: 2529785 - DNA, 15 bp, Homo sapiens
cctttctccagccag

SEQ ID NO: 2529786 - DNA, 16 bp, Homo sapiens
cctttctccagccagc

SEQ ID NO: 2529787 - DNA, 14 bp, Homo sapiens
cctttctggctctc

SEQ ID NO: 2529788 - DNA, 11 bp, Homo sapiens
cctttctgtgt

SEQ ID NO: 2529789 - DNA, 16 bp, Homo sapiens
cctttgacctgcctcc

SEQ ID NO: 2529790 - DNA, 20 bp, Homo sapiens
cctttgacgccatcccagcc

SEQ ID NO: 2529791 - DNA, 23 bp, Homo sapiens
cctttgacgccatcccagcccca

SEQ ID NO: 2529792 - DNA, 22 bp, Homo sapiens
cctttgagcccacaaagcctta

SEQ ID NO: 2529793 - DNA, 17 bp, Homo sapiens
cctttgataaaataaat

SEQ ID NO: 2529794 - DNA, 21 bp, Homo sapiens
cctttgattaaagactccagt

SEQ ID NO: 2529795 - DNA, 17 bp, Homo sapiens
cctttgcactgagggcc

SEQ ID NO: 2529796 - DNA, 18 bp, Homo sapiens
cctttgcactgagggcca

SEQ ID NO: 2529797 - DNA, 19 bp, Homo sapiens
cctttgctgaggcctccag

SEQ ID NO: 2529798 - DNA, 16 bp, Homo sapiens
cctttgcttgaaagaa

SEQ ID NO: 2529799 - DNA, 14 bp, Homo sapiens
cctttggagaccat

SEQ ID NO: 2529800 - DNA, 15 bp, Homo sapiens
cctttggcagagttc

SEQ ID NO: 2529801 - DNA, 18 bp, Homo sapiens
cctttggcaggtgcagcc

SEQ ID NO: 2529802 - DNA, 19 bp, Homo sapiens
cctttggcaggtgcagccc

SEQ ID NO: 2529803 - DNA, 14 bp, Homo sapiens
cctttgggaagggg

SEQ ID NO: 2529804 - DNA, 23 bp, Homo sapiens
cctttgtcatcattgtatatatg

SEQ ID NO: 2529805 - DNA, 18 bp, Homo sapiens
cctttgtcatctttcttc

SEQ ID NO: 2529806 - DNA, 14 bp, Homo sapiens
cctttgtcccagaa

SEQ ID NO: 2529807 - DNA, 15 bp, Homo sapiens
cctttgtgaggaagc

SEQ ID NO: 2529808 - DNA, 23 bp, Homo sapiens
cctttgtgaggaagccgctgggg

SEQ ID NO: 2529809 - DNA, 18 bp, Homo sapiens
ccttttaacacctgatgt

SEQ ID NO: 2529810 - DNA, 18 bp, Homo sapiens
ccttttacatactgctgt

SEQ ID NO: 2529811 - DNA, 23 bp, Homo sapiens
ccttttcagcgatgtatgcagct

SEQ ID NO: 2529812 - DNA, 12 bp, Homo sapiens
ccttttgcaccc

SEQ ID NO: 2529813 - DNA, 15 bp, Homo sapiens
ccttttgcacccctc

SEQ ID NO: 2529814 - DNA, 17 bp, Homo sapiens
ccttttgcacctgctct

SEQ ID NO: 2529815 - DNA, 20 bp, Homo sapiens
ccttttgcacctgctctctt

SEQ ID NO: 2529816 - DNA, 18 bp, Homo sapiens
ccttttgcttgaaaccaa

SEQ ID NO: 2529817 - DNA, 17 bp, Homo sapiens
cctttttatttgcatgt

SEQ ID NO: 2529818 - DNA, 13 bp, Homo sapiens
cctttttccttcc

SEQ ID NO: 2529819 - DNA, 13 bp, Homo sapiens
ccttttttaagat

SEQ ID NO: 2529820 - DNA, 14 bp, Homo sapiens
ccttttttaagatt

SEQ ID NO: 2529821 - DNA, 20 bp, Homo sapiens
ccttttttaagatttttctc

SEQ ID NO: 2529822 - DNA, 18 bp, Homo sapiens
ccttttttatacataaac

SEQ ID NO: 2529823 - DNA, 19 bp, Homo sapiens
ccttttttatacataaaca

SEQ ID NO: 2529824 - DNA, 12 bp, Homo sapiens
ccttttttgatc

SEQ ID NO: 2529825 - DNA, 20 bp, Homo sapiens
ccttttttggctgctgaagg

SEQ ID NO: 2529826 - DNA, 19 bp, Homo sapiens
cgaaaaatcctcttcctct

SEQ ID NO: 2529827 - DNA, 13 bp, Homo sapiens
cgaaacagcgctg

SEQ ID NO: 2529828 - DNA, 19 bp, Homo sapiens
cgaaagggacttggaagct

SEQ ID NO: 2529829 - DNA, 22 bp, Homo sapiens
cgaaagggacttggaagctccg

SEQ ID NO: 2529830 - DNA, 23 bp, Homo sapiens
cgaaagggacttggaagctccgc

SEQ ID NO: 2529831 - DNA, 16 bp, Homo sapiens
cgaaataacaatgtta

SEQ ID NO: 2529832 - DNA, 13 bp, Homo sapiens
cgaaatgttattt

SEQ ID NO: 2529833 - DNA, 16 bp, Homo sapiens
cgaacctcctctgtga

SEQ ID NO: 2529834 - DNA, 15 bp, Homo sapiens
cgaagctctggctga

SEQ ID NO: 2529835 - DNA, 20 bp, Homo sapiens
cgaagctctggctgaaccct

SEQ ID NO: 2529836 - DNA, 23 bp, Homo sapiens
cgaaggcagtgcaagagactctg

SEQ ID NO: 2529837 - DNA, 22 bp, Homo sapiens
cgaagtggactggcccctgggt

SEQ ID NO: 2529838 - DNA, 13 bp, Homo sapiens
cgaagtgttgcat

SEQ ID NO: 2529839 - DNA, 14 bp, Homo sapiens
cgaagttgatgcaa

SEQ ID NO: 2529840 - DNA, 19 bp, Homo sapiens
cgaatacttttgccctttg

SEQ ID NO: 2529841 - DNA, 18 bp, Homo sapiens
cgaatcccctccctgtca

SEQ ID NO: 2529842 - DNA, 19 bp, Homo sapiens
cgaatcccctccctgtcaa

SEQ ID NO: 2529843 - DNA, 21 bp, Homo sapiens
cgacaaccgatgctccagcca

SEQ ID NO: 2529844 - DNA, 16 bp, Homo sapiens
cgacagtgagactctg

SEQ ID NO: 2529845 - DNA, 16 bp, Homo sapiens
cgaccacccctgcctc

SEQ ID NO: 2529846 - DNA, 15 bp, Homo sapiens
cgaccgaggctggag

SEQ ID NO: 2529847 - DNA, 13 bp, Homo sapiens
cgacctcagcctt

SEQ ID NO: 2529848 - DNA, 12 bp, Homo sapiens
cgacctcggtgg

SEQ ID NO: 2529849 - DNA, 15 bp, Homo sapiens
cgacgcgtctcctgt

SEQ ID NO: 2529850 - DNA, 22 bp, Homo sapiens
cgacggtgggcatttgtgaggc

SEQ ID NO: 2529851 - DNA, 13 bp, Homo sapiens
cgactcagcctca

SEQ ID NO: 2529852 - DNA, 20 bp, Homo sapiens
cgactgcacagcggcccctg

SEQ ID NO: 2529853 - DNA, 13 bp, Homo sapiens
cgagaagcaagaa

SEQ ID NO: 2529854 - DNA, 16 bp, Homo sapiens
cgagaagctgctctgg

SEQ ID NO: 2529855 - DNA, 14 bp, Homo sapiens
cgagaccagcctgg

SEQ ID NO: 2529856 - DNA, 16 bp, Homo sapiens
cgagaccagcctggcc

SEQ ID NO: 2529857 - DNA, 21 bp, Homo sapiens
cgagagagcacccctctctgc

SEQ ID NO: 2529858 - DNA, 14 bp, Homo sapiens
cgagaggcagagaa

SEQ ID NO: 2529859 - DNA, 15 bp, Homo sapiens
cgagaggcagagaaa

SEQ ID NO: 2529860 - DNA, 16 bp, Homo sapiens
cgagatcacgccactg

SEQ ID NO: 2529861 - DNA, 17 bp, Homo sapiens
cgagatcacgccactgc

SEQ ID NO: 2529862 - DNA, 18 bp, Homo sapiens
cgagatcacgccactgca

SEQ ID NO: 2529863 - DNA, 23 bp, Homo sapiens
cgagcaaagatcaaaataaaaag

SEQ ID NO: 2529864 - DNA, 18 bp, Homo sapiens
cgagcagggtgctgtggg

SEQ ID NO: 2529865 - DNA, 15 bp, Homo sapiens
cgagccctggtggca

SEQ ID NO: 2529866 - DNA, 16 bp, Homo sapiens
cgagccctggtggcag

SEQ ID NO: 2529867 - DNA, 18 bp, Homo sapiens
cgagccggggagtttctt

SEQ ID NO: 2529868 - DNA, 17 bp, Homo sapiens
cgagctcgtgtatcctg

SEQ ID NO: 2529869 - DNA, 20 bp, Homo sapiens
cgagctcgtgtatcctgggg

SEQ ID NO: 2529870 - DNA, 12 bp, Homo sapiens
cgagctgggggc

SEQ ID NO: 2529871 - DNA, 13 bp, Homo sapiens
cgagctgggggcc

SEQ ID NO: 2529872 - DNA, 16 bp, Homo sapiens
cgagctgggggccatg

SEQ ID NO: 2529873 - DNA, 20 bp, Homo sapiens
cgagctgggggccatgagct

SEQ ID NO: 2529874 - DNA, 13 bp, Homo sapiens
cgagctggtgcat

SEQ ID NO: 2529875 - DNA, 15 bp, Homo sapiens
cgaggaaccagagcc

SEQ ID NO: 2529876 - DNA, 16 bp, Homo sapiens
cgaggacagggaggtg

SEQ ID NO: 2529877 - DNA, 12 bp, Homo sapiens
cgaggacccaga

SEQ ID NO: 2529878 - DNA, 21 bp, Homo sapiens
cgaggactgtatttgtgacta

SEQ ID NO: 2529879 - DNA, 15 bp, Homo sapiens
cgaggcagaggacag

SEQ ID NO: 2529880 - DNA, 14 bp, Homo sapiens
cgaggcagggtcag

SEQ ID NO: 2529881 - DNA, 22 bp, Homo sapiens
cgaggcagggtcaggagagggg

SEQ ID NO: 2529882 - DNA, 13 bp, Homo sapiens
cgaggcccgcatg

SEQ ID NO: 2529883 - DNA, 18 bp, Homo sapiens
cgaggccttctctgaagg

SEQ ID NO: 2529884 - DNA, 12 bp, Homo sapiens
cgagggcaggga

SEQ ID NO: 2529885 - DNA, 18 bp, Homo sapiens
cgaggggagggtggcagg

SEQ ID NO: 2529886 - DNA, 14 bp, Homo sapiens
cgagggtcctggct

SEQ ID NO: 2529887 - DNA, 16 bp, Homo sapiens
cgagggtcctggctcc

SEQ ID NO: 2529888 - DNA, 23 bp, Homo sapiens
cgagggtcctggctcctgagggg

SEQ ID NO: 2529889 - DNA, 16 bp, Homo sapiens
cgaggtatgaggtcta

SEQ ID NO: 2529890 - DNA, 18 bp, Homo sapiens
ctaacagataagcaagag

SEQ ID NO: 2529891 - DNA, 23 bp, Homo sapiens
ctaacatataatgttgttattta

SEQ ID NO: 2529892 - DNA, 18 bp, Homo sapiens
ctaacattttaaataaaa

SEQ ID NO: 2529893 - DNA, 14 bp, Homo sapiens
ctaaccacgctgga

SEQ ID NO: 2529894 - DNA, 17 bp, Homo sapiens
ctaaccacgctggacct

SEQ ID NO: 2529895 - DNA, 16 bp, Homo sapiens
ctaaccagcagaaatg

SEQ ID NO: 2529896 - DNA, 21 bp, Homo sapiens
ctaacctgaccgtgggcgggg

SEQ ID NO: 2529897 - DNA, 17 bp, Homo sapiens
ctaacctgggttccctt

SEQ ID NO: 2529898 - DNA, 20 bp, Homo sapiens
ctaacgacttcagggcaggg

SEQ ID NO: 2529899 - DNA, 20 bp, Homo sapiens
ctaactagagcagccctgga

SEQ ID NO: 2529900 - DNA, 14 bp, Homo sapiens
ctaactccagtgaa

SEQ ID NO: 2529901 - DNA, 14 bp, Homo sapiens
ctaactggactggt

SEQ ID NO: 2529902 - DNA, 14 bp, Homo sapiens
ctaacttggagccg

SEQ ID NO: 2529903 - DNA, 11 bp, Homo sapiens
ctaagagccat

SEQ ID NO: 2529904 - DNA, 22 bp, Homo sapiens
ctaagagggagggagggctcca

SEQ ID NO: 2529905 - DNA, 12 bp, Homo sapiens
ctaagatgacat

SEQ ID NO: 2529906 - DNA, 15 bp, Homo sapiens
ctaagatgacattgc

SEQ ID NO: 2529907 - DNA, 18 bp, Homo sapiens
ctaagatgacattgctaa

SEQ ID NO: 2529908 - DNA, 20 bp, Homo sapiens
ctaagatgacattgctaaga

SEQ ID NO: 2529909 - DNA, 20 bp, Homo sapiens
ctaagcacgggccatatgaa

SEQ ID NO: 2529910 - DNA, 23 bp, Homo sapiens
ctaagcacgggccatatgaataa

SEQ ID NO: 2529911 - DNA, 14 bp, Homo sapiens
ctaagcccccgctg

SEQ ID NO: 2529912 - DNA, 18 bp, Homo sapiens
ctaagcccccgctgtaat

SEQ ID NO: 2529913 - DNA, 20 bp, Homo sapiens
ctaagccctgtcgagacact

SEQ ID NO: 2529914 - DNA, 21 bp, Homo sapiens
ctaagccctgtcgagacactt

SEQ ID NO: 2529915 - DNA, 17 bp, Homo sapiens
ctaagcctttccataag

SEQ ID NO: 2529916 - DNA, 14 bp, Homo sapiens
ctaagctaggaatg

SEQ ID NO: 2529917 - DNA, 19 bp, Homo sapiens
ctaagctattcagtaataa

SEQ ID NO: 2529918 - DNA, 19 bp, Homo sapiens
ctaagctttgccagctgct

SEQ ID NO: 2529919 - DNA, 11 bp, Homo sapiens
ctaaggacaca

SEQ ID NO: 2529920 - DNA, 12 bp, Homo sapiens
ctaaggacacac

SEQ ID NO: 2529921 - DNA, 12 bp, Homo sapiens
ctaaggatctct

SEQ ID NO: 2529922 - DNA, 20 bp, Homo sapiens
ctaaggatctctcaggagca

SEQ ID NO: 2529923 - DNA, 20 bp, Homo sapiens
ctaaggatgctaaaccttag

SEQ ID NO: 2529924 - DNA, 19 bp, Homo sapiens
ctaaggatgtcacagggcc

SEQ ID NO: 2529925 - DNA, 18 bp, Homo sapiens
ctaagtaaaaccacagca

SEQ ID NO: 2529926 - DNA, 15 bp, Homo sapiens
ctaagtcctttatgt

SEQ ID NO: 2529927 - DNA, 23 bp, Homo sapiens
ctaagtgaaataagccagacatc

SEQ ID NO: 2529928 - DNA, 13 bp, Homo sapiens
ctaagtttcagtt

SEQ ID NO: 2529929 - DNA, 20 bp, Homo sapiens
ctaataaaatttaaaagtct

SEQ ID NO: 2529930 - DNA, 19 bp, Homo sapiens
ctaatacagcaacaattta

SEQ ID NO: 2529931 - DNA, 19 bp, Homo sapiens
ctaatagacaatttattat

SEQ ID NO: 2529932 - DNA, 23 bp, Homo sapiens
ctaatagttttattaataaacat

SEQ ID NO: 2529933 - DNA, 12 bp, Homo sapiens
ctaatatcagca

SEQ ID NO: 2529934 - DNA, 21 bp, Homo sapiens
ctaatcagggaggtcattttg

SEQ ID NO: 2529935 - DNA, 12 bp, Homo sapiens
ctaatcagtgtc

SEQ ID NO: 2529936 - DNA, 13 bp, Homo sapiens
ctaatcagtgtct

SEQ ID NO: 2529937 - DNA, 17 bp, Homo sapiens
ctaatcagtgtctcaca

SEQ ID NO: 2529938 - DNA, 20 bp, Homo sapiens
ctaatcagtgtctcacactg

SEQ ID NO: 2529939 - DNA, 23 bp, Homo sapiens
ctaatccctgggcattgctttcc

SEQ ID NO: 2529940 - DNA, 18 bp, Homo sapiens
ctaatctattgggttcat

SEQ ID NO: 2529941 - DNA, 20 bp, Homo sapiens
ctaatctattgggttcatta

SEQ ID NO: 2529942 - DNA, 21 bp, Homo sapiens
ctaatctattgggttcattat

SEQ ID NO: 2529943 - DNA, 13 bp, Homo sapiens
ctaatctgtaggg

SEQ ID NO: 2529944 - DNA, 14 bp, Homo sapiens
ctaatctgtagggc

SEQ ID NO: 2529945 - DNA, 22 bp, Homo sapiens
ctaatctgtagggctggaccta

SEQ ID NO: 2529946 - DNA, 22 bp, Homo sapiens
ctaatgaatgcataaaatgtta

SEQ ID NO: 2529947 - DNA, 14 bp, Homo sapiens
ctaatgtactgcat

SEQ ID NO: 2529948 - DNA, 15 bp, Homo sapiens
ctaattcctttctat

SEQ ID NO: 2529949 - DNA, 15 bp, Homo sapiens
ctaattgtataacag

SEQ ID NO: 2529950 - DNA, 17 bp, Homo sapiens
ctaattgtataacaggt

SEQ ID NO: 2529951 - DNA, 20 bp, Homo sapiens
ctaattgtataacaggttat

SEQ ID NO: 2529952 - DNA, 21 bp, Homo sapiens
ctaatttatcctgaaatttca

SEQ ID NO: 2529953 - DNA, 21 bp, Homo sapiens
ctaatttatcttgtctctggg

SEQ ID NO: 2529954 - DNA, 16 bp, Homo sapiens
ctacaaaaacacagca

SEQ ID NO: 2529955 - DNA, 18 bp, Homo sapiens
ctacaaaaacacagcaag

SEQ ID NO: 2529956 - DNA, 20 bp, Homo sapiens
ctacaaaaacacagcaaggg

SEQ ID NO: 2529957 - DNA, 21 bp, Homo sapiens
ctacaaaacctgatgttaaaa

SEQ ID NO: 2529958 - DNA, 19 bp, Homo sapiens
ctacaaagaagacatgttt

SEQ ID NO: 2529959 - DNA, 19 bp, Homo sapiens
ctacaagagcagcctgtgg

SEQ ID NO: 2529960 - DNA, 22 bp, Homo sapiens
ctacaagagcagcctgtggcat

SEQ ID NO: 2529961 - DNA, 16 bp, Homo sapiens
ctacaattttctccca

SEQ ID NO: 2529962 - DNA, 13 bp, Homo sapiens
ctacacactgcat

SEQ ID NO: 2529963 - DNA, 21 bp, Homo sapiens
ctacacactgcatgtttgtga

SEQ ID NO: 2529964 - DNA, 13 bp, Homo sapiens
ctacaccttgagg

SEQ ID NO: 2529965 - DNA, 18 bp, Homo sapiens
ctacactccagcctgagc

SEQ ID NO: 2529966 - DNA, 16 bp, Homo sapiens
ctacactccagtgaga

SEQ ID NO: 2529967 - DNA, 17 bp, Homo sapiens
ctacagaggccatgggc

SEQ ID NO: 2529968 - DNA, 18 bp, Homo sapiens
ctacagaggccatgggcc

SEQ ID NO: 2529969 - DNA, 20 bp, Homo sapiens
ctacagaggccatgggcctc

SEQ ID NO: 2529970 - DNA, 20 bp, Homo sapiens
ctacagaggtctctgccggc

SEQ ID NO: 2529971 - DNA, 22 bp, Homo sapiens
ctacagctttgtgactgtatat

SEQ ID NO: 2529972 - DNA, 18 bp, Homo sapiens
ctacaggaagcaccccat

SEQ ID NO: 2529973 - DNA, 22 bp, Homo sapiens
ctacaggaagcaccccatgcca

SEQ ID NO: 2529974 - DNA, 14 bp, Homo sapiens
ctacaggtgtgagt

SEQ ID NO: 2529975 - DNA, 11 bp, Homo sapiens
ctacaggttac

SEQ ID NO: 2529976 - DNA, 20 bp, Homo sapiens
ctacaggttacaacagattt

SEQ ID NO: 2529977 - DNA, 18 bp, Homo sapiens
ctacagtcaggaaaggaa

SEQ ID NO: 2529978 - DNA, 21 bp, Homo sapiens
ctacagtcaggaaaggaatca

SEQ ID NO: 2529979 - DNA, 13 bp, Homo sapiens
ctacagtcctccc

SEQ ID NO: 2529980 - DNA, 15 bp, Homo sapiens
ctacagtcctcccat

SEQ ID NO: 2529981 - DNA, 19 bp, Homo sapiens
ctacagtcctcccatctca

SEQ ID NO: 2529982 - DNA, 17 bp, Homo sapiens
ctacagtgtacagtctt

SEQ ID NO: 2529983 - DNA, 20 bp, Homo sapiens
ctacagtgtacagtcttgta

SEQ ID NO: 2529984 - DNA, 19 bp, Homo sapiens
ctacagttgaaaaacagct

SEQ ID NO: 2529985 - DNA, 22 bp, Homo sapiens
ctacagttgaaaaacagctgag

SEQ ID NO: 2529986 - DNA, 20 bp, Homo sapiens
ctacagttgttttttgaaaa

SEQ ID NO: 2529987 - DNA, 15 bp, Homo sapiens
ctacataaactgact

SEQ ID NO: 2529988 - DNA, 22 bp, Homo sapiens
ctacataaactgactttatcct

SEQ ID NO: 2529989 - DNA, 18 bp, Homo sapiens
ctacatacaattccaaac

SEQ ID NO: 2529990 - DNA, 18 bp, Homo sapiens
ctacatactatggaattt

SEQ ID NO: 2529991 - DNA, 14 bp, Homo sapiens
ctacatcttctgcc

SEQ ID NO: 2529992 - DNA, 15 bp, Homo sapiens
ctacatcttctgcct

SEQ ID NO: 2529993 - DNA, 15 bp, Homo sapiens
ctacatgaaacagaa

SEQ ID NO: 2529994 - DNA, 14 bp, Homo sapiens
ctacatgcagccca

SEQ ID NO: 2529995 - DNA, 15 bp, Homo sapiens
ctacatgcagcccat

SEQ ID NO: 2529996 - DNA, 23 bp, Homo sapiens
ctacatgcagcccatgcccacct

SEQ ID NO: 2529997 - DNA, 17 bp, Homo sapiens
ctacatgctttgtgaac

SEQ ID NO: 2529998 - DNA, 23 bp, Homo sapiens
ctacatggttgaaaccccatctc

SEQ ID NO: 2529999 - DNA, 14 bp, Homo sapiens
ctacattctgttaa

SEQ ID NO: 2530000 - DNA, 14 bp, Homo sapiens
ctaccaaagcacct

SEQ ID NO: 2530001 - DNA, 15 bp, Homo sapiens
ctaccaatgcatgca

SEQ ID NO: 2530002 - DNA, 16 bp, Homo sapiens
ctaccatcagggacag

SEQ ID NO: 2530003 - DNA, 18 bp, Homo sapiens
ctaccatcccctgtagag

SEQ ID NO: 2530004 - DNA, 16 bp, Homo sapiens
ctacccaaccactcaa

SEQ ID NO: 2530005 - DNA, 18 bp, Homo sapiens
ctacccacacctctgcca

SEQ ID NO: 2530006 - DNA, 19 bp, Homo sapiens
ctacccacacctctgccag

SEQ ID NO: 2530007 - DNA, 20 bp, Homo sapiens
ctacccacacctctgccaga

SEQ ID NO: 2530008 - DNA, 13 bp, Homo sapiens
ctacccaccctcc

SEQ ID NO: 2530009 - DNA, 17 bp, Homo sapiens
ctacccaccctcctttc

SEQ ID NO: 2530010 - DNA, 12 bp, Homo sapiens
ctacccaggtgc

SEQ ID NO: 2530011 - DNA, 13 bp, Homo sapiens
ctacccaggtgct

SEQ ID NO: 2530012 - DNA, 17 bp, Homo sapiens
ctaccccctaagagcca

SEQ ID NO: 2530013 - DNA, 17 bp, Homo sapiens
ctacccgcatcttctgt

SEQ ID NO: 2530014 - DNA, 14 bp, Homo sapiens
ctaccctcccccag

SEQ ID NO: 2530015 - DNA, 19 bp, Homo sapiens
ctaccctcgggcccacctg

SEQ ID NO: 2530016 - DNA, 18 bp, Homo sapiens
ctaccgaaaccttgcctt

SEQ ID NO: 2530017 - DNA, 13 bp, Homo sapiens
ctacctcaggcag

SEQ ID NO: 2530018 - DNA, 14 bp, Homo sapiens
ctacctcaggttgc

SEQ ID NO: 2530019 - DNA, 11 bp, Homo sapiens
ctacctgaggg

SEQ ID NO: 2530020 - DNA, 14 bp, Homo sapiens
ctacctgaggggcc

SEQ ID NO: 2530021 - DNA, 23 bp, Homo sapiens
ctacctgaggggcctcttatggg

SEQ ID NO: 2530022 - DNA, 14 bp, Homo sapiens
ctacctgccactca

SEQ ID NO: 2530023 - DNA, 12 bp, Homo sapiens
ctacctgctctc

SEQ ID NO: 2530024 - DNA, 22 bp, Homo sapiens
ctacctgttcagtgtcccgggc

SEQ ID NO: 2530025 - DNA, 18 bp, Homo sapiens
ctaccttcatttcaggag

SEQ ID NO: 2530026 - DNA, 15 bp, Homo sapiens
ctaccttctgtagtt

SEQ ID NO: 2530027 - DNA, 15 bp, Homo sapiens
ctacgccaatcaagg

SEQ ID NO: 2530028 - DNA, 22 bp, Homo sapiens
ctacgctgaagatggcatcctg

SEQ ID NO: 2530029 - DNA, 17 bp, Homo sapiens
ctacgttaccaggcagg

SEQ ID NO: 2530030 - DNA, 14 bp, Homo sapiens
ctactaaaaatgca

SEQ ID NO: 2530031 - DNA, 13 bp, Homo sapiens
ctactaatgatgt

SEQ ID NO: 2530032 - DNA, 14 bp, Homo sapiens
ctactatatatgtg

SEQ ID NO: 2530033 - DNA, 19 bp, Homo sapiens
ctactcagaagcctgaggc

SEQ ID NO: 2530034 - DNA, 16 bp, Homo sapiens
ctactcctacctcagc

SEQ ID NO: 2530035 - DNA, 22 bp, Homo sapiens
ctcaaaccaaatcactgaactt

SEQ ID NO: 2530036 - DNA, 15 bp, Homo sapiens
ctcaaacctcctctt

SEQ ID NO: 2530037 - DNA, 18 bp, Homo sapiens
ctcaaacctgtttaaata

SEQ ID NO: 2530038 - DNA, 21 bp, Homo sapiens
ctcaaacctgtttaaatattt

SEQ ID NO: 2530039 - DNA, 13 bp, Homo sapiens
ctcaaactcctga

SEQ ID NO: 2530040 - DNA, 19 bp, Homo sapiens
ctcaaactgaggaatttca

SEQ ID NO: 2530041 - DNA, 22 bp, Homo sapiens
ctcaaactgaggaatttcacct

SEQ ID NO: 2530042 - DNA, 13 bp, Homo sapiens
ctcaaagtctgca

SEQ ID NO: 2530043 - DNA, 15 bp, Homo sapiens
ctcaaagttttgaaa

SEQ ID NO: 2530044 - DNA, 14 bp, Homo sapiens
ctcaaataaaataa

SEQ ID NO: 2530045 - DNA, 16 bp, Homo sapiens
ctcaaatctattcaga

SEQ ID NO: 2530046 - DNA, 15 bp, Homo sapiens
ctcaacaaagcacag

SEQ ID NO: 2530047 - DNA, 19 bp, Homo sapiens
ctcaacaaagcacagtgtt

SEQ ID NO: 2530048 - DNA, 22 bp, Homo sapiens
ctcaacaagggagagacctcat

SEQ ID NO: 2530049 - DNA, 23 bp, Homo sapiens
ctcaacaagggagagacctcatc

SEQ ID NO: 2530050 - DNA, 15 bp, Homo sapiens
ctcaacatgagtcaa

SEQ ID NO: 2530051 - DNA, 18 bp, Homo sapiens
ctcaacatgagtcaagag

SEQ ID NO: 2530052 - DNA, 22 bp, Homo sapiens
ctcaacccccatttctatttat

SEQ ID NO: 2530053 - DNA, 17 bp, Homo sapiens
ctcaacctcctgggcta

SEQ ID NO: 2530054 - DNA, 18 bp, Homo sapiens
ctcaactagcagatacag

SEQ ID NO: 2530055 - DNA, 17 bp, Homo sapiens
ctcaactcacctaatgt

SEQ ID NO: 2530056 - DNA, 16 bp, Homo sapiens
ctcaagaggctgaggc

SEQ ID NO: 2530057 - DNA, 23 bp, Homo sapiens
ctcaagcagcgaccgccccctcc

SEQ ID NO: 2530058 - DNA, 18 bp, Homo sapiens
ctcaagccaatcccctcc

SEQ ID NO: 2530059 - DNA, 23 bp, Homo sapiens
ctcaaggaataatgggcttagag

SEQ ID NO: 2530060 - DNA, 20 bp, Homo sapiens
ctcaaggggccatcctgtcc

SEQ ID NO: 2530061 - DNA, 22 bp, Homo sapiens
ctcaaggggccatcctgtccca

SEQ ID NO: 2530062 - DNA, 16 bp, Homo sapiens
ctcaagtcttccctga

SEQ ID NO: 2530063 - DNA, 18 bp, Homo sapiens
ctcaagtcttccctgatc

SEQ ID NO: 2530064 - DNA, 17 bp, Homo sapiens
ctcaagtgattctcctg

SEQ ID NO: 2530065 - DNA, 20 bp, Homo sapiens
ctcaagtgattctcctgcct

SEQ ID NO: 2530066 - DNA, 21 bp, Homo sapiens
ctcaagtgattctcctgcctc

SEQ ID NO: 2530067 - DNA, 22 bp, Homo sapiens
ctcaagtgggaacgactgggca

SEQ ID NO: 2530068 - DNA, 18 bp, Homo sapiens
ctcaagtttttcagaaag

SEQ ID NO: 2530069 - DNA, 22 bp, Homo sapiens
ctcaataaaatcatgtacattt

SEQ ID NO: 2530070 - DNA, 13 bp, Homo sapiens
ctcaatattttcc

SEQ ID NO: 2530071 - DNA, 18 bp, Homo sapiens
ctcaatattttccatgaa

SEQ ID NO: 2530072 - DNA, 15 bp, Homo sapiens
ctcaatcaagaaaat

SEQ ID NO: 2530073 - DNA, 12 bp, Homo sapiens
ctcaatgagctc

SEQ ID NO: 2530074 - DNA, 16 bp, Homo sapiens
ctcaatgcagccagac

SEQ ID NO: 2530075 - DNA, 15 bp, Homo sapiens
ctcaatttctcccca

SEQ ID NO: 2530076 - DNA, 12 bp, Homo sapiens
ctcaatttttgg

SEQ ID NO: 2530077 - DNA, 22 bp, Homo sapiens
ctcacaaaccatgcaaatgcta

SEQ ID NO: 2530078 - DNA, 19 bp, Homo sapiens
ctcacaacatggtgtctgg

SEQ ID NO: 2530079 - DNA, 15 bp, Homo sapiens
ctcacaagaagacca

SEQ ID NO: 2530080 - DNA, 19 bp, Homo sapiens
ctcacaagaagaccagact

SEQ ID NO: 2530081 - DNA, 14 bp, Homo sapiens
ctcacacatgagca

SEQ ID NO: 2530082 - DNA, 21 bp, Homo sapiens
ctcacacatgagcatcaggcc

SEQ ID NO: 2530083 - DNA, 13 bp, Homo sapiens
ctcacagaaatga

SEQ ID NO: 2530084 - DNA, 20 bp, Homo sapiens
ctcacagacctggagcccct

SEQ ID NO: 2530085 - DNA, 19 bp, Homo sapiens
ctcacagtctctttaatct

SEQ ID NO: 2530086 - DNA, 18 bp, Homo sapiens
ctcacagtgggagccagg

SEQ ID NO: 2530087 - DNA, 19 bp, Homo sapiens
ctcacagtgggagccaggg

SEQ ID NO: 2530088 - DNA, 21 bp, Homo sapiens
ctcacagtgttgcccaggctg

SEQ ID NO: 2530089 - DNA, 22 bp, Homo sapiens
ctcacatgtcagtaccttcaaa

SEQ ID NO: 2530090 - DNA, 14 bp, Homo sapiens
ctcaccagccccag

SEQ ID NO: 2530091 - DNA, 17 bp, Homo sapiens
ctcaccagccccagtgc

SEQ ID NO: 2530092 - DNA, 18 bp, Homo sapiens
ctcaccagccccagtgcc

SEQ ID NO: 2530093 - DNA, 19 bp, Homo sapiens
ctcaccagccccagtgccc

SEQ ID NO: 2530094 - DNA, 20 bp, Homo sapiens
ctcaccagtgtcccctccac

SEQ ID NO: 2530095 - DNA, 23 bp, Homo sapiens
ctcaccagtgtcccctccactgt

SEQ ID NO: 2530096 - DNA, 14 bp, Homo sapiens
ctcaccatctgtgc

SEQ ID NO: 2530097 - DNA, 13 bp, Homo sapiens
ctcaccccagccc

SEQ ID NO: 2530098 - DNA, 14 bp, Homo sapiens
ctcaccccagcccc

SEQ ID NO: 2530099 - DNA, 12 bp, Homo sapiens
ctcaccccatcc

SEQ ID NO: 2530100 - DNA, 19 bp, Homo sapiens
ctcaccccatcccacaccc

SEQ ID NO: 2530101 - DNA, 17 bp, Homo sapiens
ctcacccccagctttgc

SEQ ID NO: 2530102 - DNA, 19 bp, Homo sapiens
ctcaccccccacactcact

SEQ ID NO: 2530103 - DNA, 20 bp, Homo sapiens
ctcaccccccacactcactc

SEQ ID NO: 2530104 - DNA, 13 bp, Homo sapiens
ctcaccccggcag

SEQ ID NO: 2530105 - DNA, 16 bp, Homo sapiens
ctcacccctgccctgg

SEQ ID NO: 2530106 - DNA, 14 bp, Homo sapiens
ctcaccctgagccc

SEQ ID NO: 2530107 - DNA, 21 bp, Homo sapiens
ctcaccgtggctaagagtgtc

SEQ ID NO: 2530108 - DNA, 23 bp, Homo sapiens
ctcacctaatgtttatgagccag

SEQ ID NO: 2530109 - DNA, 13 bp, Homo sapiens
ctcacctctccct

SEQ ID NO: 2530110 - DNA, 15 bp, Homo sapiens
ctcacctctggactg

SEQ ID NO: 2530111 - DNA, 15 bp, Homo sapiens
ctcacctgctggccc

SEQ ID NO: 2530112 - DNA, 19 bp, Homo sapiens
ctcacctgggcacctgggg

SEQ ID NO: 2530113 - DNA, 21 bp, Homo sapiens
ctcacctgggcacctggggag

SEQ ID NO: 2530114 - DNA, 13 bp, Homo sapiens
ctcacctgttgct

SEQ ID NO: 2530115 - DNA, 17 bp, Homo sapiens
ctcacctgttgcttaca

SEQ ID NO: 2530116 - DNA, 16 bp, Homo sapiens
ctcacgcacctcccat

SEQ ID NO: 2530117 - DNA, 19 bp, Homo sapiens
ctcacgcacctcccatcct

SEQ ID NO: 2530118 - DNA, 20 bp, Homo sapiens
ctcacgcctatgatcccagc

SEQ ID NO: 2530119 - DNA, 16 bp, Homo sapiens
ctcacgtgagagtgtc

SEQ ID NO: 2530120 - DNA, 17 bp, Homo sapiens
ctcactataccagtata

SEQ ID NO: 2530121 - DNA, 15 bp, Homo sapiens
ctcactcccttccca

SEQ ID NO: 2530122 - DNA, 20 bp, Homo sapiens
ctcactcctgagacccctgg

SEQ ID NO: 2530123 - DNA, 22 bp, Homo sapiens
ctcactcctgagacccctggcc

SEQ ID NO: 2530124 - DNA, 11 bp, Homo sapiens
ctcactcctgt

SEQ ID NO: 2530125 - DNA, 20 bp, Homo sapiens
ctcactcctgttacttacct

SEQ ID NO: 2530126 - DNA, 13 bp, Homo sapiens
ctcactccttgaa

SEQ ID NO: 2530127 - DNA, 12 bp, Homo sapiens
ctcactctgtcg

SEQ ID NO: 2530128 - DNA, 13 bp, Homo sapiens
ctcactctgtcgc

SEQ ID NO: 2530129 - DNA, 18 bp, Homo sapiens
ctcactgaaaacatctgg

SEQ ID NO: 2530130 - DNA, 21 bp, Homo sapiens
ctcactgaaaacatctggaag

SEQ ID NO: 2530131 - DNA, 14 bp, Homo sapiens
ctcactgaaaccag

SEQ ID NO: 2530132 - DNA, 17 bp, Homo sapiens
ctcactgcaacctccgc

SEQ ID NO: 2530133 - DNA, 12 bp, Homo sapiens
ctcactgcagcc

SEQ ID NO: 2530134 - DNA, 22 bp, Homo sapiens
ctcactgccatgccagcttatc

SEQ ID NO: 2530135 - DNA, 12 bp, Homo sapiens
ctcactgctcaa

SEQ ID NO: 2530136 - DNA, 16 bp, Homo sapiens
ctcactgctcaagaag

SEQ ID NO: 2530137 - DNA, 19 bp, Homo sapiens
ctcactgctcaagaagaca

SEQ ID NO: 2530138 - DNA, 21 bp, Homo sapiens
ctcactgctcaagaagacatg

SEQ ID NO: 2530139 - DNA, 12 bp, Homo sapiens
ctcactgtctga

SEQ ID NO: 2530140 - DNA, 18 bp, Homo sapiens
ctcactgttccctctgct

SEQ ID NO: 2530141 - DNA, 16 bp, Homo sapiens
ctcactgttgcccagg

SEQ ID NO: 2530142 - DNA, 18 bp, Homo sapiens
ctcactgttgcccaggct

SEQ ID NO: 2530143 - DNA, 20 bp, Homo sapiens
ctcactgttgcccaggctgg

SEQ ID NO: 2530144 - DNA, 21 bp, Homo sapiens
ctcacttatcccaagagaatg

SEQ ID NO: 2530145 - DNA, 15 bp, Homo sapiens
ctcacttgcccacac

SEQ ID NO: 2530146 - DNA, 14 bp, Homo sapiens
ctcacttttctcca

SEQ ID NO: 2530147 - DNA, 18 bp, Homo sapiens
ctcagaaacactggggct

SEQ ID NO: 2530148 - DNA, 19 bp, Homo sapiens
ctcagaaacactggggctg

SEQ ID NO: 2530149 - DNA, 11 bp, Homo sapiens
ctcagaagcct

SEQ ID NO: 2530150 - DNA, 13 bp, Homo sapiens
ctcagaagcctga

SEQ ID NO: 2530151 - DNA, 15 bp, Homo sapiens
ctcagaaggctcttc

SEQ ID NO: 2530152 - DNA, 13 bp, Homo sapiens
ctcagaaggtatt

SEQ ID NO: 2530153 - DNA, 14 bp, Homo sapiens
ctcagaccagctct

SEQ ID NO: 2530154 - DNA, 15 bp, Homo sapiens
ctcagagagggcagg

SEQ ID NO: 2530155 - DNA, 22 bp, Homo sapiens
ctcagagatgtgcacccatggg

SEQ ID NO: 2530156 - DNA, 19 bp, Homo sapiens
ctcagagctacttgggcca

SEQ ID NO: 2530157 - DNA, 17 bp, Homo sapiens
ctcagagtcggaacgga

SEQ ID NO: 2530158 - DNA, 13 bp, Homo sapiens
ctcagagtgcaag

SEQ ID NO: 2530159 - DNA, 17 bp, Homo sapiens
ctcagatatttatattt

SEQ ID NO: 2530160 - DNA, 19 bp, Homo sapiens
ctcagatccttgtttcaaa

SEQ ID NO: 2530161 - DNA, 16 bp, Homo sapiens
ctcagatggaaccgca

SEQ ID NO: 2530162 - DNA, 20 bp, Homo sapiens
ctcagcaaaagatgcttctc

SEQ ID NO: 2530163 - DNA, 19 bp, Homo sapiens
ctcagcagcgaccacccct

SEQ ID NO: 2530164 - DNA, 21 bp, Homo sapiens
ctcagcagcgaccacccctgc

SEQ ID NO: 2530165 - DNA, 15 bp, Homo sapiens
ctcagcatcctggca

SEQ ID NO: 2530166 - DNA, 21 bp, Homo sapiens
ctcagcatcctggcacccggc

SEQ ID NO: 2530167 - DNA, 15 bp, Homo sapiens
ctcagccaagcacag

SEQ ID NO: 2530168 - DNA, 23 bp, Homo sapiens
ctcagccaagcacagtggtggca

SEQ ID NO: 2530169 - DNA, 16 bp, Homo sapiens
ctcagccagccccatc

SEQ ID NO: 2530170 - DNA, 19 bp, Homo sapiens
ctcagcccacccccctcat

SEQ ID NO: 2530171 - DNA, 16 bp, Homo sapiens
ctcagcccctcttgcc

SEQ ID NO: 2530172 - DNA, 19 bp, Homo sapiens
ctcagcccctcttgccccc

SEQ ID NO: 2530173 - DNA, 13 bp, Homo sapiens
ctcagccctgact

SEQ ID NO: 2530174 - DNA, 15 bp, Homo sapiens
ctcagccctgaggtg

SEQ ID NO: 2530175 - DNA, 11 bp, Homo sapiens
ctcagccctgt

SEQ ID NO: 2530176 - DNA, 20 bp, Homo sapiens
ctcagcctcaataagccttg

SEQ ID NO: 2530177 - DNA, 20 bp, Homo sapiens
ctcagcctcccagagtgctg

SEQ ID NO: 2530178 - DNA, 21 bp, Homo sapiens
ctcagcctcccgaatagctgg

SEQ ID NO: 2530179 - DNA, 17 bp, Homo sapiens
ctcagcctcctcatctg

SEQ ID NO: 2530180 - DNA, 17 bp, Homo sapiens
ctccttgctacccagaa

SEQ ID NO: 2530181 - DNA, 13 bp, Homo sapiens
ctccttgctctgc

SEQ ID NO: 2530182 - DNA, 14 bp, Homo sapiens
ctccttgctctgca

SEQ ID NO: 2530183 - DNA, 21 bp, Homo sapiens
ctccttgggaggccccactgg

SEQ ID NO: 2530184 - DNA, 21 bp, Homo sapiens
ctccttgggcactttttaatt

SEQ ID NO: 2530185 - DNA, 13 bp, Homo sapiens
ctccttgggccct

SEQ ID NO: 2530186 - DNA, 16 bp, Homo sapiens
ctccttgggccctttg

SEQ ID NO: 2530187 - DNA, 15 bp, Homo sapiens
ctccttggtgcctgg

SEQ ID NO: 2530188 - DNA, 15 bp, Homo sapiens
ctccttgtccaccca

SEQ ID NO: 2530189 - DNA, 16 bp, Homo sapiens
ctccttgtggcctggg

SEQ ID NO: 2530190 - DNA, 17 bp, Homo sapiens
ctccttgtggtttatgt

SEQ ID NO: 2530191 - DNA, 18 bp, Homo sapiens
ctccttgtggtttatgtc

SEQ ID NO: 2530192 - DNA, 22 bp, Homo sapiens
ctcctttagcgcccagttgggt

SEQ ID NO: 2530193 - DNA, 18 bp, Homo sapiens
ctcctttctccagccagc

SEQ ID NO: 2530194 - DNA, 16 bp, Homo sapiens
ctcctttctcttctct

SEQ ID NO: 2530195 - DNA, 20 bp, Homo sapiens
ctcctttctttttcttcttc

SEQ ID NO: 2530196 - DNA, 22 bp, Homo sapiens
ctcctttgcactgagggccaca

SEQ ID NO: 2530197 - DNA, 17 bp, Homo sapiens
ctcctttggccattcca

SEQ ID NO: 2530198 - DNA, 13 bp, Homo sapiens
ctcctttgtatat

SEQ ID NO: 2530199 - DNA, 17 bp, Homo sapiens
ctcctttgtgaggaagc

SEQ ID NO: 2530200 - DNA, 23 bp, Homo sapiens
ctcctttgtgaggaagccgctgg

SEQ ID NO: 2530201 - DNA, 15 bp, Homo sapiens
ctcctttttctccct

SEQ ID NO: 2530202 - DNA, 19 bp, Homo sapiens
ctcctttttctccctctgg

SEQ ID NO: 2530203 - DNA, 14 bp, Homo sapiens
ctcgaactggctgc

SEQ ID NO: 2530204 - DNA, 15 bp, Homo sapiens
ctcgagcaactgctg

SEQ ID NO: 2530205 - DNA, 17 bp, Homo sapiens
ctcgagcagtcctgcct

SEQ ID NO: 2530206 - DNA, 20 bp, Homo sapiens
ctcgaggactgtatttgtga

SEQ ID NO: 2530207 - DNA, 23 bp, Homo sapiens
ctcgagggcagggaccacaccct

SEQ ID NO: 2530208 - DNA, 13 bp, Homo sapiens
ctcgcaagctggg

SEQ ID NO: 2530209 - DNA, 14 bp, Homo sapiens
ctcgcaagctgggt

SEQ ID NO: 2530210 - DNA, 14 bp, Homo sapiens
ctcgcacctttcca

SEQ ID NO: 2530211 - DNA, 17 bp, Homo sapiens
ctcgccatgccgggggt

SEQ ID NO: 2530212 - DNA, 16 bp, Homo sapiens
ctcgcccgcccactgt

SEQ ID NO: 2530213 - DNA, 22 bp, Homo sapiens
ctcgcccgcccactgtcctggg

SEQ ID NO: 2530214 - DNA, 23 bp, Homo sapiens
ctcgcccgcccactgtcctgggc

SEQ ID NO: 2530215 - DNA, 12 bp, Homo sapiens
ctcgctctgtca

SEQ ID NO: 2530216 - DNA, 13 bp, Homo sapiens
ctcgctctgtcac

SEQ ID NO: 2530217 - DNA, 12 bp, Homo sapiens
ctcgctgccagc

SEQ ID NO: 2530218 - DNA, 15 bp, Homo sapiens
ctcgctgcttctgtg

SEQ ID NO: 2530219 - DNA, 15 bp, Homo sapiens
ctcgctggactctca

SEQ ID NO: 2530220 - DNA, 19 bp, Homo sapiens
ctcgctggactctcagtct

SEQ ID NO: 2530221 - DNA, 16 bp, Homo sapiens
ctcggaaggctggctg

SEQ ID NO: 2530222 - DNA, 12 bp, Homo sapiens
ctcggagaagag

SEQ ID NO: 2530223 - DNA, 20 bp, Homo sapiens
ctcggagaagagctgttcac

SEQ ID NO: 2530224 - DNA, 12 bp, Homo sapiens
ctcggagcctca

SEQ ID NO: 2530225 - DNA, 22 bp, Homo sapiens
ctcggagcctcatccgaggcag

SEQ ID NO: 2530226 - DNA, 23 bp, Homo sapiens
ctcggagcctcatccgaggcagg

SEQ ID NO: 2530227 - DNA, 21 bp, Homo sapiens
ctcggccgtcttcactcgccc

SEQ ID NO: 2530228 - DNA, 22 bp, Homo sapiens
ctcggctccccatgtgtcctgg

SEQ ID NO: 2530229 - DNA, 15 bp, Homo sapiens
ctcgggacacctgcc

SEQ ID NO: 2530230 - DNA, 15 bp, Homo sapiens
ctcgggaggctgaga

SEQ ID NO: 2530231 - DNA, 14 bp, Homo sapiens
ctcgggcccacctg

SEQ ID NO: 2530232 - DNA, 17 bp, Homo sapiens
ctcgggcccacctggcc

SEQ ID NO: 2530233 - DNA, 20 bp, Homo sapiens
ctcgggcccacctggccacc

SEQ ID NO: 2530234 - DNA, 18 bp, Homo sapiens
ctcggtggacccagggat

SEQ ID NO: 2530235 - DNA, 16 bp, Homo sapiens
ctcggtgtggagaagc

SEQ ID NO: 2530236 - DNA, 17 bp, Homo sapiens
ctcggtgtggagaagcg

SEQ ID NO: 2530237 - DNA, 15 bp, Homo sapiens
ctcgtggtaggactg

SEQ ID NO: 2530238 - DNA, 15 bp, Homo sapiens
ctcgtgtatcctggg

SEQ ID NO: 2530239 - DNA, 16 bp, Homo sapiens
ctcgtgtatcctgggg

SEQ ID NO: 2530240 - DNA, 18 bp, Homo sapiens
ctcgtgtatcctggggct

SEQ ID NO: 2530241 - DNA, 20 bp, Homo sapiens
ctcgtgtatcctggggctcc

SEQ ID NO: 2530242 - DNA, 20 bp, Homo sapiens
ctcgttgactggctgtgtgt

SEQ ID NO: 2530243 - DNA, 21 bp, Homo sapiens
ctctaaagagtttattttaag

SEQ ID NO: 2530244 - DNA, 18 bp, Homo sapiens
ctctaaccccaggccccg

SEQ ID NO: 2530245 - DNA, 15 bp, Homo sapiens
ctctaaccctaggca

SEQ ID NO: 2530246 - DNA, 16 bp, Homo sapiens
ctctaagttccactga

SEQ ID NO: 2530247 - DNA, 17 bp, Homo sapiens
ctctacagagcttccct

SEQ ID NO: 2530248 - DNA, 20 bp, Homo sapiens
ctctacagagcttccctgac

SEQ ID NO: 2530249 - DNA, 14 bp, Homo sapiens
ctctacagaggcca

SEQ ID NO: 2530250 - DNA, 20 bp, Homo sapiens
ctctaccaagctatcctggc

SEQ ID NO: 2530251 - DNA, 16 bp, Homo sapiens
ctctacccatattaca

SEQ ID NO: 2530252 - DNA, 17 bp, Homo sapiens
ctctaccctcccacccc

SEQ ID NO: 2530253 - DNA, 13 bp, Homo sapiens
ctctaccctggca

SEQ ID NO: 2530254 - DNA, 20 bp, Homo sapiens
ctctacctcatatcagtttg

SEQ ID NO: 2530255 - DNA, 20 bp, Homo sapiens
ctctacgtggcaaattaact

SEQ ID NO: 2530256 - DNA, 21 bp, Homo sapiens
ctctactaacaatcagctcct

SEQ ID NO: 2530257 - DNA, 23 bp, Homo sapiens
ctctagaattttaagtgctttgt

SEQ ID NO: 2530258 - DNA, 18 bp, Homo sapiens
ctctagacaaccctgcaa

SEQ ID NO: 2530259 - DNA, 16 bp, Homo sapiens
ctctagacactgccac

SEQ ID NO: 2530260 - DNA, 13 bp, Homo sapiens
ctctagcctgggc

SEQ ID NO: 2530261 - DNA, 13 bp, Homo sapiens
ctctagctggtgg

SEQ ID NO: 2530262 - DNA, 12 bp, Homo sapiens
ctctaggctggg

SEQ ID NO: 2530263 - DNA, 13 bp, Homo sapiens
ctctaggctgggg

SEQ ID NO: 2530264 - DNA, 23 bp, Homo sapiens
ctctagggaaaaaccagcgtgtg

SEQ ID NO: 2530265 - DNA, 17 bp, Homo sapiens
ctctaggggtcaggctc

SEQ ID NO: 2530266 - DNA, 22 bp, Homo sapiens
ctctaggtgcccttggaggcca

SEQ ID NO: 2530267 - DNA, 14 bp, Homo sapiens
ctctaggtggggcg

SEQ ID NO: 2530268 - DNA, 15 bp, Homo sapiens
ctctaggtggggcgg

SEQ ID NO: 2530269 - DNA, 20 bp, Homo sapiens
ctctagtgctgtgaaaaaaa

SEQ ID NO: 2530270 - DNA, 11 bp, Homo sapiens
ctctatattta

SEQ ID NO: 2530271 - DNA, 22 bp, Homo sapiens
ctctatatttagattgttaaaa

SEQ ID NO: 2530272 - DNA, 16 bp, Homo sapiens
ctctatcttgctctgt

SEQ ID NO: 2530273 - DNA, 17 bp, Homo sapiens
ctctatgccagctcagt

SEQ ID NO: 2530274 - DNA, 19 bp, Homo sapiens
ctctatgttctaagaagtg

SEQ ID NO: 2530275 - DNA, 16 bp, Homo sapiens
ctctatttaatattta

SEQ ID NO: 2530276 - DNA, 14 bp, Homo sapiens
ctctatttagcatg

SEQ ID NO: 2530277 - DNA, 15 bp, Homo sapiens
ctctcaatatgctta

SEQ ID NO: 2530278 - DNA, 13 bp, Homo sapiens
ctctcaatttttg

SEQ ID NO: 2530279 - DNA, 22 bp, Homo sapiens
ctctcaatttttggttgaataa

SEQ ID NO: 2530280 - DNA, 22 bp, Homo sapiens
ctctcacatgtttagagttgca

SEQ ID NO: 2530281 - DNA, 12 bp, Homo sapiens
ctctcactcctt

SEQ ID NO: 2530282 - DNA, 16 bp, Homo sapiens
ctctcagaaggtattc

SEQ ID NO: 2530283 - DNA, 20 bp, Homo sapiens
ctctcagagctacttgggcc

SEQ ID NO: 2530284 - DNA, 16 bp, Homo sapiens
ctctcagctcagcgcc

SEQ ID NO: 2530285 - DNA, 17 bp, Homo sapiens
ctctcaggaccaaagct

SEQ ID NO: 2530286 - DNA, 13 bp, Homo sapiens
ctctcaggagcac

SEQ ID NO: 2530287 - DNA, 21 bp, Homo sapiens
ctctcaggagcacaggcagct

SEQ ID NO: 2530288 - DNA, 16 bp, Homo sapiens
ctctcaggcatgcctg

SEQ ID NO: 2530289 - DNA, 19 bp, Homo sapiens
ctctcaggcatgcctgtgt

SEQ ID NO: 2530290 - DNA, 15 bp, Homo sapiens
ctctcaggtgaccaa

SEQ ID NO: 2530291 - DNA, 15 bp, Homo sapiens
ctctcagtctctgag

SEQ ID NO: 2530292 - DNA, 21 bp, Homo sapiens
ctctcagttccgatttcccag

SEQ ID NO: 2530293 - DNA, 12 bp, Homo sapiens
ctctccaagggc

SEQ ID NO: 2530294 - DNA, 14 bp, Homo sapiens
ctctccaagggctt

SEQ ID NO: 2530295 - DNA, 21 bp, Homo sapiens
ctctccaagggcttctgcacc

SEQ ID NO: 2530296 - DNA, 23 bp, Homo sapiens
ctctccaagggcttctgcaccct

SEQ ID NO: 2530297 - DNA, 16 bp, Homo sapiens
ctctccaagtgccaga

SEQ ID NO: 2530298 - DNA, 12 bp, Homo sapiens
ctctccagcccc

SEQ ID NO: 2530299 - DNA, 17 bp, Homo sapiens
ctctccagcccctggat

SEQ ID NO: 2530300 - DNA, 14 bp, Homo sapiens
ctctccagcctgac

SEQ ID NO: 2530301 - DNA, 16 bp, Homo sapiens
ctctccagctccaaga

SEQ ID NO: 2530302 - DNA, 19 bp, Homo sapiens
ctctccaggcacccttctt

SEQ ID NO: 2530303 - DNA, 20 bp, Homo sapiens
ctctcccatcacttccctac

SEQ ID NO: 2530304 - DNA, 12 bp, Homo sapiens
ctctcccatccc

SEQ ID NO: 2530305 - DNA, 13 bp, Homo sapiens
ctctcccatcccc

SEQ ID NO: 2530306 - DNA, 19 bp, Homo sapiens
ctctcccatggagccccag

SEQ ID NO: 2530307 - DNA, 13 bp, Homo sapiens
ctctccccacact

SEQ ID NO: 2530308 - DNA, 15 bp, Homo sapiens
ctctccccacactaa

SEQ ID NO: 2530309 - DNA, 13 bp, Homo sapiens
ctctccccagcaa

SEQ ID NO: 2530310 - DNA, 14 bp, Homo sapiens
ctctccccagcaag

SEQ ID NO: 2530311 - DNA, 17 bp, Homo sapiens
ctctcccccccccctcc

SEQ ID NO: 2530312 - DNA, 15 bp, Homo sapiens
ctctcccctgccctg

SEQ ID NO: 2530313 - DNA, 16 bp, Homo sapiens
ctctcccctgccctgc

SEQ ID NO: 2530314 - DNA, 17 bp, Homo sapiens
ctctcccgtcagggccc

SEQ ID NO: 2530315 - DNA, 13 bp, Homo sapiens
ctctcccttggat

SEQ ID NO: 2530316 - DNA, 16 bp, Homo sapiens
ctctccgaccagacac

SEQ ID NO: 2530317 - DNA, 14 bp, Homo sapiens
ctctcctagagaca

SEQ ID NO: 2530318 - DNA, 20 bp, Homo sapiens
ctctcctccccaaggagaca

SEQ ID NO: 2530319 - DNA, 19 bp, Homo sapiens
ctctcctcctgcccacctg

SEQ ID NO: 2530320 - DNA, 13 bp, Homo sapiens
ctctcctctgctg

SEQ ID NO: 2530321 - DNA, 21 bp, Homo sapiens
ctctcctttctttttcttctt

SEQ ID NO: 2530322 - DNA, 23 bp, Homo sapiens
ctctcctttctttttcttcttcc

SEQ ID NO: 2530323 - DNA, 13 bp, Homo sapiens
ctctcctttgtat

SEQ ID NO: 2530324 - DNA, 20 bp, Homo sapiens
ctctcctttgtatattattt

SEQ ID NO: 2530325 - DNA, 18 bp, Homo sapiens
ctctcggaaggctggctg

SEQ ID NO: 2530326 - DNA, 15 bp, Homo sapiens
ctgagcccctacccc

SEQ ID NO: 2530327 - DNA, 14 bp, Homo sapiens
ctgagcccgggctg

SEQ ID NO: 2530328 - DNA, 15 bp, Homo sapiens
ctgagcccgggctgc

SEQ ID NO: 2530329 - DNA, 17 bp, Homo sapiens
ctgagcccgggctgcct

SEQ ID NO: 2530330 - DNA, 18 bp, Homo sapiens
ctgagcccgggctgcctg

SEQ ID NO: 2530331 - DNA, 22 bp, Homo sapiens
ctgagcccgggctgcctgggct

SEQ ID NO: 2530332 - DNA, 17 bp, Homo sapiens
ctgagccctcaaagtga

SEQ ID NO: 2530333 - DNA, 14 bp, Homo sapiens
ctgagccctggcag

SEQ ID NO: 2530334 - DNA, 12 bp, Homo sapiens
ctgagccttcag

SEQ ID NO: 2530335 - DNA, 16 bp, Homo sapiens
ctgagcgacagtgaga

SEQ ID NO: 2530336 - DNA, 17 bp, Homo sapiens
ctgagcgattattatct

SEQ ID NO: 2530337 - DNA, 13 bp, Homo sapiens
ctgagctcactcg

SEQ ID NO: 2530338 - DNA, 15 bp, Homo sapiens
ctgagctcctctggg

SEQ ID NO: 2530339 - DNA, 18 bp, Homo sapiens
ctgagctcctctgggcag

SEQ ID NO: 2530340 - DNA, 23 bp, Homo sapiens
ctgagctcctctgggcaggacct

SEQ ID NO: 2530341 - DNA, 18 bp, Homo sapiens
ctgagctcggtggaccca

SEQ ID NO: 2530342 - DNA, 16 bp, Homo sapiens
ctgagctgctctgaat

SEQ ID NO: 2530343 - DNA, 22 bp, Homo sapiens
ctgagctgggatgattggaggg

SEQ ID NO: 2530344 - DNA, 15 bp, Homo sapiens
ctgagcttctctgtg

SEQ ID NO: 2530345 - DNA, 16 bp, Homo sapiens
ctgagcttggccagaa

SEQ ID NO: 2530346 - DNA, 17 bp, Homo sapiens
ctgagcttggccagaag

SEQ ID NO: 2530347 - DNA, 18 bp, Homo sapiens
ctgagcttggccagaagg

SEQ ID NO: 2530348 - DNA, 15 bp, Homo sapiens
ctgaggaaaggccag

SEQ ID NO: 2530349 - DNA, 17 bp, Homo sapiens
ctgaggaaaggccagct

SEQ ID NO: 2530350 - DNA, 18 bp, Homo sapiens
ctgaggaaaggccagctg

SEQ ID NO: 2530351 - DNA, 19 bp, Homo sapiens
ctgaggaaaggccagctgg

SEQ ID NO: 2530352 - DNA, 17 bp, Homo sapiens
ctgaggaatccagaccc

SEQ ID NO: 2530353 - DNA, 21 bp, Homo sapiens
ctgaggaatccagacccggct

SEQ ID NO: 2530354 - DNA, 16 bp, Homo sapiens
ctgaggaatttcacct

SEQ ID NO: 2530355 - DNA, 16 bp, Homo sapiens
ctgaggaattttcttt

SEQ ID NO: 2530356 - DNA, 20 bp, Homo sapiens
ctgaggacactaaccacgct

SEQ ID NO: 2530357 - DNA, 13 bp, Homo sapiens
ctgaggaggcctc

SEQ ID NO: 2530358 - DNA, 15 bp, Homo sapiens
ctgaggagtgaggaa

SEQ ID NO: 2530359 - DNA, 17 bp, Homo sapiens
ctgaggatgagctggaa

SEQ ID NO: 2530360 - DNA, 17 bp, Homo sapiens
ctgaggatttcaagcct

SEQ ID NO: 2530361 - DNA, 18 bp, Homo sapiens
ctgaggatttcaagcctg

SEQ ID NO: 2530362 - DNA, 15 bp, Homo sapiens
ctgaggcagacagca

SEQ ID NO: 2530363 - DNA, 18 bp, Homo sapiens
ctgaggcagacagcagct

SEQ ID NO: 2530364 - DNA, 20 bp, Homo sapiens
ctgaggcagggaagtcccca

SEQ ID NO: 2530365 - DNA, 12 bp, Homo sapiens
ctgaggcccaga

SEQ ID NO: 2530366 - DNA, 15 bp, Homo sapiens
ctgaggcccagaggg

SEQ ID NO: 2530367 - DNA, 17 bp, Homo sapiens
ctgaggcccagagggcc

SEQ ID NO: 2530368 - DNA, 21 bp, Homo sapiens
ctgaggcctaaaagtaaacat

SEQ ID NO: 2530369 - DNA, 23 bp, Homo sapiens
ctgaggcctaaaagtaaacatta

SEQ ID NO: 2530370 - DNA, 16 bp, Homo sapiens
ctgaggctcagggaaa

SEQ ID NO: 2530371 - DNA, 23 bp, Homo sapiens
ctgaggctctgacccagtgagat

SEQ ID NO: 2530372 - DNA, 16 bp, Homo sapiens
ctgaggctctttctgg

SEQ ID NO: 2530373 - DNA, 15 bp, Homo sapiens
ctgaggctggatcct

SEQ ID NO: 2530374 - DNA, 13 bp, Homo sapiens
ctgaggctgggct

SEQ ID NO: 2530375 - DNA, 14 bp, Homo sapiens
ctgaggcttccaga

SEQ ID NO: 2530376 - DNA, 19 bp, Homo sapiens
ctgagggaaagcccagaaa

SEQ ID NO: 2530377 - DNA, 19 bp, Homo sapiens
ctgagggaccaactgggcc

SEQ ID NO: 2530378 - DNA, 20 bp, Homo sapiens
ctgagggaccaactgggccc

SEQ ID NO: 2530379 - DNA, 13 bp, Homo sapiens
ctgagggaccagc

SEQ ID NO: 2530380 - DNA, 17 bp, Homo sapiens
ctgagggaggaggccac

SEQ ID NO: 2530381 - DNA, 19 bp, Homo sapiens
ctgagggaggaggccacct

SEQ ID NO: 2530382 - DNA, 22 bp, Homo sapiens
ctgagggaggaggccacctctc

SEQ ID NO: 2530383 - DNA, 20 bp, Homo sapiens
ctgagggcagaaaggttctg

SEQ ID NO: 2530384 - DNA, 15 bp, Homo sapiens
ctgagggcccctctg

SEQ ID NO: 2530385 - DNA, 16 bp, Homo sapiens
ctgagggcccctctgc

SEQ ID NO: 2530386 - DNA, 19 bp, Homo sapiens
ctgagggcccctctgccca

SEQ ID NO: 2530387 - DNA, 22 bp, Homo sapiens
ctgagggcccctctgcccagct

SEQ ID NO: 2530388 - DNA, 14 bp, Homo sapiens
ctgagggcttcctt

SEQ ID NO: 2530389 - DNA, 23 bp, Homo sapiens
ctgaggggaggatcactggagcc

SEQ ID NO: 2530390 - DNA, 20 bp, Homo sapiens
ctgaggggcatctgcccctc

SEQ ID NO: 2530391 - DNA, 21 bp, Homo sapiens
ctgaggggggccgtgcccagg

SEQ ID NO: 2530392 - DNA, 22 bp, Homo sapiens
ctgaggggggccgtgcccaggg

SEQ ID NO: 2530393 - DNA, 20 bp, Homo sapiens
ctgagggtccccacctggga

SEQ ID NO: 2530394 - DNA, 19 bp, Homo sapiens
ctgagggtggagactaagc

SEQ ID NO: 2530395 - DNA, 17 bp, Homo sapiens
ctgaggtctagaaatag

SEQ ID NO: 2530396 - DNA, 19 bp, Homo sapiens
ctgaggtgcctgtcccacc

SEQ ID NO: 2530397 - DNA, 22 bp, Homo sapiens
ctgaggtgcctgtcccaccccc

SEQ ID NO: 2530398 - DNA, 12 bp, Homo sapiens
ctgaggtgggag

SEQ ID NO: 2530399 - DNA, 13 bp, Homo sapiens
ctgaggtgggagg

SEQ ID NO: 2530400 - DNA, 15 bp, Homo sapiens
ctgaggtgggcccag

SEQ ID NO: 2530401 - DNA, 17 bp, Homo sapiens
ctgaggtgggcccagga

SEQ ID NO: 2530402 - DNA, 23 bp, Homo sapiens
ctgaggtgggcccaggaccagct

SEQ ID NO: 2530403 - DNA, 17 bp, Homo sapiens
ctgaggtgtgggggctg

SEQ ID NO: 2530404 - DNA, 20 bp, Homo sapiens
ctgaggtgtgggggctgcag

SEQ ID NO: 2530405 - DNA, 21 bp, Homo sapiens
ctgaggtgtgggggctgcagc

SEQ ID NO: 2530406 - DNA, 22 bp, Homo sapiens
ctgaggtgtgggggctgcagca

SEQ ID NO: 2530407 - DNA, 22 bp, Homo sapiens
ctgagtaatcgcttaaagatgt

SEQ ID NO: 2530408 - DNA, 19 bp, Homo sapiens
ctgagtacgttgtgcattt

SEQ ID NO: 2530409 - DNA, 20 bp, Homo sapiens
ctgagtagctgggattacag

SEQ ID NO: 2530410 - DNA, 21 bp, Homo sapiens
ctgagtatctcctcgcaagct

SEQ ID NO: 2530411 - DNA, 22 bp, Homo sapiens
ctgagtcacccatgaagacagg

SEQ ID NO: 2530412 - DNA, 18 bp, Homo sapiens
ctgagtcatggccgggtg

SEQ ID NO: 2530413 - DNA, 15 bp, Homo sapiens
ctgagtccttaaaca

SEQ ID NO: 2530414 - DNA, 22 bp, Homo sapiens
ctgagtccttaaacagggcatc

SEQ ID NO: 2530415 - DNA, 21 bp, Homo sapiens
ctgagtcgtacagaaagctgc

SEQ ID NO: 2530416 - DNA, 13 bp, Homo sapiens
ctgagtctcctgt

SEQ ID NO: 2530417 - DNA, 16 bp, Homo sapiens
ctgagtctcctgtgcc

SEQ ID NO: 2530418 - DNA, 15 bp, Homo sapiens
ctgagtctgaaggct

SEQ ID NO: 2530419 - DNA, 18 bp, Homo sapiens
ctgagtctgaaggctggg

SEQ ID NO: 2530420 - DNA, 14 bp, Homo sapiens
ctgagtgcctggcc

SEQ ID NO: 2530421 - DNA, 16 bp, Homo sapiens
ctgagtggactggagt

SEQ ID NO: 2530422 - DNA, 17 bp, Homo sapiens
ctgagttacattgtcat

SEQ ID NO: 2530423 - DNA, 20 bp, Homo sapiens
ctgagtttcattctcctgcc

SEQ ID NO: 2530424 - DNA, 21 bp, Homo sapiens
ctgagtttcattctcctgcct

SEQ ID NO: 2530425 - DNA, 21 bp, Homo sapiens
ctgataaagatgagtgagcat

SEQ ID NO: 2530426 - DNA, 18 bp, Homo sapiens
ctgataacaacctggaga

SEQ ID NO: 2530427 - DNA, 22 bp, Homo sapiens
ctgataacaacctggagaccag

SEQ ID NO: 2530428 - DNA, 14 bp, Homo sapiens
ctgataataattga

SEQ ID NO: 2530429 - DNA, 14 bp, Homo sapiens
ctgatacccagagc

SEQ ID NO: 2530430 - DNA, 15 bp, Homo sapiens
ctgatagttactgtt

SEQ ID NO: 2530431 - DNA, 18 bp, Homo sapiens
ctgatatattttacaatt

SEQ ID NO: 2530432 - DNA, 22 bp, Homo sapiens
ctgatatgatttaaaacatgta

SEQ ID NO: 2530433 - DNA, 23 bp, Homo sapiens
ctgatatgatttaaaacatgtaa

SEQ ID NO: 2530434 - DNA, 20 bp, Homo sapiens
ctgatattcaaatggacaaa

SEQ ID NO: 2530435 - DNA, 18 bp, Homo sapiens
ctgatattccatgaatgt

SEQ ID NO: 2530436 - DNA, 18 bp, Homo sapiens
ctgatcaagtcaccggag

SEQ ID NO: 2530437 - DNA, 17 bp, Homo sapiens
ctgatcatgcattgttg

SEQ ID NO: 2530438 - DNA, 12 bp, Homo sapiens
ctgatccctcta

SEQ ID NO: 2530439 - DNA, 15 bp, Homo sapiens
ctgatccctctacag

SEQ ID NO: 2530440 - DNA, 21 bp, Homo sapiens
ctgatcgtgacgctgaataaa

SEQ ID NO: 2530441 - DNA, 17 bp, Homo sapiens
ctgatcgtgctaaattt

SEQ ID NO: 2530442 - DNA, 14 bp, Homo sapiens
ctgatctccatggc

SEQ ID NO: 2530443 - DNA, 18 bp, Homo sapiens
ctgatctgacatccccac

SEQ ID NO: 2530444 - DNA, 21 bp, Homo sapiens
ctgatctgtgctttccagctc

SEQ ID NO: 2530445 - DNA, 15 bp, Homo sapiens
ctgatgacagagcga

SEQ ID NO: 2530446 - DNA, 17 bp, Homo sapiens
ctgatgacagagcgaga

SEQ ID NO: 2530447 - DNA, 20 bp, Homo sapiens
ctgatgatttcttgaaaagg

SEQ ID NO: 2530448 - DNA, 23 bp, Homo sapiens
ctgatgcagtcacgtggaggagc

SEQ ID NO: 2530449 - DNA, 19 bp, Homo sapiens
ctgatgccaagttgtttga

SEQ ID NO: 2530450 - DNA, 14 bp, Homo sapiens
ctgatgctccctcc

SEQ ID NO: 2530451 - DNA, 22 bp, Homo sapiens
ctgatggcaggatggcctggcc

SEQ ID NO: 2530452 - DNA, 12 bp, Homo sapiens
ctgatggcttct

SEQ ID NO: 2530453 - DNA, 21 bp, Homo sapiens
ctgatgggcaacccccagcct

SEQ ID NO: 2530454 - DNA, 22 bp, Homo sapiens
ctgatgggcaacccccagcctg

SEQ ID NO: 2530455 - DNA, 16 bp, Homo sapiens
ctgatggtcagctccc

SEQ ID NO: 2530456 - DNA, 13 bp, Homo sapiens
ctgatgttcagtg

SEQ ID NO: 2530457 - DNA, 17 bp, Homo sapiens
ctgatgttcagtgtaat

SEQ ID NO: 2530458 - DNA, 19 bp, Homo sapiens
ctgatgttcagtgtaattt

SEQ ID NO: 2530459 - DNA, 21 bp, Homo sapiens
ctgatgttcctagtgaaagag

SEQ ID NO: 2530460 - DNA, 19 bp, Homo sapiens
ctgattagaaatgaccaat

SEQ ID NO: 2530461 - DNA, 20 bp, Homo sapiens
ctgattcactgcatggctcc

SEQ ID NO: 2530462 - DNA, 18 bp, Homo sapiens
ctgattctcagggtctct

SEQ ID NO: 2530463 - DNA, 20 bp, Homo sapiens
ctgattctcagggtctctgc

SEQ ID NO: 2530464 - DNA, 14 bp, Homo sapiens
ctgattgtaacgtt

SEQ ID NO: 2530465 - DNA, 23 bp, Homo sapiens
ctgattgtaacgttgctgtggga

SEQ ID NO: 2530466 - DNA, 13 bp, Homo sapiens
ctgattgtattta

SEQ ID NO: 2530467 - DNA, 17 bp, Homo sapiens
ctgattgtgtctcttgg

SEQ ID NO: 2530468 - DNA, 16 bp, Homo sapiens
ctgatttgcaaaaaaa

SEQ ID NO: 2530469 - DNA, 12 bp, Homo sapiens
ctgattttaaca

SEQ ID NO: 2530470 - DNA, 16 bp, Homo sapiens
cttctcttaatttaat

SEQ ID NO: 2530471 - DNA, 14 bp, Homo sapiens
cttctcttcctgta

SEQ ID NO: 2530472 - DNA, 16 bp, Homo sapiens
cttctgaatgctgcta

SEQ ID NO: 2530473 - DNA, 17 bp, Homo sapiens
cttctgaccacacttcc

SEQ ID NO: 2530474 - DNA, 18 bp, Homo sapiens
cttctgaccacacttcct

SEQ ID NO: 2530475 - DNA, 19 bp, Homo sapiens
cttctgaccacacttcctg

SEQ ID NO: 2530476 - DNA, 18 bp, Homo sapiens
cttctgaccacagcatca

SEQ ID NO: 2530477 - DNA, 20 bp, Homo sapiens
cttctgacccatgctgccct

SEQ ID NO: 2530478 - DNA, 20 bp, Homo sapiens
cttctgacgtgccttttgca

SEQ ID NO: 2530479 - DNA, 18 bp, Homo sapiens
cttctgagctatttcatc

SEQ ID NO: 2530480 - DNA, 19 bp, Homo sapiens
cttctgcaattgcttagga

SEQ ID NO: 2530481 - DNA, 15 bp, Homo sapiens
cttctgcaccctcca

SEQ ID NO: 2530482 - DNA, 16 bp, Homo sapiens
cttctgcaccctccac

SEQ ID NO: 2530483 - DNA, 18 bp, Homo sapiens
cttctgcaccctccaccc

SEQ ID NO: 2530484 - DNA, 18 bp, Homo sapiens
cttctgccggccctgggg

SEQ ID NO: 2530485 - DNA, 21 bp, Homo sapiens
cttctgccttagtctcagttt

SEQ ID NO: 2530486 - DNA, 10 bp, Homo sapiens
cttctgctcc

SEQ ID NO: 2530487 - DNA, 12 bp, Homo sapiens
cttctgctccac

SEQ ID NO: 2530488 - DNA, 23 bp, Homo sapiens
cttctgctccacccttggcctgt

SEQ ID NO: 2530489 - DNA, 15 bp, Homo sapiens
cttctgctggataaa

SEQ ID NO: 2530490 - DNA, 17 bp, Homo sapiens
cttctgctggataaaat

SEQ ID NO: 2530491 - DNA, 11 bp, Homo sapiens
cttctggagcc

SEQ ID NO: 2530492 - DNA, 19 bp, Homo sapiens
cttctggcctcccacagac

SEQ ID NO: 2530493 - DNA, 20 bp, Homo sapiens
cttctggcttccttctctca

SEQ ID NO: 2530494 - DNA, 21 bp, Homo sapiens
cttctgggcttcatctggcaa

SEQ ID NO: 2530495 - DNA, 22 bp, Homo sapiens
cttctgggcttcatctggcaac

SEQ ID NO: 2530496 - DNA, 15 bp, Homo sapiens
cttctggtactctcc

SEQ ID NO: 2530497 - DNA, 21 bp, Homo sapiens
cttctgtacgtctgacaggca

SEQ ID NO: 2530498 - DNA, 18 bp, Homo sapiens
cttctgtaggaattcttt

SEQ ID NO: 2530499 - DNA, 15 bp, Homo sapiens
cttctgtattcactt

SEQ ID NO: 2530500 - DNA, 19 bp, Homo sapiens
cttctgtattcacttatat

SEQ ID NO: 2530501 - DNA, 18 bp, Homo sapiens
cttctgtcctactctgtg

SEQ ID NO: 2530502 - DNA, 19 bp, Homo sapiens
cttctgtcctactctgtgt

SEQ ID NO: 2530503 - DNA, 18 bp, Homo sapiens
cttctgtcttcacaacag

SEQ ID NO: 2530504 - DNA, 21 bp, Homo sapiens
cttctgtcttcacaacagatt

SEQ ID NO: 2530505 - DNA, 16 bp, Homo sapiens
cttcttaaatgagaag

SEQ ID NO: 2530506 - DNA, 21 bp, Homo sapiens
cttcttaaatgagaaggaatt

SEQ ID NO: 2530507 - DNA, 16 bp, Homo sapiens
cttcttaatcttttca

SEQ ID NO: 2530508 - DNA, 22 bp, Homo sapiens
cttcttaatcttttcacaaata

SEQ ID NO: 2530509 - DNA, 23 bp, Homo sapiens
cttcttaatcttttcacaaataa

SEQ ID NO: 2530510 - DNA, 14 bp, Homo sapiens
cttcttacatgcat

SEQ ID NO: 2530511 - DNA, 13 bp, Homo sapiens
cttcttatacatt

SEQ ID NO: 2530512 - DNA, 14 bp, Homo sapiens
cttcttcacccagc

SEQ ID NO: 2530513 - DNA, 13 bp, Homo sapiens
cttcttcagagac

SEQ ID NO: 2530514 - DNA, 14 bp, Homo sapiens
cttcttcagagact

SEQ ID NO: 2530515 - DNA, 18 bp, Homo sapiens
cttcttcagagactcctg

SEQ ID NO: 2530516 - DNA, 22 bp, Homo sapiens
cttcttcagagactcctgcagg

SEQ ID NO: 2530517 - DNA, 14 bp, Homo sapiens
cttcttcagagctg

SEQ ID NO: 2530518 - DNA, 16 bp, Homo sapiens
cttcttcagagctgac

SEQ ID NO: 2530519 - DNA, 13 bp, Homo sapiens
cttcttctcaggc

SEQ ID NO: 2530520 - DNA, 13 bp, Homo sapiens
cttcttctccccc

SEQ ID NO: 2530521 - DNA, 21 bp, Homo sapiens
cttcttcttttgagcaacttt

SEQ ID NO: 2530522 - DNA, 17 bp, Homo sapiens
cttcttctttttgctgt

SEQ ID NO: 2530523 - DNA, 21 bp, Homo sapiens
cttcttgaacactcatgctga

SEQ ID NO: 2530524 - DNA, 13 bp, Homo sapiens
cttcttgttcccc

SEQ ID NO: 2530525 - DNA, 14 bp, Homo sapiens
cttctttcattttc

SEQ ID NO: 2530526 - DNA, 14 bp, Homo sapiens
cttcttttgctctt

SEQ ID NO: 2530527 - DNA, 13 bp, Homo sapiens
cttcttttgtgaa

SEQ ID NO: 2530528 - DNA, 22 bp, Homo sapiens
cttgaaaaatgtgcaaaacagc

SEQ ID NO: 2530529 - DNA, 23 bp, Homo sapiens
cttgaaaatattttttatatata

SEQ ID NO: 2530530 - DNA, 16 bp, Homo sapiens
cttgaaagcatccatg

SEQ ID NO: 2530531 - DNA, 17 bp, Homo sapiens
cttgaaagcatccatgt

SEQ ID NO: 2530532 - DNA, 13 bp, Homo sapiens
cttgaaagctgtg

SEQ ID NO: 2530533 - DNA, 17 bp, Homo sapiens
cttgaaataccagtgaa

SEQ ID NO: 2530534 - DNA, 17 bp, Homo sapiens
cttgaaattttaaccta

SEQ ID NO: 2530535 - DNA, 23 bp, Homo sapiens
cttgaacactcatgctgaaagcc

SEQ ID NO: 2530536 - DNA, 13 bp, Homo sapiens
cttgaacactggg

SEQ ID NO: 2530537 - DNA, 15 bp, Homo sapiens
cttgaacactggggg

SEQ ID NO: 2530538 - DNA, 15 bp, Homo sapiens
cttgaaccacttccc

SEQ ID NO: 2530539 - DNA, 15 bp, Homo sapiens
cttgaactcctggcc

SEQ ID NO: 2530540 - DNA, 18 bp, Homo sapiens
cttgaactgggtacttgt

SEQ ID NO: 2530541 - DNA, 21 bp, Homo sapiens
cttgaactttgacctctgcag

SEQ ID NO: 2530542 - DNA, 13 bp, Homo sapiens
cttgaagatcgtt

SEQ ID NO: 2530543 - DNA, 17 bp, Homo sapiens
cttgaagccactgaagc

SEQ ID NO: 2530544 - DNA, 22 bp, Homo sapiens
cttgaatatcccctcccagtca

SEQ ID NO: 2530545 - DNA, 13 bp, Homo sapiens
cttgaatgtcttt

SEQ ID NO: 2530546 - DNA, 21 bp, Homo sapiens
cttgaattgtaactgttcttg

SEQ ID NO: 2530547 - DNA, 22 bp, Homo sapiens
cttgaattgtaactgttcttga

SEQ ID NO: 2530548 - DNA, 20 bp, Homo sapiens
cttgaccaagcaggaagctc

SEQ ID NO: 2530549 - DNA, 19 bp, Homo sapiens
cttgaccagcagatcccag

SEQ ID NO: 2530550 - DNA, 20 bp, Homo sapiens
cttgaccagcagatcccagc

SEQ ID NO: 2530551 - DNA, 21 bp, Homo sapiens
cttgaccagcagatcccagct

SEQ ID NO: 2530552 - DNA, 13 bp, Homo sapiens
cttgacccatctc

SEQ ID NO: 2530553 - DNA, 13 bp, Homo sapiens
cttgacctcaggt

SEQ ID NO: 2530554 - DNA, 22 bp, Homo sapiens
cttgagactgttttgaatttgg

SEQ ID NO: 2530555 - DNA, 14 bp, Homo sapiens
cttgagagaccagg

SEQ ID NO: 2530556 - DNA, 22 bp, Homo sapiens
cttgagagtatcaggtctccca

SEQ ID NO: 2530557 - DNA, 21 bp, Homo sapiens
cttgagcaagttccttctggt

SEQ ID NO: 2530558 - DNA, 13 bp, Homo sapiens
cttgagccagtaa

SEQ ID NO: 2530559 - DNA, 16 bp, Homo sapiens
cttgagccagtaattg

SEQ ID NO: 2530560 - DNA, 15 bp, Homo sapiens
cttgagcctgggagg

SEQ ID NO: 2530561 - DNA, 13 bp, Homo sapiens
cttgagctcagga

SEQ ID NO: 2530562 - DNA, 16 bp, Homo sapiens
cttgagctgagatgga

SEQ ID NO: 2530563 - DNA, 20 bp, Homo sapiens
cttgagcttggcagctgaac

SEQ ID NO: 2530564 - DNA, 22 bp, Homo sapiens
cttgaggagtgtgagaatcaaa

SEQ ID NO: 2530565 - DNA, 16 bp, Homo sapiens
cttgagggcccagagc

SEQ ID NO: 2530566 - DNA, 22 bp, Homo sapiens
cttgaggtcttttgacatgtgg

SEQ ID NO: 2530567 - DNA, 23 bp, Homo sapiens
cttgaggtcttttgacatgtgga

SEQ ID NO: 2530568 - DNA, 23 bp, Homo sapiens
cttgagtggggttatctctgtgt

SEQ ID NO: 2530569 - DNA, 20 bp, Homo sapiens
cttgagttgattcagctctg

SEQ ID NO: 2530570 - DNA, 21 bp, Homo sapiens
cttgagttgattcagctctgc

SEQ ID NO: 2530571 - DNA, 16 bp, Homo sapiens
cttgagttttatttat

SEQ ID NO: 2530572 - DNA, 19 bp, Homo sapiens
cttgatacccccctctgtc

SEQ ID NO: 2530573 - DNA, 22 bp, Homo sapiens
cttgatactaaaagttcttctc

SEQ ID NO: 2530574 - DNA, 19 bp, Homo sapiens
cttgatgccagtaggctca

SEQ ID NO: 2530575 - DNA, 22 bp, Homo sapiens
cttgatgtgccattttaaaaaa

SEQ ID NO: 2530576 - DNA, 15 bp, Homo sapiens
cttgatgtgttatct

SEQ ID NO: 2530577 - DNA, 14 bp, Homo sapiens
cttgcaacacacag

SEQ ID NO: 2530578 - DNA, 19 bp, Homo sapiens
cttgcaacacacagacaca

SEQ ID NO: 2530579 - DNA, 14 bp, Homo sapiens
cttgcaagaatcag

SEQ ID NO: 2530580 - DNA, 15 bp, Homo sapiens
cttgcaatggcagcc

SEQ ID NO: 2530581 - DNA, 23 bp, Homo sapiens
cttgcacactcccctgcactgga

SEQ ID NO: 2530582 - DNA, 14 bp, Homo sapiens
cttgcacccctcac

SEQ ID NO: 2530583 - DNA, 16 bp, Homo sapiens
cttgcacccctcactc

SEQ ID NO: 2530584 - DNA, 18 bp, Homo sapiens
cttgcacccgcctctccc

SEQ ID NO: 2530585 - DNA, 19 bp, Homo sapiens
cttgcacgcccatgtgtga

SEQ ID NO: 2530586 - DNA, 21 bp, Homo sapiens
cttgcactaaagtatgtaaag

SEQ ID NO: 2530587 - DNA, 20 bp, Homo sapiens
cttgcaggtctcaacccttt

SEQ ID NO: 2530588 - DNA, 21 bp, Homo sapiens
cttgcagtagattttctttaa

SEQ ID NO: 2530589 - DNA, 18 bp, Homo sapiens
cttgcagttcagcaccac

SEQ ID NO: 2530590 - DNA, 17 bp, Homo sapiens
cttgcatcgtggagaca

SEQ ID NO: 2530591 - DNA, 13 bp, Homo sapiens
cttgcatgaggct

SEQ ID NO: 2530592 - DNA, 21 bp, Homo sapiens
cttgcatgaggctagtgtggt

SEQ ID NO: 2530593 - DNA, 12 bp, Homo sapiens
cttgcatttttg

SEQ ID NO: 2530594 - DNA, 14 bp, Homo sapiens
cttgcatttttgca

SEQ ID NO: 2530595 - DNA, 21 bp, Homo sapiens
cttgcatttttgcaggagcag

SEQ ID NO: 2530596 - DNA, 13 bp, Homo sapiens
cttgccaccccac

SEQ ID NO: 2530597 - DNA, 23 bp, Homo sapiens
cttgccagggtttcgagaagctg

SEQ ID NO: 2530598 - DNA, 14 bp, Homo sapiens
cttgcccacaccga

SEQ ID NO: 2530599 - DNA, 15 bp, Homo sapiens
cttgcccagggctca

SEQ ID NO: 2530600 - DNA, 16 bp, Homo sapiens
cttgcccagggctcag

SEQ ID NO: 2530601 - DNA, 18 bp, Homo sapiens
cttgcccagggctcagcc

SEQ ID NO: 2530602 - DNA, 14 bp, Homo sapiens
cttgcccagtttca

SEQ ID NO: 2530603 - DNA, 21 bp, Homo sapiens
cttgccccggccccggcccca

SEQ ID NO: 2530604 - DNA, 15 bp, Homo sapiens
cttgccctgacctcc

SEQ ID NO: 2530605 - DNA, 17 bp, Homo sapiens
cttgccctgacctccca

SEQ ID NO: 2530606 - DNA, 19 bp, Homo sapiens
cttgccctgacctcccagc

SEQ ID NO: 2530607 - DNA, 18 bp, Homo sapiens
cttgccctggtgcctcac

SEQ ID NO: 2530608 - DNA, 19 bp, Homo sapiens
cttgcccttccctgtccct

SEQ ID NO: 2530609 - DNA, 21 bp, Homo sapiens
cttgccgcgtcgccctcccag

SEQ ID NO: 2530610 - DNA, 20 bp, Homo sapiens
cttgccgtctacctgagggg

SEQ ID NO: 2530611 - DNA, 16 bp, Homo sapiens
cttgcctagggcctgg

SEQ ID NO: 2530612 - DNA, 13 bp, Homo sapiens
cttgcctctctgt

SEQ ID NO: 2530613 - DNA, 21 bp, Homo sapiens
cttgccttattagagtgtctt

SEQ ID NO: 2530614 - DNA, 17 bp, Homo sapiens
ctttaagtgcacaacat

SEQ ID NO: 2530615 - DNA, 12 bp, Homo sapiens
ctttaatataaa

SEQ ID NO: 2530616 - DNA, 19 bp, Homo sapiens
ctttaatatcatcagtatt

SEQ ID NO: 2530617 - DNA, 21 bp, Homo sapiens
ctttaatatcatcagtattga

SEQ ID NO: 2530618 - DNA, 17 bp, Homo sapiens
ctttaatgtcacaggca

SEQ ID NO: 2530619 - DNA, 20 bp, Homo sapiens
ctttaatgtcacaggcaggt

SEQ ID NO: 2530620 - DNA, 22 bp, Homo sapiens
ctttaatgtcacaggcaggtcc

SEQ ID NO: 2530621 - DNA, 19 bp, Homo sapiens
ctttaattaccaacctgtt

SEQ ID NO: 2530622 - DNA, 20 bp, Homo sapiens
ctttaattctcatgtgatcc

SEQ ID NO: 2530623 - DNA, 23 bp, Homo sapiens
ctttaattgttaagatatgatgt

SEQ ID NO: 2530624 - DNA, 21 bp, Homo sapiens
ctttacacattcggctccctg

SEQ ID NO: 2530625 - DNA, 20 bp, Homo sapiens
ctttacatggggttttcaat

SEQ ID NO: 2530626 - DNA, 14 bp, Homo sapiens
ctttaccaccccca

SEQ ID NO: 2530627 - DNA, 16 bp, Homo sapiens
ctttaccacccccaca

SEQ ID NO: 2530628 - DNA, 13 bp, Homo sapiens
ctttacctgagac

SEQ ID NO: 2530629 - DNA, 17 bp, Homo sapiens
ctttaccttttttatac

SEQ ID NO: 2530630 - DNA, 13 bp, Homo sapiens
ctttactatggcc

SEQ ID NO: 2530631 - DNA, 19 bp, Homo sapiens
ctttactgtcaaaataatt

SEQ ID NO: 2530632 - DNA, 12 bp, Homo sapiens
ctttagatgctg

SEQ ID NO: 2530633 - DNA, 18 bp, Homo sapiens
ctttaggcagcagctttt

SEQ ID NO: 2530634 - DNA, 20 bp, Homo sapiens
ctttagtgatcacagcagct

SEQ ID NO: 2530635 - DNA, 17 bp, Homo sapiens
ctttagtggtggccatt

SEQ ID NO: 2530636 - DNA, 12 bp, Homo sapiens
ctttataaactt

SEQ ID NO: 2530637 - DNA, 13 bp, Homo sapiens
ctttataattcta

SEQ ID NO: 2530638 - DNA, 19 bp, Homo sapiens
ctttatacgtgtagctata

SEQ ID NO: 2530639 - DNA, 19 bp, Homo sapiens
ctttatcacattatttgca

SEQ ID NO: 2530640 - DNA, 21 bp, Homo sapiens
ctttatctaatacctctgtgt

SEQ ID NO: 2530641 - DNA, 18 bp, Homo sapiens
ctttatgtggaaaacaga

SEQ ID NO: 2530642 - DNA, 22 bp, Homo sapiens
ctttattttttaagtatttata

SEQ ID NO: 2530643 - DNA, 14 bp, Homo sapiens
ctttcaaaaacatg

SEQ ID NO: 2530644 - DNA, 15 bp, Homo sapiens
ctttcaaagaaggaa

SEQ ID NO: 2530645 - DNA, 15 bp, Homo sapiens
ctttcaaatttcaca

SEQ ID NO: 2530646 - DNA, 20 bp, Homo sapiens
ctttcaatggtttgcaagga

SEQ ID NO: 2530647 - DNA, 21 bp, Homo sapiens
ctttcaattccgtagccagct

SEQ ID NO: 2530648 - DNA, 17 bp, Homo sapiens
ctttcacaaaattttat

SEQ ID NO: 2530649 - DNA, 14 bp, Homo sapiens
ctttcacacttcca

SEQ ID NO: 2530650 - DNA, 13 bp, Homo sapiens
ctttcacagctcc

SEQ ID NO: 2530651 - DNA, 15 bp, Homo sapiens
ctttcacagctcctc

SEQ ID NO: 2530652 - DNA, 18 bp, Homo sapiens
ctttcacagctcctccca

SEQ ID NO: 2530653 - DNA, 12 bp, Homo sapiens
ctttcagatgtc

SEQ ID NO: 2530654 - DNA, 20 bp, Homo sapiens
ctttcagggaatttcaggaa

SEQ ID NO: 2530655 - DNA, 14 bp, Homo sapiens
ctttcatattttag

SEQ ID NO: 2530656 - DNA, 22 bp, Homo sapiens
ctttcatcctgactctgccccc

SEQ ID NO: 2530657 - DNA, 19 bp, Homo sapiens
ctttcatggggtgatgctg

SEQ ID NO: 2530658 - DNA, 20 bp, Homo sapiens
ctttcatgtaaactgtgcac

SEQ ID NO: 2530659 - DNA, 20 bp, Homo sapiens
ctttcattaaagcatttact

SEQ ID NO: 2530660 - DNA, 17 bp, Homo sapiens
ctttcatttactgtggc

SEQ ID NO: 2530661 - DNA, 19 bp, Homo sapiens
ctttccaaatgcccagctt

SEQ ID NO: 2530662 - DNA, 20 bp, Homo sapiens
ctttccaccccctccctggc

SEQ ID NO: 2530663 - DNA, 22 bp, Homo sapiens
ctttccaccccctccctggcct

SEQ ID NO: 2530664 - DNA, 21 bp, Homo sapiens
ctttccacggagccactcctc

SEQ ID NO: 2530665 - DNA, 16 bp, Homo sapiens
ctttcccatcttccaa

SEQ ID NO: 2530666 - DNA, 14 bp, Homo sapiens
ctttcccctgtggg

SEQ ID NO: 2530667 - DNA, 17 bp, Homo sapiens
ctttcccctgtggggat

SEQ ID NO: 2530668 - DNA, 13 bp, Homo sapiens
ctttccctgaact

SEQ ID NO: 2530669 - DNA, 20 bp, Homo sapiens
ctttcccttttccatttgaa

SEQ ID NO: 2530670 - DNA, 19 bp, Homo sapiens
ctttccgtggcactgcata

SEQ ID NO: 2530671 - DNA, 19 bp, Homo sapiens
ctttcctcaaaacttcaga

SEQ ID NO: 2530672 - DNA, 16 bp, Homo sapiens
ctttcctcctggcaga

SEQ ID NO: 2530673 - DNA, 13 bp, Homo sapiens
ctttcctcttccc

SEQ ID NO: 2530674 - DNA, 15 bp, Homo sapiens
ctttcctgaatccaa

SEQ ID NO: 2530675 - DNA, 16 bp, Homo sapiens
ctttcctgaggctggg

SEQ ID NO: 2530676 - DNA, 22 bp, Homo sapiens
ctttcctgatggtacaggaaag

SEQ ID NO: 2530677 - DNA, 18 bp, Homo sapiens
ctttccttttttaaaaat

SEQ ID NO: 2530678 - DNA, 20 bp, Homo sapiens
ctttctacagggctgacatt

SEQ ID NO: 2530679 - DNA, 17 bp, Homo sapiens
ctttctacccagcgagc

SEQ ID NO: 2530680 - DNA, 23 bp, Homo sapiens
ctttctagctgttgagctgtttt

SEQ ID NO: 2530681 - DNA, 21 bp, Homo sapiens
ctttctagtggtctttgtaag

SEQ ID NO: 2530682 - DNA, 12 bp, Homo sapiens
ctttctatcatt

SEQ ID NO: 2530683 - DNA, 14 bp, Homo sapiens
ctttctatcatttt

SEQ ID NO: 2530684 - DNA, 17 bp, Homo sapiens
ctttctatcctctgtaa

SEQ ID NO: 2530685 - DNA, 17 bp, Homo sapiens
ctttctcagttttcata

SEQ ID NO: 2530686 - DNA, 15 bp, Homo sapiens
ctttctccagccagc

SEQ ID NO: 2530687 - DNA, 19 bp, Homo sapiens
ctttctccagccagcaatg

SEQ ID NO: 2530688 - DNA, 20 bp, Homo sapiens
ctttctccagccagcaatga

SEQ ID NO: 2530689 - DNA, 20 bp, Homo sapiens
ctttctccttagtcttctca

SEQ ID NO: 2530690 - DNA, 23 bp, Homo sapiens
ctttctccttagtcttctcatag

SEQ ID NO: 2530691 - DNA, 19 bp, Homo sapiens
ctttctcgattttatcttt

SEQ ID NO: 2530692 - DNA, 13 bp, Homo sapiens
ctttctctacttt

SEQ ID NO: 2530693 - DNA, 13 bp, Homo sapiens
ctttctgaaataa

SEQ ID NO: 2530694 - DNA, 20 bp, Homo sapiens
ctttctgagcacactttagt

SEQ ID NO: 2530695 - DNA, 18 bp, Homo sapiens
ctttctggctatgcattt

SEQ ID NO: 2530696 - DNA, 19 bp, Homo sapiens
ctttctggctatgcatttg

SEQ ID NO: 2530697 - DNA, 15 bp, Homo sapiens
ctttctgtgtgcacc

SEQ ID NO: 2530698 - DNA, 15 bp, Homo sapiens
ctttctgttgtcatt

SEQ ID NO: 2530699 - DNA, 21 bp, Homo sapiens
ctttctgttgtcattgctgtt

SEQ ID NO: 2530700 - DNA, 15 bp, Homo sapiens
ctttcttctatttta

SEQ ID NO: 2530701 - DNA, 16 bp, Homo sapiens
ctttcttctattttat

SEQ ID NO: 2530702 - DNA, 20 bp, Homo sapiens
ctttcttggttcataaatga

SEQ ID NO: 2530703 - DNA, 22 bp, Homo sapiens
ctttcttttctggaatgtaatc

SEQ ID NO: 2530704 - DNA, 15 bp, Homo sapiens
ctttctttttcttct

SEQ ID NO: 2530705 - DNA, 16 bp, Homo sapiens
ctttctttttcttctt

SEQ ID NO: 2530706 - DNA, 21 bp, Homo sapiens
ctttgaaatagtctgtgtgaa

SEQ ID NO: 2530707 - DNA, 16 bp, Homo sapiens
ctttgaaatgaatata

SEQ ID NO: 2530708 - DNA, 14 bp, Homo sapiens
ctttgaagcagttg

SEQ ID NO: 2530709 - DNA, 16 bp, Homo sapiens
ctttgaagtcatacca

SEQ ID NO: 2530710 - DNA, 16 bp, Homo sapiens
ctttgaatgcggccca

SEQ ID NO: 2530711 - DNA, 13 bp, Homo sapiens
ctttgaatgcttt

SEQ ID NO: 2530712 - DNA, 12 bp, Homo sapiens
ctttgaattttc

SEQ ID NO: 2530713 - DNA, 18 bp, Homo sapiens
ctttgacctcaacctgtg

SEQ ID NO: 2530714 - DNA, 14 bp, Homo sapiens
ctttgacctctgca

SEQ ID NO: 2530715 - DNA, 15 bp, Homo sapiens
ctttgacctgcctcc

SEQ ID NO: 2530716 - DNA, 18 bp, Homo sapiens
ctttgacctgcctccctt

SEQ ID NO: 2530717 - DNA, 20 bp, Homo sapiens
ctttgacctgcctcccttca

SEQ ID NO: 2530718 - DNA, 16 bp, Homo sapiens
ctttgacgccatccca

SEQ ID NO: 2530719 - DNA, 15 bp, Homo sapiens
ctttgactttttgca

SEQ ID NO: 2530720 - DNA, 16 bp, Homo sapiens
ctttgagacagtttct

SEQ ID NO: 2530721 - DNA, 17 bp, Homo sapiens
ctttgagactgggtctc

SEQ ID NO: 2530722 - DNA, 21 bp, Homo sapiens
ctttgagcccacaaagcctta

SEQ ID NO: 2530723 - DNA, 21 bp, Homo sapiens
ctttgagtgcagtcctgatca

SEQ ID NO: 2530724 - DNA, 15 bp, Homo sapiens
ctttgatcaggtggg

SEQ ID NO: 2530725 - DNA, 15 bp, Homo sapiens
ctttgatgttaacac

SEQ ID NO: 2530726 - DNA, 19 bp, Homo sapiens
ctttgatgttaacacattt

SEQ ID NO: 2530727 - DNA, 20 bp, Homo sapiens
ctttgattaaagactccagt

SEQ ID NO: 2530728 - DNA, 16 bp, Homo sapiens
ctttgattaatccaga

SEQ ID NO: 2530729 - DNA, 18 bp, Homo sapiens
ctttgcacagctctccgg

SEQ ID NO: 2530730 - DNA, 14 bp, Homo sapiens
ctttgcactgaggg

SEQ ID NO: 2530731 - DNA, 18 bp, Homo sapiens
ctttgcactgagggccac

SEQ ID NO: 2530732 - DNA, 12 bp, Homo sapiens
ctttgcaggcat

SEQ ID NO: 2530733 - DNA, 13 bp, Homo sapiens
ctttgcaggctca

SEQ ID NO: 2530734 - DNA, 19 bp, Homo sapiens
ctttgcattttaaaaatga

SEQ ID NO: 2530735 - DNA, 18 bp, Homo sapiens
ctttgccagaaagcataa

SEQ ID NO: 2530736 - DNA, 13 bp, Homo sapiens
ctttgccagcttt

SEQ ID NO: 2530737 - DNA, 16 bp, Homo sapiens
ctttgcctgttcagtt

SEQ ID NO: 2530738 - DNA, 16 bp, Homo sapiens
ctttgccttgggctgc

SEQ ID NO: 2530739 - DNA, 18 bp, Homo sapiens
ctttgccttgggctgctc

SEQ ID NO: 2530740 - DNA, 19 bp, Homo sapiens
ctttgccttgggctgctcc

SEQ ID NO: 2530741 - DNA, 22 bp, Homo sapiens
ctttgccttgggctgctcctca

SEQ ID NO: 2530742 - DNA, 14 bp, Homo sapiens
ctttgcttgaaaga

SEQ ID NO: 2530743 - DNA, 16 bp, Homo sapiens
ctttgctttgcccagc

SEQ ID NO: 2530744 - DNA, 19 bp, Homo sapiens
ctttggaaaatgcattgta

SEQ ID NO: 2530745 - DNA, 20 bp, Homo sapiens
ctttggaaaatgcattgtat

SEQ ID NO: 2530746 - DNA, 17 bp, Homo sapiens
ctttggaaacaggacca

SEQ ID NO: 2530747 - DNA, 12 bp, Homo sapiens
ctttggaaagac

SEQ ID NO: 2530748 - DNA, 23 bp, Homo sapiens
ctttggaaagacttttccaaccc

SEQ ID NO: 2530749 - DNA, 19 bp, Homo sapiens
ctttggaaagagtaggaag

SEQ ID NO: 2530750 - DNA, 23 bp, Homo sapiens
ctttggaaagagtaggaagactt

SEQ ID NO: 2530751 - DNA, 15 bp, Homo sapiens
ctttggaaggagtga

SEQ ID NO: 2530752 - DNA, 18 bp, Homo sapiens
ctttggacagaagcagct

SEQ ID NO: 2530753 - DNA, 15 bp, Homo sapiens
ctttggaccctgagg

SEQ ID NO: 2530754 - DNA, 19 bp, Homo sapiens
ctttggaccctgaggccca

SEQ ID NO: 2530755 - DNA, 13 bp, Homo sapiens
ctttggagctttt

SEQ ID NO: 2530756 - DNA, 13 bp, Homo sapiens
ctttggcaggtgc

SEQ ID NO: 2530757 - DNA, 19 bp, Homo sapiens
ctttggctattagagatca

SEQ ID NO: 2530758 - DNA, 15 bp, Homo sapiens
ctttgggaaaggaga

SEQ ID NO: 2530759 - DNA, 23 bp, Homo sapiens
gaagacaccagagcagatgcaga

SEQ ID NO: 2530760 - DNA, 21 bp, Homo sapiens
gaagacactgaaatatacaca

SEQ ID NO: 2530761 - DNA, 21 bp, Homo sapiens
gaagacactgatgggcaaccc

SEQ ID NO: 2530762 - DNA, 18 bp, Homo sapiens
gaagacagagacctcctg

SEQ ID NO: 2530763 - DNA, 21 bp, Homo sapiens
gaagacagagacctcctgcct

SEQ ID NO: 2530764 - DNA, 18 bp, Homo sapiens
gaagacatgaaccaagtg

SEQ ID NO: 2530765 - DNA, 20 bp, Homo sapiens
gaagacatggagactcctgc

SEQ ID NO: 2530766 - DNA, 22 bp, Homo sapiens
gaagacatggggaggaaggaca

SEQ ID NO: 2530767 - DNA, 20 bp, Homo sapiens
gaagaccacatccacacacg

SEQ ID NO: 2530768 - DNA, 18 bp, Homo sapiens
gaagaccagactgtggag

SEQ ID NO: 2530769 - DNA, 14 bp, Homo sapiens
gaagaccccaccca

SEQ ID NO: 2530770 - DNA, 16 bp, Homo sapiens
gaagaccccacccaag

SEQ ID NO: 2530771 - DNA, 14 bp, Homo sapiens
gaagaccctccccg

SEQ ID NO: 2530772 - DNA, 14 bp, Homo sapiens
gaagacgaggccct

SEQ ID NO: 2530773 - DNA, 23 bp, Homo sapiens
gaagacgaggccctcgggcccag

SEQ ID NO: 2530774 - DNA, 16 bp, Homo sapiens
gaagactcattcttct

SEQ ID NO: 2530775 - DNA, 15 bp, Homo sapiens
gaagactctaccaga

SEQ ID NO: 2530776 - DNA, 11 bp, Homo sapiens
gaagactgtgg

SEQ ID NO: 2530777 - DNA, 11 bp, Homo sapiens
gaagactttgg

SEQ ID NO: 2530778 - DNA, 14 bp, Homo sapiens
gaagactttggaaa

SEQ ID NO: 2530779 - DNA, 17 bp, Homo sapiens
gaagagaagggcagggc

SEQ ID NO: 2530780 - DNA, 16 bp, Homo sapiens
gaagagagcatgagag

SEQ ID NO: 2530781 - DNA, 18 bp, Homo sapiens
gaagagaggagttcaatg

SEQ ID NO: 2530782 - DNA, 18 bp, Homo sapiens
gaagagcaggcacatgga

SEQ ID NO: 2530783 - DNA, 23 bp, Homo sapiens
gaagagcaggcacatggaggagc

SEQ ID NO: 2530784 - DNA, 20 bp, Homo sapiens
gaagagctgttcacagccag

SEQ ID NO: 2530785 - DNA, 23 bp, Homo sapiens
gaagagctgttcacagccagact

SEQ ID NO: 2530786 - DNA, 15 bp, Homo sapiens
gaagaggctggttct

SEQ ID NO: 2530787 - DNA, 14 bp, Homo sapiens
gaagaggggcagcc

SEQ ID NO: 2530788 - DNA, 17 bp, Homo sapiens
gaagagtgggtttcaca

SEQ ID NO: 2530789 - DNA, 17 bp, Homo sapiens
gaagagtgtactggggg

SEQ ID NO: 2530790 - DNA, 13 bp, Homo sapiens
gaagataggctct

SEQ ID NO: 2530791 - DNA, 16 bp, Homo sapiens
gaagataggctctgca

SEQ ID NO: 2530792 - DNA, 18 bp, Homo sapiens
gaagataggctctgcaca

SEQ ID NO: 2530793 - DNA, 21 bp, Homo sapiens
gaagatcatatacgtgaaaat

SEQ ID NO: 2530794 - DNA, 20 bp, Homo sapiens
gaagatcccctcaggactgc

SEQ ID NO: 2530795 - DNA, 17 bp, Homo sapiens
gaagatcctaaaacaaa

SEQ ID NO: 2530796 - DNA, 13 bp, Homo sapiens
gaagatgcagctc

SEQ ID NO: 2530797 - DNA, 17 bp, Homo sapiens
gaagcaaacacattaag

SEQ ID NO: 2530798 - DNA, 16 bp, Homo sapiens
gaagcaacagaaaaaa

SEQ ID NO: 2530799 - DNA, 16 bp, Homo sapiens
gaagcaacgaagggaa

SEQ ID NO: 2530800 - DNA, 19 bp, Homo sapiens
gaagcaataaagaagagtg

SEQ ID NO: 2530801 - DNA, 13 bp, Homo sapiens
gaagcacagcttc

SEQ ID NO: 2530802 - DNA, 14 bp, Homo sapiens
gaagcacagcttca

SEQ ID NO: 2530803 - DNA, 14 bp, Homo sapiens
gaagcacatgttta

SEQ ID NO: 2530804 - DNA, 15 bp, Homo sapiens
gaagcagaggaagga

SEQ ID NO: 2530805 - DNA, 18 bp, Homo sapiens
gaagcaggttgaggggct

SEQ ID NO: 2530806 - DNA, 19 bp, Homo sapiens
gaagcaggttgaggggctc

SEQ ID NO: 2530807 - DNA, 18 bp, Homo sapiens
gaagcagtgccttccata

SEQ ID NO: 2530808 - DNA, 13 bp, Homo sapiens
gaagcagttgtgt

SEQ ID NO: 2530809 - DNA, 13 bp, Homo sapiens
gaagcatgaaaaa

SEQ ID NO: 2530810 - DNA, 12 bp, Homo sapiens
gaagcatgtttc

SEQ ID NO: 2530811 - DNA, 21 bp, Homo sapiens
gaagcattaacttctctggaa

SEQ ID NO: 2530812 - DNA, 22 bp, Homo sapiens
gaagcattccttctttgataat

SEQ ID NO: 2530813 - DNA, 18 bp, Homo sapiens
gaagcatttactttgtgt

SEQ ID NO: 2530814 - DNA, 15 bp, Homo sapiens
gaagcattttataaa

SEQ ID NO: 2530815 - DNA, 17 bp, Homo sapiens
gaagcattttataaatc

SEQ ID NO: 2530816 - DNA, 18 bp, Homo sapiens
gaagccaaacctctgtga

SEQ ID NO: 2530817 - DNA, 15 bp, Homo sapiens
gaagccaacttggct

SEQ ID NO: 2530818 - DNA, 17 bp, Homo sapiens
gaagccaacttggcttt

SEQ ID NO: 2530819 - DNA, 12 bp, Homo sapiens
gaagccaggagc

SEQ ID NO: 2530820 - DNA, 13 bp, Homo sapiens
gaagccaggagca

SEQ ID NO: 2530821 - DNA, 15 bp, Homo sapiens
gaagccaggagcaaa

SEQ ID NO: 2530822 - DNA, 19 bp, Homo sapiens
gaagcccaataaacctctt

SEQ ID NO: 2530823 - DNA, 19 bp, Homo sapiens
gaagcccaggaaaggctcc

SEQ ID NO: 2530824 - DNA, 20 bp, Homo sapiens
gaagcccaggaaaggctcca

SEQ ID NO: 2530825 - DNA, 22 bp, Homo sapiens
gaagcccaggaaaggctccagg

SEQ ID NO: 2530826 - DNA, 14 bp, Homo sapiens
gaagccccttcccc

SEQ ID NO: 2530827 - DNA, 17 bp, Homo sapiens
gaagccccttccccatg

SEQ ID NO: 2530828 - DNA, 16 bp, Homo sapiens
gaagcctccccagctc

SEQ ID NO: 2530829 - DNA, 22 bp, Homo sapiens
gaagcctgttttgttggaaggt

SEQ ID NO: 2530830 - DNA, 14 bp, Homo sapiens
gaagcggctggcag

SEQ ID NO: 2530831 - DNA, 22 bp, Homo sapiens
gaagctacaggttacaacagat

SEQ ID NO: 2530832 - DNA, 23 bp, Homo sapiens
gaagctacaggttacaacagatt

SEQ ID NO: 2530833 - DNA, 17 bp, Homo sapiens
gaagctagctcccctcc

SEQ ID NO: 2530834 - DNA, 22 bp, Homo sapiens
gaagctagctcccctcctctcc

SEQ ID NO: 2530835 - DNA, 18 bp, Homo sapiens
gaagctcagcccaccccc

SEQ ID NO: 2530836 - DNA, 19 bp, Homo sapiens
gaagctcagcccacccccc

SEQ ID NO: 2530837 - DNA, 15 bp, Homo sapiens
gaagctcagggcctg

SEQ ID NO: 2530838 - DNA, 18 bp, Homo sapiens
gaagctcagggcctggct

SEQ ID NO: 2530839 - DNA, 19 bp, Homo sapiens
gaagctcagggcctggctc

SEQ ID NO: 2530840 - DNA, 21 bp, Homo sapiens
gaagctcagggcctggctcag

SEQ ID NO: 2530841 - DNA, 13 bp, Homo sapiens
gaagctccactgt

SEQ ID NO: 2530842 - DNA, 14 bp, Homo sapiens
gaagctccactgtc

SEQ ID NO: 2530843 - DNA, 15 bp, Homo sapiens
gaagctccactgtca

SEQ ID NO: 2530844 - DNA, 23 bp, Homo sapiens
gaagctccactgtcaccctccac

SEQ ID NO: 2530845 - DNA, 15 bp, Homo sapiens
gaagctctgaagtca

SEQ ID NO: 2530846 - DNA, 18 bp, Homo sapiens
gaagctcttgaagacact

SEQ ID NO: 2530847 - DNA, 17 bp, Homo sapiens
gaagctgatgctttgct

SEQ ID NO: 2530848 - DNA, 16 bp, Homo sapiens
gaagctgccctgccca

SEQ ID NO: 2530849 - DNA, 17 bp, Homo sapiens
gaagctgctctggaatt

SEQ ID NO: 2530850 - DNA, 17 bp, Homo sapiens
gaagctggccgagggtc

SEQ ID NO: 2530851 - DNA, 23 bp, Homo sapiens
gaagctggccgagggtcctggct

SEQ ID NO: 2530852 - DNA, 13 bp, Homo sapiens
gaagcttccagtc

SEQ ID NO: 2530853 - DNA, 16 bp, Homo sapiens
gaagcttccagtccaa

SEQ ID NO: 2530854 - DNA, 14 bp, Homo sapiens
gaagctttcagtat

SEQ ID NO: 2530855 - DNA, 14 bp, Homo sapiens
gaagctttctgtct

SEQ ID NO: 2530856 - DNA, 19 bp, Homo sapiens
gaaggaaacccagctctgg

SEQ ID NO: 2530857 - DNA, 20 bp, Homo sapiens
gaaggaaacccagctctggt

SEQ ID NO: 2530858 - DNA, 19 bp, Homo sapiens
gaaggaaagaaagaaggaa

SEQ ID NO: 2530859 - DNA, 22 bp, Homo sapiens
gaaggaataaattgctccttga

SEQ ID NO: 2530860 - DNA, 22 bp, Homo sapiens
gaaggaccacattttatattta

SEQ ID NO: 2530861 - DNA, 19 bp, Homo sapiens
gaaggactgtgacaggcag

SEQ ID NO: 2530862 - DNA, 15 bp, Homo sapiens
gaaggagagcctgct

SEQ ID NO: 2530863 - DNA, 20 bp, Homo sapiens
gaaggagccccattcctggg

SEQ ID NO: 2530864 - DNA, 13 bp, Homo sapiens
gaaggaggtgagg

SEQ ID NO: 2530865 - DNA, 17 bp, Homo sapiens
gaaggaggtgagggatg

SEQ ID NO: 2530866 - DNA, 19 bp, Homo sapiens
gaaggatacaaaagcatgt

SEQ ID NO: 2530867 - DNA, 21 bp, Homo sapiens
gaaggatacaaaagcatgtga

SEQ ID NO: 2530868 - DNA, 14 bp, Homo sapiens
gaaggatgagcatt

SEQ ID NO: 2530869 - DNA, 18 bp, Homo sapiens
gaaggcagaaagcaaaat

SEQ ID NO: 2530870 - DNA, 13 bp, Homo sapiens
gaaggcagggaaa

SEQ ID NO: 2530871 - DNA, 22 bp, Homo sapiens
gaaggcagggggaaggtggggt

SEQ ID NO: 2530872 - DNA, 22 bp, Homo sapiens
gaaggccagctgccccagccag

SEQ ID NO: 2530873 - DNA, 19 bp, Homo sapiens
gaaggccccgcccaggctt

SEQ ID NO: 2530874 - DNA, 18 bp, Homo sapiens
gaaggccgagaagcaaga

SEQ ID NO: 2530875 - DNA, 21 bp, Homo sapiens
gaaggctcgagcatgcctgga

SEQ ID NO: 2530876 - DNA, 15 bp, Homo sapiens
gaaggctgggttctg

SEQ ID NO: 2530877 - DNA, 12 bp, Homo sapiens
gaaggctgtcct

SEQ ID NO: 2530878 - DNA, 17 bp, Homo sapiens
gaaggctgtccttaccc

SEQ ID NO: 2530879 - DNA, 16 bp, Homo sapiens
gaaggcttctctctgt

SEQ ID NO: 2530880 - DNA, 20 bp, Homo sapiens
gaagggaccttgaagggtaa

SEQ ID NO: 2530881 - DNA, 12 bp, Homo sapiens
gaagggagaagg

SEQ ID NO: 2530882 - DNA, 18 bp, Homo sapiens
gaagggcatcatgcatct

SEQ ID NO: 2530883 - DNA, 10 bp, Homo sapiens
gaagggccag

SEQ ID NO: 2530884 - DNA, 16 bp, Homo sapiens
gaagggccagtcctgc

SEQ ID NO: 2530885 - DNA, 18 bp, Homo sapiens
gaagggccagtcctgcct

SEQ ID NO: 2530886 - DNA, 19 bp, Homo sapiens
gaagggccagtcctgcctg

SEQ ID NO: 2530887 - DNA, 22 bp, Homo sapiens
gaagggccagtcctgcctggcc

SEQ ID NO: 2530888 - DNA, 21 bp, Homo sapiens
gaagggcccttcactgccttt

SEQ ID NO: 2530889 - DNA, 21 bp, Homo sapiens
gaaggggacccccgccccctg

SEQ ID NO: 2530890 - DNA, 17 bp, Homo sapiens
gaaggggccagaggctc

SEQ ID NO: 2530891 - DNA, 13 bp, Homo sapiens
gaagggggatatg

SEQ ID NO: 2530892 - DNA, 13 bp, Homo sapiens
gaagggggctggg

SEQ ID NO: 2530893 - DNA, 16 bp, Homo sapiens
gaagggggctgggaca

SEQ ID NO: 2530894 - DNA, 19 bp, Homo sapiens
gaagggggctgggacatgg

SEQ ID NO: 2530895 - DNA, 17 bp, Homo sapiens
gaagggggtccacccag

SEQ ID NO: 2530896 - DNA, 17 bp, Homo sapiens
gaagggtggtggagcca

SEQ ID NO: 2530897 - DNA, 20 bp, Homo sapiens
gaagggttttccaccctgga

SEQ ID NO: 2530898 - DNA, 13 bp, Homo sapiens
gaaggtaaaattg

SEQ ID NO: 2530899 - DNA, 14 bp, Homo sapiens
gaaggtcaccagca

SEQ ID NO: 2530900 - DNA, 17 bp, Homo sapiens
gaaggtcacctgagccc

SEQ ID NO: 2530901 - DNA, 20 bp, Homo sapiens
gaaggttaggatttaacagt

SEQ ID NO: 2530902 - DNA, 16 bp, Homo sapiens
gaaggttctggtgtga

SEQ ID NO: 2530903 - DNA, 15 bp, Homo sapiens
gaaggttgtgatgaa

SEQ ID NO: 2530904 - DNA, 15 bp, Homo sapiens
gaccctgccctgtgg

SEQ ID NO: 2530905 - DNA, 17 bp, Homo sapiens
gaccctgccctgtgggc

SEQ ID NO: 2530906 - DNA, 12 bp, Homo sapiens
gaccctgtctca

SEQ ID NO: 2530907 - DNA, 12 bp, Homo sapiens
gaccctgtctct

SEQ ID NO: 2530908 - DNA, 19 bp, Homo sapiens
gacccttgccgtctacctg

SEQ ID NO: 2530909 - DNA, 19 bp, Homo sapiens
gacccttgtggtcccaccc

SEQ ID NO: 2530910 - DNA, 21 bp, Homo sapiens
gacccttgtggtcccacccca

SEQ ID NO: 2530911 - DNA, 19 bp, Homo sapiens
gaccgaactgttgtataaa

SEQ ID NO: 2530912 - DNA, 19 bp, Homo sapiens
gacctaaaatttgccctcc

SEQ ID NO: 2530913 - DNA, 20 bp, Homo sapiens
gacctaaaatttgccctccc

SEQ ID NO: 2530914 - DNA, 19 bp, Homo sapiens
gacctacctcaggttgctg

SEQ ID NO: 2530915 - DNA, 13 bp, Homo sapiens
gacctactctcat

SEQ ID NO: 2530916 - DNA, 17 bp, Homo sapiens
gacctagggaggacctt

SEQ ID NO: 2530917 - DNA, 21 bp, Homo sapiens
gacctagggaggaccttatct

SEQ ID NO: 2530918 - DNA, 17 bp, Homo sapiens
gacctcagagtccaggc

SEQ ID NO: 2530919 - DNA, 19 bp, Homo sapiens
gacctcagagtccaggccc

SEQ ID NO: 2530920 - DNA, 13 bp, Homo sapiens
gacctcagcctgt

SEQ ID NO: 2530921 - DNA, 14 bp, Homo sapiens
gacctcagcctgtg

SEQ ID NO: 2530922 - DNA, 16 bp, Homo sapiens
gacctcagcctgtgct

SEQ ID NO: 2530923 - DNA, 20 bp, Homo sapiens
gacctcaggtgatccaccca

SEQ ID NO: 2530924 - DNA, 17 bp, Homo sapiens
gacctcatgcatctcca

SEQ ID NO: 2530925 - DNA, 15 bp, Homo sapiens
gacctcccagcccta

SEQ ID NO: 2530926 - DNA, 22 bp, Homo sapiens
gacctcccagccctatggatgt

SEQ ID NO: 2530927 - DNA, 17 bp, Homo sapiens
gacctcctaacaagtag

SEQ ID NO: 2530928 - DNA, 21 bp, Homo sapiens
gacctcgagcagatgatgcca

SEQ ID NO: 2530929 - DNA, 12 bp, Homo sapiens
gacctctcccag

SEQ ID NO: 2530930 - DNA, 14 bp, Homo sapiens
gacctctgcagcaa

SEQ ID NO: 2530931 - DNA, 13 bp, Homo sapiens
gacctctgcctga

SEQ ID NO: 2530932 - DNA, 11 bp, Homo sapiens
gacctgaggcc

SEQ ID NO: 2530933 - DNA, 18 bp, Homo sapiens
gacctgaggcccttctct

SEQ ID NO: 2530934 - DNA, 21 bp, Homo sapiens
gacctgaggcccttctctcca

SEQ ID NO: 2530935 - DNA, 14 bp, Homo sapiens
gacctgaggctcct

SEQ ID NO: 2530936 - DNA, 16 bp, Homo sapiens
gacctgcactggggag

SEQ ID NO: 2530937 - DNA, 11 bp, Homo sapiens
gacctgcctcc

SEQ ID NO: 2530938 - DNA, 20 bp, Homo sapiens
gacctgcctcctgcctgccc

SEQ ID NO: 2530939 - DNA, 19 bp, Homo sapiens
gacctgctgagggaccagc

SEQ ID NO: 2530940 - DNA, 14 bp, Homo sapiens
gacctggagcccct

SEQ ID NO: 2530941 - DNA, 15 bp, Homo sapiens
gacctggagcccctg

SEQ ID NO: 2530942 - DNA, 23 bp, Homo sapiens
gacctggtaccctcctggctctt

SEQ ID NO: 2530943 - DNA, 13 bp, Homo sapiens
gacctggttttta

SEQ ID NO: 2530944 - DNA, 15 bp, Homo sapiens
gacctgtcatgcccc

SEQ ID NO: 2530945 - DNA, 16 bp, Homo sapiens
gacctgtcctcctggt

SEQ ID NO: 2530946 - DNA, 21 bp, Homo sapiens
gacctgtggggatttctccca

SEQ ID NO: 2530947 - DNA, 12 bp, Homo sapiens
gaccttatctgt

SEQ ID NO: 2530948 - DNA, 21 bp, Homo sapiens
gaccttatctgtgcgtgaaac

SEQ ID NO: 2530949 - DNA, 22 bp, Homo sapiens
gaccttccataatgctactgtc

SEQ ID NO: 2530950 - DNA, 20 bp, Homo sapiens
gaccttcctcgcagagaggc

SEQ ID NO: 2530951 - DNA, 15 bp, Homo sapiens
gaccttctaggaagc

SEQ ID NO: 2530952 - DNA, 23 bp, Homo sapiens
gaccttctaggacgccacccagc

SEQ ID NO: 2530953 - DNA, 14 bp, Homo sapiens
gaccttctccttca

SEQ ID NO: 2530954 - DNA, 15 bp, Homo sapiens
gaccttctccttcac

SEQ ID NO: 2530955 - DNA, 21 bp, Homo sapiens
gaccttctccttcacctttgt

SEQ ID NO: 2530956 - DNA, 17 bp, Homo sapiens
gacctttcctgaggaag

SEQ ID NO: 2530957 - DNA, 21 bp, Homo sapiens
gacgaacttccatggccctca

SEQ ID NO: 2530958 - DNA, 14 bp, Homo sapiens
gacgacctttacct

SEQ ID NO: 2530959 - DNA, 22 bp, Homo sapiens
gacgcatgccctcaatcccagc

SEQ ID NO: 2530960 - DNA, 13 bp, Homo sapiens
gacgccacccagc

SEQ ID NO: 2530961 - DNA, 14 bp, Homo sapiens
gacgccacccagca

SEQ ID NO: 2530962 - DNA, 12 bp, Homo sapiens
gacgccatccca

SEQ ID NO: 2530963 - DNA, 17 bp, Homo sapiens
gacgccatcccagcccc

SEQ ID NO: 2530964 - DNA, 13 bp, Homo sapiens
gacgcctgagctc

SEQ ID NO: 2530965 - DNA, 14 bp, Homo sapiens
gacgcctgaggaac

SEQ ID NO: 2530966 - DNA, 22 bp, Homo sapiens
gacgcctgccctccccagagca

SEQ ID NO: 2530967 - DNA, 12 bp, Homo sapiens
gacgcctggggg

SEQ ID NO: 2530968 - DNA, 15 bp, Homo sapiens
gacgcgtctcctgtt

SEQ ID NO: 2530969 - DNA, 19 bp, Homo sapiens
gacgctacccgggaagggg

SEQ ID NO: 2530970 - DNA, 17 bp, Homo sapiens
gacgctgaataaatgtc

SEQ ID NO: 2530971 - DNA, 15 bp, Homo sapiens
gacgctgtgctgccc

SEQ ID NO: 2530972 - DNA, 13 bp, Homo sapiens
gacgcttctgaat

SEQ ID NO: 2530973 - DNA, 13 bp, Homo sapiens
gacggagtcccac

SEQ ID NO: 2530974 - DNA, 23 bp, Homo sapiens
gacggagtcccaccttggctgca

SEQ ID NO: 2530975 - DNA, 18 bp, Homo sapiens
gacggctgggcacacgcc

SEQ ID NO: 2530976 - DNA, 23 bp, Homo sapiens
gacgggtgggcggctggagacca

SEQ ID NO: 2530977 - DNA, 16 bp, Homo sapiens
gacggtcccacactgg

SEQ ID NO: 2530978 - DNA, 21 bp, Homo sapiens
gacggtgggcatttgtgaggc

SEQ ID NO: 2530979 - DNA, 17 bp, Homo sapiens
gacggttcaccagcctc

SEQ ID NO: 2530980 - DNA, 18 bp, Homo sapiens
gacggttcaccagcctct

SEQ ID NO: 2530981 - DNA, 19 bp, Homo sapiens
gacggttcaccagcctctc

SEQ ID NO: 2530982 - DNA, 20 bp, Homo sapiens
gacgtaggaacggtaaattt

SEQ ID NO: 2530983 - DNA, 23 bp, Homo sapiens
gacgtatgcttattttaaaattt

SEQ ID NO: 2530984 - DNA, 14 bp, Homo sapiens
gacgtcaagtctcc

SEQ ID NO: 2530985 - DNA, 16 bp, Homo sapiens
gacgtgattttgctgt

SEQ ID NO: 2530986 - DNA, 12 bp, Homo sapiens
gacgttccagcc

SEQ ID NO: 2530987 - DNA, 21 bp, Homo sapiens
gacgttcggggcatgctgggg

SEQ ID NO: 2530988 - DNA, 10 bp, Homo sapiens
gactaaagag

SEQ ID NO: 2530989 - DNA, 14 bp, Homo sapiens
gactaaagagagaa

SEQ ID NO: 2530990 - DNA, 14 bp, Homo sapiens
gactaagccctgtc

SEQ ID NO: 2530991 - DNA, 18 bp, Homo sapiens
gactaagcctacctgctc

SEQ ID NO: 2530992 - DNA, 20 bp, Homo sapiens
gactaattgtataacaggtt

SEQ ID NO: 2530993 - DNA, 21 bp, Homo sapiens
gactaattgtataacaggtta

SEQ ID NO: 2530994 - DNA, 18 bp, Homo sapiens
gactaatttaaaaaataa

SEQ ID NO: 2530995 - DNA, 15 bp, Homo sapiens
gactacacctacgga

SEQ ID NO: 2530996 - DNA, 12 bp, Homo sapiens
gactacaggcac

SEQ ID NO: 2530997 - DNA, 18 bp, Homo sapiens
gactacaggtgtgagtca

SEQ ID NO: 2530998 - DNA, 17 bp, Homo sapiens
gactactcccccaggtg

SEQ ID NO: 2530999 - DNA, 23 bp, Homo sapiens
gactactgggcaaagagtgtaga

SEQ ID NO: 2531000 - DNA, 15 bp, Homo sapiens
gactagaagggccag

SEQ ID NO: 2531001 - DNA, 23 bp, Homo sapiens
gactagaagggccagtcctgcct

SEQ ID NO: 2531002 - DNA, 16 bp, Homo sapiens
gactagaggcttgcat

SEQ ID NO: 2531003 - DNA, 23 bp, Homo sapiens
gactagagggacctctcccaggg

SEQ ID NO: 2531004 - DNA, 17 bp, Homo sapiens
gactatagcccaggtcc

SEQ ID NO: 2531005 - DNA, 16 bp, Homo sapiens
gactatatagagatgt

SEQ ID NO: 2531006 - DNA, 18 bp, Homo sapiens
gactatattgtacacacc

SEQ ID NO: 2531007 - DNA, 15 bp, Homo sapiens
gactattcaaacagt

SEQ ID NO: 2531008 - DNA, 22 bp, Homo sapiens
gactattcaaacagtctcagga

SEQ ID NO: 2531009 - DNA, 13 bp, Homo sapiens
gactatttatgaa

SEQ ID NO: 2531010 - DNA, 19 bp, Homo sapiens
gactcaaatctccagtatt

SEQ ID NO: 2531011 - DNA, 22 bp, Homo sapiens
gactcaaatgctcagaccagct

SEQ ID NO: 2531012 - DNA, 17 bp, Homo sapiens
gactcaagtccttacct

SEQ ID NO: 2531013 - DNA, 17 bp, Homo sapiens
gactcaataaaatcatg

SEQ ID NO: 2531014 - DNA, 17 bp, Homo sapiens
gactcaatgcactgaca

SEQ ID NO: 2531015 - DNA, 17 bp, Homo sapiens
gactcaatttctcccca

SEQ ID NO: 2531016 - DNA, 17 bp, Homo sapiens
gactcacctgttacttg

SEQ ID NO: 2531017 - DNA, 13 bp, Homo sapiens
gactcagccctga

SEQ ID NO: 2531018 - DNA, 15 bp, Homo sapiens
gactcagccctgagg

SEQ ID NO: 2531019 - DNA, 16 bp, Homo sapiens
gactcagccctgaggt

SEQ ID NO: 2531020 - DNA, 17 bp, Homo sapiens
gactcaggatccagtcc

SEQ ID NO: 2531021 - DNA, 19 bp, Homo sapiens
gactcaggatgcccagggc

SEQ ID NO: 2531022 - DNA, 19 bp, Homo sapiens
gactcagggccatgcctgc

SEQ ID NO: 2531023 - DNA, 22 bp, Homo sapiens
gactcagggccatgcctgcccc

SEQ ID NO: 2531024 - DNA, 17 bp, Homo sapiens
gactcagggccccagca

SEQ ID NO: 2531025 - DNA, 15 bp, Homo sapiens
gactcagtttgtcag

SEQ ID NO: 2531026 - DNA, 20 bp, Homo sapiens
gactcattccctagatcttt

SEQ ID NO: 2531027 - DNA, 15 bp, Homo sapiens
gactcattcttctgt

SEQ ID NO: 2531028 - DNA, 12 bp, Homo sapiens
gactccctcctc

SEQ ID NO: 2531029 - DNA, 19 bp, Homo sapiens
gactccctcctcacctctg

SEQ ID NO: 2531030 - DNA, 23 bp, Homo sapiens
gactccgggtttgagatggacac

SEQ ID NO: 2531031 - DNA, 21 bp, Homo sapiens
gactcctgaggacagctgtcc

SEQ ID NO: 2531032 - DNA, 12 bp, Homo sapiens
gactcctgcagg

SEQ ID NO: 2531033 - DNA, 14 bp, Homo sapiens
gactcctgcaggca

SEQ ID NO: 2531034 - DNA, 15 bp, Homo sapiens
gactcctgcaggcag

SEQ ID NO: 2531035 - DNA, 16 bp, Homo sapiens
gactcctgcaggcagc

SEQ ID NO: 2531036 - DNA, 13 bp, Homo sapiens
gactcctgccctg

SEQ ID NO: 2531037 - DNA, 21 bp, Homo sapiens
gactctacagaggccatgggc

SEQ ID NO: 2531038 - DNA, 16 bp, Homo sapiens
gactctgaagcctctg

SEQ ID NO: 2531039 - DNA, 17 bp, Homo sapiens
gactctgaagcctctgg

SEQ ID NO: 2531040 - DNA, 19 bp, Homo sapiens
gactctgaagcctctggga

SEQ ID NO: 2531041 - DNA, 14 bp, Homo sapiens
gactctgccccctg

SEQ ID NO: 2531042 - DNA, 15 bp, Homo sapiens
gactctgccccctgc

SEQ ID NO: 2531043 - DNA, 17 bp, Homo sapiens
gactctgccccctgctg

SEQ ID NO: 2531044 - DNA, 18 bp, Homo sapiens
gactctgccccctgctgg

SEQ ID NO: 2531045 - DNA, 16 bp, Homo sapiens
gactctgcctcctctt

SEQ ID NO: 2531046 - DNA, 15 bp, Homo sapiens
gactcttacttttta

SEQ ID NO: 2531047 - DNA, 15 bp, Homo sapiens
gactcttgctctttc

SEQ ID NO: 2531048 - DNA, 16 bp, Homo sapiens
gactcttgctctttct

SEQ ID NO: 2531049 - DNA, 19 bp, Homo sapiens
gactctttttagggccagg

SEQ ID NO: 2531050 - DNA, 23 bp, Homo sapiens
gaggcaatgtcaggaacagaagg

SEQ ID NO: 2531051 - DNA, 16 bp, Homo sapiens
gaggcagagaaagaag

SEQ ID NO: 2531052 - DNA, 17 bp, Homo sapiens
gaggcagagaaagaaga

SEQ ID NO: 2531053 - DNA, 13 bp, Homo sapiens
gaggcagcagtgt

SEQ ID NO: 2531054 - DNA, 20 bp, Homo sapiens
gaggcagccccattctgcct

SEQ ID NO: 2531055 - DNA, 23 bp, Homo sapiens
gaggcagccccattctgcctgcc

SEQ ID NO: 2531056 - DNA, 23 bp, Homo sapiens
gaggcaggaggattgcttgagcc

SEQ ID NO: 2531057 - DNA, 14 bp, Homo sapiens
gaggcagggaagtc

SEQ ID NO: 2531058 - DNA, 15 bp, Homo sapiens
gaggcagggagggga

SEQ ID NO: 2531059 - DNA, 19 bp, Homo sapiens
gaggcatttgtttgaactg

SEQ ID NO: 2531060 - DNA, 15 bp, Homo sapiens
gaggccacctctcca

SEQ ID NO: 2531061 - DNA, 16 bp, Homo sapiens
gaggccacctctccaa

SEQ ID NO: 2531062 - DNA, 20 bp, Homo sapiens
gaggccacctctccaagggc

SEQ ID NO: 2531063 - DNA, 12 bp, Homo sapiens
gaggccagcctg

SEQ ID NO: 2531064 - DNA, 13 bp, Homo sapiens
gaggccagcctgg

SEQ ID NO: 2531065 - DNA, 22 bp, Homo sapiens
gaggccaggagtttgagaccag

SEQ ID NO: 2531066 - DNA, 23 bp, Homo sapiens
gaggccatgattcgcccaaagcc

SEQ ID NO: 2531067 - DNA, 20 bp, Homo sapiens
gaggccatgggcctcctgtg

SEQ ID NO: 2531068 - DNA, 21 bp, Homo sapiens
gaggccatgggcctcctgtgt

SEQ ID NO: 2531069 - DNA, 19 bp, Homo sapiens
gaggccattgtgtgagcct

SEQ ID NO: 2531070 - DNA, 13 bp, Homo sapiens
gaggcccagaggg

SEQ ID NO: 2531071 - DNA, 19 bp, Homo sapiens
gaggcccagagggcctgca

SEQ ID NO: 2531072 - DNA, 13 bp, Homo sapiens
gaggcccctggac

SEQ ID NO: 2531073 - DNA, 15 bp, Homo sapiens
gaggcccctggccca

SEQ ID NO: 2531074 - DNA, 20 bp, Homo sapiens
gaggcccgcatgcggcccag

SEQ ID NO: 2531075 - DNA, 16 bp, Homo sapiens
gaggccctcgggccca

SEQ ID NO: 2531076 - DNA, 14 bp, Homo sapiens
gaggcccttctctc

SEQ ID NO: 2531077 - DNA, 15 bp, Homo sapiens
gaggccgctagaggc

SEQ ID NO: 2531078 - DNA, 20 bp, Homo sapiens
gaggccgctagaggcctgag

SEQ ID NO: 2531079 - DNA, 19 bp, Homo sapiens
gaggcctaaaagtaaacat

SEQ ID NO: 2531080 - DNA, 16 bp, Homo sapiens
gaggcctcagtggact

SEQ ID NO: 2531081 - DNA, 22 bp, Homo sapiens
gaggcctcttggacctctgctc

SEQ ID NO: 2531082 - DNA, 13 bp, Homo sapiens
gaggcctgaggat

SEQ ID NO: 2531083 - DNA, 16 bp, Homo sapiens
gaggcctgcccgggcg

SEQ ID NO: 2531084 - DNA, 16 bp, Homo sapiens
gaggcctggccaggca

SEQ ID NO: 2531085 - DNA, 16 bp, Homo sapiens
gaggccttctctgaag

SEQ ID NO: 2531086 - DNA, 18 bp, Homo sapiens
gaggccttctctgaagga

SEQ ID NO: 2531087 - DNA, 12 bp, Homo sapiens
gaggccttgctc

SEQ ID NO: 2531088 - DNA, 18 bp, Homo sapiens
gaggcggacgttccagcc

SEQ ID NO: 2531089 - DNA, 19 bp, Homo sapiens
gaggcggatctttggacag

SEQ ID NO: 2531090 - DNA, 19 bp, Homo sapiens
gaggcgggccagccaggcg

SEQ ID NO: 2531091 - DNA, 20 bp, Homo sapiens
gaggctattattttcactgt

SEQ ID NO: 2531092 - DNA, 17 bp, Homo sapiens
gaggctccagagggcac

SEQ ID NO: 2531093 - DNA, 17 bp, Homo sapiens
gaggctctgcccttggt

SEQ ID NO: 2531094 - DNA, 20 bp, Homo sapiens
gaggctgaaagaggccaatg

SEQ ID NO: 2531095 - DNA, 14 bp, Homo sapiens
gaggctgagacagg

SEQ ID NO: 2531096 - DNA, 18 bp, Homo sapiens
gaggctgagatgggagaa

SEQ ID NO: 2531097 - DNA, 12 bp, Homo sapiens
gaggctgaggca

SEQ ID NO: 2531098 - DNA, 13 bp, Homo sapiens
gaggctgaggcag

SEQ ID NO: 2531099 - DNA, 17 bp, Homo sapiens
gaggctgaggcaggagg

SEQ ID NO: 2531100 - DNA, 23 bp, Homo sapiens
gaggctgccccacccctccccat

SEQ ID NO: 2531101 - DNA, 23 bp, Homo sapiens
gaggctgcccccggccccctggt

SEQ ID NO: 2531102 - DNA, 14 bp, Homo sapiens
gaggctgcctctcc

SEQ ID NO: 2531103 - DNA, 23 bp, Homo sapiens
gaggctgtaggactcgcagtcag

SEQ ID NO: 2531104 - DNA, 22 bp, Homo sapiens
gaggcttagctttgctctgcca

SEQ ID NO: 2531105 - DNA, 23 bp, Homo sapiens
gaggcttccagagagtcctctgg

SEQ ID NO: 2531106 - DNA, 14 bp, Homo sapiens
gaggcttgctgaga

SEQ ID NO: 2531107 - DNA, 18 bp, Homo sapiens
gaggcttgtcagagctgg

SEQ ID NO: 2531108 - DNA, 21 bp, Homo sapiens
gagggaaagcccagaaaagga

SEQ ID NO: 2531109 - DNA, 19 bp, Homo sapiens
gagggaccaactgggccca

SEQ ID NO: 2531110 - DNA, 16 bp, Homo sapiens
gagggaccagccaaga

SEQ ID NO: 2531111 - DNA, 13 bp, Homo sapiens
gagggacctctcc

SEQ ID NO: 2531112 - DNA, 16 bp, Homo sapiens
gagggacgcctggggg

SEQ ID NO: 2531113 - DNA, 14 bp, Homo sapiens
gagggactctgaag

SEQ ID NO: 2531114 - DNA, 21 bp, Homo sapiens
gagggactctgaagcctctgg

SEQ ID NO: 2531115 - DNA, 22 bp, Homo sapiens
gagggactctgaagcctctggg

SEQ ID NO: 2531116 - DNA, 13 bp, Homo sapiens
gagggagaaggga

SEQ ID NO: 2531117 - DNA, 13 bp, Homo sapiens
gagggaggaatcg

SEQ ID NO: 2531118 - DNA, 13 bp, Homo sapiens
gagggaggaggcc

SEQ ID NO: 2531119 - DNA, 14 bp, Homo sapiens
gagggaggtaagga

SEQ ID NO: 2531120 - DNA, 18 bp, Homo sapiens
gagggaggtgtttaaaga

SEQ ID NO: 2531121 - DNA, 17 bp, Homo sapiens
gagggatgctgcctgag

SEQ ID NO: 2531122 - DNA, 20 bp, Homo sapiens
gagggatgctgcctgagtca

SEQ ID NO: 2531123 - DNA, 18 bp, Homo sapiens
gagggatggcgggtgggg

SEQ ID NO: 2531124 - DNA, 19 bp, Homo sapiens
gagggatggcgggtggggg

SEQ ID NO: 2531125 - DNA, 15 bp, Homo sapiens
gagggcacacactgt

SEQ ID NO: 2531126 - DNA, 20 bp, Homo sapiens
gagggcacattccttgcctg

SEQ ID NO: 2531127 - DNA, 15 bp, Homo sapiens
gagggcactggagct

SEQ ID NO: 2531128 - DNA, 23 bp, Homo sapiens
gagggcagaaaggttctgcccgg

SEQ ID NO: 2531129 - DNA, 14 bp, Homo sapiens
gagggcagcagggc

SEQ ID NO: 2531130 - DNA, 22 bp, Homo sapiens
gagggcatgcgcacaaggctga

SEQ ID NO: 2531131 - DNA, 18 bp, Homo sapiens
gagggccaagacttggca

SEQ ID NO: 2531132 - DNA, 13 bp, Homo sapiens
gagggcccagagc

SEQ ID NO: 2531133 - DNA, 11 bp, Homo sapiens
gagggcccctc

SEQ ID NO: 2531134 - DNA, 12 bp, Homo sapiens
gagggcccctct

SEQ ID NO: 2531135 - DNA, 15 bp, Homo sapiens
gagggcccctctgcc

SEQ ID NO: 2531136 - DNA, 22 bp, Homo sapiens
gagggccctggtgtttctagca

SEQ ID NO: 2531137 - DNA, 16 bp, Homo sapiens
gagggccgagtgagag

SEQ ID NO: 2531138 - DNA, 22 bp, Homo sapiens
gagggcctcaaaggcccgctct

SEQ ID NO: 2531139 - DNA, 14 bp, Homo sapiens
gagggcctgcaagg

SEQ ID NO: 2531140 - DNA, 16 bp, Homo sapiens
gagggctagaacctgg

SEQ ID NO: 2531141 - DNA, 19 bp, Homo sapiens
gagggctagaatctggaga

SEQ ID NO: 2531142 - DNA, 13 bp, Homo sapiens
gagggctggaatc

SEQ ID NO: 2531143 - DNA, 18 bp, Homo sapiens
gagggctggaatctggag

SEQ ID NO: 2531144 - DNA, 20 bp, Homo sapiens
gagggctggaatctggagag

SEQ ID NO: 2531145 - DNA, 12 bp, Homo sapiens
gaggggaacaga

SEQ ID NO: 2531146 - DNA, 19 bp, Homo sapiens
gaggggaagagtgtactgg

SEQ ID NO: 2531147 - DNA, 13 bp, Homo sapiens
gaggggacaggtc

SEQ ID NO: 2531148 - DNA, 22 bp, Homo sapiens
gaggggactatttatgaaggca

SEQ ID NO: 2531149 - DNA, 21 bp, Homo sapiens
gaggggaggatcactggagcc

SEQ ID NO: 2531150 - DNA, 14 bp, Homo sapiens
gaggggcagccctt

SEQ ID NO: 2531151 - DNA, 15 bp, Homo sapiens
gaggggcaggtaaac

SEQ ID NO: 2531152 - DNA, 17 bp, Homo sapiens
gaggggcatctgcccct

SEQ ID NO: 2531153 - DNA, 13 bp, Homo sapiens
gaggggcgctggc

SEQ ID NO: 2531154 - DNA, 15 bp, Homo sapiens
gaggggcgctggccc

SEQ ID NO: 2531155 - DNA, 17 bp, Homo sapiens
gaggggcgctggcccag

SEQ ID NO: 2531156 - DNA, 19 bp, Homo sapiens
gaggggcgctggcccagcc

SEQ ID NO: 2531157 - DNA, 20 bp, Homo sapiens
gaggggcgctggcccagccg

SEQ ID NO: 2531158 - DNA, 22 bp, Homo sapiens
gaggggcgctggcccagccggc

SEQ ID NO: 2531159 - DNA, 15 bp, Homo sapiens
gaggggctcaggaaa

SEQ ID NO: 2531160 - DNA, 16 bp, Homo sapiens
gaggggctcaggaaaa

SEQ ID NO: 2531161 - DNA, 12 bp, Homo sapiens
gaggggctcctg

SEQ ID NO: 2531162 - DNA, 13 bp, Homo sapiens
gaggggctcctgg

SEQ ID NO: 2531163 - DNA, 15 bp, Homo sapiens
gaggggctcctggaa

SEQ ID NO: 2531164 - DNA, 11 bp, Homo sapiens
gaggggctctc

SEQ ID NO: 2531165 - DNA, 16 bp, Homo sapiens
gaggggctctcagctc

SEQ ID NO: 2531166 - DNA, 19 bp, Homo sapiens
gaggggctctcagctcagc

SEQ ID NO: 2531167 - DNA, 15 bp, Homo sapiens
gagggtcaggaagga

SEQ ID NO: 2531168 - DNA, 16 bp, Homo sapiens
gagggtcaggaaggat

SEQ ID NO: 2531169 - DNA, 19 bp, Homo sapiens
gagggtcccaagctgggcc

SEQ ID NO: 2531170 - DNA, 23 bp, Homo sapiens
gagggtcccaagctgggccccag

SEQ ID NO: 2531171 - DNA, 19 bp, Homo sapiens
gagggtccccacctgggac

SEQ ID NO: 2531172 - DNA, 13 bp, Homo sapiens
gagggtggagact

SEQ ID NO: 2531173 - DNA, 19 bp, Homo sapiens
gagggtgggagagcccagc

SEQ ID NO: 2531174 - DNA, 15 bp, Homo sapiens
gagggttagggaggg

SEQ ID NO: 2531175 - DNA, 12 bp, Homo sapiens
gagggttcctgt

SEQ ID NO: 2531176 - DNA, 14 bp, Homo sapiens
gagggttgggctgg

SEQ ID NO: 2531177 - DNA, 15 bp, Homo sapiens
gagggttgggctggt

SEQ ID NO: 2531178 - DNA, 21 bp, Homo sapiens
gagggtttccatggggtagga

SEQ ID NO: 2531179 - DNA, 22 bp, Homo sapiens
gaggtaaaagtgtgagcagtga

SEQ ID NO: 2531180 - DNA, 17 bp, Homo sapiens
gaggtagaaaagattgg

SEQ ID NO: 2531181 - DNA, 13 bp, Homo sapiens
gaggtatgaggtc

SEQ ID NO: 2531182 - DNA, 12 bp, Homo sapiens
gaggtcagagcc

SEQ ID NO: 2531183 - DNA, 20 bp, Homo sapiens
gaggtcagagcctgcagtta

SEQ ID NO: 2531184 - DNA, 22 bp, Homo sapiens
gaggtccagccctggctgaagg

SEQ ID NO: 2531185 - DNA, 12 bp, Homo sapiens
gaggtcccaggc

SEQ ID NO: 2531186 - DNA, 14 bp, Homo sapiens
gaggtcccaggcag

SEQ ID NO: 2531187 - DNA, 19 bp, Homo sapiens
gaggtctgctcggccgtct

SEQ ID NO: 2531188 - DNA, 21 bp, Homo sapiens
gaggtctgtacgttacctctt

SEQ ID NO: 2531189 - DNA, 13 bp, Homo sapiens
gaggtgcctgtcc

SEQ ID NO: 2531190 - DNA, 20 bp, Homo sapiens
gaggtgcttaagcagaagca

SEQ ID NO: 2531191 - DNA, 22 bp, Homo sapiens
gaggtgcttaagcagaagcatt

SEQ ID NO: 2531192 - DNA, 21 bp, Homo sapiens
gaggtggagcaaagtgagggc

SEQ ID NO: 2531193 - DNA, 22 bp, Homo sapiens
gaggtggccagagctgggaggc

SEQ ID NO: 2531194 - DNA, 15 bp, Homo sapiens
gaggtgggatcctcc

SEQ ID NO: 2531195 - DNA, 20 bp, Homo sapiens
gattagagggaggtgtttaa

SEQ ID NO: 2531196 - DNA, 13 bp, Homo sapiens
gattagctctgga

SEQ ID NO: 2531197 - DNA, 16 bp, Homo sapiens
gattagctctggacca

SEQ ID NO: 2531198 - DNA, 15 bp, Homo sapiens
gattagtaaagaaat

SEQ ID NO: 2531199 - DNA, 21 bp, Homo sapiens
gattatagttgtgggtgggag

SEQ ID NO: 2531200 - DNA, 15 bp, Homo sapiens
gattatggttttgtg

SEQ ID NO: 2531201 - DNA, 16 bp, Homo sapiens
gattatggttttgtga

SEQ ID NO: 2531202 - DNA, 19 bp, Homo sapiens
gattatgtagcaaaataca

SEQ ID NO: 2531203 - DNA, 23 bp, Homo sapiens
gattattaactaatatgggcatt

SEQ ID NO: 2531204 - DNA, 14 bp, Homo sapiens
gattattatctaaa

SEQ ID NO: 2531205 - DNA, 20 bp, Homo sapiens
gattattcatttaaaatgat

SEQ ID NO: 2531206 - DNA, 12 bp, Homo sapiens
gattattggaaa

SEQ ID NO: 2531207 - DNA, 14 bp, Homo sapiens
gattattgtattta

SEQ ID NO: 2531208 - DNA, 16 bp, Homo sapiens
gattatttaataacat

SEQ ID NO: 2531209 - DNA, 22 bp, Homo sapiens
gattatttcactttagatgctg

SEQ ID NO: 2531210 - DNA, 23 bp, Homo sapiens
gattatttcactttagatgctga

SEQ ID NO: 2531211 - DNA, 21 bp, Homo sapiens
gattcaatctgtaaactgtgt

SEQ ID NO: 2531212 - DNA, 22 bp, Homo sapiens
gattcaatctgtaaactgtgta

SEQ ID NO: 2531213 - DNA, 12 bp, Homo sapiens
gattcacactgt

SEQ ID NO: 2531214 - DNA, 14 bp, Homo sapiens
gattcagaagggga

SEQ ID NO: 2531215 - DNA, 14 bp, Homo sapiens
gattcagacagctg

SEQ ID NO: 2531216 - DNA, 17 bp, Homo sapiens
gattcagacagctgcct

SEQ ID NO: 2531217 - DNA, 19 bp, Homo sapiens
gattcagacagctgcctgg

SEQ ID NO: 2531218 - DNA, 13 bp, Homo sapiens
gattcagctctgc

SEQ ID NO: 2531219 - DNA, 17 bp, Homo sapiens
gattcaggtatgttgcc

SEQ ID NO: 2531220 - DNA, 18 bp, Homo sapiens
gattcatatttacttctt

SEQ ID NO: 2531221 - DNA, 22 bp, Homo sapiens
gattcatctctcagaagggagg

SEQ ID NO: 2531222 - DNA, 23 bp, Homo sapiens
gattcatctctcagaagggaggc

SEQ ID NO: 2531223 - DNA, 11 bp, Homo sapiens
gattcatgtgg

SEQ ID NO: 2531224 - DNA, 19 bp, Homo sapiens
gattcatttttaatcatga

SEQ ID NO: 2531225 - DNA, 16 bp, Homo sapiens
gattcccaccaaggtc

SEQ ID NO: 2531226 - DNA, 19 bp, Homo sapiens
gattcccagagcaaaataa

SEQ ID NO: 2531227 - DNA, 17 bp, Homo sapiens
gattcccaggatgagca

SEQ ID NO: 2531228 - DNA, 17 bp, Homo sapiens
gattccccattgcctcc

SEQ ID NO: 2531229 - DNA, 22 bp, Homo sapiens
gattccccattgcctcctcctt

SEQ ID NO: 2531230 - DNA, 19 bp, Homo sapiens
gattctaatttttaagcaa

SEQ ID NO: 2531231 - DNA, 23 bp, Homo sapiens
gattctaccacacagcagcagtt

SEQ ID NO: 2531232 - DNA, 14 bp, Homo sapiens
gattctactttaag

SEQ ID NO: 2531233 - DNA, 22 bp, Homo sapiens
gattctactttaagcactacat

SEQ ID NO: 2531234 - DNA, 11 bp, Homo sapiens
gattctcagat

SEQ ID NO: 2531235 - DNA, 16 bp, Homo sapiens
gattctcctgtgctag

SEQ ID NO: 2531236 - DNA, 17 bp, Homo sapiens
gattctggataaagcca

SEQ ID NO: 2531237 - DNA, 19 bp, Homo sapiens
gattctggataaagccact

SEQ ID NO: 2531238 - DNA, 22 bp, Homo sapiens
gattctggataaagccactgaa

SEQ ID NO: 2531239 - DNA, 15 bp, Homo sapiens
gattctgggaggaag

SEQ ID NO: 2531240 - DNA, 19 bp, Homo sapiens
gattctgtgtgttttcata

SEQ ID NO: 2531241 - DNA, 15 bp, Homo sapiens
gattcttctgcttca

SEQ ID NO: 2531242 - DNA, 21 bp, Homo sapiens
gattcttctgcttcagcctcc

SEQ ID NO: 2531243 - DNA, 12 bp, Homo sapiens
gattctttcctg

SEQ ID NO: 2531244 - DNA, 17 bp, Homo sapiens
gattctttcctgaggct

SEQ ID NO: 2531245 - DNA, 14 bp, Homo sapiens
gattgaaaactttt

SEQ ID NO: 2531246 - DNA, 21 bp, Homo sapiens
gattgaagtattttgctggaa

SEQ ID NO: 2531247 - DNA, 16 bp, Homo sapiens
gattgagtctgtgcca

SEQ ID NO: 2531248 - DNA, 15 bp, Homo sapiens
gattgcaacaggctg

SEQ ID NO: 2531249 - DNA, 16 bp, Homo sapiens
gattgcaacaggctgg

SEQ ID NO: 2531250 - DNA, 17 bp, Homo sapiens
gattgcaacaggctggg

SEQ ID NO: 2531251 - DNA, 21 bp, Homo sapiens
gattgcaacaggctgggcttc

SEQ ID NO: 2531252 - DNA, 14 bp, Homo sapiens
gattgcaatttgca

SEQ ID NO: 2531253 - DNA, 21 bp, Homo sapiens
gattgcaatttgcacaagttt

SEQ ID NO: 2531254 - DNA, 17 bp, Homo sapiens
gattgcatgtgactctg

SEQ ID NO: 2531255 - DNA, 14 bp, Homo sapiens
gattgctaaatgta

SEQ ID NO: 2531256 - DNA, 20 bp, Homo sapiens
gattgctgccccatcagtgc

SEQ ID NO: 2531257 - DNA, 19 bp, Homo sapiens
gattgcttgagcccaggag

SEQ ID NO: 2531258 - DNA, 23 bp, Homo sapiens
gattggacggcctgatgctccct

SEQ ID NO: 2531259 - DNA, 22 bp, Homo sapiens
gattggagatagggaaagaaag

SEQ ID NO: 2531260 - DNA, 17 bp, Homo sapiens
gattggattattcattt

SEQ ID NO: 2531261 - DNA, 12 bp, Homo sapiens
gattggctcacc

SEQ ID NO: 2531262 - DNA, 15 bp, Homo sapiens
gattgggaataaata

SEQ ID NO: 2531263 - DNA, 23 bp, Homo sapiens
gattgggaataaatatgcctctc

SEQ ID NO: 2531264 - DNA, 20 bp, Homo sapiens
gattggggaagactgtggct

SEQ ID NO: 2531265 - DNA, 14 bp, Homo sapiens
gattgggggctggt

SEQ ID NO: 2531266 - DNA, 12 bp, Homo sapiens
gattgggtctag

SEQ ID NO: 2531267 - DNA, 22 bp, Homo sapiens
gattgtaaaaaaaaatgccttt

SEQ ID NO: 2531268 - DNA, 23 bp, Homo sapiens
gattgtaaaatagcttgtatagt

SEQ ID NO: 2531269 - DNA, 22 bp, Homo sapiens
gattgtaacgttgctgtgggaa

SEQ ID NO: 2531270 - DNA, 14 bp, Homo sapiens
gattgttaaaataa

SEQ ID NO: 2531271 - DNA, 21 bp, Homo sapiens
gattgttaagtctaaatattt

SEQ ID NO: 2531272 - DNA, 17 bp, Homo sapiens
gattgtttgctctgaga

SEQ ID NO: 2531273 - DNA, 12 bp, Homo sapiens
gatttaaatcag

SEQ ID NO: 2531274 - DNA, 17 bp, Homo sapiens
gatttaacagaaatgta

SEQ ID NO: 2531275 - DNA, 20 bp, Homo sapiens
gatttaacagaaatgtacag

SEQ ID NO: 2531276 - DNA, 23 bp, Homo sapiens
gatttaacagaaatgtacagcaa

SEQ ID NO: 2531277 - DNA, 18 bp, Homo sapiens
gatttaacagtcatttaa

SEQ ID NO: 2531278 - DNA, 18 bp, Homo sapiens
gatttaagacactttttg

SEQ ID NO: 2531279 - DNA, 23 bp, Homo sapiens
gatttaataaaataattctaaag

SEQ ID NO: 2531280 - DNA, 16 bp, Homo sapiens
gatttaatagtgttaa

SEQ ID NO: 2531281 - DNA, 19 bp, Homo sapiens
gatttaatagtgttaatca

SEQ ID NO: 2531282 - DNA, 21 bp, Homo sapiens
gatttaatagtgttaatcaat

SEQ ID NO: 2531283 - DNA, 15 bp, Homo sapiens
gatttaattctcttg

SEQ ID NO: 2531284 - DNA, 16 bp, Homo sapiens
gatttacactgggaga

SEQ ID NO: 2531285 - DNA, 20 bp, Homo sapiens
gatttacctgttttcgcacc

SEQ ID NO: 2531286 - DNA, 22 bp, Homo sapiens
gatttagtgtttttacctctgt

SEQ ID NO: 2531287 - DNA, 13 bp, Homo sapiens
gatttataaatgc

SEQ ID NO: 2531288 - DNA, 20 bp, Homo sapiens
gatttatagtttgtacatgc

SEQ ID NO: 2531289 - DNA, 21 bp, Homo sapiens
gatttatagtttgtacatgca

SEQ ID NO: 2531290 - DNA, 12 bp, Homo sapiens
gatttatcaaat

SEQ ID NO: 2531291 - DNA, 14 bp, Homo sapiens
gatttatcaaatca

SEQ ID NO: 2531292 - DNA, 15 bp, Homo sapiens
gatttatcaaatcag

SEQ ID NO: 2531293 - DNA, 15 bp, Homo sapiens
gatttcaagcctgcc

SEQ ID NO: 2531294 - DNA, 22 bp, Homo sapiens
gatttcaggatactctgtcaga

SEQ ID NO: 2531295 - DNA, 20 bp, Homo sapiens
gatttcatgctatctctgtg

SEQ ID NO: 2531296 - DNA, 15 bp, Homo sapiens
gatttccgttaaaat

SEQ ID NO: 2531297 - DNA, 18 bp, Homo sapiens
gatttccgttaaaatacc

SEQ ID NO: 2531298 - DNA, 19 bp, Homo sapiens
gatttcgtgggtctgtttt

SEQ ID NO: 2531299 - DNA, 11 bp, Homo sapiens
gatttctccca

SEQ ID NO: 2531300 - DNA, 17 bp, Homo sapiens
gatttctgcaggttctt

SEQ ID NO: 2531301 - DNA, 16 bp, Homo sapiens
gatttctgccttcctt

SEQ ID NO: 2531302 - DNA, 17 bp, Homo sapiens
gatttctgccttccttg

SEQ ID NO: 2531303 - DNA, 19 bp, Homo sapiens
gatttctgtttagataata

SEQ ID NO: 2531304 - DNA, 21 bp, Homo sapiens
gatttctgtttagataataca

SEQ ID NO: 2531305 - DNA, 17 bp, Homo sapiens
gatttctttccagaggg

SEQ ID NO: 2531306 - DNA, 16 bp, Homo sapiens
gatttgaagcaaagca

SEQ ID NO: 2531307 - DNA, 12 bp, Homo sapiens
gatttgactgtt

SEQ ID NO: 2531308 - DNA, 14 bp, Homo sapiens
gatttgactgtttt

SEQ ID NO: 2531309 - DNA, 21 bp, Homo sapiens
gatttgactgtttttacccat

SEQ ID NO: 2531310 - DNA, 21 bp, Homo sapiens
gatttgatgctggagaggtta

SEQ ID NO: 2531311 - DNA, 18 bp, Homo sapiens
gatttgatgctgtttgac

SEQ ID NO: 2531312 - DNA, 14 bp, Homo sapiens
gatttgcaaaaaaa

SEQ ID NO: 2531313 - DNA, 23 bp, Homo sapiens
gatttgggctggaacagattcac

SEQ ID NO: 2531314 - DNA, 19 bp, Homo sapiens
gatttggtgtacaattcag

SEQ ID NO: 2531315 - DNA, 14 bp, Homo sapiens
gatttgtcccaggt

SEQ ID NO: 2531316 - DNA, 20 bp, Homo sapiens
gatttgtgaactcagccaag

SEQ ID NO: 2531317 - DNA, 19 bp, Homo sapiens
gatttgttaatgatagcta

SEQ ID NO: 2531318 - DNA, 17 bp, Homo sapiens
gattttaacaataacta

SEQ ID NO: 2531319 - DNA, 14 bp, Homo sapiens
gattttaactctgt

SEQ ID NO: 2531320 - DNA, 16 bp, Homo sapiens
gattttaactctgtct

SEQ ID NO: 2531321 - DNA, 18 bp, Homo sapiens
gattttacaattgaaatg

SEQ ID NO: 2531322 - DNA, 20 bp, Homo sapiens
gattttatctgtgaattcag

SEQ ID NO: 2531323 - DNA, 12 bp, Homo sapiens
gattttctattg

SEQ ID NO: 2531324 - DNA, 18 bp, Homo sapiens
gattttctattgttactc

SEQ ID NO: 2531325 - DNA, 16 bp, Homo sapiens
gattttctttaaaaga

SEQ ID NO: 2531326 - DNA, 21 bp, Homo sapiens
gattttgaaaccatgaagaga

SEQ ID NO: 2531327 - DNA, 19 bp, Homo sapiens
gattttgatccaagctggt

SEQ ID NO: 2531328 - DNA, 18 bp, Homo sapiens
gatttttctcaaagtttt

SEQ ID NO: 2531329 - DNA, 13 bp, Homo sapiens
gatttttgcctct

SEQ ID NO: 2531330 - DNA, 15 bp, Homo sapiens
gatttttttttcata

SEQ ID NO: 2531331 - DNA, 20 bp, Homo sapiens
gcaaaaaactcgaggactgt

SEQ ID NO: 2531332 - DNA, 14 bp, Homo sapiens
gcaaaaaggcagga

SEQ ID NO: 2531333 - DNA, 12 bp, Homo sapiens
gcaaaactgaat

SEQ ID NO: 2531334 - DNA, 16 bp, Homo sapiens
gcaaaagatgcttctc

SEQ ID NO: 2531335 - DNA, 15 bp, Homo sapiens
gcaaaatttgatgcc

SEQ ID NO: 2531336 - DNA, 21 bp, Homo sapiens
gcaaacatggggttggctggg

SEQ ID NO: 2531337 - DNA, 22 bp, Homo sapiens
gcaaaccccctttgtgctgtgg

SEQ ID NO: 2531338 - DNA, 21 bp, Homo sapiens
gcaaacctgacccctgctcag

SEQ ID NO: 2531339 - DNA, 15 bp, Homo sapiens
gcatcacagggcaga

SEQ ID NO: 2531340 - DNA, 17 bp, Homo sapiens
gcatcacagggcagagc

SEQ ID NO: 2531341 - DNA, 21 bp, Homo sapiens
gcatcacagggcagagccggg

SEQ ID NO: 2531342 - DNA, 18 bp, Homo sapiens
gcatcaccttaggcaggg

SEQ ID NO: 2531343 - DNA, 12 bp, Homo sapiens
gcatcaggccag

SEQ ID NO: 2531344 - DNA, 12 bp, Homo sapiens
gcatccacctcc

SEQ ID NO: 2531345 - DNA, 17 bp, Homo sapiens
gcatccatgtgtggact

SEQ ID NO: 2531346 - DNA, 14 bp, Homo sapiens
gcatcccaggggac

SEQ ID NO: 2531347 - DNA, 15 bp, Homo sapiens
gcatcccaggggacc

SEQ ID NO: 2531348 - DNA, 19 bp, Homo sapiens
gcatcccaggggaccacac

SEQ ID NO: 2531349 - DNA, 17 bp, Homo sapiens
gcatcccagtggcctca

SEQ ID NO: 2531350 - DNA, 20 bp, Homo sapiens
gcatcccagtggcctcaacc

SEQ ID NO: 2531351 - DNA, 14 bp, Homo sapiens
gcatcctccaagaa

SEQ ID NO: 2531352 - DNA, 18 bp, Homo sapiens
gcatcctccacaatagca

SEQ ID NO: 2531353 - DNA, 13 bp, Homo sapiens
gcatcctggcacc

SEQ ID NO: 2531354 - DNA, 23 bp, Homo sapiens
gcatcctggcacccggcccctgc

SEQ ID NO: 2531355 - DNA, 14 bp, Homo sapiens
gcatcctgtgaagt

SEQ ID NO: 2531356 - DNA, 17 bp, Homo sapiens
gcatcctgtgaagtcct

SEQ ID NO: 2531357 - DNA, 17 bp, Homo sapiens
gcatctccacctgctcc

SEQ ID NO: 2531358 - DNA, 20 bp, Homo sapiens
gcatctccacctgctcccag

SEQ ID NO: 2531359 - DNA, 17 bp, Homo sapiens
gcatctccctcactgaa

SEQ ID NO: 2531360 - DNA, 20 bp, Homo sapiens
gcatctccctcactgaaacc

SEQ ID NO: 2531361 - DNA, 16 bp, Homo sapiens
gcatctcttgaggcca

SEQ ID NO: 2531362 - DNA, 18 bp, Homo sapiens
gcatctcttgaggccagg

SEQ ID NO: 2531363 - DNA, 19 bp, Homo sapiens
gcatctgactcacaagaag

SEQ ID NO: 2531364 - DNA, 15 bp, Homo sapiens
gcatctgcccctccc

SEQ ID NO: 2531365 - DNA, 13 bp, Homo sapiens
gcatctgtcctca

SEQ ID NO: 2531366 - DNA, 15 bp, Homo sapiens
gcatcttactgaagg

SEQ ID NO: 2531367 - DNA, 13 bp, Homo sapiens
gcatcttccagaa

SEQ ID NO: 2531368 - DNA, 20 bp, Homo sapiens
gcatcttctggagtctccag

SEQ ID NO: 2531369 - DNA, 23 bp, Homo sapiens
gcatctttgccttgggctgctcc

SEQ ID NO: 2531370 - DNA, 20 bp, Homo sapiens
gcatgaacatgtactgttct

SEQ ID NO: 2531371 - DNA, 18 bp, Homo sapiens
gcatgaagtaatatgcac

SEQ ID NO: 2531372 - DNA, 22 bp, Homo sapiens
gcatgaagtaatatgcacacat

SEQ ID NO: 2531373 - DNA, 19 bp, Homo sapiens
gcatgacaagccccaggca

SEQ ID NO: 2531374 - DNA, 17 bp, Homo sapiens
gcatgacctgtgaccag

SEQ ID NO: 2531375 - DNA, 22 bp, Homo sapiens
gcatgacctgtgaccagcactg

SEQ ID NO: 2531376 - DNA, 21 bp, Homo sapiens
gcatgagggatcacagggccc

SEQ ID NO: 2531377 - DNA, 22 bp, Homo sapiens
gcatgcactgttccccctgtgc

SEQ ID NO: 2531378 - DNA, 14 bp, Homo sapiens
gcatgcattttgca

SEQ ID NO: 2531379 - DNA, 21 bp, Homo sapiens
gcatgcattttgcagcagtga

SEQ ID NO: 2531380 - DNA, 14 bp, Homo sapiens
gcatgcctggatgg

SEQ ID NO: 2531381 - DNA, 21 bp, Homo sapiens
gcatgccttccagcaccctgc

SEQ ID NO: 2531382 - DNA, 17 bp, Homo sapiens
gcatgcggcccagcccg

SEQ ID NO: 2531383 - DNA, 18 bp, Homo sapiens
gcatgcggcccagcccgg

SEQ ID NO: 2531384 - DNA, 15 bp, Homo sapiens
gcatgctggggcaag

SEQ ID NO: 2531385 - DNA, 12 bp, Homo sapiens
gcatggagctgg

SEQ ID NO: 2531386 - DNA, 23 bp, Homo sapiens
gcatggagtgtgtattgttccca

SEQ ID NO: 2531387 - DNA, 15 bp, Homo sapiens
gcatggcacttgcat

SEQ ID NO: 2531388 - DNA, 13 bp, Homo sapiens
gcatggctccagt

SEQ ID NO: 2531389 - DNA, 22 bp, Homo sapiens
gcatgggcctggccacctctct

SEQ ID NO: 2531390 - DNA, 21 bp, Homo sapiens
gcatgggtgaagggagagcca

SEQ ID NO: 2531391 - DNA, 20 bp, Homo sapiens
gcatgtaccatttgcatggc

SEQ ID NO: 2531392 - DNA, 14 bp, Homo sapiens
gcatgtatgtcttg

SEQ ID NO: 2531393 - DNA, 15 bp, Homo sapiens
gcatgtattggcctg

SEQ ID NO: 2531394 - DNA, 18 bp, Homo sapiens
gcatgtattggcctggag

SEQ ID NO: 2531395 - DNA, 20 bp, Homo sapiens
gcatgtattggcctggaggt

SEQ ID NO: 2531396 - DNA, 23 bp, Homo sapiens
gcatgtcgtgaccaactagacat

SEQ ID NO: 2531397 - DNA, 21 bp, Homo sapiens
gcatgtgaaaatcaaatacat

SEQ ID NO: 2531398 - DNA, 21 bp, Homo sapiens
gcatgtgactctgaagctgac

SEQ ID NO: 2531399 - DNA, 11 bp, Homo sapiens
gcatgtgtgtg

SEQ ID NO: 2531400 - DNA, 16 bp, Homo sapiens
gcatgtgtgtgctcag

SEQ ID NO: 2531401 - DNA, 13 bp, Homo sapiens
gcatgttacataa

SEQ ID NO: 2531402 - DNA, 18 bp, Homo sapiens
gcatgttttccagctcct

SEQ ID NO: 2531403 - DNA, 14 bp, Homo sapiens
gcattaaaagaaaa

SEQ ID NO: 2531404 - DNA, 14 bp, Homo sapiens
gcattaactaatct

SEQ ID NO: 2531405 - DNA, 18 bp, Homo sapiens
gcattacgtgagccaggt

SEQ ID NO: 2531406 - DNA, 13 bp, Homo sapiens
gcattagaaatta

SEQ ID NO: 2531407 - DNA, 17 bp, Homo sapiens
gcattagaattatttaa

SEQ ID NO: 2531408 - DNA, 19 bp, Homo sapiens
gcattatataccatttatc

SEQ ID NO: 2531409 - DNA, 19 bp, Homo sapiens
gcattatctagatactgta

SEQ ID NO: 2531410 - DNA, 19 bp, Homo sapiens
gcattatgtccactgtgta

SEQ ID NO: 2531411 - DNA, 21 bp, Homo sapiens
gcattatgtccactgtgtata

SEQ ID NO: 2531412 - DNA, 22 bp, Homo sapiens
gcattatgtccactgtgtatag

SEQ ID NO: 2531413 - DNA, 23 bp, Homo sapiens
gcattatgtccactgtgtataga

SEQ ID NO: 2531414 - DNA, 15 bp, Homo sapiens
gcattcacccagaca

SEQ ID NO: 2531415 - DNA, 13 bp, Homo sapiens
gcattcagagagc

SEQ ID NO: 2531416 - DNA, 16 bp, Homo sapiens
gcattcagagagcagc

SEQ ID NO: 2531417 - DNA, 20 bp, Homo sapiens
gcattccccaggaggccagc

SEQ ID NO: 2531418 - DNA, 22 bp, Homo sapiens
gcattccccaggaggccagcct

SEQ ID NO: 2531419 - DNA, 16 bp, Homo sapiens
gcattcctacaaagat

SEQ ID NO: 2531420 - DNA, 14 bp, Homo sapiens
gcattccttctttg

SEQ ID NO: 2531421 - DNA, 22 bp, Homo sapiens
gcattccttctttgataatgtt

SEQ ID NO: 2531422 - DNA, 23 bp, Homo sapiens
gcattccttctttgataatgtta

SEQ ID NO: 2531423 - DNA, 14 bp, Homo sapiens
gcattctcatggag

SEQ ID NO: 2531424 - DNA, 17 bp, Homo sapiens
gcattcttggttggctg

SEQ ID NO: 2531425 - DNA, 13 bp, Homo sapiens
gcattctttctgt

SEQ ID NO: 2531426 - DNA, 12 bp, Homo sapiens
gcattgctttct

SEQ ID NO: 2531427 - DNA, 19 bp, Homo sapiens
gcattgtggctgtcagcag

SEQ ID NO: 2531428 - DNA, 15 bp, Homo sapiens
gcattgtgggaaggg

SEQ ID NO: 2531429 - DNA, 18 bp, Homo sapiens
gcattgtgggaaggggag

SEQ ID NO: 2531430 - DNA, 15 bp, Homo sapiens
gcattgttgaggtgg

SEQ ID NO: 2531431 - DNA, 23 bp, Homo sapiens
gcattgttgaggtggtctgaatg

SEQ ID NO: 2531432 - DNA, 17 bp, Homo sapiens
gcattgtttgcttattg

SEQ ID NO: 2531433 - DNA, 20 bp, Homo sapiens
gcattgtttgcttattgttc

SEQ ID NO: 2531434 - DNA, 22 bp, Homo sapiens
gcattgtttgcttattgttcca

SEQ ID NO: 2531435 - DNA, 18 bp, Homo sapiens
gcatttactttgtgttca

SEQ ID NO: 2531436 - DNA, 20 bp, Homo sapiens
gcatttcattcttctctagc

SEQ ID NO: 2531437 - DNA, 22 bp, Homo sapiens
gcatttccaacaccacagacac

SEQ ID NO: 2531438 - DNA, 14 bp, Homo sapiens
gcatttgaaaattt

SEQ ID NO: 2531439 - DNA, 16 bp, Homo sapiens
gcatttgaaaattttg

SEQ ID NO: 2531440 - DNA, 15 bp, Homo sapiens
gcatttgagaaatgc

SEQ ID NO: 2531441 - DNA, 14 bp, Homo sapiens
gcatttgctgaata

SEQ ID NO: 2531442 - DNA, 21 bp, Homo sapiens
gcatttggtggtttcagaaat

SEQ ID NO: 2531443 - DNA, 18 bp, Homo sapiens
gcatttgtcaatgacagt

SEQ ID NO: 2531444 - DNA, 12 bp, Homo sapiens
gcatttgtgaaa

SEQ ID NO: 2531445 - DNA, 16 bp, Homo sapiens
gcattttattgcttga

SEQ ID NO: 2531446 - DNA, 14 bp, Homo sapiens
gcattttgctattg

SEQ ID NO: 2531447 - DNA, 16 bp, Homo sapiens
gcatttttgcaggagc

SEQ ID NO: 2531448 - DNA, 14 bp, Homo sapiens
gccaaaaaaagaca

SEQ ID NO: 2531449 - DNA, 14 bp, Homo sapiens
gccaaacctctgtt

SEQ ID NO: 2531450 - DNA, 16 bp, Homo sapiens
gccaaacctctgttca

SEQ ID NO: 2531451 - DNA, 18 bp, Homo sapiens
gccaaactctgccagcca

SEQ ID NO: 2531452 - DNA, 19 bp, Homo sapiens
gccaaagacttagtatatt

SEQ ID NO: 2531453 - DNA, 13 bp, Homo sapiens
gccaaagccaaag

SEQ ID NO: 2531454 - DNA, 11 bp, Homo sapiens
gccaaattatt

SEQ ID NO: 2531455 - DNA, 15 bp, Homo sapiens
gccaaattatttgtg

SEQ ID NO: 2531456 - DNA, 14 bp, Homo sapiens
gccaaattttggcc

SEQ ID NO: 2531457 - DNA, 13 bp, Homo sapiens
gccaacaaagctg

SEQ ID NO: 2531458 - DNA, 20 bp, Homo sapiens
gccaacactcaagaagcagg

SEQ ID NO: 2531459 - DNA, 17 bp, Homo sapiens
gccaacagaagcttcca

SEQ ID NO: 2531460 - DNA, 16 bp, Homo sapiens
gccaacaggtggcagg

SEQ ID NO: 2531461 - DNA, 12 bp, Homo sapiens
gccaactgttgt

SEQ ID NO: 2531462 - DNA, 21 bp, Homo sapiens
gccaacttgagggcccagagc

SEQ ID NO: 2531463 - DNA, 22 bp, Homo sapiens
gccaagacttggcaacagaagc

SEQ ID NO: 2531464 - DNA, 23 bp, Homo sapiens
gccaagacttggcaacagaagca

SEQ ID NO: 2531465 - DNA, 20 bp, Homo sapiens
gccaagagcagaggcagcga

SEQ ID NO: 2531466 - DNA, 19 bp, Homo sapiens
gccaagcaacctgggtcca

SEQ ID NO: 2531467 - DNA, 23 bp, Homo sapiens
gccaagcactgtgctcagggcta

SEQ ID NO: 2531468 - DNA, 22 bp, Homo sapiens
gccaagcatttaatgtagccat

SEQ ID NO: 2531469 - DNA, 21 bp, Homo sapiens
gccaagccctccccatcccat

SEQ ID NO: 2531470 - DNA, 20 bp, Homo sapiens
gccaagctcaggaccaggca

SEQ ID NO: 2531471 - DNA, 14 bp, Homo sapiens
gccaaggactgccg

SEQ ID NO: 2531472 - DNA, 17 bp, Homo sapiens
gccaaggactgccgacc

SEQ ID NO: 2531473 - DNA, 23 bp, Homo sapiens
gccaaggagggtggatcacctga

SEQ ID NO: 2531474 - DNA, 18 bp, Homo sapiens
gccaaggccgaagctctg

SEQ ID NO: 2531475 - DNA, 14 bp, Homo sapiens
gccaaggccttctc

SEQ ID NO: 2531476 - DNA, 14 bp, Homo sapiens
gccaaggtgggagg

SEQ ID NO: 2531477 - DNA, 15 bp, Homo sapiens
gccaaggtgggagga

SEQ ID NO: 2531478 - DNA, 23 bp, Homo sapiens
gccaaggtgggaggattgcttga

SEQ ID NO: 2531479 - DNA, 20 bp, Homo sapiens
gccaagtgcaggctggcacc

SEQ ID NO: 2531480 - DNA, 21 bp, Homo sapiens
gccaagttcctctagtgccct

SEQ ID NO: 2531481 - DNA, 18 bp, Homo sapiens
gccaatcccctccttggg

SEQ ID NO: 2531482 - DNA, 18 bp, Homo sapiens
gccaatgccccactggca

SEQ ID NO: 2531483 - DNA, 21 bp, Homo sapiens
gccctagagcctgcctggagc

SEQ ID NO: 2531484 - DNA, 23 bp, Homo sapiens
gccctagagcctgcctggagcgt

SEQ ID NO: 2531485 - DNA, 20 bp, Homo sapiens
gccctcacccctgccctggg

SEQ ID NO: 2531486 - DNA, 16 bp, Homo sapiens
gccctcatggcccctc

SEQ ID NO: 2531487 - DNA, 20 bp, Homo sapiens
gccctccacagccgcagcct

SEQ ID NO: 2531488 - DNA, 13 bp, Homo sapiens
gccctccccagag

SEQ ID NO: 2531489 - DNA, 16 bp, Homo sapiens
gccctccccagagcac

SEQ ID NO: 2531490 - DNA, 18 bp, Homo sapiens
gccctcccctctctgcac

SEQ ID NO: 2531491 - DNA, 19 bp, Homo sapiens
gccctcccctctctgcacc

SEQ ID NO: 2531492 - DNA, 23 bp, Homo sapiens
gccctcccttggaaacctgccct

SEQ ID NO: 2531493 - DNA, 14 bp, Homo sapiens
gccctccgacagcc

SEQ ID NO: 2531494 - DNA, 16 bp, Homo sapiens
gccctccttgtccacc

SEQ ID NO: 2531495 - DNA, 17 bp, Homo sapiens
gccctccttgtccaccc

SEQ ID NO: 2531496 - DNA, 19 bp, Homo sapiens
gccctccttgtccacccac

SEQ ID NO: 2531497 - DNA, 16 bp, Homo sapiens
gccctcgcccccgccc

SEQ ID NO: 2531498 - DNA, 15 bp, Homo sapiens
gccctcgggcccagc

SEQ ID NO: 2531499 - DNA, 20 bp, Homo sapiens
gccctcgggcccagccccca

SEQ ID NO: 2531500 - DNA, 16 bp, Homo sapiens
gccctcgtggccagcc

SEQ ID NO: 2531501 - DNA, 19 bp, Homo sapiens
gccctcgtggccagcccgg

SEQ ID NO: 2531502 - DNA, 13 bp, Homo sapiens
gccctctgcccac

SEQ ID NO: 2531503 - DNA, 15 bp, Homo sapiens
gccctgacctcccag

SEQ ID NO: 2531504 - DNA, 22 bp, Homo sapiens
gccctgagctcggtggacccag

SEQ ID NO: 2531505 - DNA, 21 bp, Homo sapiens
gccctgaggtgaaagggagct

SEQ ID NO: 2531506 - DNA, 22 bp, Homo sapiens
gccctgagtggatctccaagga

SEQ ID NO: 2531507 - DNA, 21 bp, Homo sapiens
gccctgcaaaaggactctcag

SEQ ID NO: 2531508 - DNA, 16 bp, Homo sapiens
gccctgcacctgtgca

SEQ ID NO: 2531509 - DNA, 17 bp, Homo sapiens
gccctgcccacctggcc

SEQ ID NO: 2531510 - DNA, 20 bp, Homo sapiens
gccctgcccacctggcctct

SEQ ID NO: 2531511 - DNA, 22 bp, Homo sapiens
gccctgcccacctggcctctgc

SEQ ID NO: 2531512 - DNA, 18 bp, Homo sapiens
gccctgccctagctccac

SEQ ID NO: 2531513 - DNA, 11 bp, Homo sapiens
gccctgcctcc

SEQ ID NO: 2531514 - DNA, 14 bp, Homo sapiens
gccctgcctccttt

SEQ ID NO: 2531515 - DNA, 16 bp, Homo sapiens
gccctgcctcctttgt

SEQ ID NO: 2531516 - DNA, 13 bp, Homo sapiens
gccctgcctctgt

SEQ ID NO: 2531517 - DNA, 16 bp, Homo sapiens
gccctgcctgagggcc

SEQ ID NO: 2531518 - DNA, 15 bp, Homo sapiens
gccctgcggccccgt

SEQ ID NO: 2531519 - DNA, 14 bp, Homo sapiens
gccctgctcctccc

SEQ ID NO: 2531520 - DNA, 22 bp, Homo sapiens
gccctgctcctccctggctgcc

SEQ ID NO: 2531521 - DNA, 22 bp, Homo sapiens
gccctgctgccgcctcccagcc

SEQ ID NO: 2531522 - DNA, 19 bp, Homo sapiens
gccctggagccaactgctg

SEQ ID NO: 2531523 - DNA, 20 bp, Homo sapiens
gccctggagccaactgctgc

SEQ ID NO: 2531524 - DNA, 20 bp, Homo sapiens
gccctggagtcatgccaagc

SEQ ID NO: 2531525 - DNA, 16 bp, Homo sapiens
gccctggctgaaggac

SEQ ID NO: 2531526 - DNA, 17 bp, Homo sapiens
gccctggctgaaggact

SEQ ID NO: 2531527 - DNA, 21 bp, Homo sapiens
gccctggctgaaggactgtga

SEQ ID NO: 2531528 - DNA, 15 bp, Homo sapiens
gccctgggctcggag

SEQ ID NO: 2531529 - DNA, 16 bp, Homo sapiens
gccctggtagggcagt

SEQ ID NO: 2531530 - DNA, 14 bp, Homo sapiens
gccctggtccaggg

SEQ ID NO: 2531531 - DNA, 18 bp, Homo sapiens
gccctggtccagggaagc

SEQ ID NO: 2531532 - DNA, 20 bp, Homo sapiens
gccctggtccagggaagctg

SEQ ID NO: 2531533 - DNA, 15 bp, Homo sapiens
gccctggtccttcca

SEQ ID NO: 2531534 - DNA, 13 bp, Homo sapiens
gccctggtggaga

SEQ ID NO: 2531535 - DNA, 21 bp, Homo sapiens
gccctggtggagaaagcactg

SEQ ID NO: 2531536 - DNA, 16 bp, Homo sapiens
gccctgtcgagacact

SEQ ID NO: 2531537 - DNA, 17 bp, Homo sapiens
gccctgtggaagggact

SEQ ID NO: 2531538 - DNA, 17 bp, Homo sapiens
gccctgtgggcccccaa

SEQ ID NO: 2531539 - DNA, 13 bp, Homo sapiens
gccctgttaaaag

SEQ ID NO: 2531540 - DNA, 22 bp, Homo sapiens
gccctgttctctaccaagctat

SEQ ID NO: 2531541 - DNA, 16 bp, Homo sapiens
gcccttacacttactg

SEQ ID NO: 2531542 - DNA, 20 bp, Homo sapiens
gcccttattttcaagaaact

SEQ ID NO: 2531543 - DNA, 19 bp, Homo sapiens
gcccttcactgcctttgct

SEQ ID NO: 2531544 - DNA, 21 bp, Homo sapiens
gcccttccatgtcgcctctgc

SEQ ID NO: 2531545 - DNA, 18 bp, Homo sapiens
gcccttccctgtccctct

SEQ ID NO: 2531546 - DNA, 17 bp, Homo sapiens
gcccttctctccagccc

SEQ ID NO: 2531547 - DNA, 19 bp, Homo sapiens
gcccttctctccagcccct

SEQ ID NO: 2531548 - DNA, 23 bp, Homo sapiens
gcccttctctccagcccctggat

SEQ ID NO: 2531549 - DNA, 22 bp, Homo sapiens
gcccttgcagttcagcaccacc

SEQ ID NO: 2531550 - DNA, 13 bp, Homo sapiens
gcccttgccctga

SEQ ID NO: 2531551 - DNA, 15 bp, Homo sapiens
gcccttgccctgacc

SEQ ID NO: 2531552 - DNA, 16 bp, Homo sapiens
gcccttggaggccagc

SEQ ID NO: 2531553 - DNA, 12 bp, Homo sapiens
gccctttctgtg

SEQ ID NO: 2531554 - DNA, 13 bp, Homo sapiens
gccctttctgtgt

SEQ ID NO: 2531555 - DNA, 14 bp, Homo sapiens
gccctttttaagga

SEQ ID NO: 2531556 - DNA, 17 bp, Homo sapiens
gccgaagctctggctga

SEQ ID NO: 2531557 - DNA, 14 bp, Homo sapiens
gccgaccagagccc

SEQ ID NO: 2531558 - DNA, 17 bp, Homo sapiens
gccgacctcagccttcc

SEQ ID NO: 2531559 - DNA, 13 bp, Homo sapiens
gccgactcctggg

SEQ ID NO: 2531560 - DNA, 13 bp, Homo sapiens
gccgagaagcaag

SEQ ID NO: 2531561 - DNA, 20 bp, Homo sapiens
gccgagatcacgccactgca

SEQ ID NO: 2531562 - DNA, 21 bp, Homo sapiens
gccgagatcacgccactgcac

SEQ ID NO: 2531563 - DNA, 17 bp, Homo sapiens
gccgagccgggcctggg

SEQ ID NO: 2531564 - DNA, 19 bp, Homo sapiens
gccgagccgggcctggggc

SEQ ID NO: 2531565 - DNA, 21 bp, Homo sapiens
gccgagctcgtgtatcctggg

SEQ ID NO: 2531566 - DNA, 14 bp, Homo sapiens
gccgagtctgtctc

SEQ ID NO: 2531567 - DNA, 17 bp, Homo sapiens
gccgcaaaccacactgg

SEQ ID NO: 2531568 - DNA, 19 bp, Homo sapiens
gccgcaaaccacactggac

SEQ ID NO: 2531569 - DNA, 15 bp, Homo sapiens
gccgcagctcttgcc

SEQ ID NO: 2531570 - DNA, 15 bp, Homo sapiens
gccgccatgctcctg

SEQ ID NO: 2531571 - DNA, 17 bp, Homo sapiens
gccgccattgccaccag

SEQ ID NO: 2531572 - DNA, 18 bp, Homo sapiens
gccgccattgccaccagg

SEQ ID NO: 2531573 - DNA, 14 bp, Homo sapiens
gccgcccaaggccc

SEQ ID NO: 2531574 - DNA, 23 bp, Homo sapiens
gccgccccctgccccccagcctc

SEQ ID NO: 2531575 - DNA, 16 bp, Homo sapiens
gccgcctcaccccctc

SEQ ID NO: 2531576 - DNA, 16 bp, Homo sapiens
gccgcctcccagcctg

SEQ ID NO: 2531577 - DNA, 17 bp, Homo sapiens
gccgctagaggcctgag

SEQ ID NO: 2531578 - DNA, 18 bp, Homo sapiens
gccgctagaggcctgagg

SEQ ID NO: 2531579 - DNA, 23 bp, Homo sapiens
gccgctagatgggcatggggtgg

SEQ ID NO: 2531580 - DNA, 15 bp, Homo sapiens
gccgctccaggggtg

SEQ ID NO: 2531581 - DNA, 17 bp, Homo sapiens
gccgctgagcgaggaga

SEQ ID NO: 2531582 - DNA, 12 bp, Homo sapiens
gccgctgtgagc

SEQ ID NO: 2531583 - DNA, 16 bp, Homo sapiens
gccggagtcagtgcca

SEQ ID NO: 2531584 - DNA, 16 bp, Homo sapiens
gccggagtccactccc

SEQ ID NO: 2531585 - DNA, 19 bp, Homo sapiens
gccggcaaccccagttctg

SEQ ID NO: 2531586 - DNA, 21 bp, Homo sapiens
gccggcaaccccagttctgct

SEQ ID NO: 2531587 - DNA, 15 bp, Homo sapiens
gccggcatggctggg

SEQ ID NO: 2531588 - DNA, 13 bp, Homo sapiens
gccggcctctctg

SEQ ID NO: 2531589 - DNA, 14 bp, Homo sapiens
gccggcctctctgg

SEQ ID NO: 2531590 - DNA, 15 bp, Homo sapiens
gccggcctctctggc

SEQ ID NO: 2531591 - DNA, 18 bp, Homo sapiens
gccggcctctctggcctc

SEQ ID NO: 2531592 - DNA, 19 bp, Homo sapiens
gccggcctctctggcctcc

SEQ ID NO: 2531593 - DNA, 20 bp, Homo sapiens
gccggcctctctggcctccc

SEQ ID NO: 2531594 - DNA, 18 bp, Homo sapiens
gccgggaccccgagcctg

SEQ ID NO: 2531595 - DNA, 12 bp, Homo sapiens
gccgggcctggg

SEQ ID NO: 2531596 - DNA, 19 bp, Homo sapiens
gccgggcgtggtggcgggc

SEQ ID NO: 2531597 - DNA, 23 bp, Homo sapiens
gccggggacagaggcctgcccgg

SEQ ID NO: 2531598 - DNA, 15 bp, Homo sapiens
gccggggctgagact

SEQ ID NO: 2531599 - DNA, 22 bp, Homo sapiens
gccgggggttcataggtcactg

SEQ ID NO: 2531600 - DNA, 14 bp, Homo sapiens
gccgggtctgcctc

SEQ ID NO: 2531601 - DNA, 13 bp, Homo sapiens
gccgggtgcggtg

SEQ ID NO: 2531602 - DNA, 16 bp, Homo sapiens
gccgggtgcggtggct

SEQ ID NO: 2531603 - DNA, 18 bp, Homo sapiens
gccgggttctagtctcct

SEQ ID NO: 2531604 - DNA, 14 bp, Homo sapiens
gccggtacctggga

SEQ ID NO: 2531605 - DNA, 18 bp, Homo sapiens
gccgtcagccaaatgtaa

SEQ ID NO: 2531606 - DNA, 16 bp, Homo sapiens
gccgtctacctgaggg

SEQ ID NO: 2531607 - DNA, 17 bp, Homo sapiens
gccgtctacctgagggg

SEQ ID NO: 2531608 - DNA, 22 bp, Homo sapiens
gccgtctacctgaggggcctct

SEQ ID NO: 2531609 - DNA, 16 bp, Homo sapiens
gccgtgagttctcagg

SEQ ID NO: 2531610 - DNA, 16 bp, Homo sapiens
gccgtggtcctttggg

SEQ ID NO: 2531611 - DNA, 18 bp, Homo sapiens
gccgttgaagaggaaggg

SEQ ID NO: 2531612 - DNA, 17 bp, Homo sapiens
gcctaaaaatgcaactt

SEQ ID NO: 2531613 - DNA, 16 bp, Homo sapiens
gcctacaggagtgagc

SEQ ID NO: 2531614 - DNA, 14 bp, Homo sapiens
gcctacctgctctc

SEQ ID NO: 2531615 - DNA, 17 bp, Homo sapiens
gcctactccaaaatgtt

SEQ ID NO: 2531616 - DNA, 17 bp, Homo sapiens
gcctagatccacacaca

SEQ ID NO: 2531617 - DNA, 12 bp, Homo sapiens
gcctagcatacg

SEQ ID NO: 2531618 - DNA, 22 bp, Homo sapiens
gcctagcatacgtacacatttt

SEQ ID NO: 2531619 - DNA, 15 bp, Homo sapiens
gcctagctgctacaa

SEQ ID NO: 2531620 - DNA, 17 bp, Homo sapiens
gcctagctgctacaaag

SEQ ID NO: 2531621 - DNA, 19 bp, Homo sapiens
gcctagctgctacaaagaa

SEQ ID NO: 2531622 - DNA, 17 bp, Homo sapiens
gcctagggcctggtcca

SEQ ID NO: 2531623 - DNA, 17 bp, Homo sapiens
gcctaggggtcagggac

SEQ ID NO: 2531624 - DNA, 20 bp, Homo sapiens
gcctaggtgacagagtgaga

SEQ ID NO: 2531625 - DNA, 19 bp, Homo sapiens
gcctagtgaaggcttctct

SEQ ID NO: 2531626 - DNA, 16 bp, Homo sapiens
gcctataatgaagctt

SEQ ID NO: 2531627 - DNA, 21 bp, Homo sapiens
gcctataatgaagctttatac

SEQ ID NO: 2531628 - DNA, 17 bp, Homo sapiens
gctatgagctggggatg

SEQ ID NO: 2531629 - DNA, 18 bp, Homo sapiens
gctatggatggcttctaa

SEQ ID NO: 2531630 - DNA, 19 bp, Homo sapiens
gctatgggagccccagggt

SEQ ID NO: 2531631 - DNA, 14 bp, Homo sapiens
gctatggtgagatg

SEQ ID NO: 2531632 - DNA, 17 bp, Homo sapiens
gctattattttcactgt

SEQ ID NO: 2531633 - DNA, 16 bp, Homo sapiens
gctattgacaagtcat

SEQ ID NO: 2531634 - DNA, 14 bp, Homo sapiens
gctatttaaaactt

SEQ ID NO: 2531635 - DNA, 17 bp, Homo sapiens
gctatttccattccaga

SEQ ID NO: 2531636 - DNA, 12 bp, Homo sapiens
gctatttttccc

SEQ ID NO: 2531637 - DNA, 20 bp, Homo sapiens
gctcaaaatttgaagaatga

SEQ ID NO: 2531638 - DNA, 14 bp, Homo sapiens
gctcaaatctattc

SEQ ID NO: 2531639 - DNA, 17 bp, Homo sapiens
gctcaaatctattcaga

SEQ ID NO: 2531640 - DNA, 18 bp, Homo sapiens
gctcaaatctattcagac

SEQ ID NO: 2531641 - DNA, 23 bp, Homo sapiens
gctcaagcagcgaccgccccctc

SEQ ID NO: 2531642 - DNA, 18 bp, Homo sapiens
gctcaagtcctcttttct

SEQ ID NO: 2531643 - DNA, 19 bp, Homo sapiens
gctcaagtcctcttttctg

SEQ ID NO: 2531644 - DNA, 20 bp, Homo sapiens
gctcaagtcttccctgatca

SEQ ID NO: 2531645 - DNA, 16 bp, Homo sapiens
gctcaatcaagaaaat

SEQ ID NO: 2531646 - DNA, 16 bp, Homo sapiens
gctcaatcctctaagc

SEQ ID NO: 2531647 - DNA, 17 bp, Homo sapiens
gctcaatggactggaag

SEQ ID NO: 2531648 - DNA, 23 bp, Homo sapiens
gctcacaataaaaatggctcaga

SEQ ID NO: 2531649 - DNA, 14 bp, Homo sapiens
gctcacacatgaga

SEQ ID NO: 2531650 - DNA, 14 bp, Homo sapiens
gctcacaccccatt

SEQ ID NO: 2531651 - DNA, 22 bp, Homo sapiens
gctcacaccccattggtggact

SEQ ID NO: 2531652 - DNA, 14 bp, Homo sapiens
gctcaccagcccca

SEQ ID NO: 2531653 - DNA, 20 bp, Homo sapiens
gctcaccagccccagtgccc

SEQ ID NO: 2531654 - DNA, 20 bp, Homo sapiens
gctcacccaataaacattaa

SEQ ID NO: 2531655 - DNA, 18 bp, Homo sapiens
gctcacccagccccaggg

SEQ ID NO: 2531656 - DNA, 20 bp, Homo sapiens
gctcaccccccacactcact

SEQ ID NO: 2531657 - DNA, 15 bp, Homo sapiens
gctcacccctggagg

SEQ ID NO: 2531658 - DNA, 19 bp, Homo sapiens
gctcacctgttgcttacaa

SEQ ID NO: 2531659 - DNA, 21 bp, Homo sapiens
gctcacctgttgcttacaatt

SEQ ID NO: 2531660 - DNA, 22 bp, Homo sapiens
gctcacgtgagagtgtcttcac

SEQ ID NO: 2531661 - DNA, 17 bp, Homo sapiens
gctcacgtgtgtgactc

SEQ ID NO: 2531662 - DNA, 14 bp, Homo sapiens
gctcactatgaatc

SEQ ID NO: 2531663 - DNA, 18 bp, Homo sapiens
gctcactatggtgccaat

SEQ ID NO: 2531664 - DNA, 17 bp, Homo sapiens
gctcactgcagcctcaa

SEQ ID NO: 2531665 - DNA, 15 bp, Homo sapiens
gctcacttctgggct

SEQ ID NO: 2531666 - DNA, 21 bp, Homo sapiens
gctcagaaggctcttctgact

SEQ ID NO: 2531667 - DNA, 19 bp, Homo sapiens
gctcagagagggcaggcat

SEQ ID NO: 2531668 - DNA, 13 bp, Homo sapiens
gctcagagagggt

SEQ ID NO: 2531669 - DNA, 15 bp, Homo sapiens
gctcagagagggtgg

SEQ ID NO: 2531670 - DNA, 20 bp, Homo sapiens
gctcagagagggtgggagtg

SEQ ID NO: 2531671 - DNA, 18 bp, Homo sapiens
gctcagagatgtgcaccc

SEQ ID NO: 2531672 - DNA, 17 bp, Homo sapiens
gctcagccagccccatc

SEQ ID NO: 2531673 - DNA, 11 bp, Homo sapiens
gctcagcccac

SEQ ID NO: 2531674 - DNA, 16 bp, Homo sapiens
gctcagcccacccccc

SEQ ID NO: 2531675 - DNA, 21 bp, Homo sapiens
gctcagccctgactggtgcta

SEQ ID NO: 2531676 - DNA, 17 bp, Homo sapiens
gctcagcctggtgggcc

SEQ ID NO: 2531677 - DNA, 17 bp, Homo sapiens
gctcagcggggacagct

SEQ ID NO: 2531678 - DNA, 18 bp, Homo sapiens
gctcagcggggacagctc

SEQ ID NO: 2531679 - DNA, 22 bp, Homo sapiens
gctcagcggggacagctccttc

SEQ ID NO: 2531680 - DNA, 21 bp, Homo sapiens
gctcagctttttgtcttttct

SEQ ID NO: 2531681 - DNA, 15 bp, Homo sapiens
gctcaggaccaggca

SEQ ID NO: 2531682 - DNA, 20 bp, Homo sapiens
gctcaggcctataaccccag

SEQ ID NO: 2531683 - DNA, 19 bp, Homo sapiens
gctcaggcgatccacctgt

SEQ ID NO: 2531684 - DNA, 17 bp, Homo sapiens
gctcagggaaaggccag

SEQ ID NO: 2531685 - DNA, 12 bp, Homo sapiens
gctcagggcctg

SEQ ID NO: 2531686 - DNA, 13 bp, Homo sapiens
gctcagggcctgg

SEQ ID NO: 2531687 - DNA, 17 bp, Homo sapiens
gctcagggcctggctca

SEQ ID NO: 2531688 - DNA, 18 bp, Homo sapiens
gctcaggggcgtgtggct

SEQ ID NO: 2531689 - DNA, 18 bp, Homo sapiens
gctcaggtgtccctgcac

SEQ ID NO: 2531690 - DNA, 19 bp, Homo sapiens
gctcaggtgtccctgcact

SEQ ID NO: 2531691 - DNA, 14 bp, Homo sapiens
gctcagtctcagga

SEQ ID NO: 2531692 - DNA, 20 bp, Homo sapiens
gctcagtctcaggagcatgg

SEQ ID NO: 2531693 - DNA, 16 bp, Homo sapiens
gctcagtctccctttc

SEQ ID NO: 2531694 - DNA, 19 bp, Homo sapiens
gctcagtctccctttccct

SEQ ID NO: 2531695 - DNA, 17 bp, Homo sapiens
gctcagttcagaatcac

SEQ ID NO: 2531696 - DNA, 12 bp, Homo sapiens
gctcagttgtag

SEQ ID NO: 2531697 - DNA, 21 bp, Homo sapiens
gctcatccccacctgtcttca

SEQ ID NO: 2531698 - DNA, 16 bp, Homo sapiens
gctcatctctgtccca

SEQ ID NO: 2531699 - DNA, 14 bp, Homo sapiens
gctccaagctccca

SEQ ID NO: 2531700 - DNA, 16 bp, Homo sapiens
gctccaagctcccagg

SEQ ID NO: 2531701 - DNA, 17 bp, Homo sapiens
gctccaagctcccaggc

SEQ ID NO: 2531702 - DNA, 21 bp, Homo sapiens
gctccaagctcccaggcattc

SEQ ID NO: 2531703 - DNA, 19 bp, Homo sapiens
gctccacaccctctcccag

SEQ ID NO: 2531704 - DNA, 15 bp, Homo sapiens
gctccaccacatcct

SEQ ID NO: 2531705 - DNA, 13 bp, Homo sapiens
gctccacccttgg

SEQ ID NO: 2531706 - DNA, 14 bp, Homo sapiens
gctccacccttggc

SEQ ID NO: 2531707 - DNA, 15 bp, Homo sapiens
gctccacccttggcc

SEQ ID NO: 2531708 - DNA, 16 bp, Homo sapiens
gctccacccttggcct

SEQ ID NO: 2531709 - DNA, 9 bp, Homo sapiens
gctccagac

SEQ ID NO: 2531710 - DNA, 20 bp, Homo sapiens
gctccagagggcactctgct

SEQ ID NO: 2531711 - DNA, 14 bp, Homo sapiens
gctccagccaaccc

SEQ ID NO: 2531712 - DNA, 16 bp, Homo sapiens
gctccagccaacccct

SEQ ID NO: 2531713 - DNA, 22 bp, Homo sapiens
gctccagccaacccctgtggag

SEQ ID NO: 2531714 - DNA, 15 bp, Homo sapiens
gctccagcctggctc

SEQ ID NO: 2531715 - DNA, 11 bp, Homo sapiens
gctccagctgt

SEQ ID NO: 2531716 - DNA, 12 bp, Homo sapiens
gctccaggagca

SEQ ID NO: 2531717 - DNA, 12 bp, Homo sapiens
gctccaggctcc

SEQ ID NO: 2531718 - DNA, 16 bp, Homo sapiens
gctccaggtggctctg

SEQ ID NO: 2531719 - DNA, 18 bp, Homo sapiens
gctccaggtggctctgag

SEQ ID NO: 2531720 - DNA, 18 bp, Homo sapiens
gctccatgtgccccctct

SEQ ID NO: 2531721 - DNA, 11 bp, Homo sapiens
gctcccaaggg

SEQ ID NO: 2531722 - DNA, 18 bp, Homo sapiens
gctcccacaggcagcttt

SEQ ID NO: 2531723 - DNA, 12 bp, Homo sapiens
gctcccagcagc

SEQ ID NO: 2531724 - DNA, 19 bp, Homo sapiens
gctcccagcagccctaagg

SEQ ID NO: 2531725 - DNA, 23 bp, Homo sapiens
gctcccagcagccctaaggatct

SEQ ID NO: 2531726 - DNA, 21 bp, Homo sapiens
gctcccaggcattccccagga

SEQ ID NO: 2531727 - DNA, 23 bp, Homo sapiens
gctcccaggcattccccaggagg

SEQ ID NO: 2531728 - DNA, 22 bp, Homo sapiens
gctcccaggccgagaagccagt

SEQ ID NO: 2531729 - DNA, 15 bp, Homo sapiens
gctcccatttctact

SEQ ID NO: 2531730 - DNA, 17 bp, Homo sapiens
gctcccatttctactct

SEQ ID NO: 2531731 - DNA, 18 bp, Homo sapiens
gctcccatttctactctc

SEQ ID NO: 2531732 - DNA, 17 bp, Homo sapiens
gctcccccatcctcccc

SEQ ID NO: 2531733 - DNA, 20 bp, Homo sapiens
gctccctaccacctccccag

SEQ ID NO: 2531734 - DNA, 13 bp, Homo sapiens
gctccctctgcct

SEQ ID NO: 2531735 - DNA, 23 bp, Homo sapiens
gctccctctgcctgaaccttcca

SEQ ID NO: 2531736 - DNA, 17 bp, Homo sapiens
gctccctcttggtcttc

SEQ ID NO: 2531737 - DNA, 13 bp, Homo sapiens
gctccctggagcc

SEQ ID NO: 2531738 - DNA, 16 bp, Homo sapiens
gctcccttcccacctc

SEQ ID NO: 2531739 - DNA, 17 bp, Homo sapiens
gctccgtgcctccacca

SEQ ID NO: 2531740 - DNA, 14 bp, Homo sapiens
gctcctatctgtgt

SEQ ID NO: 2531741 - DNA, 18 bp, Homo sapiens
gctcctcatccagggctc

SEQ ID NO: 2531742 - DNA, 19 bp, Homo sapiens
gctcctcatggtgggttca

SEQ ID NO: 2531743 - DNA, 11 bp, Homo sapiens
gctcctcccac

SEQ ID NO: 2531744 - DNA, 14 bp, Homo sapiens
gctcctccctggct

SEQ ID NO: 2531745 - DNA, 15 bp, Homo sapiens
gctcctccctggctg

SEQ ID NO: 2531746 - DNA, 20 bp, Homo sapiens
gctcctccctggctgccctg

SEQ ID NO: 2531747 - DNA, 22 bp, Homo sapiens
gctcctccctggctgccctggc

SEQ ID NO: 2531748 - DNA, 23 bp, Homo sapiens
gctcctccctggctgccctggcc

SEQ ID NO: 2531749 - DNA, 17 bp, Homo sapiens
gctcctcgagggcaggg

SEQ ID NO: 2531750 - DNA, 16 bp, Homo sapiens
gctcctctccaggcac

SEQ ID NO: 2531751 - DNA, 14 bp, Homo sapiens
gctcctctcctgga

SEQ ID NO: 2531752 - DNA, 11 bp, Homo sapiens
gctcctctggg

SEQ ID NO: 2531753 - DNA, 12 bp, Homo sapiens
gctcctctgggc

SEQ ID NO: 2531754 - DNA, 16 bp, Homo sapiens
gctcctctgggcagga

SEQ ID NO: 2531755 - DNA, 18 bp, Homo sapiens
gctcctgaggggcatctg

SEQ ID NO: 2531756 - DNA, 19 bp, Homo sapiens
gctcctgccagtgtggaac

SEQ ID NO: 2531757 - DNA, 15 bp, Homo sapiens
gctcctgccttctgt

SEQ ID NO: 2531758 - DNA, 14 bp, Homo sapiens
gctcctgctccaca

SEQ ID NO: 2531759 - DNA, 17 bp, Homo sapiens
gctcctgctccacagcc

SEQ ID NO: 2531760 - DNA, 21 bp, Homo sapiens
gctcctggaaaggctcagtct

SEQ ID NO: 2531761 - DNA, 22 bp, Homo sapiens
gctcctggaaaggctcagtctc

SEQ ID NO: 2531762 - DNA, 23 bp, Homo sapiens
gctcctggaaaggctcagtctca

SEQ ID NO: 2531763 - DNA, 15 bp, Homo sapiens
gctcctgtcctccca

SEQ ID NO: 2531764 - DNA, 22 bp, Homo sapiens
gctcctgtcctcccatcccctg

SEQ ID NO: 2531765 - DNA, 19 bp, Homo sapiens
gctcctgtctgccagccag

SEQ ID NO: 2531766 - DNA, 12 bp, Homo sapiens
gctcctgtgtct

SEQ ID NO: 2531767 - DNA, 18 bp, Homo sapiens
gctccttcccatcgctgt

SEQ ID NO: 2531768 - DNA, 14 bp, Homo sapiens
gctccttcctggag

SEQ ID NO: 2531769 - DNA, 15 bp, Homo sapiens
gctccttgactcctt

SEQ ID NO: 2531770 - DNA, 18 bp, Homo sapiens
gctcctttttctccctct

SEQ ID NO: 2531771 - DNA, 20 bp, Homo sapiens
gctcctttttctccctctgg

SEQ ID NO: 2531772 - DNA, 17 bp, Homo sapiens
gctcgagcagtcctgcc

SEQ ID NO: 2531773 - DNA, 13 bp, Homo sapiens
gctgggctctgca

SEQ ID NO: 2531774 - DNA, 12 bp, Homo sapiens
gctgggctgagc

SEQ ID NO: 2531775 - DNA, 13 bp, Homo sapiens
gctgggctgagcc

SEQ ID NO: 2531776 - DNA, 22 bp, Homo sapiens
gctgggctgagcccctacccca

SEQ ID NO: 2531777 - DNA, 13 bp, Homo sapiens
gctgggctggctc

SEQ ID NO: 2531778 - DNA, 21 bp, Homo sapiens
gctgggcttcagtggcagctg

SEQ ID NO: 2531779 - DNA, 22 bp, Homo sapiens
gctgggcttggcagcccgggtc

SEQ ID NO: 2531780 - DNA, 20 bp, Homo sapiens
gctggggaagtcctctgggt

SEQ ID NO: 2531781 - DNA, 16 bp, Homo sapiens
gctggggacctggtac

SEQ ID NO: 2531782 - DNA, 17 bp, Homo sapiens
gctggggcaagtccctg

SEQ ID NO: 2531783 - DNA, 18 bp, Homo sapiens
gctggggcgtggggaggg

SEQ ID NO: 2531784 - DNA, 13 bp, Homo sapiens
gctgggggcctca

SEQ ID NO: 2531785 - DNA, 20 bp, Homo sapiens
gctgggggcctcagtgccac

SEQ ID NO: 2531786 - DNA, 21 bp, Homo sapiens
gctgggtggcaccagcagcct

SEQ ID NO: 2531787 - DNA, 15 bp, Homo sapiens
gctgggttctaccca

SEQ ID NO: 2531788 - DNA, 15 bp, Homo sapiens
gctgggttctgatcc

SEQ ID NO: 2531789 - DNA, 13 bp, Homo sapiens
gctggtaacagtt

SEQ ID NO: 2531790 - DNA, 16 bp, Homo sapiens
gctggtaacagttcat

SEQ ID NO: 2531791 - DNA, 22 bp, Homo sapiens
gctggtcaaacaaactctctga

SEQ ID NO: 2531792 - DNA, 19 bp, Homo sapiens
gctggtcccactcagtcca

SEQ ID NO: 2531793 - DNA, 13 bp, Homo sapiens
gctggtgcattac

SEQ ID NO: 2531794 - DNA, 18 bp, Homo sapiens
gctggtgcattacagaga

SEQ ID NO: 2531795 - DNA, 15 bp, Homo sapiens
gctggtgccagcctt

SEQ ID NO: 2531796 - DNA, 13 bp, Homo sapiens
gctggtgcccgga

SEQ ID NO: 2531797 - DNA, 17 bp, Homo sapiens
gctggtgctgtggccag

SEQ ID NO: 2531798 - DNA, 14 bp, Homo sapiens
gctggttagaaatg

SEQ ID NO: 2531799 - DNA, 22 bp, Homo sapiens
gctggttcagggttggcccctg

SEQ ID NO: 2531800 - DNA, 23 bp, Homo sapiens
gctggttcagggttggcccctgc

SEQ ID NO: 2531801 - DNA, 16 bp, Homo sapiens
gctggttggagagcta

SEQ ID NO: 2531802 - DNA, 17 bp, Homo sapiens
gctggttggagagctag

SEQ ID NO: 2531803 - DNA, 23 bp, Homo sapiens
gctggttttcctaaatgcagtga

SEQ ID NO: 2531804 - DNA, 16 bp, Homo sapiens
gctgtaagaagagact

SEQ ID NO: 2531805 - DNA, 19 bp, Homo sapiens
gctgtaaggcatgaaggat

SEQ ID NO: 2531806 - DNA, 13 bp, Homo sapiens
gctgtagaaggag

SEQ ID NO: 2531807 - DNA, 20 bp, Homo sapiens
gctgtagacatttgctatga

SEQ ID NO: 2531808 - DNA, 13 bp, Homo sapiens
gctgtattcttct

SEQ ID NO: 2531809 - DNA, 17 bp, Homo sapiens
gctgtattgaatcatgt

SEQ ID NO: 2531810 - DNA, 18 bp, Homo sapiens
gctgtattgaatcatgta

SEQ ID NO: 2531811 - DNA, 23 bp, Homo sapiens
gctgtcatcaattgaatggtcag

SEQ ID NO: 2531812 - DNA, 15 bp, Homo sapiens
gctgtccctccccct

SEQ ID NO: 2531813 - DNA, 16 bp, Homo sapiens
gctgtcctaggccaca

SEQ ID NO: 2531814 - DNA, 17 bp, Homo sapiens
gctgtccttacccatct

SEQ ID NO: 2531815 - DNA, 15 bp, Homo sapiens
gctgtctccagaccc

SEQ ID NO: 2531816 - DNA, 19 bp, Homo sapiens
gctgtctgatctgtgcttt

SEQ ID NO: 2531817 - DNA, 22 bp, Homo sapiens
gctgtcttctcaggctctgccc

SEQ ID NO: 2531818 - DNA, 18 bp, Homo sapiens
gctgtgagacagtgggaa

SEQ ID NO: 2531819 - DNA, 15 bp, Homo sapiens
gctgtgagcccctgg

SEQ ID NO: 2531820 - DNA, 20 bp, Homo sapiens
gctgtgagcccctggtcctg

SEQ ID NO: 2531821 - DNA, 16 bp, Homo sapiens
gctgtgaggcccctgg

SEQ ID NO: 2531822 - DNA, 14 bp, Homo sapiens
gctgtgcctctgcc

SEQ ID NO: 2531823 - DNA, 15 bp, Homo sapiens
gctgtgcctctgcct

SEQ ID NO: 2531824 - DNA, 15 bp, Homo sapiens
gctgtgctatgaatt

SEQ ID NO: 2531825 - DNA, 16 bp, Homo sapiens
gctgtgctatgaattt

SEQ ID NO: 2531826 - DNA, 15 bp, Homo sapiens
gctgtgctctggaca

SEQ ID NO: 2531827 - DNA, 14 bp, Homo sapiens
gctgtgctgccctg

SEQ ID NO: 2531828 - DNA, 16 bp, Homo sapiens
gctgtgctgccctgcc

SEQ ID NO: 2531829 - DNA, 16 bp, Homo sapiens
gctgtggccagggtga

SEQ ID NO: 2531830 - DNA, 22 bp, Homo sapiens
gctgtggccagggtgagagctg

SEQ ID NO: 2531831 - DNA, 15 bp, Homo sapiens
gctgtggcctgggca

SEQ ID NO: 2531832 - DNA, 18 bp, Homo sapiens
gctgtgggcctcaaggac

SEQ ID NO: 2531833 - DNA, 23 bp, Homo sapiens
gctgtggtagggggtgtctcagg

SEQ ID NO: 2531834 - DNA, 14 bp, Homo sapiens
gctgtgtaaagtta

SEQ ID NO: 2531835 - DNA, 16 bp, Homo sapiens
gctgtgtaaagttagt

SEQ ID NO: 2531836 - DNA, 14 bp, Homo sapiens
gctgtgtatctgat

SEQ ID NO: 2531837 - DNA, 13 bp, Homo sapiens
gctgtgtggtttg

SEQ ID NO: 2531838 - DNA, 22 bp, Homo sapiens
gctgtgtggtttggtgtgttcc

SEQ ID NO: 2531839 - DNA, 18 bp, Homo sapiens
gctgttatttctattttt

SEQ ID NO: 2531840 - DNA, 15 bp, Homo sapiens
gctgttcacagccag

SEQ ID NO: 2531841 - DNA, 23 bp, Homo sapiens
gctgttcacagccagactggcac

SEQ ID NO: 2531842 - DNA, 18 bp, Homo sapiens
gctgttgatttctttcca

SEQ ID NO: 2531843 - DNA, 13 bp, Homo sapiens
gctgttggcactc

SEQ ID NO: 2531844 - DNA, 16 bp, Homo sapiens
gctgttggctgggggc

SEQ ID NO: 2531845 - DNA, 21 bp, Homo sapiens
gctgttggctgggggcctcag

SEQ ID NO: 2531846 - DNA, 12 bp, Homo sapiens
gctgttgtacat

SEQ ID NO: 2531847 - DNA, 14 bp, Homo sapiens
gctgttgtacattt

SEQ ID NO: 2531848 - DNA, 16 bp, Homo sapiens
gctgttgtccctctgc

SEQ ID NO: 2531849 - DNA, 16 bp, Homo sapiens
gctgtttattttatat

SEQ ID NO: 2531850 - DNA, 12 bp, Homo sapiens
gcttaaagatgt

SEQ ID NO: 2531851 - DNA, 16 bp, Homo sapiens
gcttaaaggtgtcttc

SEQ ID NO: 2531852 - DNA, 20 bp, Homo sapiens
gcttaaaggtgtcttcctcc

SEQ ID NO: 2531853 - DNA, 23 bp, Homo sapiens
gcttaaaggtgtcttcctcccaa

SEQ ID NO: 2531854 - DNA, 16 bp, Homo sapiens
gcttaagcagaagcat

SEQ ID NO: 2531855 - DNA, 18 bp, Homo sapiens
gcttaatgacactagcta

SEQ ID NO: 2531856 - DNA, 23 bp, Homo sapiens
gcttaatgtttattcctgataat

SEQ ID NO: 2531857 - DNA, 13 bp, Homo sapiens
gcttacaagccag

SEQ ID NO: 2531858 - DNA, 19 bp, Homo sapiens
gcttacaagccagctggag

SEQ ID NO: 2531859 - DNA, 22 bp, Homo sapiens
gcttacaagccagctggagaaa

SEQ ID NO: 2531860 - DNA, 14 bp, Homo sapiens
gcttacaattccct

SEQ ID NO: 2531861 - DNA, 20 bp, Homo sapiens
gcttacaattccctgctgtc

SEQ ID NO: 2531862 - DNA, 11 bp, Homo sapiens
gcttacatttt

SEQ ID NO: 2531863 - DNA, 18 bp, Homo sapiens
gcttacatttttacaata

SEQ ID NO: 2531864 - DNA, 17 bp, Homo sapiens
gcttactgatatatttt

SEQ ID NO: 2531865 - DNA, 21 bp, Homo sapiens
gcttactgatatattttacaa

SEQ ID NO: 2531866 - DNA, 17 bp, Homo sapiens
gcttagacctcagcctg

SEQ ID NO: 2531867 - DNA, 19 bp, Homo sapiens
gcttagacctcagcctgtg

SEQ ID NO: 2531868 - DNA, 11 bp, Homo sapiens
gcttagcagga

SEQ ID NO: 2531869 - DNA, 21 bp, Homo sapiens
gcttagcaggagaggagagcc

SEQ ID NO: 2531870 - DNA, 23 bp, Homo sapiens
gcttatcatgctgtctttacatg

SEQ ID NO: 2531871 - DNA, 19 bp, Homo sapiens
gcttatctcaggggtgtgc

SEQ ID NO: 2531872 - DNA, 18 bp, Homo sapiens
gcttatgacatcacttgt

SEQ ID NO: 2531873 - DNA, 23 bp, Homo sapiens
gcttatgacatcacttgtacaaa

SEQ ID NO: 2531874 - DNA, 21 bp, Homo sapiens
gcttattgttccaagacattg

SEQ ID NO: 2531875 - DNA, 17 bp, Homo sapiens
gcttatttttaaaattt

SEQ ID NO: 2531876 - DNA, 22 bp, Homo sapiens
gcttatttttaaaattttaata

SEQ ID NO: 2531877 - DNA, 22 bp, Homo sapiens
gcttcaatacccaaatcctctc

SEQ ID NO: 2531878 - DNA, 14 bp, Homo sapiens
gcttcaccagagca

SEQ ID NO: 2531879 - DNA, 15 bp, Homo sapiens
gcttcaccagagcat

SEQ ID NO: 2531880 - DNA, 15 bp, Homo sapiens
gcttcactgtataaa

SEQ ID NO: 2531881 - DNA, 17 bp, Homo sapiens
gcttcagcatatttata

SEQ ID NO: 2531882 - DNA, 22 bp, Homo sapiens
gcttcagccacagtttcctcat

SEQ ID NO: 2531883 - DNA, 12 bp, Homo sapiens
gcttcagcctcc

SEQ ID NO: 2531884 - DNA, 12 bp, Homo sapiens
gcttcaggttat

SEQ ID NO: 2531885 - DNA, 16 bp, Homo sapiens
gcttcagtggcagctg

SEQ ID NO: 2531886 - DNA, 19 bp, Homo sapiens
gcttcagtggcagctgctt

SEQ ID NO: 2531887 - DNA, 20 bp, Homo sapiens
gcttcagtggcagctgcttt

SEQ ID NO: 2531888 - DNA, 14 bp, Homo sapiens
gcttcatctggcaa

SEQ ID NO: 2531889 - DNA, 18 bp, Homo sapiens
gcttcatctgtcaagtgg

SEQ ID NO: 2531890 - DNA, 14 bp, Homo sapiens
gcttcatgctcagc

SEQ ID NO: 2531891 - DNA, 18 bp, Homo sapiens
gcttcatgctcagccctg

SEQ ID NO: 2531892 - DNA, 18 bp, Homo sapiens
gcttcattagagcaggcg

SEQ ID NO: 2531893 - DNA, 13 bp, Homo sapiens
gcttcatttcctg

SEQ ID NO: 2531894 - DNA, 18 bp, Homo sapiens
gcttcatttcctgtgtct

SEQ ID NO: 2531895 - DNA, 22 bp, Homo sapiens
gcttccagagagtcctctggat

SEQ ID NO: 2531896 - DNA, 19 bp, Homo sapiens
gcttccaggtatctccagg

SEQ ID NO: 2531897 - DNA, 17 bp, Homo sapiens
gcttccatgagaacagc

SEQ ID NO: 2531898 - DNA, 21 bp, Homo sapiens
gcttcccagtggctgctgccc

SEQ ID NO: 2531899 - DNA, 17 bp, Homo sapiens
gcttcccatcctaccct

SEQ ID NO: 2531900 - DNA, 16 bp, Homo sapiens
gcttcccctctctcct

SEQ ID NO: 2531901 - DNA, 15 bp, Homo sapiens
gcttccctctgcctg

SEQ ID NO: 2531902 - DNA, 19 bp, Homo sapiens
gcttccctctgcctgtccc

SEQ ID NO: 2531903 - DNA, 14 bp, Homo sapiens
gcttccctgactca

SEQ ID NO: 2531904 - DNA, 16 bp, Homo sapiens
gcttccggctcctgtg

SEQ ID NO: 2531905 - DNA, 18 bp, Homo sapiens
gcttccggctcctgtgct

SEQ ID NO: 2531906 - DNA, 22 bp, Homo sapiens
gcttcctacccacacctctgcc

SEQ ID NO: 2531907 - DNA, 21 bp, Homo sapiens
gcttcctagaagttactgaat

SEQ ID NO: 2531908 - DNA, 19 bp, Homo sapiens
gcttcgaggcccagcgacc

SEQ ID NO: 2531909 - DNA, 22 bp, Homo sapiens
gcttcggtttctaacttggagc

SEQ ID NO: 2531910 - DNA, 12 bp, Homo sapiens
gcttctatccca

SEQ ID NO: 2531911 - DNA, 16 bp, Homo sapiens
gcttctattagccagt

SEQ ID NO: 2531912 - DNA, 16 bp, Homo sapiens
gcttctcatcctgcag

SEQ ID NO: 2531913 - DNA, 17 bp, Homo sapiens
gcttctcatcctgcagg

SEQ ID NO: 2531914 - DNA, 12 bp, Homo sapiens
gcttctccaggc

SEQ ID NO: 2531915 - DNA, 15 bp, Homo sapiens
gcttctgcaccctcc

SEQ ID NO: 2531916 - DNA, 19 bp, Homo sapiens
gcttctgcaccctccaccc

SEQ ID NO: 2531917 - DNA, 12 bp, Homo sapiens
gcttctgcctgc

SEQ ID NO: 2531918 - DNA, 17 bp, Homo sapiens
ggatgtccacagatgcc

SEQ ID NO: 2531919 - DNA, 14 bp, Homo sapiens
ggatgtctgccaat

SEQ ID NO: 2531920 - DNA, 13 bp, Homo sapiens
ggatgtctgggcc

SEQ ID NO: 2531921 - DNA, 14 bp, Homo sapiens
ggatgtcttccttg

SEQ ID NO: 2531922 - DNA, 17 bp, Homo sapiens
ggatgtggctgcagcag

SEQ ID NO: 2531923 - DNA, 22 bp, Homo sapiens
ggatgtggggtccccatcatcc

SEQ ID NO: 2531924 - DNA, 15 bp, Homo sapiens
ggatgttctggccct

SEQ ID NO: 2531925 - DNA, 15 bp, Homo sapiens
ggattattcatttaa

SEQ ID NO: 2531926 - DNA, 19 bp, Homo sapiens
ggattattcatttaaaatg

SEQ ID NO: 2531927 - DNA, 22 bp, Homo sapiens
ggattattcatttaaaatgatt

SEQ ID NO: 2531928 - DNA, 17 bp, Homo sapiens
ggattatttaataacat

SEQ ID NO: 2531929 - DNA, 19 bp, Homo sapiens
ggattatttaataacatta

SEQ ID NO: 2531930 - DNA, 14 bp, Homo sapiens
ggattattttttca

SEQ ID NO: 2531931 - DNA, 16 bp, Homo sapiens
ggattattttttcaga

SEQ ID NO: 2531932 - DNA, 17 bp, Homo sapiens
ggattattttttcagac

SEQ ID NO: 2531933 - DNA, 14 bp, Homo sapiens
ggattcaggctgct

SEQ ID NO: 2531934 - DNA, 15 bp, Homo sapiens
ggattcaggctgctt

SEQ ID NO: 2531935 - DNA, 13 bp, Homo sapiens
ggattcctgaccc

SEQ ID NO: 2531936 - DNA, 15 bp, Homo sapiens
ggattcctgacccag

SEQ ID NO: 2531937 - DNA, 19 bp, Homo sapiens
ggattctgggaggaagcag

SEQ ID NO: 2531938 - DNA, 17 bp, Homo sapiens
ggattgctactgtccta

SEQ ID NO: 2531939 - DNA, 16 bp, Homo sapiens
ggattgctatgaatga

SEQ ID NO: 2531940 - DNA, 19 bp, Homo sapiens
ggattggggaagactgtgg

SEQ ID NO: 2531941 - DNA, 14 bp, Homo sapiens
ggattgggggctgg

SEQ ID NO: 2531942 - DNA, 23 bp, Homo sapiens
ggattgtaaaaaaaaatgccttt

SEQ ID NO: 2531943 - DNA, 20 bp, Homo sapiens
ggattgtccccgacccttgc

SEQ ID NO: 2531944 - DNA, 22 bp, Homo sapiens
ggatttaacagaaatgtacagc

SEQ ID NO: 2531945 - DNA, 14 bp, Homo sapiens
ggatttatttttcc

SEQ ID NO: 2531946 - DNA, 14 bp, Homo sapiens
ggatttttgtcttg

SEQ ID NO: 2531947 - DNA, 15 bp, Homo sapiens
ggcaaaaaaattaaa

SEQ ID NO: 2531948 - DNA, 13 bp, Homo sapiens
ggcaaacaggcag

SEQ ID NO: 2531949 - DNA, 20 bp, Homo sapiens
ggcaaaggtggctctccagt

SEQ ID NO: 2531950 - DNA, 21 bp, Homo sapiens
ggcaacacagcgagactccgt

SEQ ID NO: 2531951 - DNA, 12 bp, Homo sapiens
ggcaacagagca

SEQ ID NO: 2531952 - DNA, 19 bp, Homo sapiens
ggcaacagagcaagatcct

SEQ ID NO: 2531953 - DNA, 14 bp, Homo sapiens
ggcaacatctttat

SEQ ID NO: 2531954 - DNA, 17 bp, Homo sapiens
ggcaaccccagttctgc

SEQ ID NO: 2531955 - DNA, 20 bp, Homo sapiens
ggcaaccccagttctgctcc

SEQ ID NO: 2531956 - DNA, 15 bp, Homo sapiens
ggcaaccttgtctct

SEQ ID NO: 2531957 - DNA, 15 bp, Homo sapiens
ggcaactgaggcaga

SEQ ID NO: 2531958 - DNA, 23 bp, Homo sapiens
ggcaactgaggcagacagcagct

SEQ ID NO: 2531959 - DNA, 18 bp, Homo sapiens
ggcaactgcattggcttt

SEQ ID NO: 2531960 - DNA, 18 bp, Homo sapiens
ggcaacttgggaactaga

SEQ ID NO: 2531961 - DNA, 22 bp, Homo sapiens
ggcaagagcccccttgacaccg

SEQ ID NO: 2531962 - DNA, 14 bp, Homo sapiens
ggcaagaggggtgg

SEQ ID NO: 2531963 - DNA, 18 bp, Homo sapiens
ggcaagcacctcctgcct

SEQ ID NO: 2531964 - DNA, 18 bp, Homo sapiens
ggcaagctagaacctgga

SEQ ID NO: 2531965 - DNA, 20 bp, Homo sapiens
ggcaagctagaacctggagg

SEQ ID NO: 2531966 - DNA, 22 bp, Homo sapiens
ggcaagctgtgacttctccagg

SEQ ID NO: 2531967 - DNA, 12 bp, Homo sapiens
ggcaaggcaggt

SEQ ID NO: 2531968 - DNA, 14 bp, Homo sapiens
ggcaaggcaggtgc

SEQ ID NO: 2531969 - DNA, 21 bp, Homo sapiens
ggcaagggccatgctgaaggg

SEQ ID NO: 2531970 - DNA, 15 bp, Homo sapiens
ggcaatgatggcaat

SEQ ID NO: 2531971 - DNA, 14 bp, Homo sapiens
ggcaattttgtaac

SEQ ID NO: 2531972 - DNA, 22 bp, Homo sapiens
ggcacaagcaaaagggtgtctg

SEQ ID NO: 2531973 - DNA, 12 bp, Homo sapiens
ggcacacgcctc

SEQ ID NO: 2531974 - DNA, 21 bp, Homo sapiens
ggcacagaaacacaatatttt

SEQ ID NO: 2531975 - DNA, 16 bp, Homo sapiens
ggcaccaaagccacca

SEQ ID NO: 2531976 - DNA, 17 bp, Homo sapiens
ggcaccagcagcctgga

SEQ ID NO: 2531977 - DNA, 18 bp, Homo sapiens
ggcaccccctggagagaa

SEQ ID NO: 2531978 - DNA, 23 bp, Homo sapiens
ggcacctcctacgtcaaacatga

SEQ ID NO: 2531979 - DNA, 14 bp, Homo sapiens
ggcacctggggagt

SEQ ID NO: 2531980 - DNA, 23 bp, Homo sapiens
ggcactaacgttgagcccctgga

SEQ ID NO: 2531981 - DNA, 17 bp, Homo sapiens
ggcactcacagacctgg

SEQ ID NO: 2531982 - DNA, 23 bp, Homo sapiens
ggcactcacagacctggagcccc

SEQ ID NO: 2531983 - DNA, 18 bp, Homo sapiens
ggcactcagaagacactg

SEQ ID NO: 2531984 - DNA, 14 bp, Homo sapiens
ggcactgcaggggc

SEQ ID NO: 2531985 - DNA, 12 bp, Homo sapiens
ggcactgcctga

SEQ ID NO: 2531986 - DNA, 16 bp, Homo sapiens
ggcactgcttccagtg

SEQ ID NO: 2531987 - DNA, 20 bp, Homo sapiens
ggcactggcattgtccctgt

SEQ ID NO: 2531988 - DNA, 19 bp, Homo sapiens
ggcactgggatgagccgct

SEQ ID NO: 2531989 - DNA, 16 bp, Homo sapiens
ggcacttgattccttg

SEQ ID NO: 2531990 - DNA, 14 bp, Homo sapiens
ggcactttttaatt

SEQ ID NO: 2531991 - DNA, 11 bp, Homo sapiens
ggcagaaaatt

SEQ ID NO: 2531992 - DNA, 22 bp, Homo sapiens
ggcagaaagcaaatgtgacctg

SEQ ID NO: 2531993 - DNA, 20 bp, Homo sapiens
ggcagaaaggttctgcccgg

SEQ ID NO: 2531994 - DNA, 14 bp, Homo sapiens
ggcagaaagtggcc

SEQ ID NO: 2531995 - DNA, 20 bp, Homo sapiens
ggcagaacactaacctgacc

SEQ ID NO: 2531996 - DNA, 12 bp, Homo sapiens
ggcagaagacac

SEQ ID NO: 2531997 - DNA, 17 bp, Homo sapiens
ggcagaagacaccagag

SEQ ID NO: 2531998 - DNA, 18 bp, Homo sapiens
ggcagaagacaccagagc

SEQ ID NO: 2531999 - DNA, 15 bp, Homo sapiens
ggcagaagggagaag

SEQ ID NO: 2532000 - DNA, 16 bp, Homo sapiens
ggcagacgccggggac

SEQ ID NO: 2532001 - DNA, 17 bp, Homo sapiens
ggcagagaaagaagaga

SEQ ID NO: 2532002 - DNA, 21 bp, Homo sapiens
ggcagagaaagaagagacagg

SEQ ID NO: 2532003 - DNA, 23 bp, Homo sapiens
ggcagagattggaatgggcagct

SEQ ID NO: 2532004 - DNA, 10 bp, Homo sapiens
ggcagagcag

SEQ ID NO: 2532005 - DNA, 22 bp, Homo sapiens
ggcagagcagagaccatccctg

SEQ ID NO: 2532006 - DNA, 22 bp, Homo sapiens
ggcagagcctttggatgaccag

SEQ ID NO: 2532007 - DNA, 15 bp, Homo sapiens
ggcagaggacagatc

SEQ ID NO: 2532008 - DNA, 18 bp, Homo sapiens
ggcagaggttgtggtgag

SEQ ID NO: 2532009 - DNA, 21 bp, Homo sapiens
ggcagagttctataatgtaaa

SEQ ID NO: 2532010 - DNA, 15 bp, Homo sapiens
ggcagatctgtgccc

SEQ ID NO: 2532011 - DNA, 16 bp, Homo sapiens
ggcagatctgtgcccc

SEQ ID NO: 2532012 - DNA, 18 bp, Homo sapiens
ggcagatctgtgccccat

SEQ ID NO: 2532013 - DNA, 18 bp, Homo sapiens
ggcagcagggctaccctg

SEQ ID NO: 2532014 - DNA, 14 bp, Homo sapiens
ggcagcagtgtgag

SEQ ID NO: 2532015 - DNA, 17 bp, Homo sapiens
ggcagcatagcaagaca

SEQ ID NO: 2532016 - DNA, 16 bp, Homo sapiens
ggcagccaaacccatg

SEQ ID NO: 2532017 - DNA, 18 bp, Homo sapiens
ggcagccaaacccatgag

SEQ ID NO: 2532018 - DNA, 14 bp, Homo sapiens
ggcagccaggccac

SEQ ID NO: 2532019 - DNA, 16 bp, Homo sapiens
ggcagccccattctgc

SEQ ID NO: 2532020 - DNA, 18 bp, Homo sapiens
ggcagcgcggggagcccg

SEQ ID NO: 2532021 - DNA, 14 bp, Homo sapiens
ggcagctcacctct

SEQ ID NO: 2532022 - DNA, 18 bp, Homo sapiens
ggcagctcacctctccct

SEQ ID NO: 2532023 - DNA, 13 bp, Homo sapiens
ggcagctcagaga

SEQ ID NO: 2532024 - DNA, 11 bp, Homo sapiens
ggcagctctcc

SEQ ID NO: 2532025 - DNA, 13 bp, Homo sapiens
ggcagctctccag

SEQ ID NO: 2532026 - DNA, 17 bp, Homo sapiens
ggcagctgaccatggaa

SEQ ID NO: 2532027 - DNA, 13 bp, Homo sapiens
ggcagctgggccc

SEQ ID NO: 2532028 - DNA, 18 bp, Homo sapiens
ggcagctgggcccaaccc

SEQ ID NO: 2532029 - DNA, 20 bp, Homo sapiens
ggcagcttctattagccagt

SEQ ID NO: 2532030 - DNA, 18 bp, Homo sapiens
ggcagcttgccccggccc

SEQ ID NO: 2532031 - DNA, 21 bp, Homo sapiens
ggcagctttaaccattaaaac

SEQ ID NO: 2532032 - DNA, 21 bp, Homo sapiens
ggcaggacaacgaggaagccc

SEQ ID NO: 2532033 - DNA, 23 bp, Homo sapiens
ggcaggacatgctgaagccaaag

SEQ ID NO: 2532034 - DNA, 14 bp, Homo sapiens
ggcaggaccaggac

SEQ ID NO: 2532035 - DNA, 15 bp, Homo sapiens
ggcaggatggcctgg

SEQ ID NO: 2532036 - DNA, 19 bp, Homo sapiens
ggcaggatggcctggccag

SEQ ID NO: 2532037 - DNA, 13 bp, Homo sapiens
ggcaggcagcgcc

SEQ ID NO: 2532038 - DNA, 15 bp, Homo sapiens
ggcaggcagcgccaa

SEQ ID NO: 2532039 - DNA, 22 bp, Homo sapiens
ggcaggctaaggcgtggagctg

SEQ ID NO: 2532040 - DNA, 19 bp, Homo sapiens
ggcagggtctcactctgtc

SEQ ID NO: 2532041 - DNA, 14 bp, Homo sapiens
ggcagggtgaccct

SEQ ID NO: 2532042 - DNA, 14 bp, Homo sapiens
ggcaggtgcctcca

SEQ ID NO: 2532043 - DNA, 16 bp, Homo sapiens
ggcaggtgcctccagg

SEQ ID NO: 2532044 - DNA, 21 bp, Homo sapiens
ggcaggtgcctccaggtgtgc

SEQ ID NO: 2532045 - DNA, 17 bp, Homo sapiens
ggcaggtggtggcactg

SEQ ID NO: 2532046 - DNA, 22 bp, Homo sapiens
ggcaggtggtggcactgagccc

SEQ ID NO: 2532047 - DNA, 16 bp, Homo sapiens
ggcaggttagaaccta

SEQ ID NO: 2532048 - DNA, 17 bp, Homo sapiens
ggcaggttggtgggggc

SEQ ID NO: 2532049 - DNA, 14 bp, Homo sapiens
ggcagtcgggggct

SEQ ID NO: 2532050 - DNA, 18 bp, Homo sapiens
ggcagtcgggggctggcc

SEQ ID NO: 2532051 - DNA, 18 bp, Homo sapiens
ggcagtgatgctggatgc

SEQ ID NO: 2532052 - DNA, 21 bp, Homo sapiens
ggcagtggtggttttctgttc

SEQ ID NO: 2532053 - DNA, 11 bp, Homo sapiens
ggcagttacat

SEQ ID NO: 2532054 - DNA, 15 bp, Homo sapiens
ggcagttctgggtgc

SEQ ID NO: 2532055 - DNA, 21 bp, Homo sapiens
ggcatacgcctgtagtcctag

SEQ ID NO: 2532056 - DNA, 21 bp, Homo sapiens
ggcatagctccccgcttctgc

SEQ ID NO: 2532057 - DNA, 21 bp, Homo sapiens
ggcatcacatgctcaatgact

SEQ ID NO: 2532058 - DNA, 18 bp, Homo sapiens
ggcatcaccttaggcagg

SEQ ID NO: 2532059 - DNA, 20 bp, Homo sapiens
ggcatcaccttaggcaggga

SEQ ID NO: 2532060 - DNA, 23 bp, Homo sapiens
ggcatcaccttaggcagggaagt

SEQ ID NO: 2532061 - DNA, 13 bp, Homo sapiens
ggcatcagctggc

SEQ ID NO: 2532062 - DNA, 20 bp, Homo sapiens
ggcatccttcctcacaccag

SEQ ID NO: 2532063 - DNA, 22 bp, Homo sapiens
ggctccagagggcactctgctt

SEQ ID NO: 2532064 - DNA, 18 bp, Homo sapiens
ggctccaggagcagccac

SEQ ID NO: 2532065 - DNA, 14 bp, Homo sapiens
ggctccaggctcct

SEQ ID NO: 2532066 - DNA, 15 bp, Homo sapiens
ggctccaggctcctt

SEQ ID NO: 2532067 - DNA, 18 bp, Homo sapiens
ggctccagtctgctgccc

SEQ ID NO: 2532068 - DNA, 11 bp, Homo sapiens
ggctcccctct

SEQ ID NO: 2532069 - DNA, 17 bp, Homo sapiens
ggctccctgactgggag

SEQ ID NO: 2532070 - DNA, 21 bp, Homo sapiens
ggctcccttcatctccaggga

SEQ ID NO: 2532071 - DNA, 16 bp, Homo sapiens
ggctcccttcccacct

SEQ ID NO: 2532072 - DNA, 13 bp, Homo sapiens
ggctcctgtgcta

SEQ ID NO: 2532073 - DNA, 12 bp, Homo sapiens
ggctcctttctc

SEQ ID NO: 2532074 - DNA, 18 bp, Homo sapiens
ggctcgagcatgcctgga

SEQ ID NO: 2532075 - DNA, 16 bp, Homo sapiens
ggctcgccatgccggg

SEQ ID NO: 2532076 - DNA, 16 bp, Homo sapiens
ggctcggaggctgccc

SEQ ID NO: 2532077 - DNA, 17 bp, Homo sapiens
ggctcggaggctgcccc

SEQ ID NO: 2532078 - DNA, 22 bp, Homo sapiens
ggctcgtcggggggacagctcc

SEQ ID NO: 2532079 - DNA, 12 bp, Homo sapiens
ggctctcagctc

SEQ ID NO: 2532080 - DNA, 19 bp, Homo sapiens
ggctctcagctcagcgcca

SEQ ID NO: 2532081 - DNA, 20 bp, Homo sapiens
ggctctccaagtgccagagg

SEQ ID NO: 2532082 - DNA, 12 bp, Homo sapiens
ggctctctccag

SEQ ID NO: 2532083 - DNA, 20 bp, Homo sapiens
ggctctgaggtgcctgtccc

SEQ ID NO: 2532084 - DNA, 23 bp, Homo sapiens
ggctctgaggtgcctgtcccacc

SEQ ID NO: 2532085 - DNA, 19 bp, Homo sapiens
ggctctgcaattcccctct

SEQ ID NO: 2532086 - DNA, 18 bp, Homo sapiens
ggctctgccccagaggcc

SEQ ID NO: 2532087 - DNA, 21 bp, Homo sapiens
ggctctgccccagctctggct

SEQ ID NO: 2532088 - DNA, 15 bp, Homo sapiens
ggctctgcctcccat

SEQ ID NO: 2532089 - DNA, 17 bp, Homo sapiens
ggctctgcctcccatca

SEQ ID NO: 2532090 - DNA, 18 bp, Homo sapiens
ggctctgtgctgaccctc

SEQ ID NO: 2532091 - DNA, 14 bp, Homo sapiens
ggctcttccaggct

SEQ ID NO: 2532092 - DNA, 17 bp, Homo sapiens
ggctcttccaggctggg

SEQ ID NO: 2532093 - DNA, 23 bp, Homo sapiens
ggctcttccaggctgggagagcc

SEQ ID NO: 2532094 - DNA, 21 bp, Homo sapiens
ggctcttgatacccccctctg

SEQ ID NO: 2532095 - DNA, 22 bp, Homo sapiens
ggctctttggggtcagccaggg

SEQ ID NO: 2532096 - DNA, 24 bp, Homo sapiens
ggctgaaagaacatggacttgtat

SEQ ID NO: 2532097 - DNA, 21 bp, Homo sapiens
ggctgaacactccaattaagg

SEQ ID NO: 2532098 - DNA, 17 bp, Homo sapiens
ggctgaaccctgtgctg

SEQ ID NO: 2532099 - DNA, 22 bp, Homo sapiens
ggctgaaccctgtgctggtgtc

SEQ ID NO: 2532100 - DNA, 23 bp, Homo sapiens
ggctgaaccctgtgctggtgtcc

SEQ ID NO: 2532101 - DNA, 13 bp, Homo sapiens
ggctgaaggactg

SEQ ID NO: 2532102 - DNA, 18 bp, Homo sapiens
ggctgacatctgtgtttc

SEQ ID NO: 2532103 - DNA, 22 bp, Homo sapiens
ggctgacggtgcagtctgggtg

SEQ ID NO: 2532104 - DNA, 19 bp, Homo sapiens
ggctgactagaagggccag

SEQ ID NO: 2532105 - DNA, 18 bp, Homo sapiens
ggctgagacaggagaatc

SEQ ID NO: 2532106 - DNA, 21 bp, Homo sapiens
ggctgagactgcgggatggtc

SEQ ID NO: 2532107 - DNA, 13 bp, Homo sapiens
ggctgagactgga

SEQ ID NO: 2532108 - DNA, 21 bp, Homo sapiens
ggctgagactggatactgccc

SEQ ID NO: 2532109 - DNA, 14 bp, Homo sapiens
ggctgagagcccca

SEQ ID NO: 2532110 - DNA, 16 bp, Homo sapiens
ggctgagagccccagc

SEQ ID NO: 2532111 - DNA, 15 bp, Homo sapiens
ggctgagatatgaac

SEQ ID NO: 2532112 - DNA, 22 bp, Homo sapiens
ggctgagcccctaccccacacc

SEQ ID NO: 2532113 - DNA, 19 bp, Homo sapiens
ggctgagcggatgcatctg

SEQ ID NO: 2532114 - DNA, 16 bp, Homo sapiens
ggctgaggaggcctcc

SEQ ID NO: 2532115 - DNA, 14 bp, Homo sapiens
ggctgaggcaggag

SEQ ID NO: 2532116 - DNA, 16 bp, Homo sapiens
ggctgagggagcctgg

SEQ ID NO: 2532117 - DNA, 19 bp, Homo sapiens
ggctgataattccagtggt

SEQ ID NO: 2532118 - DNA, 22 bp, Homo sapiens
ggctgatgccaagttgtttgag

SEQ ID NO: 2532119 - DNA, 18 bp, Homo sapiens
ggctgcaaagggtatcag

SEQ ID NO: 2532120 - DNA, 24 bp, Homo sapiens
ggctgcaaagggtatcaggtgctg

SEQ ID NO: 2532121 - DNA, 18 bp, Homo sapiens
ggctgcaccggctggcct

SEQ ID NO: 2532122 - DNA, 12 bp, Homo sapiens
ggctgcagcatg

SEQ ID NO: 2532123 - DNA, 12 bp, Homo sapiens
ggctgcagggag

SEQ ID NO: 2532124 - DNA, 22 bp, Homo sapiens
ggctgcagtgacgtgcacctgt

SEQ ID NO: 2532125 - DNA, 15 bp, Homo sapiens
ggctgccaaggccag

SEQ ID NO: 2532126 - DNA, 19 bp, Homo sapiens
ggctgccccaacctgctga

SEQ ID NO: 2532127 - DNA, 11 bp, Homo sapiens
ggctgccctgg

SEQ ID NO: 2532128 - DNA, 19 bp, Homo sapiens
ggctgccctggccctgagg

SEQ ID NO: 2532129 - DNA, 20 bp, Homo sapiens
ggctgccctggccctgaggt

SEQ ID NO: 2532130 - DNA, 11 bp, Homo sapiens
ggctgcctggg

SEQ ID NO: 2532131 - DNA, 22 bp, Homo sapiens
ggctgcggaatgaaccacatct

SEQ ID NO: 2532132 - DNA, 15 bp, Homo sapiens
ggctgctacccagaa

SEQ ID NO: 2532133 - DNA, 16 bp, Homo sapiens
ggctgctacccagaaa

SEQ ID NO: 2532134 - DNA, 13 bp, Homo sapiens
ggctgctgaaggc

SEQ ID NO: 2532135 - DNA, 15 bp, Homo sapiens
ggctgctgaaggctc

SEQ ID NO: 2532136 - DNA, 17 bp, Homo sapiens
ggctgctgaaggctcga

SEQ ID NO: 2532137 - DNA, 18 bp, Homo sapiens
ggctggaatctggagagc

SEQ ID NO: 2532138 - DNA, 23 bp, Homo sapiens
ggctggagcccagggagcggaaa

SEQ ID NO: 2532139 - DNA, 19 bp, Homo sapiens
ggctggagtggagtggcgt

SEQ ID NO: 2532140 - DNA, 20 bp, Homo sapiens
ggctggagttcagtggtgtg

SEQ ID NO: 2532141 - DNA, 18 bp, Homo sapiens
ggctggatgtggtggcat

SEQ ID NO: 2532142 - DNA, 19 bp, Homo sapiens
ggctggcaccgccttctct

SEQ ID NO: 2532143 - DNA, 15 bp, Homo sapiens
ggctggcagctctcc

SEQ ID NO: 2532144 - DNA, 18 bp, Homo sapiens
ggctggcagctctccagt

SEQ ID NO: 2532145 - DNA, 14 bp, Homo sapiens
ggctggcccagccc

SEQ ID NO: 2532146 - DNA, 15 bp, Homo sapiens
ggctggcccagccct

SEQ ID NO: 2532147 - DNA, 18 bp, Homo sapiens
ggctggcccagccctgct

SEQ ID NO: 2532148 - DNA, 21 bp, Homo sapiens
ggctggcctaggagatatctg

SEQ ID NO: 2532149 - DNA, 14 bp, Homo sapiens
ggctggcctggccc

SEQ ID NO: 2532150 - DNA, 17 bp, Homo sapiens
ggctggcctggcccctc

SEQ ID NO: 2532151 - DNA, 22 bp, Homo sapiens
ggctggcctggcccctcagggt

SEQ ID NO: 2532152 - DNA, 14 bp, Homo sapiens
ggctggcgtgcagt

SEQ ID NO: 2532153 - DNA, 16 bp, Homo sapiens
ggctggctccctcttg

SEQ ID NO: 2532154 - DNA, 23 bp, Homo sapiens
ggctgggaactgcagacctgtcc

SEQ ID NO: 2532155 - DNA, 16 bp, Homo sapiens
ggctgggagagccttc

SEQ ID NO: 2532156 - DNA, 18 bp, Homo sapiens
ggctgggagagccttcca

SEQ ID NO: 2532157 - DNA, 23 bp, Homo sapiens
ggctgggagagccttccaggggt

SEQ ID NO: 2532158 - DNA, 15 bp, Homo sapiens
ggctgggagctctgc

SEQ ID NO: 2532159 - DNA, 12 bp, Homo sapiens
ggctgggcagct

SEQ ID NO: 2532160 - DNA, 12 bp, Homo sapiens
ggctgggcttca

SEQ ID NO: 2532161 - DNA, 17 bp, Homo sapiens
ggctggggaagtcctct

SEQ ID NO: 2532162 - DNA, 18 bp, Homo sapiens
ggctgggggcaggagggc

SEQ ID NO: 2532163 - DNA, 15 bp, Homo sapiens
ggctgggggcctcag

SEQ ID NO: 2532164 - DNA, 19 bp, Homo sapiens
ggctgggttctacccaggt

SEQ ID NO: 2532165 - DNA, 19 bp, Homo sapiens
ggctggtaacagttcatgt

SEQ ID NO: 2532166 - DNA, 16 bp, Homo sapiens
ggctggtagctcaggt

SEQ ID NO: 2532167 - DNA, 21 bp, Homo sapiens
ggctggtagctcaggtgggcg

SEQ ID NO: 2532168 - DNA, 10 bp, Homo sapiens
ggctggtgcc

SEQ ID NO: 2532169 - DNA, 19 bp, Homo sapiens
ggctggtgctgtggccagg

SEQ ID NO: 2532170 - DNA, 21 bp, Homo sapiens
ggctggttttgtaagatgctg

SEQ ID NO: 2532171 - DNA, 21 bp, Homo sapiens
ggctgtaggactcgcagtcag

SEQ ID NO: 2532172 - DNA, 18 bp, Homo sapiens
ggctgtatcccatgagcc

SEQ ID NO: 2532173 - DNA, 22 bp, Homo sapiens
ggctgtatcccatgagcctcag

SEQ ID NO: 2532174 - DNA, 11 bp, Homo sapiens
ggctgtgagtg

SEQ ID NO: 2532175 - DNA, 16 bp, Homo sapiens
ggctgtgcctctgcct

SEQ ID NO: 2532176 - DNA, 17 bp, Homo sapiens
ggctgttggcactcaca

SEQ ID NO: 2532177 - DNA, 15 bp, Homo sapiens
ggctgttggctgggg

SEQ ID NO: 2532178 - DNA, 16 bp, Homo sapiens
ggctgttggctggggg

SEQ ID NO: 2532179 - DNA, 14 bp, Homo sapiens
ggctgtttgaggat

SEQ ID NO: 2532180 - DNA, 19 bp, Homo sapiens
ggcttaagaaatctagtat

SEQ ID NO: 2532181 - DNA, 14 bp, Homo sapiens
ggcttaatgtttat

SEQ ID NO: 2532182 - DNA, 13 bp, Homo sapiens
ggcttacacccac

SEQ ID NO: 2532183 - DNA, 18 bp, Homo sapiens
ggcttagctttgctctgc

SEQ ID NO: 2532184 - DNA, 22 bp, Homo sapiens
ggcttcaaccttgagacagctt

SEQ ID NO: 2532185 - DNA, 12 bp, Homo sapiens
ggcttcacagat

SEQ ID NO: 2532186 - DNA, 20 bp, Homo sapiens
ggcttcacggaagagccttg

SEQ ID NO: 2532187 - DNA, 15 bp, Homo sapiens
ggcttcactgtataa

SEQ ID NO: 2532188 - DNA, 17 bp, Homo sapiens
ggcttcagtggcagctg

SEQ ID NO: 2532189 - DNA, 20 bp, Homo sapiens
ggcttcagtggcagctgctt

SEQ ID NO: 2532190 - DNA, 18 bp, Homo sapiens
ggcttcattagagcaggc

SEQ ID NO: 2532191 - DNA, 14 bp, Homo sapiens
ggcttccagagagt

SEQ ID NO: 2532192 - DNA, 20 bp, Homo sapiens
ggcttccagagagtcctctg

SEQ ID NO: 2532193 - DNA, 17 bp, Homo sapiens
ggcttccatttgtgtgt

SEQ ID NO: 2532194 - DNA, 21 bp, Homo sapiens
ggcttctcatacgtccaccat

SEQ ID NO: 2532195 - DNA, 13 bp, Homo sapiens
ggcttctggagcc

SEQ ID NO: 2532196 - DNA, 20 bp, Homo sapiens
ggcttctggagcccttgggt

SEQ ID NO: 2532197 - DNA, 14 bp, Homo sapiens
ggcttgcatgccaa

SEQ ID NO: 2532198 - DNA, 13 bp, Homo sapiens
ggcttgctgagag

SEQ ID NO: 2532199 - DNA, 15 bp, Homo sapiens
ggcttggggcttcct

SEQ ID NO: 2532200 - DNA, 15 bp, Homo sapiens
ggcttgtcagagctg

SEQ ID NO: 2532201 - DNA, 16 bp, Homo sapiens
ggcttgtcagagctgg

SEQ ID NO: 2532202 - DNA, 12 bp, Homo sapiens
ggctttctggag

SEQ ID NO: 2532203 - DNA, 14 bp, Homo sapiens
ggcttttgtgcatt

SEQ ID NO: 2532204 - DNA, 23 bp, Homo sapiens
gggaaaaagaggatctggagaac

SEQ ID NO: 2532205 - DNA, 23 bp, Homo sapiens
gggaaaatcagcctgctccagct

SEQ ID NO: 2532206 - DNA, 17 bp, Homo sapiens
gggaaaattatttgcat

SEQ ID NO: 2532207 - DNA, 18 bp, Homo sapiens
gggaaaattatttgcata

SEQ ID NO: 2532208 - DNA, 16 bp, Homo sapiens
ggtccatgggcagagc

SEQ ID NO: 2532209 - DNA, 22 bp, Homo sapiens
ggtcccaacaggaggacaattc

SEQ ID NO: 2532210 - DNA, 20 bp, Homo sapiens
ggtcccaagctgggccccag

SEQ ID NO: 2532211 - DNA, 21 bp, Homo sapiens
ggtcccaagctgggccccagc

SEQ ID NO: 2532212 - DNA, 23 bp, Homo sapiens
ggtcccaagctgggccccagccc

SEQ ID NO: 2532213 - DNA, 14 bp, Homo sapiens
ggtcccaccccaca

SEQ ID NO: 2532214 - DNA, 12 bp, Homo sapiens
ggtcccactcag

SEQ ID NO: 2532215 - DNA, 14 bp, Homo sapiens
ggtcccagccaccc

SEQ ID NO: 2532216 - DNA, 11 bp, Homo sapiens
ggtcccagtgg

SEQ ID NO: 2532217 - DNA, 15 bp, Homo sapiens
ggtcccagtgggagg

SEQ ID NO: 2532218 - DNA, 12 bp, Homo sapiens
ggtcccatccag

SEQ ID NO: 2532219 - DNA, 13 bp, Homo sapiens
ggtcccccttcca

SEQ ID NO: 2532220 - DNA, 18 bp, Homo sapiens
ggtcccccttccatggac

SEQ ID NO: 2532221 - DNA, 21 bp, Homo sapiens
ggtcccgtgcagcttctgtcc

SEQ ID NO: 2532222 - DNA, 23 bp, Homo sapiens
ggtccctgataacaacctggaga

SEQ ID NO: 2532223 - DNA, 23 bp, Homo sapiens
ggtccctgggaggaaatttgaat

SEQ ID NO: 2532224 - DNA, 22 bp, Homo sapiens
ggtccctggtggcagctcacct

SEQ ID NO: 2532225 - DNA, 20 bp, Homo sapiens
ggtccggacactcctagaga

SEQ ID NO: 2532226 - DNA, 22 bp, Homo sapiens
ggtcctaccaatagattcccca

SEQ ID NO: 2532227 - DNA, 15 bp, Homo sapiens
ggtcctcttgcctcc

SEQ ID NO: 2532228 - DNA, 19 bp, Homo sapiens
ggtcctgcagtctggctga

SEQ ID NO: 2532229 - DNA, 11 bp, Homo sapiens
ggtcctgctgc

SEQ ID NO: 2532230 - DNA, 17 bp, Homo sapiens
ggtcctggagcagacca

SEQ ID NO: 2532231 - DNA, 15 bp, Homo sapiens
ggtcctggctcctga

SEQ ID NO: 2532232 - DNA, 16 bp, Homo sapiens
ggtcctggctcctgag

SEQ ID NO: 2532233 - DNA, 14 bp, Homo sapiens
ggtcctggggcctc

SEQ ID NO: 2532234 - DNA, 23 bp, Homo sapiens
ggtcctggggctctgtgcaggga

SEQ ID NO: 2532235 - DNA, 13 bp, Homo sapiens
ggtcctgtggcag

SEQ ID NO: 2532236 - DNA, 16 bp, Homo sapiens
ggtcctgtggcaggca

SEQ ID NO: 2532237 - DNA, 18 bp, Homo sapiens
ggtcctgtggcaggcagc

SEQ ID NO: 2532238 - DNA, 21 bp, Homo sapiens
ggtccttcaagttagctcagg

SEQ ID NO: 2532239 - DNA, 15 bp, Homo sapiens
ggtcctttggggtga

SEQ ID NO: 2532240 - DNA, 12 bp, Homo sapiens
ggtcgcccagga

SEQ ID NO: 2532241 - DNA, 14 bp, Homo sapiens
ggtcgcccaggaga

SEQ ID NO: 2532242 - DNA, 16 bp, Homo sapiens
ggtcggaggcttggga

SEQ ID NO: 2532243 - DNA, 17 bp, Homo sapiens
ggtctacactgtgctga

SEQ ID NO: 2532244 - DNA, 19 bp, Homo sapiens
ggtctattgtctgtatttg

SEQ ID NO: 2532245 - DNA, 23 bp, Homo sapiens
ggtctcactctgtcgcccagtct

SEQ ID NO: 2532246 - DNA, 16 bp, Homo sapiens
ggtctcccacgtggga

SEQ ID NO: 2532247 - DNA, 19 bp, Homo sapiens
ggtctcgctttgttgccca

SEQ ID NO: 2532248 - DNA, 20 bp, Homo sapiens
ggtctcgctttgttgcccag

SEQ ID NO: 2532249 - DNA, 15 bp, Homo sapiens
ggtctctaggctggg

SEQ ID NO: 2532250 - DNA, 17 bp, Homo sapiens
ggtctctaggctgggga

SEQ ID NO: 2532251 - DNA, 18 bp, Homo sapiens
ggtctctaggctggggaa

SEQ ID NO: 2532252 - DNA, 16 bp, Homo sapiens
ggtctctagtgctgtg

SEQ ID NO: 2532253 - DNA, 19 bp, Homo sapiens
ggtctctagtgctgtgaaa

SEQ ID NO: 2532254 - DNA, 19 bp, Homo sapiens
ggtctctctctctctacaa

SEQ ID NO: 2532255 - DNA, 15 bp, Homo sapiens
ggtctcttgagggag

SEQ ID NO: 2532256 - DNA, 12 bp, Homo sapiens
ggtctgaaatgg

SEQ ID NO: 2532257 - DNA, 13 bp, Homo sapiens
ggtctgaaatgga

SEQ ID NO: 2532258 - DNA, 11 bp, Homo sapiens
ggtctgaatgt

SEQ ID NO: 2532259 - DNA, 12 bp, Homo sapiens
ggtctgaatgtt

SEQ ID NO: 2532260 - DNA, 19 bp, Homo sapiens
ggtctgaggaatccagacc

SEQ ID NO: 2532261 - DNA, 16 bp, Homo sapiens
ggtctgcaagtcagag

SEQ ID NO: 2532262 - DNA, 20 bp, Homo sapiens
ggtctgcaagtcagaggatg

SEQ ID NO: 2532263 - DNA, 23 bp, Homo sapiens
ggtctgcaggcagggctgactct

SEQ ID NO: 2532264 - DNA, 23 bp, Homo sapiens
ggtctggagaagctcccaggaac

SEQ ID NO: 2532265 - DNA, 14 bp, Homo sapiens
ggtctgtcccacca

SEQ ID NO: 2532266 - DNA, 15 bp, Homo sapiens
ggtctgtcccaccag

SEQ ID NO: 2532267 - DNA, 13 bp, Homo sapiens
ggtctgtgtctct

SEQ ID NO: 2532268 - DNA, 11 bp, Homo sapiens
ggtctgtgtgt

SEQ ID NO: 2532269 - DNA, 13 bp, Homo sapiens
ggtctgttcttga

SEQ ID NO: 2532270 - DNA, 20 bp, Homo sapiens
ggtcttcccaggctggggct

SEQ ID NO: 2532271 - DNA, 22 bp, Homo sapiens
ggtcttcttacatgcatttgag

SEQ ID NO: 2532272 - DNA, 13 bp, Homo sapiens
ggtcttgatctcc

SEQ ID NO: 2532273 - DNA, 13 bp, Homo sapiens
ggtctttgtaaga

SEQ ID NO: 2532274 - DNA, 14 bp, Homo sapiens
ggtctttgtaagag

SEQ ID NO: 2532275 - DNA, 17 bp, Homo sapiens
ggtcttttgacatgtgg

SEQ ID NO: 2532276 - DNA, 17 bp, Homo sapiens
ggtctttttatgcattt

SEQ ID NO: 2532277 - DNA, 13 bp, Homo sapiens
ggtgaaagggagc

SEQ ID NO: 2532278 - DNA, 16 bp, Homo sapiens
ggtgaagaaaactcct

SEQ ID NO: 2532279 - DNA, 17 bp, Homo sapiens
ggtgaagctatttatct

SEQ ID NO: 2532280 - DNA, 18 bp, Homo sapiens
ggtgaagctatttatctg

SEQ ID NO: 2532281 - DNA, 21 bp, Homo sapiens
ggtgaagctcacttctgggct

SEQ ID NO: 2532282 - DNA, 17 bp, Homo sapiens
ggtgacaagatagagag

SEQ ID NO: 2532283 - DNA, 16 bp, Homo sapiens
ggtgacaccagccttt

SEQ ID NO: 2532284 - DNA, 21 bp, Homo sapiens
ggtgacagagtgagactctgt

SEQ ID NO: 2532285 - DNA, 18 bp, Homo sapiens
ggtgacatgtgaaacctt

SEQ ID NO: 2532286 - DNA, 14 bp, Homo sapiens
ggtgacctctgcct

SEQ ID NO: 2532287 - DNA, 23 bp, Homo sapiens
ggtgagcacggccaacaaagctg

SEQ ID NO: 2532288 - DNA, 13 bp, Homo sapiens
ggtgagggatgtg

SEQ ID NO: 2532289 - DNA, 20 bp, Homo sapiens
ggtgagtcttggcggcagca

SEQ ID NO: 2532290 - DNA, 19 bp, Homo sapiens
ggtgatcaattaaatgtag

SEQ ID NO: 2532291 - DNA, 15 bp, Homo sapiens
ggtgatgctgggctg

SEQ ID NO: 2532292 - DNA, 17 bp, Homo sapiens
ggtgcatgatcttgagc

SEQ ID NO: 2532293 - DNA, 19 bp, Homo sapiens
ggtgcattacagagaggag

SEQ ID NO: 2532294 - DNA, 18 bp, Homo sapiens
ggtgccacaaataaaatg

SEQ ID NO: 2532295 - DNA, 19 bp, Homo sapiens
ggtgccagcaactgaataa

SEQ ID NO: 2532296 - DNA, 23 bp, Homo sapiens
ggtgccagccttcctctgcagct

SEQ ID NO: 2532297 - DNA, 21 bp, Homo sapiens
ggtgccaggttttctgggtgt

SEQ ID NO: 2532298 - DNA, 22 bp, Homo sapiens
ggtgcccaagctcagaaggctc

SEQ ID NO: 2532299 - DNA, 22 bp, Homo sapiens
ggtgccccctcctctcccatcc

SEQ ID NO: 2532300 - DNA, 17 bp, Homo sapiens
ggtgcccttggaggcca

SEQ ID NO: 2532301 - DNA, 18 bp, Homo sapiens
ggtgcccttggaggccag

SEQ ID NO: 2532302 - DNA, 21 bp, Homo sapiens
ggtgcctaggattgtgcctgt

SEQ ID NO: 2532303 - DNA, 13 bp, Homo sapiens
ggtgcctccaggt

SEQ ID NO: 2532304 - DNA, 17 bp, Homo sapiens
ggtgcctccaggtgtgc

SEQ ID NO: 2532305 - DNA, 20 bp, Homo sapiens
ggtgctaaatggtcgcccag

SEQ ID NO: 2532306 - DNA, 22 bp, Homo sapiens
ggtgctaaatggtcgcccagga

SEQ ID NO: 2532307 - DNA, 19 bp, Homo sapiens
ggtgctacaaaaacacagc

SEQ ID NO: 2532308 - DNA, 21 bp, Homo sapiens
ggtgctataggctggagaagc

SEQ ID NO: 2532309 - DNA, 21 bp, Homo sapiens
ggtgctgccatccaggttcag

SEQ ID NO: 2532310 - DNA, 14 bp, Homo sapiens
ggtgctgcttccct

SEQ ID NO: 2532311 - DNA, 21 bp, Homo sapiens
ggtgctgcttccctctgcctg

SEQ ID NO: 2532312 - DNA, 16 bp, Homo sapiens
ggtgctggatattttc

SEQ ID NO: 2532313 - DNA, 19 bp, Homo sapiens
ggtgctgggactgagccag

SEQ ID NO: 2532314 - DNA, 24 bp, Homo sapiens
ggtgctgggactgagccagtccca

SEQ ID NO: 2532315 - DNA, 21 bp, Homo sapiens
ggtgcttgttccctctccctg

SEQ ID NO: 2532316 - DNA, 16 bp, Homo sapiens
ggtggacagtcctggg

SEQ ID NO: 2532317 - DNA, 16 bp, Homo sapiens
ggtggagaaagcactg

SEQ ID NO: 2532318 - DNA, 11 bp, Homo sapiens
ggtggagaagc

SEQ ID NO: 2532319 - DNA, 20 bp, Homo sapiens
ggtggagggtggggggcgct

SEQ ID NO: 2532320 - DNA, 17 bp, Homo sapiens
ggtggcaaggctgtgct

SEQ ID NO: 2532321 - DNA, 20 bp, Homo sapiens
ggtggcaaggctgtgctccc

SEQ ID NO: 2532322 - DNA, 17 bp, Homo sapiens
ggtggcacaggccccct

SEQ ID NO: 2532323 - DNA, 11 bp, Homo sapiens
ggtggcagctg

SEQ ID NO: 2532324 - DNA, 15 bp, Homo sapiens
ggtggcaggaccagg

SEQ ID NO: 2532325 - DNA, 22 bp, Homo sapiens
ggtggcagtgggagctgcctgt

SEQ ID NO: 2532326 - DNA, 15 bp, Homo sapiens
ggtggcatacgcctg

SEQ ID NO: 2532327 - DNA, 13 bp, Homo sapiens
ggtggcatcccag

SEQ ID NO: 2532328 - DNA, 18 bp, Homo sapiens
ggtggccatttagccacc

SEQ ID NO: 2532329 - DNA, 13 bp, Homo sapiens
ggtggcctcccaa

SEQ ID NO: 2532330 - DNA, 19 bp, Homo sapiens
ggtggcgggcacctatagt

SEQ ID NO: 2532331 - DNA, 22 bp, Homo sapiens
ggtgggaaatggtatgagctga

SEQ ID NO: 2532332 - DNA, 21 bp, Homo sapiens
ggtgggaaccatgaagacagg

SEQ ID NO: 2532333 - DNA, 16 bp, Homo sapiens
ggtgggacaccctgtg

SEQ ID NO: 2532334 - DNA, 17 bp, Homo sapiens
ggtgggacaccctgtga

SEQ ID NO: 2532335 - DNA, 19 bp, Homo sapiens
ggtgggatcctccaggtgc

SEQ ID NO: 2532336 - DNA, 16 bp, Homo sapiens
ggtgggccagcccctc

SEQ ID NO: 2532337 - DNA, 17 bp, Homo sapiens
ggtgggcccaggaccag

SEQ ID NO: 2532338 - DNA, 14 bp, Homo sapiens
ggtgggcctctggt

SEQ ID NO: 2532339 - DNA, 20 bp, Homo sapiens
ggtgggcggcacagccttct

SEQ ID NO: 2532340 - DNA, 13 bp, Homo sapiens
ggtggggcagctt

SEQ ID NO: 2532341 - DNA, 17 bp, Homo sapiens
ggtggggcagcttgagg

SEQ ID NO: 2532342 - DNA, 13 bp, Homo sapiens
ggtgggggcctcg

SEQ ID NO: 2532343 - DNA, 15 bp, Homo sapiens
ggtggggtcactctg

SEQ ID NO: 2532344 - DNA, 14 bp, Homo sapiens
ggtggggtcctgga

SEQ ID NO: 2532345 - DNA, 10 bp, Homo sapiens
ggtgggtcca

SEQ ID NO: 2532346 - DNA, 20 bp, Homo sapiens
ggtgggtccatgggcagagc

SEQ ID NO: 2532347 - DNA, 14 bp, Homo sapiens
ggtgggtggtgggg

SEQ ID NO: 2532348 - DNA, 16 bp, Homo sapiens
ggtgggtggtggggag

SEQ ID NO: 2532349 - DNA, 14 bp, Homo sapiens
ggtggtcaggcgta

SEQ ID NO: 2532350 - DNA, 15 bp, Homo sapiens
ggtggtctgaatgtt

SEQ ID NO: 2532351 - DNA, 18 bp, Homo sapiens
ggtggtctgaatgttctg

SEQ ID NO: 2532352 - DNA, 23 bp, Homo sapiens
ggtggtgctgggactgagccagt

SEQ ID NO: 2532353 - DNA, 18 bp, Homo sapiens
gtcagcctccagcctctg

SEQ ID NO: 2532354 - DNA, 19 bp, Homo sapiens
gtcagcctccagcctctgt

SEQ ID NO: 2532355 - DNA, 22 bp, Homo sapiens
gtcagccttccccctcccaggg

SEQ ID NO: 2532356 - DNA, 18 bp, Homo sapiens
gtcagcgttgcatgtcgt

SEQ ID NO: 2532357 - DNA, 19 bp, Homo sapiens
gtcagcgttgcatgtcgtg

SEQ ID NO: 2532358 - DNA, 14 bp, Homo sapiens
gtcagctactaatg

SEQ ID NO: 2532359 - DNA, 22 bp, Homo sapiens
gtcagctcccctcggagaagag

SEQ ID NO: 2532360 - DNA, 16 bp, Homo sapiens
gtcagctcccttctct

SEQ ID NO: 2532361 - DNA, 17 bp, Homo sapiens
gtcaggaacagaaggat

SEQ ID NO: 2532362 - DNA, 18 bp, Homo sapiens
gtcaggaaggatgagcat

SEQ ID NO: 2532363 - DNA, 15 bp, Homo sapiens
gtcaggagagcagcg

SEQ ID NO: 2532364 - DNA, 19 bp, Homo sapiens
gtcaggagttagaggccag

SEQ ID NO: 2532365 - DNA, 23 bp, Homo sapiens
gtcaggagttagaggccagcctg

SEQ ID NO: 2532366 - DNA, 22 bp, Homo sapiens
gtcaggcccttattttcaagaa

SEQ ID NO: 2532367 - DNA, 23 bp, Homo sapiens
gtcaggcctgtgtgtgaaaggaa

SEQ ID NO: 2532368 - DNA, 22 bp, Homo sapiens
gtcaggctgctggcgcctctgc

SEQ ID NO: 2532369 - DNA, 21 bp, Homo sapiens
gtcagggaccaaggacccctc

SEQ ID NO: 2532370 - DNA, 18 bp, Homo sapiens
gtcagggacccctgccct

SEQ ID NO: 2532371 - DNA, 12 bp, Homo sapiens
gtcagggcccaa

SEQ ID NO: 2532372 - DNA, 14 bp, Homo sapiens
gtcagggcccaagt

SEQ ID NO: 2532373 - DNA, 21 bp, Homo sapiens
gtcagggcccaagtccctgtt

SEQ ID NO: 2532374 - DNA, 17 bp, Homo sapiens
gtcaggggcagctgacc

SEQ ID NO: 2532375 - DNA, 22 bp, Homo sapiens
gtcagtaccttcaaactagggc

SEQ ID NO: 2532376 - DNA, 22 bp, Homo sapiens
gtcagtcatgatggcaccactg

SEQ ID NO: 2532377 - DNA, 18 bp, Homo sapiens
gtcagtgcaaatgtcaga

SEQ ID NO: 2532378 - DNA, 16 bp, Homo sapiens
gtcagtgcagcccgtg

SEQ ID NO: 2532379 - DNA, 17 bp, Homo sapiens
gtcagtgtccaaagcag

SEQ ID NO: 2532380 - DNA, 20 bp, Homo sapiens
gtcagtgtccaaagcagggt

SEQ ID NO: 2532381 - DNA, 13 bp, Homo sapiens
gtcagttgtatca

SEQ ID NO: 2532382 - DNA, 15 bp, Homo sapiens
gtcataccaatgaaa

SEQ ID NO: 2532383 - DNA, 21 bp, Homo sapiens
gtcatataagattcatattta

SEQ ID NO: 2532384 - DNA, 16 bp, Homo sapiens
gtcatattttgattat

SEQ ID NO: 2532385 - DNA, 15 bp, Homo sapiens
gtcatcacttttcag

SEQ ID NO: 2532386 - DNA, 17 bp, Homo sapiens
gtcatcaggagaaaaag

SEQ ID NO: 2532387 - DNA, 22 bp, Homo sapiens
gtcatcttgaccaagcaggaag

SEQ ID NO: 2532388 - DNA, 16 bp, Homo sapiens
gtcatgagctgagcag

SEQ ID NO: 2532389 - DNA, 13 bp, Homo sapiens
gtcatgcataaat

SEQ ID NO: 2532390 - DNA, 14 bp, Homo sapiens
gtcatgcataaata

SEQ ID NO: 2532391 - DNA, 22 bp, Homo sapiens
gtcatggctgtgccctcttgat

SEQ ID NO: 2532392 - DNA, 19 bp, Homo sapiens
gtcattatccttgctatga

SEQ ID NO: 2532393 - DNA, 23 bp, Homo sapiens
gtcatttatatagattataactt

SEQ ID NO: 2532394 - DNA, 22 bp, Homo sapiens
gtcatttgctgagcatgtactg

SEQ ID NO: 2532395 - DNA, 21 bp, Homo sapiens
gtcattttttttaagaaaaag

SEQ ID NO: 2532396 - DNA, 14 bp, Homo sapiens
gtccaaactgccta

SEQ ID NO: 2532397 - DNA, 21 bp, Homo sapiens
gtccaaactgcctaagccctc

SEQ ID NO: 2532398 - DNA, 13 bp, Homo sapiens
gtccaaataaaaa

SEQ ID NO: 2532399 - DNA, 20 bp, Homo sapiens
gtccaagaagcccaggaaag

SEQ ID NO: 2532400 - DNA, 24 bp, Homo sapiens
gtccaagcataccaacacgagcag

SEQ ID NO: 2532401 - DNA, 16 bp, Homo sapiens
gtccaagtgtgtgtgc

SEQ ID NO: 2532402 - DNA, 17 bp, Homo sapiens
gtccacagatgcctcca

SEQ ID NO: 2532403 - DNA, 11 bp, Homo sapiens
gtccacccagc

SEQ ID NO: 2532404 - DNA, 14 bp, Homo sapiens
gtccacccagcaaa

SEQ ID NO: 2532405 - DNA, 15 bp, Homo sapiens
gtccacccaggagcc

SEQ ID NO: 2532406 - DNA, 16 bp, Homo sapiens
gtccacgactgtctcc

SEQ ID NO: 2532407 - DNA, 18 bp, Homo sapiens
gtccacgactgtctccat

SEQ ID NO: 2532408 - DNA, 12 bp, Homo sapiens
gtccactgtcac

SEQ ID NO: 2532409 - DNA, 20 bp, Homo sapiens
gtccagccgccattgccacc

SEQ ID NO: 2532410 - DNA, 15 bp, Homo sapiens
gtccaggcactgaga

SEQ ID NO: 2532411 - DNA, 17 bp, Homo sapiens
gtccaggccccaaaacc

SEQ ID NO: 2532412 - DNA, 17 bp, Homo sapiens
gtccagggccctgagct

SEQ ID NO: 2532413 - DNA, 14 bp, Homo sapiens
gtccaggggcccct

SEQ ID NO: 2532414 - DNA, 19 bp, Homo sapiens
gtccaggggcccctccagc

SEQ ID NO: 2532415 - DNA, 20 bp, Homo sapiens
gtccaggggcccctccagct

SEQ ID NO: 2532416 - DNA, 23 bp, Homo sapiens
gtccaggggcccctccagcttgt

SEQ ID NO: 2532417 - DNA, 13 bp, Homo sapiens
gtccatagagagc

SEQ ID NO: 2532418 - DNA, 14 bp, Homo sapiens
gtccatagagagca

SEQ ID NO: 2532419 - DNA, 22 bp, Homo sapiens
gtccatgaagatgtagaggaga

SEQ ID NO: 2532420 - DNA, 23 bp, Homo sapiens
gtccatgaagatgtagaggagaa

SEQ ID NO: 2532421 - DNA, 14 bp, Homo sapiens
gtccatggaatgct

SEQ ID NO: 2532422 - DNA, 18 bp, Homo sapiens
gtccatggaatgcttgaa

SEQ ID NO: 2532423 - DNA, 19 bp, Homo sapiens
gtccatgtggttcttcaaa

SEQ ID NO: 2532424 - DNA, 21 bp, Homo sapiens
gtccattgtccaatcctatgt

SEQ ID NO: 2532425 - DNA, 20 bp, Homo sapiens
gtcccaacaggaggacaatt

SEQ ID NO: 2532426 - DNA, 21 bp, Homo sapiens
gtcccaagctgggccccagcc

SEQ ID NO: 2532427 - DNA, 22 bp, Homo sapiens
gtcccaagctgggccccagccc

SEQ ID NO: 2532428 - DNA, 23 bp, Homo sapiens
gtcccaaggaaagccccagcact

SEQ ID NO: 2532429 - DNA, 21 bp, Homo sapiens
gtcccaccccacacacgccag

SEQ ID NO: 2532430 - DNA, 14 bp, Homo sapiens
gtcccacccccacc

SEQ ID NO: 2532431 - DNA, 23 bp, Homo sapiens
gtcccacccccacccccagctca

SEQ ID NO: 2532432 - DNA, 19 bp, Homo sapiens
gtcccacctcttctcttcc

SEQ ID NO: 2532433 - DNA, 23 bp, Homo sapiens
gtcccacctcttctcttcctgta

SEQ ID NO: 2532434 - DNA, 14 bp, Homo sapiens
gtcccaccttggct

SEQ ID NO: 2532435 - DNA, 15 bp, Homo sapiens
gtcccaccttggctg

SEQ ID NO: 2532436 - DNA, 16 bp, Homo sapiens
gtcccaccttggctgc

SEQ ID NO: 2532437 - DNA, 19 bp, Homo sapiens
gtcccaccttggctgcagg

SEQ ID NO: 2532438 - DNA, 20 bp, Homo sapiens
gtcccaccttggctgcaggg

SEQ ID NO: 2532439 - DNA, 21 bp, Homo sapiens
gtcccaccttggctgcaggga

SEQ ID NO: 2532440 - DNA, 17 bp, Homo sapiens
gtcccactgcctcaggt

SEQ ID NO: 2532441 - DNA, 19 bp, Homo sapiens
gtcccagagcaggaggccc

SEQ ID NO: 2532442 - DNA, 17 bp, Homo sapiens
gtcccagtctctggcag

SEQ ID NO: 2532443 - DNA, 20 bp, Homo sapiens
gtcccagtgggaggggcagg

SEQ ID NO: 2532444 - DNA, 22 bp, Homo sapiens
gtcccagtgggaggggcaggct

SEQ ID NO: 2532445 - DNA, 23 bp, Homo sapiens
gtcccagtgggaggggcaggctg

SEQ ID NO: 2532446 - DNA, 16 bp, Homo sapiens
gtcccataggcccagt

SEQ ID NO: 2532447 - DNA, 16 bp, Homo sapiens
gtcccatccaggcagt

SEQ ID NO: 2532448 - DNA, 20 bp, Homo sapiens
gtcccatgacccacccctgt

SEQ ID NO: 2532449 - DNA, 22 bp, Homo sapiens
gtcccatgacccacccctgtgc

SEQ ID NO: 2532450 - DNA, 21 bp, Homo sapiens
gtcccatggacactccagtgc

SEQ ID NO: 2532451 - DNA, 17 bp, Homo sapiens
gtccccaaacctgcaag

SEQ ID NO: 2532452 - DNA, 21 bp, Homo sapiens
gtccccaagattcacacctga

SEQ ID NO: 2532453 - DNA, 11 bp, Homo sapiens
gtccccacact

SEQ ID NO: 2532454 - DNA, 24 bp, Homo sapiens
gtccccacactcctacacctaact

SEQ ID NO: 2532455 - DNA, 19 bp, Homo sapiens
gtccccaggccccaggaag

SEQ ID NO: 2532456 - DNA, 20 bp, Homo sapiens
gtccccaggccccaggaagc

SEQ ID NO: 2532457 - DNA, 21 bp, Homo sapiens
gtccccaggccccaggaagcc

SEQ ID NO: 2532458 - DNA, 19 bp, Homo sapiens
gtccccatcatcccagctg

SEQ ID NO: 2532459 - DNA, 20 bp, Homo sapiens
gtccccatcatcccagctgc

SEQ ID NO: 2532460 - DNA, 14 bp, Homo sapiens
gtcccccagctctg

SEQ ID NO: 2532461 - DNA, 21 bp, Homo sapiens
gtccccctctgtccaggcact

SEQ ID NO: 2532462 - DNA, 18 bp, Homo sapiens
gtccccctgacaacactc

SEQ ID NO: 2532463 - DNA, 14 bp, Homo sapiens
gtcccctcccatct

SEQ ID NO: 2532464 - DNA, 16 bp, Homo sapiens
gtcccctcccatctgg

SEQ ID NO: 2532465 - DNA, 19 bp, Homo sapiens
gtcccctcccatctgggag

SEQ ID NO: 2532466 - DNA, 22 bp, Homo sapiens
gtcccctccccggccctaccag

SEQ ID NO: 2532467 - DNA, 23 bp, Homo sapiens
gtcccctgtttgtttctgaaagg

SEQ ID NO: 2532468 - DNA, 22 bp, Homo sapiens
gtcccctttgtattccttaaat

SEQ ID NO: 2532469 - DNA, 23 bp, Homo sapiens
gtcccggggtcctgtggcaggca

SEQ ID NO: 2532470 - DNA, 19 bp, Homo sapiens
gtcccgtcaggacgttgag

SEQ ID NO: 2532471 - DNA, 15 bp, Homo sapiens
gtccctaaagaaaaa

SEQ ID NO: 2532472 - DNA, 20 bp, Homo sapiens
gtccctcaaatgacccaaag

SEQ ID NO: 2532473 - DNA, 23 bp, Homo sapiens
gtccctccgggacctggtgctgc

SEQ ID NO: 2532474 - DNA, 13 bp, Homo sapiens
gtccctctcaggc

SEQ ID NO: 2532475 - DNA, 16 bp, Homo sapiens
gtccctgaagagaagg

SEQ ID NO: 2532476 - DNA, 17 bp, Homo sapiens
gtccctgactctctgtg

SEQ ID NO: 2532477 - DNA, 16 bp, Homo sapiens
gtccctgcacttgcag

SEQ ID NO: 2532478 - DNA, 19 bp, Homo sapiens
gtccctgcacttgcagact

SEQ ID NO: 2532479 - DNA, 21 bp, Homo sapiens
gtccctgcacttgcagactct

SEQ ID NO: 2532480 - DNA, 15 bp, Homo sapiens
gtccctgccaatgga

SEQ ID NO: 2532481 - DNA, 17 bp, Homo sapiens
gtccctggtggcagctc

SEQ ID NO: 2532482 - DNA, 19 bp, Homo sapiens
gtccctggtggcagctcac

SEQ ID NO: 2532483 - DNA, 15 bp, Homo sapiens
gtccctgttttctga

SEQ ID NO: 2532484 - DNA, 18 bp, Homo sapiens
gtcccttccacaccccca

SEQ ID NO: 2532485 - DNA, 20 bp, Homo sapiens
gtcccttccacacccccacc

SEQ ID NO: 2532486 - DNA, 14 bp, Homo sapiens
gtcccttcccctcc

SEQ ID NO: 2532487 - DNA, 19 bp, Homo sapiens
gtcccttcccctccctggc

SEQ ID NO: 2532488 - DNA, 17 bp, Homo sapiens
gtcccttgtttccagct

SEQ ID NO: 2532489 - DNA, 20 bp, Homo sapiens
gtccgccctgctcctccctg

SEQ ID NO: 2532490 - DNA, 17 bp, Homo sapiens
gtccggacactcctaga

SEQ ID NO: 2532491 - DNA, 18 bp, Homo sapiens
gtccggacactcctagag

SEQ ID NO: 2532492 - DNA, 12 bp, Homo sapiens
gtcctaggagta

SEQ ID NO: 2532493 - DNA, 20 bp, Homo sapiens
gtcctcaaggggccatcctg

SEQ ID NO: 2532494 - DNA, 18 bp, Homo sapiens
gtcctcacatctttcaca

SEQ ID NO: 2532495 - DNA, 14 bp, Homo sapiens
gtgcggctgtgcag

SEQ ID NO: 2532496 - DNA, 13 bp, Homo sapiens
gtgcgtgtgtaga

SEQ ID NO: 2532497 - DNA, 15 bp, Homo sapiens
gtgcgtgtgtagagt

SEQ ID NO: 2532498 - DNA, 21 bp, Homo sapiens
gtgctaaaaatgggacttctt

SEQ ID NO: 2532499 - DNA, 16 bp, Homo sapiens
gtgctaaattttcagt

SEQ ID NO: 2532500 - DNA, 15 bp, Homo sapiens
gtgctacaaaaacac

SEQ ID NO: 2532501 - DNA, 22 bp, Homo sapiens
gtgctacaaaaacacagcaagg

SEQ ID NO: 2532502 - DNA, 19 bp, Homo sapiens
gtgctataggctggagaag

SEQ ID NO: 2532503 - DNA, 13 bp, Homo sapiens
gtgctatgaattt

SEQ ID NO: 2532504 - DNA, 19 bp, Homo sapiens
gtgctatggatggcttcta

SEQ ID NO: 2532505 - DNA, 17 bp, Homo sapiens
gtgctcagttgtagaat

SEQ ID NO: 2532506 - DNA, 19 bp, Homo sapiens
gtgctcagttgtagaatgt

SEQ ID NO: 2532507 - DNA, 22 bp, Homo sapiens
gtgctcagttgtagaatgtatt

SEQ ID NO: 2532508 - DNA, 18 bp, Homo sapiens
gtgctccctaccacctcc

SEQ ID NO: 2532509 - DNA, 22 bp, Homo sapiens
gtgctccgtgcctccaccacca

SEQ ID NO: 2532510 - DNA, 16 bp, Homo sapiens
gtgctctgatcatcca

SEQ ID NO: 2532511 - DNA, 17 bp, Homo sapiens
gtgctcttcttctttct

SEQ ID NO: 2532512 - DNA, 18 bp, Homo sapiens
gtgctgaccctcctgttg

SEQ ID NO: 2532513 - DNA, 14 bp, Homo sapiens
gtgctgacctctgg

SEQ ID NO: 2532514 - DNA, 19 bp, Homo sapiens
gtgctgagtctgaaggctg

SEQ ID NO: 2532515 - DNA, 23 bp, Homo sapiens
gtgctgagttggtgttgacatgt

SEQ ID NO: 2532516 - DNA, 19 bp, Homo sapiens
gtgctgcatttaaaagata

SEQ ID NO: 2532517 - DNA, 15 bp, Homo sapiens
gtgctgccatccagg

SEQ ID NO: 2532518 - DNA, 13 bp, Homo sapiens
gtgctgccctgcc

SEQ ID NO: 2532519 - DNA, 14 bp, Homo sapiens
gtgctgccctgccc

SEQ ID NO: 2532520 - DNA, 11 bp, Homo sapiens
gtgctgcctct

SEQ ID NO: 2532521 - DNA, 16 bp, Homo sapiens
gtgctggaggactgag

SEQ ID NO: 2532522 - DNA, 13 bp, Homo sapiens
gtgctgggactga

SEQ ID NO: 2532523 - DNA, 19 bp, Homo sapiens
gtgctgggactgagccagt

SEQ ID NO: 2532524 - DNA, 22 bp, Homo sapiens
gtgctgggattacaagcgtgag

SEQ ID NO: 2532525 - DNA, 20 bp, Homo sapiens
gtgctgtctgatctgtgctt

SEQ ID NO: 2532526 - DNA, 11 bp, Homo sapiens
gtgctgtggcc

SEQ ID NO: 2532527 - DNA, 18 bp, Homo sapiens
gtgctgtggccagggtga

SEQ ID NO: 2532528 - DNA, 17 bp, Homo sapiens
gtgctgtggcctgggca

SEQ ID NO: 2532529 - DNA, 14 bp, Homo sapiens
gtgctgtgtaaagt

SEQ ID NO: 2532530 - DNA, 15 bp, Homo sapiens
gtgctgtgtaaagtt

SEQ ID NO: 2532531 - DNA, 16 bp, Homo sapiens
gtgctgtgtaaagtta

SEQ ID NO: 2532532 - DNA, 15 bp, Homo sapiens
gtgcttcaattaata

SEQ ID NO: 2532533 - DNA, 15 bp, Homo sapiens
gtgcttcagcctgag

SEQ ID NO: 2532534 - DNA, 16 bp, Homo sapiens
gtgcttccaaggcaga

SEQ ID NO: 2532535 - DNA, 14 bp, Homo sapiens
gtgcttcgggccct

SEQ ID NO: 2532536 - DNA, 20 bp, Homo sapiens
gtgcttgttccctctccctg

SEQ ID NO: 2532537 - DNA, 21 bp, Homo sapiens
gtgcttgtttgctcacctggg

SEQ ID NO: 2532538 - DNA, 15 bp, Homo sapiens
gtgctttccagctca

SEQ ID NO: 2532539 - DNA, 19 bp, Homo sapiens
gtgctttccttttttaaaa

SEQ ID NO: 2532540 - DNA, 15 bp, Homo sapiens
gtgcttttaaatgca

SEQ ID NO: 2532541 - DNA, 18 bp, Homo sapiens
gtggaaaaatagcctgcc

SEQ ID NO: 2532542 - DNA, 13 bp, Homo sapiens
gtggaaaaatatt

SEQ ID NO: 2532543 - DNA, 22 bp, Homo sapiens
gtggaaagggtgctgcttccct

SEQ ID NO: 2532544 - DNA, 23 bp, Homo sapiens
gtggaaagtgtaaagcattccaa

SEQ ID NO: 2532545 - DNA, 15 bp, Homo sapiens
gtggaaccaggaacc

SEQ ID NO: 2532546 - DNA, 17 bp, Homo sapiens
gtggaagaagagggaga

SEQ ID NO: 2532547 - DNA, 17 bp, Homo sapiens
gtggaagaggggacagg

SEQ ID NO: 2532548 - DNA, 21 bp, Homo sapiens
gtggaagtgtgggtctgtgtg

SEQ ID NO: 2532549 - DNA, 18 bp, Homo sapiens
gtggaatagtatcctcca

SEQ ID NO: 2532550 - DNA, 20 bp, Homo sapiens
gtggaatagtatcctccagg

SEQ ID NO: 2532551 - DNA, 13 bp, Homo sapiens
gtggaatataaag

SEQ ID NO: 2532552 - DNA, 15 bp, Homo sapiens
gtggacacagctctt

SEQ ID NO: 2532553 - DNA, 21 bp, Homo sapiens
gtggacaccaggagtccctgg

SEQ ID NO: 2532554 - DNA, 13 bp, Homo sapiens
gtggacagtcctg

SEQ ID NO: 2532555 - DNA, 13 bp, Homo sapiens
gtggaccttcctg

SEQ ID NO: 2532556 - DNA, 17 bp, Homo sapiens
gtggactctttggtggc

SEQ ID NO: 2532557 - DNA, 13 bp, Homo sapiens
gtggactggaagg

SEQ ID NO: 2532558 - DNA, 17 bp, Homo sapiens
gtggactggcccctggg

SEQ ID NO: 2532559 - DNA, 21 bp, Homo sapiens
gtggagaaactgtagtctcag

SEQ ID NO: 2532560 - DNA, 22 bp, Homo sapiens
gtggagaaataaaaatacctct

SEQ ID NO: 2532561 - DNA, 16 bp, Homo sapiens
gtggagaactcctagg

SEQ ID NO: 2532562 - DNA, 12 bp, Homo sapiens
gtggagaagcca

SEQ ID NO: 2532563 - DNA, 13 bp, Homo sapiens
gtggagaagccat

SEQ ID NO: 2532564 - DNA, 20 bp, Homo sapiens
gtggagaagcggctggcagc

SEQ ID NO: 2532565 - DNA, 11 bp, Homo sapiens
gtggagactgc

SEQ ID NO: 2532566 - DNA, 14 bp, Homo sapiens
gtggagagcccggc

SEQ ID NO: 2532567 - DNA, 14 bp, Homo sapiens
gtggagagctggtg

SEQ ID NO: 2532568 - DNA, 19 bp, Homo sapiens
gtggagatgtcttcgtaca

SEQ ID NO: 2532569 - DNA, 17 bp, Homo sapiens
gtggagcatgggcctgg

SEQ ID NO: 2532570 - DNA, 18 bp, Homo sapiens
gtggagccccacactggg

SEQ ID NO: 2532571 - DNA, 13 bp, Homo sapiens
gtggagctgcctg

SEQ ID NO: 2532572 - DNA, 14 bp, Homo sapiens
gtggaggaaggatt

SEQ ID NO: 2532573 - DNA, 15 bp, Homo sapiens
gtggaggaaggattg

SEQ ID NO: 2532574 - DNA, 16 bp, Homo sapiens
gtggaggaatgctccc

SEQ ID NO: 2532575 - DNA, 15 bp, Homo sapiens
gtggaggagcagtgc

SEQ ID NO: 2532576 - DNA, 20 bp, Homo sapiens
gtggaggagctcaggacact

SEQ ID NO: 2532577 - DNA, 23 bp, Homo sapiens
gtggagggcacattccttgcctg

SEQ ID NO: 2532578 - DNA, 16 bp, Homo sapiens
gtggagggcgtggagg

SEQ ID NO: 2532579 - DNA, 22 bp, Homo sapiens
gtggaggttaaggctgaggaaa

SEQ ID NO: 2532580 - DNA, 18 bp, Homo sapiens
gtggatctccaaggacca

SEQ ID NO: 2532581 - DNA, 23 bp, Homo sapiens
gtggatctccaaggaccaggtta

SEQ ID NO: 2532582 - DNA, 18 bp, Homo sapiens
gtggatgcctggtggcag

SEQ ID NO: 2532583 - DNA, 13 bp, Homo sapiens
gtggatgtcttcc

SEQ ID NO: 2532584 - DNA, 21 bp, Homo sapiens
gtggatttaacagaaatgtac

SEQ ID NO: 2532585 - DNA, 23 bp, Homo sapiens
gtggatttaacagaaatgtacag

SEQ ID NO: 2532586 - DNA, 23 bp, Homo sapiens
gtggcagagcttggactggatgc

SEQ ID NO: 2532587 - DNA, 23 bp, Homo sapiens
gtggcagataatcagcctcttaa

SEQ ID NO: 2532588 - DNA, 19 bp, Homo sapiens
gtggcagctgcggtccacc

SEQ ID NO: 2532589 - DNA, 12 bp, Homo sapiens
gtggcagctgct

SEQ ID NO: 2532590 - DNA, 15 bp, Homo sapiens
gtggcaggaccagga

SEQ ID NO: 2532591 - DNA, 23 bp, Homo sapiens
gtggcagggcctagctgctacaa

SEQ ID NO: 2532592 - DNA, 12 bp, Homo sapiens
gtggcagggctc

SEQ ID NO: 2532593 - DNA, 16 bp, Homo sapiens
gtggcagggctcagga

SEQ ID NO: 2532594 - DNA, 15 bp, Homo sapiens
gtggcagtgggagct

SEQ ID NO: 2532595 - DNA, 19 bp, Homo sapiens
gtggcagtgggagctgcct

SEQ ID NO: 2532596 - DNA, 17 bp, Homo sapiens
gtggcatagcccagaca

SEQ ID NO: 2532597 - DNA, 18 bp, Homo sapiens
gtggcatctttgccttgg

SEQ ID NO: 2532598 - DNA, 14 bp, Homo sapiens
gtggccaagttctt

SEQ ID NO: 2532599 - DNA, 16 bp, Homo sapiens
gtggccagcccggctg

SEQ ID NO: 2532600 - DNA, 19 bp, Homo sapiens
gtggcctcaaccctccctc

SEQ ID NO: 2532601 - DNA, 20 bp, Homo sapiens
gtggcctcaaccctccctca

SEQ ID NO: 2532602 - DNA, 21 bp, Homo sapiens
gtggcctcaaccctccctcag

SEQ ID NO: 2532603 - DNA, 11 bp, Homo sapiens
gtggcctcaga

SEQ ID NO: 2532604 - DNA, 21 bp, Homo sapiens
gtggcctcccaactcacccca

SEQ ID NO: 2532605 - DNA, 22 bp, Homo sapiens
gtggcctctccttgtggcctgg

SEQ ID NO: 2532606 - DNA, 16 bp, Homo sapiens
gtggcctctttgtcta

SEQ ID NO: 2532607 - DNA, 20 bp, Homo sapiens
gtggcctggccaggagctct

SEQ ID NO: 2532608 - DNA, 16 bp, Homo sapiens
gtggcctgtggcctgt

SEQ ID NO: 2532609 - DNA, 15 bp, Homo sapiens
gtggcgggcgcctgt

SEQ ID NO: 2532610 - DNA, 22 bp, Homo sapiens
gtggctcacgcctgtaatccca

SEQ ID NO: 2532611 - DNA, 14 bp, Homo sapiens
gtggctcccctcta

SEQ ID NO: 2532612 - DNA, 18 bp, Homo sapiens
gtggctcctatctgtgtt

SEQ ID NO: 2532613 - DNA, 21 bp, Homo sapiens
gtggctctacaactgagtcct

SEQ ID NO: 2532614 - DNA, 13 bp, Homo sapiens
gtggctctccagt

SEQ ID NO: 2532615 - DNA, 21 bp, Homo sapiens
gtggctctgaggtgcctgtcc

SEQ ID NO: 2532616 - DNA, 11 bp, Homo sapiens
gtggctggggg

SEQ ID NO: 2532617 - DNA, 16 bp, Homo sapiens
gtggctgggggcagga

SEQ ID NO: 2532618 - DNA, 16 bp, Homo sapiens
gtggctttgcatttta

SEQ ID NO: 2532619 - DNA, 23 bp, Homo sapiens
gtggctttgcattttaaaaatga

SEQ ID NO: 2532620 - DNA, 20 bp, Homo sapiens
gtggcttttttcctcctgtg

SEQ ID NO: 2532621 - DNA, 21 bp, Homo sapiens
gtgggaacgagaggggaagag

SEQ ID NO: 2532622 - DNA, 13 bp, Homo sapiens
gtgggacaccctg

SEQ ID NO: 2532623 - DNA, 15 bp, Homo sapiens
gtgggacagagtctg

SEQ ID NO: 2532624 - DNA, 19 bp, Homo sapiens
gtgggagcagcggtttggg

SEQ ID NO: 2532625 - DNA, 15 bp, Homo sapiens
gtgggaggggcaggc

SEQ ID NO: 2532626 - DNA, 15 bp, Homo sapiens
gtgggagtcatctca

SEQ ID NO: 2532627 - DNA, 13 bp, Homo sapiens
gtgggagtgtgta

SEQ ID NO: 2532628 - DNA, 13 bp, Homo sapiens
gtgggatcctcca

SEQ ID NO: 2532629 - DNA, 17 bp, Homo sapiens
gtgggcaaacaggcagt

SEQ ID NO: 2532630 - DNA, 17 bp, Homo sapiens
gtgggcaggtggtggca

SEQ ID NO: 2532631 - DNA, 17 bp, Homo sapiens
gtgggccagcccctccc

SEQ ID NO: 2532632 - DNA, 19 bp, Homo sapiens
gtgggccagcccctcccac

SEQ ID NO: 2532633 - DNA, 17 bp, Homo sapiens
gtgggcccaatgcactt

SEQ ID NO: 2532634 - DNA, 11 bp, Homo sapiens
gtgggcccagg

SEQ ID NO: 2532635 - DNA, 14 bp, Homo sapiens
gtgggcccaggacc

SEQ ID NO: 2532636 - DNA, 20 bp, Homo sapiens
gtgggcccaggaccagctgg

SEQ ID NO: 2532637 - DNA, 18 bp, Homo sapiens
gtgggccctccgacagcc

SEQ ID NO: 2532638 - DNA, 19 bp, Homo sapiens
gtgggcctcaaggacttga

SEQ ID NO: 2532639 - DNA, 20 bp, Homo sapiens
gtgggcctcctctgtccagg

SEQ ID NO: 2532640 - DNA, 20 bp, Homo sapiens
gttgggattcctgacccagg

SEQ ID NO: 2532641 - DNA, 21 bp, Homo sapiens
gttgggattcctgacccaggc

SEQ ID NO: 2532642 - DNA, 22 bp, Homo sapiens
gttgggattcctgacccaggcc

SEQ ID NO: 2532643 - DNA, 21 bp, Homo sapiens
gttgggattgggggctggtgc

SEQ ID NO: 2532644 - DNA, 13 bp, Homo sapiens
gttgggcccagat

SEQ ID NO: 2532645 - DNA, 15 bp, Homo sapiens
gttgggcccagatct

SEQ ID NO: 2532646 - DNA, 15 bp, Homo sapiens
gttgggctggtgtca

SEQ ID NO: 2532647 - DNA, 17 bp, Homo sapiens
gttgggctggtgtcacc

SEQ ID NO: 2532648 - DNA, 13 bp, Homo sapiens
gttgggtggatgc

SEQ ID NO: 2532649 - DNA, 15 bp, Homo sapiens
gttgggttcatctga

SEQ ID NO: 2532650 - DNA, 18 bp, Homo sapiens
gttggtcccccttccatg

SEQ ID NO: 2532651 - DNA, 18 bp, Homo sapiens
gttggtgttccacgtgtt

SEQ ID NO: 2532652 - DNA, 15 bp, Homo sapiens
gttggtgttgcagaa

SEQ ID NO: 2532653 - DNA, 14 bp, Homo sapiens
gttgtagtaaagaa

SEQ ID NO: 2532654 - DNA, 15 bp, Homo sapiens
gttgtcaatattaaa

SEQ ID NO: 2532655 - DNA, 17 bp, Homo sapiens
gttgtcaatattaaata

SEQ ID NO: 2532656 - DNA, 12 bp, Homo sapiens
gttgtcagctga

SEQ ID NO: 2532657 - DNA, 13 bp, Homo sapiens
gttgtccctctgc

SEQ ID NO: 2532658 - DNA, 17 bp, Homo sapiens
gttgtccctctgctacg

SEQ ID NO: 2532659 - DNA, 16 bp, Homo sapiens
gttgtcctccccttgg

SEQ ID NO: 2532660 - DNA, 17 bp, Homo sapiens
gttgtgaccttagtgtt

SEQ ID NO: 2532661 - DNA, 17 bp, Homo sapiens
gttgtgcaaattaacag

SEQ ID NO: 2532662 - DNA, 15 bp, Homo sapiens
gttgtgggtgggaga

SEQ ID NO: 2532663 - DNA, 17 bp, Homo sapiens
gttgtggtgctgacaaa

SEQ ID NO: 2532664 - DNA, 12 bp, Homo sapiens
gttgtgtgtggg

SEQ ID NO: 2532665 - DNA, 22 bp, Homo sapiens
gttgtgtgtgggagtgtgtaat

SEQ ID NO: 2532666 - DNA, 15 bp, Homo sapiens
gttgttaataaaagt

SEQ ID NO: 2532667 - DNA, 19 bp, Homo sapiens
gttgttaatgaaaatgtca

SEQ ID NO: 2532668 - DNA, 14 bp, Homo sapiens
gttgttacattttt

SEQ ID NO: 2532669 - DNA, 12 bp, Homo sapiens
gttgtttgcatg

SEQ ID NO: 2532670 - DNA, 13 bp, Homo sapiens
gttgtttgtatgt

SEQ ID NO: 2532671 - DNA, 19 bp, Homo sapiens
gttgttttttgaaaacatg

SEQ ID NO: 2532672 - DNA, 12 bp, Homo sapiens
gtttaaactgat

SEQ ID NO: 2532673 - DNA, 13 bp, Homo sapiens
gtttaaatatttc

SEQ ID NO: 2532674 - DNA, 14 bp, Homo sapiens
gtttaaatatttca

SEQ ID NO: 2532675 - DNA, 23 bp, Homo sapiens
gtttaaccaaaaagaccagacta

SEQ ID NO: 2532676 - DNA, 17 bp, Homo sapiens
gtttaactcagatcact

SEQ ID NO: 2532677 - DNA, 21 bp, Homo sapiens
gtttaagtgactgatggctaa

SEQ ID NO: 2532678 - DNA, 17 bp, Homo sapiens
gtttaatatttaaacag

SEQ ID NO: 2532679 - DNA, 16 bp, Homo sapiens
gtttacaagtgtatat

SEQ ID NO: 2532680 - DNA, 18 bp, Homo sapiens
gtttacaagtgtatatca

SEQ ID NO: 2532681 - DNA, 16 bp, Homo sapiens
gtttacttaaagattt

SEQ ID NO: 2532682 - DNA, 22 bp, Homo sapiens
gtttacttaaagatttatcaaa

SEQ ID NO: 2532683 - DNA, 19 bp, Homo sapiens
gtttacttttcagggcatc

SEQ ID NO: 2532684 - DNA, 13 bp, Homo sapiens
gtttagaaagctt

SEQ ID NO: 2532685 - DNA, 15 bp, Homo sapiens
gtttagataatacac

SEQ ID NO: 2532686 - DNA, 20 bp, Homo sapiens
gtttaggatgttgaaaaagt

SEQ ID NO: 2532687 - DNA, 19 bp, Homo sapiens
gtttatatctctcatgcat

SEQ ID NO: 2532688 - DNA, 14 bp, Homo sapiens
gtttatcattcaag

SEQ ID NO: 2532689 - DNA, 14 bp, Homo sapiens
gtttatggcctcag

SEQ ID NO: 2532690 - DNA, 13 bp, Homo sapiens
gtttatgtgtgtg

SEQ ID NO: 2532691 - DNA, 18 bp, Homo sapiens
gtttattaacaaattatg

SEQ ID NO: 2532692 - DNA, 14 bp, Homo sapiens
gtttatttatcagt

SEQ ID NO: 2532693 - DNA, 16 bp, Homo sapiens
gtttatttatcagtga

SEQ ID NO: 2532694 - DNA, 12 bp, Homo sapiens
gtttatttccaa

SEQ ID NO: 2532695 - DNA, 21 bp, Homo sapiens
gtttatttccaaataaaatga

SEQ ID NO: 2532696 - DNA, 14 bp, Homo sapiens
gtttatttttcata

SEQ ID NO: 2532697 - DNA, 19 bp, Homo sapiens
gtttcaaaaacacagtgtt

SEQ ID NO: 2532698 - DNA, 16 bp, Homo sapiens
gtttcaaactttacta

SEQ ID NO: 2532699 - DNA, 22 bp, Homo sapiens
gtttcaattccacctgcaatca

SEQ ID NO: 2532700 - DNA, 14 bp, Homo sapiens
gtttcagaaatgtg

SEQ ID NO: 2532701 - DNA, 20 bp, Homo sapiens
gtttcaggtgacatgtgaaa

SEQ ID NO: 2532702 - DNA, 20 bp, Homo sapiens
gtttcattgcgaatcttttt

SEQ ID NO: 2532703 - DNA, 23 bp, Homo sapiens
gtttccaatgtttagcaaataca

SEQ ID NO: 2532704 - DNA, 20 bp, Homo sapiens
gtttcccataattttcttca

SEQ ID NO: 2532705 - DNA, 14 bp, Homo sapiens
gtttcctgcaggcc

SEQ ID NO: 2532706 - DNA, 16 bp, Homo sapiens
gtttcctggcactgct

SEQ ID NO: 2532707 - DNA, 13 bp, Homo sapiens
gtttcgagaagct

SEQ ID NO: 2532708 - DNA, 15 bp, Homo sapiens
gtttcgtttctgtat

SEQ ID NO: 2532709 - DNA, 18 bp, Homo sapiens
gtttctagcactggcctg

SEQ ID NO: 2532710 - DNA, 14 bp, Homo sapiens
gtttctcagatcct

SEQ ID NO: 2532711 - DNA, 17 bp, Homo sapiens
gtttctccccctgggct

SEQ ID NO: 2532712 - DNA, 20 bp, Homo sapiens
gtttctgaaaattaacactg

SEQ ID NO: 2532713 - DNA, 18 bp, Homo sapiens
gtttctgaaagggacgct

SEQ ID NO: 2532714 - DNA, 17 bp, Homo sapiens
gtttctgactctgagct

SEQ ID NO: 2532715 - DNA, 16 bp, Homo sapiens
gtttctgtcctgctgg

SEQ ID NO: 2532716 - DNA, 17 bp, Homo sapiens
gtttctgtcctgctggt

SEQ ID NO: 2532717 - DNA, 17 bp, Homo sapiens
gtttctgttctgtggaa

SEQ ID NO: 2532718 - DNA, 16 bp, Homo sapiens
gtttcttagcttttta

SEQ ID NO: 2532719 - DNA, 16 bp, Homo sapiens
gtttctttagcagttt

SEQ ID NO: 2532720 - DNA, 16 bp, Homo sapiens
gtttctttagtttttg

SEQ ID NO: 2532721 - DNA, 19 bp, Homo sapiens
gtttctttcctgccttctt

SEQ ID NO: 2532722 - DNA, 14 bp, Homo sapiens
gtttgaagcctgga

SEQ ID NO: 2532723 - DNA, 16 bp, Homo sapiens
gtttgaaggaaacagt

SEQ ID NO: 2532724 - DNA, 13 bp, Homo sapiens
gtttgaatataaa

SEQ ID NO: 2532725 - DNA, 19 bp, Homo sapiens
gtttgaatataaacactat

SEQ ID NO: 2532726 - DNA, 17 bp, Homo sapiens
gtttgagatcagcctgg

SEQ ID NO: 2532727 - DNA, 18 bp, Homo sapiens
gtttgagatcagcctggg

SEQ ID NO: 2532728 - DNA, 16 bp, Homo sapiens
gtttgattcagacagc

SEQ ID NO: 2532729 - DNA, 20 bp, Homo sapiens
gtttgattcagacagctgcc

SEQ ID NO: 2532730 - DNA, 15 bp, Homo sapiens
gtttgcaaggaagcc

SEQ ID NO: 2532731 - DNA, 17 bp, Homo sapiens
gtttgcaaggaagccac

SEQ ID NO: 2532732 - DNA, 15 bp, Homo sapiens
gtttgcacacttgtg

SEQ ID NO: 2532733 - DNA, 22 bp, Homo sapiens
gtttgcactgtatgctggacgg

SEQ ID NO: 2532734 - DNA, 20 bp, Homo sapiens
gtttgcagagcttgaacaca

SEQ ID NO: 2532735 - DNA, 18 bp, Homo sapiens
gtttgccttctactttta

SEQ ID NO: 2532736 - DNA, 17 bp, Homo sapiens
gtttgctattagagcat

SEQ ID NO: 2532737 - DNA, 19 bp, Homo sapiens
gtttgctgaacaccttgtg

SEQ ID NO: 2532738 - DNA, 13 bp, Homo sapiens
gtttgcttattgt

SEQ ID NO: 2532739 - DNA, 15 bp, Homo sapiens
gtttgcttattgttc

SEQ ID NO: 2532740 - DNA, 16 bp, Homo sapiens
gtttgcttattgttcc

SEQ ID NO: 2532741 - DNA, 13 bp, Homo sapiens
gtttggaatgctt

SEQ ID NO: 2532742 - DNA, 18 bp, Homo sapiens
gtttggaccccagctggg

SEQ ID NO: 2532743 - DNA, 19 bp, Homo sapiens
gtttggaccccagctggga

SEQ ID NO: 2532744 - DNA, 20 bp, Homo sapiens
gtttggatgggagtgagaca

SEQ ID NO: 2532745 - DNA, 21 bp, Homo sapiens
gtttggcgggccaaggactgc

SEQ ID NO: 2532746 - DNA, 16 bp, Homo sapiens
gtttgggcccctctcc

SEQ ID NO: 2532747 - DNA, 15 bp, Homo sapiens
gtttggggagcagag

SEQ ID NO: 2532748 - DNA, 20 bp, Homo sapiens
gtttggggagcagagacact

SEQ ID NO: 2532749 - DNA, 11 bp, Homo sapiens
gtttggggcga

SEQ ID NO: 2532750 - DNA, 16 bp, Homo sapiens
gtttgggtatattcat

SEQ ID NO: 2532751 - DNA, 19 bp, Homo sapiens
gtttgtaaattaactttta

SEQ ID NO: 2532752 - DNA, 15 bp, Homo sapiens
gtttgtggcctcaga

SEQ ID NO: 2532753 - DNA, 16 bp, Homo sapiens
gtttgtggcctcagaa

SEQ ID NO: 2532754 - DNA, 15 bp, Homo sapiens
gtttgtgtgtcttaa

SEQ ID NO: 2532755 - DNA, 15 bp, Homo sapiens
gtttgtgtgttgtct

SEQ ID NO: 2532756 - DNA, 17 bp, Homo sapiens
gtttgttacataggtat

SEQ ID NO: 2532757 - DNA, 10 bp, Homo sapiens
gtttgtttca

SEQ ID NO: 2532758 - DNA, 21 bp, Homo sapiens
gtttgtttctccccctgggct

SEQ ID NO: 2532759 - DNA, 14 bp, Homo sapiens
gtttgtttgtttca

SEQ ID NO: 2532760 - DNA, 19 bp, Homo sapiens
gttttaaatttatttcaaa

SEQ ID NO: 2532761 - DNA, 22 bp, Homo sapiens
gttttaacaatttcctttatat

SEQ ID NO: 2532762 - DNA, 16 bp, Homo sapiens
gttttaagaggcaggg

SEQ ID NO: 2532763 - DNA, 17 bp, Homo sapiens
gttttaagttgtttgca

SEQ ID NO: 2532764 - DNA, 14 bp, Homo sapiens
gttttaatttaaac

SEQ ID NO: 2532765 - DNA, 21 bp, Homo sapiens
gttttacttttaaactgtgta

SEQ ID NO: 2532766 - DNA, 17 bp, Homo sapiens
gttttagacaaatactc

SEQ ID NO: 2532767 - DNA, 20 bp, Homo sapiens
gttttagctccttgactcct

SEQ ID NO: 2532768 - DNA, 18 bp, Homo sapiens
gttttatactgtacttaa

SEQ ID NO: 2532769 - DNA, 14 bp, Homo sapiens
gttttattcctgta

SEQ ID NO: 2532770 - DNA, 17 bp, Homo sapiens
gttttcaaaataaaaat

SEQ ID NO: 2532771 - DNA, 11 bp, Homo sapiens
gttttcactct

SEQ ID NO: 2532772 - DNA, 20 bp, Homo sapiens
gttttcagaacctcttcccc

SEQ ID NO: 2532773 - DNA, 24 bp, Homo sapiens
gttttcaggagtgggttgatttca

SEQ ID NO: 2532774 - DNA, 10 bp, Homo sapiens
gttttcatgg

SEQ ID NO: 2532775 - DNA, 21 bp, Homo sapiens
gttttcatggtgaaaatgtac

SEQ ID NO: 2532776 - DNA, 14 bp, Homo sapiens
gttttccatgaaaa

SEQ ID NO: 2532777 - DNA, 19 bp, Homo sapiens
gttttccatgagtcccctg

SEQ ID NO: 2532778 - DNA, 21 bp, Homo sapiens
gttttccctgacctccctcta

SEQ ID NO: 2532779 - DNA, 20 bp, Homo sapiens
gttttcccttgaggaaacaa

SEQ ID NO: 2532780 - DNA, 16 bp, Homo sapiens
gttttcctaaatgcag

SEQ ID NO: 2532781 - DNA, 17 bp, Homo sapiens
gttttcctaaatgcagt

SEQ ID NO: 2532782 - DNA, 16 bp, Homo sapiens
gttttcctttctcacc

SEQ ID NO: 2532783 - DNA, 19 bp, Homo sapiens
gttttcgaagctcagccca

SEQ ID NO: 2532784 - DNA, 20 bp, Homo sapiens
gttttcgaagctcagcccac

SEQ ID NO: 2532785 - DNA, 23 bp, Homo sapiens
gttttcgaagctcagcccacccc

SEQ ID NO: 2532786 - DNA, 22 bp, Homo sapiens
taagcactacataaactgactt

SEQ ID NO: 2532787 - DNA, 16 bp, Homo sapiens
taagcactgtgctaat

SEQ ID NO: 2532788 - DNA, 17 bp, Homo sapiens
taagcagaccactgata

SEQ ID NO: 2532789 - DNA, 20 bp, Homo sapiens
taagcagaccactgataaaa

SEQ ID NO: 2532790 - DNA, 18 bp, Homo sapiens
taagcagcatttctgaag

SEQ ID NO: 2532791 - DNA, 21 bp, Homo sapiens
taagcagcatttctgaagtgg

SEQ ID NO: 2532792 - DNA, 18 bp, Homo sapiens
taagcagctcttgctaat

SEQ ID NO: 2532793 - DNA, 15 bp, Homo sapiens
taagcatcaaactct

SEQ ID NO: 2532794 - DNA, 21 bp, Homo sapiens
taagcattaccactcaggcat

SEQ ID NO: 2532795 - DNA, 16 bp, Homo sapiens
taagccacaagaaatt

SEQ ID NO: 2532796 - DNA, 19 bp, Homo sapiens
taagccacttaaaatgttc

SEQ ID NO: 2532797 - DNA, 20 bp, Homo sapiens
taagccacttaaaatgttca

SEQ ID NO: 2532798 - DNA, 15 bp, Homo sapiens
taagccatgggagac

SEQ ID NO: 2532799 - DNA, 14 bp, Homo sapiens
taagcccttgaaga

SEQ ID NO: 2532800 - DNA, 16 bp, Homo sapiens
taagcctcatatttaa

SEQ ID NO: 2532801 - DNA, 17 bp, Homo sapiens
taagcctcatatttaaa

SEQ ID NO: 2532802 - DNA, 20 bp, Homo sapiens
taagcctcatatttaaagac

SEQ ID NO: 2532803 - DNA, 20 bp, Homo sapiens
taagctcaaggcgtgaggat

SEQ ID NO: 2532804 - DNA, 13 bp, Homo sapiens
taagctctggctt

SEQ ID NO: 2532805 - DNA, 13 bp, Homo sapiens
taagctgaaaata

SEQ ID NO: 2532806 - DNA, 22 bp, Homo sapiens
taagctgttactgtcttcagta

SEQ ID NO: 2532807 - DNA, 16 bp, Homo sapiens
taagctgtttccatag

SEQ ID NO: 2532808 - DNA, 19 bp, Homo sapiens
taagctttgccagctgctg

SEQ ID NO: 2532809 - DNA, 22 bp, Homo sapiens
taagctttgccagctgctgctg

SEQ ID NO: 2532810 - DNA, 11 bp, Homo sapiens
taaggaaacaa

SEQ ID NO: 2532811 - DNA, 10 bp, Homo sapiens
taaggaaact

SEQ ID NO: 2532812 - DNA, 17 bp, Homo sapiens
taaggaaactcttatct

SEQ ID NO: 2532813 - DNA, 18 bp, Homo sapiens
taaggaaagcaataaatg

SEQ ID NO: 2532814 - DNA, 19 bp, Homo sapiens
taaggatcagaacagcaga

SEQ ID NO: 2532815 - DNA, 19 bp, Homo sapiens
taaggatggagccagctct

SEQ ID NO: 2532816 - DNA, 18 bp, Homo sapiens
taaggatgggaaggaggg

SEQ ID NO: 2532817 - DNA, 19 bp, Homo sapiens
taaggatgtcacagggcca

SEQ ID NO: 2532818 - DNA, 20 bp, Homo sapiens
taaggattttatgctttaaa

SEQ ID NO: 2532819 - DNA, 17 bp, Homo sapiens
taaggcgtggagctgcc

SEQ ID NO: 2532820 - DNA, 13 bp, Homo sapiens
taaggctgaggaa

SEQ ID NO: 2532821 - DNA, 13 bp, Homo sapiens
taagggaagaatt

SEQ ID NO: 2532822 - DNA, 21 bp, Homo sapiens
taagggaaggaactctggctt

SEQ ID NO: 2532823 - DNA, 22 bp, Homo sapiens
taagggctggtctctgctgaag

SEQ ID NO: 2532824 - DNA, 21 bp, Homo sapiens
taaggtacctttcacatagag

SEQ ID NO: 2532825 - DNA, 18 bp, Homo sapiens
taaggtcattaccacagg

SEQ ID NO: 2532826 - DNA, 19 bp, Homo sapiens
taaggtttcgtttctgtat

SEQ ID NO: 2532827 - DNA, 22 bp, Homo sapiens
taaggtttcgtttctgtataca

SEQ ID NO: 2532828 - DNA, 13 bp, Homo sapiens
taagtaaaaccac

SEQ ID NO: 2532829 - DNA, 21 bp, Homo sapiens
taagtaattatcgggaacagt

SEQ ID NO: 2532830 - DNA, 14 bp, Homo sapiens
taagtactgtgtac

SEQ ID NO: 2532831 - DNA, 15 bp, Homo sapiens
taagtatctgacatc

SEQ ID NO: 2532832 - DNA, 17 bp, Homo sapiens
taagtattatgtctctt

SEQ ID NO: 2532833 - DNA, 21 bp, Homo sapiens
taagtattcttatttaatgaa

SEQ ID NO: 2532834 - DNA, 20 bp, Homo sapiens
taagtatttaggtttttgtt

SEQ ID NO: 2532835 - DNA, 17 bp, Homo sapiens
taagtatttatatattt

SEQ ID NO: 2532836 - DNA, 17 bp, Homo sapiens
taagtcctttatgtgga

SEQ ID NO: 2532837 - DNA, 20 bp, Homo sapiens
taagtcctttatgtggaaaa

SEQ ID NO: 2532838 - DNA, 19 bp, Homo sapiens
taagtctgttttatgactt

SEQ ID NO: 2532839 - DNA, 21 bp, Homo sapiens
taagtctgttttatgacttca

SEQ ID NO: 2532840 - DNA, 20 bp, Homo sapiens
taagtcttatcaagcagcca

SEQ ID NO: 2532841 - DNA, 16 bp, Homo sapiens
taagtgcgtgtgtaga

SEQ ID NO: 2532842 - DNA, 16 bp, Homo sapiens
taagtgctgcatttaa

SEQ ID NO: 2532843 - DNA, 20 bp, Homo sapiens
taagtggggttgcaaccact

SEQ ID NO: 2532844 - DNA, 21 bp, Homo sapiens
taagtgtgagtaagagctggt

SEQ ID NO: 2532845 - DNA, 14 bp, Homo sapiens
taagtgtgtgtgtg

SEQ ID NO: 2532846 - DNA, 14 bp, Homo sapiens
taagttattgcagt

SEQ ID NO: 2532847 - DNA, 16 bp, Homo sapiens
taagttattgcagttt

SEQ ID NO: 2532848 - DNA, 20 bp, Homo sapiens
taagttcaaattcttctgaa

SEQ ID NO: 2532849 - DNA, 22 bp, Homo sapiens
taagttcatattccatatttat

SEQ ID NO: 2532850 - DNA, 19 bp, Homo sapiens
taagttccactgagctcca

SEQ ID NO: 2532851 - DNA, 19 bp, Homo sapiens
taagtttacctatgtaaca

SEQ ID NO: 2532852 - DNA, 17 bp, Homo sapiens
taagtttatttcttaaa

SEQ ID NO: 2532853 - DNA, 17 bp, Homo sapiens
taagtttcaggtgacat

SEQ ID NO: 2532854 - DNA, 20 bp, Homo sapiens
taagtttcaggtgacatgtg

SEQ ID NO: 2532855 - DNA, 23 bp, Homo sapiens
taagtttctcagctcccatttct

SEQ ID NO: 2532856 - DNA, 16 bp, Homo sapiens
taagtttgatttcatt

SEQ ID NO: 2532857 - DNA, 15 bp, Homo sapiens
taataaaaaatggaa

SEQ ID NO: 2532858 - DNA, 13 bp, Homo sapiens
taataaaaggaaa

SEQ ID NO: 2532859 - DNA, 14 bp, Homo sapiens
taataaaaggaaaa

SEQ ID NO: 2532860 - DNA, 20 bp, Homo sapiens
taataaaaggaaaagcaaat

SEQ ID NO: 2532861 - DNA, 13 bp, Homo sapiens
taataaagacagg

SEQ ID NO: 2532862 - DNA, 15 bp, Homo sapiens
taataaagctactga

SEQ ID NO: 2532863 - DNA, 15 bp, Homo sapiens
taataaatatttatg

SEQ ID NO: 2532864 - DNA, 17 bp, Homo sapiens
taataaatgtacattaa

SEQ ID NO: 2532865 - DNA, 13 bp, Homo sapiens
taataaattcaga

SEQ ID NO: 2532866 - DNA, 15 bp, Homo sapiens
taataaattcagata

SEQ ID NO: 2532867 - DNA, 17 bp, Homo sapiens
taataacagtgcatatt

SEQ ID NO: 2532868 - DNA, 21 bp, Homo sapiens
taataacattaccttactgtg

SEQ ID NO: 2532869 - DNA, 13 bp, Homo sapiens
taataatatatgt

SEQ ID NO: 2532870 - DNA, 16 bp, Homo sapiens
taatacaccactacat

SEQ ID NO: 2532871 - DNA, 20 bp, Homo sapiens
taatacactaattcctttct

SEQ ID NO: 2532872 - DNA, 23 bp, Homo sapiens
taatacagcagtgtcatcagaag

SEQ ID NO: 2532873 - DNA, 20 bp, Homo sapiens
taatacagccaaagataatc

SEQ ID NO: 2532874 - DNA, 13 bp, Homo sapiens
taatacctctgtg

SEQ ID NO: 2532875 - DNA, 14 bp, Homo sapiens
taatacctctgtgt

SEQ ID NO: 2532876 - DNA, 15 bp, Homo sapiens
taatacctgggtgat

SEQ ID NO: 2532877 - DNA, 18 bp, Homo sapiens
taatactagttgtgacct

SEQ ID NO: 2532878 - DNA, 23 bp, Homo sapiens
taatactagttgtgaccttagtg

SEQ ID NO: 2532879 - DNA, 12 bp, Homo sapiens
taatactatatt

SEQ ID NO: 2532880 - DNA, 12 bp, Homo sapiens
taatactgtatt

SEQ ID NO: 2532881 - DNA, 14 bp, Homo sapiens
taatagacaattta

SEQ ID NO: 2532882 - DNA, 22 bp, Homo sapiens
taatagacaatttattatggca

SEQ ID NO: 2532883 - DNA, 22 bp, Homo sapiens
taatagcgggttactttcacat

SEQ ID NO: 2532884 - DNA, 13 bp, Homo sapiens
taatagtgttaat

SEQ ID NO: 2532885 - DNA, 17 bp, Homo sapiens
taatagtgttaatcaat

SEQ ID NO: 2532886 - DNA, 21 bp, Homo sapiens
taatagtgttaatcaatttaa

SEQ ID NO: 2532887 - DNA, 14 bp, Homo sapiens
taatataaagttgg

SEQ ID NO: 2532888 - DNA, 16 bp, Homo sapiens
taatatactatattta

SEQ ID NO: 2532889 - DNA, 15 bp, Homo sapiens
taatatcaatagaag

SEQ ID NO: 2532890 - DNA, 17 bp, Homo sapiens
taatatgcacacatttt

SEQ ID NO: 2532891 - DNA, 19 bp, Homo sapiens
taatatgcacacatttttt

SEQ ID NO: 2532892 - DNA, 10 bp, Homo sapiens
taatatgcat

SEQ ID NO: 2532893 - DNA, 18 bp, Homo sapiens
taatatggcaaaaatggc

SEQ ID NO: 2532894 - DNA, 15 bp, Homo sapiens
taatatgggcattgt

SEQ ID NO: 2532895 - DNA, 21 bp, Homo sapiens
taatatgttaacctcagtgtc

SEQ ID NO: 2532896 - DNA, 14 bp, Homo sapiens
taatattaaaaata

SEQ ID NO: 2532897 - DNA, 18 bp, Homo sapiens
taatattaaaaatatgga

SEQ ID NO: 2532898 - DNA, 14 bp, Homo sapiens
taatatttgctgac

SEQ ID NO: 2532899 - DNA, 13 bp, Homo sapiens
taatattttgcac

SEQ ID NO: 2532900 - DNA, 13 bp, Homo sapiens
taatcaatttaaa

SEQ ID NO: 2532901 - DNA, 18 bp, Homo sapiens
taatcacgctttcctgaa

SEQ ID NO: 2532902 - DNA, 12 bp, Homo sapiens
taatcagcctct

SEQ ID NO: 2532903 - DNA, 22 bp, Homo sapiens
taatcattcttatttcatgaaa

SEQ ID NO: 2532904 - DNA, 12 bp, Homo sapiens
taatcatttctt

SEQ ID NO: 2532905 - DNA, 20 bp, Homo sapiens
taatcccagctacttgggaa

SEQ ID NO: 2532906 - DNA, 22 bp, Homo sapiens
taatccctgggcattgctttcc

SEQ ID NO: 2532907 - DNA, 15 bp, Homo sapiens
taatcgttatgtgtg

SEQ ID NO: 2532908 - DNA, 16 bp, Homo sapiens
taatcgttatgtgtgt

SEQ ID NO: 2532909 - DNA, 17 bp, Homo sapiens
taatcgttatgtgtgta

SEQ ID NO: 2532910 - DNA, 18 bp, Homo sapiens
taatcgttatgtgtgtat

SEQ ID NO: 2532911 - DNA, 17 bp, Homo sapiens
taatctaattctaagga

SEQ ID NO: 2532912 - DNA, 18 bp, Homo sapiens
taatctattgggttcatt

SEQ ID NO: 2532913 - DNA, 20 bp, Homo sapiens
taatctattgggttcattat

SEQ ID NO: 2532914 - DNA, 19 bp, Homo sapiens
taatctatttctatgagaa

SEQ ID NO: 2532915 - DNA, 18 bp, Homo sapiens
taatctcctcttttatct

SEQ ID NO: 2532916 - DNA, 20 bp, Homo sapiens
taatctgatggcttctccag

SEQ ID NO: 2532917 - DNA, 17 bp, Homo sapiens
taatctggactcctctg

SEQ ID NO: 2532918 - DNA, 19 bp, Homo sapiens
taatcttaggggagagctt

SEQ ID NO: 2532919 - DNA, 20 bp, Homo sapiens
taatcttaggggagagcttt

SEQ ID NO: 2532920 - DNA, 13 bp, Homo sapiens
taatcttcagttt

SEQ ID NO: 2532921 - DNA, 21 bp, Homo sapiens
taatctttctttacctgagac

SEQ ID NO: 2532922 - DNA, 22 bp, Homo sapiens
taatctttgggtaacttcaaaa

SEQ ID NO: 2532923 - DNA, 16 bp, Homo sapiens
taatcttttcacaaat

SEQ ID NO: 2532924 - DNA, 17 bp, Homo sapiens
taatcttttcacaaata

SEQ ID NO: 2532925 - DNA, 13 bp, Homo sapiens
taatgaaaatgtc

SEQ ID NO: 2532926 - DNA, 14 bp, Homo sapiens
taatgaaaatgtca

SEQ ID NO: 2532927 - DNA, 15 bp, Homo sapiens
taatgaaaatgtcag

SEQ ID NO: 2532928 - DNA, 17 bp, Homo sapiens
taatgaaagactgtaca

SEQ ID NO: 2532929 - DNA, 15 bp, Homo sapiens
taatgacacttgtcc

SEQ ID NO: 2532930 - DNA, 15 bp, Homo sapiens
taatgacagagccag

SEQ ID NO: 2532931 - DNA, 20 bp, Homo sapiens
tagatttggctcctctgctt

SEQ ID NO: 2532932 - DNA, 14 bp, Homo sapiens
tagcaaactttgta

SEQ ID NO: 2532933 - DNA, 17 bp, Homo sapiens
tagcaaatgttttgaca

SEQ ID NO: 2532934 - DNA, 12 bp, Homo sapiens
tagcaagacaca

SEQ ID NO: 2532935 - DNA, 18 bp, Homo sapiens
tagcaagacacatcccta

SEQ ID NO: 2532936 - DNA, 20 bp, Homo sapiens
tagcaagattgcttaaaata

SEQ ID NO: 2532937 - DNA, 22 bp, Homo sapiens
tagcaagtgaatttttctctaa

SEQ ID NO: 2532938 - DNA, 18 bp, Homo sapiens
tagcaagttctagagaag

SEQ ID NO: 2532939 - DNA, 19 bp, Homo sapiens
tagcaagttctagagaaga

SEQ ID NO: 2532940 - DNA, 21 bp, Homo sapiens
tagcaatccatgttagttttt

SEQ ID NO: 2532941 - DNA, 18 bp, Homo sapiens
tagcacacacttttggtt

SEQ ID NO: 2532942 - DNA, 14 bp, Homo sapiens
tagcacagaccctg

SEQ ID NO: 2532943 - DNA, 19 bp, Homo sapiens
tagcacagaccctgccctg

SEQ ID NO: 2532944 - DNA, 24 bp, Homo sapiens
tagcacagaccctgccctgtgggc

SEQ ID NO: 2532945 - DNA, 13 bp, Homo sapiens
tagcactggcctg

SEQ ID NO: 2532946 - DNA, 15 bp, Homo sapiens
tagcagacagtgttt

SEQ ID NO: 2532947 - DNA, 18 bp, Homo sapiens
tagcagagagactttcag

SEQ ID NO: 2532948 - DNA, 20 bp, Homo sapiens
tagcagattttaattttgaa

SEQ ID NO: 2532949 - DNA, 22 bp, Homo sapiens
tagcagcggaacaaggagtcag

SEQ ID NO: 2532950 - DNA, 15 bp, Homo sapiens
tagcaggtggtcctg

SEQ ID NO: 2532951 - DNA, 18 bp, Homo sapiens
tagcatacgtacacattt

SEQ ID NO: 2532952 - DNA, 16 bp, Homo sapiens
tagcatcttctggagt

SEQ ID NO: 2532953 - DNA, 18 bp, Homo sapiens
tagcatgacaagccccag

SEQ ID NO: 2532954 - DNA, 22 bp, Homo sapiens
tagcatgacaagccccaggcag

SEQ ID NO: 2532955 - DNA, 20 bp, Homo sapiens
tagcatgttgagccaggcct

SEQ ID NO: 2532956 - DNA, 13 bp, Homo sapiens
tagcatgtttgct

SEQ ID NO: 2532957 - DNA, 16 bp, Homo sapiens
tagcattaactaatct

SEQ ID NO: 2532958 - DNA, 15 bp, Homo sapiens
tagcatttcattctt

SEQ ID NO: 2532959 - DNA, 17 bp, Homo sapiens
tagcatttcattcttct

SEQ ID NO: 2532960 - DNA, 18 bp, Homo sapiens
tagcatttcattcttctc

SEQ ID NO: 2532961 - DNA, 14 bp, Homo sapiens
tagcatttttgatt

SEQ ID NO: 2532962 - DNA, 14 bp, Homo sapiens
tagccaatgtggga

SEQ ID NO: 2532963 - DNA, 13 bp, Homo sapiens
tagccaccatctt

SEQ ID NO: 2532964 - DNA, 16 bp, Homo sapiens
tagccaccatctttgc

SEQ ID NO: 2532965 - DNA, 16 bp, Homo sapiens
tagccacttaccttca

SEQ ID NO: 2532966 - DNA, 17 bp, Homo sapiens
tagccacttaccttcaa

SEQ ID NO: 2532967 - DNA, 18 bp, Homo sapiens
tagccacttaccttcaat

SEQ ID NO: 2532968 - DNA, 22 bp, Homo sapiens
tagccacttaccttcaataaag

SEQ ID NO: 2532969 - DNA, 18 bp, Homo sapiens
tagccagctgctccccag

SEQ ID NO: 2532970 - DNA, 23 bp, Homo sapiens
tagcccacacttgagaggatgaa

SEQ ID NO: 2532971 - DNA, 18 bp, Homo sapiens
tagccccttagcccccac

SEQ ID NO: 2532972 - DNA, 14 bp, Homo sapiens
tagcccgcctgcca

SEQ ID NO: 2532973 - DNA, 13 bp, Homo sapiens
tagccctttctgt

SEQ ID NO: 2532974 - DNA, 17 bp, Homo sapiens
tagccgacctcagcctt

SEQ ID NO: 2532975 - DNA, 20 bp, Homo sapiens
tagcctaacacactccaaga

SEQ ID NO: 2532976 - DNA, 20 bp, Homo sapiens
tagcctcgccgtctgtgaat

SEQ ID NO: 2532977 - DNA, 20 bp, Homo sapiens
tagcctgtgcctctgggact

SEQ ID NO: 2532978 - DNA, 17 bp, Homo sapiens
tagccttatcctctgat

SEQ ID NO: 2532979 - DNA, 17 bp, Homo sapiens
tagcgcccagttgggtg

SEQ ID NO: 2532980 - DNA, 20 bp, Homo sapiens
tagctaacattttaaataaa

SEQ ID NO: 2532981 - DNA, 20 bp, Homo sapiens
tagctacaggaagcacccca

SEQ ID NO: 2532982 - DNA, 23 bp, Homo sapiens
tagctacaggaagcaccccatgc

SEQ ID NO: 2532983 - DNA, 13 bp, Homo sapiens
tagctagaggaac

SEQ ID NO: 2532984 - DNA, 14 bp, Homo sapiens
tagctatatccatg

SEQ ID NO: 2532985 - DNA, 17 bp, Homo sapiens
tagctatatctatatat

SEQ ID NO: 2532986 - DNA, 14 bp, Homo sapiens
tagctattactgtc

SEQ ID NO: 2532987 - DNA, 15 bp, Homo sapiens
tagctattactgtct

SEQ ID NO: 2532988 - DNA, 16 bp, Homo sapiens
tagctatttttatgga

SEQ ID NO: 2532989 - DNA, 17 bp, Homo sapiens
tagctatttttatggaa

SEQ ID NO: 2532990 - DNA, 19 bp, Homo sapiens
tagctatttttatggaatt

SEQ ID NO: 2532991 - DNA, 20 bp, Homo sapiens
tagctcaggtgtccctgcac

SEQ ID NO: 2532992 - DNA, 22 bp, Homo sapiens
tagctcattctccttgtgttac

SEQ ID NO: 2532993 - DNA, 20 bp, Homo sapiens
tagctccacaccctctccca

SEQ ID NO: 2532994 - DNA, 21 bp, Homo sapiens
tagctccccgcttctgcctgc

SEQ ID NO: 2532995 - DNA, 13 bp, Homo sapiens
tagctcccctcct

SEQ ID NO: 2532996 - DNA, 23 bp, Homo sapiens
tagctgcacagggcagctgggcc

SEQ ID NO: 2532997 - DNA, 23 bp, Homo sapiens
tagctgcatcctccaagaatcta

SEQ ID NO: 2532998 - DNA, 13 bp, Homo sapiens
tagctgctacaaa

SEQ ID NO: 2532999 - DNA, 15 bp, Homo sapiens
tagctgctacaaaga

SEQ ID NO: 2533000 - DNA, 19 bp, Homo sapiens
tagctgctacaaagaagac

SEQ ID NO: 2533001 - DNA, 20 bp, Homo sapiens
tagctgctacaaagaagaca

SEQ ID NO: 2533002 - DNA, 21 bp, Homo sapiens
tagctgctacaaagaagacat

SEQ ID NO: 2533003 - DNA, 11 bp, Homo sapiens
tagctgggact

SEQ ID NO: 2533004 - DNA, 14 bp, Homo sapiens
tagctggtggtttc

SEQ ID NO: 2533005 - DNA, 12 bp, Homo sapiens
tagctgtaaggc

SEQ ID NO: 2533006 - DNA, 12 bp, Homo sapiens
tagctgtattga

SEQ ID NO: 2533007 - DNA, 16 bp, Homo sapiens
tagctgtattgaatca

SEQ ID NO: 2533008 - DNA, 14 bp, Homo sapiens
tagctgtgggggtg

SEQ ID NO: 2533009 - DNA, 20 bp, Homo sapiens
tagctgttatttctattttt

SEQ ID NO: 2533010 - DNA, 18 bp, Homo sapiens
tagcttagacctcagcct

SEQ ID NO: 2533011 - DNA, 23 bp, Homo sapiens
tagcttagacctcagcctgtgct

SEQ ID NO: 2533012 - DNA, 19 bp, Homo sapiens
tagcttgataaagggccaa

SEQ ID NO: 2533013 - DNA, 18 bp, Homo sapiens
tagcttgggacaaatcaa

SEQ ID NO: 2533014 - DNA, 19 bp, Homo sapiens
tagcttgtatagtgtaaaa

SEQ ID NO: 2533015 - DNA, 15 bp, Homo sapiens
tagctttaccctcag

SEQ ID NO: 2533016 - DNA, 13 bp, Homo sapiens
tagctttattctt

SEQ ID NO: 2533017 - DNA, 14 bp, Homo sapiens
tagctttattcttc

SEQ ID NO: 2533018 - DNA, 15 bp, Homo sapiens
tagctttattcttca

SEQ ID NO: 2533019 - DNA, 19 bp, Homo sapiens
tagctttattttttaagta

SEQ ID NO: 2533020 - DNA, 20 bp, Homo sapiens
tagctttattttttaagtat

SEQ ID NO: 2533021 - DNA, 23 bp, Homo sapiens
tagctttcaattccgtagccagc

SEQ ID NO: 2533022 - DNA, 11 bp, Homo sapiens
tagctttgctc

SEQ ID NO: 2533023 - DNA, 15 bp, Homo sapiens
tagctttgctctttg

SEQ ID NO: 2533024 - DNA, 14 bp, Homo sapiens
tagctttttaattg

SEQ ID NO: 2533025 - DNA, 15 bp, Homo sapiens
tagctttttaattgt

SEQ ID NO: 2533026 - DNA, 21 bp, Homo sapiens
taggaaacaaagcttagcagg

SEQ ID NO: 2533027 - DNA, 14 bp, Homo sapiens
taggaaataaaacc

SEQ ID NO: 2533028 - DNA, 14 bp, Homo sapiens
taggaacactcctt

SEQ ID NO: 2533029 - DNA, 18 bp, Homo sapiens
taggaactgctgggcttg

SEQ ID NO: 2533030 - DNA, 15 bp, Homo sapiens
taggaagaattttaa

SEQ ID NO: 2533031 - DNA, 16 bp, Homo sapiens
taggaagactttggaa

SEQ ID NO: 2533032 - DNA, 15 bp, Homo sapiens
taggaagggaccaag

SEQ ID NO: 2533033 - DNA, 17 bp, Homo sapiens
taggaagtgtaacagct

SEQ ID NO: 2533034 - DNA, 12 bp, Homo sapiens
taggaatcagca

SEQ ID NO: 2533035 - DNA, 19 bp, Homo sapiens
taggaattcttttggggaa

SEQ ID NO: 2533036 - DNA, 20 bp, Homo sapiens
taggacaatcagtcccctcc

SEQ ID NO: 2533037 - DNA, 13 bp, Homo sapiens
taggacccttccc

SEQ ID NO: 2533038 - DNA, 15 bp, Homo sapiens
taggacgccacccag

SEQ ID NO: 2533039 - DNA, 14 bp, Homo sapiens
taggactgtagaaa

SEQ ID NO: 2533040 - DNA, 14 bp, Homo sapiens
taggagaccaaggc

SEQ ID NO: 2533041 - DNA, 18 bp, Homo sapiens
taggagaggatgagagcc

SEQ ID NO: 2533042 - DNA, 22 bp, Homo sapiens
taggagaggatgagagcccaga

SEQ ID NO: 2533043 - DNA, 14 bp, Homo sapiens
taggagcagagctc

SEQ ID NO: 2533044 - DNA, 23 bp, Homo sapiens
taggagcctgctggtcacagcct

SEQ ID NO: 2533045 - DNA, 14 bp, Homo sapiens
taggagggagacac

SEQ ID NO: 2533046 - DNA, 21 bp, Homo sapiens
taggagttcgagaccagcctg

SEQ ID NO: 2533047 - DNA, 13 bp, Homo sapiens
taggatagcattt

SEQ ID NO: 2533048 - DNA, 20 bp, Homo sapiens
taggatcatttgttggaatg

SEQ ID NO: 2533049 - DNA, 13 bp, Homo sapiens
taggatgtttttc

SEQ ID NO: 2533050 - DNA, 19 bp, Homo sapiens
taggatgtttttcatgaaa

SEQ ID NO: 2533051 - DNA, 12 bp, Homo sapiens
taggatttaaca

SEQ ID NO: 2533052 - DNA, 16 bp, Homo sapiens
taggcagagcctttgg

SEQ ID NO: 2533053 - DNA, 12 bp, Homo sapiens
taggcaggacca

SEQ ID NO: 2533054 - DNA, 13 bp, Homo sapiens
taggcattctgga

SEQ ID NO: 2533055 - DNA, 19 bp, Homo sapiens
taggccaaatttgtagtgc

SEQ ID NO: 2533056 - DNA, 16 bp, Homo sapiens
taggcctgggtgctgg

SEQ ID NO: 2533057 - DNA, 19 bp, Homo sapiens
taggcctgggtgctggctg

SEQ ID NO: 2533058 - DNA, 11 bp, Homo sapiens
taggctctgca

SEQ ID NO: 2533059 - DNA, 15 bp, Homo sapiens
taggctctgcacaga

SEQ ID NO: 2533060 - DNA, 18 bp, Homo sapiens
taggctctgcacagatgg

SEQ ID NO: 2533061 - DNA, 17 bp, Homo sapiens
taggctggagaagctca

SEQ ID NO: 2533062 - DNA, 16 bp, Homo sapiens
tagggaaaagttcata

SEQ ID NO: 2533063 - DNA, 13 bp, Homo sapiens
tagggaaatgaaa

SEQ ID NO: 2533064 - DNA, 15 bp, Homo sapiens
tagggaactctgggg

SEQ ID NO: 2533065 - DNA, 20 bp, Homo sapiens
tagggaagggtggtggagcc

SEQ ID NO: 2533066 - DNA, 14 bp, Homo sapiens
tagggaagtaacag

SEQ ID NO: 2533067 - DNA, 20 bp, Homo sapiens
tagggactcaatttctcccc

SEQ ID NO: 2533068 - DNA, 14 bp, Homo sapiens
tagggagagaagat

SEQ ID NO: 2533069 - DNA, 23 bp, Homo sapiens
tagggaggaccagggcagggcca

SEQ ID NO: 2533070 - DNA, 15 bp, Homo sapiens
tagggattcaggctg

SEQ ID NO: 2533071 - DNA, 19 bp, Homo sapiens
tagggcagtaacattgggt

SEQ ID NO: 2533072 - DNA, 21 bp, Homo sapiens
tagggcctggtccctgggagg

SEQ ID NO: 2533073 - DNA, 23 bp, Homo sapiens
tagggctacaaaacctgatgtta

SEQ ID NO: 2533074 - DNA, 15 bp, Homo sapiens
tagggtctcttcagg

SEQ ID NO: 2533075 - DNA, 14 bp, Homo sapiens
taggtatacagtgg

SEQ ID NO: 2533076 - DNA, 18 bp, Homo sapiens
taggtcaagaagaagatg

SEQ ID NO: 2533077 - DNA, 19 bp, Homo sapiens
tatctgtgaaatgctggca

SEQ ID NO: 2533078 - DNA, 19 bp, Homo sapiens
tatctgtgcgtgaaacaca

SEQ ID NO: 2533079 - DNA, 12 bp, Homo sapiens
tatctgttcttg

SEQ ID NO: 2533080 - DNA, 17 bp, Homo sapiens
tatcttgctctgtaatc

SEQ ID NO: 2533081 - DNA, 17 bp, Homo sapiens
tatcttggactgacatt

SEQ ID NO: 2533082 - DNA, 22 bp, Homo sapiens
tatcttgtttttccactactgc

SEQ ID NO: 2533083 - DNA, 13 bp, Homo sapiens
tatctttctacag

SEQ ID NO: 2533084 - DNA, 11 bp, Homo sapiens
tatctttgcca

SEQ ID NO: 2533085 - DNA, 16 bp, Homo sapiens
tatctttgccaccctc

SEQ ID NO: 2533086 - DNA, 18 bp, Homo sapiens
tatgaaaaatatgatatt

SEQ ID NO: 2533087 - DNA, 20 bp, Homo sapiens
tatgaaagatggctgtgcct

SEQ ID NO: 2533088 - DNA, 22 bp, Homo sapiens
tatgaaagatggctgtgcctct

SEQ ID NO: 2533089 - DNA, 13 bp, Homo sapiens
tatgaaataaaga

SEQ ID NO: 2533090 - DNA, 14 bp, Homo sapiens
tatgaacatattgt

SEQ ID NO: 2533091 - DNA, 14 bp, Homo sapiens
tatgaagaactgag

SEQ ID NO: 2533092 - DNA, 15 bp, Homo sapiens
tatgaagtatataat

SEQ ID NO: 2533093 - DNA, 12 bp, Homo sapiens
tatgaatacagg

SEQ ID NO: 2533094 - DNA, 17 bp, Homo sapiens
tatgaatttaaatataa

SEQ ID NO: 2533095 - DNA, 23 bp, Homo sapiens
tatgaatttaaatataattctgt

SEQ ID NO: 2533096 - DNA, 19 bp, Homo sapiens
tatgacatcacttgtacaa

SEQ ID NO: 2533097 - DNA, 20 bp, Homo sapiens
tatgacatcacttgtacaaa

SEQ ID NO: 2533098 - DNA, 23 bp, Homo sapiens
tatgacatcacttgtacaaaata

SEQ ID NO: 2533099 - DNA, 19 bp, Homo sapiens
tatgacattcatgcctggc

SEQ ID NO: 2533100 - DNA, 20 bp, Homo sapiens
tatgacggaagaacatagaa

SEQ ID NO: 2533101 - DNA, 19 bp, Homo sapiens
tatgactaaagagagaatg

SEQ ID NO: 2533102 - DNA, 17 bp, Homo sapiens
tatgactgctccccagc

SEQ ID NO: 2533103 - DNA, 18 bp, Homo sapiens
tatgactgctccccagcc

SEQ ID NO: 2533104 - DNA, 17 bp, Homo sapiens
tatgactgcttcatgac

SEQ ID NO: 2533105 - DNA, 23 bp, Homo sapiens
tatgactgcttcatgacattcct

SEQ ID NO: 2533106 - DNA, 20 bp, Homo sapiens
tatgacttcattaataataa

SEQ ID NO: 2533107 - DNA, 13 bp, Homo sapiens
tatgagctgaggg

SEQ ID NO: 2533108 - DNA, 17 bp, Homo sapiens
tatgaggaataattatt

SEQ ID NO: 2533109 - DNA, 23 bp, Homo sapiens
tatgaggcatttgtttgaactga

SEQ ID NO: 2533110 - DNA, 19 bp, Homo sapiens
tatgaggtctaggaacata

SEQ ID NO: 2533111 - DNA, 15 bp, Homo sapiens
tatgagtcaatgtgc

SEQ ID NO: 2533112 - DNA, 18 bp, Homo sapiens
tatgatattgcatatgca

SEQ ID NO: 2533113 - DNA, 15 bp, Homo sapiens
tatgatattttctgt

SEQ ID NO: 2533114 - DNA, 21 bp, Homo sapiens
tatgatcacggctcactgcag

SEQ ID NO: 2533115 - DNA, 15 bp, Homo sapiens
tatgatcgcgccact

SEQ ID NO: 2533116 - DNA, 16 bp, Homo sapiens
tatgattagtaaagaa

SEQ ID NO: 2533117 - DNA, 21 bp, Homo sapiens
tatgattcagattgttatcta

SEQ ID NO: 2533118 - DNA, 17 bp, Homo sapiens
tatgatttaaaacatgt

SEQ ID NO: 2533119 - DNA, 17 bp, Homo sapiens
tatgatttaataaaata

SEQ ID NO: 2533120 - DNA, 18 bp, Homo sapiens
tatgatttaataaaataa

SEQ ID NO: 2533121 - DNA, 18 bp, Homo sapiens
tatgatttatagtttgta

SEQ ID NO: 2533122 - DNA, 13 bp, Homo sapiens
tatgcaaagcact

SEQ ID NO: 2533123 - DNA, 18 bp, Homo sapiens
tatgcaatcaaatctgct

SEQ ID NO: 2533124 - DNA, 14 bp, Homo sapiens
tatgcacacatttt

SEQ ID NO: 2533125 - DNA, 14 bp, Homo sapiens
tatgcaccttgtgt

SEQ ID NO: 2533126 - DNA, 22 bp, Homo sapiens
tatgcaccttgtgtctgtacac

SEQ ID NO: 2533127 - DNA, 20 bp, Homo sapiens
tatgcacttataattttcct

SEQ ID NO: 2533128 - DNA, 17 bp, Homo sapiens
tatgcatctaataaaaa

SEQ ID NO: 2533129 - DNA, 13 bp, Homo sapiens
tatgcatgaagta

SEQ ID NO: 2533130 - DNA, 22 bp, Homo sapiens
tatgcatggtgtagatgccctg

SEQ ID NO: 2533131 - DNA, 16 bp, Homo sapiens
tatgcatgtgaagaaa

SEQ ID NO: 2533132 - DNA, 14 bp, Homo sapiens
tatgccagctcagt

SEQ ID NO: 2533133 - DNA, 14 bp, Homo sapiens
tatgccatgatgga

SEQ ID NO: 2533134 - DNA, 18 bp, Homo sapiens
tatgcccagtttctgcct

SEQ ID NO: 2533135 - DNA, 14 bp, Homo sapiens
tatgcctctccttt

SEQ ID NO: 2533136 - DNA, 14 bp, Homo sapiens
tatgccttcttatt

SEQ ID NO: 2533137 - DNA, 20 bp, Homo sapiens
tatgcctttaaatctgtgat

SEQ ID NO: 2533138 - DNA, 13 bp, Homo sapiens
tatgctaatcagg

SEQ ID NO: 2533139 - DNA, 22 bp, Homo sapiens
tatgcttatacacttacacttt

SEQ ID NO: 2533140 - DNA, 12 bp, Homo sapiens
tatgctttgaat

SEQ ID NO: 2533141 - DNA, 17 bp, Homo sapiens
tatggaaataaatgtat

SEQ ID NO: 2533142 - DNA, 13 bp, Homo sapiens
tatggaacttcta

SEQ ID NO: 2533143 - DNA, 20 bp, Homo sapiens
tatggaacttctaatatatt

SEQ ID NO: 2533144 - DNA, 22 bp, Homo sapiens
tatggaagcatattgttattat

SEQ ID NO: 2533145 - DNA, 24 bp, Homo sapiens
tatggaatacagtgttattttctt

SEQ ID NO: 2533146 - DNA, 18 bp, Homo sapiens
tatggaattacatgtaaa

SEQ ID NO: 2533147 - DNA, 22 bp, Homo sapiens
tatggaattacatgtaaaacat

SEQ ID NO: 2533148 - DNA, 16 bp, Homo sapiens
tatggactctgcacat

SEQ ID NO: 2533149 - DNA, 18 bp, Homo sapiens
tatggagccctgtaattt

SEQ ID NO: 2533150 - DNA, 20 bp, Homo sapiens
tatggatgattcagaaattg

SEQ ID NO: 2533151 - DNA, 22 bp, Homo sapiens
tatggcagaagacaccagagca

SEQ ID NO: 2533152 - DNA, 22 bp, Homo sapiens
tatggcccagtgtcaagttgtg

SEQ ID NO: 2533153 - DNA, 19 bp, Homo sapiens
tatggcctcagctgcctca

SEQ ID NO: 2533154 - DNA, 17 bp, Homo sapiens
tatggcttttgtgcatt

SEQ ID NO: 2533155 - DNA, 18 bp, Homo sapiens
tatggcttttgtgcatta

SEQ ID NO: 2533156 - DNA, 19 bp, Homo sapiens
tatggggggccaacaccag

SEQ ID NO: 2533157 - DNA, 23 bp, Homo sapiens
tatggggggccaacaccagggat

SEQ ID NO: 2533158 - DNA, 13 bp, Homo sapiens
tatggtataatgg

SEQ ID NO: 2533159 - DNA, 22 bp, Homo sapiens
tatggtcaacacttaagggttt

SEQ ID NO: 2533160 - DNA, 13 bp, Homo sapiens
tatggtgccaatg

SEQ ID NO: 2533161 - DNA, 19 bp, Homo sapiens
tatggtgccaatggaacct

SEQ ID NO: 2533162 - DNA, 12 bp, Homo sapiens
tatgtaaaataa

SEQ ID NO: 2533163 - DNA, 15 bp, Homo sapiens
tatgtaaacaggaga

SEQ ID NO: 2533164 - DNA, 19 bp, Homo sapiens
tatgtaaactgcattagaa

SEQ ID NO: 2533165 - DNA, 14 bp, Homo sapiens
tatgtaactgcatt

SEQ ID NO: 2533166 - DNA, 15 bp, Homo sapiens
tatgtaataatgtga

SEQ ID NO: 2533167 - DNA, 14 bp, Homo sapiens
tatgtacaagtgtt

SEQ ID NO: 2533168 - DNA, 19 bp, Homo sapiens
tatgtacgtttgtatgtgt

SEQ ID NO: 2533169 - DNA, 14 bp, Homo sapiens
tatgtagataacaa

SEQ ID NO: 2533170 - DNA, 16 bp, Homo sapiens
tatgtagatgtgcatt

SEQ ID NO: 2533171 - DNA, 15 bp, Homo sapiens
tatgtataattcaaa

SEQ ID NO: 2533172 - DNA, 19 bp, Homo sapiens
tatgtatatttaaaagaaa

SEQ ID NO: 2533173 - DNA, 16 bp, Homo sapiens
tatgtatgtgaaagtt

SEQ ID NO: 2533174 - DNA, 14 bp, Homo sapiens
tatgtatgtgtgta

SEQ ID NO: 2533175 - DNA, 17 bp, Homo sapiens
tatgtatgtgtgtatgg

SEQ ID NO: 2533176 - DNA, 16 bp, Homo sapiens
tatgtatgtttacata

SEQ ID NO: 2533177 - DNA, 20 bp, Homo sapiens
tatgtattgtaaacatgtgt

SEQ ID NO: 2533178 - DNA, 19 bp, Homo sapiens
tatgtcatcatacatgact

SEQ ID NO: 2533179 - DNA, 23 bp, Homo sapiens
tatgtccactgtgtatagaagta

SEQ ID NO: 2533180 - DNA, 13 bp, Homo sapiens
tatgtctatttaa

SEQ ID NO: 2533181 - DNA, 14 bp, Homo sapiens
tatgtcttggacac

SEQ ID NO: 2533182 - DNA, 14 bp, Homo sapiens
tatgtgaacattta

SEQ ID NO: 2533183 - DNA, 18 bp, Homo sapiens
tatgtgattttaactctg

SEQ ID NO: 2533184 - DNA, 19 bp, Homo sapiens
tatgtgattttaactctgt

SEQ ID NO: 2533185 - DNA, 12 bp, Homo sapiens
tatgtgcactgt

SEQ ID NO: 2533186 - DNA, 20 bp, Homo sapiens
tatgtgcactgtcactttgc

SEQ ID NO: 2533187 - DNA, 12 bp, Homo sapiens
tatgtggaagtg

SEQ ID NO: 2533188 - DNA, 17 bp, Homo sapiens
tatgtgggcagattttc

SEQ ID NO: 2533189 - DNA, 13 bp, Homo sapiens
tatgtgtatgtac

SEQ ID NO: 2533190 - DNA, 16 bp, Homo sapiens
tatgtgtgaggagctg

SEQ ID NO: 2533191 - DNA, 21 bp, Homo sapiens
tatgtgtgaggagctgctggc

SEQ ID NO: 2533192 - DNA, 14 bp, Homo sapiens
tatgtgtgtagaca

SEQ ID NO: 2533193 - DNA, 22 bp, Homo sapiens
tatgtgtgtgtgttgtgtgtgg

SEQ ID NO: 2533194 - DNA, 23 bp, Homo sapiens
tatgtgtgtgtgttgtgtgtggg

SEQ ID NO: 2533195 - DNA, 15 bp, Homo sapiens
tatgtgtttgtgtgt

SEQ ID NO: 2533196 - DNA, 15 bp, Homo sapiens
tatgtgtttttcaca

SEQ ID NO: 2533197 - DNA, 16 bp, Homo sapiens
tatgtgtttttcacat

SEQ ID NO: 2533198 - DNA, 17 bp, Homo sapiens
tatgtgtttttcacatt

SEQ ID NO: 2533199 - DNA, 19 bp, Homo sapiens
tatgttaacctcagtgtca

SEQ ID NO: 2533200 - DNA, 19 bp, Homo sapiens
tatgttgcccaggcaggtc

SEQ ID NO: 2533201 - DNA, 20 bp, Homo sapiens
tatgttgcctttatggtttc

SEQ ID NO: 2533202 - DNA, 16 bp, Homo sapiens
tatgttgtccaattgt

SEQ ID NO: 2533203 - DNA, 14 bp, Homo sapiens
tatgtttacatatc

SEQ ID NO: 2533204 - DNA, 14 bp, Homo sapiens
tatgtttgcacact

SEQ ID NO: 2533205 - DNA, 22 bp, Homo sapiens
tatgtttgccactttgcaaagg

SEQ ID NO: 2533206 - DNA, 22 bp, Homo sapiens
tatgttttgacatttttagttt

SEQ ID NO: 2533207 - DNA, 12 bp, Homo sapiens
tatgttttggta

SEQ ID NO: 2533208 - DNA, 23 bp, Homo sapiens
tatgttttttagatcaaatactt

SEQ ID NO: 2533209 - DNA, 13 bp, Homo sapiens
tattaaaaaacaa

SEQ ID NO: 2533210 - DNA, 12 bp, Homo sapiens
tattaaaaatat

SEQ ID NO: 2533211 - DNA, 18 bp, Homo sapiens
tattaaaaatctcaaatt

SEQ ID NO: 2533212 - DNA, 20 bp, Homo sapiens
tattaaacgtatgcatgtga

SEQ ID NO: 2533213 - DNA, 17 bp, Homo sapiens
tattaaatgcccagccc

SEQ ID NO: 2533214 - DNA, 19 bp, Homo sapiens
tattaaatgcccagcccct

SEQ ID NO: 2533215 - DNA, 23 bp, Homo sapiens
tattaacaaacatcactctgctg

SEQ ID NO: 2533216 - DNA, 18 bp, Homo sapiens
tattaacaaattatgtta

SEQ ID NO: 2533217 - DNA, 18 bp, Homo sapiens
tattaagatggattctca

SEQ ID NO: 2533218 - DNA, 19 bp, Homo sapiens
tattaagatggattctcag

SEQ ID NO: 2533219 - DNA, 17 bp, Homo sapiens
tattaagatttccaagt

SEQ ID NO: 2533220 - DNA, 20 bp, Homo sapiens
tattaatatatatctgctgt

SEQ ID NO: 2533221 - DNA, 13 bp, Homo sapiens
tattaatgaaaat

SEQ ID NO: 2533222 - DNA, 12 bp, Homo sapiens
tcagagagcagc

SEQ ID NO: 2533223 - DNA, 17 bp, Homo sapiens
tcagagaggagtcagag

SEQ ID NO: 2533224 - DNA, 16 bp, Homo sapiens
tcagagaggccttttg

SEQ ID NO: 2533225 - DNA, 11 bp, Homo sapiens
tcagagagggt

SEQ ID NO: 2533226 - DNA, 17 bp, Homo sapiens
tcagagcagcagtgaaa

SEQ ID NO: 2533227 - DNA, 20 bp, Homo sapiens
tcagagccgtggtcctttgg

SEQ ID NO: 2533228 - DNA, 14 bp, Homo sapiens
tcagagctgacaca

SEQ ID NO: 2533229 - DNA, 14 bp, Homo sapiens
tcagaggatggcca

SEQ ID NO: 2533230 - DNA, 19 bp, Homo sapiens
tcagaggatggccagtgtc

SEQ ID NO: 2533231 - DNA, 18 bp, Homo sapiens
tcagaggccctcgctgcc

SEQ ID NO: 2533232 - DNA, 21 bp, Homo sapiens
tcagaggccctcgctgccagc

SEQ ID NO: 2533233 - DNA, 15 bp, Homo sapiens
tcagaggcctataat

SEQ ID NO: 2533234 - DNA, 20 bp, Homo sapiens
tcagaggcctataatgaagc

SEQ ID NO: 2533235 - DNA, 23 bp, Homo sapiens
tcagaggtgaaagctatatcaat

SEQ ID NO: 2533236 - DNA, 14 bp, Homo sapiens
tcagagtccaggcc

SEQ ID NO: 2533237 - DNA, 18 bp, Homo sapiens
tcagatataaaagactga

SEQ ID NO: 2533238 - DNA, 20 bp, Homo sapiens
tcagatataaaagactgacc

SEQ ID NO: 2533239 - DNA, 18 bp, Homo sapiens
tcagatatatttttcaca

SEQ ID NO: 2533240 - DNA, 23 bp, Homo sapiens
tcagatattttttcagaaatatg

SEQ ID NO: 2533241 - DNA, 17 bp, Homo sapiens
tcagatcactactgcag

SEQ ID NO: 2533242 - DNA, 19 bp, Homo sapiens
tcagatccttgtttcaaac

SEQ ID NO: 2533243 - DNA, 16 bp, Homo sapiens
tcagatctctaacttc

SEQ ID NO: 2533244 - DNA, 15 bp, Homo sapiens
tcagatgtcttctgc

SEQ ID NO: 2533245 - DNA, 17 bp, Homo sapiens
tcagatgtcttctgcct

SEQ ID NO: 2533246 - DNA, 20 bp, Homo sapiens
tcagatgtcttctgcctgtt

SEQ ID NO: 2533247 - DNA, 21 bp, Homo sapiens
tcagattcccagagcaaaata

SEQ ID NO: 2533248 - DNA, 16 bp, Homo sapiens
tcagattgcatgtgac

SEQ ID NO: 2533249 - DNA, 19 bp, Homo sapiens
tcagattttaaaaagtctt

SEQ ID NO: 2533250 - DNA, 23 bp, Homo sapiens
tcagcaccaccctagtcccttcc

SEQ ID NO: 2533251 - DNA, 20 bp, Homo sapiens
tcagcacctacagtgtacag

SEQ ID NO: 2533252 - DNA, 15 bp, Homo sapiens
tcagcacgatttctg

SEQ ID NO: 2533253 - DNA, 18 bp, Homo sapiens
tcagcacgatttctgttt

SEQ ID NO: 2533254 - DNA, 19 bp, Homo sapiens
tcagcacgatttctgttta

SEQ ID NO: 2533255 - DNA, 17 bp, Homo sapiens
tcagcactgatttcaca

SEQ ID NO: 2533256 - DNA, 14 bp, Homo sapiens
tcagcaggaagcaa

SEQ ID NO: 2533257 - DNA, 20 bp, Homo sapiens
tcagcagtacctataaagta

SEQ ID NO: 2533258 - DNA, 17 bp, Homo sapiens
tcagcatacctttattg

SEQ ID NO: 2533259 - DNA, 19 bp, Homo sapiens
tcagcatgtctattcagct

SEQ ID NO: 2533260 - DNA, 16 bp, Homo sapiens
tcagccaaatgtaatt

SEQ ID NO: 2533261 - DNA, 23 bp, Homo sapiens
tcagccaaatgtaattgaataaa

SEQ ID NO: 2533262 - DNA, 12 bp, Homo sapiens
tcagccaagcac

SEQ ID NO: 2533263 - DNA, 16 bp, Homo sapiens
tcagccagggccaggg

SEQ ID NO: 2533264 - DNA, 16 bp, Homo sapiens
tcagcccaagatgctt

SEQ ID NO: 2533265 - DNA, 12 bp, Homo sapiens
tcagcccacccc

SEQ ID NO: 2533266 - DNA, 17 bp, Homo sapiens
tcagcccacccccctca

SEQ ID NO: 2533267 - DNA, 20 bp, Homo sapiens
tcagccccaccccaggtcct

SEQ ID NO: 2533268 - DNA, 11 bp, Homo sapiens
tcagcccctct

SEQ ID NO: 2533269 - DNA, 23 bp, Homo sapiens
tcagcccctcttgccccccaccc

SEQ ID NO: 2533270 - DNA, 14 bp, Homo sapiens
tcagcccctgatcc

SEQ ID NO: 2533271 - DNA, 21 bp, Homo sapiens
tcagccgagccgggcctgggg

SEQ ID NO: 2533272 - DNA, 23 bp, Homo sapiens
tcagccgtgtaaccatggaccca

SEQ ID NO: 2533273 - DNA, 19 bp, Homo sapiens
tcagcctagccgacctcag

SEQ ID NO: 2533274 - DNA, 14 bp, Homo sapiens
tcagcctccagcct

SEQ ID NO: 2533275 - DNA, 16 bp, Homo sapiens
tcagcctccagcctct

SEQ ID NO: 2533276 - DNA, 17 bp, Homo sapiens
tcagcctccagcctctg

SEQ ID NO: 2533277 - DNA, 18 bp, Homo sapiens
tcagcctccagcctctgt

SEQ ID NO: 2533278 - DNA, 14 bp, Homo sapiens
tcagcctcccaaag

SEQ ID NO: 2533279 - DNA, 19 bp, Homo sapiens
tcagcctcccaaagtgctg

SEQ ID NO: 2533280 - DNA, 20 bp, Homo sapiens
tcagcctcccaagtagctgg

SEQ ID NO: 2533281 - DNA, 21 bp, Homo sapiens
tcagcctcccgagtagctgag

SEQ ID NO: 2533282 - DNA, 20 bp, Homo sapiens
tcagcctcccgagtagctgg

SEQ ID NO: 2533283 - DNA, 22 bp, Homo sapiens
tcagcctcccgagtagctggga

SEQ ID NO: 2533284 - DNA, 17 bp, Homo sapiens
tcagcctctctcccagt

SEQ ID NO: 2533285 - DNA, 13 bp, Homo sapiens
tcagcctgaggct

SEQ ID NO: 2533286 - DNA, 16 bp, Homo sapiens
tcagcctgagtctcct

SEQ ID NO: 2533287 - DNA, 17 bp, Homo sapiens
tcagcctggtgggcctc

SEQ ID NO: 2533288 - DNA, 16 bp, Homo sapiens
tcagcctgtgctgccc

SEQ ID NO: 2533289 - DNA, 14 bp, Homo sapiens
tcagcggggacagc

SEQ ID NO: 2533290 - DNA, 13 bp, Homo sapiens
tcagcgttgcatg

SEQ ID NO: 2533291 - DNA, 23 bp, Homo sapiens
tcagctatttaaaaaaaaaagag

SEQ ID NO: 2533292 - DNA, 18 bp, Homo sapiens
tcagctccactttcagtg

SEQ ID NO: 2533293 - DNA, 18 bp, Homo sapiens
tcagctccagctcaccag

SEQ ID NO: 2533294 - DNA, 21 bp, Homo sapiens
tcagctccagctcaccagccc

SEQ ID NO: 2533295 - DNA, 23 bp, Homo sapiens
tcagctccagctcaccagcccca

SEQ ID NO: 2533296 - DNA, 14 bp, Homo sapiens
tcagctccaggtgg

SEQ ID NO: 2533297 - DNA, 17 bp, Homo sapiens
tcagctcccctcggaga

SEQ ID NO: 2533298 - DNA, 14 bp, Homo sapiens
tcagctccttcctg

SEQ ID NO: 2533299 - DNA, 17 bp, Homo sapiens
tcagctccttcctggag

SEQ ID NO: 2533300 - DNA, 18 bp, Homo sapiens
tcagctctgggagaggat

SEQ ID NO: 2533301 - DNA, 19 bp, Homo sapiens
tcagctcttggctccactg

SEQ ID NO: 2533302 - DNA, 15 bp, Homo sapiens
tcagctgaacctggg

SEQ ID NO: 2533303 - DNA, 15 bp, Homo sapiens
tcagctgcctcactt

SEQ ID NO: 2533304 - DNA, 24 bp, Homo sapiens
tcagctgcctcacttcctacaaga

SEQ ID NO: 2533305 - DNA, 15 bp, Homo sapiens
tcagctgctactact

SEQ ID NO: 2533306 - DNA, 16 bp, Homo sapiens
tcagctgctgaaacaa

SEQ ID NO: 2533307 - DNA, 20 bp, Homo sapiens
tcagctgtaagaagagactg

SEQ ID NO: 2533308 - DNA, 23 bp, Homo sapiens
tcagctgtaagaagagactggga

SEQ ID NO: 2533309 - DNA, 17 bp, Homo sapiens
tcagctgtacttcgtct

SEQ ID NO: 2533310 - DNA, 16 bp, Homo sapiens
tcagcttcatttgtgt

SEQ ID NO: 2533311 - DNA, 19 bp, Homo sapiens
tcagcttcgtttattttca

SEQ ID NO: 2533312 - DNA, 20 bp, Homo sapiens
tcagcttgtaaatagctcag

SEQ ID NO: 2533313 - DNA, 16 bp, Homo sapiens
tcagctttgccttcca

SEQ ID NO: 2533314 - DNA, 18 bp, Homo sapiens
tcagctttttgtcttttc

SEQ ID NO: 2533315 - DNA, 18 bp, Homo sapiens
tcaggaaatatatatgtg

SEQ ID NO: 2533316 - DNA, 21 bp, Homo sapiens
tcaggaaatcaaatatgcaaa

SEQ ID NO: 2533317 - DNA, 20 bp, Homo sapiens
tcaggaagatgaaagaggag

SEQ ID NO: 2533318 - DNA, 12 bp, Homo sapiens
tcaggaagctca

SEQ ID NO: 2533319 - DNA, 20 bp, Homo sapiens
tcaggaaggatgagcattta

SEQ ID NO: 2533320 - DNA, 16 bp, Homo sapiens
tcaggacccagaggaa

SEQ ID NO: 2533321 - DNA, 21 bp, Homo sapiens
tcaggacctgggacctcccct

SEQ ID NO: 2533322 - DNA, 20 bp, Homo sapiens
tcaggacttaacggctccag

SEQ ID NO: 2533323 - DNA, 12 bp, Homo sapiens
tcaggagaaaaa

SEQ ID NO: 2533324 - DNA, 20 bp, Homo sapiens
tcaggagaggggcagaacag

SEQ ID NO: 2533325 - DNA, 12 bp, Homo sapiens
tcaggaggctga

SEQ ID NO: 2533326 - DNA, 22 bp, Homo sapiens
tcaggagttagaggccagcctg

SEQ ID NO: 2533327 - DNA, 15 bp, Homo sapiens
tcaggatacatgtgc

SEQ ID NO: 2533328 - DNA, 18 bp, Homo sapiens
tcaggatactctgtcaga

SEQ ID NO: 2533329 - DNA, 13 bp, Homo sapiens
tcaggatgcccag

SEQ ID NO: 2533330 - DNA, 14 bp, Homo sapiens
tcaggatgcccagg

SEQ ID NO: 2533331 - DNA, 13 bp, Homo sapiens
tcaggcagctcaa

SEQ ID NO: 2533332 - DNA, 13 bp, Homo sapiens
tcaggcaggaagg

SEQ ID NO: 2533333 - DNA, 21 bp, Homo sapiens
tcaggcaggaagggcaggaag

SEQ ID NO: 2533334 - DNA, 19 bp, Homo sapiens
tcaggcataggcctgggtg

SEQ ID NO: 2533335 - DNA, 20 bp, Homo sapiens
tcaggcataggcctgggtgc

SEQ ID NO: 2533336 - DNA, 21 bp, Homo sapiens
tcaggccacctgcccccttct

SEQ ID NO: 2533337 - DNA, 11 bp, Homo sapiens
tcaggccaggc

SEQ ID NO: 2533338 - DNA, 13 bp, Homo sapiens
tcaggccaggccc

SEQ ID NO: 2533339 - DNA, 14 bp, Homo sapiens
tcaggccaggccct

SEQ ID NO: 2533340 - DNA, 18 bp, Homo sapiens
tcaggccaggccctctgc

SEQ ID NO: 2533341 - DNA, 20 bp, Homo sapiens
tcaggccaggccctctgccc

SEQ ID NO: 2533342 - DNA, 21 bp, Homo sapiens
tcaggccaggccctctgccca

SEQ ID NO: 2533343 - DNA, 22 bp, Homo sapiens
tcaggccaggccctctgcccac

SEQ ID NO: 2533344 - DNA, 23 bp, Homo sapiens
tcaggccaggccctctgcccact

SEQ ID NO: 2533345 - DNA, 16 bp, Homo sapiens
tcaggccaggtgcagt

SEQ ID NO: 2533346 - DNA, 17 bp, Homo sapiens
tcaggccaggtgcagtg

SEQ ID NO: 2533347 - DNA, 18 bp, Homo sapiens
tcaggccaggtgcagtgg

SEQ ID NO: 2533348 - DNA, 22 bp, Homo sapiens
tcaggccatcatcagtggagcc

SEQ ID NO: 2533349 - DNA, 18 bp, Homo sapiens
tcaggcctataaccccag

SEQ ID NO: 2533350 - DNA, 20 bp, Homo sapiens
tcaggcgatccacctgtctc

SEQ ID NO: 2533351 - DNA, 15 bp, Homo sapiens
tcaggctccattagg

SEQ ID NO: 2533352 - DNA, 13 bp, Homo sapiens
tcaggctctgccc

SEQ ID NO: 2533353 - DNA, 19 bp, Homo sapiens
tcaggctctgccctgccct

SEQ ID NO: 2533354 - DNA, 15 bp, Homo sapiens
tcaggcttccttggc

SEQ ID NO: 2533355 - DNA, 18 bp, Homo sapiens
tcaggcttgaaatgcatt

SEQ ID NO: 2533356 - DNA, 14 bp, Homo sapiens
tcagggacagagcc

SEQ ID NO: 2533357 - DNA, 17 bp, Homo sapiens
tcagggacccctgccct

SEQ ID NO: 2533358 - DNA, 15 bp, Homo sapiens
tcagggaggtcattt

SEQ ID NO: 2533359 - DNA, 16 bp, Homo sapiens
tcagggccccagcact

SEQ ID NO: 2533360 - DNA, 23 bp, Homo sapiens
tcagggctaaacgggcattgcct

SEQ ID NO: 2533361 - DNA, 21 bp, Homo sapiens
tcagggctcctgccttctgtc

SEQ ID NO: 2533362 - DNA, 18 bp, Homo sapiens
tcaggggactcagccctg

SEQ ID NO: 2533363 - DNA, 16 bp, Homo sapiens
tcaggggagtcccgtc

SEQ ID NO: 2533364 - DNA, 12 bp, Homo sapiens
tcaggggccaga

SEQ ID NO: 2533365 - DNA, 23 bp, Homo sapiens
tcaggggtcgtcaccacctctcc

SEQ ID NO: 2533366 - DNA, 19 bp, Homo sapiens
tcccattttggaagttttc

SEQ ID NO: 2533367 - DNA, 20 bp, Homo sapiens
tcccattttggaagttttca

SEQ ID NO: 2533368 - DNA, 14 bp, Homo sapiens
tccccaaatccgaa

SEQ ID NO: 2533369 - DNA, 18 bp, Homo sapiens
tccccaacagtgtgaagt

SEQ ID NO: 2533370 - DNA, 23 bp, Homo sapiens
tccccaacagtgtgaagttagaa

SEQ ID NO: 2533371 - DNA, 18 bp, Homo sapiens
tccccaacatgtaataag

SEQ ID NO: 2533372 - DNA, 19 bp, Homo sapiens
tccccaaccctgcccctgc

SEQ ID NO: 2533373 - DNA, 23 bp, Homo sapiens
tccccaagattcacacctgactc

SEQ ID NO: 2533374 - DNA, 10 bp, Homo sapiens
tccccacact

SEQ ID NO: 2533375 - DNA, 14 bp, Homo sapiens
tccccacactccta

SEQ ID NO: 2533376 - DNA, 15 bp, Homo sapiens
tccccaccgcagaca

SEQ ID NO: 2533377 - DNA, 17 bp, Homo sapiens
tccccaccgcagacagg

SEQ ID NO: 2533378 - DNA, 23 bp, Homo sapiens
tccccaccttcaattcctgggcc

SEQ ID NO: 2533379 - DNA, 20 bp, Homo sapiens
tccccaccttcttcagccac

SEQ ID NO: 2533380 - DNA, 22 bp, Homo sapiens
tccccactccctggctctcaga

SEQ ID NO: 2533381 - DNA, 18 bp, Homo sapiens
tccccactgcctactgca

SEQ ID NO: 2533382 - DNA, 18 bp, Homo sapiens
tccccactgcctgcccac

SEQ ID NO: 2533383 - DNA, 21 bp, Homo sapiens
tccccacttgtccgctgggtg

SEQ ID NO: 2533384 - DNA, 17 bp, Homo sapiens
tccccagaaaggagact

SEQ ID NO: 2533385 - DNA, 18 bp, Homo sapiens
tccccagagttccccatg

SEQ ID NO: 2533386 - DNA, 20 bp, Homo sapiens
tccccagagttccccatgca

SEQ ID NO: 2533387 - DNA, 22 bp, Homo sapiens
tccccagcagggtcttttcatc

SEQ ID NO: 2533388 - DNA, 23 bp, Homo sapiens
tccccagcagggtcttttcatct

SEQ ID NO: 2533389 - DNA, 14 bp, Homo sapiens
tccccagcccaggg

SEQ ID NO: 2533390 - DNA, 23 bp, Homo sapiens
tccccagcctttgatcaggtggg

SEQ ID NO: 2533391 - DNA, 15 bp, Homo sapiens
tccccagctgtttat

SEQ ID NO: 2533392 - DNA, 16 bp, Homo sapiens
tccccaggaggccagc

SEQ ID NO: 2533393 - DNA, 17 bp, Homo sapiens
tccccaggaggccagcc

SEQ ID NO: 2533394 - DNA, 20 bp, Homo sapiens
tccccaggaggccagccttg

SEQ ID NO: 2533395 - DNA, 23 bp, Homo sapiens
tccccaggaggccagccttgacc

SEQ ID NO: 2533396 - DNA, 12 bp, Homo sapiens
tccccaggccag

SEQ ID NO: 2533397 - DNA, 16 bp, Homo sapiens
tccccaggccaggcca

SEQ ID NO: 2533398 - DNA, 22 bp, Homo sapiens
tccccaggccaggccaccagga

SEQ ID NO: 2533399 - DNA, 13 bp, Homo sapiens
tccccaggcccca

SEQ ID NO: 2533400 - DNA, 19 bp, Homo sapiens
tccccaggccccaggaagc

SEQ ID NO: 2533401 - DNA, 18 bp, Homo sapiens
tccccaggggaaaatgaa

SEQ ID NO: 2533402 - DNA, 16 bp, Homo sapiens
tccccatcatcccagc

SEQ ID NO: 2533403 - DNA, 19 bp, Homo sapiens
tccccatcatcccagctgc

SEQ ID NO: 2533404 - DNA, 15 bp, Homo sapiens
tccccatcctccagc

SEQ ID NO: 2533405 - DNA, 14 bp, Homo sapiens
tccccattcttcct

SEQ ID NO: 2533406 - DNA, 22 bp, Homo sapiens
tccccattcttcctagttttct

SEQ ID NO: 2533407 - DNA, 12 bp, Homo sapiens
tcccccaacaga

SEQ ID NO: 2533408 - DNA, 14 bp, Homo sapiens
tcccccaaccccca

SEQ ID NO: 2533409 - DNA, 17 bp, Homo sapiens
tcccccaacccccaccc

SEQ ID NO: 2533410 - DNA, 19 bp, Homo sapiens
tcccccaacccccacccca

SEQ ID NO: 2533411 - DNA, 20 bp, Homo sapiens
tcccccaacccccaccccac

SEQ ID NO: 2533412 - DNA, 17 bp, Homo sapiens
tcccccaacctcagact

SEQ ID NO: 2533413 - DNA, 22 bp, Homo sapiens
tcccccaccagctaaggacatt

SEQ ID NO: 2533414 - DNA, 15 bp, Homo sapiens
tcccccagccccatc

SEQ ID NO: 2533415 - DNA, 13 bp, Homo sapiens
tcccccagccctg

SEQ ID NO: 2533416 - DNA, 15 bp, Homo sapiens
tcccccagccctgtg

SEQ ID NO: 2533417 - DNA, 12 bp, Homo sapiens
tccccccactct

SEQ ID NO: 2533418 - DNA, 14 bp, Homo sapiens
tcccccgccactcc

SEQ ID NO: 2533419 - DNA, 18 bp, Homo sapiens
tccccctcccccttctcc

SEQ ID NO: 2533420 - DNA, 12 bp, Homo sapiens
tccccctctgtc

SEQ ID NO: 2533421 - DNA, 15 bp, Homo sapiens
tccccctctgtccag

SEQ ID NO: 2533422 - DNA, 14 bp, Homo sapiens
tccccctgggctct

SEQ ID NO: 2533423 - DNA, 22 bp, Homo sapiens
tccccctgggctctgccccagc

SEQ ID NO: 2533424 - DNA, 23 bp, Homo sapiens
tccccctgggctctgccccagct

SEQ ID NO: 2533425 - DNA, 21 bp, Homo sapiens
tcccccttccatggactttgt

SEQ ID NO: 2533426 - DNA, 12 bp, Homo sapiens
tcccccttctcc

SEQ ID NO: 2533427 - DNA, 15 bp, Homo sapiens
tcccccttctcccac

SEQ ID NO: 2533428 - DNA, 23 bp, Homo sapiens
tcccccttgccaccccaccctcc

SEQ ID NO: 2533429 - DNA, 13 bp, Homo sapiens
tccccggctcgag

SEQ ID NO: 2533430 - DNA, 17 bp, Homo sapiens
tcccctaccactgtctt

SEQ ID NO: 2533431 - DNA, 20 bp, Homo sapiens
tcccctagtaagtgccttcc

SEQ ID NO: 2533432 - DNA, 22 bp, Homo sapiens
tcccctagtaagtgccttccat

SEQ ID NO: 2533433 - DNA, 15 bp, Homo sapiens
tcccctcacctcctc

SEQ ID NO: 2533434 - DNA, 16 bp, Homo sapiens
tcccctccaaggtatg

SEQ ID NO: 2533435 - DNA, 11 bp, Homo sapiens
tcccctcccat

SEQ ID NO: 2533436 - DNA, 17 bp, Homo sapiens
tcccctcccatctggga

SEQ ID NO: 2533437 - DNA, 15 bp, Homo sapiens
tcccctccctggctc

SEQ ID NO: 2533438 - DNA, 14 bp, Homo sapiens
tcccctccctgggt

SEQ ID NO: 2533439 - DNA, 16 bp, Homo sapiens
tcccctcctctcccct

SEQ ID NO: 2533440 - DNA, 18 bp, Homo sapiens
tcccctcctctcccctac

SEQ ID NO: 2533441 - DNA, 14 bp, Homo sapiens
tcccctccttctcc

SEQ ID NO: 2533442 - DNA, 16 bp, Homo sapiens
tcccctcggagaagag

SEQ ID NO: 2533443 - DNA, 14 bp, Homo sapiens
tcccctctctgcac

SEQ ID NO: 2533444 - DNA, 20 bp, Homo sapiens
tcccctctcttgcacccgcc

SEQ ID NO: 2533445 - DNA, 15 bp, Homo sapiens
tcccctctgctgctg

SEQ ID NO: 2533446 - DNA, 17 bp, Homo sapiens
tcccctctgctgctgtc

SEQ ID NO: 2533447 - DNA, 15 bp, Homo sapiens
tcccctgccctgctg

SEQ ID NO: 2533448 - DNA, 17 bp, Homo sapiens
tcccctgccctggtcca

SEQ ID NO: 2533449 - DNA, 15 bp, Homo sapiens
tcccctgctgggtgt

SEQ ID NO: 2533450 - DNA, 24 bp, Homo sapiens
tcccctgctgggtgtggcgcagca

SEQ ID NO: 2533451 - DNA, 16 bp, Homo sapiens
tcccctggactgggag

SEQ ID NO: 2533452 - DNA, 22 bp, Homo sapiens
tcccctgtagagtgggagctga

SEQ ID NO: 2533453 - DNA, 14 bp, Homo sapiens
tcccctgtgcagtc

SEQ ID NO: 2533454 - DNA, 20 bp, Homo sapiens
tcccctgtggggatctcagg

SEQ ID NO: 2533455 - DNA, 18 bp, Homo sapiens
tcccctgtttgtttctga

SEQ ID NO: 2533456 - DNA, 20 bp, Homo sapiens
tcccctgtttgtttctgaaa

SEQ ID NO: 2533457 - DNA, 21 bp, Homo sapiens
tcccctgtttgtttctgaaag

SEQ ID NO: 2533458 - DNA, 13 bp, Homo sapiens
tccccttcactcc

SEQ ID NO: 2533459 - DNA, 13 bp, Homo sapiens
tccccttccactg

SEQ ID NO: 2533460 - DNA, 17 bp, Homo sapiens
tccccttccactgaggg

SEQ ID NO: 2533461 - DNA, 13 bp, Homo sapiens
tccccttccctgc

SEQ ID NO: 2533462 - DNA, 16 bp, Homo sapiens
tccccttcctcactgc

SEQ ID NO: 2533463 - DNA, 13 bp, Homo sapiens
tccccttgcccag

SEQ ID NO: 2533464 - DNA, 16 bp, Homo sapiens
tccccttgcccagggc

SEQ ID NO: 2533465 - DNA, 24 bp, Homo sapiens
tccccttgcccagggctcagcctg

SEQ ID NO: 2533466 - DNA, 18 bp, Homo sapiens
tccccttgcccttgccct

SEQ ID NO: 2533467 - DNA, 20 bp, Homo sapiens
tccccttgcccttgccctga

SEQ ID NO: 2533468 - DNA, 21 bp, Homo sapiens
tccccttgcccttgccctgac

SEQ ID NO: 2533469 - DNA, 21 bp, Homo sapiens
tccccttttcttttctaccct

SEQ ID NO: 2533470 - DNA, 16 bp, Homo sapiens
tcccgaatagctggga

SEQ ID NO: 2533471 - DNA, 18 bp, Homo sapiens
tcccgaatagctgggact

SEQ ID NO: 2533472 - DNA, 17 bp, Homo sapiens
tcccgagtagctgggac

SEQ ID NO: 2533473 - DNA, 19 bp, Homo sapiens
tcccgcctcttcttcttca

SEQ ID NO: 2533474 - DNA, 18 bp, Homo sapiens
tcccggaggttgggtggg

SEQ ID NO: 2533475 - DNA, 23 bp, Homo sapiens
tcccggcatgggaaagccacctc

SEQ ID NO: 2533476 - DNA, 14 bp, Homo sapiens
tcccgggccctccc

SEQ ID NO: 2533477 - DNA, 14 bp, Homo sapiens
tcccggggctccac

SEQ ID NO: 2533478 - DNA, 16 bp, Homo sapiens
tcccgtcagggcccaa

SEQ ID NO: 2533479 - DNA, 16 bp, Homo sapiens
tcccgtggaacgtttt

SEQ ID NO: 2533480 - DNA, 22 bp, Homo sapiens
tcccgtggaacgtttttcctgt

SEQ ID NO: 2533481 - DNA, 19 bp, Homo sapiens
tccctaccccctaagagcc

SEQ ID NO: 2533482 - DNA, 17 bp, Homo sapiens
tccctacctcaggcagg

SEQ ID NO: 2533483 - DNA, 15 bp, Homo sapiens
tccctactgtaattt

SEQ ID NO: 2533484 - DNA, 15 bp, Homo sapiens
tccctacttcctgtg

SEQ ID NO: 2533485 - DNA, 16 bp, Homo sapiens
tccctacttcctgtga

SEQ ID NO: 2533486 - DNA, 18 bp, Homo sapiens
tccctagagggttcctgt

SEQ ID NO: 2533487 - DNA, 23 bp, Homo sapiens
tccctagatctttctattccaaa

SEQ ID NO: 2533488 - DNA, 16 bp, Homo sapiens
tccctagccagcactt

SEQ ID NO: 2533489 - DNA, 20 bp, Homo sapiens
tccctagccagcacttgtat

SEQ ID NO: 2533490 - DNA, 17 bp, Homo sapiens
tccctagtctattcatt

SEQ ID NO: 2533491 - DNA, 18 bp, Homo sapiens
tccctagtcttcaagcag

SEQ ID NO: 2533492 - DNA, 15 bp, Homo sapiens
tccctcaccctgagc

SEQ ID NO: 2533493 - DNA, 22 bp, Homo sapiens
tccctcaccctgagccccttcc

SEQ ID NO: 2533494 - DNA, 15 bp, Homo sapiens
tccctcagcccctct

SEQ ID NO: 2533495 - DNA, 13 bp, Homo sapiens
tccctcatctctc

SEQ ID NO: 2533496 - DNA, 14 bp, Homo sapiens
tccctcccccttgt

SEQ ID NO: 2533497 - DNA, 16 bp, Homo sapiens
tccctcccctgccatt

SEQ ID NO: 2533498 - DNA, 14 bp, Homo sapiens
tccctcccctgccc

SEQ ID NO: 2533499 - DNA, 17 bp, Homo sapiens
tccctcccctgccctgg

SEQ ID NO: 2533500 - DNA, 22 bp, Homo sapiens
tccctcccggcatgggaaagcc

SEQ ID NO: 2533501 - DNA, 15 bp, Homo sapiens
tccctccctttgaaa

SEQ ID NO: 2533502 - DNA, 19 bp, Homo sapiens
tccctccgatccttcctcc

SEQ ID NO: 2533503 - DNA, 14 bp, Homo sapiens
tccctcctcacctc

SEQ ID NO: 2533504 - DNA, 18 bp, Homo sapiens
tccctcctcacctctgga

SEQ ID NO: 2533505 - DNA, 16 bp, Homo sapiens
tccctcctgccgactc

SEQ ID NO: 2533506 - DNA, 16 bp, Homo sapiens
tccctctaatttatct

SEQ ID NO: 2533507 - DNA, 21 bp, Homo sapiens
tccctctacagagcttccctg

SEQ ID NO: 2533508 - DNA, 22 bp, Homo sapiens
tccctctacagagcttccctga

SEQ ID NO: 2533509 - DNA, 13 bp, Homo sapiens
tccctctctctga

SEQ ID NO: 2533510 - DNA, 16 bp, Homo sapiens
tccctctctcttctgc

SEQ ID NO: 2533511 - DNA, 21 bp, Homo sapiens
tctagctagaaatatgatttt

SEQ ID NO: 2533512 - DNA, 15 bp, Homo sapiens
tctaggaagaatttt

SEQ ID NO: 2533513 - DNA, 22 bp, Homo sapiens
tctaggaagaattttaaaaatg

SEQ ID NO: 2533514 - DNA, 23 bp, Homo sapiens
tctaggaagaattttaaaaatga

SEQ ID NO: 2533515 - DNA, 19 bp, Homo sapiens
tctaggagggagacactgg

SEQ ID NO: 2533516 - DNA, 18 bp, Homo sapiens
tctaggcatcccagggga

SEQ ID NO: 2533517 - DNA, 12 bp, Homo sapiens
tctaggctgggg

SEQ ID NO: 2533518 - DNA, 12 bp, Homo sapiens
tctagggaaaaa

SEQ ID NO: 2533519 - DNA, 18 bp, Homo sapiens
tctaggtggcaaggctgt

SEQ ID NO: 2533520 - DNA, 17 bp, Homo sapiens
tctaggtttaactcaga

SEQ ID NO: 2533521 - DNA, 20 bp, Homo sapiens
tctaggtttaactcagatca

SEQ ID NO: 2533522 - DNA, 22 bp, Homo sapiens
tctagtacttgggagacctgta

SEQ ID NO: 2533523 - DNA, 18 bp, Homo sapiens
tctagtctctctggggcc

SEQ ID NO: 2533524 - DNA, 15 bp, Homo sapiens
tctagtggtctttgt

SEQ ID NO: 2533525 - DNA, 19 bp, Homo sapiens
tctagtggtctttgtaaga

SEQ ID NO: 2533526 - DNA, 22 bp, Homo sapiens
tctagtttaattaatctgtaat

SEQ ID NO: 2533527 - DNA, 14 bp, Homo sapiens
tctagtttcttgtg

SEQ ID NO: 2533528 - DNA, 22 bp, Homo sapiens
tctagtttgattaaattcttgc

SEQ ID NO: 2533529 - DNA, 23 bp, Homo sapiens
tctagtttgattaaattcttgca

SEQ ID NO: 2533530 - DNA, 13 bp, Homo sapiens
tctataaataacc

SEQ ID NO: 2533531 - DNA, 13 bp, Homo sapiens
tctatagactcta

SEQ ID NO: 2533532 - DNA, 16 bp, Homo sapiens
tctatagactctagga

SEQ ID NO: 2533533 - DNA, 18 bp, Homo sapiens
tctataggaacatatgaa

SEQ ID NO: 2533534 - DNA, 20 bp, Homo sapiens
tctataggaacatatgaaaa

SEQ ID NO: 2533535 - DNA, 13 bp, Homo sapiens
tctatatgtactt

SEQ ID NO: 2533536 - DNA, 14 bp, Homo sapiens
tctatcagagaaaa

SEQ ID NO: 2533537 - DNA, 15 bp, Homo sapiens
tctatcatttttgta

SEQ ID NO: 2533538 - DNA, 17 bp, Homo sapiens
tctatcatttttgtaca

SEQ ID NO: 2533539 - DNA, 19 bp, Homo sapiens
tctatcttgctctgtaatc

SEQ ID NO: 2533540 - DNA, 17 bp, Homo sapiens
tctatgaagtatataat

SEQ ID NO: 2533541 - DNA, 13 bp, Homo sapiens
tctatgggactca

SEQ ID NO: 2533542 - DNA, 19 bp, Homo sapiens
tctatgtaaatgcatctgt

SEQ ID NO: 2533543 - DNA, 17 bp, Homo sapiens
tctattgggttcattat

SEQ ID NO: 2533544 - DNA, 22 bp, Homo sapiens
tctattgttgtacacagaaata

SEQ ID NO: 2533545 - DNA, 23 bp, Homo sapiens
tctattgttgtacacagaaatac

SEQ ID NO: 2533546 - DNA, 16 bp, Homo sapiens
tctattgtttattctt

SEQ ID NO: 2533547 - DNA, 17 bp, Homo sapiens
tctattgtttattcttt

SEQ ID NO: 2533548 - DNA, 22 bp, Homo sapiens
tctatttatttactgagcttct

SEQ ID NO: 2533549 - DNA, 15 bp, Homo sapiens
tctatttcctggaat

SEQ ID NO: 2533550 - DNA, 15 bp, Homo sapiens
tctatttctcctcca

SEQ ID NO: 2533551 - DNA, 20 bp, Homo sapiens
tctatttctcctccatggga

SEQ ID NO: 2533552 - DNA, 24 bp, Homo sapiens
tctattttgtaactttctctatga

SEQ ID NO: 2533553 - DNA, 14 bp, Homo sapiens
tctcaaactggggc

SEQ ID NO: 2533554 - DNA, 16 bp, Homo sapiens
tctcaaagttttgaaa

SEQ ID NO: 2533555 - DNA, 17 bp, Homo sapiens
tctcaaagttttgaaaa

SEQ ID NO: 2533556 - DNA, 19 bp, Homo sapiens
tctcaacaaagcacagtgt

SEQ ID NO: 2533557 - DNA, 13 bp, Homo sapiens
tctcaaccatccc

SEQ ID NO: 2533558 - DNA, 22 bp, Homo sapiens
tctcaacctaccaccccttcct

SEQ ID NO: 2533559 - DNA, 23 bp, Homo sapiens
tctcaacctaccaccccttcctg

SEQ ID NO: 2533560 - DNA, 14 bp, Homo sapiens
tctcaatatgctta

SEQ ID NO: 2533561 - DNA, 22 bp, Homo sapiens
tctcaatttttggttgaataaa

SEQ ID NO: 2533562 - DNA, 23 bp, Homo sapiens
tctcacacatgagcatcaggcca

SEQ ID NO: 2533563 - DNA, 21 bp, Homo sapiens
tctcacactggcgtagaagtt

SEQ ID NO: 2533564 - DNA, 21 bp, Homo sapiens
tctcacagtgggagccagggc

SEQ ID NO: 2533565 - DNA, 15 bp, Homo sapiens
tctcaccaggaaggg

SEQ ID NO: 2533566 - DNA, 16 bp, Homo sapiens
tctcaccgcagtcgtc

SEQ ID NO: 2533567 - DNA, 21 bp, Homo sapiens
tctcacgggcatgggcactcc

SEQ ID NO: 2533568 - DNA, 13 bp, Homo sapiens
tctcactaaactt

SEQ ID NO: 2533569 - DNA, 20 bp, Homo sapiens
tctcactatgttgcccaggc

SEQ ID NO: 2533570 - DNA, 12 bp, Homo sapiens
tctcactctgtc

SEQ ID NO: 2533571 - DNA, 16 bp, Homo sapiens
tctcactctgtcgccc

SEQ ID NO: 2533572 - DNA, 21 bp, Homo sapiens
tctcactgagaagattgtgaa

SEQ ID NO: 2533573 - DNA, 17 bp, Homo sapiens
tctcactgttccctctg

SEQ ID NO: 2533574 - DNA, 21 bp, Homo sapiens
tctcactgttccctctgctcc

SEQ ID NO: 2533575 - DNA, 17 bp, Homo sapiens
tctcactgttgcccagg

SEQ ID NO: 2533576 - DNA, 18 bp, Homo sapiens
tctcactgttgcccaggc

SEQ ID NO: 2533577 - DNA, 20 bp, Homo sapiens
tctcactgttgcccaggctg

SEQ ID NO: 2533578 - DNA, 17 bp, Homo sapiens
tctcacttttctccatg

SEQ ID NO: 2533579 - DNA, 18 bp, Homo sapiens
tctcagaagggaggctgg

SEQ ID NO: 2533580 - DNA, 21 bp, Homo sapiens
tctcagaatctcaaataacta

SEQ ID NO: 2533581 - DNA, 17 bp, Homo sapiens
tctcagaccctttagcc

SEQ ID NO: 2533582 - DNA, 21 bp, Homo sapiens
tctcagagctacttgggccat

SEQ ID NO: 2533583 - DNA, 20 bp, Homo sapiens
tctcagatatttatattttt

SEQ ID NO: 2533584 - DNA, 23 bp, Homo sapiens
tctcagatatttatatttttatt

SEQ ID NO: 2533585 - DNA, 16 bp, Homo sapiens
tctcagatccttgttt

SEQ ID NO: 2533586 - DNA, 19 bp, Homo sapiens
tctcagatccttgtttcaa

SEQ ID NO: 2533587 - DNA, 18 bp, Homo sapiens
tctcagcagcgaccaccc

SEQ ID NO: 2533588 - DNA, 15 bp, Homo sapiens
tctcagccaacgagt

SEQ ID NO: 2533589 - DNA, 21 bp, Homo sapiens
tctcagccgcttctgactgct

SEQ ID NO: 2533590 - DNA, 16 bp, Homo sapiens
tctcagctccaggtgg

SEQ ID NO: 2533591 - DNA, 18 bp, Homo sapiens
tctcagctcccatttcta

SEQ ID NO: 2533592 - DNA, 12 bp, Homo sapiens
tctcaggaaatc

SEQ ID NO: 2533593 - DNA, 14 bp, Homo sapiens
tctcaggaaatcaa

SEQ ID NO: 2533594 - DNA, 16 bp, Homo sapiens
tctcaggagcacaggc

SEQ ID NO: 2533595 - DNA, 18 bp, Homo sapiens
tctcaggagcacaggcag

SEQ ID NO: 2533596 - DNA, 20 bp, Homo sapiens
tctcaggagcacaggcagct

SEQ ID NO: 2533597 - DNA, 21 bp, Homo sapiens
tctcaggccacctgccccctt

SEQ ID NO: 2533598 - DNA, 20 bp, Homo sapiens
tctcaggctctgccctgccc

SEQ ID NO: 2533599 - DNA, 19 bp, Homo sapiens
tctcagggcctggtcgttt

SEQ ID NO: 2533600 - DNA, 11 bp, Homo sapiens
tctcagggctc

SEQ ID NO: 2533601 - DNA, 16 bp, Homo sapiens
tctcaggggctgtttg

SEQ ID NO: 2533602 - DNA, 18 bp, Homo sapiens
tctcagggtctctgctgc

SEQ ID NO: 2533603 - DNA, 15 bp, Homo sapiens
tctcagtcagtaatt

SEQ ID NO: 2533604 - DNA, 16 bp, Homo sapiens
tctcagtcatgcataa

SEQ ID NO: 2533605 - DNA, 17 bp, Homo sapiens
tctcagtctctgagcag

SEQ ID NO: 2533606 - DNA, 18 bp, Homo sapiens
tctcagtctctgagcagt

SEQ ID NO: 2533607 - DNA, 18 bp, Homo sapiens
tctcagtgttgagccttt

SEQ ID NO: 2533608 - DNA, 13 bp, Homo sapiens
tctcagtttcact

SEQ ID NO: 2533609 - DNA, 14 bp, Homo sapiens
tctcatacgtccac

SEQ ID NO: 2533610 - DNA, 17 bp, Homo sapiens
tctcatacgtccaccat

SEQ ID NO: 2533611 - DNA, 21 bp, Homo sapiens
tctcataggaaaagtacattt

SEQ ID NO: 2533612 - DNA, 23 bp, Homo sapiens
tctcataggaaaagtacatttaa

SEQ ID NO: 2533613 - DNA, 14 bp, Homo sapiens
tctcatccccaggg

SEQ ID NO: 2533614 - DNA, 13 bp, Homo sapiens
tctcatcctgcag

SEQ ID NO: 2533615 - DNA, 15 bp, Homo sapiens
tctcatggagaagtt

SEQ ID NO: 2533616 - DNA, 17 bp, Homo sapiens
tctcatgtgatcctttt

SEQ ID NO: 2533617 - DNA, 18 bp, Homo sapiens
tctcatgtgatcctttta

SEQ ID NO: 2533618 - DNA, 19 bp, Homo sapiens
tctcatgtgatccttttat

SEQ ID NO: 2533619 - DNA, 20 bp, Homo sapiens
tctcattggacccttccatg

SEQ ID NO: 2533620 - DNA, 22 bp, Homo sapiens
tctccaaaataaaactttttaa

SEQ ID NO: 2533621 - DNA, 14 bp, Homo sapiens
tctccaagaatgct

SEQ ID NO: 2533622 - DNA, 14 bp, Homo sapiens
tctccaaggaccag

SEQ ID NO: 2533623 - DNA, 23 bp, Homo sapiens
tctccaagggcttctgcaccctc

SEQ ID NO: 2533624 - DNA, 17 bp, Homo sapiens
tctccaagtctcagtgg

SEQ ID NO: 2533625 - DNA, 14 bp, Homo sapiens
tctccaagtgccag

SEQ ID NO: 2533626 - DNA, 21 bp, Homo sapiens
tctccaagtgccagaggtggg

SEQ ID NO: 2533627 - DNA, 23 bp, Homo sapiens
tctccaagtgccagaggtgggca

SEQ ID NO: 2533628 - DNA, 12 bp, Homo sapiens
tctccaccctgc

SEQ ID NO: 2533629 - DNA, 14 bp, Homo sapiens
tctccaccctgctc

SEQ ID NO: 2533630 - DNA, 16 bp, Homo sapiens
tctccaccctgctctc

SEQ ID NO: 2533631 - DNA, 14 bp, Homo sapiens
tctccacctgccag

SEQ ID NO: 2533632 - DNA, 15 bp, Homo sapiens
tctccacctgccagg

SEQ ID NO: 2533633 - DNA, 16 bp, Homo sapiens
tctccacctgccaggg

SEQ ID NO: 2533634 - DNA, 13 bp, Homo sapiens
tctccacctgctc

SEQ ID NO: 2533635 - DNA, 13 bp, Homo sapiens
tctccactccaga

SEQ ID NO: 2533636 - DNA, 12 bp, Homo sapiens
tctccagcccct

SEQ ID NO: 2533637 - DNA, 20 bp, Homo sapiens
tctccagggagtcccctccc

SEQ ID NO: 2533638 - DNA, 19 bp, Homo sapiens
tctccaggtctcacgggca

SEQ ID NO: 2533639 - DNA, 19 bp, Homo sapiens
tctccagtatccactttgc

SEQ ID NO: 2533640 - DNA, 17 bp, Homo sapiens
tctccagtggttgctgt

SEQ ID NO: 2533641 - DNA, 20 bp, Homo sapiens
tctccagtggttgctgttga

SEQ ID NO: 2533642 - DNA, 17 bp, Homo sapiens
tctccatcagctgtaag

SEQ ID NO: 2533643 - DNA, 13 bp, Homo sapiens
tctccatccacat

SEQ ID NO: 2533644 - DNA, 15 bp, Homo sapiens
tctccatggccctgc

SEQ ID NO: 2533645 - DNA, 18 bp, Homo sapiens
tctcccagataatgtgaa

SEQ ID NO: 2533646 - DNA, 23 bp, Homo sapiens
tctcccagataatgtgaaaatgg

SEQ ID NO: 2533647 - DNA, 13 bp, Homo sapiens
tctcccaggaagc

SEQ ID NO: 2533648 - DNA, 15 bp, Homo sapiens
tctcccagtcattta

SEQ ID NO: 2533649 - DNA, 14 bp, Homo sapiens
tctcccatccccct

SEQ ID NO: 2533650 - DNA, 22 bp, Homo sapiens
tctcccatccccctgccctcgt

SEQ ID NO: 2533651 - DNA, 20 bp, Homo sapiens
tctcccatggagccccagcc

SEQ ID NO: 2533652 - DNA, 22 bp, Homo sapiens
tctcccatggcttaatgcttct

SEQ ID NO: 2533653 - DNA, 10 bp, Homo sapiens
tctccccaca

SEQ ID NO: 2533654 - DNA, 11 bp, Homo sapiens
tctccccacac

SEQ ID NO: 2533655 - DNA, 12 bp, Homo sapiens
tctgttgaagtt

SEQ ID NO: 2533656 - DNA, 12 bp, Homo sapiens
tctgttgcaaac

SEQ ID NO: 2533657 - DNA, 18 bp, Homo sapiens
tctgttgccacaaccctg

SEQ ID NO: 2533658 - DNA, 15 bp, Homo sapiens
tctgttgccaggcta

SEQ ID NO: 2533659 - DNA, 18 bp, Homo sapiens
tctgttgtcattgctgtt

SEQ ID NO: 2533660 - DNA, 21 bp, Homo sapiens
tctgttgtcctccccttgggc

SEQ ID NO: 2533661 - DNA, 17 bp, Homo sapiens
tctgtttaaagtagatt

SEQ ID NO: 2533662 - DNA, 17 bp, Homo sapiens
tctgttttcctttctca

SEQ ID NO: 2533663 - DNA, 20 bp, Homo sapiens
tctgttttcctttctcaccg

SEQ ID NO: 2533664 - DNA, 18 bp, Homo sapiens
tcttaaaaagtggaaaaa

SEQ ID NO: 2533665 - DNA, 16 bp, Homo sapiens
tcttaaagctgcctgt

SEQ ID NO: 2533666 - DNA, 20 bp, Homo sapiens
tcttaaagctgcctgtagtt

SEQ ID NO: 2533667 - DNA, 19 bp, Homo sapiens
tcttaaataataaagatca

SEQ ID NO: 2533668 - DNA, 13 bp, Homo sapiens
tcttaaattttgt

SEQ ID NO: 2533669 - DNA, 18 bp, Homo sapiens
tcttaaattttgtgatat

SEQ ID NO: 2533670 - DNA, 19 bp, Homo sapiens
tcttaacaatttctgtcct

SEQ ID NO: 2533671 - DNA, 15 bp, Homo sapiens
tcttaagacttttgg

SEQ ID NO: 2533672 - DNA, 20 bp, Homo sapiens
tcttaagccatcttggtaaa

SEQ ID NO: 2533673 - DNA, 22 bp, Homo sapiens
tcttaagccatcttggtaaatt

SEQ ID NO: 2533674 - DNA, 22 bp, Homo sapiens
tcttaatcttttcacaaataaa

SEQ ID NO: 2533675 - DNA, 20 bp, Homo sapiens
tcttaattattatttgtgtt

SEQ ID NO: 2533676 - DNA, 19 bp, Homo sapiens
tcttaattttggttgtatt

SEQ ID NO: 2533677 - DNA, 20 bp, Homo sapiens
tcttaattttggttgtattc

SEQ ID NO: 2533678 - DNA, 17 bp, Homo sapiens
tcttacaggcacaaaat

SEQ ID NO: 2533679 - DNA, 18 bp, Homo sapiens
tcttactgtacctgttcc

SEQ ID NO: 2533680 - DNA, 13 bp, Homo sapiens
tcttagaaatgaa

SEQ ID NO: 2533681 - DNA, 14 bp, Homo sapiens
tcttagaaatgaag

SEQ ID NO: 2533682 - DNA, 14 bp, Homo sapiens
tcttagactacatt

SEQ ID NO: 2533683 - DNA, 15 bp, Homo sapiens
tcttagacttctgct

SEQ ID NO: 2533684 - DNA, 20 bp, Homo sapiens
tcttagacttctgctttcca

SEQ ID NO: 2533685 - DNA, 12 bp, Homo sapiens
tcttagatgtat

SEQ ID NO: 2533686 - DNA, 15 bp, Homo sapiens
tcttagctgtctgct

SEQ ID NO: 2533687 - DNA, 18 bp, Homo sapiens
tcttagctttttaattgt

SEQ ID NO: 2533688 - DNA, 12 bp, Homo sapiens
tcttataaatat

SEQ ID NO: 2533689 - DNA, 12 bp, Homo sapiens
tcttatctcagt

SEQ ID NO: 2533690 - DNA, 14 bp, Homo sapiens
tcttatctcagtca

SEQ ID NO: 2533691 - DNA, 20 bp, Homo sapiens
tcttatctcagtcatgcata

SEQ ID NO: 2533692 - DNA, 14 bp, Homo sapiens
tcttatgcaatttc

SEQ ID NO: 2533693 - DNA, 16 bp, Homo sapiens
tcttatgggctgggtt

SEQ ID NO: 2533694 - DNA, 22 bp, Homo sapiens
tcttattgcaaaatagcatttg

SEQ ID NO: 2533695 - DNA, 22 bp, Homo sapiens
tcttattgcccacgctggagtg

SEQ ID NO: 2533696 - DNA, 13 bp, Homo sapiens
tcttatttattat

SEQ ID NO: 2533697 - DNA, 18 bp, Homo sapiens
tcttcaacaggagaattt

SEQ ID NO: 2533698 - DNA, 23 bp, Homo sapiens
tcttcaacatcaatgttcattgt

SEQ ID NO: 2533699 - DNA, 15 bp, Homo sapiens
tcttcacaacagatt

SEQ ID NO: 2533700 - DNA, 18 bp, Homo sapiens
tcttcagaagacactgca

SEQ ID NO: 2533701 - DNA, 12 bp, Homo sapiens
tcttcagagact

SEQ ID NO: 2533702 - DNA, 20 bp, Homo sapiens
tcttcagagactcctgcagg

SEQ ID NO: 2533703 - DNA, 21 bp, Homo sapiens
tcttcagagactcctgcaggc

SEQ ID NO: 2533704 - DNA, 16 bp, Homo sapiens
tcttcagccacctctc

SEQ ID NO: 2533705 - DNA, 13 bp, Homo sapiens
tcttcagccatca

SEQ ID NO: 2533706 - DNA, 16 bp, Homo sapiens
tcttcagccatcaaca

SEQ ID NO: 2533707 - DNA, 12 bp, Homo sapiens
tcttcagcctag

SEQ ID NO: 2533708 - DNA, 13 bp, Homo sapiens
tcttcagcttctt

SEQ ID NO: 2533709 - DNA, 18 bp, Homo sapiens
tcttcaggcctccctctc

SEQ ID NO: 2533710 - DNA, 21 bp, Homo sapiens
tcttcagggtcctgagattta

SEQ ID NO: 2533711 - DNA, 18 bp, Homo sapiens
tcttcagttttatcttta

SEQ ID NO: 2533712 - DNA, 18 bp, Homo sapiens
tcttcatacctacatgta

SEQ ID NO: 2533713 - DNA, 22 bp, Homo sapiens
tcttcatactttttttcacagt

SEQ ID NO: 2533714 - DNA, 18 bp, Homo sapiens
tcttcatcttcaccagag

SEQ ID NO: 2533715 - DNA, 22 bp, Homo sapiens
tcttcattacctcagtgagaag

SEQ ID NO: 2533716 - DNA, 16 bp, Homo sapiens
tcttcatttcattgta

SEQ ID NO: 2533717 - DNA, 18 bp, Homo sapiens
tcttccaagcaaaggtga

SEQ ID NO: 2533718 - DNA, 11 bp, Homo sapiens
tcttccagaag

SEQ ID NO: 2533719 - DNA, 16 bp, Homo sapiens
tcttccagaagtgtga

SEQ ID NO: 2533720 - DNA, 17 bp, Homo sapiens
tcttccagaagtgtgat

SEQ ID NO: 2533721 - DNA, 18 bp, Homo sapiens
tcttccagaagtgtgatt

SEQ ID NO: 2533722 - DNA, 20 bp, Homo sapiens
tcttccagaagtgtgattgg

SEQ ID NO: 2533723 - DNA, 16 bp, Homo sapiens
tcttccataatgtata

SEQ ID NO: 2533724 - DNA, 13 bp, Homo sapiens
tcttccatcatgg

SEQ ID NO: 2533725 - DNA, 13 bp, Homo sapiens
tcttccatttgca

SEQ ID NO: 2533726 - DNA, 14 bp, Homo sapiens
tcttcccagggtag

SEQ ID NO: 2533727 - DNA, 19 bp, Homo sapiens
tcttccccactccccacct

SEQ ID NO: 2533728 - DNA, 14 bp, Homo sapiens
tcttcccctctcag

SEQ ID NO: 2533729 - DNA, 15 bp, Homo sapiens
tcttccccttgccct

SEQ ID NO: 2533730 - DNA, 23 bp, Homo sapiens
tcttccccttgcccttgccctga

SEQ ID NO: 2533731 - DNA, 19 bp, Homo sapiens
tcttccctacagttgaaaa

SEQ ID NO: 2533732 - DNA, 20 bp, Homo sapiens
tcttccctagagggttcctg

SEQ ID NO: 2533733 - DNA, 19 bp, Homo sapiens
tcttcccttttacatactg

SEQ ID NO: 2533734 - DNA, 22 bp, Homo sapiens
tcttcccttttacatactgctg

SEQ ID NO: 2533735 - DNA, 21 bp, Homo sapiens
tcttccgaaaaatcctcttcc

SEQ ID NO: 2533736 - DNA, 15 bp, Homo sapiens
tcttccggagatgta

SEQ ID NO: 2533737 - DNA, 19 bp, Homo sapiens
tcttcctagttttctcctc

SEQ ID NO: 2533738 - DNA, 14 bp, Homo sapiens
tcttcctctgaggc

SEQ ID NO: 2533739 - DNA, 12 bp, Homo sapiens
tcttcctctgct

SEQ ID NO: 2533740 - DNA, 13 bp, Homo sapiens
tcttcctgacact

SEQ ID NO: 2533741 - DNA, 15 bp, Homo sapiens
tcttcctgacacttt

SEQ ID NO: 2533742 - DNA, 16 bp, Homo sapiens
tcttcctgacacttta

SEQ ID NO: 2533743 - DNA, 18 bp, Homo sapiens
tcttccttggagggggga

SEQ ID NO: 2533744 - DNA, 18 bp, Homo sapiens
tcttcgggaagagaggag

SEQ ID NO: 2533745 - DNA, 14 bp, Homo sapiens
tcttcgtacagttc

SEQ ID NO: 2533746 - DNA, 17 bp, Homo sapiens
tcttcgtacagttcttc

SEQ ID NO: 2533747 - DNA, 15 bp, Homo sapiens
tcttctattttattc

SEQ ID NO: 2533748 - DNA, 15 bp, Homo sapiens
tcttctcaagtgcct

SEQ ID NO: 2533749 - DNA, 20 bp, Homo sapiens
tcttctcaggctctgccctg

SEQ ID NO: 2533750 - DNA, 14 bp, Homo sapiens
tcttctccaggatg

SEQ ID NO: 2533751 - DNA, 15 bp, Homo sapiens
tcttctccaggctgt

SEQ ID NO: 2533752 - DNA, 14 bp, Homo sapiens
tcttctccccaggt

SEQ ID NO: 2533753 - DNA, 13 bp, Homo sapiens
tcttctctagctg

SEQ ID NO: 2533754 - DNA, 15 bp, Homo sapiens
tcttctctagctggt

SEQ ID NO: 2533755 - DNA, 20 bp, Homo sapiens
tcttctctagctggtggttt

SEQ ID NO: 2533756 - DNA, 17 bp, Homo sapiens
tcttctgacgtgccttt

SEQ ID NO: 2533757 - DNA, 16 bp, Homo sapiens
tcttctgctccaccct

SEQ ID NO: 2533758 - DNA, 17 bp, Homo sapiens
tcttctgctccaccctt

SEQ ID NO: 2533759 - DNA, 22 bp, Homo sapiens
tcttctgctccacccttggcct

SEQ ID NO: 2533760 - DNA, 18 bp, Homo sapiens
tcttctgcttaggagaga

SEQ ID NO: 2533761 - DNA, 12 bp, Homo sapiens
tcttctgcttca

SEQ ID NO: 2533762 - DNA, 19 bp, Homo sapiens
tcttctgcttcagcctccc

SEQ ID NO: 2533763 - DNA, 22 bp, Homo sapiens
tcttctgcttcagcctcccgag

SEQ ID NO: 2533764 - DNA, 17 bp, Homo sapiens
tcttctggagtctccag

SEQ ID NO: 2533765 - DNA, 23 bp, Homo sapiens
tcttctgtacgtctgacaggcaa

SEQ ID NO: 2533766 - DNA, 19 bp, Homo sapiens
tcttctgtatactgtggag

SEQ ID NO: 2533767 - DNA, 23 bp, Homo sapiens
tcttctgtgattcggtggagact

SEQ ID NO: 2533768 - DNA, 13 bp, Homo sapiens
tcttctgtggacc

SEQ ID NO: 2533769 - DNA, 14 bp, Homo sapiens
tcttcttcaccatt

SEQ ID NO: 2533770 - DNA, 14 bp, Homo sapiens
tcttcttcagaaga

SEQ ID NO: 2533771 - DNA, 16 bp, Homo sapiens
tcttcttcagaagaca

SEQ ID NO: 2533772 - DNA, 22 bp, Homo sapiens
tcttcttccctccctatctaac

SEQ ID NO: 2533773 - DNA, 13 bp, Homo sapiens
tcttcttgaaatt

SEQ ID NO: 2533774 - DNA, 22 bp, Homo sapiens
tcttcttttgagcaactttctt

SEQ ID NO: 2533775 - DNA, 16 bp, Homo sapiens
tcttcttttggcttcc

SEQ ID NO: 2533776 - DNA, 18 bp, Homo sapiens
tcttcttttggcttccat

SEQ ID NO: 2533777 - DNA, 21 bp, Homo sapiens
tcttctttttgaaatcagcat

SEQ ID NO: 2533778 - DNA, 14 bp, Homo sapiens
tcttgaaagctgtg

SEQ ID NO: 2533779 - DNA, 13 bp, Homo sapiens
tcttgaaatgaaa

SEQ ID NO: 2533780 - DNA, 19 bp, Homo sapiens
tcttgaacactcatgctga

SEQ ID NO: 2533781 - DNA, 21 bp, Homo sapiens
tcttgaacactcatgctgaaa

SEQ ID NO: 2533782 - DNA, 15 bp, Homo sapiens
tcttgaactcctggc

SEQ ID NO: 2533783 - DNA, 16 bp, Homo sapiens
tcttgaactcctggcc

SEQ ID NO: 2533784 - DNA, 17 bp, Homo sapiens
tcttgaactcctggcct

SEQ ID NO: 2533785 - DNA, 18 bp, Homo sapiens
tcttgaactcctggcctc

SEQ ID NO: 2533786 - DNA, 14 bp, Homo sapiens
tcttgaatgtcttt

SEQ ID NO: 2533787 - DNA, 21 bp, Homo sapiens
tcttgacaccagctgttctgt

SEQ ID NO: 2533788 - DNA, 19 bp, Homo sapiens
tcttgaccaagcaggaagc

SEQ ID NO: 2533789 - DNA, 21 bp, Homo sapiens
tcttgaccaagcaggaagctc

SEQ ID NO: 2533790 - DNA, 13 bp, Homo sapiens
tcttgagcctggg

SEQ ID NO: 2533791 - DNA, 19 bp, Homo sapiens
tcttgagccttgaactttg

SEQ ID NO: 2533792 - DNA, 20 bp, Homo sapiens
tcttgagccttgaactttga

SEQ ID NO: 2533793 - DNA, 15 bp, Homo sapiens
tcttgaggccaggag

SEQ ID NO: 2533794 - DNA, 21 bp, Homo sapiens
tcttgatgcatgcactgttcc

SEQ ID NO: 2533795 - DNA, 18 bp, Homo sapiens
tcttgcaatggcagcctt

SEQ ID NO: 2533796 - DNA, 16 bp, Homo sapiens
tcttgccactgcctct

SEQ ID NO: 2533797 - DNA, 13 bp, Homo sapiens
tcttgcccttccc

SEQ ID NO: 2533798 - DNA, 16 bp, Homo sapiens
tcttgcccttccctgt

SEQ ID NO: 2533799 - DNA, 20 bp, Homo sapiens
tcttgctaatcagtgtctca

SEQ ID NO: 2533800 - DNA, 15 bp, Homo sapiens
tgacattcatgcctg

SEQ ID NO: 2533801 - DNA, 17 bp, Homo sapiens
tgacattcatgcctggc

SEQ ID NO: 2533802 - DNA, 21 bp, Homo sapiens
tgacattcctaaactatcttt

SEQ ID NO: 2533803 - DNA, 22 bp, Homo sapiens
tgacattctcaggaagccccca

SEQ ID NO: 2533804 - DNA, 16 bp, Homo sapiens
tgacattgctaagatg

SEQ ID NO: 2533805 - DNA, 18 bp, Homo sapiens
tgacattgctaagatgct

SEQ ID NO: 2533806 - DNA, 13 bp, Homo sapiens
tgacattgcttta

SEQ ID NO: 2533807 - DNA, 18 bp, Homo sapiens
tgacattgtagagcttct

SEQ ID NO: 2533808 - DNA, 22 bp, Homo sapiens
tgacattgtagagcttctggca

SEQ ID NO: 2533809 - DNA, 20 bp, Homo sapiens
tgacattgtggcacattctt

SEQ ID NO: 2533810 - DNA, 22 bp, Homo sapiens
tgacatttatttttctcatgaa

SEQ ID NO: 2533811 - DNA, 14 bp, Homo sapiens
tgacattttgccaa

SEQ ID NO: 2533812 - DNA, 18 bp, Homo sapiens
tgaccaaaatccccttct

SEQ ID NO: 2533813 - DNA, 17 bp, Homo sapiens
tgaccaacagttccttc

SEQ ID NO: 2533814 - DNA, 15 bp, Homo sapiens
tgaccaactagacat

SEQ ID NO: 2533815 - DNA, 20 bp, Homo sapiens
tgaccaactagacattctgt

SEQ ID NO: 2533816 - DNA, 21 bp, Homo sapiens
tgaccaactagacattctgtc

SEQ ID NO: 2533817 - DNA, 17 bp, Homo sapiens
tgaccaagagagaaaga

SEQ ID NO: 2533818 - DNA, 17 bp, Homo sapiens
tgaccaagcaggaagct

SEQ ID NO: 2533819 - DNA, 18 bp, Homo sapiens
tgaccaagcaggaagctc

SEQ ID NO: 2533820 - DNA, 13 bp, Homo sapiens
tgaccaagttata

SEQ ID NO: 2533821 - DNA, 23 bp, Homo sapiens
tgaccaatattatactaagaaaa

SEQ ID NO: 2533822 - DNA, 15 bp, Homo sapiens
tgaccaatgtcttga

SEQ ID NO: 2533823 - DNA, 20 bp, Homo sapiens
tgaccacacttcctgtccag

SEQ ID NO: 2533824 - DNA, 21 bp, Homo sapiens
tgaccacgctttctagctgtt

SEQ ID NO: 2533825 - DNA, 22 bp, Homo sapiens
tgaccacgctttctagctgttg

SEQ ID NO: 2533826 - DNA, 18 bp, Homo sapiens
tgaccactgcagaagaca

SEQ ID NO: 2533827 - DNA, 19 bp, Homo sapiens
tgaccagcaacttgtcttt

SEQ ID NO: 2533828 - DNA, 12 bp, Homo sapiens
tgaccaggcctg

SEQ ID NO: 2533829 - DNA, 19 bp, Homo sapiens
tgaccatccactctaccct

SEQ ID NO: 2533830 - DNA, 13 bp, Homo sapiens
tgaccattctcca

SEQ ID NO: 2533831 - DNA, 14 bp, Homo sapiens
tgaccattctccac

SEQ ID NO: 2533832 - DNA, 16 bp, Homo sapiens
tgacccaaagaccaat

SEQ ID NO: 2533833 - DNA, 11 bp, Homo sapiens
tgacccacccc

SEQ ID NO: 2533834 - DNA, 18 bp, Homo sapiens
tgacccacccctgtgctc

SEQ ID NO: 2533835 - DNA, 23 bp, Homo sapiens
tgacccacccctgtgctccgtgc

SEQ ID NO: 2533836 - DNA, 12 bp, Homo sapiens
tgacccactgct

SEQ ID NO: 2533837 - DNA, 21 bp, Homo sapiens
tgacccagccccttgagaaac

SEQ ID NO: 2533838 - DNA, 23 bp, Homo sapiens
tgacccagccccttgagaaacct

SEQ ID NO: 2533839 - DNA, 14 bp, Homo sapiens
tgacccaggccgca

SEQ ID NO: 2533840 - DNA, 16 bp, Homo sapiens
tgacccaggccgcagc

SEQ ID NO: 2533841 - DNA, 19 bp, Homo sapiens
tgacccaggccgcagctct

SEQ ID NO: 2533842 - DNA, 21 bp, Homo sapiens
tgacccaggccgcagctcttg

SEQ ID NO: 2533843 - DNA, 14 bp, Homo sapiens
tgacccatgctgcc

SEQ ID NO: 2533844 - DNA, 19 bp, Homo sapiens
tgacccatgctgccctgtg

SEQ ID NO: 2533845 - DNA, 21 bp, Homo sapiens
tgaccccaaacaccttccagc

SEQ ID NO: 2533846 - DNA, 22 bp, Homo sapiens
tgaccctcctgttgcacccagc

SEQ ID NO: 2533847 - DNA, 22 bp, Homo sapiens
tgaccctctgaatggtccaggg

SEQ ID NO: 2533848 - DNA, 22 bp, Homo sapiens
tgaccctgcgaaggggccctgg

SEQ ID NO: 2533849 - DNA, 16 bp, Homo sapiens
tgaccgtgggcggggc

SEQ ID NO: 2533850 - DNA, 23 bp, Homo sapiens
tgaccgtgggcggggccttgcgg

SEQ ID NO: 2533851 - DNA, 17 bp, Homo sapiens
tgacctactcgagggac

SEQ ID NO: 2533852 - DNA, 22 bp, Homo sapiens
tgacctagttttccatgcgtgt

SEQ ID NO: 2533853 - DNA, 21 bp, Homo sapiens
tgacctcaagatgtcctcctt

SEQ ID NO: 2533854 - DNA, 16 bp, Homo sapiens
tgacctcatgcatctc

SEQ ID NO: 2533855 - DNA, 22 bp, Homo sapiens
tgacctccatgactgcacagta

SEQ ID NO: 2533856 - DNA, 23 bp, Homo sapiens
tgacctcccagccctatggatgt

SEQ ID NO: 2533857 - DNA, 18 bp, Homo sapiens
tgacctcgtgatccaccc

SEQ ID NO: 2533858 - DNA, 12 bp, Homo sapiens
tgacctctgcct

SEQ ID NO: 2533859 - DNA, 13 bp, Homo sapiens
tgacctctgcctg

SEQ ID NO: 2533860 - DNA, 18 bp, Homo sapiens
tgacctctgttgtcctcc

SEQ ID NO: 2533861 - DNA, 21 bp, Homo sapiens
tgacctctgttgtcctcccct

SEQ ID NO: 2533862 - DNA, 22 bp, Homo sapiens
tgacctctgttgtcctcccctt

SEQ ID NO: 2533863 - DNA, 12 bp, Homo sapiens
tgacctgagggc

SEQ ID NO: 2533864 - DNA, 11 bp, Homo sapiens
tgacctgcagg

SEQ ID NO: 2533865 - DNA, 16 bp, Homo sapiens
tgacctgccaggcaca

SEQ ID NO: 2533866 - DNA, 19 bp, Homo sapiens
tgacctgccaggcacactg

SEQ ID NO: 2533867 - DNA, 20 bp, Homo sapiens
tgacctgccccgcccagctg

SEQ ID NO: 2533868 - DNA, 19 bp, Homo sapiens
tgacctgcctcccttcatg

SEQ ID NO: 2533869 - DNA, 22 bp, Homo sapiens
tgacctggataacttaggtggc

SEQ ID NO: 2533870 - DNA, 12 bp, Homo sapiens
tgacctgtcacc

SEQ ID NO: 2533871 - DNA, 13 bp, Homo sapiens
tgacctgtgacca

SEQ ID NO: 2533872 - DNA, 15 bp, Homo sapiens
tgacctgtgaccagc

SEQ ID NO: 2533873 - DNA, 19 bp, Homo sapiens
tgacctgtggggatttctc

SEQ ID NO: 2533874 - DNA, 21 bp, Homo sapiens
tgaccttagtgtttctgtgca

SEQ ID NO: 2533875 - DNA, 23 bp, Homo sapiens
tgaccttagtgtttctgtgcatg

SEQ ID NO: 2533876 - DNA, 20 bp, Homo sapiens
tgaccttcctcgcagagagg

SEQ ID NO: 2533877 - DNA, 21 bp, Homo sapiens
tgaccttcctcgcagagaggc

SEQ ID NO: 2533878 - DNA, 21 bp, Homo sapiens
tgaccttgaggagtcttgtgt

SEQ ID NO: 2533879 - DNA, 16 bp, Homo sapiens
tgaccttgcaacttca

SEQ ID NO: 2533880 - DNA, 19 bp, Homo sapiens
tgacgaacttccatggccc

SEQ ID NO: 2533881 - DNA, 13 bp, Homo sapiens
tgacgccatccca

SEQ ID NO: 2533882 - DNA, 15 bp, Homo sapiens
tgacgccatcccagc

SEQ ID NO: 2533883 - DNA, 17 bp, Homo sapiens
tgacgccatcccagccc

SEQ ID NO: 2533884 - DNA, 20 bp, Homo sapiens
tgacgctgaataaatgtctt

SEQ ID NO: 2533885 - DNA, 14 bp, Homo sapiens
tgacggaagaacat

SEQ ID NO: 2533886 - DNA, 18 bp, Homo sapiens
tgacggaagaacatagaa

SEQ ID NO: 2533887 - DNA, 18 bp, Homo sapiens
tgacggtgcagtctgggt

SEQ ID NO: 2533888 - DNA, 19 bp, Homo sapiens
tgacgtgccttttgcaccc

SEQ ID NO: 2533889 - DNA, 22 bp, Homo sapiens
tgacgtgccttttgcacccctc

SEQ ID NO: 2533890 - DNA, 15 bp, Homo sapiens
tgactaaaaaacaaa

SEQ ID NO: 2533891 - DNA, 14 bp, Homo sapiens
tgactaaaatattt

SEQ ID NO: 2533892 - DNA, 16 bp, Homo sapiens
tgactaaagagagaat

SEQ ID NO: 2533893 - DNA, 19 bp, Homo sapiens
tgactaattgtataacagg

SEQ ID NO: 2533894 - DNA, 22 bp, Homo sapiens
tgactaattgtataacaggtta

SEQ ID NO: 2533895 - DNA, 18 bp, Homo sapiens
tgactacagtcaggaaag

SEQ ID NO: 2533896 - DNA, 17 bp, Homo sapiens
tgactagaggcagggag

SEQ ID NO: 2533897 - DNA, 18 bp, Homo sapiens
tgactagggattcaggct

SEQ ID NO: 2533898 - DNA, 18 bp, Homo sapiens
tgactatatagagatgtt

SEQ ID NO: 2533899 - DNA, 22 bp, Homo sapiens
tgactatcaaactgaagccaga

SEQ ID NO: 2533900 - DNA, 16 bp, Homo sapiens
tgactcaaatctccag

SEQ ID NO: 2533901 - DNA, 19 bp, Homo sapiens
tgactcacaagaagaccag

SEQ ID NO: 2533902 - DNA, 19 bp, Homo sapiens
tgactcagggctcctgggt

SEQ ID NO: 2533903 - DNA, 20 bp, Homo sapiens
tgactcattctgaaggagcc

SEQ ID NO: 2533904 - DNA, 14 bp, Homo sapiens
tgactccaggagag

SEQ ID NO: 2533905 - DNA, 20 bp, Homo sapiens
tgactcctatgatctcaggt

SEQ ID NO: 2533906 - DNA, 21 bp, Homo sapiens
tgactccttgtggtttatgtc

SEQ ID NO: 2533907 - DNA, 13 bp, Homo sapiens
tgactctcaaatc

SEQ ID NO: 2533908 - DNA, 13 bp, Homo sapiens
tgactctctgtga

SEQ ID NO: 2533909 - DNA, 16 bp, Homo sapiens
tgactctgaaatctga

SEQ ID NO: 2533910 - DNA, 14 bp, Homo sapiens
tgactcttggcaca

SEQ ID NO: 2533911 - DNA, 14 bp, Homo sapiens
tgactgaatttctt

SEQ ID NO: 2533912 - DNA, 15 bp, Homo sapiens
tgactgctgattctc

SEQ ID NO: 2533913 - DNA, 15 bp, Homo sapiens
tgactggcacagtct

SEQ ID NO: 2533914 - DNA, 17 bp, Homo sapiens
tgactgtcactgttcct

SEQ ID NO: 2533915 - DNA, 11 bp, Homo sapiens
tgactgtgtgt

SEQ ID NO: 2533916 - DNA, 18 bp, Homo sapiens
tgactgttcaagagcaca

SEQ ID NO: 2533917 - DNA, 15 bp, Homo sapiens
tgactgtttttaccc

SEQ ID NO: 2533918 - DNA, 15 bp, Homo sapiens
tgacttactgtacat

SEQ ID NO: 2533919 - DNA, 16 bp, Homo sapiens
tgacttactgtacatg

SEQ ID NO: 2533920 - DNA, 20 bp, Homo sapiens
tgacttactgtacatgaaaa

SEQ ID NO: 2533921 - DNA, 17 bp, Homo sapiens
tgacttatttatataaa

SEQ ID NO: 2533922 - DNA, 18 bp, Homo sapiens
tgacttattttctctgtg

SEQ ID NO: 2533923 - DNA, 19 bp, Homo sapiens
tgacttattttctctgtgt

SEQ ID NO: 2533924 - DNA, 23 bp, Homo sapiens
tgacttcaatgatagtaagaaaa

SEQ ID NO: 2533925 - DNA, 15 bp, Homo sapiens
tgacttctaagtaaa

SEQ ID NO: 2533926 - DNA, 22 bp, Homo sapiens
tgacttctaagtaaaaccacag

SEQ ID NO: 2533927 - DNA, 14 bp, Homo sapiens
tgacttctccaggt

SEQ ID NO: 2533928 - DNA, 23 bp, Homo sapiens
tgacttctccaggtctcacgggc

SEQ ID NO: 2533929 - DNA, 19 bp, Homo sapiens
tgacttgacagaacactgt

SEQ ID NO: 2533930 - DNA, 13 bp, Homo sapiens
tgacttgcccagt

SEQ ID NO: 2533931 - DNA, 20 bp, Homo sapiens
tgacttttaaggctaaaact

SEQ ID NO: 2533932 - DNA, 22 bp, Homo sapiens
tgacttttctgtccgagctttg

SEQ ID NO: 2533933 - DNA, 22 bp, Homo sapiens
tgactttttctaagagctcccg

SEQ ID NO: 2533934 - DNA, 23 bp, Homo sapiens
tgactttttgcatttaaaacaga

SEQ ID NO: 2533935 - DNA, 21 bp, Homo sapiens
tgagaaaaatttacatggcaa

SEQ ID NO: 2533936 - DNA, 17 bp, Homo sapiens
tgagaaaacttctttta

SEQ ID NO: 2533937 - DNA, 21 bp, Homo sapiens
tgagaaagtcttatttattca

SEQ ID NO: 2533938 - DNA, 20 bp, Homo sapiens
tgagaaatgaataatttccc

SEQ ID NO: 2533939 - DNA, 12 bp, Homo sapiens
tgagaaatgcat

SEQ ID NO: 2533940 - DNA, 14 bp, Homo sapiens
tgagaaattaagta

SEQ ID NO: 2533941 - DNA, 18 bp, Homo sapiens
tgagaaccctgcgtgggg

SEQ ID NO: 2533942 - DNA, 22 bp, Homo sapiens
tgagaaccctgcgtggggacag

SEQ ID NO: 2533943 - DNA, 23 bp, Homo sapiens
tgcagcccccactgcctttgacc

SEQ ID NO: 2533944 - DNA, 14 bp, Homo sapiens
tgcagccgctgagc

SEQ ID NO: 2533945 - DNA, 22 bp, Homo sapiens
tgcagcctcaacctcctgggct

SEQ ID NO: 2533946 - DNA, 13 bp, Homo sapiens
tgcagcctcacag

SEQ ID NO: 2533947 - DNA, 17 bp, Homo sapiens
tgcagcctcacagtcct

SEQ ID NO: 2533948 - DNA, 14 bp, Homo sapiens
tgcagctatctggt

SEQ ID NO: 2533949 - DNA, 20 bp, Homo sapiens
tgcagctgacctctgttgtc

SEQ ID NO: 2533950 - DNA, 14 bp, Homo sapiens
tgcagctgatttta

SEQ ID NO: 2533951 - DNA, 19 bp, Homo sapiens
tgcagctgattttaacaat

SEQ ID NO: 2533952 - DNA, 16 bp, Homo sapiens
tgcagctttacatgca

SEQ ID NO: 2533953 - DNA, 15 bp, Homo sapiens
tgcaggacctcaggt

SEQ ID NO: 2533954 - DNA, 21 bp, Homo sapiens
tgcaggcaccttagtggcttt

SEQ ID NO: 2533955 - DNA, 13 bp, Homo sapiens
tgcaggcagccag

SEQ ID NO: 2533956 - DNA, 15 bp, Homo sapiens
tgcaggcagccaggc

SEQ ID NO: 2533957 - DNA, 16 bp, Homo sapiens
tgcaggcatcacagct

SEQ ID NO: 2533958 - DNA, 21 bp, Homo sapiens
tgcaggccaagagcagaggca

SEQ ID NO: 2533959 - DNA, 16 bp, Homo sapiens
tgcaggcctgctcagg

SEQ ID NO: 2533960 - DNA, 18 bp, Homo sapiens
tgcaggctggcaccgcct

SEQ ID NO: 2533961 - DNA, 15 bp, Homo sapiens
tgcagggaaaattat

SEQ ID NO: 2533962 - DNA, 21 bp, Homo sapiens
tgcagggaaaattatttgcat

SEQ ID NO: 2533963 - DNA, 23 bp, Homo sapiens
tgcagggagcatggctgtgagga

SEQ ID NO: 2533964 - DNA, 24 bp, Homo sapiens
tgcagggaggaggtggcagccctg

SEQ ID NO: 2533965 - DNA, 21 bp, Homo sapiens
tgcaggggattgaagccctcc

SEQ ID NO: 2533966 - DNA, 22 bp, Homo sapiens
tgcaggggattgaagccctcca

SEQ ID NO: 2533967 - DNA, 19 bp, Homo sapiens
tgcaggtgagcccatggcc

SEQ ID NO: 2533968 - DNA, 14 bp, Homo sapiens
tgcaggtgctgctg

SEQ ID NO: 2533969 - DNA, 20 bp, Homo sapiens
tgcaggttcttcttcctgaa

SEQ ID NO: 2533970 - DNA, 16 bp, Homo sapiens
tgcaggtttgttacat

SEQ ID NO: 2533971 - DNA, 16 bp, Homo sapiens
tgcagtagattttctt

SEQ ID NO: 2533972 - DNA, 21 bp, Homo sapiens
tgcagtcacgtggaggagcag

SEQ ID NO: 2533973 - DNA, 21 bp, Homo sapiens
tgcagtcagtcatgatggcac

SEQ ID NO: 2533974 - DNA, 13 bp, Homo sapiens
tgcagtcatcttg

SEQ ID NO: 2533975 - DNA, 19 bp, Homo sapiens
tgcagtcctgatcagagcc

SEQ ID NO: 2533976 - DNA, 22 bp, Homo sapiens
tgcagtcctgatcagagccgtg

SEQ ID NO: 2533977 - DNA, 19 bp, Homo sapiens
tgcagtgacgtgcacctgt

SEQ ID NO: 2533978 - DNA, 20 bp, Homo sapiens
tgcagtgatatggcagaaga

SEQ ID NO: 2533979 - DNA, 16 bp, Homo sapiens
tgcagtgcccctagct

SEQ ID NO: 2533980 - DNA, 21 bp, Homo sapiens
tgcagttacactaaaaggtga

SEQ ID NO: 2533981 - DNA, 15 bp, Homo sapiens
tgcagttcagcacca

SEQ ID NO: 2533982 - DNA, 19 bp, Homo sapiens
tgcagttcagcaccaccct

SEQ ID NO: 2533983 - DNA, 20 bp, Homo sapiens
tgcagttcccccaacctcag

SEQ ID NO: 2533984 - DNA, 17 bp, Homo sapiens
tgcagttctagtttgca

SEQ ID NO: 2533985 - DNA, 18 bp, Homo sapiens
tgcagttctagtttgcat

SEQ ID NO: 2533986 - DNA, 17 bp, Homo sapiens
tgcagttgacagcaggt

SEQ ID NO: 2533987 - DNA, 14 bp, Homo sapiens
tgcagttgccagtc

SEQ ID NO: 2533988 - DNA, 15 bp, Homo sapiens
tgcagttgccagtca

SEQ ID NO: 2533989 - DNA, 12 bp, Homo sapiens
tgcagtttatca

SEQ ID NO: 2533990 - DNA, 19 bp, Homo sapiens
tgcagtttatcattcaagt

SEQ ID NO: 2533991 - DNA, 12 bp, Homo sapiens
tgcataaatatg

SEQ ID NO: 2533992 - DNA, 14 bp, Homo sapiens
tgcataaatatgca

SEQ ID NO: 2533993 - DNA, 17 bp, Homo sapiens
tgcataacaattcctct

SEQ ID NO: 2533994 - DNA, 14 bp, Homo sapiens
tgcataagttaact

SEQ ID NO: 2533995 - DNA, 19 bp, Homo sapiens
tgcataataagctaaagag

SEQ ID NO: 2533996 - DNA, 12 bp, Homo sapiens
tgcatacacaca

SEQ ID NO: 2533997 - DNA, 14 bp, Homo sapiens
tgcatacacacaca

SEQ ID NO: 2533998 - DNA, 14 bp, Homo sapiens
tgcataccactttt

SEQ ID NO: 2533999 - DNA, 16 bp, Homo sapiens
tgcataccacttttgt

SEQ ID NO: 2534000 - DNA, 18 bp, Homo sapiens
tgcataccacttttgttc

SEQ ID NO: 2534001 - DNA, 14 bp, Homo sapiens
tgcatacttcaaaa

SEQ ID NO: 2534002 - DNA, 15 bp, Homo sapiens
tgcatacttcaaaag

SEQ ID NO: 2534003 - DNA, 17 bp, Homo sapiens
tgcatacttcaaaagta

SEQ ID NO: 2534004 - DNA, 21 bp, Homo sapiens
tgcatagtaccaatcatttta

SEQ ID NO: 2534005 - DNA, 19 bp, Homo sapiens
tgcatagttcccatgttaa

SEQ ID NO: 2534006 - DNA, 18 bp, Homo sapiens
tgcatataacttatattg

SEQ ID NO: 2534007 - DNA, 21 bp, Homo sapiens
tgcatataacttatattgtaa

SEQ ID NO: 2534008 - DNA, 22 bp, Homo sapiens
tgcatataacttatattgtaag

SEQ ID NO: 2534009 - DNA, 13 bp, Homo sapiens
tgcatatcctgag

SEQ ID NO: 2534010 - DNA, 16 bp, Homo sapiens
tgcatatcctgagcca

SEQ ID NO: 2534011 - DNA, 12 bp, Homo sapiens
tgcatatgtatg

SEQ ID NO: 2534012 - DNA, 22 bp, Homo sapiens
tgcatattcctttctatcattt

SEQ ID NO: 2534013 - DNA, 23 bp, Homo sapiens
tgcatattcttatgtatgtgaaa

SEQ ID NO: 2534014 - DNA, 15 bp, Homo sapiens
tgcatattgtacact

SEQ ID NO: 2534015 - DNA, 15 bp, Homo sapiens
tgcatattgtattac

SEQ ID NO: 2534016 - DNA, 13 bp, Homo sapiens
tgcatcagctgct

SEQ ID NO: 2534017 - DNA, 18 bp, Homo sapiens
tgcatccaaaggtgctca

SEQ ID NO: 2534018 - DNA, 17 bp, Homo sapiens
tgcatccaactccagga

SEQ ID NO: 2534019 - DNA, 22 bp, Homo sapiens
tgcatcgagtcaaaactcaaat

SEQ ID NO: 2534020 - DNA, 13 bp, Homo sapiens
tgcatctccacct

SEQ ID NO: 2534021 - DNA, 18 bp, Homo sapiens
tgcatctgggtagctgta

SEQ ID NO: 2534022 - DNA, 20 bp, Homo sapiens
tgcatctgggtagctgtaag

SEQ ID NO: 2534023 - DNA, 13 bp, Homo sapiens
tgcatctgtcctc

SEQ ID NO: 2534024 - DNA, 22 bp, Homo sapiens
tgcatgaagtaatatgcacaca

SEQ ID NO: 2534025 - DNA, 22 bp, Homo sapiens
tgcatgcactgttccccctgtg

SEQ ID NO: 2534026 - DNA, 22 bp, Homo sapiens
tgcatgccaaattgtagttctt

SEQ ID NO: 2534027 - DNA, 15 bp, Homo sapiens
tgcatgcggcccagc

SEQ ID NO: 2534028 - DNA, 18 bp, Homo sapiens
tgcatgcggcccagcccg

SEQ ID NO: 2534029 - DNA, 11 bp, Homo sapiens
tgcatggaaat

SEQ ID NO: 2534030 - DNA, 23 bp, Homo sapiens
tgcatggacaccccttatccagg

SEQ ID NO: 2534031 - DNA, 16 bp, Homo sapiens
tgcatggctccagaaa

SEQ ID NO: 2534032 - DNA, 19 bp, Homo sapiens
tgcatggctccagaaatgt

SEQ ID NO: 2534033 - DNA, 23 bp, Homo sapiens
tgcatggggtggggtagggctga

SEQ ID NO: 2534034 - DNA, 17 bp, Homo sapiens
tgcatgggtgaagggag

SEQ ID NO: 2534035 - DNA, 13 bp, Homo sapiens
tgcatgtgactct

SEQ ID NO: 2534036 - DNA, 16 bp, Homo sapiens
tgcatgtgactctgaa

SEQ ID NO: 2534037 - DNA, 11 bp, Homo sapiens
tgcatgtgtgt

SEQ ID NO: 2534038 - DNA, 22 bp, Homo sapiens
tgcatgttaggaaaatttcaca

SEQ ID NO: 2534039 - DNA, 14 bp, Homo sapiens
tgcatgttccacta

SEQ ID NO: 2534040 - DNA, 21 bp, Homo sapiens
tgcatgttttccagctcctca

SEQ ID NO: 2534041 - DNA, 17 bp, Homo sapiens
tgcattaaaagaaaata

SEQ ID NO: 2534042 - DNA, 11 bp, Homo sapiens
tgcattacaga

SEQ ID NO: 2534043 - DNA, 15 bp, Homo sapiens
tgcattacagagagg

SEQ ID NO: 2534044 - DNA, 16 bp, Homo sapiens
tgcattacagagagga

SEQ ID NO: 2534045 - DNA, 18 bp, Homo sapiens
tgcattacagagaggaga

SEQ ID NO: 2534046 - DNA, 13 bp, Homo sapiens
tgcattagaaatt

SEQ ID NO: 2534047 - DNA, 14 bp, Homo sapiens
tgcattagaaatta

SEQ ID NO: 2534048 - DNA, 23 bp, Homo sapiens
tgcattagaaattagctgtgtga

SEQ ID NO: 2534049 - DNA, 21 bp, Homo sapiens
tgcattatctagatactgtat

SEQ ID NO: 2534050 - DNA, 22 bp, Homo sapiens
tgcattatctagatactgtatc

SEQ ID NO: 2534051 - DNA, 23 bp, Homo sapiens
tgcattcctgatatgatttaaaa

SEQ ID NO: 2534052 - DNA, 12 bp, Homo sapiens
tgcattctagta

SEQ ID NO: 2534053 - DNA, 16 bp, Homo sapiens
tgcattctttctgtat

SEQ ID NO: 2534054 - DNA, 13 bp, Homo sapiens
tgcattgaatata

SEQ ID NO: 2534055 - DNA, 14 bp, Homo sapiens
tgcattgaatatat

SEQ ID NO: 2534056 - DNA, 20 bp, Homo sapiens
tgcattggaagaccccaccc

SEQ ID NO: 2534057 - DNA, 24 bp, Homo sapiens
tgcatttaaatacagtcttccatt

SEQ ID NO: 2534058 - DNA, 14 bp, Homo sapiens
tgcatttctctggg

SEQ ID NO: 2534059 - DNA, 18 bp, Homo sapiens
tgcatttgaggtctgttc

SEQ ID NO: 2534060 - DNA, 21 bp, Homo sapiens
tgcatttgaggtctgttcttt

SEQ ID NO: 2534061 - DNA, 21 bp, Homo sapiens
tgcatttggtggtttcagaaa

SEQ ID NO: 2534062 - DNA, 20 bp, Homo sapiens
tgcattttgctattgtaaat

SEQ ID NO: 2534063 - DNA, 14 bp, Homo sapiens
tgcatttttgtgaa

SEQ ID NO: 2534064 - DNA, 17 bp, Homo sapiens
tgcatttttgtgaaatg

SEQ ID NO: 2534065 - DNA, 20 bp, Homo sapiens
tgccaaaaaaagacagggct

SEQ ID NO: 2534066 - DNA, 14 bp, Homo sapiens
tgccaaagggaaat

SEQ ID NO: 2534067 - DNA, 18 bp, Homo sapiens
tgccaaagggaaatatca

SEQ ID NO: 2534068 - DNA, 18 bp, Homo sapiens
tgccaaattgtagttctt

SEQ ID NO: 2534069 - DNA, 23 bp, Homo sapiens
tgccaaattttggccaaagtgtt

SEQ ID NO: 2534070 - DNA, 15 bp, Homo sapiens
tgccaacaatcctag

SEQ ID NO: 2534071 - DNA, 20 bp, Homo sapiens
tgccaacaatcctagtgctt

SEQ ID NO: 2534072 - DNA, 21 bp, Homo sapiens
tgccaacaatcctagtgcttt

SEQ ID NO: 2534073 - DNA, 23 bp, Homo sapiens
tgccaacactcaagaagcaggct

SEQ ID NO: 2534074 - DNA, 16 bp, Homo sapiens
tgccaacctctggagc

SEQ ID NO: 2534075 - DNA, 21 bp, Homo sapiens
tgccaacttcttcagagctga

SEQ ID NO: 2534076 - DNA, 15 bp, Homo sapiens
tgccaagcacagtgc

SEQ ID NO: 2534077 - DNA, 19 bp, Homo sapiens
tgccaagcacagtgcctgc

SEQ ID NO: 2534078 - DNA, 14 bp, Homo sapiens
tgccaagcactgtg

SEQ ID NO: 2534079 - DNA, 16 bp, Homo sapiens
tgccaaggccagagtg

SEQ ID NO: 2534080 - DNA, 20 bp, Homo sapiens
tgccaaggccagagtggcct

SEQ ID NO: 2534081 - DNA, 18 bp, Homo sapiens
tgccaatggaacctcctt

SEQ ID NO: 2534082 - DNA, 21 bp, Homo sapiens
tgccaatttttgccttcatta

SEQ ID NO: 2534083 - DNA, 14 bp, Homo sapiens
tgccacacaaacgt

SEQ ID NO: 2534084 - DNA, 17 bp, Homo sapiens
tgccacagcctcccctg

SEQ ID NO: 2534085 - DNA, 22 bp, Homo sapiens
tgccacatttatttttatatct

SEQ ID NO: 2534086 - DNA, 16 bp, Homo sapiens
tgccaccagtcactgt

SEQ ID NO: 2534087 - DNA, 12 bp, Homo sapiens
tggaaactgaat

SEQ ID NO: 2534088 - DNA, 15 bp, Homo sapiens
tggaaactgaatgct

SEQ ID NO: 2534089 - DNA, 21 bp, Homo sapiens
tggaaagcatcacctcaggcc

SEQ ID NO: 2534090 - DNA, 12 bp, Homo sapiens
tggaaagcctct

SEQ ID NO: 2534091 - DNA, 16 bp, Homo sapiens
tggaaagcctctgctg

SEQ ID NO: 2534092 - DNA, 23 bp, Homo sapiens
tggaaaggctcagtctcaggagc

SEQ ID NO: 2534093 - DNA, 18 bp, Homo sapiens
tggaaaggggggagctgg

SEQ ID NO: 2534094 - DNA, 19 bp, Homo sapiens
tggaaaggggggagctggg

SEQ ID NO: 2534095 - DNA, 14 bp, Homo sapiens
tggaaagtgaattt

SEQ ID NO: 2534096 - DNA, 16 bp, Homo sapiens
tggaaagtgaatttga

SEQ ID NO: 2534097 - DNA, 17 bp, Homo sapiens
tggaaagtgaatttgaa

SEQ ID NO: 2534098 - DNA, 23 bp, Homo sapiens
tggaaagtgaatttgaatgaaaa

SEQ ID NO: 2534099 - DNA, 14 bp, Homo sapiens
tggaaagtgtaaag

SEQ ID NO: 2534100 - DNA, 15 bp, Homo sapiens
tggaaagtgtaaagc

SEQ ID NO: 2534101 - DNA, 18 bp, Homo sapiens
tggaaagtgtaaagcatt

SEQ ID NO: 2534102 - DNA, 13 bp, Homo sapiens
tggaaataaatgt

SEQ ID NO: 2534103 - DNA, 15 bp, Homo sapiens
tggaaatattaagaa

SEQ ID NO: 2534104 - DNA, 20 bp, Homo sapiens
tggaaatattaagaaagact

SEQ ID NO: 2534105 - DNA, 18 bp, Homo sapiens
tggaacccttttggcccc

SEQ ID NO: 2534106 - DNA, 19 bp, Homo sapiens
tggaacccttttggccccc

SEQ ID NO: 2534107 - DNA, 15 bp, Homo sapiens
tggaacctcctttct

SEQ ID NO: 2534108 - DNA, 21 bp, Homo sapiens
tggaacgtttttcctgttctt

SEQ ID NO: 2534109 - DNA, 16 bp, Homo sapiens
tggaactcattcctgc

SEQ ID NO: 2534110 - DNA, 14 bp, Homo sapiens
tggaactctcgagc

SEQ ID NO: 2534111 - DNA, 13 bp, Homo sapiens
tggaacttctaat

SEQ ID NO: 2534112 - DNA, 14 bp, Homo sapiens
tggaacttctaata

SEQ ID NO: 2534113 - DNA, 17 bp, Homo sapiens
tggaagaaattcctgta

SEQ ID NO: 2534114 - DNA, 23 bp, Homo sapiens
tggaagacagagacctcctgcct

SEQ ID NO: 2534115 - DNA, 21 bp, Homo sapiens
tggaagaggggacaggtccct

SEQ ID NO: 2534116 - DNA, 16 bp, Homo sapiens
tggaagcacagcttca

SEQ ID NO: 2534117 - DNA, 14 bp, Homo sapiens
tggaagctagctcc

SEQ ID NO: 2534118 - DNA, 19 bp, Homo sapiens
tggaaggaccacattttat

SEQ ID NO: 2534119 - DNA, 19 bp, Homo sapiens
tggaagggttctggctgcc

SEQ ID NO: 2534120 - DNA, 15 bp, Homo sapiens
tggaagggtttgtgg

SEQ ID NO: 2534121 - DNA, 20 bp, Homo sapiens
tggaaggtttggtgtgtgga

SEQ ID NO: 2534122 - DNA, 23 bp, Homo sapiens
tggaagtgactttggctgcatgc

SEQ ID NO: 2534123 - DNA, 14 bp, Homo sapiens
tggaagtgaggcat

SEQ ID NO: 2534124 - DNA, 19 bp, Homo sapiens
tggaagtgagggtcagaga

SEQ ID NO: 2534125 - DNA, 13 bp, Homo sapiens
tggaagtgtgggt

SEQ ID NO: 2534126 - DNA, 14 bp, Homo sapiens
tggaagtgtgggtc

SEQ ID NO: 2534127 - DNA, 21 bp, Homo sapiens
tggaagtgtgggtctgtgtgt

SEQ ID NO: 2534128 - DNA, 18 bp, Homo sapiens
tggaagttgcatggcatc

SEQ ID NO: 2534129 - DNA, 18 bp, Homo sapiens
tggaataaaatactattt

SEQ ID NO: 2534130 - DNA, 21 bp, Homo sapiens
tggaataaaatatttttttca

SEQ ID NO: 2534131 - DNA, 14 bp, Homo sapiens
tggaataacatgta

SEQ ID NO: 2534132 - DNA, 15 bp, Homo sapiens
tggaataacatgtaa

SEQ ID NO: 2534133 - DNA, 15 bp, Homo sapiens
tggaataagttcaaa

SEQ ID NO: 2534134 - DNA, 14 bp, Homo sapiens
tggaataatgtaaa

SEQ ID NO: 2534135 - DNA, 19 bp, Homo sapiens
tggaatagtatcctccagg

SEQ ID NO: 2534136 - DNA, 16 bp, Homo sapiens
tggaatatataaccag

SEQ ID NO: 2534137 - DNA, 15 bp, Homo sapiens
tggaatattgtccat

SEQ ID NO: 2534138 - DNA, 20 bp, Homo sapiens
tggaatattgtccattgtcc

SEQ ID NO: 2534139 - DNA, 17 bp, Homo sapiens
tggaatgaattaaataa

SEQ ID NO: 2534140 - DNA, 18 bp, Homo sapiens
tggaatgaattaaataaa

SEQ ID NO: 2534141 - DNA, 22 bp, Homo sapiens
tggaatgcttgaaaaatgtgca

SEQ ID NO: 2534142 - DNA, 21 bp, Homo sapiens
tggaatggttataaaagtgat

SEQ ID NO: 2534143 - DNA, 21 bp, Homo sapiens
tggaattaacctggtgctgga

SEQ ID NO: 2534144 - DNA, 17 bp, Homo sapiens
tggaattgggagcttgg

SEQ ID NO: 2534145 - DNA, 17 bp, Homo sapiens
tggaatttgtaacctca

SEQ ID NO: 2534146 - DNA, 17 bp, Homo sapiens
tggacaagccaacttgt

SEQ ID NO: 2534147 - DNA, 14 bp, Homo sapiens
tggacaaggaggtc

SEQ ID NO: 2534148 - DNA, 18 bp, Homo sapiens
tggacaatacccccaggc

SEQ ID NO: 2534149 - DNA, 15 bp, Homo sapiens
tggacacagctcttc

SEQ ID NO: 2534150 - DNA, 20 bp, Homo sapiens
tggacaccaggagtccctgg

SEQ ID NO: 2534151 - DNA, 21 bp, Homo sapiens
tggacaccccttatccaggac

SEQ ID NO: 2534152 - DNA, 22 bp, Homo sapiens
tggacaccccttatccaggact

SEQ ID NO: 2534153 - DNA, 23 bp, Homo sapiens
tggacaccccttatccaggactc

SEQ ID NO: 2534154 - DNA, 15 bp, Homo sapiens
tggacaccggaaaca

SEQ ID NO: 2534155 - DNA, 19 bp, Homo sapiens
tggacactccagtgccagc

SEQ ID NO: 2534156 - DNA, 21 bp, Homo sapiens
tggacactccagtgccagcaa

SEQ ID NO: 2534157 - DNA, 14 bp, Homo sapiens
tggacactgtacaa

SEQ ID NO: 2534158 - DNA, 17 bp, Homo sapiens
tggacagtcctgggaga

SEQ ID NO: 2534159 - DNA, 19 bp, Homo sapiens
tggacatagagagggagaa

SEQ ID NO: 2534160 - DNA, 19 bp, Homo sapiens
tggacatcctcttctgctt

SEQ ID NO: 2534161 - DNA, 17 bp, Homo sapiens
tggacattttttcagtc

SEQ ID NO: 2534162 - DNA, 20 bp, Homo sapiens
tggaccaatagggctgagct

SEQ ID NO: 2534163 - DNA, 13 bp, Homo sapiens
tggaccccagctg

SEQ ID NO: 2534164 - DNA, 14 bp, Homo sapiens
tggaccccagctgg

SEQ ID NO: 2534165 - DNA, 18 bp, Homo sapiens
tggaccccagctgggagg

SEQ ID NO: 2534166 - DNA, 12 bp, Homo sapiens
tggaccctgagg

SEQ ID NO: 2534167 - DNA, 13 bp, Homo sapiens
tggaccctgaggc

SEQ ID NO: 2534168 - DNA, 14 bp, Homo sapiens
tggaccctgaggcc

SEQ ID NO: 2534169 - DNA, 16 bp, Homo sapiens
tggaccctgaggccca

SEQ ID NO: 2534170 - DNA, 23 bp, Homo sapiens
tggaccctgtggatgataaaaca

SEQ ID NO: 2534171 - DNA, 13 bp, Homo sapiens
tggacccttccat

SEQ ID NO: 2534172 - DNA, 19 bp, Homo sapiens
tggacctgcctcctgcctg

SEQ ID NO: 2534173 - DNA, 20 bp, Homo sapiens
tggaccttgaactgggtact

SEQ ID NO: 2534174 - DNA, 22 bp, Homo sapiens
tggacctttcctgaggaagagg

SEQ ID NO: 2534175 - DNA, 18 bp, Homo sapiens
tggacggtgctccaggca

SEQ ID NO: 2534176 - DNA, 22 bp, Homo sapiens
tggacggtgctccaggcaggct

SEQ ID NO: 2534177 - DNA, 17 bp, Homo sapiens
tggacgttcggggcatg

SEQ ID NO: 2534178 - DNA, 18 bp, Homo sapiens
tggactattataatttaa

SEQ ID NO: 2534179 - DNA, 18 bp, Homo sapiens
tggactcaggatgcccag

SEQ ID NO: 2534180 - DNA, 18 bp, Homo sapiens
tggactccagactctctg

SEQ ID NO: 2534181 - DNA, 14 bp, Homo sapiens
tggactccggccct

SEQ ID NO: 2534182 - DNA, 17 bp, Homo sapiens
tggactctacactgtga

SEQ ID NO: 2534183 - DNA, 21 bp, Homo sapiens
tggactctacactgtgaactt

SEQ ID NO: 2534184 - DNA, 15 bp, Homo sapiens
tggactctcagtctc

SEQ ID NO: 2534185 - DNA, 13 bp, Homo sapiens
tggactctgcaca

SEQ ID NO: 2534186 - DNA, 22 bp, Homo sapiens
tggactctgcacatgtcttgta

SEQ ID NO: 2534187 - DNA, 14 bp, Homo sapiens
tggactcttgctct

SEQ ID NO: 2534188 - DNA, 18 bp, Homo sapiens
tggactcttgctctttct

SEQ ID NO: 2534189 - DNA, 18 bp, Homo sapiens
tggactggaaaatctctt

SEQ ID NO: 2534190 - DNA, 14 bp, Homo sapiens
tggactggaagggg

SEQ ID NO: 2534191 - DNA, 17 bp, Homo sapiens
tggactggagtggagca

SEQ ID NO: 2534192 - DNA, 17 bp, Homo sapiens
tggactggcccctgggt

SEQ ID NO: 2534193 - DNA, 20 bp, Homo sapiens
tggactggcccctgggtcag

SEQ ID NO: 2534194 - DNA, 22 bp, Homo sapiens
tggactggctagagtcctcact

SEQ ID NO: 2534195 - DNA, 20 bp, Homo sapiens
tggacttggtcaccagctcc

SEQ ID NO: 2534196 - DNA, 17 bp, Homo sapiens
tggacttgtatatttgt

SEQ ID NO: 2534197 - DNA, 22 bp, Homo sapiens
tggacttgtatatttgtacaaa

SEQ ID NO: 2534198 - DNA, 16 bp, Homo sapiens
tggactttccaccccc

SEQ ID NO: 2534199 - DNA, 18 bp, Homo sapiens
tggactttccaccccctc

SEQ ID NO: 2534200 - DNA, 17 bp, Homo sapiens
tggagaaacccttgaaa

SEQ ID NO: 2534201 - DNA, 15 bp, Homo sapiens
tggagaaaggagtga

SEQ ID NO: 2534202 - DNA, 15 bp, Homo sapiens
tggagaaattattta

SEQ ID NO: 2534203 - DNA, 17 bp, Homo sapiens
tggagaaattatttaat

SEQ ID NO: 2534204 - DNA, 18 bp, Homo sapiens
tggagaactagaacctgg

SEQ ID NO: 2534205 - DNA, 20 bp, Homo sapiens
tggagaactagaacctggag

SEQ ID NO: 2534206 - DNA, 21 bp, Homo sapiens
tggagaagctccctgaagtaa

SEQ ID NO: 2534207 - DNA, 14 bp, Homo sapiens
tggagaattatata

SEQ ID NO: 2534208 - DNA, 15 bp, Homo sapiens
tggagacattcctgg

SEQ ID NO: 2534209 - DNA, 20 bp, Homo sapiens
tggagacattcctgggcaca

SEQ ID NO: 2534210 - DNA, 22 bp, Homo sapiens
tggagacattcctgggcacagt

SEQ ID NO: 2534211 - DNA, 19 bp, Homo sapiens
tggagaccatgcagagcgc

SEQ ID NO: 2534212 - DNA, 20 bp, Homo sapiens
tggagaccatgcagagcgcc

SEQ ID NO: 2534213 - DNA, 18 bp, Homo sapiens
tggagactaagccctgtc

SEQ ID NO: 2534214 - DNA, 19 bp, Homo sapiens
tggagactcctaggcagga

SEQ ID NO: 2534215 - DNA, 18 bp, Homo sapiens
tggagactcctgccctgt

SEQ ID NO: 2534216 - DNA, 12 bp, Homo sapiens
tggagactgctt

SEQ ID NO: 2534217 - DNA, 19 bp, Homo sapiens
tggagactggtcctgtgtg

SEQ ID NO: 2534218 - DNA, 23 bp, Homo sapiens
tggagagaagtttctggccctgg

SEQ ID NO: 2534219 - DNA, 12 bp, Homo sapiens
tggagagagggg

SEQ ID NO: 2534220 - DNA, 20 bp, Homo sapiens
tggagagccagaacctggag

SEQ ID NO: 2534221 - DNA, 19 bp, Homo sapiens
tggagagctagaacctgga

SEQ ID NO: 2534222 - DNA, 20 bp, Homo sapiens
tggagagctagaacctggag

SEQ ID NO: 2534223 - DNA, 22 bp, Homo sapiens
tggagagctagaacctggagag

SEQ ID NO: 2534224 - DNA, 21 bp, Homo sapiens
tggagagctagaacctggagg

SEQ ID NO: 2534225 - DNA, 13 bp, Homo sapiens
tggagagctggag

SEQ ID NO: 2534226 - DNA, 15 bp, Homo sapiens
tggagagctggagcc

SEQ ID NO: 2534227 - DNA, 16 bp, Homo sapiens
tggagagctggtgccc

SEQ ID NO: 2534228 - DNA, 19 bp, Homo sapiens
tggagagctggtgcccgga

SEQ ID NO: 2534229 - DNA, 23 bp, Homo sapiens
tggagaggagggatgctgcctga

SEQ ID NO: 2534230 - DNA, 15 bp, Homo sapiens
tggagagtaaaaact

SEQ ID NO: 2534231 - DNA, 17 bp, Homo sapiens
tgggcaggtggtggcac

SEQ ID NO: 2534232 - DNA, 14 bp, Homo sapiens
tgggcattgctttc

SEQ ID NO: 2534233 - DNA, 20 bp, Homo sapiens
tgggcattgctttccactga

SEQ ID NO: 2534234 - DNA, 14 bp, Homo sapiens
tgggccagcccctc

SEQ ID NO: 2534235 - DNA, 18 bp, Homo sapiens
tgggccatagctcctgct

SEQ ID NO: 2534236 - DNA, 14 bp, Homo sapiens
tgggcccaaccctg

SEQ ID NO: 2534237 - DNA, 12 bp, Homo sapiens
tgggcccagaag

SEQ ID NO: 2534238 - DNA, 13 bp, Homo sapiens
tgggcccagatct

SEQ ID NO: 2534239 - DNA, 19 bp, Homo sapiens
tgggcccagctgggctctg

SEQ ID NO: 2534240 - DNA, 20 bp, Homo sapiens
tgggcccagctgggctctgc

SEQ ID NO: 2534241 - DNA, 22 bp, Homo sapiens
tgggcccagctgggctctgcca

SEQ ID NO: 2534242 - DNA, 10 bp, Homo sapiens
tgggcccagg

SEQ ID NO: 2534243 - DNA, 17 bp, Homo sapiens
tgggcccaggaccagct

SEQ ID NO: 2534244 - DNA, 18 bp, Homo sapiens
tgggcccaggaccagctg

SEQ ID NO: 2534245 - DNA, 21 bp, Homo sapiens
tgggcccaggaccagctgggg

SEQ ID NO: 2534246 - DNA, 22 bp, Homo sapiens
tgggcccaggaccagctggggc

SEQ ID NO: 2534247 - DNA, 23 bp, Homo sapiens
tgggcccaggaccagctggggcg

SEQ ID NO: 2534248 - DNA, 13 bp, Homo sapiens
tgggcccagggac

SEQ ID NO: 2534249 - DNA, 22 bp, Homo sapiens
tgggcccagggacaccagccag

SEQ ID NO: 2534250 - DNA, 18 bp, Homo sapiens
tgggccccagcccaccct

SEQ ID NO: 2534251 - DNA, 15 bp, Homo sapiens
tgggcccctctccca

SEQ ID NO: 2534252 - DNA, 18 bp, Homo sapiens
tgggcctcctctgtccag

SEQ ID NO: 2534253 - DNA, 20 bp, Homo sapiens
tgggcctcctctgtccaggg

SEQ ID NO: 2534254 - DNA, 16 bp, Homo sapiens
tgggcctctggtttgg

SEQ ID NO: 2534255 - DNA, 13 bp, Homo sapiens
tgggcctgcttcc

SEQ ID NO: 2534256 - DNA, 15 bp, Homo sapiens
tgggcctgcttcctg

SEQ ID NO: 2534257 - DNA, 17 bp, Homo sapiens
tgggcctgcttcctgtc

SEQ ID NO: 2534258 - DNA, 13 bp, Homo sapiens
tgggccttgctac

SEQ ID NO: 2534259 - DNA, 14 bp, Homo sapiens
tgggccttgctggg

SEQ ID NO: 2534260 - DNA, 16 bp, Homo sapiens
tgggcgccctggaagc

SEQ ID NO: 2534261 - DNA, 14 bp, Homo sapiens
tgggcggctgagag

SEQ ID NO: 2534262 - DNA, 15 bp, Homo sapiens
tgggcggctgagagc

SEQ ID NO: 2534263 - DNA, 21 bp, Homo sapiens
tgggcggctgagagccccagc

SEQ ID NO: 2534264 - DNA, 16 bp, Homo sapiens
tgggcggggccttgcg

SEQ ID NO: 2534265 - DNA, 20 bp, Homo sapiens
tgggcgtggtcactgctgtc

SEQ ID NO: 2534266 - DNA, 17 bp, Homo sapiens
tgggctaattaaataaa

SEQ ID NO: 2534267 - DNA, 19 bp, Homo sapiens
tgggctccctgactgggag

SEQ ID NO: 2534268 - DNA, 22 bp, Homo sapiens
tgggctctgcaattcccctctg

SEQ ID NO: 2534269 - DNA, 12 bp, Homo sapiens
tgggctctgccc

SEQ ID NO: 2534270 - DNA, 14 bp, Homo sapiens
tgggctctgggagc

SEQ ID NO: 2534271 - DNA, 15 bp, Homo sapiens
tgggctctgggagca

SEQ ID NO: 2534272 - DNA, 19 bp, Homo sapiens
tgggctgaacactccaatt

SEQ ID NO: 2534273 - DNA, 23 bp, Homo sapiens
tgggctgagactggatactgccc

SEQ ID NO: 2534274 - DNA, 19 bp, Homo sapiens
tgggctgagcccctacccc

SEQ ID NO: 2534275 - DNA, 16 bp, Homo sapiens
tgggctgagccctggc

SEQ ID NO: 2534276 - DNA, 16 bp, Homo sapiens
tgggctgccatgtgaa

SEQ ID NO: 2534277 - DNA, 16 bp, Homo sapiens
tgggctgctcctcatg

SEQ ID NO: 2534278 - DNA, 19 bp, Homo sapiens
tgggctggctccctcttgg

SEQ ID NO: 2534279 - DNA, 17 bp, Homo sapiens
tgggctggtgtcacctg

SEQ ID NO: 2534280 - DNA, 23 bp, Homo sapiens
tgggctgttggcactcacagacc

SEQ ID NO: 2534281 - DNA, 14 bp, Homo sapiens
tgggcttaagaaat

SEQ ID NO: 2534282 - DNA, 16 bp, Homo sapiens
tgggcttcactgtata

SEQ ID NO: 2534283 - DNA, 18 bp, Homo sapiens
tgggcttcactgtataaa

SEQ ID NO: 2534284 - DNA, 23 bp, Homo sapiens
tgggcttccatttgtgtgtgtgc

SEQ ID NO: 2534285 - DNA, 22 bp, Homo sapiens
tgggcttcccagtggctgctgc

SEQ ID NO: 2534286 - DNA, 21 bp, Homo sapiens
tgggcttgtctgtagatttta

SEQ ID NO: 2534287 - DNA, 24 bp, Homo sapiens
tggggaagactgtggctgctagca

SEQ ID NO: 2534288 - DNA, 13 bp, Homo sapiens
tggggacagggct

SEQ ID NO: 2534289 - DNA, 20 bp, Homo sapiens
tggggacatctctttgaatt

SEQ ID NO: 2534290 - DNA, 18 bp, Homo sapiens
tggggacctggtaccctc

SEQ ID NO: 2534291 - DNA, 19 bp, Homo sapiens
tggggacggggggccccag

SEQ ID NO: 2534292 - DNA, 21 bp, Homo sapiens
tggggagactgggctgaggga

SEQ ID NO: 2534293 - DNA, 17 bp, Homo sapiens
tggggagcagagacact

SEQ ID NO: 2534294 - DNA, 16 bp, Homo sapiens
tggggagccaacagaa

SEQ ID NO: 2534295 - DNA, 21 bp, Homo sapiens
tggggagcccgtctcagtgtt

SEQ ID NO: 2534296 - DNA, 14 bp, Homo sapiens
tggggagggatttg

SEQ ID NO: 2534297 - DNA, 22 bp, Homo sapiens
tggggaggggcgctggcccagc

SEQ ID NO: 2534298 - DNA, 16 bp, Homo sapiens
tggggagtgggacaga

SEQ ID NO: 2534299 - DNA, 13 bp, Homo sapiens
tggggatatgctt

SEQ ID NO: 2534300 - DNA, 23 bp, Homo sapiens
tggggatgagaaaggttgaagca

SEQ ID NO: 2534301 - DNA, 17 bp, Homo sapiens
tggggatttctcccagc

SEQ ID NO: 2534302 - DNA, 12 bp, Homo sapiens
tggggcaggcag

SEQ ID NO: 2534303 - DNA, 14 bp, Homo sapiens
tggggccacacaga

SEQ ID NO: 2534304 - DNA, 22 bp, Homo sapiens
tggggcccctttttactcccct

SEQ ID NO: 2534305 - DNA, 15 bp, Homo sapiens
tggggccctgcctcc

SEQ ID NO: 2534306 - DNA, 16 bp, Homo sapiens
tggggccctgcctcct

SEQ ID NO: 2534307 - DNA, 16 bp, Homo sapiens
tggggcctggacctgc

SEQ ID NO: 2534308 - DNA, 13 bp, Homo sapiens
tggggcgaggcag

SEQ ID NO: 2534309 - DNA, 19 bp, Homo sapiens
tggggcgggaaagccagtg

SEQ ID NO: 2534310 - DNA, 19 bp, Homo sapiens
tggggcgtggggagggccg

SEQ ID NO: 2534311 - DNA, 15 bp, Homo sapiens
tggggctcagagtgg

SEQ ID NO: 2534312 - DNA, 23 bp, Homo sapiens
tggggctgaccttcctcgcagag

SEQ ID NO: 2534313 - DNA, 14 bp, Homo sapiens
tggggctgattgta

SEQ ID NO: 2534314 - DNA, 19 bp, Homo sapiens
tggggctggtagctcaggt

SEQ ID NO: 2534315 - DNA, 17 bp, Homo sapiens
tgggggaagacctggca

SEQ ID NO: 2534316 - DNA, 19 bp, Homo sapiens
tgggggagtctgaagcaga

SEQ ID NO: 2534317 - DNA, 12 bp, Homo sapiens
tgggggagtgga

SEQ ID NO: 2534318 - DNA, 15 bp, Homo sapiens
tgggggagtggaata

SEQ ID NO: 2534319 - DNA, 21 bp, Homo sapiens
tgggggcggggtgggaaagat

SEQ ID NO: 2534320 - DNA, 13 bp, Homo sapiens
tgggggctggtgc

SEQ ID NO: 2534321 - DNA, 21 bp, Homo sapiens
tggggggccaacaccagggat

SEQ ID NO: 2534322 - DNA, 15 bp, Homo sapiens
tgggggtagagctga

SEQ ID NO: 2534323 - DNA, 16 bp, Homo sapiens
tgggggtagcagctgg

SEQ ID NO: 2534324 - DNA, 15 bp, Homo sapiens
tgggggtgagggtcc

SEQ ID NO: 2534325 - DNA, 12 bp, Homo sapiens
tgggggtgcatt

SEQ ID NO: 2534326 - DNA, 15 bp, Homo sapiens
tgggggtgcatttga

SEQ ID NO: 2534327 - DNA, 14 bp, Homo sapiens
tgggggtgccagga

SEQ ID NO: 2534328 - DNA, 15 bp, Homo sapiens
tgggggttctttctt

SEQ ID NO: 2534329 - DNA, 14 bp, Homo sapiens
tggggtacccactg

SEQ ID NO: 2534330 - DNA, 15 bp, Homo sapiens
tggggtacccactgc

SEQ ID NO: 2534331 - DNA, 17 bp, Homo sapiens
tggggtacccactgctc

SEQ ID NO: 2534332 - DNA, 18 bp, Homo sapiens
tggggtacccactgctct

SEQ ID NO: 2534333 - DNA, 19 bp, Homo sapiens
tggggtacccactgctctg

SEQ ID NO: 2534334 - DNA, 13 bp, Homo sapiens
tggggtcactctg

SEQ ID NO: 2534335 - DNA, 22 bp, Homo sapiens
tggggtcactctggcagctcag

SEQ ID NO: 2534336 - DNA, 20 bp, Homo sapiens
tggggtcctggagcagacca

SEQ ID NO: 2534337 - DNA, 23 bp, Homo sapiens
tggggtctcacagtgttgcccag

SEQ ID NO: 2534338 - DNA, 14 bp, Homo sapiens
tggggtgaggacca

SEQ ID NO: 2534339 - DNA, 15 bp, Homo sapiens
tggggtgggagaggt

SEQ ID NO: 2534340 - DNA, 12 bp, Homo sapiens
tggggtgggcct

SEQ ID NO: 2534341 - DNA, 16 bp, Homo sapiens
tggggtgggcctctgg

SEQ ID NO: 2534342 - DNA, 18 bp, Homo sapiens
tggggttggctgggccca

SEQ ID NO: 2534343 - DNA, 19 bp, Homo sapiens
tggggtttatcagaattct

SEQ ID NO: 2534344 - DNA, 17 bp, Homo sapiens
tgggtacttgtggacac

SEQ ID NO: 2534345 - DNA, 16 bp, Homo sapiens
tgggtccaaataaaaa

SEQ ID NO: 2534346 - DNA, 22 bp, Homo sapiens
tgggtccaaataaaaactaaat

SEQ ID NO: 2534347 - DNA, 15 bp, Homo sapiens
tgggtccaggggatg

SEQ ID NO: 2534348 - DNA, 21 bp, Homo sapiens
tgggtccaggggcccctccag

SEQ ID NO: 2534349 - DNA, 18 bp, Homo sapiens
tgggtccatgggcagagc

SEQ ID NO: 2534350 - DNA, 17 bp, Homo sapiens
tgggtcccccacgtgac

SEQ ID NO: 2534351 - DNA, 15 bp, Homo sapiens
tgggtctggctgagc

SEQ ID NO: 2534352 - DNA, 22 bp, Homo sapiens
tgggtctgttttcctttctcac

SEQ ID NO: 2534353 - DNA, 15 bp, Homo sapiens
tgggtgaagacagag

SEQ ID NO: 2534354 - DNA, 17 bp, Homo sapiens
tgggtgcccaagctcag

SEQ ID NO: 2534355 - DNA, 18 bp, Homo sapiens
tgggtgcccaagctcaga

SEQ ID NO: 2534356 - DNA, 18 bp, Homo sapiens
tgggtgctggctgcccag

SEQ ID NO: 2534357 - DNA, 22 bp, Homo sapiens
tgggtgcttggaggaaggaaac

SEQ ID NO: 2534358 - DNA, 14 bp, Homo sapiens
tgggtggagaagcc

SEQ ID NO: 2534359 - DNA, 14 bp, Homo sapiens
tgggtggatgcctg

SEQ ID NO: 2534360 - DNA, 15 bp, Homo sapiens
tgggtggcactgcca

SEQ ID NO: 2534361 - DNA, 15 bp, Homo sapiens
tgggtgggtggtggg

SEQ ID NO: 2534362 - DNA, 13 bp, Homo sapiens
tgggtggtaccct

SEQ ID NO: 2534363 - DNA, 14 bp, Homo sapiens
tgggtggtaccctc

SEQ ID NO: 2534364 - DNA, 22 bp, Homo sapiens
tgggtgtatttattttcctccc

SEQ ID NO: 2534365 - DNA, 14 bp, Homo sapiens
tgggtgtggcgcag

SEQ ID NO: 2534366 - DNA, 15 bp, Homo sapiens
tgggttattctggag

SEQ ID NO: 2534367 - DNA, 17 bp, Homo sapiens
tgggttattctggagtt

SEQ ID NO: 2534368 - DNA, 22 bp, Homo sapiens
tgggttcagaaatgctgcctgc

SEQ ID NO: 2534369 - DNA, 24 bp, Homo sapiens
tgggttcaggggactcagccctga

SEQ ID NO: 2534370 - DNA, 11 bp, Homo sapiens
tgggttcatta

SEQ ID NO: 2534371 - DNA, 20 bp, Homo sapiens
tgggttcattattggaatta

SEQ ID NO: 2534372 - DNA, 13 bp, Homo sapiens
tgggttcctcttc

SEQ ID NO: 2534373 - DNA, 16 bp, Homo sapiens
tgggttctacccaggt

SEQ ID NO: 2534374 - DNA, 17 bp, Homo sapiens
tgggttctgatattgcc

SEQ ID NO: 2534375 - DNA, 23 bp, Homo sapiens
tgggttctttggaaggagtgaga

SEQ ID NO: 2534376 - DNA, 18 bp, Homo sapiens
tgtgagacccccacacct

SEQ ID NO: 2534377 - DNA, 20 bp, Homo sapiens
tgtgaggagctgctggcttg

SEQ ID NO: 2534378 - DNA, 17 bp, Homo sapiens
tgtgaggccagggcaga

SEQ ID NO: 2534379 - DNA, 23 bp, Homo sapiens
tgtgaggcccatggttgagaaat

SEQ ID NO: 2534380 - DNA, 15 bp, Homo sapiens
tgtgagtaagagctg

SEQ ID NO: 2534381 - DNA, 19 bp, Homo sapiens
tgtgagtactacagtcctc

SEQ ID NO: 2534382 - DNA, 15 bp, Homo sapiens
tgtgagtcaccaagc

SEQ ID NO: 2534383 - DNA, 16 bp, Homo sapiens
tgtgagtgtaagtgtg

SEQ ID NO: 2534384 - DNA, 16 bp, Homo sapiens
tgtgagtttaaagcaa

SEQ ID NO: 2534385 - DNA, 15 bp, Homo sapiens
tgtgatatggagccc

SEQ ID NO: 2534386 - DNA, 21 bp, Homo sapiens
tgtgatccttttatgttattt

SEQ ID NO: 2534387 - DNA, 14 bp, Homo sapiens
tgtgatgaatactg

SEQ ID NO: 2534388 - DNA, 17 bp, Homo sapiens
tgtgatgccacacagag

SEQ ID NO: 2534389 - DNA, 17 bp, Homo sapiens
tgtgatgctttgaagta

SEQ ID NO: 2534390 - DNA, 15 bp, Homo sapiens
tgtgatggggccctg

SEQ ID NO: 2534391 - DNA, 17 bp, Homo sapiens
tgtgatggggccctgcc

SEQ ID NO: 2534392 - DNA, 19 bp, Homo sapiens
tgtgatggggccctgcctc

SEQ ID NO: 2534393 - DNA, 14 bp, Homo sapiens
tgtgattcaatctg

SEQ ID NO: 2534394 - DNA, 15 bp, Homo sapiens
tgtgattcaatctgt

SEQ ID NO: 2534395 - DNA, 16 bp, Homo sapiens
tgtgattcaatctgta

SEQ ID NO: 2534396 - DNA, 19 bp, Homo sapiens
tgtgattgggaataaatat

SEQ ID NO: 2534397 - DNA, 15 bp, Homo sapiens
tgtgatttaatagtg

SEQ ID NO: 2534398 - DNA, 16 bp, Homo sapiens
tgtgatttaatagtgt

SEQ ID NO: 2534399 - DNA, 20 bp, Homo sapiens
tgtgatttaatagtgttaat

SEQ ID NO: 2534400 - DNA, 23 bp, Homo sapiens
tgtgatttagaactgtatgtcag

SEQ ID NO: 2534401 - DNA, 13 bp, Homo sapiens
tgtgatttgactg

SEQ ID NO: 2534402 - DNA, 14 bp, Homo sapiens
tgtgatttgactgt

SEQ ID NO: 2534403 - DNA, 22 bp, Homo sapiens
tgtgatttggaagggaaacttt

SEQ ID NO: 2534404 - DNA, 18 bp, Homo sapiens
tgtgattttaactctgtc

SEQ ID NO: 2534405 - DNA, 15 bp, Homo sapiens
tgtgcaaattaacag

SEQ ID NO: 2534406 - DNA, 16 bp, Homo sapiens
tgtgcaagtgtatgca

SEQ ID NO: 2534407 - DNA, 20 bp, Homo sapiens
tgtgcacaattctgttttag

SEQ ID NO: 2534408 - DNA, 16 bp, Homo sapiens
tgtgcacatgcacgtg

SEQ ID NO: 2534409 - DNA, 14 bp, Homo sapiens
tgtgcacgtacaca

SEQ ID NO: 2534410 - DNA, 14 bp, Homo sapiens
tgtgcactgtcact

SEQ ID NO: 2534411 - DNA, 21 bp, Homo sapiens
tgtgcactgtcactttgctct

SEQ ID NO: 2534412 - DNA, 18 bp, Homo sapiens
tgtgcagactcaataaaa

SEQ ID NO: 2534413 - DNA, 22 bp, Homo sapiens
tgtgcagccccgcctccaggcc

SEQ ID NO: 2534414 - DNA, 22 bp, Homo sapiens
tgtgcagttctagtttgcattc

SEQ ID NO: 2534415 - DNA, 19 bp, Homo sapiens
tgtgcatagagccacgtat

SEQ ID NO: 2534416 - DNA, 15 bp, Homo sapiens
tgtgcatattgtaca

SEQ ID NO: 2534417 - DNA, 19 bp, Homo sapiens
tgtgcatgggtgaagggag

SEQ ID NO: 2534418 - DNA, 23 bp, Homo sapiens
tgtgcatgtatgtcttggacact

SEQ ID NO: 2534419 - DNA, 14 bp, Homo sapiens
tgtgcattatctag

SEQ ID NO: 2534420 - DNA, 23 bp, Homo sapiens
tgtgcattatctagatactgtat

SEQ ID NO: 2534421 - DNA, 23 bp, Homo sapiens
tgtgccactcaccgaagccactt

SEQ ID NO: 2534422 - DNA, 21 bp, Homo sapiens
tgtgccatagagtttaacaca

SEQ ID NO: 2534423 - DNA, 22 bp, Homo sapiens
tgtgccatagagtttaacacaa

SEQ ID NO: 2534424 - DNA, 12 bp, Homo sapiens
tgtgcccaagtt

SEQ ID NO: 2534425 - DNA, 17 bp, Homo sapiens
tgtgcccacatcccagg

SEQ ID NO: 2534426 - DNA, 20 bp, Homo sapiens
tgtgcccacatcccaggctt

SEQ ID NO: 2534427 - DNA, 19 bp, Homo sapiens
tgtgcccagcccggacctt

SEQ ID NO: 2534428 - DNA, 23 bp, Homo sapiens
tgtgccccatgcctgtccagcct

SEQ ID NO: 2534429 - DNA, 14 bp, Homo sapiens
tgtgccccctctac

SEQ ID NO: 2534430 - DNA, 14 bp, Homo sapiens
tgtgccctggtgga

SEQ ID NO: 2534431 - DNA, 15 bp, Homo sapiens
tgtgcctaacaccag

SEQ ID NO: 2534432 - DNA, 16 bp, Homo sapiens
tgtgcctaacaccagc

SEQ ID NO: 2534433 - DNA, 15 bp, Homo sapiens
tgtgcctggctcaga

SEQ ID NO: 2534434 - DNA, 14 bp, Homo sapiens
tgtgcgcctacagg

SEQ ID NO: 2534435 - DNA, 13 bp, Homo sapiens
tgtgcgtgaaaca

SEQ ID NO: 2534436 - DNA, 15 bp, Homo sapiens
tgtgcgtgcatgtgc

SEQ ID NO: 2534437 - DNA, 16 bp, Homo sapiens
tgtgctactttgcctt

SEQ ID NO: 2534438 - DNA, 20 bp, Homo sapiens
tgtgctatactgcatacttt

SEQ ID NO: 2534439 - DNA, 14 bp, Homo sapiens
tgtgctatgaattt

SEQ ID NO: 2534440 - DNA, 15 bp, Homo sapiens
tgtgctatgaatttt

SEQ ID NO: 2534441 - DNA, 20 bp, Homo sapiens
tgtgctcaaaatttgaagaa

SEQ ID NO: 2534442 - DNA, 21 bp, Homo sapiens
tgtgctccctggttctgatga

SEQ ID NO: 2534443 - DNA, 22 bp, Homo sapiens
tgtgctctgatcatccactgtg

SEQ ID NO: 2534444 - DNA, 14 bp, Homo sapiens
tgtgctgaccctcc

SEQ ID NO: 2534445 - DNA, 17 bp, Homo sapiens
tgtgctgaccctcctgt

SEQ ID NO: 2534446 - DNA, 21 bp, Homo sapiens
tgtgctgacggaagccaactt

SEQ ID NO: 2534447 - DNA, 12 bp, Homo sapiens
tgtgctgccctg

SEQ ID NO: 2534448 - DNA, 13 bp, Homo sapiens
tgtgctgccctgc

SEQ ID NO: 2534449 - DNA, 13 bp, Homo sapiens
tgtgctggagatg

SEQ ID NO: 2534450 - DNA, 20 bp, Homo sapiens
tgtgctggagccactaacta

SEQ ID NO: 2534451 - DNA, 16 bp, Homo sapiens
tgtgctgtggaagcaa

SEQ ID NO: 2534452 - DNA, 20 bp, Homo sapiens
tgtgctgtggggctggtagc

SEQ ID NO: 2534453 - DNA, 13 bp, Homo sapiens
tgtgctgtgtaaa

SEQ ID NO: 2534454 - DNA, 15 bp, Homo sapiens
tgtgctgtgtaaagt

SEQ ID NO: 2534455 - DNA, 23 bp, Homo sapiens
tgtgctgtgtaaagttagtctac

SEQ ID NO: 2534456 - DNA, 19 bp, Homo sapiens
tgtgcttcgggcccttccc

SEQ ID NO: 2534457 - DNA, 23 bp, Homo sapiens
tgtgcttgtttacagcactactc

SEQ ID NO: 2534458 - DNA, 14 bp, Homo sapiens
tgtgctttccagct

SEQ ID NO: 2534459 - DNA, 20 bp, Homo sapiens
tgtgctttccagctcacccc

SEQ ID NO: 2534460 - DNA, 16 bp, Homo sapiens
tgtgcttttcctattt

SEQ ID NO: 2534461 - DNA, 16 bp, Homo sapiens
tgtggaaaaatattta

SEQ ID NO: 2534462 - DNA, 20 bp, Homo sapiens
tgtggaaaaatgagagaagg

SEQ ID NO: 2534463 - DNA, 12 bp, Homo sapiens
tgtggaaagcct

SEQ ID NO: 2534464 - DNA, 14 bp, Homo sapiens
tgtggaaagcctct

SEQ ID NO: 2534465 - DNA, 20 bp, Homo sapiens
tgtggaaagcctctgctgcc

SEQ ID NO: 2534466 - DNA, 22 bp, Homo sapiens
tgtggaaagtgaatttgaatga

SEQ ID NO: 2534467 - DNA, 12 bp, Homo sapiens
tgtggaaagtgt

SEQ ID NO: 2534468 - DNA, 14 bp, Homo sapiens
tgtggaaagtgtaa

SEQ ID NO: 2534469 - DNA, 19 bp, Homo sapiens
tgtggaaagtgtaaagcat

SEQ ID NO: 2534470 - DNA, 15 bp, Homo sapiens
tgtggaagggactag

SEQ ID NO: 2534471 - DNA, 15 bp, Homo sapiens
tgtggaagtgtgggt

SEQ ID NO: 2534472 - DNA, 19 bp, Homo sapiens
tgtggacacagctcttctc

SEQ ID NO: 2534473 - DNA, 16 bp, Homo sapiens
tgtggactttgttcac

SEQ ID NO: 2534474 - DNA, 23 bp, Homo sapiens
tgtggagaaataaaaatacctct

SEQ ID NO: 2534475 - DNA, 18 bp, Homo sapiens
tgtggagcccgcaccccc

SEQ ID NO: 2534476 - DNA, 19 bp, Homo sapiens
tgtggagcccgcaccccca

SEQ ID NO: 2534477 - DNA, 15 bp, Homo sapiens
tgtggaggaaggatt

SEQ ID NO: 2534478 - DNA, 17 bp, Homo sapiens
tgtggaggaaggattgt

SEQ ID NO: 2534479 - DNA, 21 bp, Homo sapiens
tgtggaggaaggattgtaaaa

SEQ ID NO: 2534480 - DNA, 21 bp, Homo sapiens
tgtggaggtacactcttatag

SEQ ID NO: 2534481 - DNA, 19 bp, Homo sapiens
tgtggatcaaccatcgctt

SEQ ID NO: 2534482 - DNA, 21 bp, Homo sapiens
tgtggatttttgtggtagtga

SEQ ID NO: 2534483 - DNA, 22 bp, Homo sapiens
tgtggcaaagccttcattgcct

SEQ ID NO: 2534484 - DNA, 17 bp, Homo sapiens
tgtggcatctttgcctt

SEQ ID NO: 2534485 - DNA, 16 bp, Homo sapiens
tgtggccaaaggaggg

SEQ ID NO: 2534486 - DNA, 17 bp, Homo sapiens
tgtggcccctgaacaag

SEQ ID NO: 2534487 - DNA, 22 bp, Homo sapiens
tgtggcccctgaacaagaattg

SEQ ID NO: 2534488 - DNA, 12 bp, Homo sapiens
tgtggccccttc

SEQ ID NO: 2534489 - DNA, 13 bp, Homo sapiens
tgtggccccttca

SEQ ID NO: 2534490 - DNA, 13 bp, Homo sapiens
tgtggcctcagaa

SEQ ID NO: 2534491 - DNA, 15 bp, Homo sapiens
tgtggcctgggcctc

SEQ ID NO: 2534492 - DNA, 23 bp, Homo sapiens
tgtggctcccctctatttagcat

SEQ ID NO: 2534493 - DNA, 19 bp, Homo sapiens
tgtggctcctatctgtgtt

SEQ ID NO: 2534494 - DNA, 14 bp, Homo sapiens
tgtggctccttccc

SEQ ID NO: 2534495 - DNA, 15 bp, Homo sapiens
tgtggctccttccca

SEQ ID NO: 2534496 - DNA, 13 bp, Homo sapiens
tgtggctgaggag

SEQ ID NO: 2534497 - DNA, 21 bp, Homo sapiens
tgtggctgaggaggcctccat

SEQ ID NO: 2534498 - DNA, 16 bp, Homo sapiens
tgtggctgcagcagcg

SEQ ID NO: 2534499 - DNA, 18 bp, Homo sapiens
tgtggctgggggcaggag

SEQ ID NO: 2534500 - DNA, 18 bp, Homo sapiens
tgtgggaatgcggcaaga

SEQ ID NO: 2534501 - DNA, 14 bp, Homo sapiens
tgtgggagtgtgta

SEQ ID NO: 2534502 - DNA, 22 bp, Homo sapiens
tgtgggctagttgggcttcctc

SEQ ID NO: 2534503 - DNA, 14 bp, Homo sapiens
tgtgggctgtgagt

SEQ ID NO: 2534504 - DNA, 21 bp, Homo sapiens
tgtggggtttttggagaaggt

SEQ ID NO: 2534505 - DNA, 14 bp, Homo sapiens
tgtgggtctgtgtg

SEQ ID NO: 2534506 - DNA, 20 bp, Homo sapiens
tgtgggtctgtgtgtgtgta

SEQ ID NO: 2534507 - DNA, 13 bp, Homo sapiens
tgtggtcccaccc

SEQ ID NO: 2534508 - DNA, 19 bp, Homo sapiens
tgtggtgcctgaggtctgt

SEQ ID NO: 2534509 - DNA, 23 bp, Homo sapiens
tgtggtgggttctttggaaggag

SEQ ID NO: 2534510 - DNA, 14 bp, Homo sapiens
tgtggtgtctgtgt

SEQ ID NO: 2534511 - DNA, 16 bp, Homo sapiens
tgtggtgtttcctggc

SEQ ID NO: 2534512 - DNA, 20 bp, Homo sapiens
tgtggttaatgccatggaca

SEQ ID NO: 2534513 - DNA, 22 bp, Homo sapiens
tgtggttttcccctccctgggt

SEQ ID NO: 2534514 - DNA, 14 bp, Homo sapiens
tgtgtaaagttagt

SEQ ID NO: 2534515 - DNA, 17 bp, Homo sapiens
tgtgtaaagttagtcta

SEQ ID NO: 2534516 - DNA, 21 bp, Homo sapiens
tgtgtaacaattttaatgcta

SEQ ID NO: 2534517 - DNA, 18 bp, Homo sapiens
tgtgtaatagaaaactga

SEQ ID NO: 2534518 - DNA, 22 bp, Homo sapiens
tgtgtaatttaaaattgtgatg

SEQ ID NO: 2534519 - DNA, 23 bp, Homo sapiens
tgtgtacagaattctgctacctc

SEQ ID NO: 2534520 - DNA, 17 bp, Homo sapiens
ttaatgtttattcctga

SEQ ID NO: 2534521 - DNA, 13 bp, Homo sapiens
ttaattaaatgca

SEQ ID NO: 2534522 - DNA, 14 bp, Homo sapiens
ttaattaaatgctc

SEQ ID NO: 2534523 - DNA, 19 bp, Homo sapiens
ttaattaggggttgctaag

SEQ ID NO: 2534524 - DNA, 14 bp, Homo sapiens
ttaattattattct

SEQ ID NO: 2534525 - DNA, 17 bp, Homo sapiens
ttaattattattcttca

SEQ ID NO: 2534526 - DNA, 14 bp, Homo sapiens
ttaattattattta

SEQ ID NO: 2534527 - DNA, 21 bp, Homo sapiens
ttaattattatttgtgtttta

SEQ ID NO: 2534528 - DNA, 16 bp, Homo sapiens
ttaattcaccaaagta

SEQ ID NO: 2534529 - DNA, 14 bp, Homo sapiens
ttaattcatgtttc

SEQ ID NO: 2534530 - DNA, 16 bp, Homo sapiens
ttaattcctttctcat

SEQ ID NO: 2534531 - DNA, 17 bp, Homo sapiens
ttaattctcatgtgatc

SEQ ID NO: 2534532 - DNA, 21 bp, Homo sapiens
ttaattgacttatttatataa

SEQ ID NO: 2534533 - DNA, 16 bp, Homo sapiens
ttaattgttgtttctt

SEQ ID NO: 2534534 - DNA, 18 bp, Homo sapiens
ttaatttaaacacctcct

SEQ ID NO: 2534535 - DNA, 14 bp, Homo sapiens
ttaatttatttttg

SEQ ID NO: 2534536 - DNA, 13 bp, Homo sapiens
ttaattttcagta

SEQ ID NO: 2534537 - DNA, 18 bp, Homo sapiens
ttaattttggttgtattc

SEQ ID NO: 2534538 - DNA, 20 bp, Homo sapiens
ttaattttggttgtattctt

SEQ ID NO: 2534539 - DNA, 14 bp, Homo sapiens
ttaattttgtattt

SEQ ID NO: 2534540 - DNA, 15 bp, Homo sapiens
ttaattttgtatttt

SEQ ID NO: 2534541 - DNA, 16 bp, Homo sapiens
ttaattttgtattttc

SEQ ID NO: 2534542 - DNA, 19 bp, Homo sapiens
ttaatttttttgagacaga

SEQ ID NO: 2534543 - DNA, 18 bp, Homo sapiens
ttacaaaaatataaaata

SEQ ID NO: 2534544 - DNA, 16 bp, Homo sapiens
ttacaacagatttgtg

SEQ ID NO: 2534545 - DNA, 17 bp, Homo sapiens
ttacaacagatttgtga

SEQ ID NO: 2534546 - DNA, 20 bp, Homo sapiens
ttacaagcgtgagccactgc

SEQ ID NO: 2534547 - DNA, 14 bp, Homo sapiens
ttacaagtgtatat

SEQ ID NO: 2534548 - DNA, 16 bp, Homo sapiens
ttacaagtgtatatca

SEQ ID NO: 2534549 - DNA, 23 bp, Homo sapiens
ttacaataaaatcttgaaaatgc

SEQ ID NO: 2534550 - DNA, 18 bp, Homo sapiens
ttacaattccctgctgtc

SEQ ID NO: 2534551 - DNA, 21 bp, Homo sapiens
ttacaatttttttaattttgt

SEQ ID NO: 2534552 - DNA, 18 bp, Homo sapiens
ttacacaaaacaaatgcc

SEQ ID NO: 2534553 - DNA, 18 bp, Homo sapiens
ttacacatctcagaccct

SEQ ID NO: 2534554 - DNA, 14 bp, Homo sapiens
ttacactctttgta

SEQ ID NO: 2534555 - DNA, 14 bp, Homo sapiens
ttacacttactgtt

SEQ ID NO: 2534556 - DNA, 15 bp, Homo sapiens
ttacacttactgttg

SEQ ID NO: 2534557 - DNA, 21 bp, Homo sapiens
ttacagaaagtggtgctcagt

SEQ ID NO: 2534558 - DNA, 20 bp, Homo sapiens
ttacagagaggagaaacaca

SEQ ID NO: 2534559 - DNA, 13 bp, Homo sapiens
ttacagctgcctg

SEQ ID NO: 2534560 - DNA, 21 bp, Homo sapiens
ttacagctgggtggcactgcc

SEQ ID NO: 2534561 - DNA, 18 bp, Homo sapiens
ttacaggcaccgagaatg

SEQ ID NO: 2534562 - DNA, 24 bp, Homo sapiens
ttacaggcaccgagaatgttgtat

SEQ ID NO: 2534563 - DNA, 17 bp, Homo sapiens
ttacagtaggagcccag

SEQ ID NO: 2534564 - DNA, 19 bp, Homo sapiens
ttacagtgaaaatgtaagc

SEQ ID NO: 2534565 - DNA, 21 bp, Homo sapiens
ttacataatctgtacaatgaa

SEQ ID NO: 2534566 - DNA, 14 bp, Homo sapiens
ttacatactgctgt

SEQ ID NO: 2534567 - DNA, 16 bp, Homo sapiens
ttacataggtatatat

SEQ ID NO: 2534568 - DNA, 15 bp, Homo sapiens
ttacatctttcacat

SEQ ID NO: 2534569 - DNA, 14 bp, Homo sapiens
ttacatgacacagc

SEQ ID NO: 2534570 - DNA, 19 bp, Homo sapiens
ttacatgcatacttcaaaa

SEQ ID NO: 2534571 - DNA, 21 bp, Homo sapiens
ttacatgcatacttcaaaagt

SEQ ID NO: 2534572 - DNA, 12 bp, Homo sapiens
ttacatggctct

SEQ ID NO: 2534573 - DNA, 19 bp, Homo sapiens
ttacattattatcaacaat

SEQ ID NO: 2534574 - DNA, 17 bp, Homo sapiens
ttacatttccaaatgaa

SEQ ID NO: 2534575 - DNA, 17 bp, Homo sapiens
ttacatttttacaataa

SEQ ID NO: 2534576 - DNA, 21 bp, Homo sapiens
ttacatttttacaataaataa

SEQ ID NO: 2534577 - DNA, 13 bp, Homo sapiens
ttaccaactttct

SEQ ID NO: 2534578 - DNA, 14 bp, Homo sapiens
ttaccaactttctg

SEQ ID NO: 2534579 - DNA, 18 bp, Homo sapiens
ttaccaactttctgtaaa

SEQ ID NO: 2534580 - DNA, 14 bp, Homo sapiens
ttaccacagacata

SEQ ID NO: 2534581 - DNA, 19 bp, Homo sapiens
ttaccagataatgctactt

SEQ ID NO: 2534582 - DNA, 19 bp, Homo sapiens
ttaccagcagagcacctta

SEQ ID NO: 2534583 - DNA, 22 bp, Homo sapiens
ttaccagcctccgtatttcaga

SEQ ID NO: 2534584 - DNA, 11 bp, Homo sapiens
ttaccatgaga

SEQ ID NO: 2534585 - DNA, 24 bp, Homo sapiens
ttacccaaaaactaaatctctaat

SEQ ID NO: 2534586 - DNA, 12 bp, Homo sapiens
ttacccaagcaa

SEQ ID NO: 2534587 - DNA, 20 bp, Homo sapiens
ttacccaagcaaaatcatgg

SEQ ID NO: 2534588 - DNA, 18 bp, Homo sapiens
ttacccatatcccctctc

SEQ ID NO: 2534589 - DNA, 14 bp, Homo sapiens
ttaccccttagcct

SEQ ID NO: 2534590 - DNA, 16 bp, Homo sapiens
ttaccccttagcctcc

SEQ ID NO: 2534591 - DNA, 22 bp, Homo sapiens
ttaccctcaggcataggcctgg

SEQ ID NO: 2534592 - DNA, 19 bp, Homo sapiens
ttaccctcatgttcttaat

SEQ ID NO: 2534593 - DNA, 22 bp, Homo sapiens
ttaccctgcgattttgcctgtg

SEQ ID NO: 2534594 - DNA, 13 bp, Homo sapiens
ttaccctttagac

SEQ ID NO: 2534595 - DNA, 19 bp, Homo sapiens
ttacctaaacagatataaa

SEQ ID NO: 2534596 - DNA, 20 bp, Homo sapiens
ttacctaaacagatataaat

SEQ ID NO: 2534597 - DNA, 16 bp, Homo sapiens
ttacctaccacagtgt

SEQ ID NO: 2534598 - DNA, 21 bp, Homo sapiens
ttacctaccacagtgtctgta

SEQ ID NO: 2534599 - DNA, 13 bp, Homo sapiens
ttacctactttga

SEQ ID NO: 2534600 - DNA, 11 bp, Homo sapiens
ttacctcctga

SEQ ID NO: 2534601 - DNA, 15 bp, Homo sapiens
ttacctcttaacaat

SEQ ID NO: 2534602 - DNA, 18 bp, Homo sapiens
ttacctgaaaacactgtg

SEQ ID NO: 2534603 - DNA, 22 bp, Homo sapiens
ttacctgaaaacactgtgcaca

SEQ ID NO: 2534604 - DNA, 13 bp, Homo sapiens
ttacctgtgaaat

SEQ ID NO: 2534605 - DNA, 14 bp, Homo sapiens
ttaccttacagaag

SEQ ID NO: 2534606 - DNA, 21 bp, Homo sapiens
ttaccttagattagctctgga

SEQ ID NO: 2534607 - DNA, 15 bp, Homo sapiens
ttaccttcaataaag

SEQ ID NO: 2534608 - DNA, 17 bp, Homo sapiens
ttaccttcaataaagta

SEQ ID NO: 2534609 - DNA, 18 bp, Homo sapiens
ttaccttcaataaagtat

SEQ ID NO: 2534610 - DNA, 20 bp, Homo sapiens
ttaccttttttatacataaa

SEQ ID NO: 2534611 - DNA, 15 bp, Homo sapiens
ttacgtgagccaggt

SEQ ID NO: 2534612 - DNA, 22 bp, Homo sapiens
ttactaaagaaaatatctgaaa

SEQ ID NO: 2534613 - DNA, 17 bp, Homo sapiens
ttactaagccacaagaa

SEQ ID NO: 2534614 - DNA, 16 bp, Homo sapiens
ttactagggatccctc

SEQ ID NO: 2534615 - DNA, 19 bp, Homo sapiens
ttactatggccctggccta

SEQ ID NO: 2534616 - DNA, 19 bp, Homo sapiens
ttactattttacttctaga

SEQ ID NO: 2534617 - DNA, 15 bp, Homo sapiens
ttactcaaccctctc

SEQ ID NO: 2534618 - DNA, 20 bp, Homo sapiens
ttactccccttgagctgaga

SEQ ID NO: 2534619 - DNA, 13 bp, Homo sapiens
ttactctgaaggg

SEQ ID NO: 2534620 - DNA, 22 bp, Homo sapiens
ttactctgaagggcatcatgca

SEQ ID NO: 2534621 - DNA, 18 bp, Homo sapiens
ttactgaaggtaaaattg

SEQ ID NO: 2534622 - DNA, 18 bp, Homo sapiens
ttactgcaaatgtcatca

SEQ ID NO: 2534623 - DNA, 15 bp, Homo sapiens
ttactgcagctttgt

SEQ ID NO: 2534624 - DNA, 15 bp, Homo sapiens
ttactggtccaaaag

SEQ ID NO: 2534625 - DNA, 13 bp, Homo sapiens
ttactgtacatga

SEQ ID NO: 2534626 - DNA, 13 bp, Homo sapiens
ttactgtacctgt

SEQ ID NO: 2534627 - DNA, 17 bp, Homo sapiens
ttactgtggaggaagga

SEQ ID NO: 2534628 - DNA, 18 bp, Homo sapiens
ttactgtggaggaaggat

SEQ ID NO: 2534629 - DNA, 14 bp, Homo sapiens
ttactgttgtgacc

SEQ ID NO: 2534630 - DNA, 15 bp, Homo sapiens
ttactgttgtgacct

SEQ ID NO: 2534631 - DNA, 21 bp, Homo sapiens
ttactgtttgtcttctcccca

SEQ ID NO: 2534632 - DNA, 13 bp, Homo sapiens
ttacttaaagatt

SEQ ID NO: 2534633 - DNA, 14 bp, Homo sapiens
ttacttaaagattt

SEQ ID NO: 2534634 - DNA, 16 bp, Homo sapiens
ttacttatcttatgcc

SEQ ID NO: 2534635 - DNA, 19 bp, Homo sapiens
ttacttcactttaattctc

SEQ ID NO: 2534636 - DNA, 11 bp, Homo sapiens
ttacttctgct

SEQ ID NO: 2534637 - DNA, 17 bp, Homo sapiens
ttacttttaaacagtga

SEQ ID NO: 2534638 - DNA, 15 bp, Homo sapiens
ttacttttaaactgt

SEQ ID NO: 2534639 - DNA, 23 bp, Homo sapiens
ttacttttataataaaaggaaaa

SEQ ID NO: 2534640 - DNA, 14 bp, Homo sapiens
ttactttttaaaat

SEQ ID NO: 2534641 - DNA, 20 bp, Homo sapiens
ttagaaaagcaaagggtgct

SEQ ID NO: 2534642 - DNA, 17 bp, Homo sapiens
ttagaaacatggttttg

SEQ ID NO: 2534643 - DNA, 14 bp, Homo sapiens
ttagaaaccttaat

SEQ ID NO: 2534644 - DNA, 13 bp, Homo sapiens
ttagaaatagaca

SEQ ID NO: 2534645 - DNA, 11 bp, Homo sapiens
ttagaaatata

SEQ ID NO: 2534646 - DNA, 12 bp, Homo sapiens
ttagaaatataa

SEQ ID NO: 2534647 - DNA, 17 bp, Homo sapiens
ttagaaatgaccaatat

SEQ ID NO: 2534648 - DNA, 20 bp, Homo sapiens
ttagaacaggcaagtgaaga

SEQ ID NO: 2534649 - DNA, 18 bp, Homo sapiens
ttagaagatattagtctt

SEQ ID NO: 2534650 - DNA, 23 bp, Homo sapiens
ttagaagatattagtcttggggc

SEQ ID NO: 2534651 - DNA, 12 bp, Homo sapiens
ttagaatgaaaa

SEQ ID NO: 2534652 - DNA, 12 bp, Homo sapiens
ttagaattattt

SEQ ID NO: 2534653 - DNA, 18 bp, Homo sapiens
ttagaattccttcagggt

SEQ ID NO: 2534654 - DNA, 15 bp, Homo sapiens
ttagacagtccctgc

SEQ ID NO: 2534655 - DNA, 18 bp, Homo sapiens
ttagacagtccctgccaa

SEQ ID NO: 2534656 - DNA, 14 bp, Homo sapiens
ttagacctcagcct

SEQ ID NO: 2534657 - DNA, 19 bp, Homo sapiens
ttagactcatcttactgta

SEQ ID NO: 2534658 - DNA, 17 bp, Homo sapiens
ttagacttgaaatacta

SEQ ID NO: 2534659 - DNA, 20 bp, Homo sapiens
ttagagcagtttctgtcctg

SEQ ID NO: 2534660 - DNA, 15 bp, Homo sapiens
ttagagcattgccat

SEQ ID NO: 2534661 - DNA, 13 bp, Homo sapiens
ttagaggttttaa

SEQ ID NO: 2534662 - DNA, 14 bp, Homo sapiens
ttagagtcagcctt

SEQ ID NO: 2534663 - DNA, 17 bp, Homo sapiens
ttagatataacactatg

SEQ ID NO: 2534664 - DNA, 23 bp, Homo sapiens
ttagatcaaatactttaaaggaa

SEQ ID NO: 2534665 - DNA, 14 bp, Homo sapiens
ttagcaaactttgt

SEQ ID NO: 2534666 - DNA, 12 bp, Homo sapiens
ttccactggact

SEQ ID NO: 2534667 - DNA, 20 bp, Homo sapiens
ttccactgtcaagaaagagc

SEQ ID NO: 2534668 - DNA, 23 bp, Homo sapiens
ttccactttgttctttaggagat

SEQ ID NO: 2534669 - DNA, 15 bp, Homo sapiens
ttccagaagtgtgat

SEQ ID NO: 2534670 - DNA, 21 bp, Homo sapiens
ttccagaagtgtgattgggaa

SEQ ID NO: 2534671 - DNA, 23 bp, Homo sapiens
ttccagactgcttccaattttct

SEQ ID NO: 2534672 - DNA, 17 bp, Homo sapiens
ttccagagagtcctctg

SEQ ID NO: 2534673 - DNA, 20 bp, Homo sapiens
ttccagagagtcctctggat

SEQ ID NO: 2534674 - DNA, 19 bp, Homo sapiens
ttccagaggctattatttt

SEQ ID NO: 2534675 - DNA, 21 bp, Homo sapiens
ttccagccggcatggctggga

SEQ ID NO: 2534676 - DNA, 13 bp, Homo sapiens
ttccagctcctca

SEQ ID NO: 2534677 - DNA, 15 bp, Homo sapiens
ttccaggctgggaga

SEQ ID NO: 2534678 - DNA, 18 bp, Homo sapiens
ttccaggtatctccagga

SEQ ID NO: 2534679 - DNA, 17 bp, Homo sapiens
ttccaggtttaagctgt

SEQ ID NO: 2534680 - DNA, 20 bp, Homo sapiens
ttccagtcttcctgacactt

SEQ ID NO: 2534681 - DNA, 21 bp, Homo sapiens
ttccagtgagcttatcatgct

SEQ ID NO: 2534682 - DNA, 16 bp, Homo sapiens
ttccagtgaggctctg

SEQ ID NO: 2534683 - DNA, 19 bp, Homo sapiens
ttccagtgaggctctgccc

SEQ ID NO: 2534684 - DNA, 15 bp, Homo sapiens
ttccagtgcaacact

SEQ ID NO: 2534685 - DNA, 19 bp, Homo sapiens
ttccataaggaatgtagct

SEQ ID NO: 2534686 - DNA, 19 bp, Homo sapiens
ttccataatctggactcct

SEQ ID NO: 2534687 - DNA, 12 bp, Homo sapiens
ttccataattat

SEQ ID NO: 2534688 - DNA, 14 bp, Homo sapiens
ttccataattatga

SEQ ID NO: 2534689 - DNA, 18 bp, Homo sapiens
ttccataattatgacagt

SEQ ID NO: 2534690 - DNA, 15 bp, Homo sapiens
ttccatacagctcta

SEQ ID NO: 2534691 - DNA, 15 bp, Homo sapiens
ttccatatggatttt

SEQ ID NO: 2534692 - DNA, 13 bp, Homo sapiens
ttccatcccagag

SEQ ID NO: 2534693 - DNA, 15 bp, Homo sapiens
ttccatgaaaacgtt

SEQ ID NO: 2534694 - DNA, 20 bp, Homo sapiens
ttccatgaatcgcttctctt

SEQ ID NO: 2534695 - DNA, 14 bp, Homo sapiens
ttccatgcctgagg

SEQ ID NO: 2534696 - DNA, 18 bp, Homo sapiens
ttccatgcctgagggtgg

SEQ ID NO: 2534697 - DNA, 14 bp, Homo sapiens
ttccatggattttg

SEQ ID NO: 2534698 - DNA, 15 bp, Homo sapiens
ttccatggccctcat

SEQ ID NO: 2534699 - DNA, 16 bp, Homo sapiens
ttccatggcctcttca

SEQ ID NO: 2534700 - DNA, 18 bp, Homo sapiens
ttccatgtcgcctctgca

SEQ ID NO: 2534701 - DNA, 15 bp, Homo sapiens
ttccatgtcggcctc

SEQ ID NO: 2534702 - DNA, 14 bp, Homo sapiens
ttccatgtggagaa

SEQ ID NO: 2534703 - DNA, 20 bp, Homo sapiens
ttccattctggattttgtca

SEQ ID NO: 2534704 - DNA, 17 bp, Homo sapiens
ttccattgtttgaaaca

SEQ ID NO: 2534705 - DNA, 22 bp, Homo sapiens
ttccattgtttgaaacaaagaa

SEQ ID NO: 2534706 - DNA, 18 bp, Homo sapiens
ttccattgtttggagaca

SEQ ID NO: 2534707 - DNA, 17 bp, Homo sapiens
ttccatttgcaagggaa

SEQ ID NO: 2534708 - DNA, 17 bp, Homo sapiens
ttcccaaaggactccac

SEQ ID NO: 2534709 - DNA, 20 bp, Homo sapiens
ttcccaaaggactccaccca

SEQ ID NO: 2534710 - DNA, 13 bp, Homo sapiens
ttcccaagctctg

SEQ ID NO: 2534711 - DNA, 14 bp, Homo sapiens
ttcccaattaggaa

SEQ ID NO: 2534712 - DNA, 21 bp, Homo sapiens
ttcccacacctccacagttca

SEQ ID NO: 2534713 - DNA, 22 bp, Homo sapiens
ttcccacctctctcactccttg

SEQ ID NO: 2534714 - DNA, 20 bp, Homo sapiens
ttcccaggatgagcatccca

SEQ ID NO: 2534715 - DNA, 13 bp, Homo sapiens
ttcccagggaagt

SEQ ID NO: 2534716 - DNA, 22 bp, Homo sapiens
ttcccagggaagtgctctgata

SEQ ID NO: 2534717 - DNA, 19 bp, Homo sapiens
ttcccagggtagcccgcct

SEQ ID NO: 2534718 - DNA, 11 bp, Homo sapiens
ttcccataatt

SEQ ID NO: 2534719 - DNA, 16 bp, Homo sapiens
ttcccataattttctt

SEQ ID NO: 2534720 - DNA, 14 bp, Homo sapiens
ttcccatcctaccc

SEQ ID NO: 2534721 - DNA, 14 bp, Homo sapiens
ttcccatcgctgtc

SEQ ID NO: 2534722 - DNA, 15 bp, Homo sapiens
ttcccatcgctgtca

SEQ ID NO: 2534723 - DNA, 17 bp, Homo sapiens
ttcccattttgcaaaat

SEQ ID NO: 2534724 - DNA, 19 bp, Homo sapiens
ttcccattttgcaaaattt

SEQ ID NO: 2534725 - DNA, 19 bp, Homo sapiens
ttccccaacagtgtgaagt

SEQ ID NO: 2534726 - DNA, 23 bp, Homo sapiens
ttccccaacagtgtgaagttaga

SEQ ID NO: 2534727 - DNA, 23 bp, Homo sapiens
ttccccactgacagcctcccacc

SEQ ID NO: 2534728 - DNA, 17 bp, Homo sapiens
ttccccactgcacacac

SEQ ID NO: 2534729 - DNA, 22 bp, Homo sapiens
ttccccagcagggtcttttcat

SEQ ID NO: 2534730 - DNA, 18 bp, Homo sapiens
ttccccaggaggccagcc

SEQ ID NO: 2534731 - DNA, 20 bp, Homo sapiens
ttccccaggaggccagcctt

SEQ ID NO: 2534732 - DNA, 21 bp, Homo sapiens
ttccccaggaggccagccttg

SEQ ID NO: 2534733 - DNA, 23 bp, Homo sapiens
ttccccatgggaagacgaggccc

SEQ ID NO: 2534734 - DNA, 21 bp, Homo sapiens
ttccccccactctccccacac

SEQ ID NO: 2534735 - DNA, 19 bp, Homo sapiens
ttcccctaacctcattccc

SEQ ID NO: 2534736 - DNA, 19 bp, Homo sapiens
ttcccctcactggatgaaa

SEQ ID NO: 2534737 - DNA, 14 bp, Homo sapiens
ttcccctccctggg

SEQ ID NO: 2534738 - DNA, 18 bp, Homo sapiens
ttcccctccttctccctt

SEQ ID NO: 2534739 - DNA, 18 bp, Homo sapiens
ttcccctctgctgctgtc

SEQ ID NO: 2534740 - DNA, 23 bp, Homo sapiens
ttccccttgcccagggctcagcc

SEQ ID NO: 2534741 - DNA, 22 bp, Homo sapiens
ttccccttgcccttgccctgac

SEQ ID NO: 2534742 - DNA, 23 bp, Homo sapiens
ttcccgaaccccaaggagggaga

SEQ ID NO: 2534743 - DNA, 15 bp, Homo sapiens
ttcccgtttctccac

SEQ ID NO: 2534744 - DNA, 13 bp, Homo sapiens
ttccctacttcct

SEQ ID NO: 2534745 - DNA, 17 bp, Homo sapiens
ttccctacttcctgtga

SEQ ID NO: 2534746 - DNA, 19 bp, Homo sapiens
ttccctagtctattcatta

SEQ ID NO: 2534747 - DNA, 15 bp, Homo sapiens
ttccctcatctctcc

SEQ ID NO: 2534748 - DNA, 13 bp, Homo sapiens
ttccctgactcat

SEQ ID NO: 2534749 - DNA, 18 bp, Homo sapiens
ttccctgactcctctaag

SEQ ID NO: 2534750 - DNA, 14 bp, Homo sapiens
ttccctgcctctca

SEQ ID NO: 2534751 - DNA, 16 bp, Homo sapiens
ttccctggcctttcat

SEQ ID NO: 2534752 - DNA, 20 bp, Homo sapiens
ttcccttctccatctctctg

SEQ ID NO: 2534753 - DNA, 22 bp, Homo sapiens
ttcccttctccatctctctggc

SEQ ID NO: 2534754 - DNA, 18 bp, Homo sapiens
ttcccttttacatactgc

SEQ ID NO: 2534755 - DNA, 19 bp, Homo sapiens
ttcccttttacatactgct

SEQ ID NO: 2534756 - DNA, 18 bp, Homo sapiens
ttcccttttttggctgct

SEQ ID NO: 2534757 - DNA, 21 bp, Homo sapiens
ttccgaaaaatcctcttcctc

SEQ ID NO: 2534758 - DNA, 20 bp, Homo sapiens
ttccgacaaccgatgctcca

SEQ ID NO: 2534759 - DNA, 17 bp, Homo sapiens
ttccgtaacccaactct

SEQ ID NO: 2534760 - DNA, 13 bp, Homo sapiens
ttcctaaatgcag

SEQ ID NO: 2534761 - DNA, 14 bp, Homo sapiens
ttcctaacacagca

SEQ ID NO: 2534762 - DNA, 19 bp, Homo sapiens
ttcctaacacagcatgtgt

SEQ ID NO: 2534763 - DNA, 17 bp, Homo sapiens
ttcctaagtataaatgg

SEQ ID NO: 2534764 - DNA, 13 bp, Homo sapiens
ttcctaagtgatt

SEQ ID NO: 2534765 - DNA, 13 bp, Homo sapiens
ttcctaattttag

SEQ ID NO: 2534766 - DNA, 14 bp, Homo sapiens
ttcctaattttagt

SEQ ID NO: 2534767 - DNA, 22 bp, Homo sapiens
ttcctacaagagcagcctgtgg

SEQ ID NO: 2534768 - DNA, 18 bp, Homo sapiens
ttcctacagatagtcaaa

SEQ ID NO: 2534769 - DNA, 18 bp, Homo sapiens
ttcctacagccccttttt

SEQ ID NO: 2534770 - DNA, 23 bp, Homo sapiens
ttcctacccacacctctgccaga

SEQ ID NO: 2534771 - DNA, 14 bp, Homo sapiens
ttcctagccctctc

SEQ ID NO: 2534772 - DNA, 12 bp, Homo sapiens
ttcctagtgaaa

SEQ ID NO: 2534773 - DNA, 15 bp, Homo sapiens
ttcctagttttctcc

SEQ ID NO: 2534774 - DNA, 19 bp, Homo sapiens
ttcctatacgcagcgtgct

SEQ ID NO: 2534775 - DNA, 21 bp, Homo sapiens
ttcctatatagtttattgaca

SEQ ID NO: 2534776 - DNA, 20 bp, Homo sapiens
ttcctatggctggccactgc

SEQ ID NO: 2534777 - DNA, 13 bp, Homo sapiens
ttcctattgtcat

SEQ ID NO: 2534778 - DNA, 14 bp, Homo sapiens
ttcctattgtgatt

SEQ ID NO: 2534779 - DNA, 21 bp, Homo sapiens
ttcctattgtgatttgactgt

SEQ ID NO: 2534780 - DNA, 18 bp, Homo sapiens
ttcctatttgccatgggc

SEQ ID NO: 2534781 - DNA, 20 bp, Homo sapiens
ttcctatttgccatgggctt

SEQ ID NO: 2534782 - DNA, 17 bp, Homo sapiens
ttcctattttcagccca

SEQ ID NO: 2534783 - DNA, 18 bp, Homo sapiens
ttcctcatccaccccatc

SEQ ID NO: 2534784 - DNA, 19 bp, Homo sapiens
ttcctcatccaccccatcc

SEQ ID NO: 2534785 - DNA, 13 bp, Homo sapiens
ttcctccccagca

SEQ ID NO: 2534786 - DNA, 14 bp, Homo sapiens
ttcctccccagcag

SEQ ID NO: 2534787 - DNA, 23 bp, Homo sapiens
ttcctccccattagagtcagcct

SEQ ID NO: 2534788 - DNA, 23 bp, Homo sapiens
ttcctctagtgccctccacagcc

SEQ ID NO: 2534789 - DNA, 18 bp, Homo sapiens
ttcctctcactaaacttt

SEQ ID NO: 2534790 - DNA, 13 bp, Homo sapiens
ttcctctgaggct

SEQ ID NO: 2534791 - DNA, 21 bp, Homo sapiens
ttcctctgaggctggatccta

SEQ ID NO: 2534792 - DNA, 13 bp, Homo sapiens
ttcctctgcagct

SEQ ID NO: 2534793 - DNA, 18 bp, Homo sapiens
ttcctcttccccttgccc

SEQ ID NO: 2534794 - DNA, 19 bp, Homo sapiens
ttcctcttccccttgccct

SEQ ID NO: 2534795 - DNA, 20 bp, Homo sapiens
ttcctcttctattttgtaaa

SEQ ID NO: 2534796 - DNA, 22 bp, Homo sapiens
ttcctctttttatttagttcct

SEQ ID NO: 2534797 - DNA, 17 bp, Homo sapiens
ttcctgaaagaaacagt

SEQ ID NO: 2534798 - DNA, 23 bp, Homo sapiens
ttcctgacccaggccgcagctct

SEQ ID NO: 2534799 - DNA, 11 bp, Homo sapiens
ttcctgagctt

SEQ ID NO: 2534800 - DNA, 15 bp, Homo sapiens
ttcctgatgcttctt

SEQ ID NO: 2534801 - DNA, 19 bp, Homo sapiens
ttcctgatgcttcttcaga

SEQ ID NO: 2534802 - DNA, 19 bp, Homo sapiens
ttcctgatggtacaggaaa

SEQ ID NO: 2534803 - DNA, 13 bp, Homo sapiens
ttcctgcaatgaa

SEQ ID NO: 2534804 - DNA, 20 bp, Homo sapiens
ttcctggacatcctcttctg

SEQ ID NO: 2534805 - DNA, 18 bp, Homo sapiens
ttcctggcaatagtgtgt

SEQ ID NO: 2534806 - DNA, 20 bp, Homo sapiens
ttcctggcaatagtgtgttc

SEQ ID NO: 2534807 - DNA, 19 bp, Homo sapiens
ttcctggcactgcttccag

SEQ ID NO: 2534808 - DNA, 18 bp, Homo sapiens
ttcctggtacccagccat

SEQ ID NO: 2534809 - DNA, 19 bp, Homo sapiens
ttcctggtacccagccatc

SEQ ID NO: 2534810 - DNA, 17 bp, Homo sapiens
ttggacctctgctctga

SEQ ID NO: 2534811 - DNA, 13 bp, Homo sapiens
ttggacggcctga

SEQ ID NO: 2534812 - DNA, 18 bp, Homo sapiens
ttggagaaggttatcaaa

SEQ ID NO: 2534813 - DNA, 17 bp, Homo sapiens
ttggagagtaaaaactg

SEQ ID NO: 2534814 - DNA, 20 bp, Homo sapiens
ttggagataatctagaacac

SEQ ID NO: 2534815 - DNA, 14 bp, Homo sapiens
ttggagcttcatgg

SEQ ID NO: 2534816 - DNA, 16 bp, Homo sapiens
ttggaggcctttagat

SEQ ID NO: 2534817 - DNA, 17 bp, Homo sapiens
ttggagggtcccaagct

SEQ ID NO: 2534818 - DNA, 19 bp, Homo sapiens
ttggatcttcaatggcttt

SEQ ID NO: 2534819 - DNA, 20 bp, Homo sapiens
ttggatgggagtgagacaga

SEQ ID NO: 2534820 - DNA, 20 bp, Homo sapiens
ttggattattcatttaaaat

SEQ ID NO: 2534821 - DNA, 23 bp, Homo sapiens
ttggattattcatttaaaatgat

SEQ ID NO: 2534822 - DNA, 18 bp, Homo sapiens
ttggattatttaataaca

SEQ ID NO: 2534823 - DNA, 16 bp, Homo sapiens
ttggcaaattcctagt

SEQ ID NO: 2534824 - DNA, 15 bp, Homo sapiens
ttggcaacagaagca

SEQ ID NO: 2534825 - DNA, 17 bp, Homo sapiens
ttggcaatgccatcatc

SEQ ID NO: 2534826 - DNA, 22 bp, Homo sapiens
ttggcactgagatatttattgt

SEQ ID NO: 2534827 - DNA, 14 bp, Homo sapiens
ttggcagtctgaat

SEQ ID NO: 2534828 - DNA, 21 bp, Homo sapiens
ttggcatcacagggcagagcc

SEQ ID NO: 2534829 - DNA, 16 bp, Homo sapiens
ttggcatgtgtatgtt

SEQ ID NO: 2534830 - DNA, 24 bp, Homo sapiens
ttggccaaagccaaagctaggcct

SEQ ID NO: 2534831 - DNA, 22 bp, Homo sapiens
ttggccgggtgcggtggctcac

SEQ ID NO: 2534832 - DNA, 13 bp, Homo sapiens
ttggcctccggcc

SEQ ID NO: 2534833 - DNA, 23 bp, Homo sapiens
ttggcctgtctcatccccagggg

SEQ ID NO: 2534834 - DNA, 13 bp, Homo sapiens
ttggctcaatcct

SEQ ID NO: 2534835 - DNA, 11 bp, Homo sapiens
ttggctgctga

SEQ ID NO: 2534836 - DNA, 16 bp, Homo sapiens
ttggctgctgaaggct

SEQ ID NO: 2534837 - DNA, 15 bp, Homo sapiens
ttgggaataaatatg

SEQ ID NO: 2534838 - DNA, 19 bp, Homo sapiens
ttgggaatgaggcttgctg

SEQ ID NO: 2534839 - DNA, 22 bp, Homo sapiens
ttgggactgctaaataaaattt

SEQ ID NO: 2534840 - DNA, 16 bp, Homo sapiens
ttgggagatatatttt

SEQ ID NO: 2534841 - DNA, 11 bp, Homo sapiens
ttgggagcact

SEQ ID NO: 2534842 - DNA, 22 bp, Homo sapiens
ttgggagcactggagtgcaggg

SEQ ID NO: 2534843 - DNA, 17 bp, Homo sapiens
ttgggaggccccactgg

SEQ ID NO: 2534844 - DNA, 13 bp, Homo sapiens
ttgggattaatat

SEQ ID NO: 2534845 - DNA, 16 bp, Homo sapiens
ttgggattcctgaccc

SEQ ID NO: 2534846 - DNA, 19 bp, Homo sapiens
ttgggcagaagggagaagg

SEQ ID NO: 2534847 - DNA, 16 bp, Homo sapiens
ttgggcccagctgggc

SEQ ID NO: 2534848 - DNA, 16 bp, Homo sapiens
ttgggctcctttttct

SEQ ID NO: 2534849 - DNA, 15 bp, Homo sapiens
ttggggaatttcctc

SEQ ID NO: 2534850 - DNA, 17 bp, Homo sapiens
ttggggcgaggcagagg

SEQ ID NO: 2534851 - DNA, 12 bp, Homo sapiens
ttgggggctggt

SEQ ID NO: 2534852 - DNA, 13 bp, Homo sapiens
ttggggtcagcca

SEQ ID NO: 2534853 - DNA, 15 bp, Homo sapiens
ttggggtctgacccc

SEQ ID NO: 2534854 - DNA, 19 bp, Homo sapiens
ttgggtcacccctccagga

SEQ ID NO: 2534855 - DNA, 17 bp, Homo sapiens
ttgggttcattattgga

SEQ ID NO: 2534856 - DNA, 16 bp, Homo sapiens
ttggtaaatttcccca

SEQ ID NO: 2534857 - DNA, 21 bp, Homo sapiens
ttggtaaatttccccaacagt

SEQ ID NO: 2534858 - DNA, 22 bp, Homo sapiens
ttggtaaatttccccaacagtg

SEQ ID NO: 2534859 - DNA, 19 bp, Homo sapiens
ttggtaacatcctttctat

SEQ ID NO: 2534860 - DNA, 15 bp, Homo sapiens
ttggtaattattttg

SEQ ID NO: 2534861 - DNA, 13 bp, Homo sapiens
ttggtagagattc

SEQ ID NO: 2534862 - DNA, 16 bp, Homo sapiens
ttggtcccccttccat

SEQ ID NO: 2534863 - DNA, 13 bp, Homo sapiens
ttggtccctgggg

SEQ ID NO: 2534864 - DNA, 12 bp, Homo sapiens
ttggtcctgctg

SEQ ID NO: 2534865 - DNA, 16 bp, Homo sapiens
ttggtgcaacccttac

SEQ ID NO: 2534866 - DNA, 20 bp, Homo sapiens
ttggtgcctggcctggcaca

SEQ ID NO: 2534867 - DNA, 22 bp, Homo sapiens
ttggtgcctggcctggcacaca

SEQ ID NO: 2534868 - DNA, 12 bp, Homo sapiens
ttggtggttttt

SEQ ID NO: 2534869 - DNA, 16 bp, Homo sapiens
ttggtgtgtggagatg

SEQ ID NO: 2534870 - DNA, 18 bp, Homo sapiens
ttggttaagtctgtttta

SEQ ID NO: 2534871 - DNA, 13 bp, Homo sapiens
ttggttctggggc

SEQ ID NO: 2534872 - DNA, 13 bp, Homo sapiens
ttggttgaataaa

SEQ ID NO: 2534873 - DNA, 12 bp, Homo sapiens
ttggttgtattc

SEQ ID NO: 2534874 - DNA, 18 bp, Homo sapiens
ttggttgtcaatattaaa

SEQ ID NO: 2534875 - DNA, 19 bp, Homo sapiens
ttgtaaaaaaaaatgcctt

SEQ ID NO: 2534876 - DNA, 20 bp, Homo sapiens
ttgtaaaaacagcattgctt

SEQ ID NO: 2534877 - DNA, 23 bp, Homo sapiens
ttgtaaaaacagcattgctttct

SEQ ID NO: 2534878 - DNA, 14 bp, Homo sapiens
ttgtaaaactacac

SEQ ID NO: 2534879 - DNA, 23 bp, Homo sapiens
ttgtaaaagaacagtaaacattg

SEQ ID NO: 2534880 - DNA, 15 bp, Homo sapiens
ttgtaaaatagcttg

SEQ ID NO: 2534881 - DNA, 13 bp, Homo sapiens
ttgtaaaatggtg

SEQ ID NO: 2534882 - DNA, 20 bp, Homo sapiens
ttgtaaaatggtgtgaccac

SEQ ID NO: 2534883 - DNA, 16 bp, Homo sapiens
ttgtaaactcaaaata

SEQ ID NO: 2534884 - DNA, 14 bp, Homo sapiens
ttgtaaatacacat

SEQ ID NO: 2534885 - DNA, 13 bp, Homo sapiens
ttgtaaatacacc

SEQ ID NO: 2534886 - DNA, 14 bp, Homo sapiens
ttgtaaatacacca

SEQ ID NO: 2534887 - DNA, 13 bp, Homo sapiens
ttgtaaatattta

SEQ ID NO: 2534888 - DNA, 11 bp, Homo sapiens
ttgtaaatgtg

SEQ ID NO: 2534889 - DNA, 18 bp, Homo sapiens
ttgtaaatgtgcttttaa

SEQ ID NO: 2534890 - DNA, 21 bp, Homo sapiens
ttgtaaatgtggtaaagagtt

SEQ ID NO: 2534891 - DNA, 23 bp, Homo sapiens
ttgtaaattaacttttataaact

SEQ ID NO: 2534892 - DNA, 19 bp, Homo sapiens
ttgtaacctcagctctggg

SEQ ID NO: 2534893 - DNA, 13 bp, Homo sapiens
ttgtaagaaatac

SEQ ID NO: 2534894 - DNA, 18 bp, Homo sapiens
ttgtaagacaaaggtttt

SEQ ID NO: 2534895 - DNA, 22 bp, Homo sapiens
ttgtaagtttcaggtgacatgt

SEQ ID NO: 2534896 - DNA, 14 bp, Homo sapiens
ttgtaatcactgtt

SEQ ID NO: 2534897 - DNA, 20 bp, Homo sapiens
ttgtaatcgttatgtgtgta

SEQ ID NO: 2534898 - DNA, 14 bp, Homo sapiens
ttgtaattctaaat

SEQ ID NO: 2534899 - DNA, 22 bp, Homo sapiens
ttgtacaaaaaaaaagttttat

SEQ ID NO: 2534900 - DNA, 12 bp, Homo sapiens
ttgtacaaaata

SEQ ID NO: 2534901 - DNA, 23 bp, Homo sapiens
ttgtacaattgaacttaaataaa

SEQ ID NO: 2534902 - DNA, 16 bp, Homo sapiens
ttgtacagtttgctgt

SEQ ID NO: 2534903 - DNA, 14 bp, Homo sapiens
ttgtacataatgcg

SEQ ID NO: 2534904 - DNA, 18 bp, Homo sapiens
ttgtacataatgcgtgca

SEQ ID NO: 2534905 - DNA, 15 bp, Homo sapiens
ttgtacatatttgtg

SEQ ID NO: 2534906 - DNA, 21 bp, Homo sapiens
ttgtacatgtgtagcctgtgc

SEQ ID NO: 2534907 - DNA, 14 bp, Homo sapiens
ttgtactgtaaaga

SEQ ID NO: 2534908 - DNA, 16 bp, Homo sapiens
ttgtagaatgtattgt

SEQ ID NO: 2534909 - DNA, 17 bp, Homo sapiens
ttgtagcatcctcttta

SEQ ID NO: 2534910 - DNA, 17 bp, Homo sapiens
ttgtaggggtcaaagaa

SEQ ID NO: 2534911 - DNA, 13 bp, Homo sapiens
ttgtagtttacct

SEQ ID NO: 2534912 - DNA, 16 bp, Homo sapiens
ttgtatagtgtaaaat

SEQ ID NO: 2534913 - DNA, 19 bp, Homo sapiens
ttgtatatatctgcttcag

SEQ ID NO: 2534914 - DNA, 15 bp, Homo sapiens
ttgtatatatgtgtg

SEQ ID NO: 2534915 - DNA, 16 bp, Homo sapiens
ttgtatattatttcta

SEQ ID NO: 2534916 - DNA, 13 bp, Homo sapiens
ttgtatatttgta

SEQ ID NO: 2534917 - DNA, 18 bp, Homo sapiens
ttgtatcgtatagctgta

SEQ ID NO: 2534918 - DNA, 13 bp, Homo sapiens
ttgtatctctttt

SEQ ID NO: 2534919 - DNA, 22 bp, Homo sapiens
ttgtatgaaagatggctgtgcc

SEQ ID NO: 2534920 - DNA, 13 bp, Homo sapiens
ttgtatgatgtgt

SEQ ID NO: 2534921 - DNA, 20 bp, Homo sapiens
ttgtatgcctttaaatctgt

SEQ ID NO: 2534922 - DNA, 21 bp, Homo sapiens
ttgtatgcctttaaatctgtg

SEQ ID NO: 2534923 - DNA, 19 bp, Homo sapiens
ttgtatgttaagttacttc

SEQ ID NO: 2534924 - DNA, 13 bp, Homo sapiens
ttgtattaagaat

SEQ ID NO: 2534925 - DNA, 15 bp, Homo sapiens
ttgtattctctcctg

SEQ ID NO: 2534926 - DNA, 18 bp, Homo sapiens
ttgtattctttgatgtta

SEQ ID NO: 2534927 - DNA, 15 bp, Homo sapiens
ttgtattgtttcaat

SEQ ID NO: 2534928 - DNA, 21 bp, Homo sapiens
ttgtattttccaagtgtgcat

SEQ ID NO: 2534929 - DNA, 14 bp, Homo sapiens
ttgtatttttaatg

SEQ ID NO: 2534930 - DNA, 15 bp, Homo sapiens
ttgtatttttaatgg

SEQ ID NO: 2534931 - DNA, 17 bp, Homo sapiens
ttgtcacacactttggc

SEQ ID NO: 2534932 - DNA, 18 bp, Homo sapiens
ttgtcacgcttcttcttt

SEQ ID NO: 2534933 - DNA, 12 bp, Homo sapiens
ttgtcagctact

SEQ ID NO: 2534934 - DNA, 21 bp, Homo sapiens
ttgtcatataagattcatatt

SEQ ID NO: 2534935 - DNA, 19 bp, Homo sapiens
ttgtcatctttcttctatt

SEQ ID NO: 2534936 - DNA, 21 bp, Homo sapiens
ttgtcatctttcttctatttt

SEQ ID NO: 2534937 - DNA, 14 bp, Homo sapiens
ttgtcattaaaggt

SEQ ID NO: 2534938 - DNA, 15 bp, Homo sapiens
ttgtcattttctcca

SEQ ID NO: 2534939 - DNA, 23 bp, Homo sapiens
ttgtccccaaatccgaacctcct

SEQ ID NO: 2534940 - DNA, 16 bp, Homo sapiens
ttgtccctctgctacg

SEQ ID NO: 2534941 - DNA, 18 bp, Homo sapiens
ttgtccgtgttcatacat

SEQ ID NO: 2534942 - DNA, 16 bp, Homo sapiens
ttgtcctatgggagtc

SEQ ID NO: 2534943 - DNA, 15 bp, Homo sapiens
ttgtcctccccttgg

SEQ ID NO: 2534944 - DNA, 17 bp, Homo sapiens
ttgtctatttttgtctt

SEQ ID NO: 2534945 - DNA, 13 bp, Homo sapiens
ttgtcttatatat

SEQ ID NO: 2534946 - DNA, 16 bp, Homo sapiens
ttgtcttctccccagg

SEQ ID NO: 2534947 - DNA, 20 bp, Homo sapiens
ttgtctttggaccctgaggc

SEQ ID NO: 2534948 - DNA, 24 bp, Homo sapiens
ttgtctttggaccctgaggcccag

SEQ ID NO: 2534949 - DNA, 19 bp, Homo sapiens
ttgtgaacaagtccctgta

SEQ ID NO: 2534950 - DNA, 22 bp, Homo sapiens
ttgtgaagtacccgttcacatt

SEQ ID NO: 2534951 - DNA, 15 bp, Homo sapiens
ttgtgaatggattgg

SEQ ID NO: 2534952 - DNA, 16 bp, Homo sapiens
ttgtgaccaagttata

SEQ ID NO: 2534953 - DNA, 16 bp, Homo sapiens
ttgtgacctgaagttc

SEQ ID NO: 2534954 - DNA, 20 bp, Homo sapiens
ttgtgaccttagtgtttctg

SEQ ID NO: 2534955 - DNA, 16 bp, Homo sapiens
ttgtgactaattgtat

SEQ ID NO: 2534956 - DNA, 13 bp, Homo sapiens
tttgtagagccag

SEQ ID NO: 2534957 - DNA, 18 bp, Homo sapiens
tttgtataacttcttaaa

SEQ ID NO: 2534958 - DNA, 13 bp, Homo sapiens
tttgtataattgt

SEQ ID NO: 2534959 - DNA, 17 bp, Homo sapiens
tttgtatagtaaagtga

SEQ ID NO: 2534960 - DNA, 10 bp, Homo sapiens
tttgtatgtt

SEQ ID NO: 2534961 - DNA, 12 bp, Homo sapiens
tttgtatgtttt

SEQ ID NO: 2534962 - DNA, 18 bp, Homo sapiens
tttgtatgttttttttct

SEQ ID NO: 2534963 - DNA, 23 bp, Homo sapiens
tttgtattttccaagtgtgcata

SEQ ID NO: 2534964 - DNA, 11 bp, Homo sapiens
tttgtcaatga

SEQ ID NO: 2534965 - DNA, 23 bp, Homo sapiens
tttgtcacaatcctaacacatta

SEQ ID NO: 2534966 - DNA, 20 bp, Homo sapiens
tttgtcagaactagaatttg

SEQ ID NO: 2534967 - DNA, 14 bp, Homo sapiens
tttgtcttaaaaag

SEQ ID NO: 2534968 - DNA, 16 bp, Homo sapiens
tttgtcttgaatgtct

SEQ ID NO: 2534969 - DNA, 20 bp, Homo sapiens
tttgtgaactcagccaagca

SEQ ID NO: 2534970 - DNA, 18 bp, Homo sapiens
tttgtgactaattgtata

SEQ ID NO: 2534971 - DNA, 19 bp, Homo sapiens
tttgtgaggaagccgctgg

SEQ ID NO: 2534972 - DNA, 16 bp, Homo sapiens
tttgtgatacaatgct

SEQ ID NO: 2534973 - DNA, 22 bp, Homo sapiens
tttgtgatacaatgctgtgccc

SEQ ID NO: 2534974 - DNA, 15 bp, Homo sapiens
tttgtgattcaatct

SEQ ID NO: 2534975 - DNA, 23 bp, Homo sapiens
tttgtgctatcagactgtaggat

SEQ ID NO: 2534976 - DNA, 22 bp, Homo sapiens
tttgtgctgaatgttgggactg

SEQ ID NO: 2534977 - DNA, 11 bp, Homo sapiens
tttgtggaaaa

SEQ ID NO: 2534978 - DNA, 20 bp, Homo sapiens
tttgtggaaagtcacaggtc

SEQ ID NO: 2534979 - DNA, 14 bp, Homo sapiens
tttgtggcctcaga

SEQ ID NO: 2534980 - DNA, 11 bp, Homo sapiens
tttgtggggag

SEQ ID NO: 2534981 - DNA, 21 bp, Homo sapiens
tttgtgtcatgtttaagaaat

SEQ ID NO: 2534982 - DNA, 14 bp, Homo sapiens
tttgtgtgagagac

SEQ ID NO: 2534983 - DNA, 17 bp, Homo sapiens
tttgttaaatatttaca

SEQ ID NO: 2534984 - DNA, 13 bp, Homo sapiens
tttgttaccttta

SEQ ID NO: 2534985 - DNA, 15 bp, Homo sapiens
tttgttgaaattatg

SEQ ID NO: 2534986 - DNA, 14 bp, Homo sapiens
tttgttgctgtttt

SEQ ID NO: 2534987 - DNA, 12 bp, Homo sapiens
tttgttgtaaaa

SEQ ID NO: 2534988 - DNA, 10 bp, Homo sapiens
tttgttgtta

SEQ ID NO: 2534989 - DNA, 16 bp, Homo sapiens
tttgtttctgaaaggg

SEQ ID NO: 2534990 - DNA, 14 bp, Homo sapiens
tttgtttgaactga

SEQ ID NO: 2534991 - DNA, 13 bp, Homo sapiens
tttgtttgctatc

SEQ ID NO: 2534992 - DNA, 13 bp, Homo sapiens
tttgttttctttg

SEQ ID NO: 2534993 - DNA, 12 bp, Homo sapiens
tttgttttgcac

SEQ ID NO: 2534994 - DNA, 14 bp, Homo sapiens
tttgtttttatgaa

SEQ ID NO: 2534995 - DNA, 15 bp, Homo sapiens
ttttaaaaatcataa

SEQ ID NO: 2534996 - DNA, 22 bp, Homo sapiens
ttttaaaaatctaccttctgta

SEQ ID NO: 2534997 - DNA, 16 bp, Homo sapiens
ttttaaaaatgaaatt

SEQ ID NO: 2534998 - DNA, 13 bp, Homo sapiens
ttttaaactgtgt

SEQ ID NO: 2534999 - DNA, 16 bp, Homo sapiens
ttttaaagtatatatt

SEQ ID NO: 2535000 - DNA, 17 bp, Homo sapiens
ttttaaataaaagcagc

SEQ ID NO: 2535001 - DNA, 12 bp, Homo sapiens
ttttaaatgcac

SEQ ID NO: 2535002 - DNA, 21 bp, Homo sapiens
ttttaaattataacttaaaat

SEQ ID NO: 2535003 - DNA, 13 bp, Homo sapiens
ttttaaattttat

SEQ ID NO: 2535004 - DNA, 20 bp, Homo sapiens
ttttaacaaaagcaagactg

SEQ ID NO: 2535005 - DNA, 19 bp, Homo sapiens
ttttaacaataactactgt

SEQ ID NO: 2535006 - DNA, 19 bp, Homo sapiens
ttttaacacctgatgtgta

SEQ ID NO: 2535007 - DNA, 20 bp, Homo sapiens
ttttaacacctgatgtgtac

SEQ ID NO: 2535008 - DNA, 12 bp, Homo sapiens
ttttaactagaa

SEQ ID NO: 2535009 - DNA, 19 bp, Homo sapiens
ttttaagatttttctcaaa

SEQ ID NO: 2535010 - DNA, 23 bp, Homo sapiens
ttttaagcccatcaattatagaa

SEQ ID NO: 2535011 - DNA, 15 bp, Homo sapiens
ttttaagtatttagg

SEQ ID NO: 2535012 - DNA, 18 bp, Homo sapiens
ttttaagtatttatatat

SEQ ID NO: 2535013 - DNA, 15 bp, Homo sapiens
ttttaagtgctgcat

SEQ ID NO: 2535014 - DNA, 14 bp, Homo sapiens
ttttaataaacttt

SEQ ID NO: 2535015 - DNA, 12 bp, Homo sapiens
ttttaatacagg

SEQ ID NO: 2535016 - DNA, 18 bp, Homo sapiens
ttttaatagaataaaata

SEQ ID NO: 2535017 - DNA, 14 bp, Homo sapiens
ttttaatataaatt

SEQ ID NO: 2535018 - DNA, 16 bp, Homo sapiens
ttttaatcatgaaatt

SEQ ID NO: 2535019 - DNA, 20 bp, Homo sapiens
ttttaatcatgaaattactt

SEQ ID NO: 2535020 - DNA, 11 bp, Homo sapiens
ttttaatgtgc

SEQ ID NO: 2535021 - DNA, 13 bp, Homo sapiens
ttttaatgtgctg

SEQ ID NO: 2535022 - DNA, 15 bp, Homo sapiens
ttttaatgtgctgtg

SEQ ID NO: 2535023 - DNA, 17 bp, Homo sapiens
ttttaatgtgctgtgta

SEQ ID NO: 2535024 - DNA, 19 bp, Homo sapiens
ttttaatgtgctgtgtaaa

SEQ ID NO: 2535025 - DNA, 21 bp, Homo sapiens
ttttaatgtgctgtgtaaagt

SEQ ID NO: 2535026 - DNA, 16 bp, Homo sapiens
ttttaattattattct

SEQ ID NO: 2535027 - DNA, 15 bp, Homo sapiens
ttttaattccatgaa

SEQ ID NO: 2535028 - DNA, 17 bp, Homo sapiens
ttttaatttacaaaaat

SEQ ID NO: 2535029 - DNA, 13 bp, Homo sapiens
ttttaatttgata

SEQ ID NO: 2535030 - DNA, 16 bp, Homo sapiens
ttttaattttgtattt

SEQ ID NO: 2535031 - DNA, 12 bp, Homo sapiens
ttttacaataaa

SEQ ID NO: 2535032 - DNA, 14 bp, Homo sapiens
ttttacaattgaaa

SEQ ID NO: 2535033 - DNA, 16 bp, Homo sapiens
ttttacagctgcctgc

SEQ ID NO: 2535034 - DNA, 15 bp, Homo sapiens
ttttacattctgaat

SEQ ID NO: 2535035 - DNA, 19 bp, Homo sapiens
ttttacctaccacagtgtc

SEQ ID NO: 2535036 - DNA, 21 bp, Homo sapiens
ttttacctaccacagtgtctg

SEQ ID NO: 2535037 - DNA, 14 bp, Homo sapiens
ttttactactgtgg

SEQ ID NO: 2535038 - DNA, 17 bp, Homo sapiens
ttttactgccactcttt

SEQ ID NO: 2535039 - DNA, 23 bp, Homo sapiens
ttttagagttgatactacagttt

SEQ ID NO: 2535040 - DNA, 17 bp, Homo sapiens
ttttagatcaaatactt

SEQ ID NO: 2535041 - DNA, 19 bp, Homo sapiens
ttttagatgagattgtttt

SEQ ID NO: 2535042 - DNA, 21 bp, Homo sapiens
ttttagcaatttatacaatat

SEQ ID NO: 2535043 - DNA, 18 bp, Homo sapiens
ttttagttaaatttctgg

SEQ ID NO: 2535044 - DNA, 20 bp, Homo sapiens
ttttagtttaaaaaccttgt

SEQ ID NO: 2535045 - DNA, 22 bp, Homo sapiens
ttttagtttctgttctgtggaa

SEQ ID NO: 2535046 - DNA, 12 bp, Homo sapiens
ttttataaactt

SEQ ID NO: 2535047 - DNA, 13 bp, Homo sapiens
ttttataaacttt

SEQ ID NO: 2535048 - DNA, 15 bp, Homo sapiens
ttttatcacatgtat

SEQ ID NO: 2535049 - DNA, 18 bp, Homo sapiens
ttttatcgtcactgctta

SEQ ID NO: 2535050 - DNA, 23 bp, Homo sapiens
ttttatgaagaaaaaatacattt

SEQ ID NO: 2535051 - DNA, 18 bp, Homo sapiens
ttttatgctttaaacatt

SEQ ID NO: 2535052 - DNA, 18 bp, Homo sapiens
ttttatggcttttgtgca

SEQ ID NO: 2535053 - DNA, 19 bp, Homo sapiens
ttttatggcttttgtgcat

SEQ ID NO: 2535054 - DNA, 12 bp, Homo sapiens
ttttattaataa

SEQ ID NO: 2535055 - DNA, 22 bp, Homo sapiens
ttttattaataaacattctatc

SEQ ID NO: 2535056 - DNA, 15 bp, Homo sapiens
ttttattccacatct

SEQ ID NO: 2535057 - DNA, 18 bp, Homo sapiens
ttttattcctgtatgttg

SEQ ID NO: 2535058 - DNA, 11 bp, Homo sapiens
ttttattgtgt

SEQ ID NO: 2535059 - DNA, 16 bp, Homo sapiens
ttttattttactttta

SEQ ID NO: 2535060 - DNA, 18 bp, Homo sapiens
ttttatttttagacagag

SEQ ID NO: 2535061 - DNA, 13 bp, Homo sapiens
ttttatttttcta

SEQ ID NO: 2535062 - DNA, 14 bp, Homo sapiens
ttttcaaattgtat

SEQ ID NO: 2535063 - DNA, 19 bp, Homo sapiens
ttttcaaattgtatctagt

SEQ ID NO: 2535064 - DNA, 16 bp, Homo sapiens
ttttcaagaataatca

SEQ ID NO: 2535065 - DNA, 10 bp, Homo sapiens
ttttcaatta

SEQ ID NO: 2535066 - DNA, 13 bp, Homo sapiens
ttttcaattaaac

SEQ ID NO: 2535067 - DNA, 16 bp, Homo sapiens
ttttcaattaaacgga

SEQ ID NO: 2535068 - DNA, 14 bp, Homo sapiens
ttttcacaaataaa

SEQ ID NO: 2535069 - DNA, 23 bp, Homo sapiens
ttttcacattcttataaatatga

SEQ ID NO: 2535070 - DNA, 12 bp, Homo sapiens
ttttcacatttt

SEQ ID NO: 2535071 - DNA, 17 bp, Homo sapiens
ttttcagaacctcttcc

SEQ ID NO: 2535072 - DNA, 22 bp, Homo sapiens
ttttcagaacctcttccccaga

SEQ ID NO: 2535073 - DNA, 17 bp, Homo sapiens
ttttcagatataaaaga

SEQ ID NO: 2535074 - DNA, 22 bp, Homo sapiens
ttttcagatataaaagactgac

SEQ ID NO: 2535075 - DNA, 20 bp, Homo sapiens
ttttcagtttcaattcagtg

SEQ ID NO: 2535076 - DNA, 13 bp, Homo sapiens
ttttcatattgtg

SEQ ID NO: 2535077 - DNA, 19 bp, Homo sapiens
ttttcatattgtgccaata

SEQ ID NO: 2535078 - DNA, 21 bp, Homo sapiens
ttttcatgattttgaaaccat

SEQ ID NO: 2535079 - DNA, 14 bp, Homo sapiens
ttttcatgtgtgat

SEQ ID NO: 2535080 - DNA, 20 bp, Homo sapiens
ttttcatgttttaacaaaaa

SEQ ID NO: 2535081 - DNA, 13 bp, Homo sapiens
ttttcattgtaaa

SEQ ID NO: 2535082 - DNA, 13 bp, Homo sapiens
ttttcatttgcct

SEQ ID NO: 2535083 - DNA, 23 bp, Homo sapiens
ttttccaaaagtggcctctttgt

SEQ ID NO: 2535084 - DNA, 15 bp, Homo sapiens
ttttccaccctggaa

SEQ ID NO: 2535085 - DNA, 13 bp, Homo sapiens
ttttccagctcct

SEQ ID NO: 2535086 - DNA, 11 bp, Homo sapiens
ttttccatgaa

SEQ ID NO: 2535087 - DNA, 16 bp, Homo sapiens
ttttccattggtttac

SEQ ID NO: 2535088 - DNA, 17 bp, Homo sapiens
ttttccattgtttgaaa

SEQ ID NO: 2535089 - DNA, 16 bp, Homo sapiens
ttttcccccctagaaa

SEQ ID NO: 2535090 - DNA, 16 bp, Homo sapiens
ttttcccctgtcctga

SEQ ID NO: 2535091 - DNA, 13 bp, Homo sapiens
ttttcctaagtga

SEQ ID NO: 2535092 - DNA, 17 bp, Homo sapiens
ttttcctagccctctca

SEQ ID NO: 2535093 - DNA, 18 bp, Homo sapiens
ttttcctcttctattttg

SEQ ID NO: 2535094 - DNA, 21 bp, Homo sapiens
ttttctaatgtggttatttct

SEQ ID NO: 2535095 - DNA, 16 bp, Homo sapiens
ttttctaccctagcca

SEQ ID NO: 2535096 - DNA, 17 bp, Homo sapiens
ttttctaccctagccat

SEQ ID NO: 2535097 - DNA, 17 bp, Homo sapiens
ttttctccactttgttg

SEQ ID NO: 2535098 - DNA, 22 bp, Homo sapiens
ttttctcttgggctgagactgg

SEQ ID NO: 2535099 - DNA, 15 bp, Homo sapiens
ttttctctttctctc

SEQ ID NO: 2535100 - DNA, 15 bp, Homo sapiens
ttttctgagcgatta

SEQ ID NO: 2535101 - DNA, 21 bp, Homo sapiens
ttttctgattgtaacgttgct

SEQ ID NO: 2535102 - DNA, 17 bp, Homo sapiens
ttttctggaatacatga

SEQ ID NO: 2535103 - DNA, 12 bp, Homo sapiens
aaaaaaataata

SEQ ID NO: 2535104 - DNA, 21 bp, Homo sapiens
aaaaaagaggaaagaatgaaa

SEQ ID NO: 2535105 - DNA, 14 bp, Homo sapiens
aaaaaatactgcca

SEQ ID NO: 2535106 - DNA, 11 bp, Homo sapiens
aaaaaatactt

SEQ ID NO: 2535107 - DNA, 15 bp, Homo sapiens
aaaaaatattttcct

SEQ ID NO: 2535108 - DNA, 11 bp, Homo sapiens
aaaaaatgtcc

SEQ ID NO: 2535109 - DNA, 12 bp, Homo sapiens
aaaaacacagca

SEQ ID NO: 2535110 - DNA, 18 bp, Homo sapiens
aaaaacacagcaagggtg

SEQ ID NO: 2535111 - DNA, 18 bp, Homo sapiens
aaaaacacctagctttat

SEQ ID NO: 2535112 - DNA, 12 bp, Homo sapiens
aaaaacactagt

SEQ ID NO: 2535113 - DNA, 14 bp, Homo sapiens
aaaaacagaggcca

SEQ ID NO: 2535114 - DNA, 20 bp, Homo sapiens
aaaaacagcattgctttctg

SEQ ID NO: 2535115 - DNA, 21 bp, Homo sapiens
aaaaacagcattgctttctga

SEQ ID NO: 2535116 - DNA, 14 bp, Homo sapiens
aaaaactaaattgt

SEQ ID NO: 2535117 - DNA, 17 bp, Homo sapiens
aaaaactcgaggactgt

SEQ ID NO: 2535118 - DNA, 20 bp, Homo sapiens
aaaaactctgggaaataaga

SEQ ID NO: 2535119 - DNA, 12 bp, Homo sapiens
aaaaactgaatg

SEQ ID NO: 2535120 - DNA, 19 bp, Homo sapiens
aaaaacttcagtaagtacg

SEQ ID NO: 2535121 - DNA, 12 bp, Homo sapiens
aaaaacttgtaa

SEQ ID NO: 2535122 - DNA, 18 bp, Homo sapiens
aaaaacttgtaaatgctg

SEQ ID NO: 2535123 - DNA, 11 bp, Homo sapiens
aaaaagaaaaa

SEQ ID NO: 2535124 - DNA, 13 bp, Homo sapiens
aaaaagaaaaaag

SEQ ID NO: 2535125 - DNA, 13 bp, Homo sapiens
aaaaagaccagac

SEQ ID NO: 2535126 - DNA, 19 bp, Homo sapiens
aaaaagagaagtattataa

SEQ ID NO: 2535127 - DNA, 18 bp, Homo sapiens
aaaaagaggaaagaatga

SEQ ID NO: 2535128 - DNA, 20 bp, Homo sapiens
aaaaagatgttcagtcattt

SEQ ID NO: 2535129 - DNA, 13 bp, Homo sapiens
aaaaagatttgtt

SEQ ID NO: 2535130 - DNA, 21 bp, Homo sapiens
aaaaagcagctaccaggtgtt

SEQ ID NO: 2535131 - DNA, 17 bp, Homo sapiens
aaaaaggcattgtttga

SEQ ID NO: 2535132 - DNA, 19 bp, Homo sapiens
aaaaagtaggaaatgaatg

SEQ ID NO: 2535133 - DNA, 14 bp, Homo sapiens
aaaaagtattattt

SEQ ID NO: 2535134 - DNA, 14 bp, Homo sapiens
aaaaagtgacacag

SEQ ID NO: 2535135 - DNA, 15 bp, Homo sapiens
aaaaagtgacacagc

SEQ ID NO: 2535136 - DNA, 19 bp, Homo sapiens
aaaaagtgacacagcagct

SEQ ID NO: 2535137 - DNA, 20 bp, Homo sapiens
aaaaagtgacacagcagctt

SEQ ID NO: 2535138 - DNA, 12 bp, Homo sapiens
aaaaagtgttta

SEQ ID NO: 2535139 - DNA, 13 bp, Homo sapiens
aaaaagtgtttat

SEQ ID NO: 2535140 - DNA, 12 bp, Homo sapiens
aaaaagttatat

SEQ ID NO: 2535141 - DNA, 17 bp, Homo sapiens
aaaaagtttacaagtgt

SEQ ID NO: 2535142 - DNA, 17 bp, Homo sapiens
aaaaagttttatttttc

SEQ ID NO: 2535143 - DNA, 23 bp, Homo sapiens
aaaaagttttgccctttttaagg

SEQ ID NO: 2535144 - DNA, 15 bp, Homo sapiens
aaaaatacattttat

SEQ ID NO: 2535145 - DNA, 10 bp, Homo sapiens
aaaaatactt

SEQ ID NO: 2535146 - DNA, 16 bp, Homo sapiens
aaaaatattataactt

SEQ ID NO: 2535147 - DNA, 15 bp, Homo sapiens
aaaaatcctcttcct

SEQ ID NO: 2535148 - DNA, 19 bp, Homo sapiens
aaaaatcctcttcctctga

SEQ ID NO: 2535149 - DNA, 19 bp, Homo sapiens
aaaaatctaccttctgtag

SEQ ID NO: 2535150 - DNA, 19 bp, Homo sapiens
aaaaatctcaaatttctaa

SEQ ID NO: 2535151 - DNA, 20 bp, Homo sapiens
aaaaatgactaaaaatatta

SEQ ID NO: 2535152 - DNA, 15 bp, Homo sapiens
aaaaatgatgttcat

SEQ ID NO: 2535153 - DNA, 18 bp, Homo sapiens
aaaaatgcaaatcctatg

SEQ ID NO: 2535154 - DNA, 22 bp, Homo sapiens
aaaaatgcaaatcctatgtgat

SEQ ID NO: 2535155 - DNA, 14 bp, Homo sapiens
aaaaatgcctttga

SEQ ID NO: 2535156 - DNA, 19 bp, Homo sapiens
aaaaatgcctttgagacag

SEQ ID NO: 2535157 - DNA, 20 bp, Homo sapiens
aaaaatgcctttgagacagt

SEQ ID NO: 2535158 - DNA, 17 bp, Homo sapiens
aaaaatgggacttcttt

SEQ ID NO: 2535159 - DNA, 13 bp, Homo sapiens
aaaaatggtaatt

SEQ ID NO: 2535160 - DNA, 13 bp, Homo sapiens
aaaaatgtaaata

SEQ ID NO: 2535161 - DNA, 16 bp, Homo sapiens
aaaaatgtatatgcac

SEQ ID NO: 2535162 - DNA, 16 bp, Homo sapiens
aaaaatgttggattta

SEQ ID NO: 2535163 - DNA, 12 bp, Homo sapiens
aaaaattaaaat

SEQ ID NO: 2535164 - DNA, 14 bp, Homo sapiens
aaaaatttaagcat

SEQ ID NO: 2535165 - DNA, 13 bp, Homo sapiens
aaaaatttaagtg

SEQ ID NO: 2535166 - DNA, 12 bp, Homo sapiens
aaaacaaagaag

SEQ ID NO: 2535167 - DNA, 16 bp, Homo sapiens
aaaacaataaaatttt

SEQ ID NO: 2535168 - DNA, 23 bp, Homo sapiens
aaaacacagacattctgccaggc

SEQ ID NO: 2535169 - DNA, 12 bp, Homo sapiens
aaaacacagcaa

SEQ ID NO: 2535170 - DNA, 22 bp, Homo sapiens
aaaacacctagctttattcttc

SEQ ID NO: 2535171 - DNA, 21 bp, Homo sapiens
aaaacactaaaaataaaaatg

SEQ ID NO: 2535172 - DNA, 14 bp, Homo sapiens
aaaacactagtttt

SEQ ID NO: 2535173 - DNA, 21 bp, Homo sapiens
aaaacagaacatcattagaac

SEQ ID NO: 2535174 - DNA, 22 bp, Homo sapiens
aaaacagaacatcattagaaca

SEQ ID NO: 2535175 - DNA, 18 bp, Homo sapiens
aaaacaggtcaatacagt

SEQ ID NO: 2535176 - DNA, 18 bp, Homo sapiens
aaaacataatcttctgcc

SEQ ID NO: 2535177 - DNA, 14 bp, Homo sapiens
aaaacatgctacac

SEQ ID NO: 2535178 - DNA, 16 bp, Homo sapiens
aaaacatggtagaatt

SEQ ID NO: 2535179 - DNA, 14 bp, Homo sapiens
aaaaccacagcagt

SEQ ID NO: 2535180 - DNA, 12 bp, Homo sapiens
aaaacccaagtg

SEQ ID NO: 2535181 - DNA, 15 bp, Homo sapiens
aaaaccctgccccca

SEQ ID NO: 2535182 - DNA, 22 bp, Homo sapiens
aaaacctcacccgaggctgccc

SEQ ID NO: 2535183 - DNA, 13 bp, Homo sapiens
aaaacctgacaaa

SEQ ID NO: 2535184 - DNA, 14 bp, Homo sapiens
aaaacctgtcaatg

SEQ ID NO: 2535185 - DNA, 17 bp, Homo sapiens
aaaacctgtcaatgata

SEQ ID NO: 2535186 - DNA, 20 bp, Homo sapiens
aaaacctttcaaatttcaca

SEQ ID NO: 2535187 - DNA, 17 bp, Homo sapiens
aaaacgcaaagggctga

SEQ ID NO: 2535188 - DNA, 13 bp, Homo sapiens
aaaacgcatggag

SEQ ID NO: 2535189 - DNA, 19 bp, Homo sapiens
aaaactgaaaatctaatat

SEQ ID NO: 2535190 - DNA, 15 bp, Homo sapiens
aaaactgaagtctga

SEQ ID NO: 2535191 - DNA, 19 bp, Homo sapiens
aaaactgaagtctgaaatt

SEQ ID NO: 2535192 - DNA, 22 bp, Homo sapiens
aaaacttgatgtgttatctctt

SEQ ID NO: 2535193 - DNA, 17 bp, Homo sapiens
aaaacttgtaaatgctg

SEQ ID NO: 2535194 - DNA, 15 bp, Homo sapiens
aaaacttttctcaga

SEQ ID NO: 2535195 - DNA, 17 bp, Homo sapiens
aaaactttttatatttt

SEQ ID NO: 2535196 - DNA, 20 bp, Homo sapiens
aaaactttttatattttata

SEQ ID NO: 2535197 - DNA, 12 bp, Homo sapiens
aaaagaaaaaaa

SEQ ID NO: 2535198 - DNA, 19 bp, Homo sapiens
aaaagaaaaaaaaagaaaa

SEQ ID NO: 2535199 - DNA, 11 bp, Homo sapiens
aaaagaaaaag

SEQ ID NO: 2535200 - DNA, 14 bp, Homo sapiens
aaaagaaaataaaa

SEQ ID NO: 2535201 - DNA, 17 bp, Homo sapiens
aaaagaacactagagtc

SEQ ID NO: 2535202 - DNA, 13 bp, Homo sapiens
aaaagaatatttt

SEQ ID NO: 2535203 - DNA, 13 bp, Homo sapiens
aaaagactccaaa

SEQ ID NO: 2535204 - DNA, 14 bp, Homo sapiens
aaaagagatatttt

SEQ ID NO: 2535205 - DNA, 21 bp, Homo sapiens
aaaagagatattttaaaatga

SEQ ID NO: 2535206 - DNA, 15 bp, Homo sapiens
aaaagaggggctggg

SEQ ID NO: 2535207 - DNA, 21 bp, Homo sapiens
aaaagaggtttttcttaaata

SEQ ID NO: 2535208 - DNA, 22 bp, Homo sapiens
aaaagaggtttttcttaaataa

SEQ ID NO: 2535209 - DNA, 13 bp, Homo sapiens
aaaagatcgcagt

SEQ ID NO: 2535210 - DNA, 16 bp, Homo sapiens
aaaagattgctgaaat

SEQ ID NO: 2535211 - DNA, 17 bp, Homo sapiens
aaaagatttgttttgtc

SEQ ID NO: 2535212 - DNA, 14 bp, Homo sapiens
aaaagcaaatgaga

SEQ ID NO: 2535213 - DNA, 14 bp, Homo sapiens
aaaagcaagactgt

SEQ ID NO: 2535214 - DNA, 16 bp, Homo sapiens
aaaagcaattccaacc

SEQ ID NO: 2535215 - DNA, 17 bp, Homo sapiens
aaaagcagctctcccct

SEQ ID NO: 2535216 - DNA, 13 bp, Homo sapiens
aaaagcataaatg

SEQ ID NO: 2535217 - DNA, 15 bp, Homo sapiens
aaaagctattagcca

SEQ ID NO: 2535218 - DNA, 20 bp, Homo sapiens
aaaagctattagccaggatc

SEQ ID NO: 2535219 - DNA, 14 bp, Homo sapiens
aaaagctcatattt

SEQ ID NO: 2535220 - DNA, 14 bp, Homo sapiens
aaaagctgggcagg

SEQ ID NO: 2535221 - DNA, 10 bp, Homo sapiens
aaaaggaaaa

SEQ ID NO: 2535222 - DNA, 14 bp, Homo sapiens
aaaaggaaaagcaa

SEQ ID NO: 2535223 - DNA, 15 bp, Homo sapiens
aaaaggaagactaga

SEQ ID NO: 2535224 - DNA, 19 bp, Homo sapiens
aaaaggatgcacagagttg

SEQ ID NO: 2535225 - DNA, 16 bp, Homo sapiens
aaaaggcaaatgtgta

SEQ ID NO: 2535226 - DNA, 17 bp, Homo sapiens
aaaaggcattgtttgag

SEQ ID NO: 2535227 - DNA, 23 bp, Homo sapiens
aaaaggccaaacctctgttcagt

SEQ ID NO: 2535228 - DNA, 20 bp, Homo sapiens
aaaaggctaggtacacagct

SEQ ID NO: 2535229 - DNA, 18 bp, Homo sapiens
aaaagggaactgaacatt

SEQ ID NO: 2535230 - DNA, 15 bp, Homo sapiens
aaaagtacaatttac

SEQ ID NO: 2535231 - DNA, 21 bp, Homo sapiens
aaaagtacatttaatacagca

SEQ ID NO: 2535232 - DNA, 20 bp, Homo sapiens
aaaagtaggtttacattcat

SEQ ID NO: 2535233 - DNA, 12 bp, Homo sapiens
aaaagtattttc

SEQ ID NO: 2535234 - DNA, 17 bp, Homo sapiens
aaaagtgacacagcagc

SEQ ID NO: 2535235 - DNA, 17 bp, Homo sapiens
aaaagtgattgttggca

SEQ ID NO: 2535236 - DNA, 17 bp, Homo sapiens
aaaagttattaatattt

SEQ ID NO: 2535237 - DNA, 12 bp, Homo sapiens
aaaagttgaaat

SEQ ID NO: 2535238 - DNA, 14 bp, Homo sapiens
aaaagttgaaatta

SEQ ID NO: 2535239 - DNA, 16 bp, Homo sapiens
aaaagtttacaagtgt

SEQ ID NO: 2535240 - DNA, 17 bp, Homo sapiens
aaaataaaaaaaagaaa

SEQ ID NO: 2535241 - DNA, 17 bp, Homo sapiens
aaaataaaaaacatata

SEQ ID NO: 2535242 - DNA, 20 bp, Homo sapiens
aaaataaaaagatcactttc

SEQ ID NO: 2535243 - DNA, 12 bp, Homo sapiens
aaaataaaaagt

SEQ ID NO: 2535244 - DNA, 16 bp, Homo sapiens
aaaataaaaagttaaa

SEQ ID NO: 2535245 - DNA, 16 bp, Homo sapiens
aaaataaaacttttta

SEQ ID NO: 2535246 - DNA, 22 bp, Homo sapiens
aaaataattgatttcaagacct

SEQ ID NO: 2535247 - DNA, 19 bp, Homo sapiens
aaaataattttaaacaaag

SEQ ID NO: 2535248 - DNA, 13 bp, Homo sapiens
aaaataccaagga

SEQ ID NO: 2535249 - DNA, 14 bp, Homo sapiens
aaaataccaaggaa

SEQ ID NO: 2535250 - DNA, 15 bp, Homo sapiens
aaaatactattctga

SEQ ID NO: 2535251 - DNA, 15 bp, Homo sapiens
aaagctcactttact

SEQ ID NO: 2535252 - DNA, 13 bp, Homo sapiens
aaagctcatattt

SEQ ID NO: 2535253 - DNA, 17 bp, Homo sapiens
aaagctcctagcagaga

SEQ ID NO: 2535254 - DNA, 20 bp, Homo sapiens
aaagctcctcgagggcaggg

SEQ ID NO: 2535255 - DNA, 16 bp, Homo sapiens
aaagctcctgtcctcc

SEQ ID NO: 2535256 - DNA, 12 bp, Homo sapiens
aaagctgaaaac

SEQ ID NO: 2535257 - DNA, 15 bp, Homo sapiens
aaagctgaaaactgc

SEQ ID NO: 2535258 - DNA, 16 bp, Homo sapiens
aaagctgttgatggta

SEQ ID NO: 2535259 - DNA, 21 bp, Homo sapiens
aaagcttctatcccaggaggt

SEQ ID NO: 2535260 - DNA, 20 bp, Homo sapiens
aaagcttgaagatcgttagt

SEQ ID NO: 2535261 - DNA, 19 bp, Homo sapiens
aaagcttgcaacaaaattc

SEQ ID NO: 2535262 - DNA, 19 bp, Homo sapiens
aaagctttttattcctcct

SEQ ID NO: 2535263 - DNA, 13 bp, Homo sapiens
aaaggaagactag

SEQ ID NO: 2535264 - DNA, 16 bp, Homo sapiens
aaaggacaatttcaaa

SEQ ID NO: 2535265 - DNA, 14 bp, Homo sapiens
aaaggaggctggca

SEQ ID NO: 2535266 - DNA, 14 bp, Homo sapiens
aaaggcagaagcaa

SEQ ID NO: 2535267 - DNA, 19 bp, Homo sapiens
aaaggcagaagcaacccaa

SEQ ID NO: 2535268 - DNA, 16 bp, Homo sapiens
aaaggcattctctgaa

SEQ ID NO: 2535269 - DNA, 18 bp, Homo sapiens
aaaggcattctctgaaga

SEQ ID NO: 2535270 - DNA, 14 bp, Homo sapiens
aaaggccaaacctc

SEQ ID NO: 2535271 - DNA, 14 bp, Homo sapiens
aaaggccagctggc

SEQ ID NO: 2535272 - DNA, 20 bp, Homo sapiens
aaaggccagctggcagcaga

SEQ ID NO: 2535273 - DNA, 14 bp, Homo sapiens
aaaggctacctttg

SEQ ID NO: 2535274 - DNA, 17 bp, Homo sapiens
aaaggctacctttgtat

SEQ ID NO: 2535275 - DNA, 21 bp, Homo sapiens
aaaggctcagtctcaggagca

SEQ ID NO: 2535276 - DNA, 22 bp, Homo sapiens
aaaggctccaggagcagccaca

SEQ ID NO: 2535277 - DNA, 14 bp, Homo sapiens
aaagggaaactatt

SEQ ID NO: 2535278 - DNA, 20 bp, Homo sapiens
aaagggcagggcatctcctg

SEQ ID NO: 2535279 - DNA, 16 bp, Homo sapiens
aaagggctctttagcc

SEQ ID NO: 2535280 - DNA, 18 bp, Homo sapiens
aaaggggcagaaaaactc

SEQ ID NO: 2535281 - DNA, 16 bp, Homo sapiens
aaagggggtcccagtg

SEQ ID NO: 2535282 - DNA, 20 bp, Homo sapiens
aaagggggtcccagtgggag

SEQ ID NO: 2535283 - DNA, 18 bp, Homo sapiens
aaaggggtcccatagagg

SEQ ID NO: 2535284 - DNA, 10 bp, Homo sapiens
aaagggtgaa

SEQ ID NO: 2535285 - DNA, 21 bp, Homo sapiens
aaagggtgaagctatttatct

SEQ ID NO: 2535286 - DNA, 16 bp, Homo sapiens
aaagggtgtttttctg

SEQ ID NO: 2535287 - DNA, 19 bp, Homo sapiens
aaaggtggactggaagggg

SEQ ID NO: 2535288 - DNA, 19 bp, Homo sapiens
aaaggtggtatgtgtgtgt

SEQ ID NO: 2535289 - DNA, 17 bp, Homo sapiens
aaaggttcactaaagca

SEQ ID NO: 2535290 - DNA, 19 bp, Homo sapiens
aaagtaagcccttgaagat

SEQ ID NO: 2535291 - DNA, 16 bp, Homo sapiens
aaagtacatgttaaac

SEQ ID NO: 2535292 - DNA, 15 bp, Homo sapiens
aaagtacatttaata

SEQ ID NO: 2535293 - DNA, 20 bp, Homo sapiens
aaagtacttctccaccctgc

SEQ ID NO: 2535294 - DNA, 23 bp, Homo sapiens
aaagtacttctccaccctgctct

SEQ ID NO: 2535295 - DNA, 22 bp, Homo sapiens
aaagtagaagtcttagatgtat

SEQ ID NO: 2535296 - DNA, 14 bp, Homo sapiens
aaagtagattaaga

SEQ ID NO: 2535297 - DNA, 16 bp, Homo sapiens
aaagtatcatgcattc

SEQ ID NO: 2535298 - DNA, 18 bp, Homo sapiens
aaagtatccctactgtaa

SEQ ID NO: 2535299 - DNA, 21 bp, Homo sapiens
aaagtatccctactgtaattt

SEQ ID NO: 2535300 - DNA, 15 bp, Homo sapiens
aaagtattattttcc

SEQ ID NO: 2535301 - DNA, 12 bp, Homo sapiens
aaagtattcttc

SEQ ID NO: 2535302 - DNA, 22 bp, Homo sapiens
aaagtattcttctcttcctttt

SEQ ID NO: 2535303 - DNA, 13 bp, Homo sapiens
aaagtattttcct

SEQ ID NO: 2535304 - DNA, 17 bp, Homo sapiens
aaagtcaatgttttcag

SEQ ID NO: 2535305 - DNA, 18 bp, Homo sapiens
aaagtcaatgttttcagt

SEQ ID NO: 2535306 - DNA, 23 bp, Homo sapiens
aaagtctgtgtgatgaactttct

SEQ ID NO: 2535307 - DNA, 21 bp, Homo sapiens
aaagtgaatttgaatgaaaaa

SEQ ID NO: 2535308 - DNA, 13 bp, Homo sapiens
aaagtgacacagc

SEQ ID NO: 2535309 - DNA, 15 bp, Homo sapiens
aaagtgataatttct

SEQ ID NO: 2535310 - DNA, 12 bp, Homo sapiens
aaagtgatttct

SEQ ID NO: 2535311 - DNA, 15 bp, Homo sapiens
aaagtgccactcatt

SEQ ID NO: 2535312 - DNA, 17 bp, Homo sapiens
aaagtggccatgccacc

SEQ ID NO: 2535313 - DNA, 21 bp, Homo sapiens
aaagtgggttattctggagtt

SEQ ID NO: 2535314 - DNA, 19 bp, Homo sapiens
aaagtggtgctcagttgta

SEQ ID NO: 2535315 - DNA, 13 bp, Homo sapiens
aaagtgtaaagca

SEQ ID NO: 2535316 - DNA, 20 bp, Homo sapiens
aaagtgtaaatcctttttct

SEQ ID NO: 2535317 - DNA, 22 bp, Homo sapiens
aaagtgtatttttttactaata

SEQ ID NO: 2535318 - DNA, 14 bp, Homo sapiens
aaagtgtgagcagt

SEQ ID NO: 2535319 - DNA, 14 bp, Homo sapiens
aaagtgtgttgttg

SEQ ID NO: 2535320 - DNA, 13 bp, Homo sapiens
aaagtgtttgcct

SEQ ID NO: 2535321 - DNA, 22 bp, Homo sapiens
aaagttactgattcactgcatg

SEQ ID NO: 2535322 - DNA, 14 bp, Homo sapiens
aaagttagtctact

SEQ ID NO: 2535323 - DNA, 22 bp, Homo sapiens
aaagttcatagggtctcttcag

SEQ ID NO: 2535324 - DNA, 16 bp, Homo sapiens
aaagttggtgacagat

SEQ ID NO: 2535325 - DNA, 21 bp, Homo sapiens
aaagtttctcttttcaaaaca

SEQ ID NO: 2535326 - DNA, 16 bp, Homo sapiens
aaagttttatttttct

SEQ ID NO: 2535327 - DNA, 15 bp, Homo sapiens
aaagttttcccttga

SEQ ID NO: 2535328 - DNA, 12 bp, Homo sapiens
aaagttttgaaa

SEQ ID NO: 2535329 - DNA, 16 bp, Homo sapiens
aaagttttgaaaagct

SEQ ID NO: 2535330 - DNA, 22 bp, Homo sapiens
aaataaaaaaaagaaaaaagag

SEQ ID NO: 2535331 - DNA, 23 bp, Homo sapiens
aaataaaaactaaattgtaaact

SEQ ID NO: 2535332 - DNA, 10 bp, Homo sapiens
aaataaaaag

SEQ ID NO: 2535333 - DNA, 12 bp, Homo sapiens
aaataaaaagtt

SEQ ID NO: 2535334 - DNA, 14 bp, Homo sapiens
aaataaaaccagct

SEQ ID NO: 2535335 - DNA, 12 bp, Homo sapiens
aaataaaacctt

SEQ ID NO: 2535336 - DNA, 13 bp, Homo sapiens
aaataaaactttt

SEQ ID NO: 2535337 - DNA, 16 bp, Homo sapiens
aaataaaactttttaa

SEQ ID NO: 2535338 - DNA, 11 bp, Homo sapiens
aaataaaagca

SEQ ID NO: 2535339 - DNA, 13 bp, Homo sapiens
aaataaaagcagc

SEQ ID NO: 2535340 - DNA, 15 bp, Homo sapiens
aaataaaatggattt

SEQ ID NO: 2535341 - DNA, 15 bp, Homo sapiens
aaataaaatttgttg

SEQ ID NO: 2535342 - DNA, 16 bp, Homo sapiens
aaataaaatttgttgc

SEQ ID NO: 2535343 - DNA, 17 bp, Homo sapiens
aaataaaatttgttgca

SEQ ID NO: 2535344 - DNA, 18 bp, Homo sapiens
aaataaaatttgttgcat

SEQ ID NO: 2535345 - DNA, 20 bp, Homo sapiens
aaataaatagctatatccat

SEQ ID NO: 2535346 - DNA, 13 bp, Homo sapiens
aaataaatgcaat

SEQ ID NO: 2535347 - DNA, 21 bp, Homo sapiens
aaataacaagtcgatgaacta

SEQ ID NO: 2535348 - DNA, 17 bp, Homo sapiens
aaataacaatgtgctct

SEQ ID NO: 2535349 - DNA, 14 bp, Homo sapiens
aaataacaatgtta

SEQ ID NO: 2535350 - DNA, 15 bp, Homo sapiens
aaataacaatgttaa

SEQ ID NO: 2535351 - DNA, 18 bp, Homo sapiens
aaataacaatgttaagga

SEQ ID NO: 2535352 - DNA, 13 bp, Homo sapiens
aaataacacacat

SEQ ID NO: 2535353 - DNA, 21 bp, Homo sapiens
aaataacacacatataaacat

SEQ ID NO: 2535354 - DNA, 15 bp, Homo sapiens
aaataacttcaagca

SEQ ID NO: 2535355 - DNA, 23 bp, Homo sapiens
aaataagacggatttatttttcc

SEQ ID NO: 2535356 - DNA, 12 bp, Homo sapiens
aaataataaatc

SEQ ID NO: 2535357 - DNA, 13 bp, Homo sapiens
aaataatatgcat

SEQ ID NO: 2535358 - DNA, 23 bp, Homo sapiens
aaataatctatttctatgagaaa

SEQ ID NO: 2535359 - DNA, 18 bp, Homo sapiens
aaataattttaaacaaag

SEQ ID NO: 2535360 - DNA, 18 bp, Homo sapiens
aaatacacatagcatgta

SEQ ID NO: 2535361 - DNA, 16 bp, Homo sapiens
aaatacagacactaag

SEQ ID NO: 2535362 - DNA, 20 bp, Homo sapiens
aaatacagtttgtcacatga

SEQ ID NO: 2535363 - DNA, 13 bp, Homo sapiens
aaatacatgacat

SEQ ID NO: 2535364 - DNA, 19 bp, Homo sapiens
aaataccagccagtaaatg

SEQ ID NO: 2535365 - DNA, 18 bp, Homo sapiens
aaataccagtgaaccaaa

SEQ ID NO: 2535366 - DNA, 21 bp, Homo sapiens
aaataccagtgaaccaaagag

SEQ ID NO: 2535367 - DNA, 17 bp, Homo sapiens
aaataccagtgtggttt

SEQ ID NO: 2535368 - DNA, 18 bp, Homo sapiens
aaatacctcttagctgag

SEQ ID NO: 2535369 - DNA, 16 bp, Homo sapiens
aaatactatttttact

SEQ ID NO: 2535370 - DNA, 15 bp, Homo sapiens
aaatactcatgtgta

SEQ ID NO: 2535371 - DNA, 21 bp, Homo sapiens
aaatactcatgtgtatgggca

SEQ ID NO: 2535372 - DNA, 13 bp, Homo sapiens
aaatactgccaga

SEQ ID NO: 2535373 - DNA, 17 bp, Homo sapiens
aaatactgccagatgct

SEQ ID NO: 2535374 - DNA, 22 bp, Homo sapiens
aaatactgtttttaacaactat

SEQ ID NO: 2535375 - DNA, 11 bp, Homo sapiens
aaatacttgtc

SEQ ID NO: 2535376 - DNA, 21 bp, Homo sapiens
aaatacttgtcaatatttaaa

SEQ ID NO: 2535377 - DNA, 22 bp, Homo sapiens
aaatagaagaatacaaacatat

SEQ ID NO: 2535378 - DNA, 23 bp, Homo sapiens
aaatagccaacacccatctgttt

SEQ ID NO: 2535379 - DNA, 23 bp, Homo sapiens
aaatagccacttaccttcaataa

SEQ ID NO: 2535380 - DNA, 12 bp, Homo sapiens
aaatagctatat

SEQ ID NO: 2535381 - DNA, 19 bp, Homo sapiens
aaatagctatatccatgta

SEQ ID NO: 2535382 - DNA, 19 bp, Homo sapiens
aaatagctccgtggagcag

SEQ ID NO: 2535383 - DNA, 13 bp, Homo sapiens
aaatagtaaaaat

SEQ ID NO: 2535384 - DNA, 16 bp, Homo sapiens
aaatatactgtaaaga

SEQ ID NO: 2535385 - DNA, 23 bp, Homo sapiens
aaatatactgtaaagaaagagag

SEQ ID NO: 2535386 - DNA, 18 bp, Homo sapiens
aaatatagatcagttata

SEQ ID NO: 2535387 - DNA, 20 bp, Homo sapiens
aaatatatttaagataatta

SEQ ID NO: 2535388 - DNA, 18 bp, Homo sapiens
aaatatcatttatttttt

SEQ ID NO: 2535389 - DNA, 14 bp, Homo sapiens
aaatatctgaaaat

SEQ ID NO: 2535390 - DNA, 17 bp, Homo sapiens
aaatatctgaaaatgta

SEQ ID NO: 2535391 - DNA, 19 bp, Homo sapiens
aaatatctgaaaatgtatg

SEQ ID NO: 2535392 - DNA, 23 bp, Homo sapiens
aaatatctgaaaatgtatgtgta

SEQ ID NO: 2535393 - DNA, 15 bp, Homo sapiens
aaatatctgtattta

SEQ ID NO: 2535394 - DNA, 20 bp, Homo sapiens
aaatatgattttatttgaca

SEQ ID NO: 2535395 - DNA, 17 bp, Homo sapiens
aaatatgcaaagcactg

SEQ ID NO: 2535396 - DNA, 23 bp, Homo sapiens
aaatatgcctctcctttgtatat

SEQ ID NO: 2535397 - DNA, 20 bp, Homo sapiens
aaatatgttagcaaagagtt

SEQ ID NO: 2535398 - DNA, 23 bp, Homo sapiens
aaatatgttttttagatcaaata

SEQ ID NO: 2535399 - DNA, 17 bp, Homo sapiens
aaatattagaaacagct

SEQ ID NO: 2535400 - DNA, 13 bp, Homo sapiens
aaatattagatgt

SEQ ID NO: 2535401 - DNA, 18 bp, Homo sapiens
aaatattagatgtgattt

SEQ ID NO: 2535402 - DNA, 20 bp, Homo sapiens
aaatattagatgtgatttaa

SEQ ID NO: 2535403 - DNA, 23 bp, Homo sapiens
aaatattattgtggaaatgaata

SEQ ID NO: 2535404 - DNA, 20 bp, Homo sapiens
aaatattattttatgaaagg

SEQ ID NO: 2535405 - DNA, 19 bp, Homo sapiens
aaatattccctagaaactt

SEQ ID NO: 2535406 - DNA, 15 bp, Homo sapiens
aaatattcctgcatt

SEQ ID NO: 2535407 - DNA, 20 bp, Homo sapiens
aaatattcctgcatttgtga

SEQ ID NO: 2535408 - DNA, 14 bp, Homo sapiens
aaatattctatatg

SEQ ID NO: 2535409 - DNA, 12 bp, Homo sapiens
aaatatttaaga

SEQ ID NO: 2535410 - DNA, 21 bp, Homo sapiens
aaatatttacatatgaaattt

SEQ ID NO: 2535411 - DNA, 14 bp, Homo sapiens
aaatatttcaagac

SEQ ID NO: 2535412 - DNA, 12 bp, Homo sapiens
aaatatttggag

SEQ ID NO: 2535413 - DNA, 22 bp, Homo sapiens
aaatatttgtacatagttattt

SEQ ID NO: 2535414 - DNA, 20 bp, Homo sapiens
aaatattttcatacagcatt

SEQ ID NO: 2535415 - DNA, 16 bp, Homo sapiens
aaatattttctgggtt

SEQ ID NO: 2535416 - DNA, 21 bp, Homo sapiens
aaatattttgaatcaataata

SEQ ID NO: 2535417 - DNA, 21 bp, Homo sapiens
aaatattttttcttttctatt

SEQ ID NO: 2535418 - DNA, 16 bp, Homo sapiens
aaatcaaatatgcaaa

SEQ ID NO: 2535419 - DNA, 19 bp, Homo sapiens
aaatcaaatatgcaaagca

SEQ ID NO: 2535420 - DNA, 19 bp, Homo sapiens
aaatcaatgctataactat

SEQ ID NO: 2535421 - DNA, 19 bp, Homo sapiens
aaatcagccgtgtaaccat

SEQ ID NO: 2535422 - DNA, 19 bp, Homo sapiens
aaatcagcctgctccagct

SEQ ID NO: 2535423 - DNA, 21 bp, Homo sapiens
aaatcagcctgctccagctgt

SEQ ID NO: 2535424 - DNA, 22 bp, Homo sapiens
aaatcataagatatttttcatg

SEQ ID NO: 2535425 - DNA, 17 bp, Homo sapiens
aaatcatggaatggtta

SEQ ID NO: 2535426 - DNA, 17 bp, Homo sapiens
aaatcatgtacatttct

SEQ ID NO: 2535427 - DNA, 11 bp, Homo sapiens
aaatcatttct

SEQ ID NO: 2535428 - DNA, 23 bp, Homo sapiens
aaatcatttctgcatcagctgct

SEQ ID NO: 2535429 - DNA, 14 bp, Homo sapiens
aaatccagaaagaa

SEQ ID NO: 2535430 - DNA, 13 bp, Homo sapiens
aaatccccttctc

SEQ ID NO: 2535431 - DNA, 21 bp, Homo sapiens
aaatccgaacctcctctgtga

SEQ ID NO: 2535432 - DNA, 14 bp, Homo sapiens
aaatcctatgtgat

SEQ ID NO: 2535433 - DNA, 15 bp, Homo sapiens
aaatcgcttttgata

SEQ ID NO: 2535434 - DNA, 22 bp, Homo sapiens
aaatcggatctggggctctggg

SEQ ID NO: 2535435 - DNA, 23 bp, Homo sapiens
aaatcggatctggggctctggga

SEQ ID NO: 2535436 - DNA, 22 bp, Homo sapiens
aaatctagactcaaggttccca

SEQ ID NO: 2535437 - DNA, 19 bp, Homo sapiens
aaatctattcagacaagca

SEQ ID NO: 2535438 - DNA, 19 bp, Homo sapiens
aaatctcaaatttctaaat

SEQ ID NO: 2535439 - DNA, 17 bp, Homo sapiens
aaatctcaccccatccc

SEQ ID NO: 2535440 - DNA, 22 bp, Homo sapiens
aaatctcagaattccttttcta

SEQ ID NO: 2535441 - DNA, 13 bp, Homo sapiens
aaatctctaatat

SEQ ID NO: 2535442 - DNA, 15 bp, Homo sapiens
aaatctctaatatgg

SEQ ID NO: 2535443 - DNA, 13 bp, Homo sapiens
aaatctgaagacc

SEQ ID NO: 2535444 - DNA, 17 bp, Homo sapiens
aaatctgaccaaaacaa

SEQ ID NO: 2535445 - DNA, 14 bp, Homo sapiens
aaatcttaacttga

SEQ ID NO: 2535446 - DNA, 19 bp, Homo sapiens
aaatcttatattccatata

SEQ ID NO: 2535447 - DNA, 21 bp, Homo sapiens
aaatcttatattccatatatt

SEQ ID NO: 2535448 - DNA, 17 bp, Homo sapiens
aaatgaaaatcgtgaca

SEQ ID NO: 2535449 - DNA, 16 bp, Homo sapiens
aaatgaaaatgtcttg

SEQ ID NO: 2535450 - DNA, 21 bp, Homo sapiens
aaatgaaagcagggacttgaa

SEQ ID NO: 2535451 - DNA, 15 bp, Homo sapiens
aaatgaaagcatgtg

SEQ ID NO: 2535452 - DNA, 14 bp, Homo sapiens
aaatgaaattgtaa

SEQ ID NO: 2535453 - DNA, 17 bp, Homo sapiens
aaatgaataatttccca

SEQ ID NO: 2535454 - DNA, 16 bp, Homo sapiens
aaatgaatggctcact

SEQ ID NO: 2535455 - DNA, 15 bp, Homo sapiens
aaatgaccaatatta

SEQ ID NO: 2535456 - DNA, 14 bp, Homo sapiens
aaatgacccaaaga

SEQ ID NO: 2535457 - DNA, 16 bp, Homo sapiens
aaatgacccaaagacc

SEQ ID NO: 2535458 - DNA, 17 bp, Homo sapiens
aaatgacccaaagacca

SEQ ID NO: 2535459 - DNA, 22 bp, Homo sapiens
aaatgactaaaaaacaaagaag

SEQ ID NO: 2535460 - DNA, 17 bp, Homo sapiens
aaatgagatcaggctct

SEQ ID NO: 2535461 - DNA, 23 bp, Homo sapiens
aaatgagctcgcatttgtcaatg

SEQ ID NO: 2535462 - DNA, 14 bp, Homo sapiens
aaatgaggacatgt

SEQ ID NO: 2535463 - DNA, 16 bp, Homo sapiens
aaatgaggtactctcc

SEQ ID NO: 2535464 - DNA, 23 bp, Homo sapiens
aaatgaggtactctcctggaaat

SEQ ID NO: 2535465 - DNA, 17 bp, Homo sapiens
aaatgaggtcagagcct

SEQ ID NO: 2535466 - DNA, 19 bp, Homo sapiens
aaatgaggtcagagcctgc

SEQ ID NO: 2535467 - DNA, 18 bp, Homo sapiens
aaatgagtgtgtttgtca

SEQ ID NO: 2535468 - DNA, 22 bp, Homo sapiens
aaatgatccccaagtgtgaaca

SEQ ID NO: 2535469 - DNA, 22 bp, Homo sapiens
aaatgattgtaaaatagcttgt

SEQ ID NO: 2535470 - DNA, 14 bp, Homo sapiens
aaatgcaaatccta

SEQ ID NO: 2535471 - DNA, 21 bp, Homo sapiens
aaatgcaaatcctatgtgatt

SEQ ID NO: 2535472 - DNA, 22 bp, Homo sapiens
aaatgcacctggaatatataac

SEQ ID NO: 2535473 - DNA, 23 bp, Homo sapiens
aaatgcagcgaaccaatatttgt

SEQ ID NO: 2535474 - DNA, 12 bp, Homo sapiens
aaatgcagtgaa

SEQ ID NO: 2535475 - DNA, 15 bp, Homo sapiens
aaatgcataaatgca

SEQ ID NO: 2535476 - DNA, 20 bp, Homo sapiens
aaatgcatatcctgagccat

SEQ ID NO: 2535477 - DNA, 11 bp, Homo sapiens
aaatgcatatt

SEQ ID NO: 2535478 - DNA, 14 bp, Homo sapiens
aaatgcccagcccc

SEQ ID NO: 2535479 - DNA, 13 bp, Homo sapiens
aaatgcccagctt

SEQ ID NO: 2535480 - DNA, 17 bp, Homo sapiens
aaatgcctttgagacag

SEQ ID NO: 2535481 - DNA, 12 bp, Homo sapiens
aaatgctgaaca

SEQ ID NO: 2535482 - DNA, 19 bp, Homo sapiens
aaatgctgtaactttctga

SEQ ID NO: 2535483 - DNA, 16 bp, Homo sapiens
aaatggaaatgggcag

SEQ ID NO: 2535484 - DNA, 16 bp, Homo sapiens
aaatggccatttgctt

SEQ ID NO: 2535485 - DNA, 19 bp, Homo sapiens
aaatgggggtgcatttgag

SEQ ID NO: 2535486 - DNA, 20 bp, Homo sapiens
aaatgggttggtgcttctaa

SEQ ID NO: 2535487 - DNA, 17 bp, Homo sapiens
aaatggtcgcccaggag

SEQ ID NO: 2535488 - DNA, 20 bp, Homo sapiens
aaatggtgtacataatgtat

SEQ ID NO: 2535489 - DNA, 13 bp, Homo sapiens
aaatggttaaaag

SEQ ID NO: 2535490 - DNA, 19 bp, Homo sapiens
aaatggttaaaagaggttt

SEQ ID NO: 2535491 - DNA, 17 bp, Homo sapiens
aaatgtaaatattctat

SEQ ID NO: 2535492 - DNA, 13 bp, Homo sapiens
aaatgtaacagtc

SEQ ID NO: 2535493 - DNA, 17 bp, Homo sapiens
aaatgtaacagtctgat

SEQ ID NO: 2535494 - DNA, 12 bp, Homo sapiens
aaatgtaattga

SEQ ID NO: 2535495 - DNA, 14 bp, Homo sapiens
aaatgtatatgcac

SEQ ID NO: 2535496 - DNA, 18 bp, Homo sapiens
aaatgtatgattacatca

SEQ ID NO: 2535497 - DNA, 20 bp, Homo sapiens
aaatgtcagatacaatgtat

SEQ ID NO: 2535498 - DNA, 22 bp, Homo sapiens
aaatgtcagtggaagaagcaga

SEQ ID NO: 2535499 - DNA, 24 bp, Homo sapiens
aaatgtctagttgtaacaccatga

SEQ ID NO: 2535500 - DNA, 16 bp, Homo sapiens
aaatgtcttctgtatt

SEQ ID NO: 2535501 - DNA, 15 bp, Homo sapiens
aaatgtgatttttct

SEQ ID NO: 2535502 - DNA, 12 bp, Homo sapiens
aaatgtgtacat

SEQ ID NO: 2535503 - DNA, 20 bp, Homo sapiens
aaatgttattttttaattat

SEQ ID NO: 2535504 - DNA, 17 bp, Homo sapiens
aaatgttcatcaatgaa

SEQ ID NO: 2535505 - DNA, 22 bp, Homo sapiens
aaatgttggatttataaatgct

SEQ ID NO: 2535506 - DNA, 23 bp, Homo sapiens
aaatgttgttcattattggaggg

SEQ ID NO: 2535507 - DNA, 23 bp, Homo sapiens
aaatgtttctgcagtagtctctg

SEQ ID NO: 2535508 - DNA, 18 bp, Homo sapiens
aaatgttttagcaattta

SEQ ID NO: 2535509 - DNA, 12 bp, Homo sapiens
aaattaacactg

SEQ ID NO: 2535510 - DNA, 19 bp, Homo sapiens
aaattaacttttataaact

SEQ ID NO: 2535511 - DNA, 15 bp, Homo sapiens
aaattaagaagaaac

SEQ ID NO: 2535512 - DNA, 16 bp, Homo sapiens
aaattaagaagaaact

SEQ ID NO: 2535513 - DNA, 16 bp, Homo sapiens
aaattacacccaaaga

SEQ ID NO: 2535514 - DNA, 14 bp, Homo sapiens
aaattactttgtga

SEQ ID NO: 2535515 - DNA, 17 bp, Homo sapiens
aaattagctgtgtgaaa

SEQ ID NO: 2535516 - DNA, 18 bp, Homo sapiens
aaattagctgtgtgaaat

SEQ ID NO: 2535517 - DNA, 14 bp, Homo sapiens
aaattaggaataaa

SEQ ID NO: 2535518 - DNA, 17 bp, Homo sapiens
aaattaggttttgtaca

SEQ ID NO: 2535519 - DNA, 16 bp, Homo sapiens
aaattataacttaaaa

SEQ ID NO: 2535520 - DNA, 19 bp, Homo sapiens
aaattataacttaaaatat

SEQ ID NO: 2535521 - DNA, 17 bp, Homo sapiens
aaattatgtatgtttac

SEQ ID NO: 2535522 - DNA, 14 bp, Homo sapiens
aaattatgtttata

SEQ ID NO: 2535523 - DNA, 23 bp, Homo sapiens
aaattatgtttatataaatgctt

SEQ ID NO: 2535524 - DNA, 24 bp, Homo sapiens
aaattatgtttatataaatgcttt

SEQ ID NO: 2535525 - DNA, 13 bp, Homo sapiens
aaattatttcaga

SEQ ID NO: 2535526 - DNA, 16 bp, Homo sapiens
aaattatttgtgtaat

SEQ ID NO: 2535527 - DNA, 22 bp, Homo sapiens
aaattatttgtgtaatagaaaa

SEQ ID NO: 2535528 - DNA, 23 bp, Homo sapiens
aaattatttgtgtaatagaaaac

SEQ ID NO: 2535529 - DNA, 16 bp, Homo sapiens
aaattattttggattt

SEQ ID NO: 2535530 - DNA, 21 bp, Homo sapiens
aaattcaaaaagtgtttattt

SEQ ID NO: 2535531 - DNA, 18 bp, Homo sapiens
aaattcacaagttgtgtt

SEQ ID NO: 2535532 - DNA, 21 bp, Homo sapiens
aaattcatcaaatggaagaca

SEQ ID NO: 2535533 - DNA, 12 bp, Homo sapiens
aaattcatttta

SEQ ID NO: 2535534 - DNA, 13 bp, Homo sapiens
aaattcatttttt

SEQ ID NO: 2535535 - DNA, 13 bp, Homo sapiens
aaattccactgga

SEQ ID NO: 2535536 - DNA, 15 bp, Homo sapiens
aaattccctggcctt

SEQ ID NO: 2535537 - DNA, 16 bp, Homo sapiens
aaattcccttcatctg

SEQ ID NO: 2535538 - DNA, 18 bp, Homo sapiens
aaattcccttcatctgga

SEQ ID NO: 2535539 - DNA, 21 bp, Homo sapiens
aaattcgctgcaacctgttga

SEQ ID NO: 2535540 - DNA, 20 bp, Homo sapiens
aacgttttgaactaataaaa

SEQ ID NO: 2535541 - DNA, 15 bp, Homo sapiens
aactaaactttcaca

SEQ ID NO: 2535542 - DNA, 19 bp, Homo sapiens
aactaagcccccgctgtaa

SEQ ID NO: 2535543 - DNA, 22 bp, Homo sapiens
aactaatatgggcattgtagtt

SEQ ID NO: 2535544 - DNA, 22 bp, Homo sapiens
aactaatctattgggttcatta

SEQ ID NO: 2535545 - DNA, 17 bp, Homo sapiens
aactactcagggaatga

SEQ ID NO: 2535546 - DNA, 13 bp, Homo sapiens
aactactgtgttc

SEQ ID NO: 2535547 - DNA, 16 bp, Homo sapiens
aactactgtgttcctg

SEQ ID NO: 2535548 - DNA, 16 bp, Homo sapiens
aactagaacctggagg

SEQ ID NO: 2535549 - DNA, 17 bp, Homo sapiens
aactagaatttattcaa

SEQ ID NO: 2535550 - DNA, 19 bp, Homo sapiens
aactagaatttattcaatt

SEQ ID NO: 2535551 - DNA, 16 bp, Homo sapiens
aactagaatttgatta

SEQ ID NO: 2535552 - DNA, 18 bp, Homo sapiens
aactagacattctgtcgc

SEQ ID NO: 2535553 - DNA, 20 bp, Homo sapiens
aactagactcccaagctgga

SEQ ID NO: 2535554 - DNA, 20 bp, Homo sapiens
aactagattacattcagttg

SEQ ID NO: 2535555 - DNA, 18 bp, Homo sapiens
aactagcttggaaactgg

SEQ ID NO: 2535556 - DNA, 15 bp, Homo sapiens
aactagtcctttact

SEQ ID NO: 2535557 - DNA, 14 bp, Homo sapiens
aactatatgtgaat

SEQ ID NO: 2535558 - DNA, 13 bp, Homo sapiens
aactatattttct

SEQ ID NO: 2535559 - DNA, 11 bp, Homo sapiens
aactatcttgg

SEQ ID NO: 2535560 - DNA, 18 bp, Homo sapiens
aactatgatatggtaaaa

SEQ ID NO: 2535561 - DNA, 16 bp, Homo sapiens
aactatgatttggaaa

SEQ ID NO: 2535562 - DNA, 21 bp, Homo sapiens
aactatgatttggaaaataaa

SEQ ID NO: 2535563 - DNA, 14 bp, Homo sapiens
aactattgcccagg

SEQ ID NO: 2535564 - DNA, 18 bp, Homo sapiens
aactatttgtctttcagg

SEQ ID NO: 2535565 - DNA, 11 bp, Homo sapiens
aactcaaatgc

SEQ ID NO: 2535566 - DNA, 13 bp, Homo sapiens
aactcaatatttt

SEQ ID NO: 2535567 - DNA, 15 bp, Homo sapiens
aactcaccatgtaaa

SEQ ID NO: 2535568 - DNA, 16 bp, Homo sapiens
aactcaccatgtaaaa

SEQ ID NO: 2535569 - DNA, 12 bp, Homo sapiens
aactcaccccag

SEQ ID NO: 2535570 - DNA, 17 bp, Homo sapiens
aactcaccccagcccca

SEQ ID NO: 2535571 - DNA, 17 bp, Homo sapiens
aactcacctctcaaggt

SEQ ID NO: 2535572 - DNA, 15 bp, Homo sapiens
aactcacctggggct

SEQ ID NO: 2535573 - DNA, 14 bp, Homo sapiens
aactcagagcctcc

SEQ ID NO: 2535574 - DNA, 15 bp, Homo sapiens
aactcagatcactac

SEQ ID NO: 2535575 - DNA, 17 bp, Homo sapiens
aactcagatctgtctga

SEQ ID NO: 2535576 - DNA, 12 bp, Homo sapiens
aactcagccaag

SEQ ID NO: 2535577 - DNA, 14 bp, Homo sapiens
aactcagccaagca

SEQ ID NO: 2535578 - DNA, 15 bp, Homo sapiens
aactcagccaagcac

SEQ ID NO: 2535579 - DNA, 17 bp, Homo sapiens
aactcagggacagagcc

SEQ ID NO: 2535580 - DNA, 15 bp, Homo sapiens
aactcagttttaact

SEQ ID NO: 2535581 - DNA, 18 bp, Homo sapiens
aactcatacctttaaagg

SEQ ID NO: 2535582 - DNA, 23 bp, Homo sapiens
aactcatactgtgctggagccac

SEQ ID NO: 2535583 - DNA, 18 bp, Homo sapiens
aactcatcataaaataaa

SEQ ID NO: 2535584 - DNA, 23 bp, Homo sapiens
aactcattcctgcctgtctcctt

SEQ ID NO: 2535585 - DNA, 24 bp, Homo sapiens
aactcatttttgttttcattatct

SEQ ID NO: 2535586 - DNA, 13 bp, Homo sapiens
aactccagtagct

SEQ ID NO: 2535587 - DNA, 23 bp, Homo sapiens
aactccccttcctcactgcccaa

SEQ ID NO: 2535588 - DNA, 12 bp, Homo sapiens
aactcctgcccc

SEQ ID NO: 2535589 - DNA, 17 bp, Homo sapiens
aactcctgcccctgttc

SEQ ID NO: 2535590 - DNA, 18 bp, Homo sapiens
aactcctttagcaggtgg

SEQ ID NO: 2535591 - DNA, 14 bp, Homo sapiens
aactcgaggactgt

SEQ ID NO: 2535592 - DNA, 15 bp, Homo sapiens
aactctaatagtgct

SEQ ID NO: 2535593 - DNA, 21 bp, Homo sapiens
aactctcctctgctgctggct

SEQ ID NO: 2535594 - DNA, 22 bp, Homo sapiens
aactctctccaccctatatgta

SEQ ID NO: 2535595 - DNA, 19 bp, Homo sapiens
aactctgaattttaaagca

SEQ ID NO: 2535596 - DNA, 16 bp, Homo sapiens
aactctgcttgatttt

SEQ ID NO: 2535597 - DNA, 16 bp, Homo sapiens
aactctggcttccagg

SEQ ID NO: 2535598 - DNA, 20 bp, Homo sapiens
aactctggcttccaggtatc

SEQ ID NO: 2535599 - DNA, 20 bp, Homo sapiens
aactctgtcttcacctgatt

SEQ ID NO: 2535600 - DNA, 16 bp, Homo sapiens
aactctgtggcattat

SEQ ID NO: 2535601 - DNA, 13 bp, Homo sapiens
aactcttatctca

SEQ ID NO: 2535602 - DNA, 13 bp, Homo sapiens
aactctttcaaaa

SEQ ID NO: 2535603 - DNA, 14 bp, Homo sapiens
aactctttgagaaa

SEQ ID NO: 2535604 - DNA, 13 bp, Homo sapiens
aactgaaagtgaa

SEQ ID NO: 2535605 - DNA, 14 bp, Homo sapiens
aactgaagtctgaa

SEQ ID NO: 2535606 - DNA, 21 bp, Homo sapiens
aactgacaggcagcctggaca

SEQ ID NO: 2535607 - DNA, 14 bp, Homo sapiens
aactgaccagcctc

SEQ ID NO: 2535608 - DNA, 19 bp, Homo sapiens
aactgaccagcctccatgc

SEQ ID NO: 2535609 - DNA, 18 bp, Homo sapiens
aactgactttatcctcag

SEQ ID NO: 2535610 - DNA, 23 bp, Homo sapiens
aactgagatgtgaacacatcagc

SEQ ID NO: 2535611 - DNA, 18 bp, Homo sapiens
aactgagctcctctgggc

SEQ ID NO: 2535612 - DNA, 18 bp, Homo sapiens
aactgaggaatttcacct

SEQ ID NO: 2535613 - DNA, 18 bp, Homo sapiens
aactgaggaattttcttt

SEQ ID NO: 2535614 - DNA, 20 bp, Homo sapiens
aactgaggcagacagcagct

SEQ ID NO: 2535615 - DNA, 13 bp, Homo sapiens
aactgattcataa

SEQ ID NO: 2535616 - DNA, 16 bp, Homo sapiens
aactgcattagaaatt

SEQ ID NO: 2535617 - DNA, 20 bp, Homo sapiens
aactgcattgagaactgcat

SEQ ID NO: 2535618 - DNA, 23 bp, Homo sapiens
aactgctgactgttttctcttga

SEQ ID NO: 2535619 - DNA, 13 bp, Homo sapiens
aactggactcagg

SEQ ID NO: 2535620 - DNA, 19 bp, Homo sapiens
aactggactggttcaaatg

SEQ ID NO: 2535621 - DNA, 17 bp, Homo sapiens
aactggcagttttccat

SEQ ID NO: 2535622 - DNA, 21 bp, Homo sapiens
aactggccggtctgcaagtca

SEQ ID NO: 2535623 - DNA, 23 bp, Homo sapiens
aactggccggtctgcaagtcaga

SEQ ID NO: 2535624 - DNA, 11 bp, Homo sapiens
aactggctgca

SEQ ID NO: 2535625 - DNA, 16 bp, Homo sapiens
aactgggctgaacact

SEQ ID NO: 2535626 - DNA, 16 bp, Homo sapiens
aactgggtacttgtgg

SEQ ID NO: 2535627 - DNA, 14 bp, Homo sapiens
aactgggttcctgc

SEQ ID NO: 2535628 - DNA, 11 bp, Homo sapiens
aactgtggccg

SEQ ID NO: 2535629 - DNA, 20 bp, Homo sapiens
aactgtggccgttatctgga

SEQ ID NO: 2535630 - DNA, 20 bp, Homo sapiens
aactgtgtacataactgaaa

SEQ ID NO: 2535631 - DNA, 23 bp, Homo sapiens
aactgtgtacataactgaaaatg

SEQ ID NO: 2535632 - DNA, 14 bp, Homo sapiens
aactgttatgaaat

SEQ ID NO: 2535633 - DNA, 15 bp, Homo sapiens
aactgttatttataa

SEQ ID NO: 2535634 - DNA, 16 bp, Homo sapiens
aactgttatttataat

SEQ ID NO: 2535635 - DNA, 18 bp, Homo sapiens
aacttaaaaatgtaaata

SEQ ID NO: 2535636 - DNA, 17 bp, Homo sapiens
aacttaaataatgtgaa

SEQ ID NO: 2535637 - DNA, 14 bp, Homo sapiens
aacttaacatattt

SEQ ID NO: 2535638 - DNA, 16 bp, Homo sapiens
aacttaacatatttac

SEQ ID NO: 2535639 - DNA, 12 bp, Homo sapiens
aacttacacaca

SEQ ID NO: 2535640 - DNA, 19 bp, Homo sapiens
aacttagcatgtgttgaaa

SEQ ID NO: 2535641 - DNA, 16 bp, Homo sapiens
aacttaggtggcaagc

SEQ ID NO: 2535642 - DNA, 23 bp, Homo sapiens
aacttagtgcggacaagttttaa

SEQ ID NO: 2535643 - DNA, 20 bp, Homo sapiens
aacttatatactatttccct

SEQ ID NO: 2535644 - DNA, 15 bp, Homo sapiens
aacttatattgtaag

SEQ ID NO: 2535645 - DNA, 21 bp, Homo sapiens
aacttatattgtaagaaatac

SEQ ID NO: 2535646 - DNA, 17 bp, Homo sapiens
aacttatttttttctga

SEQ ID NO: 2535647 - DNA, 19 bp, Homo sapiens
aacttatttttttctgatt

SEQ ID NO: 2535648 - DNA, 19 bp, Homo sapiens
aacttcaacatttacatgt

SEQ ID NO: 2535649 - DNA, 22 bp, Homo sapiens
aacttcacatattgatttccgt

SEQ ID NO: 2535650 - DNA, 13 bp, Homo sapiens
aacttcagacata

SEQ ID NO: 2535651 - DNA, 21 bp, Homo sapiens
aacttcaggataataaagtgt

SEQ ID NO: 2535652 - DNA, 14 bp, Homo sapiens
aacttcatttgatg

SEQ ID NO: 2535653 - DNA, 22 bp, Homo sapiens
aacttccttggactcattttaa

SEQ ID NO: 2535654 - DNA, 20 bp, Homo sapiens
aacttcgaaagcatcattat

SEQ ID NO: 2535655 - DNA, 19 bp, Homo sapiens
aacttcgcatcaaaagaca

SEQ ID NO: 2535656 - DNA, 16 bp, Homo sapiens
aacttctaatatattt

SEQ ID NO: 2535657 - DNA, 22 bp, Homo sapiens
aacttctcccctggtagaaaga

SEQ ID NO: 2535658 - DNA, 15 bp, Homo sapiens
aacttctctggaaag

SEQ ID NO: 2535659 - DNA, 20 bp, Homo sapiens
aacttgagggcccagagcag

SEQ ID NO: 2535660 - DNA, 22 bp, Homo sapiens
aacttgagggcccagagcagga

SEQ ID NO: 2535661 - DNA, 23 bp, Homo sapiens
aacttggaatttgtaacctcagc

SEQ ID NO: 2535662 - DNA, 12 bp, Homo sapiens
aacttgggaact

SEQ ID NO: 2535663 - DNA, 13 bp, Homo sapiens
aacttggggaaca

SEQ ID NO: 2535664 - DNA, 15 bp, Homo sapiens
aacttgtaaatacac

SEQ ID NO: 2535665 - DNA, 15 bp, Homo sapiens
aacttgtaaatgtgg

SEQ ID NO: 2535666 - DNA, 18 bp, Homo sapiens
aactttaagtttcaggat

SEQ ID NO: 2535667 - DNA, 19 bp, Homo sapiens
aactttactaagatgacat

SEQ ID NO: 2535668 - DNA, 22 bp, Homo sapiens
aactttagagtagcatgagaga

SEQ ID NO: 2535669 - DNA, 21 bp, Homo sapiens
aactttatgctaagtgaaata

SEQ ID NO: 2535670 - DNA, 13 bp, Homo sapiens
aactttatgtgta

SEQ ID NO: 2535671 - DNA, 11 bp, Homo sapiens
aactttctgta

SEQ ID NO: 2535672 - DNA, 15 bp, Homo sapiens
aactttgctgagcct

SEQ ID NO: 2535673 - DNA, 22 bp, Homo sapiens
aacttttaattaaatgctcatc

SEQ ID NO: 2535674 - DNA, 16 bp, Homo sapiens
aacttttataaacttt

SEQ ID NO: 2535675 - DNA, 15 bp, Homo sapiens
aactttttaaagagt

SEQ ID NO: 2535676 - DNA, 22 bp, Homo sapiens
aactttttggtttgcagatgac

SEQ ID NO: 2535677 - DNA, 13 bp, Homo sapiens
aacttttttccac

SEQ ID NO: 2535678 - DNA, 18 bp, Homo sapiens
aagaaaaaagagaaaaga

SEQ ID NO: 2535679 - DNA, 20 bp, Homo sapiens
aagaaaaaagagaaaagaaa

SEQ ID NO: 2535680 - DNA, 12 bp, Homo sapiens
aagaaaaaatac

SEQ ID NO: 2535681 - DNA, 13 bp, Homo sapiens
aagaaaaagaaaa

SEQ ID NO: 2535682 - DNA, 15 bp, Homo sapiens
aagaaaaaggatgca

SEQ ID NO: 2535683 - DNA, 18 bp, Homo sapiens
aagaaaaaggatgcacag

SEQ ID NO: 2535684 - DNA, 17 bp, Homo sapiens
aagaaaaatgagcctgg

SEQ ID NO: 2535685 - DNA, 17 bp, Homo sapiens
aagccagctttccctgc

SEQ ID NO: 2535686 - DNA, 17 bp, Homo sapiens
aagccagtgactccagg

SEQ ID NO: 2535687 - DNA, 18 bp, Homo sapiens
aagccagtgactccagga

SEQ ID NO: 2535688 - DNA, 22 bp, Homo sapiens
aagccagtgactccaggagagg

SEQ ID NO: 2535689 - DNA, 16 bp, Homo sapiens
aagccatcttggtaaa

SEQ ID NO: 2535690 - DNA, 12 bp, Homo sapiens
aagccattgtct

SEQ ID NO: 2535691 - DNA, 23 bp, Homo sapiens
aagcccagcactgcttgaggaaa

SEQ ID NO: 2535692 - DNA, 14 bp, Homo sapiens
aagcccaggaaagg

SEQ ID NO: 2535693 - DNA, 17 bp, Homo sapiens
aagcccaggaaaggctc

SEQ ID NO: 2535694 - DNA, 19 bp, Homo sapiens
aagcccaggaaaggctcca

SEQ ID NO: 2535695 - DNA, 16 bp, Homo sapiens
aagcccattcattcca

SEQ ID NO: 2535696 - DNA, 21 bp, Homo sapiens
aagcccattcattccattctg

SEQ ID NO: 2535697 - DNA, 14 bp, Homo sapiens
aagccccaggcagg

SEQ ID NO: 2535698 - DNA, 17 bp, Homo sapiens
aagcccgacttgctgtt

SEQ ID NO: 2535699 - DNA, 13 bp, Homo sapiens
aagccctcttcca

SEQ ID NO: 2535700 - DNA, 14 bp, Homo sapiens
aagccctcttccat

SEQ ID NO: 2535701 - DNA, 19 bp, Homo sapiens
aagccctgagctttctgct

SEQ ID NO: 2535702 - DNA, 23 bp, Homo sapiens
aagcccttccatgtcgcctctgc

SEQ ID NO: 2535703 - DNA, 13 bp, Homo sapiens
aagccgctgctgg

SEQ ID NO: 2535704 - DNA, 14 bp, Homo sapiens
aagccggcggccca

SEQ ID NO: 2535705 - DNA, 19 bp, Homo sapiens
aagccggcggcccaagccc

SEQ ID NO: 2535706 - DNA, 22 bp, Homo sapiens
aagccgttgtttacttaaagat

SEQ ID NO: 2535707 - DNA, 19 bp, Homo sapiens
aagcctacctgctctccaa

SEQ ID NO: 2535708 - DNA, 20 bp, Homo sapiens
aagcctagaagagcttctga

SEQ ID NO: 2535709 - DNA, 16 bp, Homo sapiens
aagcctcccacgactg

SEQ ID NO: 2535710 - DNA, 14 bp, Homo sapiens
aagcctccccagct

SEQ ID NO: 2535711 - DNA, 19 bp, Homo sapiens
aagcctcctccagccgcca

SEQ ID NO: 2535712 - DNA, 14 bp, Homo sapiens
aagcctctggctag

SEQ ID NO: 2535713 - DNA, 21 bp, Homo sapiens
aagcctgcacaataaaaatgt

SEQ ID NO: 2535714 - DNA, 21 bp, Homo sapiens
aagcctgcctaggaattccca

SEQ ID NO: 2535715 - DNA, 19 bp, Homo sapiens
aagcctgctttttaagtgt

SEQ ID NO: 2535716 - DNA, 18 bp, Homo sapiens
aagcctgttcccctcact

SEQ ID NO: 2535717 - DNA, 16 bp, Homo sapiens
aagcgattcttctgct

SEQ ID NO: 2535718 - DNA, 21 bp, Homo sapiens
aagcgattcttctgcttcagc

SEQ ID NO: 2535719 - DNA, 14 bp, Homo sapiens
aagcggctggcagc

SEQ ID NO: 2535720 - DNA, 15 bp, Homo sapiens
aagcgtgagccactg

SEQ ID NO: 2535721 - DNA, 20 bp, Homo sapiens
aagcgtgagccactgcaccg

SEQ ID NO: 2535722 - DNA, 16 bp, Homo sapiens
aagctaaaacctgagc

SEQ ID NO: 2535723 - DNA, 11 bp, Homo sapiens
aagctaaagag

SEQ ID NO: 2535724 - DNA, 16 bp, Homo sapiens
aagctagaacctggag

SEQ ID NO: 2535725 - DNA, 12 bp, Homo sapiens
aagctagctccc

SEQ ID NO: 2535726 - DNA, 19 bp, Homo sapiens
aagctagctcccctcctct

SEQ ID NO: 2535727 - DNA, 20 bp, Homo sapiens
aagctagctcccctcctctc

SEQ ID NO: 2535728 - DNA, 14 bp, Homo sapiens
aagctaggaatgaa

SEQ ID NO: 2535729 - DNA, 12 bp, Homo sapiens
aagctaggcctg

SEQ ID NO: 2535730 - DNA, 15 bp, Homo sapiens
aagctagggtggccc

SEQ ID NO: 2535731 - DNA, 19 bp, Homo sapiens
aagctagggtggcccttgc

SEQ ID NO: 2535732 - DNA, 18 bp, Homo sapiens
aagctagtggcttcaaaa

SEQ ID NO: 2535733 - DNA, 17 bp, Homo sapiens
aagctatccaaataact

SEQ ID NO: 2535734 - DNA, 12 bp, Homo sapiens
aagctatggtga

SEQ ID NO: 2535735 - DNA, 19 bp, Homo sapiens
aagctattagccaggatca

SEQ ID NO: 2535736 - DNA, 21 bp, Homo sapiens
aagctattagccaggatcatg

SEQ ID NO: 2535737 - DNA, 23 bp, Homo sapiens
aagctcacctgttgcttacaatt

SEQ ID NO: 2535738 - DNA, 13 bp, Homo sapiens
aagctcagggcct

SEQ ID NO: 2535739 - DNA, 21 bp, Homo sapiens
aagctcatattttgtatatat

SEQ ID NO: 2535740 - DNA, 23 bp, Homo sapiens
aagctcatattttgtatatatct

SEQ ID NO: 2535741 - DNA, 17 bp, Homo sapiens
aagctccaagctcccag

SEQ ID NO: 2535742 - DNA, 18 bp, Homo sapiens
aagctccaagctcccagg

SEQ ID NO: 2535743 - DNA, 17 bp, Homo sapiens
aagctcccaagggatgg

SEQ ID NO: 2535744 - DNA, 19 bp, Homo sapiens
aagctcccaagggatggtg

SEQ ID NO: 2535745 - DNA, 11 bp, Homo sapiens
aagctcccagg

SEQ ID NO: 2535746 - DNA, 14 bp, Homo sapiens
aagctcccaggaac

SEQ ID NO: 2535747 - DNA, 22 bp, Homo sapiens
aagctcccaggcattccccagg

SEQ ID NO: 2535748 - DNA, 19 bp, Homo sapiens
aagctcctggtcttgagat

SEQ ID NO: 2535749 - DNA, 13 bp, Homo sapiens
aagctcctgtcct

SEQ ID NO: 2535750 - DNA, 12 bp, Homo sapiens
aagctctgaagt

SEQ ID NO: 2535751 - DNA, 16 bp, Homo sapiens
aagctctgaagtcaca

SEQ ID NO: 2535752 - DNA, 22 bp, Homo sapiens
aagctctgaagtcacatcacag

SEQ ID NO: 2535753 - DNA, 13 bp, Homo sapiens
aagctctggctga

SEQ ID NO: 2535754 - DNA, 21 bp, Homo sapiens
aagctctggctgaaccctgtg

SEQ ID NO: 2535755 - DNA, 22 bp, Homo sapiens
aagctctggctgaaccctgtgc

SEQ ID NO: 2535756 - DNA, 19 bp, Homo sapiens
aagctcttgaagacactga

SEQ ID NO: 2535757 - DNA, 21 bp, Homo sapiens
aagctcttgaagacactgaaa

SEQ ID NO: 2535758 - DNA, 14 bp, Homo sapiens
aagctgaagtgcat

SEQ ID NO: 2535759 - DNA, 20 bp, Homo sapiens
aagctgcaaatcagccatgt

SEQ ID NO: 2535760 - DNA, 20 bp, Homo sapiens
aagctgcaccctcaggcagg

SEQ ID NO: 2535761 - DNA, 21 bp, Homo sapiens
aagctgcaccctcaggcaggt

SEQ ID NO: 2535762 - DNA, 15 bp, Homo sapiens
aagctgccctgccca

SEQ ID NO: 2535763 - DNA, 15 bp, Homo sapiens
aagctgcctgtagtt

SEQ ID NO: 2535764 - DNA, 16 bp, Homo sapiens
aagctgcctgtagtta

SEQ ID NO: 2535765 - DNA, 23 bp, Homo sapiens
aagctggaggactagaacctgga

SEQ ID NO: 2535766 - DNA, 21 bp, Homo sapiens
aagctggccgagggtcctggc

SEQ ID NO: 2535767 - DNA, 22 bp, Homo sapiens
aagctggccgagggtcctggct

SEQ ID NO: 2535768 - DNA, 15 bp, Homo sapiens
aagctgggcaggttg

SEQ ID NO: 2535769 - DNA, 17 bp, Homo sapiens
aagctgggccccagccc

SEQ ID NO: 2535770 - DNA, 13 bp, Homo sapiens
aagctgtgagaca

SEQ ID NO: 2535771 - DNA, 19 bp, Homo sapiens
aagctgttggcctctgcaa

SEQ ID NO: 2535772 - DNA, 18 bp, Homo sapiens
aagctgttgtacatttat

SEQ ID NO: 2535773 - DNA, 23 bp, Homo sapiens
aagctgtttccatagggtgacac

SEQ ID NO: 2535774 - DNA, 16 bp, Homo sapiens
aagcttagcaggagag

SEQ ID NO: 2535775 - DNA, 14 bp, Homo sapiens
aagcttatttaatt

SEQ ID NO: 2535776 - DNA, 18 bp, Homo sapiens
aagcttcaaactgcatga

SEQ ID NO: 2535777 - DNA, 19 bp, Homo sapiens
aagcttccagtccaatctc

SEQ ID NO: 2535778 - DNA, 22 bp, Homo sapiens
aagcttcgaggcccagcgacct

SEQ ID NO: 2535779 - DNA, 22 bp, Homo sapiens
aagcttcttaaatgagaaggaa

SEQ ID NO: 2535780 - DNA, 21 bp, Homo sapiens
aagcttggctgtagaaggaga

SEQ ID NO: 2535781 - DNA, 16 bp, Homo sapiens
aagcttgtgtatccat

SEQ ID NO: 2535782 - DNA, 20 bp, Homo sapiens
aagctttatacgtgtagcta

SEQ ID NO: 2535783 - DNA, 21 bp, Homo sapiens
aagctttcagtattagtgatg

SEQ ID NO: 2535784 - DNA, 23 bp, Homo sapiens
aagctttcatgtaaactgtgcac

SEQ ID NO: 2535785 - DNA, 19 bp, Homo sapiens
aaggaaaaaagagaagtat

SEQ ID NO: 2535786 - DNA, 17 bp, Homo sapiens
aaggaaaatagtaatgt

SEQ ID NO: 2535787 - DNA, 17 bp, Homo sapiens
aaggaaaccacagctgc

SEQ ID NO: 2535788 - DNA, 16 bp, Homo sapiens
aaggaaacccagctct

SEQ ID NO: 2535789 - DNA, 13 bp, Homo sapiens
aaggaaactctta

SEQ ID NO: 2535790 - DNA, 16 bp, Homo sapiens
aaggaaactcttatct

SEQ ID NO: 2535791 - DNA, 21 bp, Homo sapiens
aaggaaatgattgaggagtga

SEQ ID NO: 2535792 - DNA, 18 bp, Homo sapiens
aaggaagctccactgtca

SEQ ID NO: 2535793 - DNA, 21 bp, Homo sapiens
aaggaagtcaaagcaaggaaa

SEQ ID NO: 2535794 - DNA, 14 bp, Homo sapiens
aaggaagtgaagag

SEQ ID NO: 2535795 - DNA, 22 bp, Homo sapiens
aaggaagttactgttatagagg

SEQ ID NO: 2535796 - DNA, 23 bp, Homo sapiens
aaggaatccactcccaggcagcc

SEQ ID NO: 2535797 - DNA, 21 bp, Homo sapiens
aaggaatctccagttttcagt

SEQ ID NO: 2535798 - DNA, 20 bp, Homo sapiens
aaggaccacattttatattt

SEQ ID NO: 2535799 - DNA, 23 bp, Homo sapiens
aaggaccacattttatatttatt

SEQ ID NO: 2535800 - DNA, 15 bp, Homo sapiens
aaggacccctcacct

SEQ ID NO: 2535801 - DNA, 13 bp, Homo sapiens
aaggactgaggga

SEQ ID NO: 2535802 - DNA, 20 bp, Homo sapiens
aaggactgtgacaggcagca

SEQ ID NO: 2535803 - DNA, 12 bp, Homo sapiens
aaggacttgaaa

SEQ ID NO: 2535804 - DNA, 13 bp, Homo sapiens
aaggagaggaggc

SEQ ID NO: 2535805 - DNA, 14 bp, Homo sapiens
aaggagaggaggca

SEQ ID NO: 2535806 - DNA, 18 bp, Homo sapiens
aaggagatttacaactgg

SEQ ID NO: 2535807 - DNA, 19 bp, Homo sapiens
aaggagccccattcctggg

SEQ ID NO: 2535808 - DNA, 13 bp, Homo sapiens
aaggaggggaacc

SEQ ID NO: 2535809 - DNA, 21 bp, Homo sapiens
aaggagggtggatcacctgag

SEQ ID NO: 2535810 - DNA, 15 bp, Homo sapiens
aaggaggtgagggat

SEQ ID NO: 2535811 - DNA, 18 bp, Homo sapiens
aaggagtaatctgtgtac

SEQ ID NO: 2535812 - DNA, 15 bp, Homo sapiens
aaggatctgttttta

SEQ ID NO: 2535813 - DNA, 23 bp, Homo sapiens
aaggatgaatgaggtcccaggca

SEQ ID NO: 2535814 - DNA, 24 bp, Homo sapiens
aaggatgcacagagttgttacatt

SEQ ID NO: 2535815 - DNA, 20 bp, Homo sapiens
aaggatgccaagaagtttaa

SEQ ID NO: 2535816 - DNA, 22 bp, Homo sapiens
aaggatgccaagaagtttaagg

SEQ ID NO: 2535817 - DNA, 19 bp, Homo sapiens
aaggatgcttgtacataat

SEQ ID NO: 2535818 - DNA, 16 bp, Homo sapiens
aaggatgtacatttcc

SEQ ID NO: 2535819 - DNA, 16 bp, Homo sapiens
aaggatgtcacagggc

SEQ ID NO: 2535820 - DNA, 15 bp, Homo sapiens
aaggatgttggtgtt

SEQ ID NO: 2535821 - DNA, 12 bp, Homo sapiens
aaggattgtaaa

SEQ ID NO: 2535822 - DNA, 21 bp, Homo sapiens
aaggattgtaaaaaaaaatgc

SEQ ID NO: 2535823 - DNA, 23 bp, Homo sapiens
aaggattgtaaaaaaaaatgcct

SEQ ID NO: 2535824 - DNA, 14 bp, Homo sapiens
aaggattgtgatat

SEQ ID NO: 2535825 - DNA, 17 bp, Homo sapiens
aaggattgtgatatttt

SEQ ID NO: 2535826 - DNA, 20 bp, Homo sapiens
aaggattttatgctttaaac

SEQ ID NO: 2535827 - DNA, 21 bp, Homo sapiens
aaggattttatgctttaaaca

SEQ ID NO: 2535828 - DNA, 20 bp, Homo sapiens
aaggcaaacccatcaacaaa

SEQ ID NO: 2535829 - DNA, 12 bp, Homo sapiens
aataactttttt

SEQ ID NO: 2535830 - DNA, 15 bp, Homo sapiens
aataagaaagtttca

SEQ ID NO: 2535831 - DNA, 14 bp, Homo sapiens
aataagaatttagg

SEQ ID NO: 2535832 - DNA, 20 bp, Homo sapiens
aataagagagtcataaacct

SEQ ID NO: 2535833 - DNA, 17 bp, Homo sapiens
aataagcatcaaactct

SEQ ID NO: 2535834 - DNA, 13 bp, Homo sapiens
aataagctaaaga

SEQ ID NO: 2535835 - DNA, 17 bp, Homo sapiens
aataaggccttaatatg

SEQ ID NO: 2535836 - DNA, 22 bp, Homo sapiens
aataagttcaaattcttctgaa

SEQ ID NO: 2535837 - DNA, 21 bp, Homo sapiens
aataataaagatcatgtaaaa

SEQ ID NO: 2535838 - DNA, 18 bp, Homo sapiens
aataataaagatgctctt

SEQ ID NO: 2535839 - DNA, 21 bp, Homo sapiens
aataataattatccagagttt

SEQ ID NO: 2535840 - DNA, 18 bp, Homo sapiens
aataatacctaagccttc

SEQ ID NO: 2535841 - DNA, 14 bp, Homo sapiens
aataatatatgttt

SEQ ID NO: 2535842 - DNA, 15 bp, Homo sapiens
aataatatattttct

SEQ ID NO: 2535843 - DNA, 15 bp, Homo sapiens
aataatatgcattgt

SEQ ID NO: 2535844 - DNA, 17 bp, Homo sapiens
aataatatgcattgtca

SEQ ID NO: 2535845 - DNA, 20 bp, Homo sapiens
aataatgggcttagagcagt

SEQ ID NO: 2535846 - DNA, 17 bp, Homo sapiens
aataatggtaccagata

SEQ ID NO: 2535847 - DNA, 20 bp, Homo sapiens
aataatggtaccagataaaa

SEQ ID NO: 2535848 - DNA, 23 bp, Homo sapiens
aataatggtaccagataaaatta

SEQ ID NO: 2535849 - DNA, 16 bp, Homo sapiens
aataatgtgaaactgg

SEQ ID NO: 2535850 - DNA, 20 bp, Homo sapiens
aataattgatttcaagacct

SEQ ID NO: 2535851 - DNA, 21 bp, Homo sapiens
aatacaaaaaattagccgggc

SEQ ID NO: 2535852 - DNA, 20 bp, Homo sapiens
aatacaaaaattagccgggc

SEQ ID NO: 2535853 - DNA, 21 bp, Homo sapiens
aatacaaacatatttgttaaa

SEQ ID NO: 2535854 - DNA, 18 bp, Homo sapiens
aatacaacttaaataata

SEQ ID NO: 2535855 - DNA, 15 bp, Homo sapiens
aatacacaagtaaac

SEQ ID NO: 2535856 - DNA, 20 bp, Homo sapiens
aatacaccacctcactcctg

SEQ ID NO: 2535857 - DNA, 16 bp, Homo sapiens
aatacacgaggtatga

SEQ ID NO: 2535858 - DNA, 20 bp, Homo sapiens
aatacactaattcctttcta

SEQ ID NO: 2535859 - DNA, 21 bp, Homo sapiens
aatacagacactaagttatag

SEQ ID NO: 2535860 - DNA, 13 bp, Homo sapiens
aatacagaggcaa

SEQ ID NO: 2535861 - DNA, 16 bp, Homo sapiens
aatacagggcattttg

SEQ ID NO: 2535862 - DNA, 15 bp, Homo sapiens
aatacagtacaggca

SEQ ID NO: 2535863 - DNA, 16 bp, Homo sapiens
aatacagtacaggcag

SEQ ID NO: 2535864 - DNA, 17 bp, Homo sapiens
aatacagtacaggcagc

SEQ ID NO: 2535865 - DNA, 18 bp, Homo sapiens
aatacagtacaggcagca

SEQ ID NO: 2535866 - DNA, 21 bp, Homo sapiens
aatacagtacaggcagcacag

SEQ ID NO: 2535867 - DNA, 19 bp, Homo sapiens
aatacagtttgtcacatga

SEQ ID NO: 2535868 - DNA, 15 bp, Homo sapiens
aatacattctgcttt

SEQ ID NO: 2535869 - DNA, 23 bp, Homo sapiens
aataccattttttaaggaaacaa

SEQ ID NO: 2535870 - DNA, 14 bp, Homo sapiens
aatacctctgtgtg

SEQ ID NO: 2535871 - DNA, 16 bp, Homo sapiens
aatacctctgtgtgct

SEQ ID NO: 2535872 - DNA, 15 bp, Homo sapiens
aatacctgtccccct

SEQ ID NO: 2535873 - DNA, 19 bp, Homo sapiens
aatacctgtccccctgaca

SEQ ID NO: 2535874 - DNA, 18 bp, Homo sapiens
aatacgcactacatgtgg

SEQ ID NO: 2535875 - DNA, 19 bp, Homo sapiens
aatactagggagaaggttt

SEQ ID NO: 2535876 - DNA, 17 bp, Homo sapiens
aatactagttgtgacct

SEQ ID NO: 2535877 - DNA, 17 bp, Homo sapiens
aatactcataatgtgaa

SEQ ID NO: 2535878 - DNA, 20 bp, Homo sapiens
aatactctaccctcttagaa

SEQ ID NO: 2535879 - DNA, 16 bp, Homo sapiens
aatactgccagatgct

SEQ ID NO: 2535880 - DNA, 16 bp, Homo sapiens
aatactgtattttgta

SEQ ID NO: 2535881 - DNA, 22 bp, Homo sapiens
aatacttctcaaacctgtttaa

SEQ ID NO: 2535882 - DNA, 23 bp, Homo sapiens
aatacttctcaaacctgtttaaa

SEQ ID NO: 2535883 - DNA, 14 bp, Homo sapiens
aatactttaaagga

SEQ ID NO: 2535884 - DNA, 11 bp, Homo sapiens
aatacttttgc

SEQ ID NO: 2535885 - DNA, 13 bp, Homo sapiens
aatagaaaactga

SEQ ID NO: 2535886 - DNA, 17 bp, Homo sapiens
aatagaaaactgaaaat

SEQ ID NO: 2535887 - DNA, 19 bp, Homo sapiens
aatagaaaactgaaaatct

SEQ ID NO: 2535888 - DNA, 13 bp, Homo sapiens
aatagaaactcac

SEQ ID NO: 2535889 - DNA, 16 bp, Homo sapiens
aatagaaatttccaga

SEQ ID NO: 2535890 - DNA, 19 bp, Homo sapiens
aatagaaggatgtacattt

SEQ ID NO: 2535891 - DNA, 18 bp, Homo sapiens
aatagacaatttattatg

SEQ ID NO: 2535892 - DNA, 14 bp, Homo sapiens
aatagagcctgagg

SEQ ID NO: 2535893 - DNA, 21 bp, Homo sapiens
aatagccaacacccatctgtt

SEQ ID NO: 2535894 - DNA, 22 bp, Homo sapiens
aatagccacttaccttcaataa

SEQ ID NO: 2535895 - DNA, 15 bp, Homo sapiens
aatagctatatccat

SEQ ID NO: 2535896 - DNA, 20 bp, Homo sapiens
aatagctatatccatgtact

SEQ ID NO: 2535897 - DNA, 23 bp, Homo sapiens
aatagctatatccatgtactgta

SEQ ID NO: 2535898 - DNA, 14 bp, Homo sapiens
aatagcttgtatag

SEQ ID NO: 2535899 - DNA, 19 bp, Homo sapiens
aatagcttgtatagtgtaa

SEQ ID NO: 2535900 - DNA, 13 bp, Homo sapiens
aatagtaatgttt

SEQ ID NO: 2535901 - DNA, 23 bp, Homo sapiens
aatagtatcctccaggtttttca

SEQ ID NO: 2535902 - DNA, 17 bp, Homo sapiens
aatagtcaagaaaaatt

SEQ ID NO: 2535903 - DNA, 16 bp, Homo sapiens
aatagtggtgtgattt

SEQ ID NO: 2535904 - DNA, 12 bp, Homo sapiens
aatagtgtggaa

SEQ ID NO: 2535905 - DNA, 15 bp, Homo sapiens
aatagtgtgttctga

SEQ ID NO: 2535906 - DNA, 18 bp, Homo sapiens
aatagtgttaatcaattt

SEQ ID NO: 2535907 - DNA, 18 bp, Homo sapiens
aatagttactccagtgcc

SEQ ID NO: 2535908 - DNA, 22 bp, Homo sapiens
aatagttttattaataaacatt

SEQ ID NO: 2535909 - DNA, 23 bp, Homo sapiens
aatataaaaggcaaatgtgtaca

SEQ ID NO: 2535910 - DNA, 23 bp, Homo sapiens
aatataaaatatgaagacataaa

SEQ ID NO: 2535911 - DNA, 21 bp, Homo sapiens
aatataaggaaagcaataaat

SEQ ID NO: 2535912 - DNA, 23 bp, Homo sapiens
aatatactgtaaagaaagagaga

SEQ ID NO: 2535913 - DNA, 13 bp, Homo sapiens
aatatagctattt

SEQ ID NO: 2535914 - DNA, 17 bp, Homo sapiens
aatatatatctgctgtc

SEQ ID NO: 2535915 - DNA, 20 bp, Homo sapiens
aatatatctaaattgaataa

SEQ ID NO: 2535916 - DNA, 15 bp, Homo sapiens
aatatatttaagata

SEQ ID NO: 2535917 - DNA, 15 bp, Homo sapiens
aatatatttcagata

SEQ ID NO: 2535918 - DNA, 19 bp, Homo sapiens
aatatatttgtgtatttaa

SEQ ID NO: 2535919 - DNA, 21 bp, Homo sapiens
aatatattttctgttttcttt

SEQ ID NO: 2535920 - DNA, 18 bp, Homo sapiens
aatatcatcagtattgaa

SEQ ID NO: 2535921 - DNA, 16 bp, Homo sapiens
aatatcccctcccagt

SEQ ID NO: 2535922 - DNA, 20 bp, Homo sapiens
aatatctgaaaatgtatgtg

SEQ ID NO: 2535923 - DNA, 21 bp, Homo sapiens
aatatctgggattctacttta

SEQ ID NO: 2535924 - DNA, 12 bp, Homo sapiens
aatatgaagctc

SEQ ID NO: 2535925 - DNA, 18 bp, Homo sapiens
aatatgaatacagggcat

SEQ ID NO: 2535926 - DNA, 22 bp, Homo sapiens
aatatgaatgcccccagctggc

SEQ ID NO: 2535927 - DNA, 21 bp, Homo sapiens
aatatgacggaagaacataga

SEQ ID NO: 2535928 - DNA, 11 bp, Homo sapiens
aatatgatgac

SEQ ID NO: 2535929 - DNA, 19 bp, Homo sapiens
aatatgattagtaaagaaa

SEQ ID NO: 2535930 - DNA, 20 bp, Homo sapiens
aatatgattagtaaagaaat

SEQ ID NO: 2535931 - DNA, 17 bp, Homo sapiens
aatatgcaaagcactga

SEQ ID NO: 2535932 - DNA, 17 bp, Homo sapiens
aatatgcaatgtgaagc

SEQ ID NO: 2535933 - DNA, 16 bp, Homo sapiens
aatatgcacacatttt

SEQ ID NO: 2535934 - DNA, 17 bp, Homo sapiens
aatatgcacacattttt

SEQ ID NO: 2535935 - DNA, 22 bp, Homo sapiens
aatatgcacacattttttaaat

SEQ ID NO: 2535936 - DNA, 15 bp, Homo sapiens
aatatgcagttctgc

SEQ ID NO: 2535937 - DNA, 20 bp, Homo sapiens
aatatgcatctaataaaaaa

SEQ ID NO: 2535938 - DNA, 21 bp, Homo sapiens
aatatgcctctcctttgtata

SEQ ID NO: 2535939 - DNA, 19 bp, Homo sapiens
aatatgctgccaaattttg

SEQ ID NO: 2535940 - DNA, 15 bp, Homo sapiens
aatatggctataaat

SEQ ID NO: 2535941 - DNA, 19 bp, Homo sapiens
aatatgggcattgtagtta

SEQ ID NO: 2535942 - DNA, 16 bp, Homo sapiens
aatatggttgatagtt

SEQ ID NO: 2535943 - DNA, 20 bp, Homo sapiens
aatatgtattgtaaacatgt

SEQ ID NO: 2535944 - DNA, 22 bp, Homo sapiens
aatatgttaacctcagtgtcat

SEQ ID NO: 2535945 - DNA, 20 bp, Homo sapiens
aatatgttctttaaaaatat

SEQ ID NO: 2535946 - DNA, 17 bp, Homo sapiens
aatattaaaccctggat

SEQ ID NO: 2535947 - DNA, 13 bp, Homo sapiens
aatattagatgtg

SEQ ID NO: 2535948 - DNA, 15 bp, Homo sapiens
aatattagatgtgat

SEQ ID NO: 2535949 - DNA, 17 bp, Homo sapiens
aatattagatgtgattt

SEQ ID NO: 2535950 - DNA, 18 bp, Homo sapiens
aatattagatgtgattta

SEQ ID NO: 2535951 - DNA, 18 bp, Homo sapiens
aatattagctttactgtt

SEQ ID NO: 2535952 - DNA, 19 bp, Homo sapiens
aatattagctttactgttt

SEQ ID NO: 2535953 - DNA, 21 bp, Homo sapiens
aatattagctttactgtttgt

SEQ ID NO: 2535954 - DNA, 13 bp, Homo sapiens
aatattcccaagc

SEQ ID NO: 2535955 - DNA, 17 bp, Homo sapiens
aatattccctagaaact

SEQ ID NO: 2535956 - DNA, 17 bp, Homo sapiens
aatattgatatgcttat

SEQ ID NO: 2535957 - DNA, 18 bp, Homo sapiens
aatattgatatgcttata

SEQ ID NO: 2535958 - DNA, 20 bp, Homo sapiens
aatattgatttctgccttcc

SEQ ID NO: 2535959 - DNA, 13 bp, Homo sapiens
aatattgtacagt

SEQ ID NO: 2535960 - DNA, 15 bp, Homo sapiens
aatattgtacagttt

SEQ ID NO: 2535961 - DNA, 16 bp, Homo sapiens
aatattgtcattcctg

SEQ ID NO: 2535962 - DNA, 13 bp, Homo sapiens
aatattgtccatt

SEQ ID NO: 2535963 - DNA, 12 bp, Homo sapiens
aatatttaaaca

SEQ ID NO: 2535964 - DNA, 15 bp, Homo sapiens
aatatttacatatga

SEQ ID NO: 2535965 - DNA, 21 bp, Homo sapiens
aatatttatgtctatttaagc

SEQ ID NO: 2535966 - DNA, 23 bp, Homo sapiens
aatatttatgtctatttaagcct

SEQ ID NO: 2535967 - DNA, 15 bp, Homo sapiens
aatatttcaagacat

SEQ ID NO: 2535968 - DNA, 13 bp, Homo sapiens
aatatttccatat

SEQ ID NO: 2535969 - DNA, 23 bp, Homo sapiens
aatatttccatatggattttcta

SEQ ID NO: 2535970 - DNA, 19 bp, Homo sapiens
aatatttccttaaactgtg

SEQ ID NO: 2535971 - DNA, 21 bp, Homo sapiens
aatatttccttaaactgtgtg

SEQ ID NO: 2535972 - DNA, 17 bp, Homo sapiens
aatattttattatatat

SEQ ID NO: 2535973 - DNA, 12 bp, Homo sapiens
aattaacctggt

SEQ ID NO: 2535974 - DNA, 13 bp, Homo sapiens
aattaacctggtg

SEQ ID NO: 2535975 - DNA, 14 bp, Homo sapiens
aattaacctggtgc

SEQ ID NO: 2535976 - DNA, 15 bp, Homo sapiens
aattaacttgagttt

SEQ ID NO: 2535977 - DNA, 17 bp, Homo sapiens
aattaacttgagtttta

SEQ ID NO: 2535978 - DNA, 11 bp, Homo sapiens
aattaactttt

SEQ ID NO: 2535979 - DNA, 12 bp, Homo sapiens
aattaactttta

SEQ ID NO: 2535980 - DNA, 15 bp, Homo sapiens
aattaacttttataa

SEQ ID NO: 2535981 - DNA, 18 bp, Homo sapiens
aattaacttttataaact

SEQ ID NO: 2535982 - DNA, 20 bp, Homo sapiens
aattaaggattttatgcttt

SEQ ID NO: 2535983 - DNA, 22 bp, Homo sapiens
aattaaggattttatgctttaa

SEQ ID NO: 2535984 - DNA, 16 bp, Homo sapiens
aattaaggcataagaa

SEQ ID NO: 2535985 - DNA, 17 bp, Homo sapiens
aattaagtactatgtat

SEQ ID NO: 2535986 - DNA, 22 bp, Homo sapiens
aattaagttagggaatggcaca

SEQ ID NO: 2535987 - DNA, 23 bp, Homo sapiens
aattaataaaaaatggaaagaat

SEQ ID NO: 2535988 - DNA, 11 bp, Homo sapiens
aattaataaat

SEQ ID NO: 2535989 - DNA, 13 bp, Homo sapiens
aattaatagcttt

SEQ ID NO: 2535990 - DNA, 16 bp, Homo sapiens
aattaatgaaatatct

SEQ ID NO: 2535991 - DNA, 13 bp, Homo sapiens
aattaatgacaga

SEQ ID NO: 2535992 - DNA, 14 bp, Homo sapiens
aattacacccaaag

SEQ ID NO: 2535993 - DNA, 14 bp, Homo sapiens
aattacataatttt

SEQ ID NO: 2535994 - DNA, 23 bp, Homo sapiens
aattaccttagattagctctgga

SEQ ID NO: 2535995 - DNA, 14 bp, Homo sapiens
aattagccgggcgt

SEQ ID NO: 2535996 - DNA, 16 bp, Homo sapiens
aattagctgtgtgaaa

SEQ ID NO: 2535997 - DNA, 21 bp, Homo sapiens
aattaggaagtgtaacagctg

SEQ ID NO: 2535998 - DNA, 20 bp, Homo sapiens
aattaggggttgctaagaag

SEQ ID NO: 2535999 - DNA, 17 bp, Homo sapiens
aattaggttttgtacaa

SEQ ID NO: 2536000 - DNA, 18 bp, Homo sapiens
aattagtatttatttaat

SEQ ID NO: 2536001 - DNA, 23 bp, Homo sapiens
aattataacttaaaatattttat

SEQ ID NO: 2536002 - DNA, 16 bp, Homo sapiens
aattataatatactat

SEQ ID NO: 2536003 - DNA, 20 bp, Homo sapiens
aattatactggagaagtctt

SEQ ID NO: 2536004 - DNA, 19 bp, Homo sapiens
aattatagatgggaatgaa

SEQ ID NO: 2536005 - DNA, 20 bp, Homo sapiens
aattatcggaagcagtgcct

SEQ ID NO: 2536006 - DNA, 22 bp, Homo sapiens
aattatgtctgctgaataataa

SEQ ID NO: 2536007 - DNA, 14 bp, Homo sapiens
aattatgtttatat

SEQ ID NO: 2536008 - DNA, 17 bp, Homo sapiens
aattatgtttatataaa

SEQ ID NO: 2536009 - DNA, 22 bp, Homo sapiens
aattatgtttgccactttgcaa

SEQ ID NO: 2536010 - DNA, 22 bp, Homo sapiens
aattattaatgaaaataagaat

SEQ ID NO: 2536011 - DNA, 13 bp, Homo sapiens
aattattatttat

SEQ ID NO: 2536012 - DNA, 18 bp, Homo sapiens
aattattatttatatatg

SEQ ID NO: 2536013 - DNA, 15 bp, Homo sapiens
aattattatttgtgt

SEQ ID NO: 2536014 - DNA, 17 bp, Homo sapiens
aattatttcagaaatgt

SEQ ID NO: 2536015 - DNA, 18 bp, Homo sapiens
aattcaaccctttgcccc

SEQ ID NO: 2536016 - DNA, 15 bp, Homo sapiens
aattcagcactgatt

SEQ ID NO: 2536017 - DNA, 15 bp, Homo sapiens
aattcatttttttca

SEQ ID NO: 2536018 - DNA, 16 bp, Homo sapiens
aattccatgaatcgct

SEQ ID NO: 2536019 - DNA, 22 bp, Homo sapiens
aattcccattttgcaaaatttc

SEQ ID NO: 2536020 - DNA, 23 bp, Homo sapiens
aattccctatcttttagttttag

SEQ ID NO: 2536021 - DNA, 17 bp, Homo sapiens
aattccctctctctgac

SEQ ID NO: 2536022 - DNA, 20 bp, Homo sapiens
aattccctggcctttcatat

SEQ ID NO: 2536023 - DNA, 15 bp, Homo sapiens
aattcctattgtgat

SEQ ID NO: 2536024 - DNA, 19 bp, Homo sapiens
aattcctattgtgatttga

SEQ ID NO: 2536025 - DNA, 17 bp, Homo sapiens
aattcctgtagcatctt

SEQ ID NO: 2536026 - DNA, 23 bp, Homo sapiens
aattccttagcttagacctcagc

SEQ ID NO: 2536027 - DNA, 18 bp, Homo sapiens
aattcgctgcaacctgtt

SEQ ID NO: 2536028 - DNA, 15 bp, Homo sapiens
aattcggtgtgcacc

SEQ ID NO: 2536029 - DNA, 19 bp, Homo sapiens
aattctaaatgaatgttta

SEQ ID NO: 2536030 - DNA, 14 bp, Homo sapiens
aattctaacttttt

SEQ ID NO: 2536031 - DNA, 22 bp, Homo sapiens
aattctagctttgagcttaaga

SEQ ID NO: 2536032 - DNA, 22 bp, Homo sapiens
aattctcaacctaccacccctt

SEQ ID NO: 2536033 - DNA, 19 bp, Homo sapiens
aattctcagaatctcaaat

SEQ ID NO: 2536034 - DNA, 19 bp, Homo sapiens
aattctcatgtgatccttt

SEQ ID NO: 2536035 - DNA, 21 bp, Homo sapiens
aattctgagaaaacttctttt

SEQ ID NO: 2536036 - DNA, 19 bp, Homo sapiens
aattctgcaatgttttcct

SEQ ID NO: 2536037 - DNA, 16 bp, Homo sapiens
aattctgctacctcac

SEQ ID NO: 2536038 - DNA, 12 bp, Homo sapiens
aattctgtaaat

SEQ ID NO: 2536039 - DNA, 13 bp, Homo sapiens
aattctgtttctt

SEQ ID NO: 2536040 - DNA, 14 bp, Homo sapiens
aattctgtttttct

SEQ ID NO: 2536041 - DNA, 21 bp, Homo sapiens
aattcttccctatctttgcca

SEQ ID NO: 2536042 - DNA, 15 bp, Homo sapiens
aattcttctgaactc

SEQ ID NO: 2536043 - DNA, 18 bp, Homo sapiens
aattcttctgaactcaaa

SEQ ID NO: 2536044 - DNA, 13 bp, Homo sapiens
aattcttggaata

SEQ ID NO: 2536045 - DNA, 14 bp, Homo sapiens
aattcttgtatatt

SEQ ID NO: 2536046 - DNA, 15 bp, Homo sapiens
aattcttgtatatta

SEQ ID NO: 2536047 - DNA, 21 bp, Homo sapiens
aattgaacttaaataaatgtc

SEQ ID NO: 2536048 - DNA, 13 bp, Homo sapiens
aattgacccacaa

SEQ ID NO: 2536049 - DNA, 21 bp, Homo sapiens
aattgacccacaagaaatgaa

SEQ ID NO: 2536050 - DNA, 14 bp, Homo sapiens
aattgactgtcact

SEQ ID NO: 2536051 - DNA, 18 bp, Homo sapiens
aattgacttcgactgtga

SEQ ID NO: 2536052 - DNA, 22 bp, Homo sapiens
aattgagagaatggaaaacaga

SEQ ID NO: 2536053 - DNA, 14 bp, Homo sapiens
aattgattattctg

SEQ ID NO: 2536054 - DNA, 15 bp, Homo sapiens
aattgatttcaagac

SEQ ID NO: 2536055 - DNA, 21 bp, Homo sapiens
aattgcacaatattgaacttt

SEQ ID NO: 2536056 - DNA, 13 bp, Homo sapiens
aattgcagactgt

SEQ ID NO: 2536057 - DNA, 23 bp, Homo sapiens
aattgctatgttttgacattttt

SEQ ID NO: 2536058 - DNA, 23 bp, Homo sapiens
aattgcttactttggaatacatt

SEQ ID NO: 2536059 - DNA, 15 bp, Homo sapiens
aattgcttgaaagaa

SEQ ID NO: 2536060 - DNA, 22 bp, Homo sapiens
aattgctttaccttttttctta

SEQ ID NO: 2536061 - DNA, 20 bp, Homo sapiens
aattggaacagaatgtttta

SEQ ID NO: 2536062 - DNA, 16 bp, Homo sapiens
aattggaggaaagcaa

SEQ ID NO: 2536063 - DNA, 21 bp, Homo sapiens
aattgggagcttgggaatgga

SEQ ID NO: 2536064 - DNA, 14 bp, Homo sapiens
aattgtacatattt

SEQ ID NO: 2536065 - DNA, 15 bp, Homo sapiens
aattgtacatatttg

SEQ ID NO: 2536066 - DNA, 17 bp, Homo sapiens
aattgtataacaggtta

SEQ ID NO: 2536067 - DNA, 18 bp, Homo sapiens
aattgtatcatttgaaca

SEQ ID NO: 2536068 - DNA, 20 bp, Homo sapiens
aattgtatcgtatagctgta

SEQ ID NO: 2536069 - DNA, 21 bp, Homo sapiens
aattgtatcgtatagctgtat

SEQ ID NO: 2536070 - DNA, 20 bp, Homo sapiens
aattgtatctagtgcagctg

SEQ ID NO: 2536071 - DNA, 11 bp, Homo sapiens
aattgtccctt

SEQ ID NO: 2536072 - DNA, 14 bp, Homo sapiens
aattgtgatgtgtc

SEQ ID NO: 2536073 - DNA, 20 bp, Homo sapiens
aattgtgccgagaaaagcat

SEQ ID NO: 2536074 - DNA, 23 bp, Homo sapiens
aattgttgctaatcttcttatgc

SEQ ID NO: 2536075 - DNA, 13 bp, Homo sapiens
aattgttgtttct

SEQ ID NO: 2536076 - DNA, 18 bp, Homo sapiens
aattgttgtttctttcta

SEQ ID NO: 2536077 - DNA, 23 bp, Homo sapiens
aattgttgtttctttctagtggt

SEQ ID NO: 2536078 - DNA, 17 bp, Homo sapiens
aattgttgtttgtatgt

SEQ ID NO: 2536079 - DNA, 19 bp, Homo sapiens
aattgttgtttgtatgtat

SEQ ID NO: 2536080 - DNA, 22 bp, Homo sapiens
aattgttgtttgtatgtataat

SEQ ID NO: 2536081 - DNA, 23 bp, Homo sapiens
aattgttgtttgtatgtataatt

SEQ ID NO: 2536082 - DNA, 10 bp, Homo sapiens
aatttaaaca

SEQ ID NO: 2536083 - DNA, 15 bp, Homo sapiens
aatttaaacacctcc

SEQ ID NO: 2536084 - DNA, 20 bp, Homo sapiens
aatttaaacaggcccagcat

SEQ ID NO: 2536085 - DNA, 19 bp, Homo sapiens
aatttaaacccattttagt

SEQ ID NO: 2536086 - DNA, 18 bp, Homo sapiens
aatttaaagggtgtactt

SEQ ID NO: 2536087 - DNA, 12 bp, Homo sapiens
aatttaagcatt

SEQ ID NO: 2536088 - DNA, 14 bp, Homo sapiens
aatttaagcattgt

SEQ ID NO: 2536089 - DNA, 16 bp, Homo sapiens
aatttaagcattgttt

SEQ ID NO: 2536090 - DNA, 23 bp, Homo sapiens
aatttaagcattgtttgcttatt

SEQ ID NO: 2536091 - DNA, 14 bp, Homo sapiens
aatttaatgcatgt

SEQ ID NO: 2536092 - DNA, 16 bp, Homo sapiens
aatttacaaaaatata

SEQ ID NO: 2536093 - DNA, 18 bp, Homo sapiens
aatttacaaaaatataaa

SEQ ID NO: 2536094 - DNA, 15 bp, Homo sapiens
aatttacatactctg

SEQ ID NO: 2536095 - DNA, 14 bp, Homo sapiens
aatttacttgccat

SEQ ID NO: 2536096 - DNA, 17 bp, Homo sapiens
aatttagaaatataatt

SEQ ID NO: 2536097 - DNA, 17 bp, Homo sapiens
aatttagtttttgttct

SEQ ID NO: 2536098 - DNA, 20 bp, Homo sapiens
aatttagtttttgttcttaa

SEQ ID NO: 2536099 - DNA, 17 bp, Homo sapiens
aatttatacaatatcat

SEQ ID NO: 2536100 - DNA, 20 bp, Homo sapiens
aatttatatacaacctgctt

SEQ ID NO: 2536101 - DNA, 23 bp, Homo sapiens
aatttatcctgaaatttcagatt

SEQ ID NO: 2536102 - DNA, 19 bp, Homo sapiens
aatttatcttgtctctggg

SEQ ID NO: 2536103 - DNA, 21 bp, Homo sapiens
aatttatgaattgaattatct

SEQ ID NO: 2536104 - DNA, 23 bp, Homo sapiens
aatttatgaattgaattatcttg

SEQ ID NO: 2536105 - DNA, 16 bp, Homo sapiens
aatttatgagtttttg

SEQ ID NO: 2536106 - DNA, 14 bp, Homo sapiens
aatttatgtgatgg

SEQ ID NO: 2536107 - DNA, 14 bp, Homo sapiens
aatttattatggca

SEQ ID NO: 2536108 - DNA, 17 bp, Homo sapiens
aatttattattgaaatt

SEQ ID NO: 2536109 - DNA, 12 bp, Homo sapiens
aatttattcaat

SEQ ID NO: 2536110 - DNA, 21 bp, Homo sapiens
aatttattcaattcctctggg

SEQ ID NO: 2536111 - DNA, 17 bp, Homo sapiens
aatttatttatactatt

SEQ ID NO: 2536112 - DNA, 16 bp, Homo sapiens
aatttatttattaaga

SEQ ID NO: 2536113 - DNA, 15 bp, Homo sapiens
aatttcaaaaatata

SEQ ID NO: 2536114 - DNA, 17 bp, Homo sapiens
aatttcaaaaatataac

SEQ ID NO: 2536115 - DNA, 14 bp, Homo sapiens
aatttcacattaat

SEQ ID NO: 2536116 - DNA, 16 bp, Homo sapiens
aatttcacctgtaaac

SEQ ID NO: 2536117 - DNA, 15 bp, Homo sapiens
aatttccagagaaga

SEQ ID NO: 2536118 - DNA, 12 bp, Homo sapiens
acacctctgcca

SEQ ID NO: 2536119 - DNA, 14 bp, Homo sapiens
acacctgactctga

SEQ ID NO: 2536120 - DNA, 16 bp, Homo sapiens
acacctgactctgaaa

SEQ ID NO: 2536121 - DNA, 21 bp, Homo sapiens
acacctgactctgaaatctga

SEQ ID NO: 2536122 - DNA, 14 bp, Homo sapiens
acacctgatgtgta

SEQ ID NO: 2536123 - DNA, 15 bp, Homo sapiens
acacctgatgtgtac

SEQ ID NO: 2536124 - DNA, 18 bp, Homo sapiens
acacctgatgtgtacatc

SEQ ID NO: 2536125 - DNA, 15 bp, Homo sapiens
acaccttatatttac

SEQ ID NO: 2536126 - DNA, 16 bp, Homo sapiens
acacctttgcaggcat

SEQ ID NO: 2536127 - DNA, 22 bp, Homo sapiens
acacctttgcaggcatgcatgt

SEQ ID NO: 2536128 - DNA, 22 bp, Homo sapiens
acacgaggtatgaggtctagga

SEQ ID NO: 2536129 - DNA, 20 bp, Homo sapiens
acacgcacacacacacacag

SEQ ID NO: 2536130 - DNA, 13 bp, Homo sapiens
acacgcacgcaca

SEQ ID NO: 2536131 - DNA, 15 bp, Homo sapiens
acacgcacgcacaca

SEQ ID NO: 2536132 - DNA, 20 bp, Homo sapiens
acacgcacgcacacacacaa

SEQ ID NO: 2536133 - DNA, 19 bp, Homo sapiens
acacgcaggaactcccagc

SEQ ID NO: 2536134 - DNA, 15 bp, Homo sapiens
acacggacactcaaa

SEQ ID NO: 2536135 - DNA, 23 bp, Homo sapiens
acacgggggcagctgatacaaat

SEQ ID NO: 2536136 - DNA, 16 bp, Homo sapiens
acacgtgagaatccct

SEQ ID NO: 2536137 - DNA, 12 bp, Homo sapiens
acacgtgtcctg

SEQ ID NO: 2536138 - DNA, 14 bp, Homo sapiens
acactaaccacgct

SEQ ID NO: 2536139 - DNA, 19 bp, Homo sapiens
acactaaccacgctggacc

SEQ ID NO: 2536140 - DNA, 15 bp, Homo sapiens
acactaacctgggtt

SEQ ID NO: 2536141 - DNA, 23 bp, Homo sapiens
acactaagttatagtatatctgg

SEQ ID NO: 2536142 - DNA, 15 bp, Homo sapiens
acactagcctctcca

SEQ ID NO: 2536143 - DNA, 21 bp, Homo sapiens
acactatatctgtatataaaa

SEQ ID NO: 2536144 - DNA, 18 bp, Homo sapiens
acactattaccatgagaa

SEQ ID NO: 2536145 - DNA, 13 bp, Homo sapiens
acactcaaatcaa

SEQ ID NO: 2536146 - DNA, 19 bp, Homo sapiens
acactcacctctaaaacag

SEQ ID NO: 2536147 - DNA, 19 bp, Homo sapiens
acactcagacctgaattct

SEQ ID NO: 2536148 - DNA, 14 bp, Homo sapiens
acactcatgctgaa

SEQ ID NO: 2536149 - DNA, 15 bp, Homo sapiens
acactcatgctgaaa

SEQ ID NO: 2536150 - DNA, 23 bp, Homo sapiens
acactcattgacctgaggccctt

SEQ ID NO: 2536151 - DNA, 14 bp, Homo sapiens
acactccaagatat

SEQ ID NO: 2536152 - DNA, 18 bp, Homo sapiens
acactccaattaaggatt

SEQ ID NO: 2536153 - DNA, 14 bp, Homo sapiens
acactccagcctga

SEQ ID NO: 2536154 - DNA, 15 bp, Homo sapiens
acactccagcctgag

SEQ ID NO: 2536155 - DNA, 14 bp, Homo sapiens
acactccatcagct

SEQ ID NO: 2536156 - DNA, 15 bp, Homo sapiens
acactcccctgcact

SEQ ID NO: 2536157 - DNA, 14 bp, Homo sapiens
acactcccttgggc

SEQ ID NO: 2536158 - DNA, 11 bp, Homo sapiens
acactccttca

SEQ ID NO: 2536159 - DNA, 24 bp, Homo sapiens
acactcgcccgcccactgtcctgg

SEQ ID NO: 2536160 - DNA, 20 bp, Homo sapiens
acactctgggctccagagtg

SEQ ID NO: 2536161 - DNA, 16 bp, Homo sapiens
acactctttgtaagag

SEQ ID NO: 2536162 - DNA, 22 bp, Homo sapiens
acactgaaatatacacacagca

SEQ ID NO: 2536163 - DNA, 18 bp, Homo sapiens
acactgaatatttatatt

SEQ ID NO: 2536164 - DNA, 17 bp, Homo sapiens
acactgaccatccactc

SEQ ID NO: 2536165 - DNA, 16 bp, Homo sapiens
acactgaggcagggaa

SEQ ID NO: 2536166 - DNA, 20 bp, Homo sapiens
acactgcaggcatcacagct

SEQ ID NO: 2536167 - DNA, 22 bp, Homo sapiens
acactgccatcttagtttggat

SEQ ID NO: 2536168 - DNA, 18 bp, Homo sapiens
acactgctaggtgggcca

SEQ ID NO: 2536169 - DNA, 20 bp, Homo sapiens
acactggaggagagaagaat

SEQ ID NO: 2536170 - DNA, 13 bp, Homo sapiens
acactggccccta

SEQ ID NO: 2536171 - DNA, 14 bp, Homo sapiens
acactggcccctca

SEQ ID NO: 2536172 - DNA, 22 bp, Homo sapiens
acactggcgtagaagtttttgt

SEQ ID NO: 2536173 - DNA, 22 bp, Homo sapiens
acactgggagaggtgccagcaa

SEQ ID NO: 2536174 - DNA, 21 bp, Homo sapiens
acactggtattcctgcctcca

SEQ ID NO: 2536175 - DNA, 20 bp, Homo sapiens
acactggtgtgacctgaggg

SEQ ID NO: 2536176 - DNA, 21 bp, Homo sapiens
acactgtgcacatctgtgtct

SEQ ID NO: 2536177 - DNA, 17 bp, Homo sapiens
acactgttctctgccct

SEQ ID NO: 2536178 - DNA, 20 bp, Homo sapiens
acactgttctctgccctcca

SEQ ID NO: 2536179 - DNA, 21 bp, Homo sapiens
acactgtttacaagaaaaaat

SEQ ID NO: 2536180 - DNA, 16 bp, Homo sapiens
acactgtttcaaactt

SEQ ID NO: 2536181 - DNA, 17 bp, Homo sapiens
acactgtttcaaacttt

SEQ ID NO: 2536182 - DNA, 18 bp, Homo sapiens
acactgtttcaaacttta

SEQ ID NO: 2536183 - DNA, 20 bp, Homo sapiens
acacttaagggttttagaaa

SEQ ID NO: 2536184 - DNA, 16 bp, Homo sapiens
acacttacactttatg

SEQ ID NO: 2536185 - DNA, 20 bp, Homo sapiens
acacttattggaactctgct

SEQ ID NO: 2536186 - DNA, 17 bp, Homo sapiens
acacttcagagagctgg

SEQ ID NO: 2536187 - DNA, 15 bp, Homo sapiens
acacttccaccagcc

SEQ ID NO: 2536188 - DNA, 16 bp, Homo sapiens
acacttccaccagcct

SEQ ID NO: 2536189 - DNA, 14 bp, Homo sapiens
acacttccataatc

SEQ ID NO: 2536190 - DNA, 16 bp, Homo sapiens
acacttcctgtccaga

SEQ ID NO: 2536191 - DNA, 14 bp, Homo sapiens
acacttgagaggat

SEQ ID NO: 2536192 - DNA, 20 bp, Homo sapiens
acacttgccttcttcaccca

SEQ ID NO: 2536193 - DNA, 22 bp, Homo sapiens
acacttggttgggtcctcacat

SEQ ID NO: 2536194 - DNA, 19 bp, Homo sapiens
acacttgtccccaaatccg

SEQ ID NO: 2536195 - DNA, 22 bp, Homo sapiens
acactttaattaccaacctgtt

SEQ ID NO: 2536196 - DNA, 19 bp, Homo sapiens
acactttgccatattttca

SEQ ID NO: 2536197 - DNA, 22 bp, Homo sapiens
acacttttggttaagtctgttt

SEQ ID NO: 2536198 - DNA, 18 bp, Homo sapiens
acagaaaatatactgtaa

SEQ ID NO: 2536199 - DNA, 20 bp, Homo sapiens
acagaaaatatactgtaaag

SEQ ID NO: 2536200 - DNA, 12 bp, Homo sapiens
acagaaacaaaa

SEQ ID NO: 2536201 - DNA, 14 bp, Homo sapiens
acagaaacattttc

SEQ ID NO: 2536202 - DNA, 13 bp, Homo sapiens
acagaaatgtaca

SEQ ID NO: 2536203 - DNA, 12 bp, Homo sapiens
acagaacagctt

SEQ ID NO: 2536204 - DNA, 16 bp, Homo sapiens
acagaacagcttcagg

SEQ ID NO: 2536205 - DNA, 18 bp, Homo sapiens
acagaacagcttcaggtt

SEQ ID NO: 2536206 - DNA, 20 bp, Homo sapiens
acagaacagcttcaggttat

SEQ ID NO: 2536207 - DNA, 17 bp, Homo sapiens
acagaaccttgttattt

SEQ ID NO: 2536208 - DNA, 22 bp, Homo sapiens
acagaaccttgttatttctcag

SEQ ID NO: 2536209 - DNA, 14 bp, Homo sapiens
acagaagcagctct

SEQ ID NO: 2536210 - DNA, 22 bp, Homo sapiens
acagaagcagttgagtcgtcat

SEQ ID NO: 2536211 - DNA, 18 bp, Homo sapiens
acagaagccaggagcaaa

SEQ ID NO: 2536212 - DNA, 20 bp, Homo sapiens
acagaatgttttactgtgaa

SEQ ID NO: 2536213 - DNA, 21 bp, Homo sapiens
acagaatgttttactgtgaaa

SEQ ID NO: 2536214 - DNA, 13 bp, Homo sapiens
acagacacacaca

SEQ ID NO: 2536215 - DNA, 15 bp, Homo sapiens
acagacacacacacg

SEQ ID NO: 2536216 - DNA, 16 bp, Homo sapiens
acagacacacacacgc

SEQ ID NO: 2536217 - DNA, 13 bp, Homo sapiens
acagacacaggcc

SEQ ID NO: 2536218 - DNA, 19 bp, Homo sapiens
acagacatactaaccagca

SEQ ID NO: 2536219 - DNA, 22 bp, Homo sapiens
acagaccacatctttatctgtt

SEQ ID NO: 2536220 - DNA, 13 bp, Homo sapiens
acagaccctgccc

SEQ ID NO: 2536221 - DNA, 16 bp, Homo sapiens
acagaccctgccctgt

SEQ ID NO: 2536222 - DNA, 17 bp, Homo sapiens
acagaccctgccctgtg

SEQ ID NO: 2536223 - DNA, 20 bp, Homo sapiens
acagaccctgccctgtgggc

SEQ ID NO: 2536224 - DNA, 17 bp, Homo sapiens
acagacctggagcccct

SEQ ID NO: 2536225 - DNA, 20 bp, Homo sapiens
acagacctggagcccctggg

SEQ ID NO: 2536226 - DNA, 22 bp, Homo sapiens
acagacctggagcccctgggtg

SEQ ID NO: 2536227 - DNA, 23 bp, Homo sapiens
acagactcctgaggacagctgtc

SEQ ID NO: 2536228 - DNA, 22 bp, Homo sapiens
acagactcgattcatattgaat

SEQ ID NO: 2536229 - DNA, 17 bp, Homo sapiens
acagactggaagcacag

SEQ ID NO: 2536230 - DNA, 22 bp, Homo sapiens
acagactggaagcacagcttca

SEQ ID NO: 2536231 - DNA, 17 bp, Homo sapiens
acagagaaagagagaga

SEQ ID NO: 2536232 - DNA, 18 bp, Homo sapiens
acagagaaagtacttctc

SEQ ID NO: 2536233 - DNA, 14 bp, Homo sapiens
acagagaacctgga

SEQ ID NO: 2536234 - DNA, 15 bp, Homo sapiens
acagagacaggccca

SEQ ID NO: 2536235 - DNA, 21 bp, Homo sapiens
acagagacaggcccaagagat

SEQ ID NO: 2536236 - DNA, 16 bp, Homo sapiens
acagagacattcctcc

SEQ ID NO: 2536237 - DNA, 17 bp, Homo sapiens
acagagacattcctccg

SEQ ID NO: 2536238 - DNA, 14 bp, Homo sapiens
acagagcaggactg

SEQ ID NO: 2536239 - DNA, 11 bp, Homo sapiens
acagagccagt

SEQ ID NO: 2536240 - DNA, 15 bp, Homo sapiens
acagagcccacgccc

SEQ ID NO: 2536241 - DNA, 23 bp, Homo sapiens
acagaggacagtatttgtgggga

SEQ ID NO: 2536242 - DNA, 14 bp, Homo sapiens
acagaggcagcccc

SEQ ID NO: 2536243 - DNA, 15 bp, Homo sapiens
acagaggcagcccca

SEQ ID NO: 2536244 - DNA, 19 bp, Homo sapiens
acagaggcagccccattct

SEQ ID NO: 2536245 - DNA, 14 bp, Homo sapiens
acagaggcctgccc

SEQ ID NO: 2536246 - DNA, 17 bp, Homo sapiens
acagaggctattgtccc

SEQ ID NO: 2536247 - DNA, 20 bp, Homo sapiens
acagagggaagaaaagagct

SEQ ID NO: 2536248 - DNA, 17 bp, Homo sapiens
acagagggggtggcctc

SEQ ID NO: 2536249 - DNA, 18 bp, Homo sapiens
acagagggggtggcctcc

SEQ ID NO: 2536250 - DNA, 21 bp, Homo sapiens
acagagggggtggcctcccaa

SEQ ID NO: 2536251 - DNA, 21 bp, Homo sapiens
acagagtaaatagcattctct

SEQ ID NO: 2536252 - DNA, 23 bp, Homo sapiens
acagagtatgaacacctgggctt

SEQ ID NO: 2536253 - DNA, 12 bp, Homo sapiens
acagagtctcac

SEQ ID NO: 2536254 - DNA, 14 bp, Homo sapiens
acagagtctcactg

SEQ ID NO: 2536255 - DNA, 17 bp, Homo sapiens
acagagtctcactgttg

SEQ ID NO: 2536256 - DNA, 23 bp, Homo sapiens
acagagtctcactgttgcccagg

SEQ ID NO: 2536257 - DNA, 15 bp, Homo sapiens
acagagtgagactct

SEQ ID NO: 2536258 - DNA, 19 bp, Homo sapiens
acagagtgagactctgtct

SEQ ID NO: 2536259 - DNA, 19 bp, Homo sapiens
acagagtgatagccttccg

SEQ ID NO: 2536260 - DNA, 17 bp, Homo sapiens
acagagtgtgctggagg

SEQ ID NO: 2536261 - DNA, 19 bp, Homo sapiens
acagagtgtgctggaggac

SEQ ID NO: 2536262 - DNA, 21 bp, Homo sapiens
acatggagactcctgccctgt

SEQ ID NO: 2536263 - DNA, 19 bp, Homo sapiens
acatggagtatatgtcaag

SEQ ID NO: 2536264 - DNA, 14 bp, Homo sapiens
acatggccagtgtg

SEQ ID NO: 2536265 - DNA, 15 bp, Homo sapiens
acatggccagtgtga

SEQ ID NO: 2536266 - DNA, 17 bp, Homo sapiens
acatggcctatgcacat

SEQ ID NO: 2536267 - DNA, 14 bp, Homo sapiens
acatggcctttgct

SEQ ID NO: 2536268 - DNA, 20 bp, Homo sapiens
acatgggagccgggtctgcc

SEQ ID NO: 2536269 - DNA, 17 bp, Homo sapiens
acatggggttggctggg

SEQ ID NO: 2536270 - DNA, 20 bp, Homo sapiens
acatggggttggctgggccc

SEQ ID NO: 2536271 - DNA, 21 bp, Homo sapiens
acatggggttggctgggccca

SEQ ID NO: 2536272 - DNA, 23 bp, Homo sapiens
acatggtgtctggattcccagga

SEQ ID NO: 2536273 - DNA, 17 bp, Homo sapiens
acatgtaggaagtagga

SEQ ID NO: 2536274 - DNA, 20 bp, Homo sapiens
acatgtagtagtacttgaaa

SEQ ID NO: 2536275 - DNA, 19 bp, Homo sapiens
acatgtataatatttttaa

SEQ ID NO: 2536276 - DNA, 11 bp, Homo sapiens
acatgtatgtt

SEQ ID NO: 2536277 - DNA, 14 bp, Homo sapiens
acatgtatgttttg

SEQ ID NO: 2536278 - DNA, 23 bp, Homo sapiens
acatgtatgttttggtatctgtt

SEQ ID NO: 2536279 - DNA, 17 bp, Homo sapiens
acatgtatttgtttgca

SEQ ID NO: 2536280 - DNA, 23 bp, Homo sapiens
acatgtcaccgtggaccttcctg

SEQ ID NO: 2536281 - DNA, 18 bp, Homo sapiens
acatgtcagtaccttcaa

SEQ ID NO: 2536282 - DNA, 21 bp, Homo sapiens
acatgtccaagaagcccagga

SEQ ID NO: 2536283 - DNA, 15 bp, Homo sapiens
acatgtccctacacc

SEQ ID NO: 2536284 - DNA, 21 bp, Homo sapiens
acatgtccttgtgtgttttga

SEQ ID NO: 2536285 - DNA, 17 bp, Homo sapiens
acatgtctgttctacat

SEQ ID NO: 2536286 - DNA, 16 bp, Homo sapiens
acatgtcttgtacatg

SEQ ID NO: 2536287 - DNA, 21 bp, Homo sapiens
acatgtcttttcttgcatgag

SEQ ID NO: 2536288 - DNA, 23 bp, Homo sapiens
acatgtcttttcttgcatgaggc

SEQ ID NO: 2536289 - DNA, 13 bp, Homo sapiens
acatgtgaaacct

SEQ ID NO: 2536290 - DNA, 21 bp, Homo sapiens
acatgtgaaaccttttttaag

SEQ ID NO: 2536291 - DNA, 18 bp, Homo sapiens
acatgtgcacatgcacgt

SEQ ID NO: 2536292 - DNA, 19 bp, Homo sapiens
acatgtgccgaatgtgcag

SEQ ID NO: 2536293 - DNA, 23 bp, Homo sapiens
acatgtggtgggacagggaccca

SEQ ID NO: 2536294 - DNA, 17 bp, Homo sapiens
acatgttaaacttactt

SEQ ID NO: 2536295 - DNA, 13 bp, Homo sapiens
acatgttacaaca

SEQ ID NO: 2536296 - DNA, 21 bp, Homo sapiens
acatgtttacttttcagggca

SEQ ID NO: 2536297 - DNA, 20 bp, Homo sapiens
acatgtttagagttgcaatc

SEQ ID NO: 2536298 - DNA, 21 bp, Homo sapiens
acatgttttagacaaatactc

SEQ ID NO: 2536299 - DNA, 17 bp, Homo sapiens
acatgttttgataaagt

SEQ ID NO: 2536300 - DNA, 18 bp, Homo sapiens
acatgttttgataaagta

SEQ ID NO: 2536301 - DNA, 22 bp, Homo sapiens
acatgttttgataaagtagtaa

SEQ ID NO: 2536302 - DNA, 23 bp, Homo sapiens
acatgttttgataaagtagtaaa

SEQ ID NO: 2536303 - DNA, 17 bp, Homo sapiens
acattaaatctatgaag

SEQ ID NO: 2536304 - DNA, 12 bp, Homo sapiens
acattaacagtt

SEQ ID NO: 2536305 - DNA, 18 bp, Homo sapiens
acattaacagttttccat

SEQ ID NO: 2536306 - DNA, 22 bp, Homo sapiens
acattaacagttttccatgaaa

SEQ ID NO: 2536307 - DNA, 15 bp, Homo sapiens
acattcaataagcat

SEQ ID NO: 2536308 - DNA, 23 bp, Homo sapiens
acattcaataagcatcaaactct

SEQ ID NO: 2536309 - DNA, 12 bp, Homo sapiens
acattcaatgtt

SEQ ID NO: 2536310 - DNA, 15 bp, Homo sapiens
acattcatgcctggc

SEQ ID NO: 2536311 - DNA, 16 bp, Homo sapiens
acattcatgcctggct

SEQ ID NO: 2536312 - DNA, 14 bp, Homo sapiens
acattccaagacag

SEQ ID NO: 2536313 - DNA, 17 bp, Homo sapiens
acattccaagacagtat

SEQ ID NO: 2536314 - DNA, 13 bp, Homo sapiens
acattccatcctt

SEQ ID NO: 2536315 - DNA, 17 bp, Homo sapiens
acattcccatctgtcac

SEQ ID NO: 2536316 - DNA, 19 bp, Homo sapiens
acattcctaaactatcttt

SEQ ID NO: 2536317 - DNA, 20 bp, Homo sapiens
acattcctaaactatctttt

SEQ ID NO: 2536318 - DNA, 15 bp, Homo sapiens
acattcggctccctg

SEQ ID NO: 2536319 - DNA, 16 bp, Homo sapiens
acattctgatttggaa

SEQ ID NO: 2536320 - DNA, 14 bp, Homo sapiens
acattctgtaaaat

SEQ ID NO: 2536321 - DNA, 22 bp, Homo sapiens
acattctgtcgccttagcatgt

SEQ ID NO: 2536322 - DNA, 15 bp, Homo sapiens
acattctgttaatca

SEQ ID NO: 2536323 - DNA, 19 bp, Homo sapiens
acattgaagtaatgaattt

SEQ ID NO: 2536324 - DNA, 14 bp, Homo sapiens
acattgctaagatg

SEQ ID NO: 2536325 - DNA, 20 bp, Homo sapiens
acattgcttgtgccacaccc

SEQ ID NO: 2536326 - DNA, 18 bp, Homo sapiens
acattgctttactgtcaa

SEQ ID NO: 2536327 - DNA, 16 bp, Homo sapiens
acattggagcctgggc

SEQ ID NO: 2536328 - DNA, 18 bp, Homo sapiens
acattggttcttgtatta

SEQ ID NO: 2536329 - DNA, 19 bp, Homo sapiens
acattgtcatttatataga

SEQ ID NO: 2536330 - DNA, 16 bp, Homo sapiens
acattgttttaaaaag

SEQ ID NO: 2536331 - DNA, 18 bp, Homo sapiens
acattgttttaaaaagaa

SEQ ID NO: 2536332 - DNA, 23 bp, Homo sapiens
acatttaaattttaccctttaga

SEQ ID NO: 2536333 - DNA, 16 bp, Homo sapiens
acatttacatgtatta

SEQ ID NO: 2536334 - DNA, 21 bp, Homo sapiens
acatttagagaactgtggccg

SEQ ID NO: 2536335 - DNA, 22 bp, Homo sapiens
acatttatcaatcagtataatt

SEQ ID NO: 2536336 - DNA, 23 bp, Homo sapiens
acatttatcaatcagtataattc

SEQ ID NO: 2536337 - DNA, 14 bp, Homo sapiens
acatttatgattta

SEQ ID NO: 2536338 - DNA, 15 bp, Homo sapiens
acatttatgatttaa

SEQ ID NO: 2536339 - DNA, 17 bp, Homo sapiens
acatttatgatttaata

SEQ ID NO: 2536340 - DNA, 20 bp, Homo sapiens
acatttatgatttaataaaa

SEQ ID NO: 2536341 - DNA, 13 bp, Homo sapiens
acatttcccaggg

SEQ ID NO: 2536342 - DNA, 12 bp, Homo sapiens
acatttccctgt

SEQ ID NO: 2536343 - DNA, 22 bp, Homo sapiens
acatttctcctttgataaaata

SEQ ID NO: 2536344 - DNA, 23 bp, Homo sapiens
acatttctctaagagaacaatgt

SEQ ID NO: 2536345 - DNA, 13 bp, Homo sapiens
acatttgccttgc

SEQ ID NO: 2536346 - DNA, 14 bp, Homo sapiens
acatttgccttgct

SEQ ID NO: 2536347 - DNA, 15 bp, Homo sapiens
acatttgccttgctg

SEQ ID NO: 2536348 - DNA, 17 bp, Homo sapiens
acattttaaataaaaga

SEQ ID NO: 2536349 - DNA, 15 bp, Homo sapiens
acattttaatgcacc

SEQ ID NO: 2536350 - DNA, 19 bp, Homo sapiens
acattttaatgcacctgaa

SEQ ID NO: 2536351 - DNA, 15 bp, Homo sapiens
acattttagttcttt

SEQ ID NO: 2536352 - DNA, 19 bp, Homo sapiens
acattttattttattatgc

SEQ ID NO: 2536353 - DNA, 13 bp, Homo sapiens
acattttcacaca

SEQ ID NO: 2536354 - DNA, 12 bp, Homo sapiens
acattttcattt

SEQ ID NO: 2536355 - DNA, 19 bp, Homo sapiens
acattttccttttcaaata

SEQ ID NO: 2536356 - DNA, 14 bp, Homo sapiens
acattttgccaaaa

SEQ ID NO: 2536357 - DNA, 12 bp, Homo sapiens
acattttgtata

SEQ ID NO: 2536358 - DNA, 13 bp, Homo sapiens
acattttgtataa

SEQ ID NO: 2536359 - DNA, 16 bp, Homo sapiens
acattttgtataattg

SEQ ID NO: 2536360 - DNA, 21 bp, Homo sapiens
acatttttaagtgctgcattt

SEQ ID NO: 2536361 - DNA, 12 bp, Homo sapiens
acatttttacaa

SEQ ID NO: 2536362 - DNA, 17 bp, Homo sapiens
accaaaaagaccagact

SEQ ID NO: 2536363 - DNA, 18 bp, Homo sapiens
accaaaactgtgcagagt

SEQ ID NO: 2536364 - DNA, 15 bp, Homo sapiens
accaaaataagaaaa

SEQ ID NO: 2536365 - DNA, 16 bp, Homo sapiens
accaaaattatttcag

SEQ ID NO: 2536366 - DNA, 14 bp, Homo sapiens
accaaacctagccc

SEQ ID NO: 2536367 - DNA, 17 bp, Homo sapiens
accaaagagactggagc

SEQ ID NO: 2536368 - DNA, 14 bp, Homo sapiens
accaaattccttgg

SEQ ID NO: 2536369 - DNA, 19 bp, Homo sapiens
accaacacgagcaggctac

SEQ ID NO: 2536370 - DNA, 16 bp, Homo sapiens
accaacagttccttca

SEQ ID NO: 2536371 - DNA, 17 bp, Homo sapiens
accaacatactcccatc

SEQ ID NO: 2536372 - DNA, 14 bp, Homo sapiens
accaaccctgtttc

SEQ ID NO: 2536373 - DNA, 19 bp, Homo sapiens
accaactagacattctgtc

SEQ ID NO: 2536374 - DNA, 13 bp, Homo sapiens
accaactttctgt

SEQ ID NO: 2536375 - DNA, 14 bp, Homo sapiens
accaactttctgta

SEQ ID NO: 2536376 - DNA, 24 bp, Homo sapiens
accaagaagcctttcctgtagcct

SEQ ID NO: 2536377 - DNA, 17 bp, Homo sapiens
accaaggagatgaagca

SEQ ID NO: 2536378 - DNA, 16 bp, Homo sapiens
accaaggcaaggcagg

SEQ ID NO: 2536379 - DNA, 20 bp, Homo sapiens
accaaggctgattaaaccaa

SEQ ID NO: 2536380 - DNA, 19 bp, Homo sapiens
accaaggtcttcagccatc

SEQ ID NO: 2536381 - DNA, 16 bp, Homo sapiens
accaagtggaccttga

SEQ ID NO: 2536382 - DNA, 14 bp, Homo sapiens
accaatagattccc

SEQ ID NO: 2536383 - DNA, 23 bp, Homo sapiens
accaatagggctgagctctctgt

SEQ ID NO: 2536384 - DNA, 20 bp, Homo sapiens
accaatattatactaagaaa

SEQ ID NO: 2536385 - DNA, 16 bp, Homo sapiens
accaatattgtacagt

SEQ ID NO: 2536386 - DNA, 16 bp, Homo sapiens
accaatatttgtagaa

SEQ ID NO: 2536387 - DNA, 12 bp, Homo sapiens
accaatgcatgc

SEQ ID NO: 2536388 - DNA, 20 bp, Homo sapiens
accaatgcatgcagccactg

SEQ ID NO: 2536389 - DNA, 22 bp, Homo sapiens
accaatgcatgcagccactgtg

SEQ ID NO: 2536390 - DNA, 16 bp, Homo sapiens
accaattggttaatct

SEQ ID NO: 2536391 - DNA, 17 bp, Homo sapiens
accacacagaggctgcc

SEQ ID NO: 2536392 - DNA, 17 bp, Homo sapiens
accacaccaaacctctc

SEQ ID NO: 2536393 - DNA, 20 bp, Homo sapiens
accacacccagcccacttct

SEQ ID NO: 2536394 - DNA, 21 bp, Homo sapiens
accacacccagcccacttctg

SEQ ID NO: 2536395 - DNA, 13 bp, Homo sapiens
accacaccctgta

SEQ ID NO: 2536396 - DNA, 22 bp, Homo sapiens
accacactggactccggccctc

SEQ ID NO: 2536397 - DNA, 14 bp, Homo sapiens
accacagacacaca

SEQ ID NO: 2536398 - DNA, 15 bp, Homo sapiens
accacagacacacac

SEQ ID NO: 2536399 - DNA, 20 bp, Homo sapiens
accacagacacacacacgca

SEQ ID NO: 2536400 - DNA, 16 bp, Homo sapiens
accacagcagctgaac

SEQ ID NO: 2536401 - DNA, 19 bp, Homo sapiens
accacagcaggtgtcatat

SEQ ID NO: 2536402 - DNA, 16 bp, Homo sapiens
accacagcatcatttt

SEQ ID NO: 2536403 - DNA, 16 bp, Homo sapiens
accacagccctgtcag

SEQ ID NO: 2536404 - DNA, 12 bp, Homo sapiens
accacagtgtct

SEQ ID NO: 2536405 - DNA, 23 bp, Homo sapiens
accacatccacacacgcaggaac

SEQ ID NO: 2536406 - DNA, 21 bp, Homo sapiens
accacatcctccgtccagccg

SEQ ID NO: 2536407 - DNA, 14 bp, Homo sapiens
accacatcttgctc

SEQ ID NO: 2536408 - DNA, 17 bp, Homo sapiens
accacatcttgctctgc

SEQ ID NO: 2536409 - DNA, 24 bp, Homo sapiens
accacatcttgctctgctgacaga

SEQ ID NO: 2536410 - DNA, 22 bp, Homo sapiens
accacatgccaagcactgtgct

SEQ ID NO: 2536411 - DNA, 15 bp, Homo sapiens
accaccacacccagc

SEQ ID NO: 2536412 - DNA, 14 bp, Homo sapiens
accaccactggcca

SEQ ID NO: 2536413 - DNA, 15 bp, Homo sapiens
accaccactggccac

SEQ ID NO: 2536414 - DNA, 20 bp, Homo sapiens
accaccactggccaccaggc

SEQ ID NO: 2536415 - DNA, 23 bp, Homo sapiens
accaccactggccaccaggctgg

SEQ ID NO: 2536416 - DNA, 15 bp, Homo sapiens
accaccccccactct

SEQ ID NO: 2536417 - DNA, 18 bp, Homo sapiens
accaccccgcctgccctc

SEQ ID NO: 2536418 - DNA, 19 bp, Homo sapiens
accacccctgcctccaccc

SEQ ID NO: 2536419 - DNA, 15 bp, Homo sapiens
accaccccttcctgt

SEQ ID NO: 2536420 - DNA, 21 bp, Homo sapiens
accaccctagtcccttcccct

SEQ ID NO: 2536421 - DNA, 16 bp, Homo sapiens
accaccctcccctctc

SEQ ID NO: 2536422 - DNA, 17 bp, Homo sapiens
accaccctcccctctct

SEQ ID NO: 2536423 - DNA, 18 bp, Homo sapiens
accaccgctccccagccc

SEQ ID NO: 2536424 - DNA, 19 bp, Homo sapiens
accaccgctccccagccca

SEQ ID NO: 2536425 - DNA, 23 bp, Homo sapiens
accaccgctccccagcccagggt

SEQ ID NO: 2536426 - DNA, 16 bp, Homo sapiens
accacctcactcctgt

SEQ ID NO: 2536427 - DNA, 14 bp, Homo sapiens
accacctttcagat

SEQ ID NO: 2536428 - DNA, 18 bp, Homo sapiens
accacgctggaccttgaa

SEQ ID NO: 2536429 - DNA, 14 bp, Homo sapiens
accacggccactgg

SEQ ID NO: 2536430 - DNA, 22 bp, Homo sapiens
accacggccactggccatctcc

SEQ ID NO: 2536431 - DNA, 23 bp, Homo sapiens
accacgtgctacccccatgctgg

SEQ ID NO: 2536432 - DNA, 13 bp, Homo sapiens
accacgtttctaa

SEQ ID NO: 2536433 - DNA, 15 bp, Homo sapiens
accactatgaagcta

SEQ ID NO: 2536434 - DNA, 17 bp, Homo sapiens
accactgcactccagcc

SEQ ID NO: 2536435 - DNA, 18 bp, Homo sapiens
accactgcactccagcct

SEQ ID NO: 2536436 - DNA, 13 bp, Homo sapiens
accacttcagctg

SEQ ID NO: 2536437 - DNA, 15 bp, Homo sapiens
accacttttgttctt

SEQ ID NO: 2536438 - DNA, 16 bp, Homo sapiens
accacttttgttcttg

SEQ ID NO: 2536439 - DNA, 13 bp, Homo sapiens
accagaacaaggt

SEQ ID NO: 2536440 - DNA, 15 bp, Homo sapiens
accagaagcaacaga

SEQ ID NO: 2536441 - DNA, 17 bp, Homo sapiens
accagacaccttgacag

SEQ ID NO: 2536442 - DNA, 13 bp, Homo sapiens
accagactgtgga

SEQ ID NO: 2536443 - DNA, 20 bp, Homo sapiens
accagactgtggagaaataa

SEQ ID NO: 2536444 - DNA, 21 bp, Homo sapiens
accagactgtggagaaataaa

SEQ ID NO: 2536445 - DNA, 12 bp, Homo sapiens
accagagcagat

SEQ ID NO: 2536446 - DNA, 17 bp, Homo sapiens
accagagcagatgcaga

SEQ ID NO: 2536447 - DNA, 23 bp, Homo sapiens
accagagccatggactctacact

SEQ ID NO: 2536448 - DNA, 16 bp, Homo sapiens
accagagcccaccttg

SEQ ID NO: 2536449 - DNA, 17 bp, Homo sapiens
accagagcccaccttgg

SEQ ID NO: 2536450 - DNA, 19 bp, Homo sapiens
accagagcccaccttggct

SEQ ID NO: 2536451 - DNA, 17 bp, Homo sapiens
accagagccccacacgg

SEQ ID NO: 2536452 - DNA, 18 bp, Homo sapiens
accagaggaatcactctt

SEQ ID NO: 2536453 - DNA, 15 bp, Homo sapiens
accagaggctgcaga

SEQ ID NO: 2536454 - DNA, 20 bp, Homo sapiens
accagataaaattatagatg

SEQ ID NO: 2536455 - DNA, 17 bp, Homo sapiens
accagatgatgggggag

SEQ ID NO: 2536456 - DNA, 17 bp, Homo sapiens
accagcaatatatctga

SEQ ID NO: 2536457 - DNA, 15 bp, Homo sapiens
accagcactgtctca

SEQ ID NO: 2536458 - DNA, 13 bp, Homo sapiens
accagcagaaatg

SEQ ID NO: 2536459 - DNA, 13 bp, Homo sapiens
accagcagagcac

SEQ ID NO: 2536460 - DNA, 15 bp, Homo sapiens
accagccagatcctc

SEQ ID NO: 2536461 - DNA, 20 bp, Homo sapiens
accagccaggctctgtgctg

SEQ ID NO: 2536462 - DNA, 23 bp, Homo sapiens
accagccaggctctgtgctgacc

SEQ ID NO: 2536463 - DNA, 14 bp, Homo sapiens
accagcccagatgt

SEQ ID NO: 2536464 - DNA, 18 bp, Homo sapiens
accagccccagtgcccac

SEQ ID NO: 2536465 - DNA, 19 bp, Homo sapiens
accagccccagtgcccaca

SEQ ID NO: 2536466 - DNA, 16 bp, Homo sapiens
accagcccggcctgct

SEQ ID NO: 2536467 - DNA, 21 bp, Homo sapiens
accagcccggcctgctcccag

SEQ ID NO: 2536468 - DNA, 17 bp, Homo sapiens
accagcctcgtcttcat

SEQ ID NO: 2536469 - DNA, 23 bp, Homo sapiens
accagcctctcttggtttccttc

SEQ ID NO: 2536470 - DNA, 20 bp, Homo sapiens
accagcctggtcaacatggt

SEQ ID NO: 2536471 - DNA, 14 bp, Homo sapiens
accagcctgttgga

SEQ ID NO: 2536472 - DNA, 14 bp, Homo sapiens
accagcgcccgctg

SEQ ID NO: 2536473 - DNA, 15 bp, Homo sapiens
accagcgcccgctgg

SEQ ID NO: 2536474 - DNA, 19 bp, Homo sapiens
accagcgcccgctgggctg

SEQ ID NO: 2536475 - DNA, 22 bp, Homo sapiens
accagcgtgtgactactccccc

SEQ ID NO: 2536476 - DNA, 14 bp, Homo sapiens
accagctcctccct

SEQ ID NO: 2536477 - DNA, 11 bp, Homo sapiens
accagctgggg

SEQ ID NO: 2536478 - DNA, 22 bp, Homo sapiens
accagctgttctgtcccttgga

SEQ ID NO: 2536479 - DNA, 16 bp, Homo sapiens
accagcttagatttta

SEQ ID NO: 2536480 - DNA, 18 bp, Homo sapiens
accagcttctccaggctc

SEQ ID NO: 2536481 - DNA, 21 bp, Homo sapiens
accaggactccctcctcacct

SEQ ID NO: 2536482 - DNA, 18 bp, Homo sapiens
accaggagaaccactaca

SEQ ID NO: 2536483 - DNA, 17 bp, Homo sapiens
accaggagtccctggta

SEQ ID NO: 2536484 - DNA, 19 bp, Homo sapiens
accaggccgtcctcccggg

SEQ ID NO: 2536485 - DNA, 23 bp, Homo sapiens
accaggcgagagacttgtggcct

SEQ ID NO: 2536486 - DNA, 22 bp, Homo sapiens
accaggctggcgcagccaaggc

SEQ ID NO: 2536487 - DNA, 23 bp, Homo sapiens
accaggctggcgcagccaaggcc

SEQ ID NO: 2536488 - DNA, 18 bp, Homo sapiens
accaggcttgcctgcagg

SEQ ID NO: 2536489 - DNA, 14 bp, Homo sapiens
accagggactgagg

SEQ ID NO: 2536490 - DNA, 21 bp, Homo sapiens
accagggagaccgagcgcttt

SEQ ID NO: 2536491 - DNA, 14 bp, Homo sapiens
accagggcagggcc

SEQ ID NO: 2536492 - DNA, 19 bp, Homo sapiens
accaggtgttctacactca

SEQ ID NO: 2536493 - DNA, 18 bp, Homo sapiens
accagtgaaccaaagaga

SEQ ID NO: 2536494 - DNA, 12 bp, Homo sapiens
accagtgacttt

SEQ ID NO: 2536495 - DNA, 18 bp, Homo sapiens
accagtgcgattctggat

SEQ ID NO: 2536496 - DNA, 22 bp, Homo sapiens
accagtgttagggaagggcctg

SEQ ID NO: 2536497 - DNA, 15 bp, Homo sapiens
accagtgttgtggat

SEQ ID NO: 2536498 - DNA, 18 bp, Homo sapiens
accagtgttgtggattta

SEQ ID NO: 2536499 - DNA, 17 bp, Homo sapiens
accagttatgtgaatga

SEQ ID NO: 2536500 - DNA, 15 bp, Homo sapiens
accagttctgggcaa

SEQ ID NO: 2536501 - DNA, 18 bp, Homo sapiens
accagttgggagcactgg

SEQ ID NO: 2536502 - DNA, 20 bp, Homo sapiens
accagtttaacctgatgcag

SEQ ID NO: 2536503 - DNA, 13 bp, Homo sapiens
accataatgttac

SEQ ID NO: 2536504 - DNA, 20 bp, Homo sapiens
accatattaccacagacata

SEQ ID NO: 2536505 - DNA, 19 bp, Homo sapiens
accatattcagtgctgtgg

SEQ ID NO: 2536506 - DNA, 14 bp, Homo sapiens
accatcaagccacc

SEQ ID NO: 2536507 - DNA, 15 bp, Homo sapiens
accatcagggacagg

SEQ ID NO: 2536508 - DNA, 14 bp, Homo sapiens
accatcatgtctgg

SEQ ID NO: 2536509 - DNA, 16 bp, Homo sapiens
accatcatgtctggct

SEQ ID NO: 2536510 - DNA, 21 bp, Homo sapiens
accatccctgaaggccccgcc

SEQ ID NO: 2536511 - DNA, 13 bp, Homo sapiens
accatcctattta

SEQ ID NO: 2536512 - DNA, 16 bp, Homo sapiens
accatcctatttaact

SEQ ID NO: 2536513 - DNA, 15 bp, Homo sapiens
accatcgctttattg

SEQ ID NO: 2536514 - DNA, 15 bp, Homo sapiens
accatctcaggccac

SEQ ID NO: 2536515 - DNA, 15 bp, Homo sapiens
accatgaaacaaagc

SEQ ID NO: 2536516 - DNA, 24 bp, Homo sapiens
accatgaagagatttttcatgatt

SEQ ID NO: 2536517 - DNA, 18 bp, Homo sapiens
accatgagcaattctcct

SEQ ID NO: 2536518 - DNA, 19 bp, Homo sapiens
accatgagtggcatggcca

SEQ ID NO: 2536519 - DNA, 22 bp, Homo sapiens
accatgattaaccacttcagct

SEQ ID NO: 2536520 - DNA, 16 bp, Homo sapiens
accatgcaaatgctat

SEQ ID NO: 2536521 - DNA, 15 bp, Homo sapiens
accatggctgaagga

SEQ ID NO: 2536522 - DNA, 23 bp, Homo sapiens
accatggctgaaggaaaccagtg

SEQ ID NO: 2536523 - DNA, 12 bp, Homo sapiens
accatgggacca

SEQ ID NO: 2536524 - DNA, 13 bp, Homo sapiens
accatgtgcctga

SEQ ID NO: 2536525 - DNA, 22 bp, Homo sapiens
accattaaaactgaagtctgaa

SEQ ID NO: 2536526 - DNA, 21 bp, Homo sapiens
accattctccacctgccaggg

SEQ ID NO: 2536527 - DNA, 22 bp, Homo sapiens
accattttggggtacccactgc

SEQ ID NO: 2536528 - DNA, 23 bp, Homo sapiens
accattttggggtacccactgct

SEQ ID NO: 2536529 - DNA, 22 bp, Homo sapiens
acccaaaagctcagccagcccc

SEQ ID NO: 2536530 - DNA, 15 bp, Homo sapiens
acccaaaaggcagaa

SEQ ID NO: 2536531 - DNA, 16 bp, Homo sapiens
acccaaatgttcatca

SEQ ID NO: 2536532 - DNA, 16 bp, Homo sapiens
acccaactctcctgga

SEQ ID NO: 2536533 - DNA, 13 bp, Homo sapiens
acccaaggactga

SEQ ID NO: 2536534 - DNA, 17 bp, Homo sapiens
acccaaggactgaggga

SEQ ID NO: 2536535 - DNA, 16 bp, Homo sapiens
acccaagggcctggcc

SEQ ID NO: 2536536 - DNA, 16 bp, Homo sapiens
acccaagtccaagcat

SEQ ID NO: 2536537 - DNA, 15 bp, Homo sapiens
acccacacctctgcc

SEQ ID NO: 2536538 - DNA, 17 bp, Homo sapiens
acccacacctctgccag

SEQ ID NO: 2536539 - DNA, 17 bp, Homo sapiens
acccacccccacccaag

SEQ ID NO: 2536540 - DNA, 16 bp, Homo sapiens
acccacccctgtgctc

SEQ ID NO: 2536541 - DNA, 17 bp, Homo sapiens
acccacccctgtgctcc

SEQ ID NO: 2536542 - DNA, 20 bp, Homo sapiens
acccaccgccacaataaaga

SEQ ID NO: 2536543 - DNA, 19 bp, Homo sapiens
acccaccgtccgccctgct

SEQ ID NO: 2536544 - DNA, 14 bp, Homo sapiens
acccacctcagcct

SEQ ID NO: 2536545 - DNA, 19 bp, Homo sapiens
acccaccttgttggagcct

SEQ ID NO: 2536546 - DNA, 20 bp, Homo sapiens
acccaccttgttggagcctg

SEQ ID NO: 2536547 - DNA, 23 bp, Homo sapiens
acccaccttgttggagcctgcag

SEQ ID NO: 2536548 - DNA, 15 bp, Homo sapiens
acccactcatcagaa

SEQ ID NO: 2536549 - DNA, 11 bp, Homo sapiens
acccactgctc

SEQ ID NO: 2536550 - DNA, 14 bp, Homo sapiens
acccactgctctgg

SEQ ID NO: 2536551 - DNA, 11 bp, Homo sapiens
acccactgctt

SEQ ID NO: 2536552 - DNA, 14 bp, Homo sapiens
acgacttcagggca

SEQ ID NO: 2536553 - DNA, 22 bp, Homo sapiens
acgacttcagggcagggctctg

SEQ ID NO: 2536554 - DNA, 19 bp, Homo sapiens
acgagaccctacaggagag

SEQ ID NO: 2536555 - DNA, 20 bp, Homo sapiens
acgagcaggctactgtcagc

SEQ ID NO: 2536556 - DNA, 16 bp, Homo sapiens
acgaggccctcgggcc

SEQ ID NO: 2536557 - DNA, 18 bp, Homo sapiens
acgaggccctcgggccca

SEQ ID NO: 2536558 - DNA, 15 bp, Homo sapiens
acgatttaattctct

SEQ ID NO: 2536559 - DNA, 19 bp, Homo sapiens
acgatttaattctcttgaa

SEQ ID NO: 2536560 - DNA, 13 bp, Homo sapiens
acgatttctgttt

SEQ ID NO: 2536561 - DNA, 19 bp, Homo sapiens
acgatttctgtttagataa

SEQ ID NO: 2536562 - DNA, 12 bp, Homo sapiens
acgcacacacac

SEQ ID NO: 2536563 - DNA, 19 bp, Homo sapiens
acgcacacacacacacagg

SEQ ID NO: 2536564 - DNA, 21 bp, Homo sapiens
acgcacacacacacacaggag

SEQ ID NO: 2536565 - DNA, 13 bp, Homo sapiens
acgcacctcccat

SEQ ID NO: 2536566 - DNA, 19 bp, Homo sapiens
acgcacctcccatcctaat

SEQ ID NO: 2536567 - DNA, 20 bp, Homo sapiens
acgcagccctagagcctgcc

SEQ ID NO: 2536568 - DNA, 24 bp, Homo sapiens
acgcagccctagagcctgcctgga

SEQ ID NO: 2536569 - DNA, 17 bp, Homo sapiens
acgcaggggttgcagtg

SEQ ID NO: 2536570 - DNA, 12 bp, Homo sapiens
acgccacccagc

SEQ ID NO: 2536571 - DNA, 22 bp, Homo sapiens
acgccactgcactccagcctgg

SEQ ID NO: 2536572 - DNA, 16 bp, Homo sapiens
acgcccaacccttccc

SEQ ID NO: 2536573 - DNA, 18 bp, Homo sapiens
acgcctatgatcccagca

SEQ ID NO: 2536574 - DNA, 19 bp, Homo sapiens
acgcctgccctccccagag

SEQ ID NO: 2536575 - DNA, 12 bp, Homo sapiens
acgcctgcctcc

SEQ ID NO: 2536576 - DNA, 18 bp, Homo sapiens
acgcctgggggtgccagg

SEQ ID NO: 2536577 - DNA, 19 bp, Homo sapiens
acgcctgtaatcccagcac

SEQ ID NO: 2536578 - DNA, 22 bp, Homo sapiens
acgcgaaagtatcaccagggtg

SEQ ID NO: 2536579 - DNA, 23 bp, Homo sapiens
acgcgaaagtatcaccagggtgc

SEQ ID NO: 2536580 - DNA, 15 bp, Homo sapiens
acgcgtctcctgttt

SEQ ID NO: 2536581 - DNA, 23 bp, Homo sapiens
acgcgtgtgtacacgggactgac

SEQ ID NO: 2536582 - DNA, 14 bp, Homo sapiens
acgctgtctccaga

SEQ ID NO: 2536583 - DNA, 15 bp, Homo sapiens
acgctgtctccagac

SEQ ID NO: 2536584 - DNA, 17 bp, Homo sapiens
acgctgtctccagaccc

SEQ ID NO: 2536585 - DNA, 15 bp, Homo sapiens
acgctgtgctgccct

SEQ ID NO: 2536586 - DNA, 18 bp, Homo sapiens
acgctgtgctgccctgcc

SEQ ID NO: 2536587 - DNA, 20 bp, Homo sapiens
acgcttgcgtatgtctgtta

SEQ ID NO: 2536588 - DNA, 15 bp, Homo sapiens
acgcttgctcatttt

SEQ ID NO: 2536589 - DNA, 18 bp, Homo sapiens
acgctttcctgaatccaa

SEQ ID NO: 2536590 - DNA, 17 bp, Homo sapiens
acgctttctagctgttg

SEQ ID NO: 2536591 - DNA, 16 bp, Homo sapiens
acggaagagccttgcg

SEQ ID NO: 2536592 - DNA, 15 bp, Homo sapiens
acggaatagttggct

SEQ ID NO: 2536593 - DNA, 13 bp, Homo sapiens
acggagagcgcct

SEQ ID NO: 2536594 - DNA, 18 bp, Homo sapiens
acggattattttttcaga

SEQ ID NO: 2536595 - DNA, 15 bp, Homo sapiens
acggatttatttttc

SEQ ID NO: 2536596 - DNA, 22 bp, Homo sapiens
acggcaggacaacgaggaagcc

SEQ ID NO: 2536597 - DNA, 13 bp, Homo sapiens
acggccaggccag

SEQ ID NO: 2536598 - DNA, 16 bp, Homo sapiens
acggccaggccagagg

SEQ ID NO: 2536599 - DNA, 22 bp, Homo sapiens
acggctgggcacacgcctccca

SEQ ID NO: 2536600 - DNA, 23 bp, Homo sapiens
acggcttagacttcgactcagga

SEQ ID NO: 2536601 - DNA, 17 bp, Homo sapiens
acgggaagtttagagag

SEQ ID NO: 2536602 - DNA, 23 bp, Homo sapiens
acgggcttgttgctgttgatgtt

SEQ ID NO: 2536603 - DNA, 23 bp, Homo sapiens
acggggaggccaagtgcaggctg

SEQ ID NO: 2536604 - DNA, 18 bp, Homo sapiens
acgggtgggcggctggag

SEQ ID NO: 2536605 - DNA, 18 bp, Homo sapiens
acggtgggcatttgtgag

SEQ ID NO: 2536606 - DNA, 17 bp, Homo sapiens
acggtgggccttgctgg

SEQ ID NO: 2536607 - DNA, 15 bp, Homo sapiens
acggttttactgcag

SEQ ID NO: 2536608 - DNA, 14 bp, Homo sapiens
acgtacacatttta

SEQ ID NO: 2536609 - DNA, 18 bp, Homo sapiens
acgtacttagcagctatc

SEQ ID NO: 2536610 - DNA, 18 bp, Homo sapiens
acgtccagaatttttcat

SEQ ID NO: 2536611 - DNA, 13 bp, Homo sapiens
acgtctgacaggc

SEQ ID NO: 2536612 - DNA, 23 bp, Homo sapiens
acgtctgacaggcaatgctggct

SEQ ID NO: 2536613 - DNA, 23 bp, Homo sapiens
acgtctgggagaaattgacagat

SEQ ID NO: 2536614 - DNA, 12 bp, Homo sapiens
acgtctgtgcca

SEQ ID NO: 2536615 - DNA, 14 bp, Homo sapiens
acgtgagccaggta

SEQ ID NO: 2536616 - DNA, 18 bp, Homo sapiens
acgtgatggtctgagact

SEQ ID NO: 2536617 - DNA, 22 bp, Homo sapiens
acgtgattcaattcaacactcc

SEQ ID NO: 2536618 - DNA, 19 bp, Homo sapiens
acgtgattttgctgtagaa

SEQ ID NO: 2536619 - DNA, 21 bp, Homo sapiens
acgtgccttttgcacccctcc

SEQ ID NO: 2536620 - DNA, 17 bp, Homo sapiens
acgtggacgtttttaat

SEQ ID NO: 2536621 - DNA, 14 bp, Homo sapiens
acgtggagagctgg

SEQ ID NO: 2536622 - DNA, 18 bp, Homo sapiens
acgtggagagctggtgcc

SEQ ID NO: 2536623 - DNA, 21 bp, Homo sapiens
acgtggaggaatgctccccca

SEQ ID NO: 2536624 - DNA, 13 bp, Homo sapiens
acgtggaggagca

SEQ ID NO: 2536625 - DNA, 16 bp, Homo sapiens
acgtgggagacaagaa

SEQ ID NO: 2536626 - DNA, 16 bp, Homo sapiens
acgtgggcaaacaggc

SEQ ID NO: 2536627 - DNA, 19 bp, Homo sapiens
acgtgggcaaacaggcagt

SEQ ID NO: 2536628 - DNA, 17 bp, Homo sapiens
acgttagaccacaaata

SEQ ID NO: 2536629 - DNA, 12 bp, Homo sapiens
acgttccagccg

SEQ ID NO: 2536630 - DNA, 14 bp, Homo sapiens
acgttcggggcatg

SEQ ID NO: 2536631 - DNA, 15 bp, Homo sapiens
acgttctcacaccca

SEQ ID NO: 2536632 - DNA, 14 bp, Homo sapiens
acgttgctgtggga

SEQ ID NO: 2536633 - DNA, 13 bp, Homo sapiens
acgttgtgcattt

SEQ ID NO: 2536634 - DNA, 13 bp, Homo sapiens
acgtttgtatgtg

SEQ ID NO: 2536635 - DNA, 20 bp, Homo sapiens
acgtttttaatataaagcct

SEQ ID NO: 2536636 - DNA, 13 bp, Homo sapiens
actaaaaatacaa

SEQ ID NO: 2536637 - DNA, 13 bp, Homo sapiens
actaaaaatatta

SEQ ID NO: 2536638 - DNA, 13 bp, Homo sapiens
actaaactttacc

SEQ ID NO: 2536639 - DNA, 16 bp, Homo sapiens
actaaactttcacacc

SEQ ID NO: 2536640 - DNA, 16 bp, Homo sapiens
actaaagagagaatgt

SEQ ID NO: 2536641 - DNA, 14 bp, Homo sapiens
actaaatctctaat

SEQ ID NO: 2536642 - DNA, 17 bp, Homo sapiens
actaaatctctaatatg

SEQ ID NO: 2536643 - DNA, 18 bp, Homo sapiens
actaaattgtaaactcct

SEQ ID NO: 2536644 - DNA, 13 bp, Homo sapiens
actaacagataag

SEQ ID NO: 2536645 - DNA, 17 bp, Homo sapiens
actaacagataagcaag

SEQ ID NO: 2536646 - DNA, 17 bp, Homo sapiens
actaacaggatatttaa

SEQ ID NO: 2536647 - DNA, 17 bp, Homo sapiens
actaaccagcagaaatg

SEQ ID NO: 2536648 - DNA, 14 bp, Homo sapiens
actaaccccgggcg

SEQ ID NO: 2536649 - DNA, 13 bp, Homo sapiens
actaacctgaccg

SEQ ID NO: 2536650 - DNA, 13 bp, Homo sapiens
actaactagagca

SEQ ID NO: 2536651 - DNA, 19 bp, Homo sapiens
actaagatgacattgctaa

SEQ ID NO: 2536652 - DNA, 16 bp, Homo sapiens
actaagccctgtcgag

SEQ ID NO: 2536653 - DNA, 22 bp, Homo sapiens
actaagccctgtcgagacactt

SEQ ID NO: 2536654 - DNA, 20 bp, Homo sapiens
actaaggagtaatctgtgta

SEQ ID NO: 2536655 - DNA, 17 bp, Homo sapiens
actaagttatagtatat

SEQ ID NO: 2536656 - DNA, 19 bp, Homo sapiens
actaatattttatgtgaga

SEQ ID NO: 2536657 - DNA, 18 bp, Homo sapiens
actaatctattgggttca

SEQ ID NO: 2536658 - DNA, 19 bp, Homo sapiens
actaatctgggaagggaag

SEQ ID NO: 2536659 - DNA, 14 bp, Homo sapiens
actaatctttctgc

SEQ ID NO: 2536660 - DNA, 13 bp, Homo sapiens
actaatgatgttt

SEQ ID NO: 2536661 - DNA, 24 bp, Homo sapiens
actaatgccttactcttcttgaaa

SEQ ID NO: 2536662 - DNA, 17 bp, Homo sapiens
actaattgtataacagg

SEQ ID NO: 2536663 - DNA, 16 bp, Homo sapiens
actacaaaatttgaaa

SEQ ID NO: 2536664 - DNA, 18 bp, Homo sapiens
actacaaaatttgaaatt

SEQ ID NO: 2536665 - DNA, 20 bp, Homo sapiens
actacacagtctgcaagatt

SEQ ID NO: 2536666 - DNA, 18 bp, Homo sapiens
actacactccagcctgag

SEQ ID NO: 2536667 - DNA, 15 bp, Homo sapiens
actacagtcaggaaa

SEQ ID NO: 2536668 - DNA, 15 bp, Homo sapiens
actacagtcctccca

SEQ ID NO: 2536669 - DNA, 17 bp, Homo sapiens
actacataaactgactt

SEQ ID NO: 2536670 - DNA, 20 bp, Homo sapiens
actacatgcagcccatgccc

SEQ ID NO: 2536671 - DNA, 15 bp, Homo sapiens
actacatgtggttta

SEQ ID NO: 2536672 - DNA, 18 bp, Homo sapiens
actacggaatagttggct

SEQ ID NO: 2536673 - DNA, 17 bp, Homo sapiens
actactcccccaggtgg

SEQ ID NO: 2536674 - DNA, 18 bp, Homo sapiens
actactgtggaaaaatat

SEQ ID NO: 2536675 - DNA, 20 bp, Homo sapiens
actactgtggaaaaatattt

SEQ ID NO: 2536676 - DNA, 13 bp, Homo sapiens
actactgtgttcc

SEQ ID NO: 2536677 - DNA, 16 bp, Homo sapiens
actactgtgttcctgg

SEQ ID NO: 2536678 - DNA, 18 bp, Homo sapiens
actactgtgttcctggca

SEQ ID NO: 2536679 - DNA, 23 bp, Homo sapiens
actagaacctggagggctagaac

SEQ ID NO: 2536680 - DNA, 15 bp, Homo sapiens
actagaactctccat

SEQ ID NO: 2536681 - DNA, 18 bp, Homo sapiens
actagaagatgaatacaa

SEQ ID NO: 2536682 - DNA, 16 bp, Homo sapiens
actagacattctgtcg

SEQ ID NO: 2536683 - DNA, 16 bp, Homo sapiens
actagaggcagggagg

SEQ ID NO: 2536684 - DNA, 20 bp, Homo sapiens
actagagggacctctcccag

SEQ ID NO: 2536685 - DNA, 16 bp, Homo sapiens
actagccaccaactct

SEQ ID NO: 2536686 - DNA, 17 bp, Homo sapiens
actagcccaatgaaatg

SEQ ID NO: 2536687 - DNA, 14 bp, Homo sapiens
actaggctcagaga

SEQ ID NO: 2536688 - DNA, 16 bp, Homo sapiens
actagggatccctcat

SEQ ID NO: 2536689 - DNA, 16 bp, Homo sapiens
actagggattcaggct

SEQ ID NO: 2536690 - DNA, 16 bp, Homo sapiens
actagggccaagccca

SEQ ID NO: 2536691 - DNA, 22 bp, Homo sapiens
actaggggatataggagaggaa

SEQ ID NO: 2536692 - DNA, 16 bp, Homo sapiens
actagtgaggaaagat

SEQ ID NO: 2536693 - DNA, 22 bp, Homo sapiens
actagttacacatcttcaacag

SEQ ID NO: 2536694 - DNA, 17 bp, Homo sapiens
actagttgtgaccttag

SEQ ID NO: 2536695 - DNA, 20 bp, Homo sapiens
actataaagaagtaacaaaa

SEQ ID NO: 2536696 - DNA, 11 bp, Homo sapiens
actataatgta

SEQ ID NO: 2536697 - DNA, 18 bp, Homo sapiens
actgctcaagaagacatg

SEQ ID NO: 2536698 - DNA, 21 bp, Homo sapiens
actgctccccagccctggctc

SEQ ID NO: 2536699 - DNA, 11 bp, Homo sapiens
actgctgcaag

SEQ ID NO: 2536700 - DNA, 18 bp, Homo sapiens
actgctgcaaggcctttc

SEQ ID NO: 2536701 - DNA, 17 bp, Homo sapiens
actgctgctagagccag

SEQ ID NO: 2536702 - DNA, 14 bp, Homo sapiens
actgctgcttctcc

SEQ ID NO: 2536703 - DNA, 13 bp, Homo sapiens
actgctgggactg

SEQ ID NO: 2536704 - DNA, 19 bp, Homo sapiens
actgctgggactggccagg

SEQ ID NO: 2536705 - DNA, 18 bp, Homo sapiens
actgcttccagtgaggct

SEQ ID NO: 2536706 - DNA, 16 bp, Homo sapiens
actgcttgtgttttta

SEQ ID NO: 2536707 - DNA, 13 bp, Homo sapiens
actgcttgtttcc

SEQ ID NO: 2536708 - DNA, 17 bp, Homo sapiens
actggaagcacagcttc

SEQ ID NO: 2536709 - DNA, 19 bp, Homo sapiens
actggaagcacagcttcat

SEQ ID NO: 2536710 - DNA, 18 bp, Homo sapiens
actggaaggggaagggac

SEQ ID NO: 2536711 - DNA, 18 bp, Homo sapiens
actggaaggtggggacag

SEQ ID NO: 2536712 - DNA, 20 bp, Homo sapiens
actggaccactgggcaatga

SEQ ID NO: 2536713 - DNA, 14 bp, Homo sapiens
actggactcaggat

SEQ ID NO: 2536714 - DNA, 20 bp, Homo sapiens
actggactcaggatgcccag

SEQ ID NO: 2536715 - DNA, 23 bp, Homo sapiens
actggactcaggatgcccagggc

SEQ ID NO: 2536716 - DNA, 19 bp, Homo sapiens
actggactccggccctcct

SEQ ID NO: 2536717 - DNA, 17 bp, Homo sapiens
actggagaggctagaac

SEQ ID NO: 2536718 - DNA, 13 bp, Homo sapiens
actggagcatctg

SEQ ID NO: 2536719 - DNA, 14 bp, Homo sapiens
actggagcatctga

SEQ ID NO: 2536720 - DNA, 16 bp, Homo sapiens
actggagcatctgact

SEQ ID NO: 2536721 - DNA, 12 bp, Homo sapiens
actggagcccag

SEQ ID NO: 2536722 - DNA, 11 bp, Homo sapiens
actggagcccc

SEQ ID NO: 2536723 - DNA, 16 bp, Homo sapiens
actggaggagagaaga

SEQ ID NO: 2536724 - DNA, 17 bp, Homo sapiens
actggaggagagaagaa

SEQ ID NO: 2536725 - DNA, 19 bp, Homo sapiens
actggaggtcacattcagg

SEQ ID NO: 2536726 - DNA, 14 bp, Homo sapiens
actggagtggagca

SEQ ID NO: 2536727 - DNA, 14 bp, Homo sapiens
actggagttacatt

SEQ ID NO: 2536728 - DNA, 17 bp, Homo sapiens
actggagttacattaat

SEQ ID NO: 2536729 - DNA, 15 bp, Homo sapiens
actggagttctatgc

SEQ ID NO: 2536730 - DNA, 19 bp, Homo sapiens
actggagttctatgctctc

SEQ ID NO: 2536731 - DNA, 18 bp, Homo sapiens
actggatactgcccgggg

SEQ ID NO: 2536732 - DNA, 22 bp, Homo sapiens
actggatgaaataactccttct

SEQ ID NO: 2536733 - DNA, 14 bp, Homo sapiens
actggatgaagatt

SEQ ID NO: 2536734 - DNA, 22 bp, Homo sapiens
actggattaaacttaatctaaa

SEQ ID NO: 2536735 - DNA, 16 bp, Homo sapiens
actggcaaacttcaga

SEQ ID NO: 2536736 - DNA, 20 bp, Homo sapiens
actggcaaacttcagactga

SEQ ID NO: 2536737 - DNA, 19 bp, Homo sapiens
actggcacagttttctgag

SEQ ID NO: 2536738 - DNA, 20 bp, Homo sapiens
actggcacagttttctgaga

SEQ ID NO: 2536739 - DNA, 22 bp, Homo sapiens
actggcagttttccattggttt

SEQ ID NO: 2536740 - DNA, 16 bp, Homo sapiens
actggccaccaggctg

SEQ ID NO: 2536741 - DNA, 19 bp, Homo sapiens
actggccaccaggctggcg

SEQ ID NO: 2536742 - DNA, 14 bp, Homo sapiens
actggccatctcca

SEQ ID NO: 2536743 - DNA, 15 bp, Homo sapiens
actggcccctgggtc

SEQ ID NO: 2536744 - DNA, 17 bp, Homo sapiens
actggctctccaagtgc

SEQ ID NO: 2536745 - DNA, 21 bp, Homo sapiens
actggctctccaagtgccaga

SEQ ID NO: 2536746 - DNA, 22 bp, Homo sapiens
actggctctccaagtgccagag

SEQ ID NO: 2536747 - DNA, 14 bp, Homo sapiens
actggctctctcca

SEQ ID NO: 2536748 - DNA, 16 bp, Homo sapiens
actggctggctgcagt

SEQ ID NO: 2536749 - DNA, 17 bp, Homo sapiens
actggctgtcagtatga

SEQ ID NO: 2536750 - DNA, 21 bp, Homo sapiens
actggctgtcagtatgacatt

SEQ ID NO: 2536751 - DNA, 18 bp, Homo sapiens
actgggcaatgatggcaa

SEQ ID NO: 2536752 - DNA, 17 bp, Homo sapiens
actgggctgagggagcc

SEQ ID NO: 2536753 - DNA, 16 bp, Homo sapiens
actggggatgtgggag

SEQ ID NO: 2536754 - DNA, 18 bp, Homo sapiens
actggggatgtgggaggg

SEQ ID NO: 2536755 - DNA, 16 bp, Homo sapiens
actggggctggcacaa

SEQ ID NO: 2536756 - DNA, 20 bp, Homo sapiens
actggggtcctggggcctcg

SEQ ID NO: 2536757 - DNA, 15 bp, Homo sapiens
actggggtgccgcct

SEQ ID NO: 2536758 - DNA, 19 bp, Homo sapiens
actggggtgccgcctgccc

SEQ ID NO: 2536759 - DNA, 18 bp, Homo sapiens
actgggtacttgtggaca

SEQ ID NO: 2536760 - DNA, 23 bp, Homo sapiens
actgggtacttgtggacacagct

SEQ ID NO: 2536761 - DNA, 22 bp, Homo sapiens
actgggtggggtgaggaccact

SEQ ID NO: 2536762 - DNA, 16 bp, Homo sapiens
actgggtttggacccc

SEQ ID NO: 2536763 - DNA, 21 bp, Homo sapiens
actgggtttggaccccagctg

SEQ ID NO: 2536764 - DNA, 14 bp, Homo sapiens
actggtcctgtgtg

SEQ ID NO: 2536765 - DNA, 12 bp, Homo sapiens
actggtgactgc

SEQ ID NO: 2536766 - DNA, 14 bp, Homo sapiens
actggtgtgacctg

SEQ ID NO: 2536767 - DNA, 17 bp, Homo sapiens
actggtgtgacctgagg

SEQ ID NO: 2536768 - DNA, 20 bp, Homo sapiens
actggttgttgccaaacagc

SEQ ID NO: 2536769 - DNA, 16 bp, Homo sapiens
actgtaaaatgaaatt

SEQ ID NO: 2536770 - DNA, 12 bp, Homo sapiens
actgtaatttag

SEQ ID NO: 2536771 - DNA, 14 bp, Homo sapiens
actgtacaaagtag

SEQ ID NO: 2536772 - DNA, 15 bp, Homo sapiens
actgtacaaagtaga

SEQ ID NO: 2536773 - DNA, 22 bp, Homo sapiens
actgtacaaagtagaagtctta

SEQ ID NO: 2536774 - DNA, 13 bp, Homo sapiens
actgtacatgaaa

SEQ ID NO: 2536775 - DNA, 23 bp, Homo sapiens
actgtacatgaaaacacattttt

SEQ ID NO: 2536776 - DNA, 15 bp, Homo sapiens
actgtagaaatgatg

SEQ ID NO: 2536777 - DNA, 15 bp, Homo sapiens
actgtataaatagga

SEQ ID NO: 2536778 - DNA, 22 bp, Homo sapiens
actgtataaataggagaggatg

SEQ ID NO: 2536779 - DNA, 14 bp, Homo sapiens
actgtatcatgaca

SEQ ID NO: 2536780 - DNA, 13 bp, Homo sapiens
actgtatttgtat

SEQ ID NO: 2536781 - DNA, 13 bp, Homo sapiens
actgtatttgtga

SEQ ID NO: 2536782 - DNA, 16 bp, Homo sapiens
actgtatttgtgacta

SEQ ID NO: 2536783 - DNA, 15 bp, Homo sapiens
actgtcactgtttct

SEQ ID NO: 2536784 - DNA, 15 bp, Homo sapiens
actgtcactttgctc

SEQ ID NO: 2536785 - DNA, 16 bp, Homo sapiens
actgtcagccgggccc

SEQ ID NO: 2536786 - DNA, 18 bp, Homo sapiens
actgtcagccgggccctg

SEQ ID NO: 2536787 - DNA, 14 bp, Homo sapiens
actgtccagagagc

SEQ ID NO: 2536788 - DNA, 15 bp, Homo sapiens
actgtccagagagca

SEQ ID NO: 2536789 - DNA, 16 bp, Homo sapiens
actgtcctccaagcca

SEQ ID NO: 2536790 - DNA, 18 bp, Homo sapiens
actgtcctccaagccagc

SEQ ID NO: 2536791 - DNA, 20 bp, Homo sapiens
actgtcctgggcgccctgga

SEQ ID NO: 2536792 - DNA, 22 bp, Homo sapiens
actgtcctgggcgccctggaag

SEQ ID NO: 2536793 - DNA, 22 bp, Homo sapiens
actgtctccatggccctgcaaa

SEQ ID NO: 2536794 - DNA, 15 bp, Homo sapiens
actgtctgagagttt

SEQ ID NO: 2536795 - DNA, 17 bp, Homo sapiens
actgtctggttttaaca

SEQ ID NO: 2536796 - DNA, 12 bp, Homo sapiens
actgtctttcag

SEQ ID NO: 2536797 - DNA, 16 bp, Homo sapiens
actgtgacaggcagca

SEQ ID NO: 2536798 - DNA, 17 bp, Homo sapiens
actgtgacaggcagcag

SEQ ID NO: 2536799 - DNA, 12 bp, Homo sapiens
actgtgacctgt

SEQ ID NO: 2536800 - DNA, 23 bp, Homo sapiens
actgtgatcaggctatgtatgga

SEQ ID NO: 2536801 - DNA, 22 bp, Homo sapiens
actgtgatgccacacagagtgg

SEQ ID NO: 2536802 - DNA, 15 bp, Homo sapiens
actgtgcacatctgt

SEQ ID NO: 2536803 - DNA, 14 bp, Homo sapiens
actgtgctcagggc

SEQ ID NO: 2536804 - DNA, 22 bp, Homo sapiens
actgtgctgagtctgaaggctg

SEQ ID NO: 2536805 - DNA, 21 bp, Homo sapiens
actgtgctggagccactaact

SEQ ID NO: 2536806 - DNA, 14 bp, Homo sapiens
actgtggaaaaata

SEQ ID NO: 2536807 - DNA, 19 bp, Homo sapiens
actgtggaaaaatatttaa

SEQ ID NO: 2536808 - DNA, 12 bp, Homo sapiens
actgtggaggaa

SEQ ID NO: 2536809 - DNA, 17 bp, Homo sapiens
actgtggaggaaggatt

SEQ ID NO: 2536810 - DNA, 12 bp, Homo sapiens
actgtgtacata

SEQ ID NO: 2536811 - DNA, 16 bp, Homo sapiens
actgtgtacataactg

SEQ ID NO: 2536812 - DNA, 18 bp, Homo sapiens
actgtgtacataactgaa

SEQ ID NO: 2536813 - DNA, 15 bp, Homo sapiens
actgtgtattccaag

SEQ ID NO: 2536814 - DNA, 16 bp, Homo sapiens
actgtgtattccaaga

SEQ ID NO: 2536815 - DNA, 21 bp, Homo sapiens
actgttacctgatcaatgaca

SEQ ID NO: 2536816 - DNA, 14 bp, Homo sapiens
actgttccagcctg

SEQ ID NO: 2536817 - DNA, 16 bp, Homo sapiens
actgttccccctgtgc

SEQ ID NO: 2536818 - DNA, 15 bp, Homo sapiens
actgttccctctgct

SEQ ID NO: 2536819 - DNA, 16 bp, Homo sapiens
actgttctctgccctc

SEQ ID NO: 2536820 - DNA, 21 bp, Homo sapiens
actgttgaaaattattttaaa

SEQ ID NO: 2536821 - DNA, 12 bp, Homo sapiens
actgttgtataa

SEQ ID NO: 2536822 - DNA, 19 bp, Homo sapiens
actgttgtataaatttatt

SEQ ID NO: 2536823 - DNA, 16 bp, Homo sapiens
actgttgtgacctgaa

SEQ ID NO: 2536824 - DNA, 12 bp, Homo sapiens
actgtttctctg

SEQ ID NO: 2536825 - DNA, 15 bp, Homo sapiens
actgtttctctgctg

SEQ ID NO: 2536826 - DNA, 14 bp, Homo sapiens
actgtttctgtcag

SEQ ID NO: 2536827 - DNA, 15 bp, Homo sapiens
actgtttctgtcagg

SEQ ID NO: 2536828 - DNA, 23 bp, Homo sapiens
actgtttgaggtttttaagcctt

SEQ ID NO: 2536829 - DNA, 19 bp, Homo sapiens
actgtttgtcttctcccca

SEQ ID NO: 2536830 - DNA, 12 bp, Homo sapiens
actgtttgttat

SEQ ID NO: 2536831 - DNA, 22 bp, Homo sapiens
actgttttctctcggctcccca

SEQ ID NO: 2536832 - DNA, 23 bp, Homo sapiens
actgttttctctcggctccccat

SEQ ID NO: 2536833 - DNA, 13 bp, Homo sapiens
actgtttttaccc

SEQ ID NO: 2536834 - DNA, 14 bp, Homo sapiens
actgttttttcctg

SEQ ID NO: 2536835 - DNA, 19 bp, Homo sapiens
actgttttttcctgagctt

SEQ ID NO: 2536836 - DNA, 15 bp, Homo sapiens
acttaaaaaaatgac

SEQ ID NO: 2536837 - DNA, 16 bp, Homo sapiens
acttaaaaaaatgaca

SEQ ID NO: 2536838 - DNA, 23 bp, Homo sapiens
acttaaaaaacttgtaaatgctg

SEQ ID NO: 2536839 - DNA, 16 bp, Homo sapiens
acttaaaaatgtaaat

SEQ ID NO: 2536840 - DNA, 23 bp, Homo sapiens
acttaaaaatgtaaatattctat

SEQ ID NO: 2536841 - DNA, 22 bp, Homo sapiens
acttaaaatattcctgcatttg

SEQ ID NO: 2536842 - DNA, 11 bp, Homo sapiens
acttaaagatt

SEQ ID NO: 2536843 - DNA, 18 bp, Homo sapiens
agacaaatggaggaatat

SEQ ID NO: 2536844 - DNA, 14 bp, Homo sapiens
agacaacagaagtc

SEQ ID NO: 2536845 - DNA, 13 bp, Homo sapiens
agacaagaaatcc

SEQ ID NO: 2536846 - DNA, 17 bp, Homo sapiens
agacaagaaatccctgt

SEQ ID NO: 2536847 - DNA, 19 bp, Homo sapiens
agacaatgacttactgtac

SEQ ID NO: 2536848 - DNA, 20 bp, Homo sapiens
agacaatgacttactgtaca

SEQ ID NO: 2536849 - DNA, 20 bp, Homo sapiens
agacaatgtgaaaagaaaaa

SEQ ID NO: 2536850 - DNA, 21 bp, Homo sapiens
agacaatttattatggcacat

SEQ ID NO: 2536851 - DNA, 18 bp, Homo sapiens
agacacaacaactcctag

SEQ ID NO: 2536852 - DNA, 19 bp, Homo sapiens
agacacaacaactcctagg

SEQ ID NO: 2536853 - DNA, 10 bp, Homo sapiens
agacacacac

SEQ ID NO: 2536854 - DNA, 12 bp, Homo sapiens
agacacacacac

SEQ ID NO: 2536855 - DNA, 13 bp, Homo sapiens
agacacacacaca

SEQ ID NO: 2536856 - DNA, 14 bp, Homo sapiens
agacacacacacgc

SEQ ID NO: 2536857 - DNA, 15 bp, Homo sapiens
agacacacacacgca

SEQ ID NO: 2536858 - DNA, 16 bp, Homo sapiens
agacacacacacgcac

SEQ ID NO: 2536859 - DNA, 18 bp, Homo sapiens
agacacacacacgcacgc

SEQ ID NO: 2536860 - DNA, 20 bp, Homo sapiens
agacacacacacgcacgcac

SEQ ID NO: 2536861 - DNA, 21 bp, Homo sapiens
agacacacacacgcacgcaca

SEQ ID NO: 2536862 - DNA, 23 bp, Homo sapiens
agacacacacacgcacgcacaca

SEQ ID NO: 2536863 - DNA, 16 bp, Homo sapiens
agacacaggcccggct

SEQ ID NO: 2536864 - DNA, 23 bp, Homo sapiens
agacacaggcccggctccaggct

SEQ ID NO: 2536865 - DNA, 22 bp, Homo sapiens
agacacatgtccaagaagccca

SEQ ID NO: 2536866 - DNA, 24 bp, Homo sapiens
agacacatgtccaagaagcccagg

SEQ ID NO: 2536867 - DNA, 20 bp, Homo sapiens
agacaccagagcagatgcag

SEQ ID NO: 2536868 - DNA, 17 bp, Homo sapiens
agacaccttgacagggc

SEQ ID NO: 2536869 - DNA, 22 bp, Homo sapiens
agacaccttgacagggcacacc

SEQ ID NO: 2536870 - DNA, 16 bp, Homo sapiens
agacacgctcttctat

SEQ ID NO: 2536871 - DNA, 13 bp, Homo sapiens
agacactgaaata

SEQ ID NO: 2536872 - DNA, 13 bp, Homo sapiens
agacactggcccc

SEQ ID NO: 2536873 - DNA, 22 bp, Homo sapiens
agacactgtttacaagaaaaaa

SEQ ID NO: 2536874 - DNA, 17 bp, Homo sapiens
agacagaaccttgttat

SEQ ID NO: 2536875 - DNA, 15 bp, Homo sapiens
agacagaagcaggct

SEQ ID NO: 2536876 - DNA, 15 bp, Homo sapiens
agacagacacacaca

SEQ ID NO: 2536877 - DNA, 20 bp, Homo sapiens
agacagagtctcactgttgc

SEQ ID NO: 2536878 - DNA, 12 bp, Homo sapiens
agacagcagctc

SEQ ID NO: 2536879 - DNA, 11 bp, Homo sapiens
agacagcctgt

SEQ ID NO: 2536880 - DNA, 15 bp, Homo sapiens
agacagctccctctg

SEQ ID NO: 2536881 - DNA, 19 bp, Homo sapiens
agacagctccctctgcctg

SEQ ID NO: 2536882 - DNA, 16 bp, Homo sapiens
agacaggaccagggat

SEQ ID NO: 2536883 - DNA, 14 bp, Homo sapiens
agacaggagggcaa

SEQ ID NO: 2536884 - DNA, 20 bp, Homo sapiens
agacaggcaagcacctcctg

SEQ ID NO: 2536885 - DNA, 17 bp, Homo sapiens
agacagtatacagtcct

SEQ ID NO: 2536886 - DNA, 15 bp, Homo sapiens
agacagtatatttat

SEQ ID NO: 2536887 - DNA, 18 bp, Homo sapiens
agacagtatatttatagt

SEQ ID NO: 2536888 - DNA, 16 bp, Homo sapiens
agacagtccctgccaa

SEQ ID NO: 2536889 - DNA, 12 bp, Homo sapiens
agacagtgatct

SEQ ID NO: 2536890 - DNA, 18 bp, Homo sapiens
agacagtgatctccatat

SEQ ID NO: 2536891 - DNA, 20 bp, Homo sapiens
agacagtgatctccatatgt

SEQ ID NO: 2536892 - DNA, 15 bp, Homo sapiens
agacagttcaagaaa

SEQ ID NO: 2536893 - DNA, 20 bp, Homo sapiens
agacagtttcttagcttttt

SEQ ID NO: 2536894 - DNA, 17 bp, Homo sapiens
agacataacgtttttcc

SEQ ID NO: 2536895 - DNA, 19 bp, Homo sapiens
agacatactaaccagcaga

SEQ ID NO: 2536896 - DNA, 21 bp, Homo sapiens
agacatagaattaacacatga

SEQ ID NO: 2536897 - DNA, 18 bp, Homo sapiens
agacatcaacagataaat

SEQ ID NO: 2536898 - DNA, 20 bp, Homo sapiens
agacatcaagcacagaagga

SEQ ID NO: 2536899 - DNA, 15 bp, Homo sapiens
agacatccataaaga

SEQ ID NO: 2536900 - DNA, 18 bp, Homo sapiens
agacatccataaagaagc

SEQ ID NO: 2536901 - DNA, 22 bp, Homo sapiens
agacatccataaagaagcaata

SEQ ID NO: 2536902 - DNA, 14 bp, Homo sapiens
agacatctctgcac

SEQ ID NO: 2536903 - DNA, 17 bp, Homo sapiens
agacatgaatatgatta

SEQ ID NO: 2536904 - DNA, 15 bp, Homo sapiens
agacatgctgacttt

SEQ ID NO: 2536905 - DNA, 16 bp, Homo sapiens
agacatggggaggaag

SEQ ID NO: 2536906 - DNA, 18 bp, Homo sapiens
agacatgtctgttctaca

SEQ ID NO: 2536907 - DNA, 17 bp, Homo sapiens
agacatgttttagacaa

SEQ ID NO: 2536908 - DNA, 23 bp, Homo sapiens
agacatgttttagacaaatactc

SEQ ID NO: 2536909 - DNA, 13 bp, Homo sapiens
agacattgtcaat

SEQ ID NO: 2536910 - DNA, 17 bp, Homo sapiens
agaccaagactctgaaa

SEQ ID NO: 2536911 - DNA, 16 bp, Homo sapiens
agaccaagcttgtcca

SEQ ID NO: 2536912 - DNA, 21 bp, Homo sapiens
agaccacagggttcaaaatgt

SEQ ID NO: 2536913 - DNA, 22 bp, Homo sapiens
agaccagactgtggagaaataa

SEQ ID NO: 2536914 - DNA, 12 bp, Homo sapiens
agaccagctctt

SEQ ID NO: 2536915 - DNA, 13 bp, Homo sapiens
agaccagttggga

SEQ ID NO: 2536916 - DNA, 15 bp, Homo sapiens
agaccatagtgacca

SEQ ID NO: 2536917 - DNA, 13 bp, Homo sapiens
agaccatccctga

SEQ ID NO: 2536918 - DNA, 18 bp, Homo sapiens
agaccatccctgaaggcc

SEQ ID NO: 2536919 - DNA, 23 bp, Homo sapiens
agaccatccctgaaggccccgcc

SEQ ID NO: 2536920 - DNA, 15 bp, Homo sapiens
agacccattcctatt

SEQ ID NO: 2536921 - DNA, 16 bp, Homo sapiens
agacccattcctattt

SEQ ID NO: 2536922 - DNA, 12 bp, Homo sapiens
agaccccaccca

SEQ ID NO: 2536923 - DNA, 14 bp, Homo sapiens
agacccccacacct

SEQ ID NO: 2536924 - DNA, 12 bp, Homo sapiens
agacccccaccc

SEQ ID NO: 2536925 - DNA, 16 bp, Homo sapiens
agacccccaccccttc

SEQ ID NO: 2536926 - DNA, 17 bp, Homo sapiens
agacccccaccccttcc

SEQ ID NO: 2536927 - DNA, 14 bp, Homo sapiens
agacccctctggcc

SEQ ID NO: 2536928 - DNA, 17 bp, Homo sapiens
agacccctctggccagg

SEQ ID NO: 2536929 - DNA, 21 bp, Homo sapiens
agacccctctggccaggatgg

SEQ ID NO: 2536930 - DNA, 13 bp, Homo sapiens
agacccctggcct

SEQ ID NO: 2536931 - DNA, 14 bp, Homo sapiens
agaccctcgtggcc

SEQ ID NO: 2536932 - DNA, 12 bp, Homo sapiens
agaccctgccct

SEQ ID NO: 2536933 - DNA, 14 bp, Homo sapiens
agaccctgccctgt

SEQ ID NO: 2536934 - DNA, 21 bp, Homo sapiens
agaccctgccctgtgggcccc

SEQ ID NO: 2536935 - DNA, 23 bp, Homo sapiens
agaccctgccctgtgggccccca

SEQ ID NO: 2536936 - DNA, 13 bp, Homo sapiens
agaccctgtctct

SEQ ID NO: 2536937 - DNA, 15 bp, Homo sapiens
agacccttgtggtcc

SEQ ID NO: 2536938 - DNA, 19 bp, Homo sapiens
agacccttgtggtcccacc

SEQ ID NO: 2536939 - DNA, 19 bp, Homo sapiens
agacctacctcaggttgct

SEQ ID NO: 2536940 - DNA, 15 bp, Homo sapiens
agacctagggaggac

SEQ ID NO: 2536941 - DNA, 19 bp, Homo sapiens
agacctattcctcctgggc

SEQ ID NO: 2536942 - DNA, 13 bp, Homo sapiens
agacctcagcctg

SEQ ID NO: 2536943 - DNA, 15 bp, Homo sapiens
agacctcagcctgtg

SEQ ID NO: 2536944 - DNA, 17 bp, Homo sapiens
agacctcagcctgtgct

SEQ ID NO: 2536945 - DNA, 16 bp, Homo sapiens
agacctggagcccctg

SEQ ID NO: 2536946 - DNA, 20 bp, Homo sapiens
agacctggagcccctgggtg

SEQ ID NO: 2536947 - DNA, 15 bp, Homo sapiens
agacctgtcctcctg

SEQ ID NO: 2536948 - DNA, 17 bp, Homo sapiens
agacctgtcctcctggt

SEQ ID NO: 2536949 - DNA, 21 bp, Homo sapiens
agacctgttggttccaagccc

SEQ ID NO: 2536950 - DNA, 23 bp, Homo sapiens
agaccttccataatgctactgtc

SEQ ID NO: 2536951 - DNA, 18 bp, Homo sapiens
agaccttctaggacgcca

SEQ ID NO: 2536952 - DNA, 18 bp, Homo sapiens
agaccttctccaaatgag

SEQ ID NO: 2536953 - DNA, 19 bp, Homo sapiens
agaccttctccaaatgaga

SEQ ID NO: 2536954 - DNA, 23 bp, Homo sapiens
agaccttctccttcacctttgtc

SEQ ID NO: 2536955 - DNA, 23 bp, Homo sapiens
agaccttggatcagatgaactct

SEQ ID NO: 2536956 - DNA, 21 bp, Homo sapiens
agaccttgttcacactctcac

SEQ ID NO: 2536957 - DNA, 17 bp, Homo sapiens
agaccttttcaacttgg

SEQ ID NO: 2536958 - DNA, 13 bp, Homo sapiens
agacgaggccctc

SEQ ID NO: 2536959 - DNA, 15 bp, Homo sapiens
agacgcctgagctca

SEQ ID NO: 2536960 - DNA, 15 bp, Homo sapiens
agacgcctgaggaac

SEQ ID NO: 2536961 - DNA, 18 bp, Homo sapiens
agacgctgtgctgccctg

SEQ ID NO: 2536962 - DNA, 19 bp, Homo sapiens
agacgctgtgctgccctgc

SEQ ID NO: 2536963 - DNA, 15 bp, Homo sapiens
agacggagtctcgct

SEQ ID NO: 2536964 - DNA, 13 bp, Homo sapiens
agacgtgtacata

SEQ ID NO: 2536965 - DNA, 15 bp, Homo sapiens
agactaagccctgtc

SEQ ID NO: 2536966 - DNA, 23 bp, Homo sapiens
agactaagccctgtcgagacact

SEQ ID NO: 2536967 - DNA, 17 bp, Homo sapiens
agactatattgtacaca

SEQ ID NO: 2536968 - DNA, 19 bp, Homo sapiens
agactatctaaatgttgaa

SEQ ID NO: 2536969 - DNA, 16 bp, Homo sapiens
agactattcaaacagt

SEQ ID NO: 2536970 - DNA, 18 bp, Homo sapiens
agactattcaaacagtct

SEQ ID NO: 2536971 - DNA, 13 bp, Homo sapiens
agactcaaatgct

SEQ ID NO: 2536972 - DNA, 22 bp, Homo sapiens
agactcaaggttcccagagatg

SEQ ID NO: 2536973 - DNA, 18 bp, Homo sapiens
agactcagggccccagca

SEQ ID NO: 2536974 - DNA, 22 bp, Homo sapiens
agactcaggttgtagtaaagaa

SEQ ID NO: 2536975 - DNA, 16 bp, Homo sapiens
agactcagtttgtcag

SEQ ID NO: 2536976 - DNA, 15 bp, Homo sapiens
agactcattcttctg

SEQ ID NO: 2536977 - DNA, 14 bp, Homo sapiens
agactccaaagaaa

SEQ ID NO: 2536978 - DNA, 18 bp, Homo sapiens
agactccgtctcaaggaa

SEQ ID NO: 2536979 - DNA, 11 bp, Homo sapiens
agactcctagg

SEQ ID NO: 2536980 - DNA, 14 bp, Homo sapiens
agactcctcctcca

SEQ ID NO: 2536981 - DNA, 20 bp, Homo sapiens
agactcctgaggacagctgt

SEQ ID NO: 2536982 - DNA, 13 bp, Homo sapiens
agactcctgcagg

SEQ ID NO: 2536983 - DNA, 14 bp, Homo sapiens
agactcctgcaggc

SEQ ID NO: 2536984 - DNA, 16 bp, Homo sapiens
agactcctgcaggcag

SEQ ID NO: 2536985 - DNA, 16 bp, Homo sapiens
agactcctgccctgtt

SEQ ID NO: 2536986 - DNA, 19 bp, Homo sapiens
agactctacagaggccatg

SEQ ID NO: 2536987 - DNA, 16 bp, Homo sapiens
agactctgaaatctca

SEQ ID NO: 2536988 - DNA, 16 bp, Homo sapiens
agactctttggacact

SEQ ID NO: 2536989 - DNA, 19 bp, Homo sapiens
agatatatgctctgcatgt

SEQ ID NO: 2536990 - DNA, 23 bp, Homo sapiens
agatatatttttaagataataat

SEQ ID NO: 2536991 - DNA, 14 bp, Homo sapiens
agatatatttttca

SEQ ID NO: 2536992 - DNA, 17 bp, Homo sapiens
agatatctgagggagga

SEQ ID NO: 2536993 - DNA, 17 bp, Homo sapiens
agatatcttgaaatgaa

SEQ ID NO: 2536994 - DNA, 17 bp, Homo sapiens
agatatgggacattttt

SEQ ID NO: 2536995 - DNA, 17 bp, Homo sapiens
agatatttatattttta

SEQ ID NO: 2536996 - DNA, 19 bp, Homo sapiens
agatatttttatctttata

SEQ ID NO: 2536997 - DNA, 12 bp, Homo sapiens
agatatttttca

SEQ ID NO: 2536998 - DNA, 16 bp, Homo sapiens
agatatttttcatgat

SEQ ID NO: 2536999 - DNA, 18 bp, Homo sapiens
agatattttttcagaaat

SEQ ID NO: 2537000 - DNA, 22 bp, Homo sapiens
agatattttttcagaaatatgt

SEQ ID NO: 2537001 - DNA, 14 bp, Homo sapiens
agatcaaaataaaa

SEQ ID NO: 2537002 - DNA, 17 bp, Homo sapiens
agatcaaaataaaaagt

SEQ ID NO: 2537003 - DNA, 13 bp, Homo sapiens
agatcaaatactt

SEQ ID NO: 2537004 - DNA, 12 bp, Homo sapiens
agatcaagctgt

SEQ ID NO: 2537005 - DNA, 14 bp, Homo sapiens
agatcaatttgtaa

SEQ ID NO: 2537006 - DNA, 14 bp, Homo sapiens
agatcaccagcccg

SEQ ID NO: 2537007 - DNA, 15 bp, Homo sapiens
agatcactactgcag

SEQ ID NO: 2537008 - DNA, 18 bp, Homo sapiens
agatcactttctcagttt

SEQ ID NO: 2537009 - DNA, 17 bp, Homo sapiens
agatcagagcagcagtg

SEQ ID NO: 2537010 - DNA, 15 bp, Homo sapiens
agatcagcctgggca

SEQ ID NO: 2537011 - DNA, 18 bp, Homo sapiens
agatcatcctttccagca

SEQ ID NO: 2537012 - DNA, 12 bp, Homo sapiens
agatcatgaaga

SEQ ID NO: 2537013 - DNA, 14 bp, Homo sapiens
agatcatggcatcc

SEQ ID NO: 2537014 - DNA, 15 bp, Homo sapiens
agatccacacacaga

SEQ ID NO: 2537015 - DNA, 22 bp, Homo sapiens
agatcctaaaacaaaagctcat

SEQ ID NO: 2537016 - DNA, 15 bp, Homo sapiens
agatccttccttttg

SEQ ID NO: 2537017 - DNA, 16 bp, Homo sapiens
agatcgcatcattgca

SEQ ID NO: 2537018 - DNA, 16 bp, Homo sapiens
agatcgttagtatcta

SEQ ID NO: 2537019 - DNA, 17 bp, Homo sapiens
agatcgttagtatctaa

SEQ ID NO: 2537020 - DNA, 14 bp, Homo sapiens
agatctcctggcaa

SEQ ID NO: 2537021 - DNA, 18 bp, Homo sapiens
agatctcctggcaaaggc

SEQ ID NO: 2537022 - DNA, 17 bp, Homo sapiens
agatctggttttgctat

SEQ ID NO: 2537023 - DNA, 19 bp, Homo sapiens
agatctgtgccccatgcct

SEQ ID NO: 2537024 - DNA, 12 bp, Homo sapiens
agatctttcagg

SEQ ID NO: 2537025 - DNA, 17 bp, Homo sapiens
agatgaaacacaaacaa

SEQ ID NO: 2537026 - DNA, 13 bp, Homo sapiens
agatgaaagagga

SEQ ID NO: 2537027 - DNA, 23 bp, Homo sapiens
agatgaaatcttacagctgggtg

SEQ ID NO: 2537028 - DNA, 17 bp, Homo sapiens
agatgaagagtgagagg

SEQ ID NO: 2537029 - DNA, 15 bp, Homo sapiens
agatgcaaagaggca

SEQ ID NO: 2537030 - DNA, 17 bp, Homo sapiens
agatgcaaagaggcaag

SEQ ID NO: 2537031 - DNA, 20 bp, Homo sapiens
agatgcaaagaggcaagagg

SEQ ID NO: 2537032 - DNA, 17 bp, Homo sapiens
agatgcaaggaccagga

SEQ ID NO: 2537033 - DNA, 20 bp, Homo sapiens
agatgcaaggaccaggactc

SEQ ID NO: 2537034 - DNA, 20 bp, Homo sapiens
agatgcaatgactcaggaca

SEQ ID NO: 2537035 - DNA, 19 bp, Homo sapiens
agatgcaatgtgctactga

SEQ ID NO: 2537036 - DNA, 15 bp, Homo sapiens
agatgcaccagccct

SEQ ID NO: 2537037 - DNA, 12 bp, Homo sapiens
agatgcagctgg

SEQ ID NO: 2537038 - DNA, 21 bp, Homo sapiens
agatgcccagagggcccaggc

SEQ ID NO: 2537039 - DNA, 16 bp, Homo sapiens
agatgccgcatttgga

SEQ ID NO: 2537040 - DNA, 21 bp, Homo sapiens
agatgcctccaccccccagaa

SEQ ID NO: 2537041 - DNA, 15 bp, Homo sapiens
agatgcctgaagcca

SEQ ID NO: 2537042 - DNA, 15 bp, Homo sapiens
agatgctccttgggc

SEQ ID NO: 2537043 - DNA, 20 bp, Homo sapiens
agatgctccttgggcccttt

SEQ ID NO: 2537044 - DNA, 18 bp, Homo sapiens
agatgctctatcttgctc

SEQ ID NO: 2537045 - DNA, 21 bp, Homo sapiens
agatgctctatcttgctctgt

SEQ ID NO: 2537046 - DNA, 13 bp, Homo sapiens
agatgctgatgtt

SEQ ID NO: 2537047 - DNA, 21 bp, Homo sapiens
agatgctggatgtctgccaat

SEQ ID NO: 2537048 - DNA, 16 bp, Homo sapiens
agatgcttctcactgc

SEQ ID NO: 2537049 - DNA, 19 bp, Homo sapiens
agatgcttttctgtctctg

SEQ ID NO: 2537050 - DNA, 12 bp, Homo sapiens
agatggaagctt

SEQ ID NO: 2537051 - DNA, 12 bp, Homo sapiens
agatggacacac

SEQ ID NO: 2537052 - DNA, 11 bp, Homo sapiens
agatggattct

SEQ ID NO: 2537053 - DNA, 19 bp, Homo sapiens
agatggcccagctccccaa

SEQ ID NO: 2537054 - DNA, 14 bp, Homo sapiens
agatggctgtgcct

SEQ ID NO: 2537055 - DNA, 23 bp, Homo sapiens
agatggctgtgcctctgcctgtc

SEQ ID NO: 2537056 - DNA, 16 bp, Homo sapiens
agatgggaatgaagct

SEQ ID NO: 2537057 - DNA, 19 bp, Homo sapiens
agatgggcttgttttcttg

SEQ ID NO: 2537058 - DNA, 14 bp, Homo sapiens
agatggggcctctg

SEQ ID NO: 2537059 - DNA, 15 bp, Homo sapiens
agatgggggaaagca

SEQ ID NO: 2537060 - DNA, 18 bp, Homo sapiens
agatgggggaaagcacag

SEQ ID NO: 2537061 - DNA, 22 bp, Homo sapiens
agatgggtctggctgagctgaa

SEQ ID NO: 2537062 - DNA, 18 bp, Homo sapiens
agatgtcagccgagccgg

SEQ ID NO: 2537063 - DNA, 22 bp, Homo sapiens
agatgtccctttcttggccagt

SEQ ID NO: 2537064 - DNA, 12 bp, Homo sapiens
agatgtctattc

SEQ ID NO: 2537065 - DNA, 18 bp, Homo sapiens
agatgtcttcgtacagtt

SEQ ID NO: 2537066 - DNA, 13 bp, Homo sapiens
agatgtctttagg

SEQ ID NO: 2537067 - DNA, 23 bp, Homo sapiens
agatgtctttaggcagcagcttt

SEQ ID NO: 2537068 - DNA, 17 bp, Homo sapiens
agatgtgaacacatcag

SEQ ID NO: 2537069 - DNA, 13 bp, Homo sapiens
agatgtgcaccca

SEQ ID NO: 2537070 - DNA, 15 bp, Homo sapiens
agatgtgcacccatg

SEQ ID NO: 2537071 - DNA, 21 bp, Homo sapiens
agatgtgcacccatgggctct

SEQ ID NO: 2537072 - DNA, 16 bp, Homo sapiens
agatgtgtctatggct

SEQ ID NO: 2537073 - DNA, 12 bp, Homo sapiens
agatgttaaaaa

SEQ ID NO: 2537074 - DNA, 17 bp, Homo sapiens
agatgttagatcagggg

SEQ ID NO: 2537075 - DNA, 17 bp, Homo sapiens
agatgttcagtcatttt

SEQ ID NO: 2537076 - DNA, 20 bp, Homo sapiens
agatgttctaagtctttcca

SEQ ID NO: 2537077 - DNA, 15 bp, Homo sapiens
agatgtttgtcagat

SEQ ID NO: 2537078 - DNA, 16 bp, Homo sapiens
agatgtttttaaaagt

SEQ ID NO: 2537079 - DNA, 16 bp, Homo sapiens
agattaagagccatat

SEQ ID NO: 2537080 - DNA, 16 bp, Homo sapiens
agattagatcttttaa

SEQ ID NO: 2537081 - DNA, 17 bp, Homo sapiens
agattagctctggacca

SEQ ID NO: 2537082 - DNA, 13 bp, Homo sapiens
agattataacttg

SEQ ID NO: 2537083 - DNA, 17 bp, Homo sapiens
agattcacactgtctgg

SEQ ID NO: 2537084 - DNA, 19 bp, Homo sapiens
agattcaggtatgttgcct

SEQ ID NO: 2537085 - DNA, 20 bp, Homo sapiens
agattcaggtatgttgcctt

SEQ ID NO: 2537086 - DNA, 16 bp, Homo sapiens
agattcatatttactt

SEQ ID NO: 2537087 - DNA, 15 bp, Homo sapiens
agattcatccattta

SEQ ID NO: 2537088 - DNA, 19 bp, Homo sapiens
agattccccattgcctcct

SEQ ID NO: 2537089 - DNA, 24 bp, Homo sapiens
agattccccattgcctcctccttc

SEQ ID NO: 2537090 - DNA, 19 bp, Homo sapiens
agattctacatattcttta

SEQ ID NO: 2537091 - DNA, 17 bp, Homo sapiens
agattctgaaacattgc

SEQ ID NO: 2537092 - DNA, 21 bp, Homo sapiens
agattctttcctgaggctggg

SEQ ID NO: 2537093 - DNA, 16 bp, Homo sapiens
agattgcaacaggctg

SEQ ID NO: 2537094 - DNA, 19 bp, Homo sapiens
agattgcaacaggctgggc

SEQ ID NO: 2537095 - DNA, 23 bp, Homo sapiens
agattgcaacaggctgggcttca

SEQ ID NO: 2537096 - DNA, 16 bp, Homo sapiens
agattgcaccactgca

SEQ ID NO: 2537097 - DNA, 16 bp, Homo sapiens
agattgcatgtgactc

SEQ ID NO: 2537098 - DNA, 18 bp, Homo sapiens
agattgcatgtgactctg

SEQ ID NO: 2537099 - DNA, 12 bp, Homo sapiens
agattgggtcta

SEQ ID NO: 2537100 - DNA, 18 bp, Homo sapiens
agattgtgaatatttcca

SEQ ID NO: 2537101 - DNA, 16 bp, Homo sapiens
agattgtgcccctgca

SEQ ID NO: 2537102 - DNA, 13 bp, Homo sapiens
agattgtgtaaca

SEQ ID NO: 2537103 - DNA, 15 bp, Homo sapiens
agattgtgtaacaat

SEQ ID NO: 2537104 - DNA, 13 bp, Homo sapiens
agatttatcaaat

SEQ ID NO: 2537105 - DNA, 14 bp, Homo sapiens
agatttcaagagat

SEQ ID NO: 2537106 - DNA, 17 bp, Homo sapiens
agatttgaactcttcaa

SEQ ID NO: 2537107 - DNA, 13 bp, Homo sapiens
agatttgggctgg

SEQ ID NO: 2537108 - DNA, 16 bp, Homo sapiens
agatttgtgaactcag

SEQ ID NO: 2537109 - DNA, 22 bp, Homo sapiens
agatttgtgaactcagccaagc

SEQ ID NO: 2537110 - DNA, 21 bp, Homo sapiens
agattttaattttgaataaat

SEQ ID NO: 2537111 - DNA, 19 bp, Homo sapiens
agattttcagcaaactctt

SEQ ID NO: 2537112 - DNA, 14 bp, Homo sapiens
agattttctttaaa

SEQ ID NO: 2537113 - DNA, 21 bp, Homo sapiens
agattttgaaatttttattaa

SEQ ID NO: 2537114 - DNA, 14 bp, Homo sapiens
agattttgaatgct

SEQ ID NO: 2537115 - DNA, 13 bp, Homo sapiens
agatttttctcaa

SEQ ID NO: 2537116 - DNA, 21 bp, Homo sapiens
agcaaaaccaaatattccaga

SEQ ID NO: 2537117 - DNA, 18 bp, Homo sapiens
agcaaaagatgcttctca

SEQ ID NO: 2537118 - DNA, 18 bp, Homo sapiens
agcaaaagggtgtctgag

SEQ ID NO: 2537119 - DNA, 23 bp, Homo sapiens
agcaaaatcatggaatggttata

SEQ ID NO: 2537120 - DNA, 13 bp, Homo sapiens
agcaaactaagcc

SEQ ID NO: 2537121 - DNA, 13 bp, Homo sapiens
agcaaagatcaaa

SEQ ID NO: 2537122 - DNA, 15 bp, Homo sapiens
agcaaagcaccagct

SEQ ID NO: 2537123 - DNA, 22 bp, Homo sapiens
agcaaagcaccagcttctccag

SEQ ID NO: 2537124 - DNA, 19 bp, Homo sapiens
agcaaaggctgagaacact

SEQ ID NO: 2537125 - DNA, 11 bp, Homo sapiens
agcaaatacat

SEQ ID NO: 2537126 - DNA, 17 bp, Homo sapiens
agcaaatgttatgcata

SEQ ID NO: 2537127 - DNA, 13 bp, Homo sapiens
agcaaatgtttct

SEQ ID NO: 2537128 - DNA, 16 bp, Homo sapiens
agcaaatgtttctgca

SEQ ID NO: 2537129 - DNA, 14 bp, Homo sapiens
agcaacacaagctg

SEQ ID NO: 2537130 - DNA, 18 bp, Homo sapiens
agcaacacaagctggaag

SEQ ID NO: 2537131 - DNA, 20 bp, Homo sapiens
agcaacagagtgagaccctg

SEQ ID NO: 2537132 - DNA, 22 bp, Homo sapiens
agcaacaggaatcaagagctgc

SEQ ID NO: 2537133 - DNA, 23 bp, Homo sapiens
agcaacaggaatcaagagctgcc

SEQ ID NO: 2537134 - DNA, 18 bp, Homo sapiens
agcaacaggttttataat

SEQ ID NO: 2537135 - DNA, 19 bp, Homo sapiens
agccagtgacctgaggaag

SEQ ID NO: 2537136 - DNA, 21 bp, Homo sapiens
agccagtgactccaggagagg

SEQ ID NO: 2537137 - DNA, 21 bp, Homo sapiens
agccagttcagtacctggagg

SEQ ID NO: 2537138 - DNA, 16 bp, Homo sapiens
agccatacttatctct

SEQ ID NO: 2537139 - DNA, 19 bp, Homo sapiens
agccatacttatctctctg

SEQ ID NO: 2537140 - DNA, 22 bp, Homo sapiens
agccatacttatctctctgtgc

SEQ ID NO: 2537141 - DNA, 18 bp, Homo sapiens
agccatcaacaagagttg

SEQ ID NO: 2537142 - DNA, 18 bp, Homo sapiens
agccatcataggaaggga

SEQ ID NO: 2537143 - DNA, 13 bp, Homo sapiens
agccatcatggat

SEQ ID NO: 2537144 - DNA, 18 bp, Homo sapiens
agccatcccagccttggc

SEQ ID NO: 2537145 - DNA, 19 bp, Homo sapiens
agccatcttggtaaatttc

SEQ ID NO: 2537146 - DNA, 20 bp, Homo sapiens
agccatgacttgagaaacaa

SEQ ID NO: 2537147 - DNA, 23 bp, Homo sapiens
agccatgatgtggagtggggcag

SEQ ID NO: 2537148 - DNA, 13 bp, Homo sapiens
agccatgggacca

SEQ ID NO: 2537149 - DNA, 16 bp, Homo sapiens
agccatgggaccaaac

SEQ ID NO: 2537150 - DNA, 23 bp, Homo sapiens
agccatgtgctgcgtgcctgtgg

SEQ ID NO: 2537151 - DNA, 22 bp, Homo sapiens
agccattcctggtacccagcca

SEQ ID NO: 2537152 - DNA, 18 bp, Homo sapiens
agccatttgttggggcag

SEQ ID NO: 2537153 - DNA, 22 bp, Homo sapiens
agccatttgttggggcagtggt

SEQ ID NO: 2537154 - DNA, 13 bp, Homo sapiens
agcccaaagaagg

SEQ ID NO: 2537155 - DNA, 20 bp, Homo sapiens
agcccaaagtggtatagaaa

SEQ ID NO: 2537156 - DNA, 22 bp, Homo sapiens
agcccaaggtttaaacttctct

SEQ ID NO: 2537157 - DNA, 16 bp, Homo sapiens
agcccaatattataat

SEQ ID NO: 2537158 - DNA, 17 bp, Homo sapiens
agcccacaaagccttat

SEQ ID NO: 2537159 - DNA, 14 bp, Homo sapiens
agcccacccccctc

SEQ ID NO: 2537160 - DNA, 16 bp, Homo sapiens
agcccacccccctcat

SEQ ID NO: 2537161 - DNA, 14 bp, Homo sapiens
agcccaccctcctg

SEQ ID NO: 2537162 - DNA, 18 bp, Homo sapiens
agcccaccctcctgtctt

SEQ ID NO: 2537163 - DNA, 16 bp, Homo sapiens
agcccaccttggctca

SEQ ID NO: 2537164 - DNA, 15 bp, Homo sapiens
agcccacgcccccac

SEQ ID NO: 2537165 - DNA, 20 bp, Homo sapiens
agcccacgcccccactggtg

SEQ ID NO: 2537166 - DNA, 23 bp, Homo sapiens
agcccacgcccccactggtgaca

SEQ ID NO: 2537167 - DNA, 19 bp, Homo sapiens
agcccactgcccaccccct

SEQ ID NO: 2537168 - DNA, 20 bp, Homo sapiens
agcccactgcccaccccctc

SEQ ID NO: 2537169 - DNA, 13 bp, Homo sapiens
agcccacttctgc

SEQ ID NO: 2537170 - DNA, 16 bp, Homo sapiens
agcccagaggtaacag

SEQ ID NO: 2537171 - DNA, 16 bp, Homo sapiens
agcccagatcagctcc

SEQ ID NO: 2537172 - DNA, 17 bp, Homo sapiens
agcccagatcagctcct

SEQ ID NO: 2537173 - DNA, 21 bp, Homo sapiens
agcccagcactgcttgaggaa

SEQ ID NO: 2537174 - DNA, 23 bp, Homo sapiens
agcccaggaaaggctccaggagc

SEQ ID NO: 2537175 - DNA, 13 bp, Homo sapiens
agcccaggcccct

SEQ ID NO: 2537176 - DNA, 22 bp, Homo sapiens
agcccagggagcggaaagcagc

SEQ ID NO: 2537177 - DNA, 16 bp, Homo sapiens
agcccagggttccccc

SEQ ID NO: 2537178 - DNA, 22 bp, Homo sapiens
agcccagggttcccccagccct

SEQ ID NO: 2537179 - DNA, 17 bp, Homo sapiens
agcccatgagtccttga

SEQ ID NO: 2537180 - DNA, 14 bp, Homo sapiens
agcccattcattcc

SEQ ID NO: 2537181 - DNA, 24 bp, Homo sapiens
agccccaaaactctcctctgctgc

SEQ ID NO: 2537182 - DNA, 14 bp, Homo sapiens
agccccaagtcctg

SEQ ID NO: 2537183 - DNA, 15 bp, Homo sapiens
agccccacacggagg

SEQ ID NO: 2537184 - DNA, 16 bp, Homo sapiens
agccccacccaggagg

SEQ ID NO: 2537185 - DNA, 20 bp, Homo sapiens
agccccacccaggagggagg

SEQ ID NO: 2537186 - DNA, 14 bp, Homo sapiens
agccccaccccagg

SEQ ID NO: 2537187 - DNA, 12 bp, Homo sapiens
agccccaggcct

SEQ ID NO: 2537188 - DNA, 18 bp, Homo sapiens
agccccaggcctctgtgt

SEQ ID NO: 2537189 - DNA, 20 bp, Homo sapiens
agccccagggtcttccctac

SEQ ID NO: 2537190 - DNA, 23 bp, Homo sapiens
agccccagggtcttccctacctc

SEQ ID NO: 2537191 - DNA, 13 bp, Homo sapiens
agccccagtgcca

SEQ ID NO: 2537192 - DNA, 23 bp, Homo sapiens
agccccagtgccaagcacagtgc

SEQ ID NO: 2537193 - DNA, 15 bp, Homo sapiens
agccccagtgcccac

SEQ ID NO: 2537194 - DNA, 13 bp, Homo sapiens
agccccattctgc

SEQ ID NO: 2537195 - DNA, 21 bp, Homo sapiens
agccccattctgcctgcccag

SEQ ID NO: 2537196 - DNA, 23 bp, Homo sapiens
agccccattctgcctgcccaggc

SEQ ID NO: 2537197 - DNA, 19 bp, Homo sapiens
agcccccacagtgctgtct

SEQ ID NO: 2537198 - DNA, 17 bp, Homo sapiens
agcccccaggctgctgg

SEQ ID NO: 2537199 - DNA, 23 bp, Homo sapiens
agcccccccaacactgtgccctg

SEQ ID NO: 2537200 - DNA, 15 bp, Homo sapiens
agcccccccttccac

SEQ ID NO: 2537201 - DNA, 20 bp, Homo sapiens
agccccctttgggcccaggg

SEQ ID NO: 2537202 - DNA, 15 bp, Homo sapiens
agccccgcgcctcct

SEQ ID NO: 2537203 - DNA, 23 bp, Homo sapiens
agcccctcccaccacagcaggtg

SEQ ID NO: 2537204 - DNA, 10 bp, Homo sapiens
agcccctctt

SEQ ID NO: 2537205 - DNA, 23 bp, Homo sapiens
agcccctcttgccccccacccca

SEQ ID NO: 2537206 - DNA, 18 bp, Homo sapiens
agcccctggatgcagcct

SEQ ID NO: 2537207 - DNA, 19 bp, Homo sapiens
agcccctggatgcagcctc

SEQ ID NO: 2537208 - DNA, 18 bp, Homo sapiens
agcccctgtatggcactg

SEQ ID NO: 2537209 - DNA, 13 bp, Homo sapiens
agccccttcccca

SEQ ID NO: 2537210 - DNA, 23 bp, Homo sapiens
agccccttccttgctctgcaccc

SEQ ID NO: 2537211 - DNA, 14 bp, Homo sapiens
agccccttctgacc

SEQ ID NO: 2537212 - DNA, 24 bp, Homo sapiens
agccccttctgacccatgctgccc

SEQ ID NO: 2537213 - DNA, 17 bp, Homo sapiens
agccccttgagaaacct

SEQ ID NO: 2537214 - DNA, 23 bp, Homo sapiens
agccccttgctctcccctgccct

SEQ ID NO: 2537215 - DNA, 17 bp, Homo sapiens
agcccgcacccccaccc

SEQ ID NO: 2537216 - DNA, 13 bp, Homo sapiens
agcccgcctgcca

SEQ ID NO: 2537217 - DNA, 14 bp, Homo sapiens
agcccgcctgccag

SEQ ID NO: 2537218 - DNA, 15 bp, Homo sapiens
agcccgcctgccagt

SEQ ID NO: 2537219 - DNA, 19 bp, Homo sapiens
agcccgcctgccagtccta

SEQ ID NO: 2537220 - DNA, 21 bp, Homo sapiens
agcccgcctgccagtcctagc

SEQ ID NO: 2537221 - DNA, 23 bp, Homo sapiens
agcccgcctgccagtcctagctg

SEQ ID NO: 2537222 - DNA, 20 bp, Homo sapiens
agcccgcggggacattggga

SEQ ID NO: 2537223 - DNA, 20 bp, Homo sapiens
agcccggcctgctcccagca

SEQ ID NO: 2537224 - DNA, 18 bp, Homo sapiens
agcccggcgcccctgcca

SEQ ID NO: 2537225 - DNA, 15 bp, Homo sapiens
agcccggctcccacc

SEQ ID NO: 2537226 - DNA, 15 bp, Homo sapiens
agcccgggctctgcc

SEQ ID NO: 2537227 - DNA, 16 bp, Homo sapiens
agcccgggctctgcct

SEQ ID NO: 2537228 - DNA, 18 bp, Homo sapiens
agcccgggctctgcctcc

SEQ ID NO: 2537229 - DNA, 21 bp, Homo sapiens
agcccgggctctgcctcccat

SEQ ID NO: 2537230 - DNA, 12 bp, Homo sapiens
agcccgggctgc

SEQ ID NO: 2537231 - DNA, 18 bp, Homo sapiens
agcccgggctgcctgggc

SEQ ID NO: 2537232 - DNA, 16 bp, Homo sapiens
agcccgtgtggcccct

SEQ ID NO: 2537233 - DNA, 15 bp, Homo sapiens
agccctagagcctgc

SEQ ID NO: 2537234 - DNA, 20 bp, Homo sapiens
agccctagagcctgcctgga

SEQ ID NO: 2537235 - DNA, 13 bp, Homo sapiens
agccctatggatg

SEQ ID NO: 2537236 - DNA, 15 bp, Homo sapiens
agccctccaaaagca

SEQ ID NO: 2537237 - DNA, 17 bp, Homo sapiens
agccctccaaaagcact

SEQ ID NO: 2537238 - DNA, 13 bp, Homo sapiens
agccctcttccat

SEQ ID NO: 2537239 - DNA, 15 bp, Homo sapiens
agccctgagctttct

SEQ ID NO: 2537240 - DNA, 22 bp, Homo sapiens
agccctggagccaactgctgct

SEQ ID NO: 2537241 - DNA, 17 bp, Homo sapiens
agccctggcaggatgac

SEQ ID NO: 2537242 - DNA, 15 bp, Homo sapiens
agccctggctctgca

SEQ ID NO: 2537243 - DNA, 16 bp, Homo sapiens
agccctggctgaagga

SEQ ID NO: 2537244 - DNA, 18 bp, Homo sapiens
agccctggctgaaggact

SEQ ID NO: 2537245 - DNA, 14 bp, Homo sapiens
agccctggtggcag

SEQ ID NO: 2537246 - DNA, 15 bp, Homo sapiens
agccctggtggcagt

SEQ ID NO: 2537247 - DNA, 15 bp, Homo sapiens
agccctgtaattttt

SEQ ID NO: 2537248 - DNA, 19 bp, Homo sapiens
agccctgtcagtgcagccc

SEQ ID NO: 2537249 - DNA, 21 bp, Homo sapiens
agcccttagcagggaaacagc

SEQ ID NO: 2537250 - DNA, 13 bp, Homo sapiens
agcccttcatttg

SEQ ID NO: 2537251 - DNA, 14 bp, Homo sapiens
agcccttcatttgg

SEQ ID NO: 2537252 - DNA, 17 bp, Homo sapiens
agcccttgcattgcaga

SEQ ID NO: 2537253 - DNA, 12 bp, Homo sapiens
agcccttgggtt

SEQ ID NO: 2537254 - DNA, 18 bp, Homo sapiens
agccctttctgtgtgcac

SEQ ID NO: 2537255 - DNA, 19 bp, Homo sapiens
agccgagatcacgccactg

SEQ ID NO: 2537256 - DNA, 20 bp, Homo sapiens
agccgagattgcaccactgc

SEQ ID NO: 2537257 - DNA, 17 bp, Homo sapiens
agccgagccgggcctgg

SEQ ID NO: 2537258 - DNA, 18 bp, Homo sapiens
agccgccattgccaccag

SEQ ID NO: 2537259 - DNA, 19 bp, Homo sapiens
agccgccattgccaccagg

SEQ ID NO: 2537260 - DNA, 21 bp, Homo sapiens
agccgccattgccaccaggag

SEQ ID NO: 2537261 - DNA, 17 bp, Homo sapiens
agccgctcctgtctgcc

SEQ ID NO: 2537262 - DNA, 19 bp, Homo sapiens
agccgctcctgtctgccag

SEQ ID NO: 2537263 - DNA, 14 bp, Homo sapiens
agccgctggggcca

SEQ ID NO: 2537264 - DNA, 16 bp, Homo sapiens
agccgctgtgagcccc

SEQ ID NO: 2537265 - DNA, 23 bp, Homo sapiens
agccggactttcggagttggggg

SEQ ID NO: 2537266 - DNA, 14 bp, Homo sapiens
agccggcctctctg

SEQ ID NO: 2537267 - DNA, 19 bp, Homo sapiens
agccggcctctctggcctc

SEQ ID NO: 2537268 - DNA, 16 bp, Homo sapiens
agccgggtctgcctct

SEQ ID NO: 2537269 - DNA, 20 bp, Homo sapiens
agccgggtctgcctcttctg

SEQ ID NO: 2537270 - DNA, 19 bp, Homo sapiens
agccgtgatgctcaggctt

SEQ ID NO: 2537271 - DNA, 15 bp, Homo sapiens
agcctaatccctggg

SEQ ID NO: 2537272 - DNA, 22 bp, Homo sapiens
agcctaatccctgggcattgct

SEQ ID NO: 2537273 - DNA, 16 bp, Homo sapiens
agcctacgctgaagat

SEQ ID NO: 2537274 - DNA, 19 bp, Homo sapiens
agcctagaagagcttctga

SEQ ID NO: 2537275 - DNA, 15 bp, Homo sapiens
agcctagaccctcct

SEQ ID NO: 2537276 - DNA, 18 bp, Homo sapiens
agcctagaccctcctcct

SEQ ID NO: 2537277 - DNA, 17 bp, Homo sapiens
agcctaggtgacagagt

SEQ ID NO: 2537278 - DNA, 20 bp, Homo sapiens
agcctagtgaaggcttctct

SEQ ID NO: 2537279 - DNA, 15 bp, Homo sapiens
agcctagttcatcca

SEQ ID NO: 2537280 - DNA, 17 bp, Homo sapiens
agcctagttcatccaat

SEQ ID NO: 2537281 - DNA, 15 bp, Homo sapiens
agcctcaacctcctg

SEQ ID NO: 2537282 - DNA, 21 bp, Homo sapiens
agcctcaagtcttatttcctc

SEQ ID NO: 2537283 - DNA, 16 bp, Homo sapiens
agcctcacttgaatgt

SEQ ID NO: 2537284 - DNA, 19 bp, Homo sapiens
agcctcagcatcctggcac

SEQ ID NO: 2537285 - DNA, 15 bp, Homo sapiens
agcctcagccattca

SEQ ID NO: 2537286 - DNA, 15 bp, Homo sapiens
agcctcatatttaaa

SEQ ID NO: 2537287 - DNA, 17 bp, Homo sapiens
agcctcatatttaaaga

SEQ ID NO: 2537288 - DNA, 19 bp, Homo sapiens
agcctcatatttaaagaca

SEQ ID NO: 2537289 - DNA, 20 bp, Homo sapiens
agcctcatatttaaagacag

SEQ ID NO: 2537290 - DNA, 12 bp, Homo sapiens
agcctcatctct

SEQ ID NO: 2537291 - DNA, 15 bp, Homo sapiens
agcctccagcctctg

SEQ ID NO: 2537292 - DNA, 18 bp, Homo sapiens
agcctccagcctctgttc

SEQ ID NO: 2537293 - DNA, 22 bp, Homo sapiens
agcctccagtccaaggaaacca

SEQ ID NO: 2537294 - DNA, 20 bp, Homo sapiens
agcctccatgctgcctccag

SEQ ID NO: 2537295 - DNA, 21 bp, Homo sapiens
agcctccatttagttctttgt

SEQ ID NO: 2537296 - DNA, 16 bp, Homo sapiens
agcctcccaaagtgct

SEQ ID NO: 2537297 - DNA, 20 bp, Homo sapiens
agcctcccaaagtgctggga

SEQ ID NO: 2537298 - DNA, 17 bp, Homo sapiens
agcctcccaagtagctg

SEQ ID NO: 2537299 - DNA, 15 bp, Homo sapiens
agcctcccctgccag

SEQ ID NO: 2537300 - DNA, 17 bp, Homo sapiens
agcctcccctgccaggg

SEQ ID NO: 2537301 - DNA, 18 bp, Homo sapiens
agcctcccctgccagggc

SEQ ID NO: 2537302 - DNA, 22 bp, Homo sapiens
agcctcccgaatagctgggact

SEQ ID NO: 2537303 - DNA, 19 bp, Homo sapiens
agcctcccgagtagctggg

SEQ ID NO: 2537304 - DNA, 20 bp, Homo sapiens
agcctcccgagtagctggga

SEQ ID NO: 2537305 - DNA, 22 bp, Homo sapiens
agcctcccgagtagctgggact

SEQ ID NO: 2537306 - DNA, 20 bp, Homo sapiens
agcctcctcatcccgtgttc

SEQ ID NO: 2537307 - DNA, 16 bp, Homo sapiens
agcctcctctgtctgc

SEQ ID NO: 2537308 - DNA, 20 bp, Homo sapiens
agcctcctctgtctgccctt

SEQ ID NO: 2537309 - DNA, 14 bp, Homo sapiens
agcctcctgacctg

SEQ ID NO: 2537310 - DNA, 20 bp, Homo sapiens
agcctcgccgtctgtgaatt

SEQ ID NO: 2537311 - DNA, 16 bp, Homo sapiens
agcctcgtcttcatta

SEQ ID NO: 2537312 - DNA, 18 bp, Homo sapiens
agcctctagggacccctc

SEQ ID NO: 2537313 - DNA, 22 bp, Homo sapiens
agcctctagggacccctcctcc

SEQ ID NO: 2537314 - DNA, 14 bp, Homo sapiens
agcctctccaggaa

SEQ ID NO: 2537315 - DNA, 18 bp, Homo sapiens
agcctctctcccagtcta

SEQ ID NO: 2537316 - DNA, 14 bp, Homo sapiens
agcctctgctgcca

SEQ ID NO: 2537317 - DNA, 18 bp, Homo sapiens
agcctctgctgccatggc

SEQ ID NO: 2537318 - DNA, 21 bp, Homo sapiens
agcctctgtcactgcaggcac

SEQ ID NO: 2537319 - DNA, 22 bp, Homo sapiens
agcctctgtcactgcaggcact

SEQ ID NO: 2537320 - DNA, 17 bp, Homo sapiens
agcctgaggctgagact

SEQ ID NO: 2537321 - DNA, 18 bp, Homo sapiens
agcctgcaaactcactgc

SEQ ID NO: 2537322 - DNA, 12 bp, Homo sapiens
agcctgcagggt

SEQ ID NO: 2537323 - DNA, 17 bp, Homo sapiens
agcctgcaggtgctgct

SEQ ID NO: 2537324 - DNA, 19 bp, Homo sapiens
agcctgcaggtgctgctgc

SEQ ID NO: 2537325 - DNA, 16 bp, Homo sapiens
agcctgcctcttctct

SEQ ID NO: 2537326 - DNA, 19 bp, Homo sapiens
agcctgcctcttctctact

SEQ ID NO: 2537327 - DNA, 18 bp, Homo sapiens
agcctgcggcctgctgga

SEQ ID NO: 2537328 - DNA, 14 bp, Homo sapiens
agcctgctccagct

SEQ ID NO: 2537329 - DNA, 15 bp, Homo sapiens
agcctgctccagctg

SEQ ID NO: 2537330 - DNA, 22 bp, Homo sapiens
agcctgctccagctgttcagct

SEQ ID NO: 2537331 - DNA, 22 bp, Homo sapiens
agcctgctccttcccaggagtg

SEQ ID NO: 2537332 - DNA, 12 bp, Homo sapiens
agcctgctgcat

SEQ ID NO: 2537333 - DNA, 22 bp, Homo sapiens
agcctgctggtcacagcctcct

SEQ ID NO: 2537334 - DNA, 21 bp, Homo sapiens
agcctggaacatcatcaaggc

SEQ ID NO: 2537335 - DNA, 14 bp, Homo sapiens
agcctggaccctgt

SEQ ID NO: 2537336 - DNA, 13 bp, Homo sapiens
agcctggagaagc

SEQ ID NO: 2537337 - DNA, 14 bp, Homo sapiens
agcctggagaagct

SEQ ID NO: 2537338 - DNA, 20 bp, Homo sapiens
agcctggctccaaaccctcg

SEQ ID NO: 2537339 - DNA, 22 bp, Homo sapiens
agcctggctccaaaccctcgag

SEQ ID NO: 2537340 - DNA, 20 bp, Homo sapiens
agcctggctcccacaggcag

SEQ ID NO: 2537341 - DNA, 21 bp, Homo sapiens
agcctggctcccacaggcagc

SEQ ID NO: 2537342 - DNA, 15 bp, Homo sapiens
agcctggcttctgga

SEQ ID NO: 2537343 - DNA, 18 bp, Homo sapiens
agcctggcttctggagcc

SEQ ID NO: 2537344 - DNA, 19 bp, Homo sapiens
agcctggcttctggagccc

SEQ ID NO: 2537345 - DNA, 20 bp, Homo sapiens
agcctggcttctggagccct

SEQ ID NO: 2537346 - DNA, 12 bp, Homo sapiens
agcctgggaggt

SEQ ID NO: 2537347 - DNA, 20 bp, Homo sapiens
agcctgggcaacagagcaag

SEQ ID NO: 2537348 - DNA, 18 bp, Homo sapiens
agcctgggcaatgtgata

SEQ ID NO: 2537349 - DNA, 15 bp, Homo sapiens
agcctgggcagccag

SEQ ID NO: 2537350 - DNA, 19 bp, Homo sapiens
agcctgggcagccaggctg

SEQ ID NO: 2537351 - DNA, 20 bp, Homo sapiens
agcctgggcagccaggctgc

SEQ ID NO: 2537352 - DNA, 16 bp, Homo sapiens
agcctggtgctgctgc

SEQ ID NO: 2537353 - DNA, 19 bp, Homo sapiens
agcctgtcccatggacact

SEQ ID NO: 2537354 - DNA, 14 bp, Homo sapiens
agcctgtcctgggc

SEQ ID NO: 2537355 - DNA, 14 bp, Homo sapiens
agcctgtctcttcc

SEQ ID NO: 2537356 - DNA, 21 bp, Homo sapiens
agcctgtgcatgtatgtcttg

SEQ ID NO: 2537357 - DNA, 11 bp, Homo sapiens
agcctgtggca

SEQ ID NO: 2537358 - DNA, 18 bp, Homo sapiens
agcctgttcccctcactg

SEQ ID NO: 2537359 - DNA, 17 bp, Homo sapiens
agccttatcaagtgtct

SEQ ID NO: 2537360 - DNA, 15 bp, Homo sapiens
agccttatcctctga

SEQ ID NO: 2537361 - DNA, 17 bp, Homo sapiens
agccttatcctctgatc

SEQ ID NO: 2537362 - DNA, 23 bp, Homo sapiens
agccttcagtcttgaatttctaa

SEQ ID NO: 2537363 - DNA, 16 bp, Homo sapiens
agccttccacactcac

SEQ ID NO: 2537364 - DNA, 22 bp, Homo sapiens
agccttccccttgcccagggct

SEQ ID NO: 2537365 - DNA, 14 bp, Homo sapiens
agccttcctctgca

SEQ ID NO: 2537366 - DNA, 21 bp, Homo sapiens
agccttcctctgcagctgacc

SEQ ID NO: 2537367 - DNA, 22 bp, Homo sapiens
agccttcctctgcagctgacct

SEQ ID NO: 2537368 - DNA, 23 bp, Homo sapiens
agccttgtgtctacagagaacct

SEQ ID NO: 2537369 - DNA, 22 bp, Homo sapiens
agcctttccataaggaatgtag

SEQ ID NO: 2537370 - DNA, 18 bp, Homo sapiens
agcgaaccaatatttgta

SEQ ID NO: 2537371 - DNA, 14 bp, Homo sapiens
agcgacaaagatga

SEQ ID NO: 2537372 - DNA, 17 bp, Homo sapiens
agcgaccacccctgcct

SEQ ID NO: 2537373 - DNA, 21 bp, Homo sapiens
agcgaccacccctgcctccac

SEQ ID NO: 2537374 - DNA, 14 bp, Homo sapiens
agcgaccgccccct

SEQ ID NO: 2537375 - DNA, 13 bp, Homo sapiens
agcgagccctggt

SEQ ID NO: 2537376 - DNA, 21 bp, Homo sapiens
agcgagttgtggaaagcctct

SEQ ID NO: 2537377 - DNA, 18 bp, Homo sapiens
agcgcacctgccccctgg

SEQ ID NO: 2537378 - DNA, 19 bp, Homo sapiens
agcgcacctgccccctggt

SEQ ID NO: 2537379 - DNA, 21 bp, Homo sapiens
agcgcacctgccccctggtgg

SEQ ID NO: 2537380 - DNA, 18 bp, Homo sapiens
agcgccaagcaacctggg

SEQ ID NO: 2537381 - DNA, 14 bp, Homo sapiens
agcgcccagttggg

SEQ ID NO: 2537382 - DNA, 15 bp, Homo sapiens
agcgcccctccctag

SEQ ID NO: 2537383 - DNA, 15 bp, Homo sapiens
agcgcccgctgggct

SEQ ID NO: 2537384 - DNA, 19 bp, Homo sapiens
agcgccgtgagttctcagg

SEQ ID NO: 2537385 - DNA, 20 bp, Homo sapiens
agcgccgtgagttctcaggg

SEQ ID NO: 2537386 - DNA, 24 bp, Homo sapiens
agcgccgtgagttctcagggctcc

SEQ ID NO: 2537387 - DNA, 18 bp, Homo sapiens
agcgcctgcccctcccag

SEQ ID NO: 2537388 - DNA, 16 bp, Homo sapiens
agcgctttctggaaaa

SEQ ID NO: 2537389 - DNA, 22 bp, Homo sapiens
agcggaacaaggagtcagacat

SEQ ID NO: 2537390 - DNA, 19 bp, Homo sapiens
agcggacatcagctggtca

SEQ ID NO: 2537391 - DNA, 12 bp, Homo sapiens
agcggcccctcc

SEQ ID NO: 2537392 - DNA, 13 bp, Homo sapiens
agcggcccctccc

SEQ ID NO: 2537393 - DNA, 14 bp, Homo sapiens
agcggcccctccca

SEQ ID NO: 2537394 - DNA, 18 bp, Homo sapiens
agcggcccctcccacaca

SEQ ID NO: 2537395 - DNA, 19 bp, Homo sapiens
agcggggacagctccttct

SEQ ID NO: 2537396 - DNA, 22 bp, Homo sapiens
agcggggacagctccttctgtc

SEQ ID NO: 2537397 - DNA, 22 bp, Homo sapiens
agcggtttggggagcagagaca

SEQ ID NO: 2537398 - DNA, 23 bp, Homo sapiens
agcgtagctaagtgaaaaggtca

SEQ ID NO: 2537399 - DNA, 17 bp, Homo sapiens
agcgtcctcctctgtga

SEQ ID NO: 2537400 - DNA, 23 bp, Homo sapiens
agcgtgaaggccgagaagcaaga

SEQ ID NO: 2537401 - DNA, 16 bp, Homo sapiens
agcgtgagccactgca

SEQ ID NO: 2537402 - DNA, 14 bp, Homo sapiens
agcgttgcatgtcg

SEQ ID NO: 2537403 - DNA, 13 bp, Homo sapiens
agctaaagaggct

SEQ ID NO: 2537404 - DNA, 16 bp, Homo sapiens
agctaaagcccaacct

SEQ ID NO: 2537405 - DNA, 13 bp, Homo sapiens
agctaaatccttt

SEQ ID NO: 2537406 - DNA, 16 bp, Homo sapiens
agctaacacacagctc

SEQ ID NO: 2537407 - DNA, 17 bp, Homo sapiens
agctaacacacagctcc

SEQ ID NO: 2537408 - DNA, 18 bp, Homo sapiens
agctaacacacagctccc

SEQ ID NO: 2537409 - DNA, 17 bp, Homo sapiens
agctaacattttaaata

SEQ ID NO: 2537410 - DNA, 20 bp, Homo sapiens
agctaacattttaaataaaa

SEQ ID NO: 2537411 - DNA, 23 bp, Homo sapiens
agctaacattttaaataaaagaa

SEQ ID NO: 2537412 - DNA, 19 bp, Homo sapiens
agctaagtgaaaaggtcat

SEQ ID NO: 2537413 - DNA, 19 bp, Homo sapiens
agctaatctgtagggctgg

SEQ ID NO: 2537414 - DNA, 23 bp, Homo sapiens
agctaatctgtagggctggacct

SEQ ID NO: 2537415 - DNA, 13 bp, Homo sapiens
agctaatgggaca

SEQ ID NO: 2537416 - DNA, 15 bp, Homo sapiens
agctaatgggacact

SEQ ID NO: 2537417 - DNA, 22 bp, Homo sapiens
agctacaggaagcaccccatgc

SEQ ID NO: 2537418 - DNA, 14 bp, Homo sapiens
agctacaggttaca

SEQ ID NO: 2537419 - DNA, 13 bp, Homo sapiens
agctactaatgat

SEQ ID NO: 2537420 - DNA, 18 bp, Homo sapiens
agctactaatgatgtttt

SEQ ID NO: 2537421 - DNA, 15 bp, Homo sapiens
agctactcagaagcc

SEQ ID NO: 2537422 - DNA, 18 bp, Homo sapiens
agctactcagaagcctga

SEQ ID NO: 2537423 - DNA, 15 bp, Homo sapiens
aggagaggatgagag

SEQ ID NO: 2537424 - DNA, 21 bp, Homo sapiens
aggagaggatgagagcccaga

SEQ ID NO: 2537425 - DNA, 14 bp, Homo sapiens
aggagaggggcaca

SEQ ID NO: 2537426 - DNA, 18 bp, Homo sapiens
aggagatatctgagggag

SEQ ID NO: 2537427 - DNA, 20 bp, Homo sapiens
aggagatggaagttgcagtg

SEQ ID NO: 2537428 - DNA, 16 bp, Homo sapiens
aggagcagcctcagaa

SEQ ID NO: 2537429 - DNA, 20 bp, Homo sapiens
aggagcaggggcgtggaggg

SEQ ID NO: 2537430 - DNA, 19 bp, Homo sapiens
aggagcagtatcatgaagc

SEQ ID NO: 2537431 - DNA, 19 bp, Homo sapiens
aggagcagtgcaggcacag

SEQ ID NO: 2537432 - DNA, 14 bp, Homo sapiens
aggagccccagcta

SEQ ID NO: 2537433 - DNA, 15 bp, Homo sapiens
aggagccccattcct

SEQ ID NO: 2537434 - DNA, 22 bp, Homo sapiens
aggagccccgaggccttctctg

SEQ ID NO: 2537435 - DNA, 19 bp, Homo sapiens
aggagctcttcaggcctcc

SEQ ID NO: 2537436 - DNA, 14 bp, Homo sapiens
aggagctgctggct

SEQ ID NO: 2537437 - DNA, 13 bp, Homo sapiens
aggaggacaattc

SEQ ID NO: 2537438 - DNA, 22 bp, Homo sapiens
aggaggacaattcatgaacttc

SEQ ID NO: 2537439 - DNA, 12 bp, Homo sapiens
aggaggaggagg

SEQ ID NO: 2537440 - DNA, 15 bp, Homo sapiens
aggaggatgggctcg

SEQ ID NO: 2537441 - DNA, 20 bp, Homo sapiens
aggaggcagctgttgcagtg

SEQ ID NO: 2537442 - DNA, 14 bp, Homo sapiens
aggaggccacctct

SEQ ID NO: 2537443 - DNA, 17 bp, Homo sapiens
aggaggccacctctcca

SEQ ID NO: 2537444 - DNA, 18 bp, Homo sapiens
aggaggccacctctccaa

SEQ ID NO: 2537445 - DNA, 19 bp, Homo sapiens
aggaggccacctctccaag

SEQ ID NO: 2537446 - DNA, 20 bp, Homo sapiens
aggaggccacctctccaagg

SEQ ID NO: 2537447 - DNA, 16 bp, Homo sapiens
aggaggccaggctcag

SEQ ID NO: 2537448 - DNA, 23 bp, Homo sapiens
aggaggcgcactttcctcctggc

SEQ ID NO: 2537449 - DNA, 16 bp, Homo sapiens
aggaggctccagaggg

SEQ ID NO: 2537450 - DNA, 13 bp, Homo sapiens
aggaggctgaggg

SEQ ID NO: 2537451 - DNA, 16 bp, Homo sapiens
aggagggagacactgg

SEQ ID NO: 2537452 - DNA, 19 bp, Homo sapiens
aggagggatgctgcctgag

SEQ ID NO: 2537453 - DNA, 16 bp, Homo sapiens
aggagggcaagggcca

SEQ ID NO: 2537454 - DNA, 18 bp, Homo sapiens
aggagggttagggagggg

SEQ ID NO: 2537455 - DNA, 18 bp, Homo sapiens
aggaggtggcagccctgt

SEQ ID NO: 2537456 - DNA, 20 bp, Homo sapiens
aggaggtggcagccctgtag

SEQ ID NO: 2537457 - DNA, 23 bp, Homo sapiens
aggaggtggcagccctgtaggga

SEQ ID NO: 2537458 - DNA, 21 bp, Homo sapiens
aggagtaatctgtgtacaaag

SEQ ID NO: 2537459 - DNA, 22 bp, Homo sapiens
aggagtccaggccatggaggca

SEQ ID NO: 2537460 - DNA, 18 bp, Homo sapiens
aggagtggaggaggcctg

SEQ ID NO: 2537461 - DNA, 21 bp, Homo sapiens
aggagtgggaaaacactgcca

SEQ ID NO: 2537462 - DNA, 17 bp, Homo sapiens
aggagttaagagtagca

SEQ ID NO: 2537463 - DNA, 20 bp, Homo sapiens
aggagttccttgatctgtat

SEQ ID NO: 2537464 - DNA, 21 bp, Homo sapiens
aggagttcgagaccagcctgg

SEQ ID NO: 2537465 - DNA, 16 bp, Homo sapiens
aggagttcgaggctgc

SEQ ID NO: 2537466 - DNA, 19 bp, Homo sapiens
aggagtttcgaggtagagt

SEQ ID NO: 2537467 - DNA, 21 bp, Homo sapiens
aggatacaaaagcatgtgaga

SEQ ID NO: 2537468 - DNA, 15 bp, Homo sapiens
aggatcaagaaagtg

SEQ ID NO: 2537469 - DNA, 16 bp, Homo sapiens
aggatcactggagccc

SEQ ID NO: 2537470 - DNA, 19 bp, Homo sapiens
aggatcactggagcccagg

SEQ ID NO: 2537471 - DNA, 20 bp, Homo sapiens
aggatcactggagcccagga

SEQ ID NO: 2537472 - DNA, 22 bp, Homo sapiens
aggatcatggtgtaataagaca

SEQ ID NO: 2537473 - DNA, 22 bp, Homo sapiens
aggatcctattctcaccaggaa

SEQ ID NO: 2537474 - DNA, 13 bp, Homo sapiens
aggatctctcagg

SEQ ID NO: 2537475 - DNA, 15 bp, Homo sapiens
aggatctctcaggag

SEQ ID NO: 2537476 - DNA, 20 bp, Homo sapiens
aggatgacctggataactta

SEQ ID NO: 2537477 - DNA, 13 bp, Homo sapiens
aggatgagagccc

SEQ ID NO: 2537478 - DNA, 18 bp, Homo sapiens
aggatgagagcccagagg

SEQ ID NO: 2537479 - DNA, 23 bp, Homo sapiens
aggatgagagcccagaggtaaca

SEQ ID NO: 2537480 - DNA, 15 bp, Homo sapiens
aggatgagctggaag

SEQ ID NO: 2537481 - DNA, 16 bp, Homo sapiens
aggatgatctaggaag

SEQ ID NO: 2537482 - DNA, 17 bp, Homo sapiens
aggatgatctaggaaga

SEQ ID NO: 2537483 - DNA, 20 bp, Homo sapiens
aggatgatctaggaagactt

SEQ ID NO: 2537484 - DNA, 23 bp, Homo sapiens
aggatgatctaggaagactttgg

SEQ ID NO: 2537485 - DNA, 16 bp, Homo sapiens
aggatgattttggcct

SEQ ID NO: 2537486 - DNA, 18 bp, Homo sapiens
aggatgcagagtcagcag

SEQ ID NO: 2537487 - DNA, 16 bp, Homo sapiens
aggatgcttgtacata

SEQ ID NO: 2537488 - DNA, 19 bp, Homo sapiens
aggatggagagaggggaat

SEQ ID NO: 2537489 - DNA, 12 bp, Homo sapiens
aggatggagggg

SEQ ID NO: 2537490 - DNA, 19 bp, Homo sapiens
aggatggccagtgtctgtc

SEQ ID NO: 2537491 - DNA, 20 bp, Homo sapiens
aggatggccagtgtctgtcc

SEQ ID NO: 2537492 - DNA, 22 bp, Homo sapiens
aggatggcctggccagggcctg

SEQ ID NO: 2537493 - DNA, 17 bp, Homo sapiens
aggatgggaaggaggga

SEQ ID NO: 2537494 - DNA, 11 bp, Homo sapiens
aggatgggctc

SEQ ID NO: 2537495 - DNA, 22 bp, Homo sapiens
aggatgggtctggtttgcagag

SEQ ID NO: 2537496 - DNA, 18 bp, Homo sapiens
aggatgtcacagggccaa

SEQ ID NO: 2537497 - DNA, 14 bp, Homo sapiens
aggatgtgtgcatg

SEQ ID NO: 2537498 - DNA, 15 bp, Homo sapiens
aggatgtgtgcatgt

SEQ ID NO: 2537499 - DNA, 16 bp, Homo sapiens
aggatgttctgggaca

SEQ ID NO: 2537500 - DNA, 14 bp, Homo sapiens
aggatgttgaaaaa

SEQ ID NO: 2537501 - DNA, 16 bp, Homo sapiens
aggattctatgaggca

SEQ ID NO: 2537502 - DNA, 17 bp, Homo sapiens
aggattgctactgtcct

SEQ ID NO: 2537503 - DNA, 18 bp, Homo sapiens
aggattgctactgtccta

SEQ ID NO: 2537504 - DNA, 21 bp, Homo sapiens
aggattgcttgagcccaggag

SEQ ID NO: 2537505 - DNA, 12 bp, Homo sapiens
aggatttaacag

SEQ ID NO: 2537506 - DNA, 14 bp, Homo sapiens
aggatttcaagcct

SEQ ID NO: 2537507 - DNA, 13 bp, Homo sapiens
aggatttcgtggg

SEQ ID NO: 2537508 - DNA, 20 bp, Homo sapiens
aggattttatgctttaaaca

SEQ ID NO: 2537509 - DNA, 18 bp, Homo sapiens
aggcaaatgactttggac

SEQ ID NO: 2537510 - DNA, 15 bp, Homo sapiens
aggcaaatgcccaag

SEQ ID NO: 2537511 - DNA, 13 bp, Homo sapiens
aggcaaatgtgta

SEQ ID NO: 2537512 - DNA, 17 bp, Homo sapiens
aggcaaatgtgtacatg

SEQ ID NO: 2537513 - DNA, 17 bp, Homo sapiens
aggcaactcatcttagg

SEQ ID NO: 2537514 - DNA, 16 bp, Homo sapiens
aggcaactgaggcaga

SEQ ID NO: 2537515 - DNA, 17 bp, Homo sapiens
aggcaagcacctcctgc

SEQ ID NO: 2537516 - DNA, 18 bp, Homo sapiens
aggcaagcacctcctgcc

SEQ ID NO: 2537517 - DNA, 19 bp, Homo sapiens
aggcaagcacctcctgcct

SEQ ID NO: 2537518 - DNA, 15 bp, Homo sapiens
aggcaaggcaggtgc

SEQ ID NO: 2537519 - DNA, 13 bp, Homo sapiens
aggcaagtgaaga

SEQ ID NO: 2537520 - DNA, 22 bp, Homo sapiens
aggcaatgattgttaatttaca

SEQ ID NO: 2537521 - DNA, 17 bp, Homo sapiens
aggcaatgtcaggaaca

SEQ ID NO: 2537522 - DNA, 22 bp, Homo sapiens
aggcaatgtcaggaacagaagg

SEQ ID NO: 2537523 - DNA, 16 bp, Homo sapiens
aggcaccgagaatgtt

SEQ ID NO: 2537524 - DNA, 18 bp, Homo sapiens
aggcaccgagaatgttgt

SEQ ID NO: 2537525 - DNA, 21 bp, Homo sapiens
aggcacctataaaacaggtca

SEQ ID NO: 2537526 - DNA, 22 bp, Homo sapiens
aggcacctcacagaaatgagat

SEQ ID NO: 2537527 - DNA, 16 bp, Homo sapiens
aggcactctgttattt

SEQ ID NO: 2537528 - DNA, 16 bp, Homo sapiens
aggcactgctgcccag

SEQ ID NO: 2537529 - DNA, 16 bp, Homo sapiens
aggcagaaaattgcac

SEQ ID NO: 2537530 - DNA, 19 bp, Homo sapiens
aggcagaaagcaaaattat

SEQ ID NO: 2537531 - DNA, 20 bp, Homo sapiens
aggcagaatcctggccctct

SEQ ID NO: 2537532 - DNA, 21 bp, Homo sapiens
aggcagaatcctggccctctg

SEQ ID NO: 2537533 - DNA, 14 bp, Homo sapiens
aggcagagaatcat

SEQ ID NO: 2537534 - DNA, 13 bp, Homo sapiens
aggcagatacagg

SEQ ID NO: 2537535 - DNA, 15 bp, Homo sapiens
aggcagatctgtgcc

SEQ ID NO: 2537536 - DNA, 22 bp, Homo sapiens
aggcagatctgtgccccatgcc

SEQ ID NO: 2537537 - DNA, 20 bp, Homo sapiens
aggcagcagtgtgaggccag

SEQ ID NO: 2537538 - DNA, 22 bp, Homo sapiens
aggcagcagtgtgaggccaggg

SEQ ID NO: 2537539 - DNA, 23 bp, Homo sapiens
aggcagcagtgtgaggccagggc

SEQ ID NO: 2537540 - DNA, 22 bp, Homo sapiens
aggcagccccattctgcctgcc

SEQ ID NO: 2537541 - DNA, 22 bp, Homo sapiens
aggcagcctggacatagagagg

SEQ ID NO: 2537542 - DNA, 14 bp, Homo sapiens
aggcagcgccaagc

SEQ ID NO: 2537543 - DNA, 19 bp, Homo sapiens
aggcagcgccaagcaacct

SEQ ID NO: 2537544 - DNA, 20 bp, Homo sapiens
aggcagcgccaagcaacctg

SEQ ID NO: 2537545 - DNA, 23 bp, Homo sapiens
aggcagctttaaccattaaaact

SEQ ID NO: 2537546 - DNA, 16 bp, Homo sapiens
aggcaggaagggcagg

SEQ ID NO: 2537547 - DNA, 14 bp, Homo sapiens
aggcaggacatgct

SEQ ID NO: 2537548 - DNA, 21 bp, Homo sapiens
aggcaggacatgctgaagcca

SEQ ID NO: 2537549 - DNA, 23 bp, Homo sapiens
aggcaggacatgctgaagccaaa

SEQ ID NO: 2537550 - DNA, 12 bp, Homo sapiens
aggcaggatggc

SEQ ID NO: 2537551 - DNA, 18 bp, Homo sapiens
aggcaggctaaggcgtgg

SEQ ID NO: 2537552 - DNA, 22 bp, Homo sapiens
aggcagggaaaggctctgaaag

SEQ ID NO: 2537553 - DNA, 12 bp, Homo sapiens
aggcagggaagt

SEQ ID NO: 2537554 - DNA, 21 bp, Homo sapiens
aggcagggaagtgtaagaaac

SEQ ID NO: 2537555 - DNA, 23 bp, Homo sapiens
aggcagggggaaggtggggtcct

SEQ ID NO: 2537556 - DNA, 23 bp, Homo sapiens
aggcagggtcaggagaggggcag

SEQ ID NO: 2537557 - DNA, 21 bp, Homo sapiens
aggcagggtcccatttctcac

SEQ ID NO: 2537558 - DNA, 20 bp, Homo sapiens
aggcagggtctcactctgtc

SEQ ID NO: 2537559 - DNA, 15 bp, Homo sapiens
aggcaggtgcctcca

SEQ ID NO: 2537560 - DNA, 21 bp, Homo sapiens
aggcaggtgcctccaggtgtg

SEQ ID NO: 2537561 - DNA, 19 bp, Homo sapiens
aggcagtcgggggctggcc

SEQ ID NO: 2537562 - DNA, 22 bp, Homo sapiens
aggcagtcgggggctggcctag

SEQ ID NO: 2537563 - DNA, 22 bp, Homo sapiens
aggcagtgcaagagactctggc

SEQ ID NO: 2537564 - DNA, 15 bp, Homo sapiens
aggcataggcctggg

SEQ ID NO: 2537565 - DNA, 22 bp, Homo sapiens
aggcatattgctttttctaatg

SEQ ID NO: 2537566 - DNA, 20 bp, Homo sapiens
agggcctagctgctacaaag

SEQ ID NO: 2537567 - DNA, 12 bp, Homo sapiens
agggcctggcct

SEQ ID NO: 2537568 - DNA, 16 bp, Homo sapiens
agggcctggcctgagc

SEQ ID NO: 2537569 - DNA, 17 bp, Homo sapiens
agggcctggcctgagct

SEQ ID NO: 2537570 - DNA, 18 bp, Homo sapiens
agggcctggcctgagctg

SEQ ID NO: 2537571 - DNA, 18 bp, Homo sapiens
agggcctggctcaggtgg

SEQ ID NO: 2537572 - DNA, 17 bp, Homo sapiens
agggcctggtccctggg

SEQ ID NO: 2537573 - DNA, 21 bp, Homo sapiens
agggcctggtccctgggagga

SEQ ID NO: 2537574 - DNA, 19 bp, Homo sapiens
agggcctgtgggagcctgc

SEQ ID NO: 2537575 - DNA, 21 bp, Homo sapiens
agggctactgcagctttacat

SEQ ID NO: 2537576 - DNA, 17 bp, Homo sapiens
agggctagaacctagaa

SEQ ID NO: 2537577 - DNA, 22 bp, Homo sapiens
agggctagaacctagaagggct

SEQ ID NO: 2537578 - DNA, 17 bp, Homo sapiens
agggctagaacctggaa

SEQ ID NO: 2537579 - DNA, 18 bp, Homo sapiens
agggctagaacctggaga

SEQ ID NO: 2537580 - DNA, 19 bp, Homo sapiens
agggctagaacctggagag

SEQ ID NO: 2537581 - DNA, 22 bp, Homo sapiens
agggctagaacctggagggctg

SEQ ID NO: 2537582 - DNA, 23 bp, Homo sapiens
agggctagaacctggaggggcta

SEQ ID NO: 2537583 - DNA, 18 bp, Homo sapiens
agggctagaactggagag

SEQ ID NO: 2537584 - DNA, 14 bp, Homo sapiens
agggctcagcctgg

SEQ ID NO: 2537585 - DNA, 20 bp, Homo sapiens
agggctcagcggggacagct

SEQ ID NO: 2537586 - DNA, 23 bp, Homo sapiens
agggctcaggatttcgtgggtct

SEQ ID NO: 2537587 - DNA, 15 bp, Homo sapiens
agggctccctgccct

SEQ ID NO: 2537588 - DNA, 12 bp, Homo sapiens
agggctcctgcc

SEQ ID NO: 2537589 - DNA, 22 bp, Homo sapiens
agggctcctgccttctgtcctg

SEQ ID NO: 2537590 - DNA, 15 bp, Homo sapiens
agggctctaaaaaaa

SEQ ID NO: 2537591 - DNA, 15 bp, Homo sapiens
agggctctgatattc

SEQ ID NO: 2537592 - DNA, 21 bp, Homo sapiens
agggctctgatattccatgaa

SEQ ID NO: 2537593 - DNA, 17 bp, Homo sapiens
agggctgagctctctgt

SEQ ID NO: 2537594 - DNA, 16 bp, Homo sapiens
agggctgagctgggga

SEQ ID NO: 2537595 - DNA, 16 bp, Homo sapiens
agggctggcccagccc

SEQ ID NO: 2537596 - DNA, 20 bp, Homo sapiens
agggctggcccagccctgct

SEQ ID NO: 2537597 - DNA, 23 bp, Homo sapiens
aggggaaaccagtgtagccttgc

SEQ ID NO: 2537598 - DNA, 14 bp, Homo sapiens
aggggaacagactg

SEQ ID NO: 2537599 - DNA, 16 bp, Homo sapiens
aggggaagagtgtact

SEQ ID NO: 2537600 - DNA, 14 bp, Homo sapiens
aggggaagggccag

SEQ ID NO: 2537601 - DNA, 19 bp, Homo sapiens
aggggaataatagaagaac

SEQ ID NO: 2537602 - DNA, 21 bp, Homo sapiens
aggggaatgtttgcctctgcc

SEQ ID NO: 2537603 - DNA, 15 bp, Homo sapiens
aggggacccccgccc

SEQ ID NO: 2537604 - DNA, 18 bp, Homo sapiens
aggggacccccgccccct

SEQ ID NO: 2537605 - DNA, 19 bp, Homo sapiens
aggggacccccgccccctg

SEQ ID NO: 2537606 - DNA, 17 bp, Homo sapiens
aggggactcagccctga

SEQ ID NO: 2537607 - DNA, 22 bp, Homo sapiens
aggggactcagccctgaggtga

SEQ ID NO: 2537608 - DNA, 23 bp, Homo sapiens
aggggagcaaaatcgatgcagtg

SEQ ID NO: 2537609 - DNA, 12 bp, Homo sapiens
aggggagccctc

SEQ ID NO: 2537610 - DNA, 16 bp, Homo sapiens
aggggagccctccacg

SEQ ID NO: 2537611 - DNA, 17 bp, Homo sapiens
aggggattgaagccctc

SEQ ID NO: 2537612 - DNA, 15 bp, Homo sapiens
aggggcacagggtct

SEQ ID NO: 2537613 - DNA, 17 bp, Homo sapiens
aggggcagaaaaactct

SEQ ID NO: 2537614 - DNA, 12 bp, Homo sapiens
aggggcagccct

SEQ ID NO: 2537615 - DNA, 23 bp, Homo sapiens
aggggcaggtaaactcctgtcct

SEQ ID NO: 2537616 - DNA, 21 bp, Homo sapiens
aggggcatgtattggcctgga

SEQ ID NO: 2537617 - DNA, 22 bp, Homo sapiens
aggggcatgtattggcctggag

SEQ ID NO: 2537618 - DNA, 22 bp, Homo sapiens
aggggccagaggaactgtccag

SEQ ID NO: 2537619 - DNA, 13 bp, Homo sapiens
aggggccagaggc

SEQ ID NO: 2537620 - DNA, 17 bp, Homo sapiens
aggggccagaggctcgt

SEQ ID NO: 2537621 - DNA, 22 bp, Homo sapiens
aggggcccaaattctttcagtg

SEQ ID NO: 2537622 - DNA, 14 bp, Homo sapiens
aggggcccacaggg

SEQ ID NO: 2537623 - DNA, 21 bp, Homo sapiens
aggggcccacagggaaccctg

SEQ ID NO: 2537624 - DNA, 18 bp, Homo sapiens
aggggccccgtgtcctgc

SEQ ID NO: 2537625 - DNA, 17 bp, Homo sapiens
aggggcgctggcccagc

SEQ ID NO: 2537626 - DNA, 19 bp, Homo sapiens
aggggcgctggcccagccg

SEQ ID NO: 2537627 - DNA, 18 bp, Homo sapiens
aggggcgggacccaggca

SEQ ID NO: 2537628 - DNA, 20 bp, Homo sapiens
aggggcgtgggagtggcctg

SEQ ID NO: 2537629 - DNA, 14 bp, Homo sapiens
aggggctcctggaa

SEQ ID NO: 2537630 - DNA, 22 bp, Homo sapiens
aggggctgctgacctccacagc

SEQ ID NO: 2537631 - DNA, 17 bp, Homo sapiens
aggggctttctggagag

SEQ ID NO: 2537632 - DNA, 16 bp, Homo sapiens
agggggtccacccagc

SEQ ID NO: 2537633 - DNA, 24 bp, Homo sapiens
agggggtcccagtgggaggggcag

SEQ ID NO: 2537634 - DNA, 17 bp, Homo sapiens
agggggtggcctcccaa

SEQ ID NO: 2537635 - DNA, 18 bp, Homo sapiens
agggggtggcctcccaac

SEQ ID NO: 2537636 - DNA, 20 bp, Homo sapiens
agggggtttgctggggaact

SEQ ID NO: 2537637 - DNA, 22 bp, Homo sapiens
aggggtacatttccctgtgctg

SEQ ID NO: 2537638 - DNA, 19 bp, Homo sapiens
aggggtaggcagagccttt

SEQ ID NO: 2537639 - DNA, 16 bp, Homo sapiens
aggggtcaaagaaatg

SEQ ID NO: 2537640 - DNA, 13 bp, Homo sapiens
aggggtcaggctc

SEQ ID NO: 2537641 - DNA, 16 bp, Homo sapiens
aggggtccttggtgtg

SEQ ID NO: 2537642 - DNA, 15 bp, Homo sapiens
aggggtctccctgga

SEQ ID NO: 2537643 - DNA, 19 bp, Homo sapiens
aggggtctccctggagtgc

SEQ ID NO: 2537644 - DNA, 13 bp, Homo sapiens
aggggtgatttca

SEQ ID NO: 2537645 - DNA, 17 bp, Homo sapiens
aggggtgatttcagaga

SEQ ID NO: 2537646 - DNA, 17 bp, Homo sapiens
aggggtgccccctcctc

SEQ ID NO: 2537647 - DNA, 21 bp, Homo sapiens
aggggtgggttcctcttcccc

SEQ ID NO: 2537648 - DNA, 15 bp, Homo sapiens
aggggtgtggctcct

SEQ ID NO: 2537649 - DNA, 15 bp, Homo sapiens
aggggttcgagacca

SEQ ID NO: 2537650 - DNA, 22 bp, Homo sapiens
aggggttttaggtctcttcccc

SEQ ID NO: 2537651 - DNA, 16 bp, Homo sapiens
agggtagcccgcctgc

SEQ ID NO: 2537652 - DNA, 21 bp, Homo sapiens
agggtaggaggtttggatggg

SEQ ID NO: 2537653 - DNA, 16 bp, Homo sapiens
agggtatcaggtgctg

SEQ ID NO: 2537654 - DNA, 21 bp, Homo sapiens
agggtatcaggtgctgccatc

SEQ ID NO: 2537655 - DNA, 15 bp, Homo sapiens
agggtatctggtgac

SEQ ID NO: 2537656 - DNA, 13 bp, Homo sapiens
agggtattccaga

SEQ ID NO: 2537657 - DNA, 20 bp, Homo sapiens
agggtcaacatcttttacat

SEQ ID NO: 2537658 - DNA, 14 bp, Homo sapiens
agggtcaggagagg

SEQ ID NO: 2537659 - DNA, 18 bp, Homo sapiens
agggtcaggagaggggca

SEQ ID NO: 2537660 - DNA, 17 bp, Homo sapiens
agggtcccaagctgggc

SEQ ID NO: 2537661 - DNA, 19 bp, Homo sapiens
agggtcccaagctgggccc

SEQ ID NO: 2537662 - DNA, 11 bp, Homo sapiens
agggtccctgg

SEQ ID NO: 2537663 - DNA, 12 bp, Homo sapiens
agggtccctggg

SEQ ID NO: 2537664 - DNA, 14 bp, Homo sapiens
agggtccctggtgg

SEQ ID NO: 2537665 - DNA, 23 bp, Homo sapiens
agggtcggggaggaaataccaaa

SEQ ID NO: 2537666 - DNA, 21 bp, Homo sapiens
agggtctcactatgttgccca

SEQ ID NO: 2537667 - DNA, 16 bp, Homo sapiens
agggtctcactctgtc

SEQ ID NO: 2537668 - DNA, 20 bp, Homo sapiens
agggtctctagtgctgtgaa

SEQ ID NO: 2537669 - DNA, 17 bp, Homo sapiens
agggtctgggcaggact

SEQ ID NO: 2537670 - DNA, 15 bp, Homo sapiens
agggtcttccctacc

SEQ ID NO: 2537671 - DNA, 22 bp, Homo sapiens
agggtgctacgtacatgtgagg

SEQ ID NO: 2537672 - DNA, 14 bp, Homo sapiens
agggtggcccttgc

SEQ ID NO: 2537673 - DNA, 18 bp, Homo sapiens
agggtggcccttgcagtt

SEQ ID NO: 2537674 - DNA, 16 bp, Homo sapiens
agggtgggagagccca

SEQ ID NO: 2537675 - DNA, 17 bp, Homo sapiens
agggtgggagagcccag

SEQ ID NO: 2537676 - DNA, 18 bp, Homo sapiens
agggtgggagagcccagc

SEQ ID NO: 2537677 - DNA, 21 bp, Homo sapiens
agggtggtgacctctgcctga

SEQ ID NO: 2537678 - DNA, 14 bp, Homo sapiens
agggtggtgctggg

SEQ ID NO: 2537679 - DNA, 14 bp, Homo sapiens
agggttcaaaatgt

SEQ ID NO: 2537680 - DNA, 16 bp, Homo sapiens
agggttcagagactca

SEQ ID NO: 2537681 - DNA, 16 bp, Homo sapiens
agggttgaccccagag

SEQ ID NO: 2537682 - DNA, 14 bp, Homo sapiens
agggttgatcacac

SEQ ID NO: 2537683 - DNA, 14 bp, Homo sapiens
agggttggagcagt

SEQ ID NO: 2537684 - DNA, 14 bp, Homo sapiens
agggttggcccctg

SEQ ID NO: 2537685 - DNA, 17 bp, Homo sapiens
agggttggcccctgccc

SEQ ID NO: 2537686 - DNA, 23 bp, Homo sapiens
agggttggcccctgcccggctgc

SEQ ID NO: 2537687 - DNA, 17 bp, Homo sapiens
agggttgggctggtgtc

SEQ ID NO: 2537688 - DNA, 20 bp, Homo sapiens
agggtttatgtttaggatgt

SEQ ID NO: 2537689 - DNA, 17 bp, Homo sapiens
agggtttcgagaagctg

SEQ ID NO: 2537690 - DNA, 19 bp, Homo sapiens
agggtttcgagaagctgct

SEQ ID NO: 2537691 - DNA, 16 bp, Homo sapiens
agggttttaatgtaga

SEQ ID NO: 2537692 - DNA, 15 bp, Homo sapiens
agggttttccaccct

SEQ ID NO: 2537693 - DNA, 15 bp, Homo sapiens
aggtaaactcctgtc

SEQ ID NO: 2537694 - DNA, 14 bp, Homo sapiens
aggtaacagaacag

SEQ ID NO: 2537695 - DNA, 22 bp, Homo sapiens
aggtaacagaacagcttcaggt

SEQ ID NO: 2537696 - DNA, 16 bp, Homo sapiens
aggtacacagctctag

SEQ ID NO: 2537697 - DNA, 17 bp, Homo sapiens
aggtacccctttctggc

SEQ ID NO: 2537698 - DNA, 16 bp, Homo sapiens
aggtacctttcacata

SEQ ID NO: 2537699 - DNA, 14 bp, Homo sapiens
aggtactctcctgg

SEQ ID NO: 2537700 - DNA, 23 bp, Homo sapiens
aggtagagtttgaaggaggtgag

SEQ ID NO: 2537701 - DNA, 20 bp, Homo sapiens
aggtagatgttcagattgct

SEQ ID NO: 2537702 - DNA, 23 bp, Homo sapiens
aggtatgaccttctaggaagctc

SEQ ID NO: 2537703 - DNA, 20 bp, Homo sapiens
aggtatggaagggtttgtgg

SEQ ID NO: 2537704 - DNA, 22 bp, Homo sapiens
aggtattccttttgtgtacagt

SEQ ID NO: 2537705 - DNA, 14 bp, Homo sapiens
aggtatttatcttt

SEQ ID NO: 2537706 - DNA, 21 bp, Homo sapiens
aggtcaatacagtacaggcag

SEQ ID NO: 2537707 - DNA, 19 bp, Homo sapiens
aggtcactagatggcgagc

SEQ ID NO: 2537708 - DNA, 14 bp, Homo sapiens
aggtcactcctggg

SEQ ID NO: 2537709 - DNA, 19 bp, Homo sapiens
aggtcactcctggggcctc

SEQ ID NO: 2537710 - DNA, 21 bp, Homo sapiens
agtgatatggcagaagacacc

SEQ ID NO: 2537711 - DNA, 22 bp, Homo sapiens
agtgatatggcagaagacacca

SEQ ID NO: 2537712 - DNA, 24 bp, Homo sapiens
agtgatatggcagaagacaccaga

SEQ ID NO: 2537713 - DNA, 16 bp, Homo sapiens
agtgatcaataaaatg

SEQ ID NO: 2537714 - DNA, 14 bp, Homo sapiens
agtgatcacagcag

SEQ ID NO: 2537715 - DNA, 15 bp, Homo sapiens
agtgatcctcccacc

SEQ ID NO: 2537716 - DNA, 20 bp, Homo sapiens
agtgatcctcccacctcagc

SEQ ID NO: 2537717 - DNA, 23 bp, Homo sapiens
agtgatcctcccacctcagcctc

SEQ ID NO: 2537718 - DNA, 21 bp, Homo sapiens
agtgatctccatatgttacac

SEQ ID NO: 2537719 - DNA, 21 bp, Homo sapiens
agtgatgctgtgctatgaatt

SEQ ID NO: 2537720 - DNA, 18 bp, Homo sapiens
agtgattaccagggactg

SEQ ID NO: 2537721 - DNA, 19 bp, Homo sapiens
agtgattctcctgcctcag

SEQ ID NO: 2537722 - DNA, 18 bp, Homo sapiens
agtgcaaatttgatacat

SEQ ID NO: 2537723 - DNA, 24 bp, Homo sapiens
agtgcagcccgtgtggccccttca

SEQ ID NO: 2537724 - DNA, 20 bp, Homo sapiens
agtgcagctgattttaacaa

SEQ ID NO: 2537725 - DNA, 13 bp, Homo sapiens
agtgcaggctggc

SEQ ID NO: 2537726 - DNA, 16 bp, Homo sapiens
agtgcagtcctgatca

SEQ ID NO: 2537727 - DNA, 16 bp, Homo sapiens
agtgcatattcctttc

SEQ ID NO: 2537728 - DNA, 15 bp, Homo sapiens
agtgcatccaaaggt

SEQ ID NO: 2537729 - DNA, 15 bp, Homo sapiens
agtgcattttcccag

SEQ ID NO: 2537730 - DNA, 17 bp, Homo sapiens
agtgcattttcccagat

SEQ ID NO: 2537731 - DNA, 20 bp, Homo sapiens
agtgccactgcccgagctgg

SEQ ID NO: 2537732 - DNA, 21 bp, Homo sapiens
agtgccactgcccgagctggt

SEQ ID NO: 2537733 - DNA, 21 bp, Homo sapiens
agtgccagaggtgggcaggtg

SEQ ID NO: 2537734 - DNA, 22 bp, Homo sapiens
agtgccagaggtgggcaggtgg

SEQ ID NO: 2537735 - DNA, 17 bp, Homo sapiens
agtgcccaactgttata

SEQ ID NO: 2537736 - DNA, 14 bp, Homo sapiens
agtgcccacaggat

SEQ ID NO: 2537737 - DNA, 14 bp, Homo sapiens
agtgcctctggtct

SEQ ID NO: 2537738 - DNA, 22 bp, Homo sapiens
agtgcctgggaatgtattattc

SEQ ID NO: 2537739 - DNA, 19 bp, Homo sapiens
agtgccttcctgtttttca

SEQ ID NO: 2537740 - DNA, 17 bp, Homo sapiens
agtgcgagtatgtgttt

SEQ ID NO: 2537741 - DNA, 15 bp, Homo sapiens
agtgcgtccacgagc

SEQ ID NO: 2537742 - DNA, 16 bp, Homo sapiens
agtgcgtgtgtagagt

SEQ ID NO: 2537743 - DNA, 17 bp, Homo sapiens
agtgctccctcacatgt

SEQ ID NO: 2537744 - DNA, 12 bp, Homo sapiens
agtgctctgata

SEQ ID NO: 2537745 - DNA, 17 bp, Homo sapiens
agtgctctgatccctct

SEQ ID NO: 2537746 - DNA, 13 bp, Homo sapiens
agtgctgcattta

SEQ ID NO: 2537747 - DNA, 16 bp, Homo sapiens
agtgctgcatttaaaa

SEQ ID NO: 2537748 - DNA, 22 bp, Homo sapiens
agtgctgcatttaaaagataca

SEQ ID NO: 2537749 - DNA, 22 bp, Homo sapiens
agtgctgggattacaggcatga

SEQ ID NO: 2537750 - DNA, 20 bp, Homo sapiens
agtgctgggattacaggcgt

SEQ ID NO: 2537751 - DNA, 20 bp, Homo sapiens
agtgctgtctgatctgtgct

SEQ ID NO: 2537752 - DNA, 16 bp, Homo sapiens
agtgctgtggcctggg

SEQ ID NO: 2537753 - DNA, 15 bp, Homo sapiens
agtgcttcagcctga

SEQ ID NO: 2537754 - DNA, 16 bp, Homo sapiens
agtgcttcagcctgag

SEQ ID NO: 2537755 - DNA, 17 bp, Homo sapiens
agtgcttccaaggcaga

SEQ ID NO: 2537756 - DNA, 19 bp, Homo sapiens
agtgcttgccacagagcgg

SEQ ID NO: 2537757 - DNA, 22 bp, Homo sapiens
agtggaaagacagcttctcatc

SEQ ID NO: 2537758 - DNA, 17 bp, Homo sapiens
agtggaagaagagggag

SEQ ID NO: 2537759 - DNA, 17 bp, Homo sapiens
agtggaatagtatcctc

SEQ ID NO: 2537760 - DNA, 20 bp, Homo sapiens
agtggacaccaggagtccct

SEQ ID NO: 2537761 - DNA, 22 bp, Homo sapiens
agtggacaccaggagtccctgg

SEQ ID NO: 2537762 - DNA, 20 bp, Homo sapiens
agtggactttccaccccctc

SEQ ID NO: 2537763 - DNA, 20 bp, Homo sapiens
agtggatgatgtttcgtgaa

SEQ ID NO: 2537764 - DNA, 14 bp, Homo sapiens
agtggcagggctca

SEQ ID NO: 2537765 - DNA, 17 bp, Homo sapiens
agtggcagggctcagga

SEQ ID NO: 2537766 - DNA, 18 bp, Homo sapiens
agtggcagggctcaggat

SEQ ID NO: 2537767 - DNA, 21 bp, Homo sapiens
agtggcctctttgtctaaaac

SEQ ID NO: 2537768 - DNA, 23 bp, Homo sapiens
agtggcctctttgtctaaaacaa

SEQ ID NO: 2537769 - DNA, 14 bp, Homo sapiens
agtggctcaacatt

SEQ ID NO: 2537770 - DNA, 12 bp, Homo sapiens
agtggctgctgc

SEQ ID NO: 2537771 - DNA, 17 bp, Homo sapiens
agtggctttaatgaata

SEQ ID NO: 2537772 - DNA, 21 bp, Homo sapiens
agtggcttttttcctcctgtg

SEQ ID NO: 2537773 - DNA, 16 bp, Homo sapiens
agtgggagctgcctgt

SEQ ID NO: 2537774 - DNA, 16 bp, Homo sapiens
agtgggaggcgcgagc

SEQ ID NO: 2537775 - DNA, 12 bp, Homo sapiens
agtgggaggggc

SEQ ID NO: 2537776 - DNA, 17 bp, Homo sapiens
agtgggaggggcaggct

SEQ ID NO: 2537777 - DNA, 19 bp, Homo sapiens
agtgggaggggcaggctga

SEQ ID NO: 2537778 - DNA, 19 bp, Homo sapiens
agtgggccctccgacagcc

SEQ ID NO: 2537779 - DNA, 16 bp, Homo sapiens
agtgggggagagcagg

SEQ ID NO: 2537780 - DNA, 23 bp, Homo sapiens
agtgggggagagcaggctggcag

SEQ ID NO: 2537781 - DNA, 18 bp, Homo sapiens
agtggggttatctctgtg

SEQ ID NO: 2537782 - DNA, 21 bp, Homo sapiens
agtggggttatctctgtgtta

SEQ ID NO: 2537783 - DNA, 15 bp, Homo sapiens
agtgggtttcacaag

SEQ ID NO: 2537784 - DNA, 21 bp, Homo sapiens
agtgggtttcacaagtgaaaa

SEQ ID NO: 2537785 - DNA, 19 bp, Homo sapiens
agtggtaagctctggcttt

SEQ ID NO: 2537786 - DNA, 14 bp, Homo sapiens
agtggtatagaaat

SEQ ID NO: 2537787 - DNA, 22 bp, Homo sapiens
agtggtcaaaccgcactcaccc

SEQ ID NO: 2537788 - DNA, 20 bp, Homo sapiens
agtggtctttcctatcatgg

SEQ ID NO: 2537789 - DNA, 13 bp, Homo sapiens
agtggtctttctg

SEQ ID NO: 2537790 - DNA, 18 bp, Homo sapiens
agtggtctttgtaagagt

SEQ ID NO: 2537791 - DNA, 22 bp, Homo sapiens
agtggtctttgtaagagtgtag

SEQ ID NO: 2537792 - DNA, 16 bp, Homo sapiens
agtggtgcgatctggg

SEQ ID NO: 2537793 - DNA, 16 bp, Homo sapiens
agtggtgctcagttgt

SEQ ID NO: 2537794 - DNA, 20 bp, Homo sapiens
agtggtgctcagttgtagaa

SEQ ID NO: 2537795 - DNA, 11 bp, Homo sapiens
agtggtggcag

SEQ ID NO: 2537796 - DNA, 14 bp, Homo sapiens
agtggtggcagggc

SEQ ID NO: 2537797 - DNA, 16 bp, Homo sapiens
agtggtggcagggcct

SEQ ID NO: 2537798 - DNA, 17 bp, Homo sapiens
agtggtggttttctgtt

SEQ ID NO: 2537799 - DNA, 21 bp, Homo sapiens
agtggtggttttctgttcttt

SEQ ID NO: 2537800 - DNA, 19 bp, Homo sapiens
agtggttgttagttataga

SEQ ID NO: 2537801 - DNA, 18 bp, Homo sapiens
agtgtaaagcattccaac

SEQ ID NO: 2537802 - DNA, 21 bp, Homo sapiens
agtgtaaatagttactccagt

SEQ ID NO: 2537803 - DNA, 17 bp, Homo sapiens
agtgtaacagctgaggt

SEQ ID NO: 2537804 - DNA, 20 bp, Homo sapiens
agtgtaatttctttgcctgt

SEQ ID NO: 2537805 - DNA, 21 bp, Homo sapiens
agtgtacatggaataacatgt

SEQ ID NO: 2537806 - DNA, 23 bp, Homo sapiens
agtgtacatggaataacatgtaa

SEQ ID NO: 2537807 - DNA, 13 bp, Homo sapiens
agtgtagaagcat

SEQ ID NO: 2537808 - DNA, 14 bp, Homo sapiens
agtgtagaagcatt

SEQ ID NO: 2537809 - DNA, 18 bp, Homo sapiens
agtgtagaagcattcctt

SEQ ID NO: 2537810 - DNA, 13 bp, Homo sapiens
agtgtagccttgc

SEQ ID NO: 2537811 - DNA, 18 bp, Homo sapiens
agtgtagccttgcccgga

SEQ ID NO: 2537812 - DNA, 17 bp, Homo sapiens
agtgtatgcacgtgtgc

SEQ ID NO: 2537813 - DNA, 17 bp, Homo sapiens
agtgtatttttttacta

SEQ ID NO: 2537814 - DNA, 14 bp, Homo sapiens
agtgtcaagttgtg

SEQ ID NO: 2537815 - DNA, 17 bp, Homo sapiens
agtgtcaagttgtgctt

SEQ ID NO: 2537816 - DNA, 18 bp, Homo sapiens
agtgtcaagttgtgcttg

SEQ ID NO: 2537817 - DNA, 19 bp, Homo sapiens
agtgtcaagttgtgcttgt

SEQ ID NO: 2537818 - DNA, 20 bp, Homo sapiens
agtgtcaagttgtgcttgtt

SEQ ID NO: 2537819 - DNA, 19 bp, Homo sapiens
agtgtcaatgcagccccca

SEQ ID NO: 2537820 - DNA, 13 bp, Homo sapiens
agtgtcccctcca

SEQ ID NO: 2537821 - DNA, 17 bp, Homo sapiens
agtgtcccctccactgt

SEQ ID NO: 2537822 - DNA, 22 bp, Homo sapiens
agtgtctcggagggattcccct

SEQ ID NO: 2537823 - DNA, 21 bp, Homo sapiens
agtgtcttaattaaaagaata

SEQ ID NO: 2537824 - DNA, 14 bp, Homo sapiens
agtgtcttccataa

SEQ ID NO: 2537825 - DNA, 22 bp, Homo sapiens
agtgtgaacaaaagatgctctt

SEQ ID NO: 2537826 - DNA, 14 bp, Homo sapiens
agtgtgaagttaga

SEQ ID NO: 2537827 - DNA, 12 bp, Homo sapiens
agtgtgagaatc

SEQ ID NO: 2537828 - DNA, 16 bp, Homo sapiens
agtgtgagcagtgagt

SEQ ID NO: 2537829 - DNA, 15 bp, Homo sapiens
agtgtgaggccaggg

SEQ ID NO: 2537830 - DNA, 18 bp, Homo sapiens
agtgtgaggccagggcag

SEQ ID NO: 2537831 - DNA, 16 bp, Homo sapiens
agtgtgagtaagagct

SEQ ID NO: 2537832 - DNA, 17 bp, Homo sapiens
agtgtgagtaagagctg

SEQ ID NO: 2537833 - DNA, 18 bp, Homo sapiens
agtgtgagtaagagctgg

SEQ ID NO: 2537834 - DNA, 18 bp, Homo sapiens
agtgtgattgggaataaa

SEQ ID NO: 2537835 - DNA, 21 bp, Homo sapiens
agtgtgcagttctagtttgca

SEQ ID NO: 2537836 - DNA, 16 bp, Homo sapiens
agtgtgcatattgtac

SEQ ID NO: 2537837 - DNA, 13 bp, Homo sapiens
agtgtgctggagg

SEQ ID NO: 2537838 - DNA, 20 bp, Homo sapiens
agtgtggaagccggagggtg

SEQ ID NO: 2537839 - DNA, 14 bp, Homo sapiens
agtgtggctcccct

SEQ ID NO: 2537840 - DNA, 16 bp, Homo sapiens
agtgtgggtctgtgtg

SEQ ID NO: 2537841 - DNA, 23 bp, Homo sapiens
agtgtggtgtttcctgcaggcca

SEQ ID NO: 2537842 - DNA, 17 bp, Homo sapiens
agtgtggtgtttcctgg

SEQ ID NO: 2537843 - DNA, 9 bp, Homo sapiens
agtgtgtaa

SEQ ID NO: 2537844 - DNA, 11 bp, Homo sapiens
agtgtgtaaag

SEQ ID NO: 2537845 - DNA, 15 bp, Homo sapiens
agtgtgtattgttcc

SEQ ID NO: 2537846 - DNA, 19 bp, Homo sapiens
agtgtgtattgttcccagt

SEQ ID NO: 2537847 - DNA, 18 bp, Homo sapiens
agtgtgtgcacatgtgtg

SEQ ID NO: 2537848 - DNA, 19 bp, Homo sapiens
agtgtgtgcacatgtgtgc

SEQ ID NO: 2537849 - DNA, 14 bp, Homo sapiens
agtgtgtgcatgtg

SEQ ID NO: 2537850 - DNA, 18 bp, Homo sapiens
agtgtgtgcatgtgtgtg

SEQ ID NO: 2537851 - DNA, 14 bp, Homo sapiens
agtgtgtgggtcta

SEQ ID NO: 2537852 - DNA, 12 bp, Homo sapiens
agtgtgtgtgcg

SEQ ID NO: 2537853 - DNA, 21 bp, Homo sapiens
agtgtgttctgattagaaatg

SEQ ID NO: 2537854 - DNA, 21 bp, Homo sapiens
ataactttgcttgcagtagat

SEQ ID NO: 2537855 - DNA, 22 bp, Homo sapiens
ataagaaaagatgtagatttat

SEQ ID NO: 2537856 - DNA, 21 bp, Homo sapiens
ataagacggatttatttttcc

SEQ ID NO: 2537857 - DNA, 18 bp, Homo sapiens
ataagagaaagaaaatga

SEQ ID NO: 2537858 - DNA, 16 bp, Homo sapiens
ataagagagtcataaa

SEQ ID NO: 2537859 - DNA, 17 bp, Homo sapiens
ataagagggcacacact

SEQ ID NO: 2537860 - DNA, 13 bp, Homo sapiens
ataagataaatgt

SEQ ID NO: 2537861 - DNA, 18 bp, Homo sapiens
ataagatatttttcatga

SEQ ID NO: 2537862 - DNA, 23 bp, Homo sapiens
ataagcaaagggagcactgggtt

SEQ ID NO: 2537863 - DNA, 12 bp, Homo sapiens
ataagcaagaga

SEQ ID NO: 2537864 - DNA, 15 bp, Homo sapiens
ataagcaagagagat

SEQ ID NO: 2537865 - DNA, 16 bp, Homo sapiens
ataagcagatttaaca

SEQ ID NO: 2537866 - DNA, 21 bp, Homo sapiens
ataagcctccatttagttctt

SEQ ID NO: 2537867 - DNA, 14 bp, Homo sapiens
ataaggatcagaac

SEQ ID NO: 2537868 - DNA, 18 bp, Homo sapiens
ataaggccttaatatgtt

SEQ ID NO: 2537869 - DNA, 13 bp, Homo sapiens
ataagggcagagt

SEQ ID NO: 2537870 - DNA, 15 bp, Homo sapiens
ataagggcagagtca

SEQ ID NO: 2537871 - DNA, 18 bp, Homo sapiens
ataagggtatctggtgac

SEQ ID NO: 2537872 - DNA, 19 bp, Homo sapiens
ataaggtttcgtttctgta

SEQ ID NO: 2537873 - DNA, 20 bp, Homo sapiens
ataaggtttcgtttctgtat

SEQ ID NO: 2537874 - DNA, 21 bp, Homo sapiens
ataagtgtgtggtcccaagtt

SEQ ID NO: 2537875 - DNA, 22 bp, Homo sapiens
ataagttaactattttattttc

SEQ ID NO: 2537876 - DNA, 22 bp, Homo sapiens
ataagttaacttccaatttaca

SEQ ID NO: 2537877 - DNA, 21 bp, Homo sapiens
ataagttattgcagtttatca

SEQ ID NO: 2537878 - DNA, 24 bp, Homo sapiens
ataagttattgcagtttatcattc

SEQ ID NO: 2537879 - DNA, 14 bp, Homo sapiens
ataagtttatttct

SEQ ID NO: 2537880 - DNA, 18 bp, Homo sapiens
ataagtttatttcttaaa

SEQ ID NO: 2537881 - DNA, 22 bp, Homo sapiens
ataagtttatttcttaaatcta

SEQ ID NO: 2537882 - DNA, 20 bp, Homo sapiens
ataagtttgaaggaaacagt

SEQ ID NO: 2537883 - DNA, 17 bp, Homo sapiens
ataagtttgcaatttgg

SEQ ID NO: 2537884 - DNA, 12 bp, Homo sapiens
ataataatatat

SEQ ID NO: 2537885 - DNA, 21 bp, Homo sapiens
ataatacagccaaagataatc

SEQ ID NO: 2537886 - DNA, 19 bp, Homo sapiens
ataatacagtatctcaggg

SEQ ID NO: 2537887 - DNA, 20 bp, Homo sapiens
ataatagtttacatgtagta

SEQ ID NO: 2537888 - DNA, 22 bp, Homo sapiens
ataatatatgtttaccttttaa

SEQ ID NO: 2537889 - DNA, 15 bp, Homo sapiens
ataatatattttctg

SEQ ID NO: 2537890 - DNA, 20 bp, Homo sapiens
ataatatgcacacagtgctt

SEQ ID NO: 2537891 - DNA, 14 bp, Homo sapiens
ataatcagcctctt

SEQ ID NO: 2537892 - DNA, 17 bp, Homo sapiens
ataatccagtcttcact

SEQ ID NO: 2537893 - DNA, 12 bp, Homo sapiens
ataatctagaac

SEQ ID NO: 2537894 - DNA, 18 bp, Homo sapiens
ataatctctccattcccg

SEQ ID NO: 2537895 - DNA, 15 bp, Homo sapiens
ataatcttctgcctt

SEQ ID NO: 2537896 - DNA, 18 bp, Homo sapiens
ataatgggcttagagcag

SEQ ID NO: 2537897 - DNA, 19 bp, Homo sapiens
ataatggtaccagataaaa

SEQ ID NO: 2537898 - DNA, 18 bp, Homo sapiens
ataatggtcccatccagg

SEQ ID NO: 2537899 - DNA, 14 bp, Homo sapiens
ataatgtattgttg

SEQ ID NO: 2537900 - DNA, 13 bp, Homo sapiens
ataatgtgaaaat

SEQ ID NO: 2537901 - DNA, 21 bp, Homo sapiens
ataatgtgaaactggattaaa

SEQ ID NO: 2537902 - DNA, 10 bp, Homo sapiens
ataatgttaa

SEQ ID NO: 2537903 - DNA, 11 bp, Homo sapiens
ataatgttaaa

SEQ ID NO: 2537904 - DNA, 19 bp, Homo sapiens
ataatgttaaatttgtaag

SEQ ID NO: 2537905 - DNA, 14 bp, Homo sapiens
ataatgttgttatt

SEQ ID NO: 2537906 - DNA, 14 bp, Homo sapiens
ataatgtttgctat

SEQ ID NO: 2537907 - DNA, 16 bp, Homo sapiens
ataattataatatact

SEQ ID NO: 2537908 - DNA, 21 bp, Homo sapiens
ataattatcggaagcagtgcc

SEQ ID NO: 2537909 - DNA, 14 bp, Homo sapiens
ataattatgacagt

SEQ ID NO: 2537910 - DNA, 17 bp, Homo sapiens
ataattatttatttaat

SEQ ID NO: 2537911 - DNA, 21 bp, Homo sapiens
ataattatttatttaataaca

SEQ ID NO: 2537912 - DNA, 17 bp, Homo sapiens
ataattccctatctttt

SEQ ID NO: 2537913 - DNA, 20 bp, Homo sapiens
ataattccctatcttttagt

SEQ ID NO: 2537914 - DNA, 14 bp, Homo sapiens
ataattctactttg

SEQ ID NO: 2537915 - DNA, 11 bp, Homo sapiens
ataattctgta

SEQ ID NO: 2537916 - DNA, 13 bp, Homo sapiens
ataattctgtaca

SEQ ID NO: 2537917 - DNA, 17 bp, Homo sapiens
ataattctgtactgatt

SEQ ID NO: 2537918 - DNA, 14 bp, Homo sapiens
ataattcttgtata

SEQ ID NO: 2537919 - DNA, 15 bp, Homo sapiens
ataattgatcaaatt

SEQ ID NO: 2537920 - DNA, 20 bp, Homo sapiens
ataattgtatcgtatagctg

SEQ ID NO: 2537921 - DNA, 11 bp, Homo sapiens
ataatttccca

SEQ ID NO: 2537922 - DNA, 18 bp, Homo sapiens
ataatttcccaattagga

SEQ ID NO: 2537923 - DNA, 22 bp, Homo sapiens
ataatttcccaattaggaagtg

SEQ ID NO: 2537924 - DNA, 19 bp, Homo sapiens
ataatttgtacatatgtaa

SEQ ID NO: 2537925 - DNA, 13 bp, Homo sapiens
ataattttcttca

SEQ ID NO: 2537926 - DNA, 17 bp, Homo sapiens
ataattttcttcatgca

SEQ ID NO: 2537927 - DNA, 23 bp, Homo sapiens
ataattttcttcatgcaatgaca

SEQ ID NO: 2537928 - DNA, 18 bp, Homo sapiens
ataatttttaaagtatat

SEQ ID NO: 2537929 - DNA, 16 bp, Homo sapiens
ataattttttattcaa

SEQ ID NO: 2537930 - DNA, 21 bp, Homo sapiens
ataatttttttcaatatttat

SEQ ID NO: 2537931 - DNA, 12 bp, Homo sapiens
atacaaaagcat

SEQ ID NO: 2537932 - DNA, 15 bp, Homo sapiens
atacaatatcatcca

SEQ ID NO: 2537933 - DNA, 18 bp, Homo sapiens
atacaatgtatttattta

SEQ ID NO: 2537934 - DNA, 20 bp, Homo sapiens
atacaatgtatttatttaaa

SEQ ID NO: 2537935 - DNA, 21 bp, Homo sapiens
atacacacacacacacagcca

SEQ ID NO: 2537936 - DNA, 20 bp, Homo sapiens
atacacactcaaatcaagaa

SEQ ID NO: 2537937 - DNA, 14 bp, Homo sapiens
atacacaggatcct

SEQ ID NO: 2537938 - DNA, 17 bp, Homo sapiens
atacaccactacattct

SEQ ID NO: 2537939 - DNA, 19 bp, Homo sapiens
atacaccactacattctgt

SEQ ID NO: 2537940 - DNA, 21 bp, Homo sapiens
atacactgaagttaacagaga

SEQ ID NO: 2537941 - DNA, 16 bp, Homo sapiens
atacagaactctttca

SEQ ID NO: 2537942 - DNA, 18 bp, Homo sapiens
atacagaactctttcaaa

SEQ ID NO: 2537943 - DNA, 23 bp, Homo sapiens
atacagaactctttcaaaacctt

SEQ ID NO: 2537944 - DNA, 19 bp, Homo sapiens
atacagacactaagttata

SEQ ID NO: 2537945 - DNA, 18 bp, Homo sapiens
atacagaccgaactgttg

SEQ ID NO: 2537946 - DNA, 21 bp, Homo sapiens
atacagaccgaactgttgtat

SEQ ID NO: 2537947 - DNA, 16 bp, Homo sapiens
atacagaggcaactgc

SEQ ID NO: 2537948 - DNA, 17 bp, Homo sapiens
atacagaggcaactgca

SEQ ID NO: 2537949 - DNA, 20 bp, Homo sapiens
atacagccctcccccagcag

SEQ ID NO: 2537950 - DNA, 14 bp, Homo sapiens
atacaggaaaagct

SEQ ID NO: 2537951 - DNA, 20 bp, Homo sapiens
atacaggaaaagctgctgac

SEQ ID NO: 2537952 - DNA, 23 bp, Homo sapiens
atacaggaaaagctgctgacagt

SEQ ID NO: 2537953 - DNA, 19 bp, Homo sapiens
atacagtcttccatttgca

SEQ ID NO: 2537954 - DNA, 20 bp, Homo sapiens
atacagtcttccatttgcaa

SEQ ID NO: 2537955 - DNA, 20 bp, Homo sapiens
atacagttactcagaattct

SEQ ID NO: 2537956 - DNA, 21 bp, Homo sapiens
atacataagcggcgtaagttt

SEQ ID NO: 2537957 - DNA, 10 bp, Homo sapiens
atacatgcca

SEQ ID NO: 2537958 - DNA, 20 bp, Homo sapiens
atacatttctcctttgataa

SEQ ID NO: 2537959 - DNA, 16 bp, Homo sapiens
atacatttgataaagt

SEQ ID NO: 2537960 - DNA, 19 bp, Homo sapiens
ataccaaaattatttcaga

SEQ ID NO: 2537961 - DNA, 20 bp, Homo sapiens
ataccaaaattatttcagaa

SEQ ID NO: 2537962 - DNA, 17 bp, Homo sapiens
ataccaagtatttatta

SEQ ID NO: 2537963 - DNA, 21 bp, Homo sapiens
ataccaatgaaaaaatgtata

SEQ ID NO: 2537964 - DNA, 14 bp, Homo sapiens
ataccaggttgaaa

SEQ ID NO: 2537965 - DNA, 17 bp, Homo sapiens
ataccagtgaaccaaag

SEQ ID NO: 2537966 - DNA, 20 bp, Homo sapiens
ataccagtgaaccaaagaga

SEQ ID NO: 2537967 - DNA, 12 bp, Homo sapiens
ataccagtgtgg

SEQ ID NO: 2537968 - DNA, 11 bp, Homo sapiens
atacccacccc

SEQ ID NO: 2537969 - DNA, 13 bp, Homo sapiens
atacctaaaagag

SEQ ID NO: 2537970 - DNA, 20 bp, Homo sapiens
atacctgattttttttcctt

SEQ ID NO: 2537971 - DNA, 20 bp, Homo sapiens
atacctgggatactgtgccc

SEQ ID NO: 2537972 - DNA, 15 bp, Homo sapiens
atacctttgccttgg

SEQ ID NO: 2537973 - DNA, 17 bp, Homo sapiens
atacgactttattttct

SEQ ID NO: 2537974 - DNA, 13 bp, Homo sapiens
atactaaaaatca

SEQ ID NO: 2537975 - DNA, 19 bp, Homo sapiens
atactaaccagcagaaatg

SEQ ID NO: 2537976 - DNA, 14 bp, Homo sapiens
atactagttgtgac

SEQ ID NO: 2537977 - DNA, 17 bp, Homo sapiens
atactatggaatttctc

SEQ ID NO: 2537978 - DNA, 20 bp, Homo sapiens
atactatttagtttttgtaa

SEQ ID NO: 2537979 - DNA, 15 bp, Homo sapiens
atactatttttactg

SEQ ID NO: 2537980 - DNA, 19 bp, Homo sapiens
atactatttttactgccac

SEQ ID NO: 2537981 - DNA, 20 bp, Homo sapiens
atactatttttactgccact

SEQ ID NO: 2537982 - DNA, 13 bp, Homo sapiens
atactcatgtgta

SEQ ID NO: 2537983 - DNA, 14 bp, Homo sapiens
atactcatgtgtat

SEQ ID NO: 2537984 - DNA, 11 bp, Homo sapiens
atactcccatc

SEQ ID NO: 2537985 - DNA, 16 bp, Homo sapiens
atactctgcttagaat

SEQ ID NO: 2537986 - DNA, 19 bp, Homo sapiens
atactcttaggaagagaaa

SEQ ID NO: 2537987 - DNA, 21 bp, Homo sapiens
atactcttaggaagagaaacc

SEQ ID NO: 2537988 - DNA, 22 bp, Homo sapiens
atactcttaggaagagaaacca

SEQ ID NO: 2537989 - DNA, 14 bp, Homo sapiens
atactgagggacca

SEQ ID NO: 2537990 - DNA, 21 bp, Homo sapiens
atactgcatactttttaaatg

SEQ ID NO: 2537991 - DNA, 16 bp, Homo sapiens
atactgccagatgctg

SEQ ID NO: 2537992 - DNA, 17 bp, Homo sapiens
atactgccagatgctga

SEQ ID NO: 2537993 - DNA, 13 bp, Homo sapiens
atactggaagttt

SEQ ID NO: 2537994 - DNA, 19 bp, Homo sapiens
atactggaagttttgcatt

SEQ ID NO: 2537995 - DNA, 20 bp, Homo sapiens
atactggaagttttgcattt

SEQ ID NO: 2537996 - DNA, 21 bp, Homo sapiens
atactggtgcagtcattatga

SEQ ID NO: 2537997 - DNA, 14 bp, Homo sapiens
atactgtaaagaaa

SEQ ID NO: 2537998 - DNA, 22 bp, Homo sapiens
atactgtaaagaaagagagaaa

SEQ ID NO: 2537999 - DNA, 16 bp, Homo sapiens
atcaaagcaatgcatt

SEQ ID NO: 2538000 - DNA, 17 bp, Homo sapiens
atcaaagcaatgcattt

SEQ ID NO: 2538001 - DNA, 14 bp, Homo sapiens
atcaaagccacact

SEQ ID NO: 2538002 - DNA, 18 bp, Homo sapiens
atcaaagtaggcaggacc

SEQ ID NO: 2538003 - DNA, 21 bp, Homo sapiens
atcaaatactttaaaggaaaa

SEQ ID NO: 2538004 - DNA, 20 bp, Homo sapiens
atcaaatatgcaaagcactg

SEQ ID NO: 2538005 - DNA, 13 bp, Homo sapiens
atcaaatattaga

SEQ ID NO: 2538006 - DNA, 14 bp, Homo sapiens
atcaaatattagat

SEQ ID NO: 2538007 - DNA, 19 bp, Homo sapiens
atcaaatattagatgtgat

SEQ ID NO: 2538008 - DNA, 21 bp, Homo sapiens
atcaaatattagatgtgattt

SEQ ID NO: 2538009 - DNA, 21 bp, Homo sapiens
atcaaatggaagacacattga

SEQ ID NO: 2538010 - DNA, 13 bp, Homo sapiens
atcaactgaatga

SEQ ID NO: 2538011 - DNA, 14 bp, Homo sapiens
atcaactgaatgag

SEQ ID NO: 2538012 - DNA, 15 bp, Homo sapiens
atcaagactggaagg

SEQ ID NO: 2538013 - DNA, 12 bp, Homo sapiens
atcaagctgtga

SEQ ID NO: 2538014 - DNA, 14 bp, Homo sapiens
atcaaggcactgcc

SEQ ID NO: 2538015 - DNA, 15 bp, Homo sapiens
atcaaggcactgcct

SEQ ID NO: 2538016 - DNA, 16 bp, Homo sapiens
atcaaggcactgcctg

SEQ ID NO: 2538017 - DNA, 12 bp, Homo sapiens
atcaagtcaccg

SEQ ID NO: 2538018 - DNA, 17 bp, Homo sapiens
atcaataaaatgtgatt

SEQ ID NO: 2538019 - DNA, 15 bp, Homo sapiens
atcaataaacgattt

SEQ ID NO: 2538020 - DNA, 21 bp, Homo sapiens
atcaataatatattttctgtt

SEQ ID NO: 2538021 - DNA, 13 bp, Homo sapiens
atcaatcaaaccc

SEQ ID NO: 2538022 - DNA, 16 bp, Homo sapiens
atcaatccttgttcag

SEQ ID NO: 2538023 - DNA, 22 bp, Homo sapiens
atcaatggcgcagtgcctctgg

SEQ ID NO: 2538024 - DNA, 14 bp, Homo sapiens
atcaatgttcattg

SEQ ID NO: 2538025 - DNA, 16 bp, Homo sapiens
atcaatgttcattgta

SEQ ID NO: 2538026 - DNA, 19 bp, Homo sapiens
atcaatgtttcttctaggt

SEQ ID NO: 2538027 - DNA, 17 bp, Homo sapiens
atcaatttaaacccatt

SEQ ID NO: 2538028 - DNA, 21 bp, Homo sapiens
atcaatttaaacccattttag

SEQ ID NO: 2538029 - DNA, 20 bp, Homo sapiens
atcaatttgtaattgcttac

SEQ ID NO: 2538030 - DNA, 14 bp, Homo sapiens
atcaatttttctta

SEQ ID NO: 2538031 - DNA, 14 bp, Homo sapiens
atcacagcagcttc

SEQ ID NO: 2538032 - DNA, 16 bp, Homo sapiens
atcacagctgctttct

SEQ ID NO: 2538033 - DNA, 21 bp, Homo sapiens
atcacagcttcagccaggagc

SEQ ID NO: 2538034 - DNA, 22 bp, Homo sapiens
atcacagcttcagccaggagct

SEQ ID NO: 2538035 - DNA, 20 bp, Homo sapiens
atcacagggcagagccggga

SEQ ID NO: 2538036 - DNA, 19 bp, Homo sapiens
atcacagggttgggcccag

SEQ ID NO: 2538037 - DNA, 15 bp, Homo sapiens
atcacagttttggtt

SEQ ID NO: 2538038 - DNA, 22 bp, Homo sapiens
atcacagttttggttgctttaa

SEQ ID NO: 2538039 - DNA, 18 bp, Homo sapiens
atcaccaacgtctgtgcc

SEQ ID NO: 2538040 - DNA, 13 bp, Homo sapiens
atcaccacagttt

SEQ ID NO: 2538041 - DNA, 12 bp, Homo sapiens
atcaccagagag

SEQ ID NO: 2538042 - DNA, 14 bp, Homo sapiens
atcacctcaggcca

SEQ ID NO: 2538043 - DNA, 12 bp, Homo sapiens
atcacctgaggt

SEQ ID NO: 2538044 - DNA, 16 bp, Homo sapiens
atcaccttaggcaggg

SEQ ID NO: 2538045 - DNA, 13 bp, Homo sapiens
atcacgccactgc

SEQ ID NO: 2538046 - DNA, 19 bp, Homo sapiens
atcacggctcactgcagcc

SEQ ID NO: 2538047 - DNA, 14 bp, Homo sapiens
atcacgtaaagcta

SEQ ID NO: 2538048 - DNA, 13 bp, Homo sapiens
atcactactgcag

SEQ ID NO: 2538049 - DNA, 13 bp, Homo sapiens
atcactcccctcc

SEQ ID NO: 2538050 - DNA, 14 bp, Homo sapiens
atcactcttgtgga

SEQ ID NO: 2538051 - DNA, 16 bp, Homo sapiens
atcactggcaatgaaa

SEQ ID NO: 2538052 - DNA, 22 bp, Homo sapiens
atcactggcaatgaaaaattct

SEQ ID NO: 2538053 - DNA, 18 bp, Homo sapiens
atcactttctcagttttc

SEQ ID NO: 2538054 - DNA, 13 bp, Homo sapiens
atcagaaaaggga

SEQ ID NO: 2538055 - DNA, 15 bp, Homo sapiens
atcagaaaagggaag

SEQ ID NO: 2538056 - DNA, 14 bp, Homo sapiens
atcagaagataact

SEQ ID NO: 2538057 - DNA, 11 bp, Homo sapiens
atcagaattct

SEQ ID NO: 2538058 - DNA, 19 bp, Homo sapiens
atcagacactctggctggt

SEQ ID NO: 2538059 - DNA, 23 bp, Homo sapiens
atcagatgaactcttagaaatga

SEQ ID NO: 2538060 - DNA, 17 bp, Homo sapiens
atcagcacgatttctgt

SEQ ID NO: 2538061 - DNA, 20 bp, Homo sapiens
atcagcctaggggtcaggga

SEQ ID NO: 2538062 - DNA, 12 bp, Homo sapiens
atcagcctgagt

SEQ ID NO: 2538063 - DNA, 17 bp, Homo sapiens
atcagcctgagtctcct

SEQ ID NO: 2538064 - DNA, 18 bp, Homo sapiens
atcagcctgagtctcctg

SEQ ID NO: 2538065 - DNA, 20 bp, Homo sapiens
atcagcctgagtctcctgtg

SEQ ID NO: 2538066 - DNA, 11 bp, Homo sapiens
atcagcctggg

SEQ ID NO: 2538067 - DNA, 21 bp, Homo sapiens
atcagcctgggcaatgtgata

SEQ ID NO: 2538068 - DNA, 15 bp, Homo sapiens
atcagctatttactg

SEQ ID NO: 2538069 - DNA, 13 bp, Homo sapiens
atcagctccttcc

SEQ ID NO: 2538070 - DNA, 12 bp, Homo sapiens
atcagctgctac

SEQ ID NO: 2538071 - DNA, 17 bp, Homo sapiens
atcagctgctgaaacaa

SEQ ID NO: 2538072 - DNA, 22 bp, Homo sapiens
atcagctgctgaaacaacaaat

SEQ ID NO: 2538073 - DNA, 12 bp, Homo sapiens
atcaggatgaac

SEQ ID NO: 2538074 - DNA, 18 bp, Homo sapiens
atcaggatgaacccagga

SEQ ID NO: 2538075 - DNA, 19 bp, Homo sapiens
atcaggatgaacccaggac

SEQ ID NO: 2538076 - DNA, 20 bp, Homo sapiens
atcaggccaggccctctgcc

SEQ ID NO: 2538077 - DNA, 13 bp, Homo sapiens
atcaggccattgt

SEQ ID NO: 2538078 - DNA, 13 bp, Homo sapiens
atcaggctgaggt

SEQ ID NO: 2538079 - DNA, 18 bp, Homo sapiens
atcagggaggtcattttg

SEQ ID NO: 2538080 - DNA, 14 bp, Homo sapiens
atcaggtgctgcca

SEQ ID NO: 2538081 - DNA, 17 bp, Homo sapiens
atcaggtgctgccatcc

SEQ ID NO: 2538082 - DNA, 19 bp, Homo sapiens
atcaggtgctgccatccag

SEQ ID NO: 2538083 - DNA, 13 bp, Homo sapiens
atcaggtggggag

SEQ ID NO: 2538084 - DNA, 15 bp, Homo sapiens
atcagtaatatttat

SEQ ID NO: 2538085 - DNA, 18 bp, Homo sapiens
atcagtagccagcatctg

SEQ ID NO: 2538086 - DNA, 21 bp, Homo sapiens
atcagtataattctgtactga

SEQ ID NO: 2538087 - DNA, 15 bp, Homo sapiens
atcagtattgaagca

SEQ ID NO: 2538088 - DNA, 22 bp, Homo sapiens
atcagtattgaagcattttata

SEQ ID NO: 2538089 - DNA, 19 bp, Homo sapiens
atcagtcataactaaataa

SEQ ID NO: 2538090 - DNA, 16 bp, Homo sapiens
atcagtcccctcccat

SEQ ID NO: 2538091 - DNA, 22 bp, Homo sapiens
atcagtcccctcccatctggga

SEQ ID NO: 2538092 - DNA, 21 bp, Homo sapiens
atcagtccctatgtatttgca

SEQ ID NO: 2538093 - DNA, 21 bp, Homo sapiens
atcagtcctctttcaaaggta

SEQ ID NO: 2538094 - DNA, 14 bp, Homo sapiens
atcagtcctttgat

SEQ ID NO: 2538095 - DNA, 20 bp, Homo sapiens
atcagtctatccacagagag

SEQ ID NO: 2538096 - DNA, 18 bp, Homo sapiens
atcagtctctgagggctt

SEQ ID NO: 2538097 - DNA, 17 bp, Homo sapiens
atcagttttatccacag

SEQ ID NO: 2538098 - DNA, 15 bp, Homo sapiens
atcataaaacttgat

SEQ ID NO: 2538099 - DNA, 14 bp, Homo sapiens
atcataaactgtgt

SEQ ID NO: 2538100 - DNA, 12 bp, Homo sapiens
atcatagtacag

SEQ ID NO: 2538101 - DNA, 21 bp, Homo sapiens
atcatattggtattcactaat

SEQ ID NO: 2538102 - DNA, 18 bp, Homo sapiens
atcatcaaggcactgcct

SEQ ID NO: 2538103 - DNA, 23 bp, Homo sapiens
atcatccactgtgccatgtgcca

SEQ ID NO: 2538104 - DNA, 18 bp, Homo sapiens
atcatcctttccagcatg

SEQ ID NO: 2538105 - DNA, 16 bp, Homo sapiens
atcatctataaagaag

SEQ ID NO: 2538106 - DNA, 19 bp, Homo sapiens
atcatctgtgtgaaaatgg

SEQ ID NO: 2538107 - DNA, 14 bp, Homo sapiens
atcatgaaatatgc

SEQ ID NO: 2538108 - DNA, 16 bp, Homo sapiens
atcatgaaatatgcat

SEQ ID NO: 2538109 - DNA, 18 bp, Homo sapiens
atcatgaaatatgcatct

SEQ ID NO: 2538110 - DNA, 16 bp, Homo sapiens
atcatgacatgttata

SEQ ID NO: 2538111 - DNA, 21 bp, Homo sapiens
atcatgcatgtcctgtaaagg

SEQ ID NO: 2538112 - DNA, 12 bp, Homo sapiens
atcatgcattgt

SEQ ID NO: 2538113 - DNA, 14 bp, Homo sapiens
atcatgcattgttg

SEQ ID NO: 2538114 - DNA, 19 bp, Homo sapiens
atcatggaggtttgaagat

SEQ ID NO: 2538115 - DNA, 16 bp, Homo sapiens
atcatggtgtaataag

SEQ ID NO: 2538116 - DNA, 13 bp, Homo sapiens
atcatgtacattt

SEQ ID NO: 2538117 - DNA, 17 bp, Homo sapiens
atcatgtagtatcaaat

SEQ ID NO: 2538118 - DNA, 18 bp, Homo sapiens
atcatgtcaggcctgtgt

SEQ ID NO: 2538119 - DNA, 14 bp, Homo sapiens
atcatgtccccaaa

SEQ ID NO: 2538120 - DNA, 22 bp, Homo sapiens
atcattaaagcctgagtttgct

SEQ ID NO: 2538121 - DNA, 11 bp, Homo sapiens
atcattaatac

SEQ ID NO: 2538122 - DNA, 23 bp, Homo sapiens
atcattataaacgtgatgatcag

SEQ ID NO: 2538123 - DNA, 20 bp, Homo sapiens
atcattatcagcctgtgcca

SEQ ID NO: 2538124 - DNA, 12 bp, Homo sapiens
atcattcaagtg

SEQ ID NO: 2538125 - DNA, 14 bp, Homo sapiens
atcattctctgtct

SEQ ID NO: 2538126 - DNA, 16 bp, Homo sapiens
atcattctctgtctca

SEQ ID NO: 2538127 - DNA, 23 bp, Homo sapiens
atcattcttatttcatgaaaatt

SEQ ID NO: 2538128 - DNA, 15 bp, Homo sapiens
atcatttcttgggcc

SEQ ID NO: 2538129 - DNA, 19 bp, Homo sapiens
atcatttcttgggccctcc

SEQ ID NO: 2538130 - DNA, 17 bp, Homo sapiens
atcatttgaacaactag

SEQ ID NO: 2538131 - DNA, 18 bp, Homo sapiens
atcatttgcccttaagga

SEQ ID NO: 2538132 - DNA, 13 bp, Homo sapiens
atcatttgctttt

SEQ ID NO: 2538133 - DNA, 18 bp, Homo sapiens
atcatttgttggaatgaa

SEQ ID NO: 2538134 - DNA, 23 bp, Homo sapiens
atcattttagaagactctaccag

SEQ ID NO: 2538135 - DNA, 13 bp, Homo sapiens
atcattttccccc

SEQ ID NO: 2538136 - DNA, 15 bp, Homo sapiens
atcattttgcattca

SEQ ID NO: 2538137 - DNA, 19 bp, Homo sapiens
atcattttgcattcaaatt

SEQ ID NO: 2538138 - DNA, 23 bp, Homo sapiens
atcatttttccttcccttctcca

SEQ ID NO: 2538139 - DNA, 13 bp, Homo sapiens
atcatttttgtac

SEQ ID NO: 2538140 - DNA, 20 bp, Homo sapiens
atccaactaatgccttactc

SEQ ID NO: 2538141 - DNA, 19 bp, Homo sapiens
atccaagatattttaaaat

SEQ ID NO: 2538142 - DNA, 14 bp, Homo sapiens
atccaaggagaaac

SEQ ID NO: 2538143 - DNA, 22 bp, Homo sapiens
atccaaggagaaacagagacag

SEQ ID NO: 2538144 - DNA, 18 bp, Homo sapiens
atccaatcctcactgggt

SEQ ID NO: 2538145 - DNA, 15 bp, Homo sapiens
atctaaagtgtgttg

SEQ ID NO: 2538146 - DNA, 17 bp, Homo sapiens
atctaaagtgtgttgtt

SEQ ID NO: 2538147 - DNA, 20 bp, Homo sapiens
atctaaagtgtgttgttgct

SEQ ID NO: 2538148 - DNA, 18 bp, Homo sapiens
atctaaatacctgccctg

SEQ ID NO: 2538149 - DNA, 17 bp, Homo sapiens
atctaaatggaaccact

SEQ ID NO: 2538150 - DNA, 15 bp, Homo sapiens
atctaaattgaataa

SEQ ID NO: 2538151 - DNA, 16 bp, Homo sapiens
atctaaattgaataat

SEQ ID NO: 2538152 - DNA, 22 bp, Homo sapiens
atctaaccctcccatggcacct

SEQ ID NO: 2538153 - DNA, 13 bp, Homo sapiens
atctaacctcatc

SEQ ID NO: 2538154 - DNA, 18 bp, Homo sapiens
atctaacctcatcttctt

SEQ ID NO: 2538155 - DNA, 18 bp, Homo sapiens
atctacactccagtgaga

SEQ ID NO: 2538156 - DNA, 17 bp, Homo sapiens
atctacatcttttttca

SEQ ID NO: 2538157 - DNA, 17 bp, Homo sapiens
atctaccccttacttat

SEQ ID NO: 2538158 - DNA, 17 bp, Homo sapiens
atctaccttctgtagtt

SEQ ID NO: 2538159 - DNA, 21 bp, Homo sapiens
atctaccttctgtagttttat

SEQ ID NO: 2538160 - DNA, 21 bp, Homo sapiens
atctagaacacaggcaaaatc

SEQ ID NO: 2538161 - DNA, 18 bp, Homo sapiens
atctagatactgtatcat

SEQ ID NO: 2538162 - DNA, 18 bp, Homo sapiens
atctagcaaatgttatgc

SEQ ID NO: 2538163 - DNA, 15 bp, Homo sapiens
atctagcaatcacaa

SEQ ID NO: 2538164 - DNA, 18 bp, Homo sapiens
atctaggtttaactcaga

SEQ ID NO: 2538165 - DNA, 19 bp, Homo sapiens
atctaggtttaactcagat

SEQ ID NO: 2538166 - DNA, 21 bp, Homo sapiens
atctagtgcagctgattttaa

SEQ ID NO: 2538167 - DNA, 13 bp, Homo sapiens
atctataaagaag

SEQ ID NO: 2538168 - DNA, 18 bp, Homo sapiens
atctatatatgtgtatgt

SEQ ID NO: 2538169 - DNA, 21 bp, Homo sapiens
atctatatgtacttgtcaaag

SEQ ID NO: 2538170 - DNA, 15 bp, Homo sapiens
atctatcaatagtca

SEQ ID NO: 2538171 - DNA, 20 bp, Homo sapiens
atctatcaatagtcaagaaa

SEQ ID NO: 2538172 - DNA, 17 bp, Homo sapiens
atctattgggttcatta

SEQ ID NO: 2538173 - DNA, 22 bp, Homo sapiens
atctattgggttcattattgga

SEQ ID NO: 2538174 - DNA, 15 bp, Homo sapiens
atctatttctatgag

SEQ ID NO: 2538175 - DNA, 19 bp, Homo sapiens
atctatttttggcagtctg

SEQ ID NO: 2538176 - DNA, 21 bp, Homo sapiens
atctcaaataactaaaaggta

SEQ ID NO: 2538177 - DNA, 23 bp, Homo sapiens
atctcacacatgagcatcaggcc

SEQ ID NO: 2538178 - DNA, 14 bp, Homo sapiens
atctcaccccatcc

SEQ ID NO: 2538179 - DNA, 18 bp, Homo sapiens
atctcacttgtgccaaca

SEQ ID NO: 2538180 - DNA, 15 bp, Homo sapiens
atctcacttttctcc

SEQ ID NO: 2538181 - DNA, 15 bp, Homo sapiens
atctcaggccacctg

SEQ ID NO: 2538182 - DNA, 17 bp, Homo sapiens
atctcaggggccagagg

SEQ ID NO: 2538183 - DNA, 18 bp, Homo sapiens
atctcagtcatgcataaa

SEQ ID NO: 2538184 - DNA, 22 bp, Homo sapiens
atctcagtcatgcataaatatg

SEQ ID NO: 2538185 - DNA, 24 bp, Homo sapiens
atctcatggagaagcagaaataca

SEQ ID NO: 2538186 - DNA, 16 bp, Homo sapiens
atctcatgtatcatct

SEQ ID NO: 2538187 - DNA, 13 bp, Homo sapiens
atctccaaaataa

SEQ ID NO: 2538188 - DNA, 21 bp, Homo sapiens
atctccaaaataaaacttttt

SEQ ID NO: 2538189 - DNA, 12 bp, Homo sapiens
atctccaaggac

SEQ ID NO: 2538190 - DNA, 16 bp, Homo sapiens
atctccaaggaccagg

SEQ ID NO: 2538191 - DNA, 15 bp, Homo sapiens
atctccacccccagc

SEQ ID NO: 2538192 - DNA, 19 bp, Homo sapiens
atctccacccccagctgct

SEQ ID NO: 2538193 - DNA, 13 bp, Homo sapiens
atctccacctgct

SEQ ID NO: 2538194 - DNA, 15 bp, Homo sapiens
atctccacctgctcc

SEQ ID NO: 2538195 - DNA, 15 bp, Homo sapiens
atctccatggcttcc

SEQ ID NO: 2538196 - DNA, 22 bp, Homo sapiens
atctccatggcttcctcctccc

SEQ ID NO: 2538197 - DNA, 13 bp, Homo sapiens
atctccccactct

SEQ ID NO: 2538198 - DNA, 14 bp, Homo sapiens
atctcccccagccc

SEQ ID NO: 2538199 - DNA, 23 bp, Homo sapiens
atctccccttgcactaaagtatg

SEQ ID NO: 2538200 - DNA, 21 bp, Homo sapiens
atctccctcactgaaaccagg

SEQ ID NO: 2538201 - DNA, 19 bp, Homo sapiens
atctcctcaagtccccaag

SEQ ID NO: 2538202 - DNA, 20 bp, Homo sapiens
atctcctcgcaagctgggta

SEQ ID NO: 2538203 - DNA, 17 bp, Homo sapiens
atctcctgccttcctcc

SEQ ID NO: 2538204 - DNA, 15 bp, Homo sapiens
atctcctttcaggga

SEQ ID NO: 2538205 - DNA, 20 bp, Homo sapiens
atctcgccacccctccttcc

SEQ ID NO: 2538206 - DNA, 13 bp, Homo sapiens
atctcgtttcaaa

SEQ ID NO: 2538207 - DNA, 15 bp, Homo sapiens
atctcgtttcaaaaa

SEQ ID NO: 2538208 - DNA, 23 bp, Homo sapiens
atctcgtttttcttcttaagact

SEQ ID NO: 2538209 - DNA, 23 bp, Homo sapiens
atctctaattggaagaaattcct

SEQ ID NO: 2538210 - DNA, 21 bp, Homo sapiens
atctctagaattttaagtgct

SEQ ID NO: 2538211 - DNA, 23 bp, Homo sapiens
atctctcaggagcacaggcagct

SEQ ID NO: 2538212 - DNA, 11 bp, Homo sapiens
atctctccctc

SEQ ID NO: 2538213 - DNA, 21 bp, Homo sapiens
atctctctactcctacctcag

SEQ ID NO: 2538214 - DNA, 22 bp, Homo sapiens
atctctctactcctacctcagc

SEQ ID NO: 2538215 - DNA, 22 bp, Homo sapiens
atctctctgaatcctaagggct

SEQ ID NO: 2538216 - DNA, 14 bp, Homo sapiens
atctctctggccct

SEQ ID NO: 2538217 - DNA, 18 bp, Homo sapiens
atctctctgtgctgtgga

SEQ ID NO: 2538218 - DNA, 21 bp, Homo sapiens
atctctgcaatcttctcagaa

SEQ ID NO: 2538219 - DNA, 15 bp, Homo sapiens
atctctgtgtgcaca

SEQ ID NO: 2538220 - DNA, 19 bp, Homo sapiens
atctctgtgtgcacaaata

SEQ ID NO: 2538221 - DNA, 16 bp, Homo sapiens
atctcttattttacaa

SEQ ID NO: 2538222 - DNA, 19 bp, Homo sapiens
atctcttattttacaataa

SEQ ID NO: 2538223 - DNA, 21 bp, Homo sapiens
atctctttgaattttctgtgt

SEQ ID NO: 2538224 - DNA, 22 bp, Homo sapiens
atctcttttgaatccatgcttg

SEQ ID NO: 2538225 - DNA, 12 bp, Homo sapiens
atctgaaaatgt

SEQ ID NO: 2538226 - DNA, 14 bp, Homo sapiens
atctgaaaatgtat

SEQ ID NO: 2538227 - DNA, 20 bp, Homo sapiens
atctgaaaatgtatgtgtaa

SEQ ID NO: 2538228 - DNA, 23 bp, Homo sapiens
atctgaaaatgtatgtgtaagta

SEQ ID NO: 2538229 - DNA, 13 bp, Homo sapiens
atctgaaatgtga

SEQ ID NO: 2538230 - DNA, 14 bp, Homo sapiens
atctgacatcccca

SEQ ID NO: 2538231 - DNA, 22 bp, Homo sapiens
atctgagcaagagctggcaaag

SEQ ID NO: 2538232 - DNA, 16 bp, Homo sapiens
atctgagggaggaggc

SEQ ID NO: 2538233 - DNA, 14 bp, Homo sapiens
atctgatggcttct

SEQ ID NO: 2538234 - DNA, 18 bp, Homo sapiens
atctgatggcttctccag

SEQ ID NO: 2538235 - DNA, 13 bp, Homo sapiens
atctgcagtcact

SEQ ID NO: 2538236 - DNA, 16 bp, Homo sapiens
atctgcagtcacttcg

SEQ ID NO: 2538237 - DNA, 22 bp, Homo sapiens
atctgcattttcaccccaccct

SEQ ID NO: 2538238 - DNA, 23 bp, Homo sapiens
atctgcattttcaccccaccctt

SEQ ID NO: 2538239 - DNA, 15 bp, Homo sapiens
atctgcccaggggtg

SEQ ID NO: 2538240 - DNA, 22 bp, Homo sapiens
atctgcccaggggtgccccctc

SEQ ID NO: 2538241 - DNA, 23 bp, Homo sapiens
atctgcccaggggtgccccctcc

SEQ ID NO: 2538242 - DNA, 11 bp, Homo sapiens
atctgcccctc

SEQ ID NO: 2538243 - DNA, 15 bp, Homo sapiens
atctgcccctccccc

SEQ ID NO: 2538244 - DNA, 15 bp, Homo sapiens
atctgcttatgcagt

SEQ ID NO: 2538245 - DNA, 14 bp, Homo sapiens
atctgcttcagtgg

SEQ ID NO: 2538246 - DNA, 18 bp, Homo sapiens
atctggaaccatcagaaa

SEQ ID NO: 2538247 - DNA, 20 bp, Homo sapiens
atctggaaggggatcccacc

SEQ ID NO: 2538248 - DNA, 21 bp, Homo sapiens
atctggaccccatctgtgaat

SEQ ID NO: 2538249 - DNA, 15 bp, Homo sapiens
atctggactcctctg

SEQ ID NO: 2538250 - DNA, 16 bp, Homo sapiens
atctggactcctctgt

SEQ ID NO: 2538251 - DNA, 15 bp, Homo sapiens
atctggagagctaga

SEQ ID NO: 2538252 - DNA, 22 bp, Homo sapiens
atctggagagctagaacctgga

SEQ ID NO: 2538253 - DNA, 11 bp, Homo sapiens
atctgggaaag

SEQ ID NO: 2538254 - DNA, 18 bp, Homo sapiens
atctgggagtcccctttt

SEQ ID NO: 2538255 - DNA, 22 bp, Homo sapiens
atctgggctcctaaccttcctg

SEQ ID NO: 2538256 - DNA, 18 bp, Homo sapiens
atctgggggagtggaata

SEQ ID NO: 2538257 - DNA, 17 bp, Homo sapiens
atctgggtagctgtaag

SEQ ID NO: 2538258 - DNA, 18 bp, Homo sapiens
atctgggtagctgtaagg

SEQ ID NO: 2538259 - DNA, 18 bp, Homo sapiens
atctgggtgcatgatctt

SEQ ID NO: 2538260 - DNA, 19 bp, Homo sapiens
atctgggttcactgcaacc

SEQ ID NO: 2538261 - DNA, 10 bp, Homo sapiens
atctggtgac

SEQ ID NO: 2538262 - DNA, 14 bp, Homo sapiens
atctggttttgcta

SEQ ID NO: 2538263 - DNA, 15 bp, Homo sapiens
atctggttttgctat

SEQ ID NO: 2538264 - DNA, 17 bp, Homo sapiens
atctgtaaactgtgtat

SEQ ID NO: 2538265 - DNA, 16 bp, Homo sapiens
atctgtatataaaata

SEQ ID NO: 2538266 - DNA, 19 bp, Homo sapiens
atctgtatataaaatattt

SEQ ID NO: 2538267 - DNA, 15 bp, Homo sapiens
atctgtatctctctc

SEQ ID NO: 2538268 - DNA, 18 bp, Homo sapiens
atctgtatttaattttga

SEQ ID NO: 2538269 - DNA, 18 bp, Homo sapiens
atctgtcacaccagccat

SEQ ID NO: 2538270 - DNA, 23 bp, Homo sapiens
atctgtgaaaggaaagagggagg

SEQ ID NO: 2538271 - DNA, 16 bp, Homo sapiens
atctgtgaattcagat

SEQ ID NO: 2538272 - DNA, 22 bp, Homo sapiens
atctgtgaggggctctctcatg

SEQ ID NO: 2538273 - DNA, 12 bp, Homo sapiens
atctgtgatgat

SEQ ID NO: 2538274 - DNA, 13 bp, Homo sapiens
atctgtgccccat

SEQ ID NO: 2538275 - DNA, 17 bp, Homo sapiens
atctgtgcgtgaaacac

SEQ ID NO: 2538276 - DNA, 18 bp, Homo sapiens
atctgtgcgtgaaacaca

SEQ ID NO: 2538277 - DNA, 16 bp, Homo sapiens
atctgtgctttccagc

SEQ ID NO: 2538278 - DNA, 17 bp, Homo sapiens
atctgtgctttccagct

SEQ ID NO: 2538279 - DNA, 15 bp, Homo sapiens
atctgtgtacaaaga

SEQ ID NO: 2538280 - DNA, 13 bp, Homo sapiens
atctgtgtgaaaa

SEQ ID NO: 2538281 - DNA, 16 bp, Homo sapiens
atctgtgtttttgaaa

SEQ ID NO: 2538282 - DNA, 18 bp, Homo sapiens
atctgtgtttttgaaata

SEQ ID NO: 2538283 - DNA, 21 bp, Homo sapiens
atctgtttaaagtagattaga

SEQ ID NO: 2538284 - DNA, 14 bp, Homo sapiens
atctgttttaaatt

SEQ ID NO: 2538285 - DNA, 22 bp, Homo sapiens
atctgttttaaatttatttcaa

SEQ ID NO: 2538286 - DNA, 19 bp, Homo sapiens
atctgtttttaaaaatcat

SEQ ID NO: 2538287 - DNA, 19 bp, Homo sapiens
atcttaattttggttgtat

SEQ ID NO: 2538288 - DNA, 13 bp, Homo sapiens
atcttacagctgg

SEQ ID NO: 2538289 - DNA, 13 bp, Homo sapiens
atgcctggcttcg

SEQ ID NO: 2538290 - DNA, 18 bp, Homo sapiens
atgcctggtctttcctct

SEQ ID NO: 2538291 - DNA, 13 bp, Homo sapiens
atgcctggtggca

SEQ ID NO: 2538292 - DNA, 16 bp, Homo sapiens
atgcctggtggcagct

SEQ ID NO: 2538293 - DNA, 19 bp, Homo sapiens
atgcctggtggcagctgcg

SEQ ID NO: 2538294 - DNA, 17 bp, Homo sapiens
atgcctgtccagcctgg

SEQ ID NO: 2538295 - DNA, 18 bp, Homo sapiens
atgccttactcttcttga

SEQ ID NO: 2538296 - DNA, 20 bp, Homo sapiens
atgcctttaaatctgtgatg

SEQ ID NO: 2538297 - DNA, 12 bp, Homo sapiens
atgcggcccagc

SEQ ID NO: 2538298 - DNA, 13 bp, Homo sapiens
atgcggcccagcc

SEQ ID NO: 2538299 - DNA, 15 bp, Homo sapiens
atgcggcccagcccg

SEQ ID NO: 2538300 - DNA, 21 bp, Homo sapiens
atgcggcccagcccggctccc

SEQ ID NO: 2538301 - DNA, 20 bp, Homo sapiens
atgcgtgcataccacttttg

SEQ ID NO: 2538302 - DNA, 17 bp, Homo sapiens
atgcgtgtttctgactc

SEQ ID NO: 2538303 - DNA, 12 bp, Homo sapiens
atgctaaacctt

SEQ ID NO: 2538304 - DNA, 20 bp, Homo sapiens
atgctaaaccttagtactga

SEQ ID NO: 2538305 - DNA, 22 bp, Homo sapiens
atgctaaagaaaaagtcatcca

SEQ ID NO: 2538306 - DNA, 14 bp, Homo sapiens
atgctacgtgtgat

SEQ ID NO: 2538307 - DNA, 15 bp, Homo sapiens
atgctacgtgtgatt

SEQ ID NO: 2538308 - DNA, 16 bp, Homo sapiens
atgctacgtgtgattt

SEQ ID NO: 2538309 - DNA, 19 bp, Homo sapiens
atgctacgtgtgatttttc

SEQ ID NO: 2538310 - DNA, 21 bp, Homo sapiens
atgctactacaaaaaagttgt

SEQ ID NO: 2538311 - DNA, 16 bp, Homo sapiens
atgctagctctgagcc

SEQ ID NO: 2538312 - DNA, 14 bp, Homo sapiens
atgctcaagttttt

SEQ ID NO: 2538313 - DNA, 15 bp, Homo sapiens
atgctcacagtctca

SEQ ID NO: 2538314 - DNA, 12 bp, Homo sapiens
atgctcagacca

SEQ ID NO: 2538315 - DNA, 15 bp, Homo sapiens
atgctccaaatgctg

SEQ ID NO: 2538316 - DNA, 19 bp, Homo sapiens
atgctccagccaacccctg

SEQ ID NO: 2538317 - DNA, 20 bp, Homo sapiens
atgctccagccaacccctgt

SEQ ID NO: 2538318 - DNA, 24 bp, Homo sapiens
atgctccagtcaacaaactatttc

SEQ ID NO: 2538319 - DNA, 15 bp, Homo sapiens
atgctcccccatcct

SEQ ID NO: 2538320 - DNA, 22 bp, Homo sapiens
atgctcccccatcctccccttc

SEQ ID NO: 2538321 - DNA, 23 bp, Homo sapiens
atgctcccccatcctccccttcc

SEQ ID NO: 2538322 - DNA, 16 bp, Homo sapiens
atgctccctcccctgc

SEQ ID NO: 2538323 - DNA, 18 bp, Homo sapiens
atgctctgcatgttacat

SEQ ID NO: 2538324 - DNA, 13 bp, Homo sapiens
atgctcttctgtg

SEQ ID NO: 2538325 - DNA, 14 bp, Homo sapiens
atgctcttctgtgg

SEQ ID NO: 2538326 - DNA, 16 bp, Homo sapiens
atgctctttacttcat

SEQ ID NO: 2538327 - DNA, 14 bp, Homo sapiens
atgctgaaaccaag

SEQ ID NO: 2538328 - DNA, 12 bp, Homo sapiens
atgctgaaggga

SEQ ID NO: 2538329 - DNA, 16 bp, Homo sapiens
atgctgatgtcctcac

SEQ ID NO: 2538330 - DNA, 17 bp, Homo sapiens
atgctgatgttcagtgt

SEQ ID NO: 2538331 - DNA, 19 bp, Homo sapiens
atgctgatgttcagtgtaa

SEQ ID NO: 2538332 - DNA, 22 bp, Homo sapiens
atgctgcccatgccaccgcttc

SEQ ID NO: 2538333 - DNA, 13 bp, Homo sapiens
atgctgccctgtg

SEQ ID NO: 2538334 - DNA, 14 bp, Homo sapiens
atgctgccctgtga

SEQ ID NO: 2538335 - DNA, 14 bp, Homo sapiens
atgctgcctgcctg

SEQ ID NO: 2538336 - DNA, 13 bp, Homo sapiens
atgctgctactta

SEQ ID NO: 2538337 - DNA, 17 bp, Homo sapiens
atgctgctttcccctgt

SEQ ID NO: 2538338 - DNA, 22 bp, Homo sapiens
atgctggacggcattcctgctt

SEQ ID NO: 2538339 - DNA, 14 bp, Homo sapiens
atgctgggctggct

SEQ ID NO: 2538340 - DNA, 21 bp, Homo sapiens
atgctgggctggctccctctt

SEQ ID NO: 2538341 - DNA, 23 bp, Homo sapiens
atgctgtgacacatggcccctcc

SEQ ID NO: 2538342 - DNA, 18 bp, Homo sapiens
atgctgtgctatgaattt

SEQ ID NO: 2538343 - DNA, 12 bp, Homo sapiens
atgctgttgatt

SEQ ID NO: 2538344 - DNA, 15 bp, Homo sapiens
atgctgttgattgct

SEQ ID NO: 2538345 - DNA, 16 bp, Homo sapiens
atgctgttgattgcta

SEQ ID NO: 2538346 - DNA, 19 bp, Homo sapiens
atgctgttgattgctaaat

SEQ ID NO: 2538347 - DNA, 22 bp, Homo sapiens
atgcttactgatatattttaca

SEQ ID NO: 2538348 - DNA, 23 bp, Homo sapiens
atgcttactgatatattttacaa

SEQ ID NO: 2538349 - DNA, 20 bp, Homo sapiens
atgcttcctgacaatcaact

SEQ ID NO: 2538350 - DNA, 22 bp, Homo sapiens
atgcttcctgacaatcaactct

SEQ ID NO: 2538351 - DNA, 16 bp, Homo sapiens
atgcttctcactgcca

SEQ ID NO: 2538352 - DNA, 20 bp, Homo sapiens
atgcttctcactgccatgcc

SEQ ID NO: 2538353 - DNA, 22 bp, Homo sapiens
atgcttcttcagagactcctgc

SEQ ID NO: 2538354 - DNA, 15 bp, Homo sapiens
atgcttcttccttac

SEQ ID NO: 2538355 - DNA, 20 bp, Homo sapiens
atgcttgcctagggcctggt

SEQ ID NO: 2538356 - DNA, 19 bp, Homo sapiens
atgcttttctgtctctgcc

SEQ ID NO: 2538357 - DNA, 14 bp, Homo sapiens
atggaaaaaatgat

SEQ ID NO: 2538358 - DNA, 11 bp, Homo sapiens
atggaaagaat

SEQ ID NO: 2538359 - DNA, 19 bp, Homo sapiens
atggaaatgggcagagcag

SEQ ID NO: 2538360 - DNA, 20 bp, Homo sapiens
atggaaattcccttcatctg

SEQ ID NO: 2538361 - DNA, 16 bp, Homo sapiens
atggaacataaaatac

SEQ ID NO: 2538362 - DNA, 19 bp, Homo sapiens
atggaactcattcctgcct

SEQ ID NO: 2538363 - DNA, 22 bp, Homo sapiens
atggaactcattcctgcctgtc

SEQ ID NO: 2538364 - DNA, 13 bp, Homo sapiens
atggaagacacat

SEQ ID NO: 2538365 - DNA, 17 bp, Homo sapiens
atggaatacagtgttat

SEQ ID NO: 2538366 - DNA, 21 bp, Homo sapiens
atggaatgatgggtcagttgt

SEQ ID NO: 2538367 - DNA, 16 bp, Homo sapiens
atggaatgcttgaaaa

SEQ ID NO: 2538368 - DNA, 20 bp, Homo sapiens
atggaatggttataaaagtg

SEQ ID NO: 2538369 - DNA, 19 bp, Homo sapiens
atggacagaagaaggcagc

SEQ ID NO: 2538370 - DNA, 21 bp, Homo sapiens
atggacccaatatttaccaga

SEQ ID NO: 2538371 - DNA, 14 bp, Homo sapiens
atggacctgtcacg

SEQ ID NO: 2538372 - DNA, 22 bp, Homo sapiens
atggacggtgctccaggcaggc

SEQ ID NO: 2538373 - DNA, 19 bp, Homo sapiens
atggactaacttgtctttg

SEQ ID NO: 2538374 - DNA, 14 bp, Homo sapiens
atggactctacact

SEQ ID NO: 2538375 - DNA, 15 bp, Homo sapiens
atggactctgcacat

SEQ ID NO: 2538376 - DNA, 17 bp, Homo sapiens
atggacttgtatatttg

SEQ ID NO: 2538377 - DNA, 22 bp, Homo sapiens
atggacttgtatatttgtacaa

SEQ ID NO: 2538378 - DNA, 12 bp, Homo sapiens
atggactttgtt

SEQ ID NO: 2538379 - DNA, 20 bp, Homo sapiens
atggagactccatgagaagc

SEQ ID NO: 2538380 - DNA, 13 bp, Homo sapiens
atggagagctgga

SEQ ID NO: 2538381 - DNA, 17 bp, Homo sapiens
atggagcgcacctgccc

SEQ ID NO: 2538382 - DNA, 23 bp, Homo sapiens
atggagcgcacctgccccctggt

SEQ ID NO: 2538383 - DNA, 12 bp, Homo sapiens
atggaggcctgt

SEQ ID NO: 2538384 - DNA, 15 bp, Homo sapiens
atggaggcctgtcct

SEQ ID NO: 2538385 - DNA, 22 bp, Homo sapiens
atggaggggtggtcctgactca

SEQ ID NO: 2538386 - DNA, 22 bp, Homo sapiens
atggagtgacggtcccacactg

SEQ ID NO: 2538387 - DNA, 21 bp, Homo sapiens
atggagtgtgtattgttccca

SEQ ID NO: 2538388 - DNA, 15 bp, Homo sapiens
atggagttcttgtgc

SEQ ID NO: 2538389 - DNA, 22 bp, Homo sapiens
atggataatgccggtgagaata

SEQ ID NO: 2538390 - DNA, 22 bp, Homo sapiens
atggatatagttttacttttaa

SEQ ID NO: 2538391 - DNA, 14 bp, Homo sapiens
atggatggcttcta

SEQ ID NO: 2538392 - DNA, 12 bp, Homo sapiens
atggatgtgctt

SEQ ID NO: 2538393 - DNA, 17 bp, Homo sapiens
atggatgtggggtcccc

SEQ ID NO: 2538394 - DNA, 18 bp, Homo sapiens
atggattctcagatattt

SEQ ID NO: 2538395 - DNA, 18 bp, Homo sapiens
atggattgataattgcat

SEQ ID NO: 2538396 - DNA, 15 bp, Homo sapiens
atggattggattatt

SEQ ID NO: 2538397 - DNA, 20 bp, Homo sapiens
atggattggattatttaata

SEQ ID NO: 2538398 - DNA, 15 bp, Homo sapiens
atggatttccagcca

SEQ ID NO: 2538399 - DNA, 15 bp, Homo sapiens
atggatttgaagcaa

SEQ ID NO: 2538400 - DNA, 14 bp, Homo sapiens
atggatttgcctgt

SEQ ID NO: 2538401 - DNA, 21 bp, Homo sapiens
atggatttgcctgtgccaccc

SEQ ID NO: 2538402 - DNA, 23 bp, Homo sapiens
atggcaagaaagctggtaaacta

SEQ ID NO: 2538403 - DNA, 19 bp, Homo sapiens
atggcaaggactgcaggga

SEQ ID NO: 2538404 - DNA, 15 bp, Homo sapiens
atggcaattttgtaa

SEQ ID NO: 2538405 - DNA, 17 bp, Homo sapiens
atggcacatcagcacga

SEQ ID NO: 2538406 - DNA, 19 bp, Homo sapiens
atggcaccaaagccaccag

SEQ ID NO: 2538407 - DNA, 20 bp, Homo sapiens
atggcacttagctatcagaa

SEQ ID NO: 2538408 - DNA, 22 bp, Homo sapiens
atggcacttagctatcagaaga

SEQ ID NO: 2538409 - DNA, 17 bp, Homo sapiens
atggcacttgcatctgt

SEQ ID NO: 2538410 - DNA, 13 bp, Homo sapiens
atggcagaagaca

SEQ ID NO: 2538411 - DNA, 20 bp, Homo sapiens
atggcagaagacaccagagc

SEQ ID NO: 2538412 - DNA, 20 bp, Homo sapiens
atggcagaaggcaaacccat

SEQ ID NO: 2538413 - DNA, 15 bp, Homo sapiens
atggcagtgtctttc

SEQ ID NO: 2538414 - DNA, 16 bp, Homo sapiens
atggcatcctgtgaag

SEQ ID NO: 2538415 - DNA, 15 bp, Homo sapiens
atggccagtgtctgt

SEQ ID NO: 2538416 - DNA, 18 bp, Homo sapiens
atggcctatgcacatatg

SEQ ID NO: 2538417 - DNA, 20 bp, Homo sapiens
atggcctattatattaaaat

SEQ ID NO: 2538418 - DNA, 17 bp, Homo sapiens
atggcctcagctgcctc

SEQ ID NO: 2538419 - DNA, 19 bp, Homo sapiens
atggcctcagctgcctcac

SEQ ID NO: 2538420 - DNA, 13 bp, Homo sapiens
atggcctcctccc

SEQ ID NO: 2538421 - DNA, 20 bp, Homo sapiens
atggcctttgcttgaaagaa

SEQ ID NO: 2538422 - DNA, 16 bp, Homo sapiens
atggcgcagtgcctct

SEQ ID NO: 2538423 - DNA, 19 bp, Homo sapiens
atggcgcagtgcctctggt

SEQ ID NO: 2538424 - DNA, 20 bp, Homo sapiens
atggcgggtgggggtggaat

SEQ ID NO: 2538425 - DNA, 18 bp, Homo sapiens
atggcgtggtcaagcact

SEQ ID NO: 2538426 - DNA, 18 bp, Homo sapiens
atggctaatgtactgcat

SEQ ID NO: 2538427 - DNA, 16 bp, Homo sapiens
atggctaattcccaga

SEQ ID NO: 2538428 - DNA, 21 bp, Homo sapiens
atggctataaacaattacatg

SEQ ID NO: 2538429 - DNA, 14 bp, Homo sapiens
atggctataaatat

SEQ ID NO: 2538430 - DNA, 21 bp, Homo sapiens
atggctataaatatataaaaa

SEQ ID NO: 2538431 - DNA, 16 bp, Homo sapiens
atggctcactatgaat

SEQ ID NO: 2538432 - DNA, 19 bp, Homo sapiens
atggctcactatggtgcca

SEQ ID NO: 2538433 - DNA, 15 bp, Homo sapiens
atgtcgcctctgcat

SEQ ID NO: 2538434 - DNA, 20 bp, Homo sapiens
atgtcgtgaccaactagaca

SEQ ID NO: 2538435 - DNA, 17 bp, Homo sapiens
atgtctaaatgctgaaa

SEQ ID NO: 2538436 - DNA, 20 bp, Homo sapiens
atgtctcaatagtaaaagat

SEQ ID NO: 2538437 - DNA, 22 bp, Homo sapiens
atgtctcaggtccctgcagggc

SEQ ID NO: 2538438 - DNA, 16 bp, Homo sapiens
atgtctcttctgagct

SEQ ID NO: 2538439 - DNA, 13 bp, Homo sapiens
atgtctgccaatt

SEQ ID NO: 2538440 - DNA, 16 bp, Homo sapiens
atgtctgtagctcctc

SEQ ID NO: 2538441 - DNA, 18 bp, Homo sapiens
atgtctgtagctcctcaa

SEQ ID NO: 2538442 - DNA, 14 bp, Homo sapiens
atgtctgttctaca

SEQ ID NO: 2538443 - DNA, 14 bp, Homo sapiens
atgtcttctgcctg

SEQ ID NO: 2538444 - DNA, 19 bp, Homo sapiens
atgtcttggacactgtaca

SEQ ID NO: 2538445 - DNA, 19 bp, Homo sapiens
atgtcttgggtaggcggga

SEQ ID NO: 2538446 - DNA, 22 bp, Homo sapiens
atgtcttgtacatgtgtagcct

SEQ ID NO: 2538447 - DNA, 10 bp, Homo sapiens
atgtcttgtg

SEQ ID NO: 2538448 - DNA, 20 bp, Homo sapiens
atgtgaaaccttttttaaga

SEQ ID NO: 2538449 - DNA, 20 bp, Homo sapiens
atgtgaatgatctctctgaa

SEQ ID NO: 2538450 - DNA, 11 bp, Homo sapiens
atgtgacacat

SEQ ID NO: 2538451 - DNA, 20 bp, Homo sapiens
atgtgacccagatcctcaca

SEQ ID NO: 2538452 - DNA, 18 bp, Homo sapiens
atgtgactctgaagctga

SEQ ID NO: 2538453 - DNA, 23 bp, Homo sapiens
atgtgacttgcatcgtggagaca

SEQ ID NO: 2538454 - DNA, 18 bp, Homo sapiens
atgtgactttgcatcagc

SEQ ID NO: 2538455 - DNA, 14 bp, Homo sapiens
atgtgagagaaagt

SEQ ID NO: 2538456 - DNA, 21 bp, Homo sapiens
atgtgataagttcttatgcca

SEQ ID NO: 2538457 - DNA, 17 bp, Homo sapiens
atgtgatccttttatgt

SEQ ID NO: 2538458 - DNA, 17 bp, Homo sapiens
atgtgatttaatagtgt

SEQ ID NO: 2538459 - DNA, 21 bp, Homo sapiens
atgtgatttaatagtgttaat

SEQ ID NO: 2538460 - DNA, 15 bp, Homo sapiens
atgtgattttaactc

SEQ ID NO: 2538461 - DNA, 15 bp, Homo sapiens
atgtgatttttctga

SEQ ID NO: 2538462 - DNA, 14 bp, Homo sapiens
atgtgcaaaacagc

SEQ ID NO: 2538463 - DNA, 23 bp, Homo sapiens
atgtgcacatgcacgtgtgtgca

SEQ ID NO: 2538464 - DNA, 16 bp, Homo sapiens
atgtgcacccatgggc

SEQ ID NO: 2538465 - DNA, 22 bp, Homo sapiens
atgtgcactgtcactttgctct

SEQ ID NO: 2538466 - DNA, 17 bp, Homo sapiens
atgtgcaggtttgttac

SEQ ID NO: 2538467 - DNA, 20 bp, Homo sapiens
atgtgcatttttgtgaaatg

SEQ ID NO: 2538468 - DNA, 22 bp, Homo sapiens
atgtgccaggtttttggtctga

SEQ ID NO: 2538469 - DNA, 20 bp, Homo sapiens
atgtgcctgatccagcctct

SEQ ID NO: 2538470 - DNA, 14 bp, Homo sapiens
atgtgcgtgtgtgc

SEQ ID NO: 2538471 - DNA, 11 bp, Homo sapiens
atgtgctgtgt

SEQ ID NO: 2538472 - DNA, 17 bp, Homo sapiens
atgtgctgtgtaaagtt

SEQ ID NO: 2538473 - DNA, 19 bp, Homo sapiens
atgtgctgtgtaaagttag

SEQ ID NO: 2538474 - DNA, 13 bp, Homo sapiens
atgtggaaaacag

SEQ ID NO: 2538475 - DNA, 17 bp, Homo sapiens
atgtggaaagtgaattt

SEQ ID NO: 2538476 - DNA, 19 bp, Homo sapiens
atgtggaaagtgaatttga

SEQ ID NO: 2538477 - DNA, 16 bp, Homo sapiens
atgtggaagtgtgggt

SEQ ID NO: 2538478 - DNA, 15 bp, Homo sapiens
atgtggaatataaag

SEQ ID NO: 2538479 - DNA, 16 bp, Homo sapiens
atgtggagtggggcag

SEQ ID NO: 2538480 - DNA, 22 bp, Homo sapiens
atgtggcccctgaacaagaatt

SEQ ID NO: 2538481 - DNA, 19 bp, Homo sapiens
atgtggcctgtggcctgtg

SEQ ID NO: 2538482 - DNA, 10 bp, Homo sapiens
atgtgggagg

SEQ ID NO: 2538483 - DNA, 20 bp, Homo sapiens
atgtgggctagttgggcttc

SEQ ID NO: 2538484 - DNA, 18 bp, Homo sapiens
atgtggtggcacaggccc

SEQ ID NO: 2538485 - DNA, 18 bp, Homo sapiens
atgtggttatttctctga

SEQ ID NO: 2538486 - DNA, 13 bp, Homo sapiens
atgtggtttatag

SEQ ID NO: 2538487 - DNA, 22 bp, Homo sapiens
atgtgtaacacagtgccttcaa

SEQ ID NO: 2538488 - DNA, 14 bp, Homo sapiens
atgtgtaagtattc

SEQ ID NO: 2538489 - DNA, 22 bp, Homo sapiens
atgtgtaatcaataaacgattt

SEQ ID NO: 2538490 - DNA, 16 bp, Homo sapiens
atgtgtagcctgtgca

SEQ ID NO: 2538491 - DNA, 18 bp, Homo sapiens
atgtgtatcggatgcttt

SEQ ID NO: 2538492 - DNA, 20 bp, Homo sapiens
atgtgtatgggcaaaaaact

SEQ ID NO: 2538493 - DNA, 20 bp, Homo sapiens
atgtgtatgtacgtttgtat

SEQ ID NO: 2538494 - DNA, 18 bp, Homo sapiens
atgtgtattacaaatatt

SEQ ID NO: 2538495 - DNA, 21 bp, Homo sapiens
atgtgtcaacttcaacattta

SEQ ID NO: 2538496 - DNA, 15 bp, Homo sapiens
atgtgtgaggagctg

SEQ ID NO: 2538497 - DNA, 19 bp, Homo sapiens
atgtgtgaggagctgctgg

SEQ ID NO: 2538498 - DNA, 18 bp, Homo sapiens
atgtgtgccatagagttt

SEQ ID NO: 2538499 - DNA, 19 bp, Homo sapiens
atgtgtgcgagtgtgtgca

SEQ ID NO: 2538500 - DNA, 19 bp, Homo sapiens
atgtgtgtagacaaatatt

SEQ ID NO: 2538501 - DNA, 10 bp, Homo sapiens
atgtgtgtat

SEQ ID NO: 2538502 - DNA, 18 bp, Homo sapiens
atgtgtgtatatgtatgt

SEQ ID NO: 2538503 - DNA, 16 bp, Homo sapiens
atgtgtgtgcaagtgt

SEQ ID NO: 2538504 - DNA, 19 bp, Homo sapiens
atgtgtgtgcaagtgtgtg

SEQ ID NO: 2538505 - DNA, 10 bp, Homo sapiens
atgtgtgtgt

SEQ ID NO: 2538506 - DNA, 12 bp, Homo sapiens
atgtgtgtgtat

SEQ ID NO: 2538507 - DNA, 16 bp, Homo sapiens
atgtgtgtgtatgcta

SEQ ID NO: 2538508 - DNA, 12 bp, Homo sapiens
atgtgtgtttaa

SEQ ID NO: 2538509 - DNA, 13 bp, Homo sapiens
atgtgttgtgata

SEQ ID NO: 2538510 - DNA, 14 bp, Homo sapiens
atgtgttgtgatag

SEQ ID NO: 2538511 - DNA, 16 bp, Homo sapiens
atgtgtttgtgtgtgt

SEQ ID NO: 2538512 - DNA, 15 bp, Homo sapiens
atgtgttttctgaat

SEQ ID NO: 2538513 - DNA, 14 bp, Homo sapiens
atgttaaaatgtat

SEQ ID NO: 2538514 - DNA, 21 bp, Homo sapiens
atgttaaacttacttagtgtt

SEQ ID NO: 2538515 - DNA, 18 bp, Homo sapiens
atgttaaatcccattcat

SEQ ID NO: 2538516 - DNA, 20 bp, Homo sapiens
atgttaaatcccattcataa

SEQ ID NO: 2538517 - DNA, 16 bp, Homo sapiens
atgttaaatttgtaag

SEQ ID NO: 2538518 - DNA, 23 bp, Homo sapiens
atgttaaatttgtaagtttcagg

SEQ ID NO: 2538519 - DNA, 16 bp, Homo sapiens
atgttaacacattttg

SEQ ID NO: 2538520 - DNA, 18 bp, Homo sapiens
atgttaaggaaactctta

SEQ ID NO: 2538521 - DNA, 20 bp, Homo sapiens
atgttaagggaagaattcca

SEQ ID NO: 2538522 - DNA, 20 bp, Homo sapiens
atgttacataagataaatgt

SEQ ID NO: 2538523 - DNA, 14 bp, Homo sapiens
atgttacattgttt

SEQ ID NO: 2538524 - DNA, 21 bp, Homo sapiens
atgttacctcctataaactta

SEQ ID NO: 2538525 - DNA, 13 bp, Homo sapiens
atgttactgacca

SEQ ID NO: 2538526 - DNA, 22 bp, Homo sapiens
atgttagaggttttaaagtgat

SEQ ID NO: 2538527 - DNA, 19 bp, Homo sapiens
atgttaggaaaatttcaca

SEQ ID NO: 2538528 - DNA, 15 bp, Homo sapiens
atgttattgcataat

SEQ ID NO: 2538529 - DNA, 12 bp, Homo sapiens
atgttatttata

SEQ ID NO: 2538530 - DNA, 20 bp, Homo sapiens
atgttatttatatattggta

SEQ ID NO: 2538531 - DNA, 20 bp, Homo sapiens
atgttatttgttattttcag

SEQ ID NO: 2538532 - DNA, 17 bp, Homo sapiens
atgttattttttaatta

SEQ ID NO: 2538533 - DNA, 14 bp, Homo sapiens
atgttcaactggag

SEQ ID NO: 2538534 - DNA, 14 bp, Homo sapiens
atgttcacttttga

SEQ ID NO: 2538535 - DNA, 22 bp, Homo sapiens
atgttcagtgtaatttctttgc

SEQ ID NO: 2538536 - DNA, 21 bp, Homo sapiens
atgttcattgtaatgttactg

SEQ ID NO: 2538537 - DNA, 11 bp, Homo sapiens
atgttcattta

SEQ ID NO: 2538538 - DNA, 14 bp, Homo sapiens
atgttccactaacc

SEQ ID NO: 2538539 - DNA, 20 bp, Homo sapiens
atgttccttcaagatcatgt

SEQ ID NO: 2538540 - DNA, 18 bp, Homo sapiens
atgttctaagtctttcca

SEQ ID NO: 2538541 - DNA, 19 bp, Homo sapiens
atgttctaagtctttccat

SEQ ID NO: 2538542 - DNA, 13 bp, Homo sapiens
atgttctctgagg

SEQ ID NO: 2538543 - DNA, 18 bp, Homo sapiens
atgttctgacattaacag

SEQ ID NO: 2538544 - DNA, 20 bp, Homo sapiens
atgttctgacattaacagtt

SEQ ID NO: 2538545 - DNA, 22 bp, Homo sapiens
atgttctgaccctgcttcaaat

SEQ ID NO: 2538546 - DNA, 12 bp, Homo sapiens
atgttctgggac

SEQ ID NO: 2538547 - DNA, 15 bp, Homo sapiens
atgttcttaattctt

SEQ ID NO: 2538548 - DNA, 12 bp, Homo sapiens
atgttgcccagg

SEQ ID NO: 2538549 - DNA, 13 bp, Homo sapiens
atgttgcccaggc

SEQ ID NO: 2538550 - DNA, 14 bp, Homo sapiens
atgttgcccaggca

SEQ ID NO: 2538551 - DNA, 15 bp, Homo sapiens
atgttgcccaggcag

SEQ ID NO: 2538552 - DNA, 16 bp, Homo sapiens
atgttgcccaggcagg

SEQ ID NO: 2538553 - DNA, 20 bp, Homo sapiens
atgttgcccaggcaggtctt

SEQ ID NO: 2538554 - DNA, 17 bp, Homo sapiens
atgttgcttaggatgtg

SEQ ID NO: 2538555 - DNA, 16 bp, Homo sapiens
atgttggatttataaa

SEQ ID NO: 2538556 - DNA, 14 bp, Homo sapiens
atgttggccaggct

SEQ ID NO: 2538557 - DNA, 16 bp, Homo sapiens
atgttggccaggctgg

SEQ ID NO: 2538558 - DNA, 12 bp, Homo sapiens
atgttggctggg

SEQ ID NO: 2538559 - DNA, 12 bp, Homo sapiens
atgttgggactg

SEQ ID NO: 2538560 - DNA, 17 bp, Homo sapiens
atgttgttatttaaaga

SEQ ID NO: 2538561 - DNA, 19 bp, Homo sapiens
atgtttacagaggacagta

SEQ ID NO: 2538562 - DNA, 22 bp, Homo sapiens
atgtttacaggtggacacacaa

SEQ ID NO: 2538563 - DNA, 20 bp, Homo sapiens
atgtttatgagccagacaaa

SEQ ID NO: 2538564 - DNA, 18 bp, Homo sapiens
atgtttatgcaaggaagg

SEQ ID NO: 2538565 - DNA, 20 bp, Homo sapiens
atgtttatgcaaggaaggaa

SEQ ID NO: 2538566 - DNA, 18 bp, Homo sapiens
atgtttattcctgataat

SEQ ID NO: 2538567 - DNA, 14 bp, Homo sapiens
atgtttattccttg

SEQ ID NO: 2538568 - DNA, 17 bp, Homo sapiens
atgtttatttactaatt

SEQ ID NO: 2538569 - DNA, 22 bp, Homo sapiens
atgtttcatgttttgtgactat

SEQ ID NO: 2538570 - DNA, 18 bp, Homo sapiens
atgtttcttaaatgggct

SEQ ID NO: 2538571 - DNA, 20 bp, Homo sapiens
atgtttgcttcataaatgaa

SEQ ID NO: 2538572 - DNA, 23 bp, Homo sapiens
atgtttgggagactgctgagtca

SEQ ID NO: 2538573 - DNA, 18 bp, Homo sapiens
atgtttgggcagaaggga

SEQ ID NO: 2538574 - DNA, 18 bp, Homo sapiens
atgttttaagaggcaggg

SEQ ID NO: 2538575 - DNA, 16 bp, Homo sapiens
atgttttaattccatg

SEQ ID NO: 2538576 - DNA, 17 bp, Homo sapiens
atgttttaattccatga

SEQ ID NO: 2538577 - DNA, 16 bp, Homo sapiens
atgttttccattgttt

SEQ ID NO: 2538578 - DNA, 19 bp, Homo sapiens
attcacccagacagctccc

SEQ ID NO: 2538579 - DNA, 22 bp, Homo sapiens
attcaccccctttcctggacac

SEQ ID NO: 2538580 - DNA, 14 bp, Homo sapiens
attcagaaattgga

SEQ ID NO: 2538581 - DNA, 19 bp, Homo sapiens
attcagacagctgcctggg

SEQ ID NO: 2538582 - DNA, 21 bp, Homo sapiens
attcagatatatttttcacag

SEQ ID NO: 2538583 - DNA, 21 bp, Homo sapiens
attcagcactgatttcacaac

SEQ ID NO: 2538584 - DNA, 14 bp, Homo sapiens
attcagctctgcaa

SEQ ID NO: 2538585 - DNA, 13 bp, Homo sapiens
attcaggtatgtt

SEQ ID NO: 2538586 - DNA, 17 bp, Homo sapiens
attcaggtatgttgcct

SEQ ID NO: 2538587 - DNA, 20 bp, Homo sapiens
attcaggtatgttgccttta

SEQ ID NO: 2538588 - DNA, 15 bp, Homo sapiens
attcagtgagggtct

SEQ ID NO: 2538589 - DNA, 21 bp, Homo sapiens
attcagtgctgtggcctgggc

SEQ ID NO: 2538590 - DNA, 22 bp, Homo sapiens
attcagtgctgtggcctgggca

SEQ ID NO: 2538591 - DNA, 17 bp, Homo sapiens
attcagtgcttcttaaa

SEQ ID NO: 2538592 - DNA, 14 bp, Homo sapiens
attcagtgtcactg

SEQ ID NO: 2538593 - DNA, 14 bp, Homo sapiens
attcatattgaata

SEQ ID NO: 2538594 - DNA, 18 bp, Homo sapiens
attcatatttacttctta

SEQ ID NO: 2538595 - DNA, 20 bp, Homo sapiens
attcatatttacttcttata

SEQ ID NO: 2538596 - DNA, 19 bp, Homo sapiens
attcatcaaatggaagaca

SEQ ID NO: 2538597 - DNA, 17 bp, Homo sapiens
attcatctctctttaat

SEQ ID NO: 2538598 - DNA, 17 bp, Homo sapiens
attcatcttgtgtttta

SEQ ID NO: 2538599 - DNA, 15 bp, Homo sapiens
attcatgtttcttaa

SEQ ID NO: 2538600 - DNA, 19 bp, Homo sapiens
attcattatttttccactt

SEQ ID NO: 2538601 - DNA, 12 bp, Homo sapiens
attcattccatt

SEQ ID NO: 2538602 - DNA, 15 bp, Homo sapiens
attcattgaagtcag

SEQ ID NO: 2538603 - DNA, 13 bp, Homo sapiens
attcatttaaaat

SEQ ID NO: 2538604 - DNA, 11 bp, Homo sapiens
attcatttcaa

SEQ ID NO: 2538605 - DNA, 15 bp, Homo sapiens
attccaacaaagggt

SEQ ID NO: 2538606 - DNA, 18 bp, Homo sapiens
attccaacaaagggtttt

SEQ ID NO: 2538607 - DNA, 14 bp, Homo sapiens
attccaagacagta

SEQ ID NO: 2538608 - DNA, 22 bp, Homo sapiens
attccaagacatgtctgttcta

SEQ ID NO: 2538609 - DNA, 17 bp, Homo sapiens
attccaatatgatgact

SEQ ID NO: 2538610 - DNA, 12 bp, Homo sapiens
attccacatcta

SEQ ID NO: 2538611 - DNA, 12 bp, Homo sapiens
attccagaatat

SEQ ID NO: 2538612 - DNA, 18 bp, Homo sapiens
attccagaatatctggga

SEQ ID NO: 2538613 - DNA, 12 bp, Homo sapiens
attccatgaatc

SEQ ID NO: 2538614 - DNA, 13 bp, Homo sapiens
attccatgaatgt

SEQ ID NO: 2538615 - DNA, 15 bp, Homo sapiens
attccatgaatgtat

SEQ ID NO: 2538616 - DNA, 15 bp, Homo sapiens
attccatttatcttt

SEQ ID NO: 2538617 - DNA, 18 bp, Homo sapiens
attccatttatctttcta

SEQ ID NO: 2538618 - DNA, 19 bp, Homo sapiens
attcccacacctccacagt

SEQ ID NO: 2538619 - DNA, 15 bp, Homo sapiens
attcccaccaaggtc

SEQ ID NO: 2538620 - DNA, 19 bp, Homo sapiens
attcccagagcaaaataat

SEQ ID NO: 2538621 - DNA, 18 bp, Homo sapiens
attcccattttgcaaaat

SEQ ID NO: 2538622 - DNA, 23 bp, Homo sapiens
attcccattttgcaaaatttcca

SEQ ID NO: 2538623 - DNA, 15 bp, Homo sapiens
attccccattcttcc

SEQ ID NO: 2538624 - DNA, 21 bp, Homo sapiens
attccctggcctttcatattt

SEQ ID NO: 2538625 - DNA, 17 bp, Homo sapiens
attcctatatagtttat

SEQ ID NO: 2538626 - DNA, 17 bp, Homo sapiens
attcctattgtgatttg

SEQ ID NO: 2538627 - DNA, 16 bp, Homo sapiens
attcctcctgctcata

SEQ ID NO: 2538628 - DNA, 12 bp, Homo sapiens
attcctcctggg

SEQ ID NO: 2538629 - DNA, 22 bp, Homo sapiens
attcctctgggaatgttacatt

SEQ ID NO: 2538630 - DNA, 12 bp, Homo sapiens
attcctgaccca

SEQ ID NO: 2538631 - DNA, 17 bp, Homo sapiens
attcctgacccaggccg

SEQ ID NO: 2538632 - DNA, 22 bp, Homo sapiens
attcctgatatgatttaaaaca

SEQ ID NO: 2538633 - DNA, 15 bp, Homo sapiens
attcctgcatttgtg

SEQ ID NO: 2538634 - DNA, 18 bp, Homo sapiens
attcctgcatttgtgaaa

SEQ ID NO: 2538635 - DNA, 22 bp, Homo sapiens
attcctgggaaatattccctag

SEQ ID NO: 2538636 - DNA, 15 bp, Homo sapiens
attcctgggcacagt

SEQ ID NO: 2538637 - DNA, 15 bp, Homo sapiens
attcctggtacccag

SEQ ID NO: 2538638 - DNA, 18 bp, Homo sapiens
attcctggtacccagcca

SEQ ID NO: 2538639 - DNA, 16 bp, Homo sapiens
attcctgtagcatctt

SEQ ID NO: 2538640 - DNA, 16 bp, Homo sapiens
attcctgtatgttgtc

SEQ ID NO: 2538641 - DNA, 15 bp, Homo sapiens
attccttctttgata

SEQ ID NO: 2538642 - DNA, 21 bp, Homo sapiens
attccttctttgataatgtta

SEQ ID NO: 2538643 - DNA, 16 bp, Homo sapiens
attcctttctatcatt

SEQ ID NO: 2538644 - DNA, 15 bp, Homo sapiens
attcctttctcatcc

SEQ ID NO: 2538645 - DNA, 17 bp, Homo sapiens
attcctttctcatccca

SEQ ID NO: 2538646 - DNA, 18 bp, Homo sapiens
attccttttgtgtacagt

SEQ ID NO: 2538647 - DNA, 17 bp, Homo sapiens
attcgagacagaacctt

SEQ ID NO: 2538648 - DNA, 21 bp, Homo sapiens
attcggtgtgcaccagggttg

SEQ ID NO: 2538649 - DNA, 15 bp, Homo sapiens
attctaaatgaatgt

SEQ ID NO: 2538650 - DNA, 12 bp, Homo sapiens
attctaatgtct

SEQ ID NO: 2538651 - DNA, 16 bp, Homo sapiens
attctaatgtcttcat

SEQ ID NO: 2538652 - DNA, 17 bp, Homo sapiens
attctagttttgtcaaa

SEQ ID NO: 2538653 - DNA, 13 bp, Homo sapiens
attctcaccagga

SEQ ID NO: 2538654 - DNA, 18 bp, Homo sapiens
attctcagaatctcaaat

SEQ ID NO: 2538655 - DNA, 16 bp, Homo sapiens
attctcagatatttat

SEQ ID NO: 2538656 - DNA, 17 bp, Homo sapiens
attctcagggtctctgc

SEQ ID NO: 2538657 - DNA, 18 bp, Homo sapiens
attctcagggtctctgct

SEQ ID NO: 2538658 - DNA, 19 bp, Homo sapiens
attctcagggtctctgctg

SEQ ID NO: 2538659 - DNA, 12 bp, Homo sapiens
attctcatgtga

SEQ ID NO: 2538660 - DNA, 15 bp, Homo sapiens
attctcatgtgatcc

SEQ ID NO: 2538661 - DNA, 17 bp, Homo sapiens
attctcatttgtcacac

SEQ ID NO: 2538662 - DNA, 13 bp, Homo sapiens
attctccacctgc

SEQ ID NO: 2538663 - DNA, 18 bp, Homo sapiens
attctccacctgccaggg

SEQ ID NO: 2538664 - DNA, 19 bp, Homo sapiens
attctccacctgccaggga

SEQ ID NO: 2538665 - DNA, 17 bp, Homo sapiens
attctccttgtgttact

SEQ ID NO: 2538666 - DNA, 21 bp, Homo sapiens
attctccttgtgttactaagt

SEQ ID NO: 2538667 - DNA, 19 bp, Homo sapiens
attctctagtttgattaaa

SEQ ID NO: 2538668 - DNA, 12 bp, Homo sapiens
attctctgtctc

SEQ ID NO: 2538669 - DNA, 16 bp, Homo sapiens
attctctgtctcatcc

SEQ ID NO: 2538670 - DNA, 18 bp, Homo sapiens
attctctgtctcatccat

SEQ ID NO: 2538671 - DNA, 17 bp, Homo sapiens
attctgaagccattgtc

SEQ ID NO: 2538672 - DNA, 16 bp, Homo sapiens
attctgaaggagcccc

SEQ ID NO: 2538673 - DNA, 13 bp, Homo sapiens
attctgaatgtac

SEQ ID NO: 2538674 - DNA, 20 bp, Homo sapiens
attctgaccacccttctcat

SEQ ID NO: 2538675 - DNA, 15 bp, Homo sapiens
attctgattacacaa

SEQ ID NO: 2538676 - DNA, 16 bp, Homo sapiens
attctgcccaaaaata

SEQ ID NO: 2538677 - DNA, 13 bp, Homo sapiens
attctgcctgccc

SEQ ID NO: 2538678 - DNA, 16 bp, Homo sapiens
attctgcctgcccagg

SEQ ID NO: 2538679 - DNA, 21 bp, Homo sapiens
attctgctcacatatctgtca

SEQ ID NO: 2538680 - DNA, 22 bp, Homo sapiens
attctgctcacatatctgtcat

SEQ ID NO: 2538681 - DNA, 14 bp, Homo sapiens
attctgctgtctca

SEQ ID NO: 2538682 - DNA, 21 bp, Homo sapiens
attctggataaagccactgaa

SEQ ID NO: 2538683 - DNA, 22 bp, Homo sapiens
attctggatggatttgaagcaa

SEQ ID NO: 2538684 - DNA, 23 bp, Homo sapiens
attctggcctagtcccttccaca

SEQ ID NO: 2538685 - DNA, 20 bp, Homo sapiens
attctgtaaaatgtctgtta

SEQ ID NO: 2538686 - DNA, 12 bp, Homo sapiens
attctgtaaatg

SEQ ID NO: 2538687 - DNA, 15 bp, Homo sapiens
attctgtacatagcc

SEQ ID NO: 2538688 - DNA, 13 bp, Homo sapiens
attctgtactgat

SEQ ID NO: 2538689 - DNA, 15 bp, Homo sapiens
attctgtagattctg

SEQ ID NO: 2538690 - DNA, 23 bp, Homo sapiens
attctgtgtgttttcataataaa

SEQ ID NO: 2538691 - DNA, 19 bp, Homo sapiens
attctgttggccagtgtga

SEQ ID NO: 2538692 - DNA, 18 bp, Homo sapiens
attctgttttaggttaaa

SEQ ID NO: 2538693 - DNA, 17 bp, Homo sapiens
attcttacaaacatgtg

SEQ ID NO: 2538694 - DNA, 14 bp, Homo sapiens
attcttataaatat

SEQ ID NO: 2538695 - DNA, 15 bp, Homo sapiens
attcttataaatatg

SEQ ID NO: 2538696 - DNA, 14 bp, Homo sapiens
attcttatttaatg

SEQ ID NO: 2538697 - DNA, 19 bp, Homo sapiens
attcttcctagttttctcc

SEQ ID NO: 2538698 - DNA, 14 bp, Homo sapiens
attcttgcaaagta

SEQ ID NO: 2538699 - DNA, 18 bp, Homo sapiens
attcttggttgaggaaac

SEQ ID NO: 2538700 - DNA, 17 bp, Homo sapiens
attcttggttggctggc

SEQ ID NO: 2538701 - DNA, 12 bp, Homo sapiens
attcttgtatat

SEQ ID NO: 2538702 - DNA, 19 bp, Homo sapiens
attctttatacaacagtgc

SEQ ID NO: 2538703 - DNA, 16 bp, Homo sapiens
attctttccattatga

SEQ ID NO: 2538704 - DNA, 21 bp, Homo sapiens
attctttccattatgattctt

SEQ ID NO: 2538705 - DNA, 22 bp, Homo sapiens
attctttccattatgattcttt

SEQ ID NO: 2538706 - DNA, 21 bp, Homo sapiens
attctttcccaattcacatct

SEQ ID NO: 2538707 - DNA, 15 bp, Homo sapiens
attctttgatgttaa

SEQ ID NO: 2538708 - DNA, 18 bp, Homo sapiens
attctttgatgttaacac

SEQ ID NO: 2538709 - DNA, 19 bp, Homo sapiens
attctttgatgttaacaca

SEQ ID NO: 2538710 - DNA, 20 bp, Homo sapiens
attctttgatgttaacacat

SEQ ID NO: 2538711 - DNA, 22 bp, Homo sapiens
attctttgatgttaacacattt

SEQ ID NO: 2538712 - DNA, 14 bp, Homo sapiens
attgaaaaaataga

SEQ ID NO: 2538713 - DNA, 15 bp, Homo sapiens
attgaaaaatcacca

SEQ ID NO: 2538714 - DNA, 18 bp, Homo sapiens
attgaaaacttttctcag

SEQ ID NO: 2538715 - DNA, 18 bp, Homo sapiens
attgaaaggcattctctg

SEQ ID NO: 2538716 - DNA, 16 bp, Homo sapiens
attgaaattgtacata

SEQ ID NO: 2538717 - DNA, 23 bp, Homo sapiens
attgaactctttgaatgacaaag

SEQ ID NO: 2538718 - DNA, 16 bp, Homo sapiens
attgaagtaatgaatt

SEQ ID NO: 2538719 - DNA, 19 bp, Homo sapiens
attgaataaagttgaagct

SEQ ID NO: 2538720 - DNA, 14 bp, Homo sapiens
attgaataatggta

SEQ ID NO: 2538721 - DNA, 14 bp, Homo sapiens
attgaatcatgtag

SEQ ID NO: 2538722 - DNA, 14 bp, Homo sapiens
attgaatctattta

SEQ ID NO: 2538723 - DNA, 23 bp, Homo sapiens
attgaattcttggttgaggaaac

SEQ ID NO: 2538724 - DNA, 11 bp, Homo sapiens
atttctcccag

SEQ ID NO: 2538725 - DNA, 23 bp, Homo sapiens
atttctgagaaggtccttaatga

SEQ ID NO: 2538726 - DNA, 16 bp, Homo sapiens
atttctgccttccttg

SEQ ID NO: 2538727 - DNA, 13 bp, Homo sapiens
atttctgtgggag

SEQ ID NO: 2538728 - DNA, 12 bp, Homo sapiens
atttctgtttag

SEQ ID NO: 2538729 - DNA, 14 bp, Homo sapiens
atttctgtttagat

SEQ ID NO: 2538730 - DNA, 21 bp, Homo sapiens
atttcttaaacaaatgtatga

SEQ ID NO: 2538731 - DNA, 14 bp, Homo sapiens
atttcttatatatg

SEQ ID NO: 2538732 - DNA, 21 bp, Homo sapiens
atttcttatatatgtgaacat

SEQ ID NO: 2538733 - DNA, 14 bp, Homo sapiens
atttctttccagag

SEQ ID NO: 2538734 - DNA, 19 bp, Homo sapiens
atttctttgcctgttcagt

SEQ ID NO: 2538735 - DNA, 16 bp, Homo sapiens
atttgaaaattttgat

SEQ ID NO: 2538736 - DNA, 19 bp, Homo sapiens
atttgaagaatgaacaaat

SEQ ID NO: 2538737 - DNA, 16 bp, Homo sapiens
atttgaagcaaagcac

SEQ ID NO: 2538738 - DNA, 13 bp, Homo sapiens
atttgaaggccag

SEQ ID NO: 2538739 - DNA, 23 bp, Homo sapiens
atttgacaaaatttgttgaaatt

SEQ ID NO: 2538740 - DNA, 17 bp, Homo sapiens
atttgactgtttttacc

SEQ ID NO: 2538741 - DNA, 21 bp, Homo sapiens
atttgagaatataaaaaactt

SEQ ID NO: 2538742 - DNA, 22 bp, Homo sapiens
atttgaggacaaccattccaga

SEQ ID NO: 2538743 - DNA, 22 bp, Homo sapiens
atttgaggtcaagtaagaagac

SEQ ID NO: 2538744 - DNA, 22 bp, Homo sapiens
atttgaggtctgttctttccaa

SEQ ID NO: 2538745 - DNA, 18 bp, Homo sapiens
atttgaggttaagacaaa

SEQ ID NO: 2538746 - DNA, 23 bp, Homo sapiens
atttgatcgttccagttcccact

SEQ ID NO: 2538747 - DNA, 17 bp, Homo sapiens
atttgatgctggagagg

SEQ ID NO: 2538748 - DNA, 19 bp, Homo sapiens
atttgatgctggagaggtt

SEQ ID NO: 2538749 - DNA, 16 bp, Homo sapiens
atttgatgctgtttga

SEQ ID NO: 2538750 - DNA, 20 bp, Homo sapiens
atttgatgtttacaggtgga

SEQ ID NO: 2538751 - DNA, 18 bp, Homo sapiens
atttgcaagtcatggctg

SEQ ID NO: 2538752 - DNA, 21 bp, Homo sapiens
atttgcactggagttctatgc

SEQ ID NO: 2538753 - DNA, 22 bp, Homo sapiens
atttgcagctgagagaaaataa

SEQ ID NO: 2538754 - DNA, 17 bp, Homo sapiens
atttgcatatgtatgac

SEQ ID NO: 2538755 - DNA, 22 bp, Homo sapiens
atttgcatggctccagaaatgt

SEQ ID NO: 2538756 - DNA, 14 bp, Homo sapiens
atttgccctcccat

SEQ ID NO: 2538757 - DNA, 16 bp, Homo sapiens
atttgctatgagctgg

SEQ ID NO: 2538758 - DNA, 20 bp, Homo sapiens
atttgctatgagctggggat

SEQ ID NO: 2538759 - DNA, 23 bp, Homo sapiens
atttgctgggctttttttttctc

SEQ ID NO: 2538760 - DNA, 13 bp, Homo sapiens
atttgctggggaa

SEQ ID NO: 2538761 - DNA, 19 bp, Homo sapiens
atttggcaatgccatcatc

SEQ ID NO: 2538762 - DNA, 21 bp, Homo sapiens
atttggggcttgcatgccaaa

SEQ ID NO: 2538763 - DNA, 23 bp, Homo sapiens
atttggggtagctagaggaacca

SEQ ID NO: 2538764 - DNA, 23 bp, Homo sapiens
atttggtcaagattttgaatgct

SEQ ID NO: 2538765 - DNA, 20 bp, Homo sapiens
atttggtttggccatctctg

SEQ ID NO: 2538766 - DNA, 16 bp, Homo sapiens
atttgtaacctcagct

SEQ ID NO: 2538767 - DNA, 18 bp, Homo sapiens
atttgtaagtttcaggtg

SEQ ID NO: 2538768 - DNA, 18 bp, Homo sapiens
atttgtacatatgtaaaa

SEQ ID NO: 2538769 - DNA, 21 bp, Homo sapiens
atttgtacatatgtaaaataa

SEQ ID NO: 2538770 - DNA, 20 bp, Homo sapiens
atttgtagaagggttatatt

SEQ ID NO: 2538771 - DNA, 17 bp, Homo sapiens
atttgtcaatgacagtt

SEQ ID NO: 2538772 - DNA, 15 bp, Homo sapiens
atttgtcttgcctta

SEQ ID NO: 2538773 - DNA, 17 bp, Homo sapiens
atttgtgaactcagcca

SEQ ID NO: 2538774 - DNA, 21 bp, Homo sapiens
atttgtgaactcagccaagca

SEQ ID NO: 2538775 - DNA, 16 bp, Homo sapiens
atttgtgactaattgt

SEQ ID NO: 2538776 - DNA, 14 bp, Homo sapiens
atttgtgatacaat

SEQ ID NO: 2538777 - DNA, 22 bp, Homo sapiens
atttgtggggagggatttgggg

SEQ ID NO: 2538778 - DNA, 14 bp, Homo sapiens
atttgtgtatttaa

SEQ ID NO: 2538779 - DNA, 20 bp, Homo sapiens
atttgtgtgtgtgcaagtgt

SEQ ID NO: 2538780 - DNA, 17 bp, Homo sapiens
atttgttattttgcaac

SEQ ID NO: 2538781 - DNA, 20 bp, Homo sapiens
atttgttgaaattatgtatg

SEQ ID NO: 2538782 - DNA, 13 bp, Homo sapiens
atttgttggaatg

SEQ ID NO: 2538783 - DNA, 15 bp, Homo sapiens
atttgttggaatgaa

SEQ ID NO: 2538784 - DNA, 15 bp, Homo sapiens
atttgtttaaaagga

SEQ ID NO: 2538785 - DNA, 20 bp, Homo sapiens
atttgtttgaactgataaag

SEQ ID NO: 2538786 - DNA, 22 bp, Homo sapiens
atttgtttgaactgataaagat

SEQ ID NO: 2538787 - DNA, 12 bp, Homo sapiens
atttgtttgcat

SEQ ID NO: 2538788 - DNA, 22 bp, Homo sapiens
atttgtttttgtatttttaatg

SEQ ID NO: 2538789 - DNA, 14 bp, Homo sapiens
attttaaaaagtct

SEQ ID NO: 2538790 - DNA, 13 bp, Homo sapiens
attttaaaaatga

SEQ ID NO: 2538791 - DNA, 17 bp, Homo sapiens
attttaaaaatgaaatt

SEQ ID NO: 2538792 - DNA, 17 bp, Homo sapiens
attttaaaattttatct

SEQ ID NO: 2538793 - DNA, 22 bp, Homo sapiens
attttaaattataacttaaaat

SEQ ID NO: 2538794 - DNA, 17 bp, Homo sapiens
attttaactttatcaca

SEQ ID NO: 2538795 - DNA, 19 bp, Homo sapiens
attttaactttatcacatt

SEQ ID NO: 2538796 - DNA, 21 bp, Homo sapiens
attttaagacgtgtttgtgtt

SEQ ID NO: 2538797 - DNA, 13 bp, Homo sapiens
attttaataatat

SEQ ID NO: 2538798 - DNA, 13 bp, Homo sapiens
attttaattatta

SEQ ID NO: 2538799 - DNA, 13 bp, Homo sapiens
attttacaattga

SEQ ID NO: 2538800 - DNA, 17 bp, Homo sapiens
attttacaattgaaatg

SEQ ID NO: 2538801 - DNA, 12 bp, Homo sapiens
attttacaattt

SEQ ID NO: 2538802 - DNA, 15 bp, Homo sapiens
attttacctcttatt

SEQ ID NO: 2538803 - DNA, 18 bp, Homo sapiens
attttagctactatatat

SEQ ID NO: 2538804 - DNA, 18 bp, Homo sapiens
attttagttacagctgtg

SEQ ID NO: 2538805 - DNA, 17 bp, Homo sapiens
attttataaatcgcttt

SEQ ID NO: 2538806 - DNA, 19 bp, Homo sapiens
attttatagctcagtttat

SEQ ID NO: 2538807 - DNA, 16 bp, Homo sapiens
attttatatgcttact

SEQ ID NO: 2538808 - DNA, 14 bp, Homo sapiens
attttatctgtgaa

SEQ ID NO: 2538809 - DNA, 15 bp, Homo sapiens
attttatctgtgaat

SEQ ID NO: 2538810 - DNA, 16 bp, Homo sapiens
attttatgaatgtctt

SEQ ID NO: 2538811 - DNA, 20 bp, Homo sapiens
attttatgccttttatttct

SEQ ID NO: 2538812 - DNA, 20 bp, Homo sapiens
attttattacatctttcaca

SEQ ID NO: 2538813 - DNA, 13 bp, Homo sapiens
attttattatgca

SEQ ID NO: 2538814 - DNA, 15 bp, Homo sapiens
attttattatgcatg

SEQ ID NO: 2538815 - DNA, 18 bp, Homo sapiens
attttcaaattgtatcta

SEQ ID NO: 2538816 - DNA, 16 bp, Homo sapiens
attttcaagaaactga

SEQ ID NO: 2538817 - DNA, 12 bp, Homo sapiens
attttcaagtaa

SEQ ID NO: 2538818 - DNA, 16 bp, Homo sapiens
attttcaagtaattgt

SEQ ID NO: 2538819 - DNA, 15 bp, Homo sapiens
attttcaccccaccc

SEQ ID NO: 2538820 - DNA, 21 bp, Homo sapiens
attttcacctgtttttaagct

SEQ ID NO: 2538821 - DNA, 14 bp, Homo sapiens
attttcactttgtg

SEQ ID NO: 2538822 - DNA, 12 bp, Homo sapiens
attttcagtatt

SEQ ID NO: 2538823 - DNA, 20 bp, Homo sapiens
attttcataagtatttcaaa

SEQ ID NO: 2538824 - DNA, 21 bp, Homo sapiens
attttcataagtatttcaaat

SEQ ID NO: 2538825 - DNA, 17 bp, Homo sapiens
attttcatgtatatgtg

SEQ ID NO: 2538826 - DNA, 18 bp, Homo sapiens
attttcatgtatatgtgt

SEQ ID NO: 2538827 - DNA, 17 bp, Homo sapiens
attttccaagtgtgcat

SEQ ID NO: 2538828 - DNA, 22 bp, Homo sapiens
attttccccccactctccccac

SEQ ID NO: 2538829 - DNA, 19 bp, Homo sapiens
attttccctattagagaag

SEQ ID NO: 2538830 - DNA, 22 bp, Homo sapiens
attttcctggtgccaatttcaa

SEQ ID NO: 2538831 - DNA, 23 bp, Homo sapiens
attttcctggtgccaatttcaag

SEQ ID NO: 2538832 - DNA, 19 bp, Homo sapiens
attttctagactttctgtt

SEQ ID NO: 2538833 - DNA, 18 bp, Homo sapiens
attttctctgtgtttgtt

SEQ ID NO: 2538834 - DNA, 22 bp, Homo sapiens
attttctctgtgtttgttccta

SEQ ID NO: 2538835 - DNA, 11 bp, Homo sapiens
attttctgtgg

SEQ ID NO: 2538836 - DNA, 21 bp, Homo sapiens
attttcttccaagcaaaggtg

SEQ ID NO: 2538837 - DNA, 15 bp, Homo sapiens
attttctttaaaaga

SEQ ID NO: 2538838 - DNA, 21 bp, Homo sapiens
attttctttctctactttgag

SEQ ID NO: 2538839 - DNA, 15 bp, Homo sapiens
attttctttgaaatt

SEQ ID NO: 2538840 - DNA, 17 bp, Homo sapiens
attttgaaaaattccta

SEQ ID NO: 2538841 - DNA, 18 bp, Homo sapiens
attttgaaaaattcctat

SEQ ID NO: 2538842 - DNA, 20 bp, Homo sapiens
attttgaataaataaatgta

SEQ ID NO: 2538843 - DNA, 11 bp, Homo sapiens
attttgaatca

SEQ ID NO: 2538844 - DNA, 13 bp, Homo sapiens
attttgaatcaat

SEQ ID NO: 2538845 - DNA, 13 bp, Homo sapiens
attttgagtgact

SEQ ID NO: 2538846 - DNA, 23 bp, Homo sapiens
attttgagtgactcgagggttgg

SEQ ID NO: 2538847 - DNA, 14 bp, Homo sapiens
attttgcaaaattt

SEQ ID NO: 2538848 - DNA, 18 bp, Homo sapiens
attttgcaaaatttccag

SEQ ID NO: 2538849 - DNA, 19 bp, Homo sapiens
attttgcaaaatttccagt

SEQ ID NO: 2538850 - DNA, 15 bp, Homo sapiens
attttgcagcagtga

SEQ ID NO: 2538851 - DNA, 14 bp, Homo sapiens
attttgcattcaaa

SEQ ID NO: 2538852 - DNA, 21 bp, Homo sapiens
attttgcctcttttctctgtg

SEQ ID NO: 2538853 - DNA, 12 bp, Homo sapiens
attttgctttgt

SEQ ID NO: 2538854 - DNA, 19 bp, Homo sapiens
attttggaaaataaattat

SEQ ID NO: 2538855 - DNA, 23 bp, Homo sapiens
attttggaaagctcctagcagag

SEQ ID NO: 2538856 - DNA, 21 bp, Homo sapiens
attttggagaaattatttaat

SEQ ID NO: 2538857 - DNA, 21 bp, Homo sapiens
attttggggtacccactgctc

SEQ ID NO: 2538858 - DNA, 20 bp, Homo sapiens
attttggggttgtgttgtca

SEQ ID NO: 2538859 - DNA, 19 bp, Homo sapiens
attttgggttttgggtctt

SEQ ID NO: 2538860 - DNA, 22 bp, Homo sapiens
attttggtaaaatacttcttga

SEQ ID NO: 2538861 - DNA, 20 bp, Homo sapiens
attttgtaaactcaaaatat

SEQ ID NO: 2538862 - DNA, 15 bp, Homo sapiens
attttgtgaatggat

SEQ ID NO: 2538863 - DNA, 23 bp, Homo sapiens
attttgttgctgttttgatttgt

SEQ ID NO: 2538864 - DNA, 15 bp, Homo sapiens
attttgtttaaatta

SEQ ID NO: 2538865 - DNA, 21 bp, Homo sapiens
attttgtttttgtcttaaaaa

SEQ ID NO: 2538866 - DNA, 16 bp, Homo sapiens
atttttaaaatattta

SEQ ID NO: 2538867 - DNA, 17 bp, Homo sapiens
atttttaaaatatttat

SEQ ID NO: 2538868 - DNA, 22 bp, Homo sapiens
caaccctccctcagcccctctt

SEQ ID NO: 2538869 - DNA, 15 bp, Homo sapiens
caaccctcctatcac

SEQ ID NO: 2538870 - DNA, 11 bp, Homo sapiens
caaccctgcaa

SEQ ID NO: 2538871 - DNA, 13 bp, Homo sapiens
caaccctgcccct

SEQ ID NO: 2538872 - DNA, 12 bp, Homo sapiens
caaccctgtctg

SEQ ID NO: 2538873 - DNA, 11 bp, Homo sapiens
caacccttccc

SEQ ID NO: 2538874 - DNA, 12 bp, Homo sapiens
caacccttcccc

SEQ ID NO: 2538875 - DNA, 17 bp, Homo sapiens
caaccgatgctccagcc

SEQ ID NO: 2538876 - DNA, 22 bp, Homo sapiens
caaccgatgctccagccaaccc

SEQ ID NO: 2538877 - DNA, 22 bp, Homo sapiens
caaccgccacacacacaggagc

SEQ ID NO: 2538878 - DNA, 19 bp, Homo sapiens
caaccggggagcccccgcc

SEQ ID NO: 2538879 - DNA, 21 bp, Homo sapiens
caaccggtggatcctcaaaca

SEQ ID NO: 2538880 - DNA, 13 bp, Homo sapiens
caacctaaatttg

SEQ ID NO: 2538881 - DNA, 18 bp, Homo sapiens
caacctaccaccccttcc

SEQ ID NO: 2538882 - DNA, 20 bp, Homo sapiens
caacctaccaccccttcctg

SEQ ID NO: 2538883 - DNA, 15 bp, Homo sapiens
caacctcctgggcta

SEQ ID NO: 2538884 - DNA, 21 bp, Homo sapiens
caacctgattgtgtctcttgg

SEQ ID NO: 2538885 - DNA, 13 bp, Homo sapiens
caacctgggtcca

SEQ ID NO: 2538886 - DNA, 13 bp, Homo sapiens
caacgacaaagcc

SEQ ID NO: 2538887 - DNA, 21 bp, Homo sapiens
caacggagagcgcctgcccct

SEQ ID NO: 2538888 - DNA, 14 bp, Homo sapiens
caacgtctgtgcca

SEQ ID NO: 2538889 - DNA, 14 bp, Homo sapiens
caacgtggcccaga

SEQ ID NO: 2538890 - DNA, 21 bp, Homo sapiens
caacgtggcccagagaagcca

SEQ ID NO: 2538891 - DNA, 15 bp, Homo sapiens
caactagacattctg

SEQ ID NO: 2538892 - DNA, 17 bp, Homo sapiens
caactagacattctgtc

SEQ ID NO: 2538893 - DNA, 18 bp, Homo sapiens
caactatattatcatgca

SEQ ID NO: 2538894 - DNA, 17 bp, Homo sapiens
caactcaccccagcccc

SEQ ID NO: 2538895 - DNA, 14 bp, Homo sapiens
caactctttgagaa

SEQ ID NO: 2538896 - DNA, 15 bp, Homo sapiens
caactctttgagaaa

SEQ ID NO: 2538897 - DNA, 13 bp, Homo sapiens
caactgaaaagac

SEQ ID NO: 2538898 - DNA, 14 bp, Homo sapiens
caactgaaaagact

SEQ ID NO: 2538899 - DNA, 22 bp, Homo sapiens
caactgaaaagactcagtgttc

SEQ ID NO: 2538900 - DNA, 18 bp, Homo sapiens
caactgaataaatacctc

SEQ ID NO: 2538901 - DNA, 17 bp, Homo sapiens
caactgaccagcctcca

SEQ ID NO: 2538902 - DNA, 13 bp, Homo sapiens
caactgaggcaga

SEQ ID NO: 2538903 - DNA, 22 bp, Homo sapiens
caactgaggcagacagcagctc

SEQ ID NO: 2538904 - DNA, 14 bp, Homo sapiens
caactgctgctttt

SEQ ID NO: 2538905 - DNA, 19 bp, Homo sapiens
caactggacattgtctgcg

SEQ ID NO: 2538906 - DNA, 22 bp, Homo sapiens
caactggccggtctgcaagtca

SEQ ID NO: 2538907 - DNA, 12 bp, Homo sapiens
caactgtatata

SEQ ID NO: 2538908 - DNA, 16 bp, Homo sapiens
caactgtgttcattag

SEQ ID NO: 2538909 - DNA, 18 bp, Homo sapiens
caacttagatctccagga

SEQ ID NO: 2538910 - DNA, 18 bp, Homo sapiens
caacttcttcagagctga

SEQ ID NO: 2538911 - DNA, 20 bp, Homo sapiens
caacttgagggcccagagca

SEQ ID NO: 2538912 - DNA, 19 bp, Homo sapiens
caacttggcttcctttctt

SEQ ID NO: 2538913 - DNA, 12 bp, Homo sapiens
caacttggcttt

SEQ ID NO: 2538914 - DNA, 17 bp, Homo sapiens
caacttggctttcccgg

SEQ ID NO: 2538915 - DNA, 23 bp, Homo sapiens
caacttgtattaaagacagaggc

SEQ ID NO: 2538916 - DNA, 21 bp, Homo sapiens
caactttaagcagctcttgct

SEQ ID NO: 2538917 - DNA, 22 bp, Homo sapiens
caactttgtggatgtcttcctt

SEQ ID NO: 2538918 - DNA, 16 bp, Homo sapiens
caagaaagctggtaaa

SEQ ID NO: 2538919 - DNA, 14 bp, Homo sapiens
caagaaatccctgt

SEQ ID NO: 2538920 - DNA, 13 bp, Homo sapiens
caagaaatgaaag

SEQ ID NO: 2538921 - DNA, 13 bp, Homo sapiens
caagaaatttgat

SEQ ID NO: 2538922 - DNA, 14 bp, Homo sapiens
caagaactctgggc

SEQ ID NO: 2538923 - DNA, 13 bp, Homo sapiens
caagaagcaggct

SEQ ID NO: 2538924 - DNA, 15 bp, Homo sapiens
caagaagcccaggaa

SEQ ID NO: 2538925 - DNA, 18 bp, Homo sapiens
caagaagcccaggaaagg

SEQ ID NO: 2538926 - DNA, 19 bp, Homo sapiens
caagaagtcaaagtaaaac

SEQ ID NO: 2538927 - DNA, 15 bp, Homo sapiens
caagaagtttaagga

SEQ ID NO: 2538928 - DNA, 17 bp, Homo sapiens
caagaataatcacgctt

SEQ ID NO: 2538929 - DNA, 18 bp, Homo sapiens
caagaatcagtgcaaaga

SEQ ID NO: 2538930 - DNA, 14 bp, Homo sapiens
caagaatgctgaaa

SEQ ID NO: 2538931 - DNA, 21 bp, Homo sapiens
caagaatttcctgttggattt

SEQ ID NO: 2538932 - DNA, 13 bp, Homo sapiens
caagacactgtgg

SEQ ID NO: 2538933 - DNA, 18 bp, Homo sapiens
caagacagaagctgaagt

SEQ ID NO: 2538934 - DNA, 17 bp, Homo sapiens
caagaccacgtttctaa

SEQ ID NO: 2538935 - DNA, 23 bp, Homo sapiens
caagacccttgtggtcccacccc

SEQ ID NO: 2538936 - DNA, 17 bp, Homo sapiens
caagacctcagtgcctt

SEQ ID NO: 2538937 - DNA, 20 bp, Homo sapiens
caagaccttcaccaaacata

SEQ ID NO: 2538938 - DNA, 18 bp, Homo sapiens
caagaccttctccttcac

SEQ ID NO: 2538939 - DNA, 15 bp, Homo sapiens
caagacgctgtgctg

SEQ ID NO: 2538940 - DNA, 17 bp, Homo sapiens
caagacgctgtgctgcc

SEQ ID NO: 2538941 - DNA, 15 bp, Homo sapiens
caagactctgtctca

SEQ ID NO: 2538942 - DNA, 15 bp, Homo sapiens
caagacttggcaaca

SEQ ID NO: 2538943 - DNA, 13 bp, Homo sapiens
caagagagaaaga

SEQ ID NO: 2538944 - DNA, 17 bp, Homo sapiens
caagagagaaagaagta

SEQ ID NO: 2538945 - DNA, 15 bp, Homo sapiens
caagagatttaatta

SEQ ID NO: 2538946 - DNA, 14 bp, Homo sapiens
caagagcacacttg

SEQ ID NO: 2538947 - DNA, 17 bp, Homo sapiens
caagagcccccttgaca

SEQ ID NO: 2538948 - DNA, 13 bp, Homo sapiens
caagagctgccct

SEQ ID NO: 2538949 - DNA, 20 bp, Homo sapiens
caagagctgccctccttgtc

SEQ ID NO: 2538950 - DNA, 20 bp, Homo sapiens
caagaggctgttcccaccag

SEQ ID NO: 2538951 - DNA, 19 bp, Homo sapiens
caagagggacgcctggggg

SEQ ID NO: 2538952 - DNA, 16 bp, Homo sapiens
caagaggggtggagac

SEQ ID NO: 2538953 - DNA, 22 bp, Homo sapiens
caagagggtcctttagtacctg

SEQ ID NO: 2538954 - DNA, 12 bp, Homo sapiens
caagagggtctg

SEQ ID NO: 2538955 - DNA, 16 bp, Homo sapiens
caagagggtctgagga

SEQ ID NO: 2538956 - DNA, 22 bp, Homo sapiens
caagagtttatttccaaataaa

SEQ ID NO: 2538957 - DNA, 16 bp, Homo sapiens
caagatatttatatat

SEQ ID NO: 2538958 - DNA, 23 bp, Homo sapiens
caagatattttaaaatctgtcac

SEQ ID NO: 2538959 - DNA, 19 bp, Homo sapiens
caagatcctgtctttaagg

SEQ ID NO: 2538960 - DNA, 15 bp, Homo sapiens
caagatctgtgcagc

SEQ ID NO: 2538961 - DNA, 20 bp, Homo sapiens
caagatctgtgcagccccgc

SEQ ID NO: 2538962 - DNA, 13 bp, Homo sapiens
caagatctttcag

SEQ ID NO: 2538963 - DNA, 22 bp, Homo sapiens
caagatgctggatgtctgccaa

SEQ ID NO: 2538964 - DNA, 21 bp, Homo sapiens
caagatgtcctccttgttcta

SEQ ID NO: 2538965 - DNA, 18 bp, Homo sapiens
caagattcacacctgact

SEQ ID NO: 2538966 - DNA, 18 bp, Homo sapiens
caagattgcttaaaatag

SEQ ID NO: 2538967 - DNA, 23 bp, Homo sapiens
caagcaaaatcatggaatggtta

SEQ ID NO: 2538968 - DNA, 16 bp, Homo sapiens
caagcaacctgggtcc

SEQ ID NO: 2538969 - DNA, 17 bp, Homo sapiens
caagcaacctgggtcca

SEQ ID NO: 2538970 - DNA, 13 bp, Homo sapiens
caagcaagaaaca

SEQ ID NO: 2538971 - DNA, 19 bp, Homo sapiens
caagcacagtggtggcagg

SEQ ID NO: 2538972 - DNA, 20 bp, Homo sapiens
caagcacagtggtggcaggg

SEQ ID NO: 2538973 - DNA, 17 bp, Homo sapiens
caagcacatctgcattt

SEQ ID NO: 2538974 - DNA, 16 bp, Homo sapiens
caagcacctcctgcct

SEQ ID NO: 2538975 - DNA, 18 bp, Homo sapiens
caagcacctcctgcctcg

SEQ ID NO: 2538976 - DNA, 21 bp, Homo sapiens
caagcagattggagaaaccct

SEQ ID NO: 2538977 - DNA, 13 bp, Homo sapiens
caagcaggaagct

SEQ ID NO: 2538978 - DNA, 21 bp, Homo sapiens
caagcaggaagctcagactgg

SEQ ID NO: 2538979 - DNA, 18 bp, Homo sapiens
caagcaggacatggacaa

SEQ ID NO: 2538980 - DNA, 20 bp, Homo sapiens
caagccaacttgtaaataca

SEQ ID NO: 2538981 - DNA, 21 bp, Homo sapiens
caagccaacttgtaaatacac

SEQ ID NO: 2538982 - DNA, 15 bp, Homo sapiens
caagccaagcagcca

SEQ ID NO: 2538983 - DNA, 16 bp, Homo sapiens
caagccaagcagccaa

SEQ ID NO: 2538984 - DNA, 17 bp, Homo sapiens
caagccaatcccctcct

SEQ ID NO: 2538985 - DNA, 13 bp, Homo sapiens
caagccacagaag

SEQ ID NO: 2538986 - DNA, 22 bp, Homo sapiens
caagccagcgggaatggcagct

SEQ ID NO: 2538987 - DNA, 13 bp, Homo sapiens
caagcccctgccc

SEQ ID NO: 2538988 - DNA, 17 bp, Homo sapiens
caagcccctgcccatct

SEQ ID NO: 2538989 - DNA, 18 bp, Homo sapiens
caagcccctgcccatctg

SEQ ID NO: 2538990 - DNA, 21 bp, Homo sapiens
caagccctccccatcccatgt

SEQ ID NO: 2538991 - DNA, 22 bp, Homo sapiens
caagcctgcagtcatcttgacc

SEQ ID NO: 2538992 - DNA, 14 bp, Homo sapiens
caagcctgcctagg

SEQ ID NO: 2538993 - DNA, 18 bp, Homo sapiens
caagctagaacctggagg

SEQ ID NO: 2538994 - DNA, 16 bp, Homo sapiens
caagctcaaagcgtgg

SEQ ID NO: 2538995 - DNA, 17 bp, Homo sapiens
caagctcagaaggctct

SEQ ID NO: 2538996 - DNA, 18 bp, Homo sapiens
caagctcaggaccaggca

SEQ ID NO: 2538997 - DNA, 12 bp, Homo sapiens
caagctccaagc

SEQ ID NO: 2538998 - DNA, 18 bp, Homo sapiens
caagctccaagctcccag

SEQ ID NO: 2538999 - DNA, 14 bp, Homo sapiens
caagctcccaggca

SEQ ID NO: 2539000 - DNA, 17 bp, Homo sapiens
caagctcccaggcattc

SEQ ID NO: 2539001 - DNA, 17 bp, Homo sapiens
caagctccttgggaggc

SEQ ID NO: 2539002 - DNA, 13 bp, Homo sapiens
caagctgcaccct

SEQ ID NO: 2539003 - DNA, 21 bp, Homo sapiens
caagctgcaccctcaggcagg

SEQ ID NO: 2539004 - DNA, 12 bp, Homo sapiens
caagctggaagc

SEQ ID NO: 2539005 - DNA, 18 bp, Homo sapiens
caagctggaagcacatgt

SEQ ID NO: 2539006 - DNA, 15 bp, Homo sapiens
caagctgggccccag

SEQ ID NO: 2539007 - DNA, 17 bp, Homo sapiens
caagctggtcccactca

SEQ ID NO: 2539008 - DNA, 19 bp, Homo sapiens
caagctggtcccactcagt

SEQ ID NO: 2539009 - DNA, 18 bp, Homo sapiens
caagctgtgagacagtgg

SEQ ID NO: 2539010 - DNA, 16 bp, Homo sapiens
caagctgttttcttct

SEQ ID NO: 2539011 - DNA, 12 bp, Homo sapiens
caagcttcagtt

SEQ ID NO: 2539012 - DNA, 19 bp, Homo sapiens
caagcttcagtttcctggt

SEQ ID NO: 2539013 - DNA, 20 bp, Homo sapiens
caagcttggcagccgagctc

SEQ ID NO: 2539014 - DNA, 13 bp, Homo sapiens
caatatgtattgt

SEQ ID NO: 2539015 - DNA, 16 bp, Homo sapiens
caatatgtattgtaaa

SEQ ID NO: 2539016 - DNA, 21 bp, Homo sapiens
caatatgtattgtaaacatgt

SEQ ID NO: 2539017 - DNA, 22 bp, Homo sapiens
caatatgtattgtaaacatgtg

SEQ ID NO: 2539018 - DNA, 20 bp, Homo sapiens
caatattaaatacagacact

SEQ ID NO: 2539019 - DNA, 22 bp, Homo sapiens
caatattataatttttttcaat

SEQ ID NO: 2539020 - DNA, 22 bp, Homo sapiens
caatattatactaagaaaagat

SEQ ID NO: 2539021 - DNA, 14 bp, Homo sapiens
caatattgtacagt

SEQ ID NO: 2539022 - DNA, 14 bp, Homo sapiens
caatattgtttcta

SEQ ID NO: 2539023 - DNA, 14 bp, Homo sapiens
caatatttcctcat

SEQ ID NO: 2539024 - DNA, 15 bp, Homo sapiens
caatcagctccttcc

SEQ ID NO: 2539025 - DNA, 18 bp, Homo sapiens
caatcagctccttcctgg

SEQ ID NO: 2539026 - DNA, 15 bp, Homo sapiens
caatcagtataattc

SEQ ID NO: 2539027 - DNA, 21 bp, Homo sapiens
caatcagtcccctcccatctg

SEQ ID NO: 2539028 - DNA, 22 bp, Homo sapiens
caatcagtcccctcccatctgg

SEQ ID NO: 2539029 - DNA, 15 bp, Homo sapiens
caatcatctgtgtga

SEQ ID NO: 2539030 - DNA, 19 bp, Homo sapiens
caatcatctgtgtgaaaat

SEQ ID NO: 2539031 - DNA, 20 bp, Homo sapiens
caatcatctgtgtgaaaatg

SEQ ID NO: 2539032 - DNA, 18 bp, Homo sapiens
caatcattgctgaaaatg

SEQ ID NO: 2539033 - DNA, 21 bp, Homo sapiens
caatcattgctgaaaatggta

SEQ ID NO: 2539034 - DNA, 15 bp, Homo sapiens
caatccaagagtctg

SEQ ID NO: 2539035 - DNA, 21 bp, Homo sapiens
caatccatgttagtttttact

SEQ ID NO: 2539036 - DNA, 17 bp, Homo sapiens
caatcccagctacctca

SEQ ID NO: 2539037 - DNA, 14 bp, Homo sapiens
caatcccctccttg

SEQ ID NO: 2539038 - DNA, 14 bp, Homo sapiens
caatcctatgtttt

SEQ ID NO: 2539039 - DNA, 20 bp, Homo sapiens
caatctattaatagctgcct

SEQ ID NO: 2539040 - DNA, 20 bp, Homo sapiens
caatctcaaattctcaacct

SEQ ID NO: 2539041 - DNA, 21 bp, Homo sapiens
caatctcaaattctcaaccta

SEQ ID NO: 2539042 - DNA, 16 bp, Homo sapiens
caatctgtaaactgtg

SEQ ID NO: 2539043 - DNA, 20 bp, Homo sapiens
caatgaacccccatgatgta

SEQ ID NO: 2539044 - DNA, 17 bp, Homo sapiens
caatgacatctcagggg

SEQ ID NO: 2539045 - DNA, 19 bp, Homo sapiens
caatgacatctcaggggcc

SEQ ID NO: 2539046 - DNA, 22 bp, Homo sapiens
caatgacatctcaggggccaga

SEQ ID NO: 2539047 - DNA, 20 bp, Homo sapiens
caatgatctaggtttaactc

SEQ ID NO: 2539048 - DNA, 21 bp, Homo sapiens
caatgatggcaattttgtaac

SEQ ID NO: 2539049 - DNA, 14 bp, Homo sapiens
caatgcactgacat

SEQ ID NO: 2539050 - DNA, 23 bp, Homo sapiens
caatgcactttgttctggctctt

SEQ ID NO: 2539051 - DNA, 14 bp, Homo sapiens
caatgccatcatct

SEQ ID NO: 2539052 - DNA, 16 bp, Homo sapiens
caatgccatcctcaaa

SEQ ID NO: 2539053 - DNA, 20 bp, Homo sapiens
caatgccatcctcaaacact

SEQ ID NO: 2539054 - DNA, 22 bp, Homo sapiens
caatgctggctgttggctgggg

SEQ ID NO: 2539055 - DNA, 13 bp, Homo sapiens
caatggaaactga

SEQ ID NO: 2539056 - DNA, 19 bp, Homo sapiens
caatggatttgatgctgtt

SEQ ID NO: 2539057 - DNA, 12 bp, Homo sapiens
caatggcagcct

SEQ ID NO: 2539058 - DNA, 15 bp, Homo sapiens
caatggcagccttgg

SEQ ID NO: 2539059 - DNA, 18 bp, Homo sapiens
caatggcgcagtgcctct

SEQ ID NO: 2539060 - DNA, 17 bp, Homo sapiens
caatggctaattcccag

SEQ ID NO: 2539061 - DNA, 19 bp, Homo sapiens
caatggctaattcccagag

SEQ ID NO: 2539062 - DNA, 14 bp, Homo sapiens
caatggctgctgaa

SEQ ID NO: 2539063 - DNA, 17 bp, Homo sapiens
caatgggcactgggatg

SEQ ID NO: 2539064 - DNA, 18 bp, Homo sapiens
caatgggcactgggatga

SEQ ID NO: 2539065 - DNA, 22 bp, Homo sapiens
caatggtgttcaccatcggcag

SEQ ID NO: 2539066 - DNA, 18 bp, Homo sapiens
caatggtttgcaaggaag

SEQ ID NO: 2539067 - DNA, 19 bp, Homo sapiens
caatggtttgcaaggaagc

SEQ ID NO: 2539068 - DNA, 15 bp, Homo sapiens
caatgtatttattta

SEQ ID NO: 2539069 - DNA, 19 bp, Homo sapiens
caatgtgaaaagaaaaatg

SEQ ID NO: 2539070 - DNA, 17 bp, Homo sapiens
caatgtgaccaggggtg

SEQ ID NO: 2539071 - DNA, 17 bp, Homo sapiens
caatgtgataaaacccc

SEQ ID NO: 2539072 - DNA, 15 bp, Homo sapiens
caatgtgattctaat

SEQ ID NO: 2539073 - DNA, 12 bp, Homo sapiens
caatgtgcagtg

SEQ ID NO: 2539074 - DNA, 20 bp, Homo sapiens
caatgtttatgcaaggaagg

SEQ ID NO: 2539075 - DNA, 17 bp, Homo sapiens
caatgtttcttctaggt

SEQ ID NO: 2539076 - DNA, 13 bp, Homo sapiens
caatgtttctttt

SEQ ID NO: 2539077 - DNA, 16 bp, Homo sapiens
caatgtttcttttatc

SEQ ID NO: 2539078 - DNA, 22 bp, Homo sapiens
caatgttttcctttgtcatcat

SEQ ID NO: 2539079 - DNA, 12 bp, Homo sapiens
caattaaacgga

SEQ ID NO: 2539080 - DNA, 21 bp, Homo sapiens
caattaaggattttatgcttt

SEQ ID NO: 2539081 - DNA, 18 bp, Homo sapiens
caattaataaaaaatgga

SEQ ID NO: 2539082 - DNA, 17 bp, Homo sapiens
caattactggtccaaaa

SEQ ID NO: 2539083 - DNA, 15 bp, Homo sapiens
caattaggaagtgta

SEQ ID NO: 2539084 - DNA, 14 bp, Homo sapiens
caattcaacccttt

SEQ ID NO: 2539085 - DNA, 11 bp, Homo sapiens
caattcccctc

SEQ ID NO: 2539086 - DNA, 12 bp, Homo sapiens
caattcccctct

SEQ ID NO: 2539087 - DNA, 15 bp, Homo sapiens
caattccctgctgtc

SEQ ID NO: 2539088 - DNA, 12 bp, Homo sapiens
caattcctgggc

SEQ ID NO: 2539089 - DNA, 18 bp, Homo sapiens
caattcttacaaacatgt

SEQ ID NO: 2539090 - DNA, 20 bp, Homo sapiens
caattcttccctatctttgc

SEQ ID NO: 2539091 - DNA, 21 bp, Homo sapiens
caattgaacttaaataaatgt

SEQ ID NO: 2539092 - DNA, 19 bp, Homo sapiens
caattgactgtcactgttc

SEQ ID NO: 2539093 - DNA, 23 bp, Homo sapiens
caattgttgacagttctgaagaa

SEQ ID NO: 2539094 - DNA, 12 bp, Homo sapiens
caatttaaaaaa

SEQ ID NO: 2539095 - DNA, 13 bp, Homo sapiens
caatttaaagcaa

SEQ ID NO: 2539096 - DNA, 13 bp, Homo sapiens
caatttattatgg

SEQ ID NO: 2539097 - DNA, 20 bp, Homo sapiens
caatttcaaaaaaataaaat

SEQ ID NO: 2539098 - DNA, 21 bp, Homo sapiens
caatttcaaaaaaataaaata

SEQ ID NO: 2539099 - DNA, 17 bp, Homo sapiens
caatttccaagagctga

SEQ ID NO: 2539100 - DNA, 16 bp, Homo sapiens
caatttcctttatatt

SEQ ID NO: 2539101 - DNA, 19 bp, Homo sapiens
caatttcctttatatttag

SEQ ID NO: 2539102 - DNA, 13 bp, Homo sapiens
caatttctcccca

SEQ ID NO: 2539103 - DNA, 22 bp, Homo sapiens
caatttctgtccttcagatgga

SEQ ID NO: 2539104 - DNA, 20 bp, Homo sapiens
caattttctggaatacatga

SEQ ID NO: 2539105 - DNA, 18 bp, Homo sapiens
caattttgcatgctcgat

SEQ ID NO: 2539106 - DNA, 13 bp, Homo sapiens
caatttttgcctt

SEQ ID NO: 2539107 - DNA, 18 bp, Homo sapiens
caatttttggttgaataa

SEQ ID NO: 2539108 - DNA, 17 bp, Homo sapiens
caatttttttaattttg

SEQ ID NO: 2539109 - DNA, 15 bp, Homo sapiens
cacaaaacaacccta

SEQ ID NO: 2539110 - DNA, 18 bp, Homo sapiens
cacaaaagtttctctttt

SEQ ID NO: 2539111 - DNA, 22 bp, Homo sapiens
cacaaaataaccaatcctggac

SEQ ID NO: 2539112 - DNA, 13 bp, Homo sapiens
cacaaacctgcct

SEQ ID NO: 2539113 - DNA, 22 bp, Homo sapiens
cacaaacgtatgtaaatgtata

SEQ ID NO: 2539114 - DNA, 13 bp, Homo sapiens
cacaaagccttat

SEQ ID NO: 2539115 - DNA, 21 bp, Homo sapiens
cacaaatatttattttctttc

SEQ ID NO: 2539116 - DNA, 20 bp, Homo sapiens
cacaaattattaatgaaaat

SEQ ID NO: 2539117 - DNA, 11 bp, Homo sapiens
cacaacagatt

SEQ ID NO: 2539118 - DNA, 23 bp, Homo sapiens
cacaaccatctgtccctgcctca

SEQ ID NO: 2539119 - DNA, 12 bp, Homo sapiens
cacaacttgttt

SEQ ID NO: 2539120 - DNA, 20 bp, Homo sapiens
cacaacttgtttttggtttt

SEQ ID NO: 2539121 - DNA, 13 bp, Homo sapiens
cacaagaaatgaa

SEQ ID NO: 2539122 - DNA, 18 bp, Homo sapiens
cacaagaaatgaaagcag

SEQ ID NO: 2539123 - DNA, 13 bp, Homo sapiens
cacaagctccaag

SEQ ID NO: 2539124 - DNA, 14 bp, Homo sapiens
cacaagctccaagc

SEQ ID NO: 2539125 - DNA, 18 bp, Homo sapiens
cacaagctccaagctccc

SEQ ID NO: 2539126 - DNA, 18 bp, Homo sapiens
cacaaggctgaccaagag

SEQ ID NO: 2539127 - DNA, 16 bp, Homo sapiens
cacaaggctgttgcat

SEQ ID NO: 2539128 - DNA, 20 bp, Homo sapiens
cacaagtcctgtgaatttct

SEQ ID NO: 2539129 - DNA, 12 bp, Homo sapiens
cacaatatgaat

SEQ ID NO: 2539130 - DNA, 21 bp, Homo sapiens
cacaatggctaattcccagag

SEQ ID NO: 2539131 - DNA, 13 bp, Homo sapiens
cacacacacacaa

SEQ ID NO: 2539132 - DNA, 14 bp, Homo sapiens
cacacacacacaca

SEQ ID NO: 2539133 - DNA, 15 bp, Homo sapiens
cacacacacacacaa

SEQ ID NO: 2539134 - DNA, 15 bp, Homo sapiens
cacacacacacagcc

SEQ ID NO: 2539135 - DNA, 16 bp, Homo sapiens
cacacacacacagcca

SEQ ID NO: 2539136 - DNA, 14 bp, Homo sapiens
cacacacacagaaa

SEQ ID NO: 2539137 - DNA, 12 bp, Homo sapiens
cacacacacagc

SEQ ID NO: 2539138 - DNA, 14 bp, Homo sapiens
cacacacacagcca

SEQ ID NO: 2539139 - DNA, 14 bp, Homo sapiens
cacacacacatgca

SEQ ID NO: 2539140 - DNA, 19 bp, Homo sapiens
cacacacagaaaatatact

SEQ ID NO: 2539141 - DNA, 13 bp, Homo sapiens
cacacacagccac

SEQ ID NO: 2539142 - DNA, 14 bp, Homo sapiens
cacacacagccaca

SEQ ID NO: 2539143 - DNA, 15 bp, Homo sapiens
cacacacagccacac

SEQ ID NO: 2539144 - DNA, 16 bp, Homo sapiens
cacacacagccacaca

SEQ ID NO: 2539145 - DNA, 13 bp, Homo sapiens
cacacacaggagc

SEQ ID NO: 2539146 - DNA, 12 bp, Homo sapiens
cacacacatgca

SEQ ID NO: 2539147 - DNA, 17 bp, Homo sapiens
cacacacatgcatacac

SEQ ID NO: 2539148 - DNA, 15 bp, Homo sapiens
cacacacctgtagtc

SEQ ID NO: 2539149 - DNA, 14 bp, Homo sapiens
cacacactttggct

SEQ ID NO: 2539150 - DNA, 11 bp, Homo sapiens
cacacagaaaa

SEQ ID NO: 2539151 - DNA, 15 bp, Homo sapiens
cacacagaaaatata

SEQ ID NO: 2539152 - DNA, 20 bp, Homo sapiens
cacacagaaaatatactgta

SEQ ID NO: 2539153 - DNA, 23 bp, Homo sapiens
cacacagaaaatatactgtaaag

SEQ ID NO: 2539154 - DNA, 12 bp, Homo sapiens
cacacagaggaa

SEQ ID NO: 2539155 - DNA, 19 bp, Homo sapiens
cacacagaggctgcctctc

SEQ ID NO: 2539156 - DNA, 17 bp, Homo sapiens
cacacagccacacacac

SEQ ID NO: 2539157 - DNA, 19 bp, Homo sapiens
cacacagccacacacacag

SEQ ID NO: 2539158 - DNA, 14 bp, Homo sapiens
cacacagccaggtg

SEQ ID NO: 2539159 - DNA, 15 bp, Homo sapiens
cacacagccaggtgc

SEQ ID NO: 2539160 - DNA, 16 bp, Homo sapiens
cacagttttctgagaa

SEQ ID NO: 2539161 - DNA, 17 bp, Homo sapiens
cacagttttctgagaaa

SEQ ID NO: 2539162 - DNA, 19 bp, Homo sapiens
cacagttttctgagaaaga

SEQ ID NO: 2539163 - DNA, 22 bp, Homo sapiens
cacagttttctgagaaagacta

SEQ ID NO: 2539164 - DNA, 21 bp, Homo sapiens
cacagttttctggctggagcc

SEQ ID NO: 2539165 - DNA, 14 bp, Homo sapiens
cacataatttttct

SEQ ID NO: 2539166 - DNA, 17 bp, Homo sapiens
cacatacacacacacgc

SEQ ID NO: 2539167 - DNA, 15 bp, Homo sapiens
cacatagagatcatc

SEQ ID NO: 2539168 - DNA, 13 bp, Homo sapiens
cacatagctgtct

SEQ ID NO: 2539169 - DNA, 21 bp, Homo sapiens
cacatataaacatcacacaca

SEQ ID NO: 2539170 - DNA, 13 bp, Homo sapiens
cacatattgattt

SEQ ID NO: 2539171 - DNA, 18 bp, Homo sapiens
cacatcagcacgatttct

SEQ ID NO: 2539172 - DNA, 24 bp, Homo sapiens
cacatcagctccactttcagtgaa

SEQ ID NO: 2539173 - DNA, 13 bp, Homo sapiens
cacatctctatct

SEQ ID NO: 2539174 - DNA, 12 bp, Homo sapiens
cacatctgtgtc

SEQ ID NO: 2539175 - DNA, 16 bp, Homo sapiens
cacatctgtgtcttgt

SEQ ID NO: 2539176 - DNA, 12 bp, Homo sapiens
cacatcttccct

SEQ ID NO: 2539177 - DNA, 14 bp, Homo sapiens
cacatcttgctctg

SEQ ID NO: 2539178 - DNA, 21 bp, Homo sapiens
cacatcttgctctgctgacag

SEQ ID NO: 2539179 - DNA, 13 bp, Homo sapiens
cacatcttggcac

SEQ ID NO: 2539180 - DNA, 24 bp, Homo sapiens
cacatgaatcccacccacatgtga

SEQ ID NO: 2539181 - DNA, 21 bp, Homo sapiens
cacatgacaactttgccagct

SEQ ID NO: 2539182 - DNA, 18 bp, Homo sapiens
cacatgagcatcaggcca

SEQ ID NO: 2539183 - DNA, 21 bp, Homo sapiens
cacatgagcatcaggccaggc

SEQ ID NO: 2539184 - DNA, 14 bp, Homo sapiens
cacatgagtcccag

SEQ ID NO: 2539185 - DNA, 19 bp, Homo sapiens
cacatgcaaggtcattttt

SEQ ID NO: 2539186 - DNA, 14 bp, Homo sapiens
cacatgcatacaca

SEQ ID NO: 2539187 - DNA, 17 bp, Homo sapiens
cacatgcatacacacac

SEQ ID NO: 2539188 - DNA, 18 bp, Homo sapiens
cacatgcggagaacaaat

SEQ ID NO: 2539189 - DNA, 23 bp, Homo sapiens
cacatggcccctccccctgccag

SEQ ID NO: 2539190 - DNA, 19 bp, Homo sapiens
cacatggggctgggcagct

SEQ ID NO: 2539191 - DNA, 20 bp, Homo sapiens
cacatggggctgggcagcta

SEQ ID NO: 2539192 - DNA, 14 bp, Homo sapiens
cacatgtatgtttt

SEQ ID NO: 2539193 - DNA, 19 bp, Homo sapiens
cacatgtcaccgtggacct

SEQ ID NO: 2539194 - DNA, 20 bp, Homo sapiens
cacatgtcagtaccttcaaa

SEQ ID NO: 2539195 - DNA, 18 bp, Homo sapiens
cacatgtccaagaagccc

SEQ ID NO: 2539196 - DNA, 19 bp, Homo sapiens
cacatgtccaagaagccca

SEQ ID NO: 2539197 - DNA, 20 bp, Homo sapiens
cacatgtcttgtacatgtgt

SEQ ID NO: 2539198 - DNA, 18 bp, Homo sapiens
cacatgtttagagttgca

SEQ ID NO: 2539199 - DNA, 16 bp, Homo sapiens
cacattatcgggagca

SEQ ID NO: 2539200 - DNA, 17 bp, Homo sapiens
cacattatcgggagcag

SEQ ID NO: 2539201 - DNA, 23 bp, Homo sapiens
cacattatcgggagcagtgtctt

SEQ ID NO: 2539202 - DNA, 19 bp, Homo sapiens
cacattcaaccctggagag

SEQ ID NO: 2539203 - DNA, 20 bp, Homo sapiens
cacattctggctcagggagg

SEQ ID NO: 2539204 - DNA, 15 bp, Homo sapiens
cacattcttataaat

SEQ ID NO: 2539205 - DNA, 19 bp, Homo sapiens
cacatttaagagacagtca

SEQ ID NO: 2539206 - DNA, 12 bp, Homo sapiens
cacattttgtat

SEQ ID NO: 2539207 - DNA, 13 bp, Homo sapiens
cacattttgtata

SEQ ID NO: 2539208 - DNA, 15 bp, Homo sapiens
cacattttgtataat

SEQ ID NO: 2539209 - DNA, 21 bp, Homo sapiens
cacattttgtataattgtatc

SEQ ID NO: 2539210 - DNA, 14 bp, Homo sapiens
cacatttttcagat

SEQ ID NO: 2539211 - DNA, 14 bp, Homo sapiens
cacatttttcttag

SEQ ID NO: 2539212 - DNA, 17 bp, Homo sapiens
caccaaaataagaaaag

SEQ ID NO: 2539213 - DNA, 15 bp, Homo sapiens
caccaacaccacggt

SEQ ID NO: 2539214 - DNA, 21 bp, Homo sapiens
caccaagcaggaaatgaaaat

SEQ ID NO: 2539215 - DNA, 15 bp, Homo sapiens
caccaagcccagtta

SEQ ID NO: 2539216 - DNA, 19 bp, Homo sapiens
caccacatgtgcacatgca

SEQ ID NO: 2539217 - DNA, 13 bp, Homo sapiens
caccaccactggc

SEQ ID NO: 2539218 - DNA, 18 bp, Homo sapiens
caccaccccccactctgt

SEQ ID NO: 2539219 - DNA, 18 bp, Homo sapiens
caccacctcactcctgtt

SEQ ID NO: 2539220 - DNA, 17 bp, Homo sapiens
caccacggtagtgcctg

SEQ ID NO: 2539221 - DNA, 20 bp, Homo sapiens
caccactacattctgttaat

SEQ ID NO: 2539222 - DNA, 20 bp, Homo sapiens
caccactaggactctgaggc

SEQ ID NO: 2539223 - DNA, 19 bp, Homo sapiens
caccactggccaccaggct

SEQ ID NO: 2539224 - DNA, 20 bp, Homo sapiens
caccactggccaccaggctg

SEQ ID NO: 2539225 - DNA, 16 bp, Homo sapiens
caccagagcagatgca

SEQ ID NO: 2539226 - DNA, 17 bp, Homo sapiens
caccagagcagatgcag

SEQ ID NO: 2539227 - DNA, 19 bp, Homo sapiens
caccagagcagatgcagag

SEQ ID NO: 2539228 - DNA, 20 bp, Homo sapiens
caccagagcagatgcagaga

SEQ ID NO: 2539229 - DNA, 11 bp, Homo sapiens
caccagcacca

SEQ ID NO: 2539230 - DNA, 15 bp, Homo sapiens
caccagcagcctgga

SEQ ID NO: 2539231 - DNA, 13 bp, Homo sapiens
caccagccaggct

SEQ ID NO: 2539232 - DNA, 15 bp, Homo sapiens
caccagccaggctct

SEQ ID NO: 2539233 - DNA, 19 bp, Homo sapiens
caccagccaggctctgtgc

SEQ ID NO: 2539234 - DNA, 13 bp, Homo sapiens
caccagccccagt

SEQ ID NO: 2539235 - DNA, 17 bp, Homo sapiens
caccagccccagtgccc

SEQ ID NO: 2539236 - DNA, 18 bp, Homo sapiens
caccagccccagtgccca

SEQ ID NO: 2539237 - DNA, 22 bp, Homo sapiens
caccagccccagtgcccacagg

SEQ ID NO: 2539238 - DNA, 14 bp, Homo sapiens
caccagcctgcact

SEQ ID NO: 2539239 - DNA, 19 bp, Homo sapiens
caccagcgtttgaggggct

SEQ ID NO: 2539240 - DNA, 12 bp, Homo sapiens
caccagctcctc

SEQ ID NO: 2539241 - DNA, 22 bp, Homo sapiens
caccagctgttctgtcccttgg

SEQ ID NO: 2539242 - DNA, 17 bp, Homo sapiens
caccagcttctccaggc

SEQ ID NO: 2539243 - DNA, 17 bp, Homo sapiens
caccaggagaaccacta

SEQ ID NO: 2539244 - DNA, 13 bp, Homo sapiens
caccaggatggcc

SEQ ID NO: 2539245 - DNA, 23 bp, Homo sapiens
caccaggcacctcacagaaatga

SEQ ID NO: 2539246 - DNA, 21 bp, Homo sapiens
caccaggctgctcagggctgg

SEQ ID NO: 2539247 - DNA, 19 bp, Homo sapiens
caccaggctggcgcagcca

SEQ ID NO: 2539248 - DNA, 15 bp, Homo sapiens
caccaggctgtgggc

SEQ ID NO: 2539249 - DNA, 16 bp, Homo sapiens
caccaggctgtgggcc

SEQ ID NO: 2539250 - DNA, 17 bp, Homo sapiens
caccaggctgtgggcct

SEQ ID NO: 2539251 - DNA, 16 bp, Homo sapiens
caccagggatggtact

SEQ ID NO: 2539252 - DNA, 21 bp, Homo sapiens
caccagtgactttttctaaga

SEQ ID NO: 2539253 - DNA, 14 bp, Homo sapiens
caccagtgtcccct

SEQ ID NO: 2539254 - DNA, 18 bp, Homo sapiens
caccagtgtcccctccac

SEQ ID NO: 2539255 - DNA, 21 bp, Homo sapiens
caccatattaccacagacata

SEQ ID NO: 2539256 - DNA, 14 bp, Homo sapiens
caccatcaagccac

SEQ ID NO: 2539257 - DNA, 19 bp, Homo sapiens
caccatcaagccaccaaca

SEQ ID NO: 2539258 - DNA, 21 bp, Homo sapiens
caccatctcaggccacctgcc

SEQ ID NO: 2539259 - DNA, 21 bp, Homo sapiens
caccatgcagtgcccctagct

SEQ ID NO: 2539260 - DNA, 12 bp, Homo sapiens
caccatggccag

SEQ ID NO: 2539261 - DNA, 18 bp, Homo sapiens
caccatggggtcctacca

SEQ ID NO: 2539262 - DNA, 23 bp, Homo sapiens
caccatggggtcctaccaataga

SEQ ID NO: 2539263 - DNA, 18 bp, Homo sapiens
caccatgtacatagcttg

SEQ ID NO: 2539264 - DNA, 16 bp, Homo sapiens
cacccaagcaaggcca

SEQ ID NO: 2539265 - DNA, 13 bp, Homo sapiens
cacccaagcttgg

SEQ ID NO: 2539266 - DNA, 15 bp, Homo sapiens
cacccaagcttggca

SEQ ID NO: 2539267 - DNA, 13 bp, Homo sapiens
cacccaagggcct

SEQ ID NO: 2539268 - DNA, 14 bp, Homo sapiens
cacccaagggcctg

SEQ ID NO: 2539269 - DNA, 16 bp, Homo sapiens
cacccaagggcctggc

SEQ ID NO: 2539270 - DNA, 21 bp, Homo sapiens
cacccaagggcctggcctgag

SEQ ID NO: 2539271 - DNA, 23 bp, Homo sapiens
cacccaataaacattaagattga

SEQ ID NO: 2539272 - DNA, 12 bp, Homo sapiens
cacccacatgtg

SEQ ID NO: 2539273 - DNA, 15 bp, Homo sapiens
cacccaccagggcga

SEQ ID NO: 2539274 - DNA, 20 bp, Homo sapiens
cacccaccatcatgtctggc

SEQ ID NO: 2539275 - DNA, 22 bp, Homo sapiens
cacccaccatcatgtctggcta

SEQ ID NO: 2539276 - DNA, 12 bp, Homo sapiens
cacccacctcag

SEQ ID NO: 2539277 - DNA, 14 bp, Homo sapiens
cacccagacagctc

SEQ ID NO: 2539278 - DNA, 16 bp, Homo sapiens
cacccagccctggtct

SEQ ID NO: 2539279 - DNA, 22 bp, Homo sapiens
cacccagccctggtctcagcag

SEQ ID NO: 2539280 - DNA, 14 bp, Homo sapiens
cacccagctcagca

SEQ ID NO: 2539281 - DNA, 20 bp, Homo sapiens
cacccaggagccccgaggcc

SEQ ID NO: 2539282 - DNA, 17 bp, Homo sapiens
cacccagtctgttcccc

SEQ ID NO: 2539283 - DNA, 13 bp, Homo sapiens
cacccatctgttt

SEQ ID NO: 2539284 - DNA, 13 bp, Homo sapiens
cacccatgtgcca

SEQ ID NO: 2539285 - DNA, 15 bp, Homo sapiens
cacccattttcacat

SEQ ID NO: 2539286 - DNA, 13 bp, Homo sapiens
caccccaccctcc

SEQ ID NO: 2539287 - DNA, 11 bp, Homo sapiens
caccccagccc

SEQ ID NO: 2539288 - DNA, 11 bp, Homo sapiens
cacccccaccc

SEQ ID NO: 2539289 - DNA, 14 bp, Homo sapiens
cacccccaccccca

SEQ ID NO: 2539290 - DNA, 13 bp, Homo sapiens
caccccccagaac

SEQ ID NO: 2539291 - DNA, 13 bp, Homo sapiens
cacccccctgggc

SEQ ID NO: 2539292 - DNA, 20 bp, Homo sapiens
caccccctcaagccaatccc

SEQ ID NO: 2539293 - DNA, 13 bp, Homo sapiens
caccccctccctg

SEQ ID NO: 2539294 - DNA, 14 bp, Homo sapiens
caccccctccctgg

SEQ ID NO: 2539295 - DNA, 23 bp, Homo sapiens
caccccctccctggcctgttctg

SEQ ID NO: 2539296 - DNA, 17 bp, Homo sapiens
cacccccttctctgctc

SEQ ID NO: 2539297 - DNA, 18 bp, Homo sapiens
caccccgggctctctgct

SEQ ID NO: 2539298 - DNA, 15 bp, Homo sapiens
caccccgtagattcc

SEQ ID NO: 2539299 - DNA, 12 bp, Homo sapiens
cacccctccttc

SEQ ID NO: 2539300 - DNA, 15 bp, Homo sapiens
cacccctgccctggg

SEQ ID NO: 2539301 - DNA, 15 bp, Homo sapiens
cacccctgcctccac

SEQ ID NO: 2539302 - DNA, 13 bp, Homo sapiens
cacccctgtgctc

SEQ ID NO: 2539303 - DNA, 17 bp, Homo sapiens
cacccctgtgctccgtg

SEQ ID NO: 2539304 - DNA, 11 bp, Homo sapiens
caccccttcca

SEQ ID NO: 2539305 - DNA, 14 bp, Homo sapiens
caccccttccatgt

SEQ ID NO: 2539306 - DNA, 19 bp, Homo sapiens
cacttgtgtgtgggctgtg

SEQ ID NO: 2539307 - DNA, 21 bp, Homo sapiens
cacttgtgtgtgggctgtgag

SEQ ID NO: 2539308 - DNA, 12 bp, Homo sapiens
cactttgctctg

SEQ ID NO: 2539309 - DNA, 23 bp, Homo sapiens
cactttgttctggctcttccagg

SEQ ID NO: 2539310 - DNA, 18 bp, Homo sapiens
cactttgttctttaggag

SEQ ID NO: 2539311 - DNA, 13 bp, Homo sapiens
cacttttcagtga

SEQ ID NO: 2539312 - DNA, 17 bp, Homo sapiens
cacttttgacaaaggca

SEQ ID NO: 2539313 - DNA, 14 bp, Homo sapiens
cacttttgttcttg

SEQ ID NO: 2539314 - DNA, 14 bp, Homo sapiens
cacttttttccaca

SEQ ID NO: 2539315 - DNA, 21 bp, Homo sapiens
cacttttttggggatatgctt

SEQ ID NO: 2539316 - DNA, 19 bp, Homo sapiens
cagaaaaactctgggaaat

SEQ ID NO: 2539317 - DNA, 16 bp, Homo sapiens
cagaaaacatgtttcc

SEQ ID NO: 2539318 - DNA, 14 bp, Homo sapiens
cagaaaaccccagc

SEQ ID NO: 2539319 - DNA, 17 bp, Homo sapiens
cagaaaagggaagttgt

SEQ ID NO: 2539320 - DNA, 14 bp, Homo sapiens
cagaaaatatactg

SEQ ID NO: 2539321 - DNA, 21 bp, Homo sapiens
cagaaaatatactgtaaagaa

SEQ ID NO: 2539322 - DNA, 22 bp, Homo sapiens
cagaaacatcagttactctgaa

SEQ ID NO: 2539323 - DNA, 23 bp, Homo sapiens
cagaaacatcagttactctgaag

SEQ ID NO: 2539324 - DNA, 20 bp, Homo sapiens
cagaaacttgtgaagtggaa

SEQ ID NO: 2539325 - DNA, 20 bp, Homo sapiens
cagaaagactgagctcaagg

SEQ ID NO: 2539326 - DNA, 21 bp, Homo sapiens
cagaaagatggatgtgctttg

SEQ ID NO: 2539327 - DNA, 18 bp, Homo sapiens
cagaaagcagaacagtga

SEQ ID NO: 2539328 - DNA, 19 bp, Homo sapiens
cagaaagcagaacagtgat

SEQ ID NO: 2539329 - DNA, 18 bp, Homo sapiens
cagaaagcataaaattct

SEQ ID NO: 2539330 - DNA, 16 bp, Homo sapiens
cagaaagcattacatt

SEQ ID NO: 2539331 - DNA, 12 bp, Homo sapiens
cagaaaggagac

SEQ ID NO: 2539332 - DNA, 22 bp, Homo sapiens
cagaaagggcaacaataaaata

SEQ ID NO: 2539333 - DNA, 17 bp, Homo sapiens
cagaaaggttctgcccg

SEQ ID NO: 2539334 - DNA, 13 bp, Homo sapiens
cagaaatacatat

SEQ ID NO: 2539335 - DNA, 16 bp, Homo sapiens
cagaaatgctgcctgc

SEQ ID NO: 2539336 - DNA, 17 bp, Homo sapiens
cagaaatgctgcctgcc

SEQ ID NO: 2539337 - DNA, 23 bp, Homo sapiens
cagaaatgtacaactttttacct

SEQ ID NO: 2539338 - DNA, 16 bp, Homo sapiens
cagaaatgtacagcaa

SEQ ID NO: 2539339 - DNA, 14 bp, Homo sapiens
cagaaatgtctaaa

SEQ ID NO: 2539340 - DNA, 21 bp, Homo sapiens
cagaaatgtctaaatgctgaa

SEQ ID NO: 2539341 - DNA, 21 bp, Homo sapiens
cagaacaaggttccctctgag

SEQ ID NO: 2539342 - DNA, 13 bp, Homo sapiens
cagaacactaacc

SEQ ID NO: 2539343 - DNA, 15 bp, Homo sapiens
cagaacactaacctg

SEQ ID NO: 2539344 - DNA, 12 bp, Homo sapiens
cagaacagcaga

SEQ ID NO: 2539345 - DNA, 14 bp, Homo sapiens
cagaacagcagagg

SEQ ID NO: 2539346 - DNA, 17 bp, Homo sapiens
cagaacagccgctcctg

SEQ ID NO: 2539347 - DNA, 12 bp, Homo sapiens
cagaacagcttc

SEQ ID NO: 2539348 - DNA, 13 bp, Homo sapiens
cagaacagcttca

SEQ ID NO: 2539349 - DNA, 17 bp, Homo sapiens
cagaacagcttcaggtt

SEQ ID NO: 2539350 - DNA, 19 bp, Homo sapiens
cagaacagcttcaggttat

SEQ ID NO: 2539351 - DNA, 23 bp, Homo sapiens
cagaacagtgattaccagggact

SEQ ID NO: 2539352 - DNA, 15 bp, Homo sapiens
cagaacatcattaga

SEQ ID NO: 2539353 - DNA, 18 bp, Homo sapiens
cagaacatcattagaaca

SEQ ID NO: 2539354 - DNA, 15 bp, Homo sapiens
cagaaccatccatag

SEQ ID NO: 2539355 - DNA, 23 bp, Homo sapiens
cagaacccctacatgaaacagaa

SEQ ID NO: 2539356 - DNA, 13 bp, Homo sapiens
cagaacctggagg

SEQ ID NO: 2539357 - DNA, 18 bp, Homo sapiens
cagaaccttgttatttct

SEQ ID NO: 2539358 - DNA, 13 bp, Homo sapiens
cagaactagaatt

SEQ ID NO: 2539359 - DNA, 16 bp, Homo sapiens
cagaactctttcaaaa

SEQ ID NO: 2539360 - DNA, 13 bp, Homo sapiens
cagaactgagctc

SEQ ID NO: 2539361 - DNA, 16 bp, Homo sapiens
cagaactgagctcctc

SEQ ID NO: 2539362 - DNA, 17 bp, Homo sapiens
cagaactgagctcctct

SEQ ID NO: 2539363 - DNA, 23 bp, Homo sapiens
cagaactgagctcctctgggcag

SEQ ID NO: 2539364 - DNA, 14 bp, Homo sapiens
cagaagaaggcagc

SEQ ID NO: 2539365 - DNA, 12 bp, Homo sapiens
cagaagaatatt

SEQ ID NO: 2539366 - DNA, 19 bp, Homo sapiens
cagaagaatattcaggact

SEQ ID NO: 2539367 - DNA, 14 bp, Homo sapiens
cagaagacaccaga

SEQ ID NO: 2539368 - DNA, 15 bp, Homo sapiens
cagaagacaccagag

SEQ ID NO: 2539369 - DNA, 16 bp, Homo sapiens
cagaagacaccagagc

SEQ ID NO: 2539370 - DNA, 21 bp, Homo sapiens
cagaagacaccagagcagatg

SEQ ID NO: 2539371 - DNA, 20 bp, Homo sapiens
cagaagagatgggcttgttt

SEQ ID NO: 2539372 - DNA, 22 bp, Homo sapiens
cagaagataacttgagcaccgt

SEQ ID NO: 2539373 - DNA, 18 bp, Homo sapiens
cagaagatcccctcagga

SEQ ID NO: 2539374 - DNA, 14 bp, Homo sapiens
cagaagcagctctt

SEQ ID NO: 2539375 - DNA, 14 bp, Homo sapiens
cagaagcaggctgg

SEQ ID NO: 2539376 - DNA, 14 bp, Homo sapiens
cagaagcattaact

SEQ ID NO: 2539377 - DNA, 14 bp, Homo sapiens
cagaagcctgaggc

SEQ ID NO: 2539378 - DNA, 15 bp, Homo sapiens
cagaagcctgaggct

SEQ ID NO: 2539379 - DNA, 12 bp, Homo sapiens
cagaagcttcca

SEQ ID NO: 2539380 - DNA, 19 bp, Homo sapiens
cagaaggcaaatgactttg

SEQ ID NO: 2539381 - DNA, 20 bp, Homo sapiens
cagaaggcaaatgactttgg

SEQ ID NO: 2539382 - DNA, 14 bp, Homo sapiens
cagaaggccaagaa

SEQ ID NO: 2539383 - DNA, 12 bp, Homo sapiens
cagaaggctctt

SEQ ID NO: 2539384 - DNA, 17 bp, Homo sapiens
cagaaggctcttctgac

SEQ ID NO: 2539385 - DNA, 10 bp, Homo sapiens
cagaagggag

SEQ ID NO: 2539386 - DNA, 12 bp, Homo sapiens
cagaagggaggc

SEQ ID NO: 2539387 - DNA, 15 bp, Homo sapiens
cagaaggggagggga

SEQ ID NO: 2539388 - DNA, 17 bp, Homo sapiens
cagaagggggagaccaa

SEQ ID NO: 2539389 - DNA, 14 bp, Homo sapiens
cagaagtggagctg

SEQ ID NO: 2539390 - DNA, 15 bp, Homo sapiens
cagaagtggagctgg

SEQ ID NO: 2539391 - DNA, 13 bp, Homo sapiens
cagaagtgtgatt

SEQ ID NO: 2539392 - DNA, 22 bp, Homo sapiens
cagaagtgtgattgggaataaa

SEQ ID NO: 2539393 - DNA, 15 bp, Homo sapiens
cagaagtttctcagc

SEQ ID NO: 2539394 - DNA, 20 bp, Homo sapiens
cagaagtttgagatcagcct

SEQ ID NO: 2539395 - DNA, 16 bp, Homo sapiens
cagaagtttggcaata

SEQ ID NO: 2539396 - DNA, 17 bp, Homo sapiens
cagaataagttattgca

SEQ ID NO: 2539397 - DNA, 21 bp, Homo sapiens
cagaataagttattgcagttt

SEQ ID NO: 2539398 - DNA, 14 bp, Homo sapiens
cagaataatgaatg

SEQ ID NO: 2539399 - DNA, 12 bp, Homo sapiens
cagaatatctgg

SEQ ID NO: 2539400 - DNA, 20 bp, Homo sapiens
cagaatcaaagcaatgcatt

SEQ ID NO: 2539401 - DNA, 21 bp, Homo sapiens
cagaatcctggccctctgtgt

SEQ ID NO: 2539402 - DNA, 17 bp, Homo sapiens
cagaatctaaagccagt

SEQ ID NO: 2539403 - DNA, 14 bp, Homo sapiens
cagaatgtgatttc

SEQ ID NO: 2539404 - DNA, 15 bp, Homo sapiens
cagaattccttttct

SEQ ID NO: 2539405 - DNA, 13 bp, Homo sapiens
cagaattctgcta

SEQ ID NO: 2539406 - DNA, 13 bp, Homo sapiens
cagaattgatcat

SEQ ID NO: 2539407 - DNA, 17 bp, Homo sapiens
cagacaaaccagaagca

SEQ ID NO: 2539408 - DNA, 13 bp, Homo sapiens
cagacacacacac

SEQ ID NO: 2539409 - DNA, 14 bp, Homo sapiens
cagacacaggcccg

SEQ ID NO: 2539410 - DNA, 15 bp, Homo sapiens
cagacacaggcccgg

SEQ ID NO: 2539411 - DNA, 21 bp, Homo sapiens
cagacacaggcccggctccag

SEQ ID NO: 2539412 - DNA, 23 bp, Homo sapiens
cagacacaggcccggctccaggc

SEQ ID NO: 2539413 - DNA, 17 bp, Homo sapiens
cagacacatgtccaaga

SEQ ID NO: 2539414 - DNA, 13 bp, Homo sapiens
cagacacccaccc

SEQ ID NO: 2539415 - DNA, 22 bp, Homo sapiens
cagacaccttgacagggcacac

SEQ ID NO: 2539416 - DNA, 11 bp, Homo sapiens
cagacactaag

SEQ ID NO: 2539417 - DNA, 18 bp, Homo sapiens
cagacactaagttatagt

SEQ ID NO: 2539418 - DNA, 21 bp, Homo sapiens
cagacactgaccatccactct

SEQ ID NO: 2539419 - DNA, 21 bp, Homo sapiens
cagacacttttttgagtggat

SEQ ID NO: 2539420 - DNA, 13 bp, Homo sapiens
cagacagcagctc

SEQ ID NO: 2539421 - DNA, 15 bp, Homo sapiens
cagacagcagctcag

SEQ ID NO: 2539422 - DNA, 13 bp, Homo sapiens
cagacagcctgta

SEQ ID NO: 2539423 - DNA, 14 bp, Homo sapiens
cagacagcctgtat

SEQ ID NO: 2539424 - DNA, 11 bp, Homo sapiens
cagacagctcc

SEQ ID NO: 2539425 - DNA, 19 bp, Homo sapiens
cagacagctccctctgcct

SEQ ID NO: 2539426 - DNA, 15 bp, Homo sapiens
cagacagctgcctgg

SEQ ID NO: 2539427 - DNA, 13 bp, Homo sapiens
cagacaggaccag

SEQ ID NO: 2539428 - DNA, 11 bp, Homo sapiens
cagacaggcaa

SEQ ID NO: 2539429 - DNA, 13 bp, Homo sapiens
cagacaggcaagc

SEQ ID NO: 2539430 - DNA, 18 bp, Homo sapiens
cagacaggcaagcacctc

SEQ ID NO: 2539431 - DNA, 21 bp, Homo sapiens
cagacaggcaagcacctcctg

SEQ ID NO: 2539432 - DNA, 19 bp, Homo sapiens
cagacagtgttttctggga

SEQ ID NO: 2539433 - DNA, 18 bp, Homo sapiens
cagacatgtggtgggaca

SEQ ID NO: 2539434 - DNA, 22 bp, Homo sapiens
cagacatgtggtgggacaggga

SEQ ID NO: 2539435 - DNA, 21 bp, Homo sapiens
cagacattctgccaggccccc

SEQ ID NO: 2539436 - DNA, 14 bp, Homo sapiens
cagaccacaaaact

SEQ ID NO: 2539437 - DNA, 22 bp, Homo sapiens
cagaccaccccgcctgccctca

SEQ ID NO: 2539438 - DNA, 15 bp, Homo sapiens
cagacccccacccct

SEQ ID NO: 2539439 - DNA, 20 bp, Homo sapiens
cagacccctctggccaggat

SEQ ID NO: 2539440 - DNA, 14 bp, Homo sapiens
cagacccggctgcg

SEQ ID NO: 2539441 - DNA, 13 bp, Homo sapiens
cagaccctgccct

SEQ ID NO: 2539442 - DNA, 18 bp, Homo sapiens
cagacctattcctcctgg

SEQ ID NO: 2539443 - DNA, 19 bp, Homo sapiens
cagacctattcctcctggg

SEQ ID NO: 2539444 - DNA, 18 bp, Homo sapiens
cagacctggagcccctgg

SEQ ID NO: 2539445 - DNA, 21 bp, Homo sapiens
cagacctggagcccctgggtg

SEQ ID NO: 2539446 - DNA, 22 bp, Homo sapiens
cagacctggagcccctgggtgg

SEQ ID NO: 2539447 - DNA, 12 bp, Homo sapiens
cagacctgtcct

SEQ ID NO: 2539448 - DNA, 22 bp, Homo sapiens
cagactagtttagttaaatgag

SEQ ID NO: 2539449 - DNA, 13 bp, Homo sapiens
cagactcctgagg

SEQ ID NO: 2539450 - DNA, 16 bp, Homo sapiens
cagactcctgaggaca

SEQ ID NO: 2539451 - DNA, 18 bp, Homo sapiens
cagactctacagaggcca

SEQ ID NO: 2539452 - DNA, 18 bp, Homo sapiens
cagatcaatggcgcagtg

SEQ ID NO: 2539453 - DNA, 23 bp, Homo sapiens
cagatcaatggcgcagtgcctct

SEQ ID NO: 2539454 - DNA, 15 bp, Homo sapiens
cagatcatccagaag

SEQ ID NO: 2539455 - DNA, 23 bp, Homo sapiens
cagatcattatcagcctgtgcca

SEQ ID NO: 2539456 - DNA, 14 bp, Homo sapiens
cagatcccagctca

SEQ ID NO: 2539457 - DNA, 13 bp, Homo sapiens
cagatccttgttt

SEQ ID NO: 2539458 - DNA, 14 bp, Homo sapiens
cagatccttgtttc

SEQ ID NO: 2539459 - DNA, 16 bp, Homo sapiens
cagatccttgtttcaa

SEQ ID NO: 2539460 - DNA, 19 bp, Homo sapiens
cagatccttgtttcaaaca

SEQ ID NO: 2539461 - DNA, 13 bp, Homo sapiens
cagatctgtctga

SEQ ID NO: 2539462 - DNA, 20 bp, Homo sapiens
cagatgaactcttagaaatg

SEQ ID NO: 2539463 - DNA, 14 bp, Homo sapiens
cagatgaatgataa

SEQ ID NO: 2539464 - DNA, 23 bp, Homo sapiens
cagatgatgccaacctctggagc

SEQ ID NO: 2539465 - DNA, 13 bp, Homo sapiens
cagatgcaccagc

SEQ ID NO: 2539466 - DNA, 17 bp, Homo sapiens
cagatgcaccagccctt

SEQ ID NO: 2539467 - DNA, 22 bp, Homo sapiens
cagatgcaccagcccttagcag

SEQ ID NO: 2539468 - DNA, 13 bp, Homo sapiens
cagatgccccaga

SEQ ID NO: 2539469 - DNA, 22 bp, Homo sapiens
cagatgcctccaccccccagaa

SEQ ID NO: 2539470 - DNA, 14 bp, Homo sapiens
cagatgctgatgtt

SEQ ID NO: 2539471 - DNA, 16 bp, Homo sapiens
cagatgctgatgttca

SEQ ID NO: 2539472 - DNA, 17 bp, Homo sapiens
cagatgctgatgttcag

SEQ ID NO: 2539473 - DNA, 18 bp, Homo sapiens
cagatgctgatgttcagt

SEQ ID NO: 2539474 - DNA, 12 bp, Homo sapiens
cagatgcttctg

SEQ ID NO: 2539475 - DNA, 17 bp, Homo sapiens
cagatgcttctgggaga

SEQ ID NO: 2539476 - DNA, 14 bp, Homo sapiens
cagatgcttttctg

SEQ ID NO: 2539477 - DNA, 19 bp, Homo sapiens
cagatggaaccgcaggaag

SEQ ID NO: 2539478 - DNA, 20 bp, Homo sapiens
cagatggaaccgcaggaagc

SEQ ID NO: 2539479 - DNA, 22 bp, Homo sapiens
cagatggattgataattgcatt

SEQ ID NO: 2539480 - DNA, 23 bp, Homo sapiens
cagatggattgataattgcattc

SEQ ID NO: 2539481 - DNA, 22 bp, Homo sapiens
cagatggatttgcctgtgccac

SEQ ID NO: 2539482 - DNA, 12 bp, Homo sapiens
cagatggcactt

SEQ ID NO: 2539483 - DNA, 14 bp, Homo sapiens
cagatggggcctct

SEQ ID NO: 2539484 - DNA, 16 bp, Homo sapiens
cagatgtcttctgcct

SEQ ID NO: 2539485 - DNA, 22 bp, Homo sapiens
cagatgttttacgtctgggaga

SEQ ID NO: 2539486 - DNA, 14 bp, Homo sapiens
cagattactgccca

SEQ ID NO: 2539487 - DNA, 12 bp, Homo sapiens
cagattgaaaag

SEQ ID NO: 2539488 - DNA, 18 bp, Homo sapiens
cagattgcaacaggctgg

SEQ ID NO: 2539489 - DNA, 21 bp, Homo sapiens
cagattgcaacaggctgggct

SEQ ID NO: 2539490 - DNA, 20 bp, Homo sapiens
cagattgcatgtgactctga

SEQ ID NO: 2539491 - DNA, 19 bp, Homo sapiens
cagatttgaactcttcaat

SEQ ID NO: 2539492 - DNA, 16 bp, Homo sapiens
cagatttgtgaactca

SEQ ID NO: 2539493 - DNA, 23 bp, Homo sapiens
cagatttgtgaactcagccaagc

SEQ ID NO: 2539494 - DNA, 22 bp, Homo sapiens
cagattttaaaaagtcttcact

SEQ ID NO: 2539495 - DNA, 23 bp, Homo sapiens
cagattttaattttgaataaata

SEQ ID NO: 2539496 - DNA, 13 bp, Homo sapiens
cagattttcagca

SEQ ID NO: 2539497 - DNA, 19 bp, Homo sapiens
cagattttcagcaaactct

SEQ ID NO: 2539498 - DNA, 21 bp, Homo sapiens
cagattttggggttgtgttgt

SEQ ID NO: 2539499 - DNA, 14 bp, Homo sapiens
cagatttttacaaa

SEQ ID NO: 2539500 - DNA, 19 bp, Homo sapiens
cagattttttacagctgcc

SEQ ID NO: 2539501 - DNA, 22 bp, Homo sapiens
cagattttttacagctgcctgc

SEQ ID NO: 2539502 - DNA, 18 bp, Homo sapiens
cagcaaaagatgcttctc

SEQ ID NO: 2539503 - DNA, 20 bp, Homo sapiens
cagcaaactcttttcccact

SEQ ID NO: 2539504 - DNA, 14 bp, Homo sapiens
cagcaaccctccta

SEQ ID NO: 2539505 - DNA, 12 bp, Homo sapiens
cagcaactgaat

SEQ ID NO: 2539506 - DNA, 14 bp, Homo sapiens
cagcaactgaataa

SEQ ID NO: 2539507 - DNA, 17 bp, Homo sapiens
cagcaaggagatttaca

SEQ ID NO: 2539508 - DNA, 22 bp, Homo sapiens
cagcaagggtgatgggaaagca

SEQ ID NO: 2539509 - DNA, 17 bp, Homo sapiens
cagcaagtgagagctgg

SEQ ID NO: 2539510 - DNA, 22 bp, Homo sapiens
cagcaataaagcagcgtttcta

SEQ ID NO: 2539511 - DNA, 20 bp, Homo sapiens
cagcaatgacatctcagggg

SEQ ID NO: 2539512 - DNA, 20 bp, Homo sapiens
cagcaatgatgtccagaaga

SEQ ID NO: 2539513 - DNA, 22 bp, Homo sapiens
cagcaatgatgtccagaagaat

SEQ ID NO: 2539514 - DNA, 17 bp, Homo sapiens
cagcacagagaagacaa

SEQ ID NO: 2539515 - DNA, 16 bp, Homo sapiens
cagcacccctgtctct

SEQ ID NO: 2539516 - DNA, 14 bp, Homo sapiens
cagcaccccttcca

SEQ ID NO: 2539517 - DNA, 22 bp, Homo sapiens
cagcaccccttccatgtggaga

SEQ ID NO: 2539518 - DNA, 12 bp, Homo sapiens
cagcaccctgca

SEQ ID NO: 2539519 - DNA, 15 bp, Homo sapiens
cagcactcacacagg

SEQ ID NO: 2539520 - DNA, 13 bp, Homo sapiens
cagcactgcccaa

SEQ ID NO: 2539521 - DNA, 19 bp, Homo sapiens
cagcactgcttgaggaaaa

SEQ ID NO: 2539522 - DNA, 20 bp, Homo sapiens
cagcactggctctctccagg

SEQ ID NO: 2539523 - DNA, 21 bp, Homo sapiens
cagcactggctctctccagga

SEQ ID NO: 2539524 - DNA, 16 bp, Homo sapiens
cagcactttgggaggc

SEQ ID NO: 2539525 - DNA, 15 bp, Homo sapiens
cagcagaaatgcctt

SEQ ID NO: 2539526 - DNA, 22 bp, Homo sapiens
cagcagaaatgccttaccctca

SEQ ID NO: 2539527 - DNA, 13 bp, Homo sapiens
cagcagagcacct

SEQ ID NO: 2539528 - DNA, 16 bp, Homo sapiens
cagcagaggcactggg

SEQ ID NO: 2539529 - DNA, 15 bp, Homo sapiens
cagcagatcccagct

SEQ ID NO: 2539530 - DNA, 17 bp, Homo sapiens
cagcagatcccagctca

SEQ ID NO: 2539531 - DNA, 21 bp, Homo sapiens
cagcagatcccagctcacgtc

SEQ ID NO: 2539532 - DNA, 13 bp, Homo sapiens
cagcagccagctc

SEQ ID NO: 2539533 - DNA, 14 bp, Homo sapiens
cagcagccagctct

SEQ ID NO: 2539534 - DNA, 17 bp, Homo sapiens
cagcagccagctctcag

SEQ ID NO: 2539535 - DNA, 19 bp, Homo sapiens
cagcagccagctctcagcc

SEQ ID NO: 2539536 - DNA, 21 bp, Homo sapiens
cagcagccagctctcagccaa

SEQ ID NO: 2539537 - DNA, 12 bp, Homo sapiens
cagcagcctgga

SEQ ID NO: 2539538 - DNA, 14 bp, Homo sapiens
cagcagcctggacc

SEQ ID NO: 2539539 - DNA, 18 bp, Homo sapiens
cagcagcctggaccctgt

SEQ ID NO: 2539540 - DNA, 19 bp, Homo sapiens
cagcagcctggaccctgtg

SEQ ID NO: 2539541 - DNA, 17 bp, Homo sapiens
cagcagcggaaccgccc

SEQ ID NO: 2539542 - DNA, 12 bp, Homo sapiens
cagcagctcagg

SEQ ID NO: 2539543 - DNA, 16 bp, Homo sapiens
cagcagctcaggcaca

SEQ ID NO: 2539544 - DNA, 20 bp, Homo sapiens
cagcagctgaacagccaaat

SEQ ID NO: 2539545 - DNA, 17 bp, Homo sapiens
cagcagcttcaccagag

SEQ ID NO: 2539546 - DNA, 20 bp, Homo sapiens
cagcagggagggcttctgcc

SEQ ID NO: 2539547 - DNA, 17 bp, Homo sapiens
cagcagggctgctgtga

SEQ ID NO: 2539548 - DNA, 21 bp, Homo sapiens
cagcagggtcttttcatctgg

SEQ ID NO: 2539549 - DNA, 14 bp, Homo sapiens
cagcagtgaaaaca

SEQ ID NO: 2539550 - DNA, 17 bp, Homo sapiens
cagcagtgaaaacaagt

SEQ ID NO: 2539551 - DNA, 17 bp, Homo sapiens
cagcagtgtgaggccag

SEQ ID NO: 2539552 - DNA, 19 bp, Homo sapiens
cagcagtgtgaggccaggg

SEQ ID NO: 2539553 - DNA, 20 bp, Homo sapiens
cagcagtgtgaggccagggc

SEQ ID NO: 2539554 - DNA, 13 bp, Homo sapiens
cagcagtgttccc

SEQ ID NO: 2539555 - DNA, 19 bp, Homo sapiens
cagcagtgttccccatctg

SEQ ID NO: 2539556 - DNA, 21 bp, Homo sapiens
cagcagtgttccccatctggg

SEQ ID NO: 2539557 - DNA, 22 bp, Homo sapiens
cagcagttgaaaagactccaaa

SEQ ID NO: 2539558 - DNA, 22 bp, Homo sapiens
cagcataacaaggtccaagata

SEQ ID NO: 2539559 - DNA, 17 bp, Homo sapiens
cagcatagaagtaactt

SEQ ID NO: 2539560 - DNA, 15 bp, Homo sapiens
cagcatcctggcacc

SEQ ID NO: 2539561 - DNA, 16 bp, Homo sapiens
cagcatcctggcaccc

SEQ ID NO: 2539562 - DNA, 19 bp, Homo sapiens
cagcatcctggcacccggc

SEQ ID NO: 2539563 - DNA, 20 bp, Homo sapiens
cagcatcctggcacccggcc

SEQ ID NO: 2539564 - DNA, 21 bp, Homo sapiens
cagcatgacctgtgaccagca

SEQ ID NO: 2539565 - DNA, 18 bp, Homo sapiens
cagcatgtctattcagct

SEQ ID NO: 2539566 - DNA, 18 bp, Homo sapiens
cagcatgttgctgaggag

SEQ ID NO: 2539567 - DNA, 16 bp, Homo sapiens
cagcattgctggttct

SEQ ID NO: 2539568 - DNA, 12 bp, Homo sapiens
cagcattgcttt

SEQ ID NO: 2539569 - DNA, 15 bp, Homo sapiens
cagcatttctgaagt

SEQ ID NO: 2539570 - DNA, 16 bp, Homo sapiens
cagccaaacccatgag

SEQ ID NO: 2539571 - DNA, 15 bp, Homo sapiens
cagccaaagcctcct

SEQ ID NO: 2539572 - DNA, 14 bp, Homo sapiens
cagccaacccctgt

SEQ ID NO: 2539573 - DNA, 16 bp, Homo sapiens
cagccaacccctgtgg

SEQ ID NO: 2539574 - DNA, 18 bp, Homo sapiens
cagccaacccctgtggag

SEQ ID NO: 2539575 - DNA, 13 bp, Homo sapiens
cagccaactcatt

SEQ ID NO: 2539576 - DNA, 11 bp, Homo sapiens
cagccaagcac

SEQ ID NO: 2539577 - DNA, 14 bp, Homo sapiens
cagccaagcacagt

SEQ ID NO: 2539578 - DNA, 19 bp, Homo sapiens
cagccaagcacagtggtgg

SEQ ID NO: 2539579 - DNA, 21 bp, Homo sapiens
cagccaaggccgaagctctgg

SEQ ID NO: 2539580 - DNA, 23 bp, Homo sapiens
cagccaaggccgaagctctggct

SEQ ID NO: 2539581 - DNA, 11 bp, Homo sapiens
cagccacacac

SEQ ID NO: 2539582 - DNA, 12 bp, Homo sapiens
cagccacacaca

SEQ ID NO: 2539583 - DNA, 14 bp, Homo sapiens
cagccacacacaca

SEQ ID NO: 2539584 - DNA, 17 bp, Homo sapiens
cagccacacacacagaa

SEQ ID NO: 2539585 - DNA, 20 bp, Homo sapiens
cagccacacacacagaaaat

SEQ ID NO: 2539586 - DNA, 21 bp, Homo sapiens
cagccacacacacagaaaata

SEQ ID NO: 2539587 - DNA, 23 bp, Homo sapiens
cagccacacacacagaaaatata

SEQ ID NO: 2539588 - DNA, 23 bp, Homo sapiens
cagccacagtttcctcatctgtc

SEQ ID NO: 2539589 - DNA, 11 bp, Homo sapiens
cagccaccccg

SEQ ID NO: 2539590 - DNA, 20 bp, Homo sapiens
cagccaccccgggctctctg

SEQ ID NO: 2539591 - DNA, 15 bp, Homo sapiens
cagccacctctcttt

SEQ ID NO: 2539592 - DNA, 15 bp, Homo sapiens
cagccacggccaggc

SEQ ID NO: 2539593 - DNA, 18 bp, Homo sapiens
cagccacggccaggccag

SEQ ID NO: 2539594 - DNA, 21 bp, Homo sapiens
cagccacggccaggccagagg

SEQ ID NO: 2539595 - DNA, 23 bp, Homo sapiens
cagccactcgggaggctgagaca

SEQ ID NO: 2539596 - DNA, 23 bp, Homo sapiens
cagcctttgatcaggtggggagt

SEQ ID NO: 2539597 - DNA, 20 bp, Homo sapiens
cagcgaccacccctgcctcc

SEQ ID NO: 2539598 - DNA, 21 bp, Homo sapiens
cagcgaccacccctgcctcca

SEQ ID NO: 2539599 - DNA, 18 bp, Homo sapiens
cagcgaccttcctcatcc

SEQ ID NO: 2539600 - DNA, 13 bp, Homo sapiens
cagcgagccctgg

SEQ ID NO: 2539601 - DNA, 17 bp, Homo sapiens
cagcgaggaggctccag

SEQ ID NO: 2539602 - DNA, 23 bp, Homo sapiens
cagcgatgtatgcagctatctgg

SEQ ID NO: 2539603 - DNA, 17 bp, Homo sapiens
cagcgcccgctgggctg

SEQ ID NO: 2539604 - DNA, 19 bp, Homo sapiens
cagcgcccgctgggctgag

SEQ ID NO: 2539605 - DNA, 15 bp, Homo sapiens
cagcggcccctccca

SEQ ID NO: 2539606 - DNA, 16 bp, Homo sapiens
cagcggcccctcccac

SEQ ID NO: 2539607 - DNA, 17 bp, Homo sapiens
cagcggggacagctcct

SEQ ID NO: 2539608 - DNA, 18 bp, Homo sapiens
cagcgggggccagggaag

SEQ ID NO: 2539609 - DNA, 14 bp, Homo sapiens
cagcggtggcctct

SEQ ID NO: 2539610 - DNA, 14 bp, Homo sapiens
cagcgtcccagtct

SEQ ID NO: 2539611 - DNA, 21 bp, Homo sapiens
cagcgtcccagtctctggcag

SEQ ID NO: 2539612 - DNA, 14 bp, Homo sapiens
cagcgtcctgtcca

SEQ ID NO: 2539613 - DNA, 15 bp, Homo sapiens
cagcgtgctttaaaa

SEQ ID NO: 2539614 - DNA, 19 bp, Homo sapiens
cagcgtgctttaaaaaata

SEQ ID NO: 2539615 - DNA, 14 bp, Homo sapiens
cagcgttgcatgtc

SEQ ID NO: 2539616 - DNA, 16 bp, Homo sapiens
cagcgtttctatgaca

SEQ ID NO: 2539617 - DNA, 20 bp, Homo sapiens
cagcgtttgaggggctggcc

SEQ ID NO: 2539618 - DNA, 22 bp, Homo sapiens
cagcgtttgaggggctggcctt

SEQ ID NO: 2539619 - DNA, 12 bp, Homo sapiens
cagctaaagcaa

SEQ ID NO: 2539620 - DNA, 22 bp, Homo sapiens
cagctaaagcccaacctcctga

SEQ ID NO: 2539621 - DNA, 19 bp, Homo sapiens
cagctaaggacatttccca

SEQ ID NO: 2539622 - DNA, 17 bp, Homo sapiens
cagctaatctgtagggc

SEQ ID NO: 2539623 - DNA, 15 bp, Homo sapiens
cagctaatgggacac

SEQ ID NO: 2539624 - DNA, 21 bp, Homo sapiens
cagctacctcaaccaatgcca

SEQ ID NO: 2539625 - DNA, 15 bp, Homo sapiens
cagctacttcctcct

SEQ ID NO: 2539626 - DNA, 15 bp, Homo sapiens
cagctacttgggagg

SEQ ID NO: 2539627 - DNA, 16 bp, Homo sapiens
cagctacttgggaggc

SEQ ID NO: 2539628 - DNA, 18 bp, Homo sapiens
cagctataacagtaggga

SEQ ID NO: 2539629 - DNA, 13 bp, Homo sapiens
cagctatgggagc

SEQ ID NO: 2539630 - DNA, 20 bp, Homo sapiens
cagctatgggagccccaggg

SEQ ID NO: 2539631 - DNA, 22 bp, Homo sapiens
cagctatgggagccccagggtc

SEQ ID NO: 2539632 - DNA, 13 bp, Homo sapiens
cagctatttttat

SEQ ID NO: 2539633 - DNA, 19 bp, Homo sapiens
cagctcaagtcttccctga

SEQ ID NO: 2539634 - DNA, 22 bp, Homo sapiens
cagctcaagtcttccctgatca

SEQ ID NO: 2539635 - DNA, 17 bp, Homo sapiens
cagctcaccagccccag

SEQ ID NO: 2539636 - DNA, 22 bp, Homo sapiens
cagctcaccagccccagtgccc

SEQ ID NO: 2539637 - DNA, 20 bp, Homo sapiens
cagctcacccagccccaggg

SEQ ID NO: 2539638 - DNA, 12 bp, Homo sapiens
cagctcaccccc

SEQ ID NO: 2539639 - DNA, 18 bp, Homo sapiens
cagctcaccccccacact

SEQ ID NO: 2539640 - DNA, 22 bp, Homo sapiens
cagctcaccccccacactcact

SEQ ID NO: 2539641 - DNA, 14 bp, Homo sapiens
cagctcacccctgg

SEQ ID NO: 2539642 - DNA, 13 bp, Homo sapiens
cagctcacctctc

SEQ ID NO: 2539643 - DNA, 17 bp, Homo sapiens
cagctcacctctccctt

SEQ ID NO: 2539644 - DNA, 20 bp, Homo sapiens
cagctcacctctcccttgga

SEQ ID NO: 2539645 - DNA, 13 bp, Homo sapiens
cagctcagagagg

SEQ ID NO: 2539646 - DNA, 20 bp, Homo sapiens
cagctcagagagggtgggag

SEQ ID NO: 2539647 - DNA, 23 bp, Homo sapiens
cagctcaggcacacttcttcttg

SEQ ID NO: 2539648 - DNA, 15 bp, Homo sapiens
cagctcatctctgtc

SEQ ID NO: 2539649 - DNA, 20 bp, Homo sapiens
cagctccaagacctgttggt

SEQ ID NO: 2539650 - DNA, 19 bp, Homo sapiens
cagctccactctgactggc

SEQ ID NO: 2539651 - DNA, 23 bp, Homo sapiens
cagctccactctgactggcacag

SEQ ID NO: 2539652 - DNA, 13 bp, Homo sapiens
cagctccagctca

SEQ ID NO: 2539653 - DNA, 15 bp, Homo sapiens
cagctccagctcacc

SEQ ID NO: 2539654 - DNA, 16 bp, Homo sapiens
cagctccagctcacca

SEQ ID NO: 2539655 - DNA, 17 bp, Homo sapiens
cagctccagctcaccag

SEQ ID NO: 2539656 - DNA, 22 bp, Homo sapiens
cagctccagctcaccagcccca

SEQ ID NO: 2539657 - DNA, 17 bp, Homo sapiens
cagctccaggtggctct

SEQ ID NO: 2539658 - DNA, 21 bp, Homo sapiens
cagctccaggtggctctgagg

SEQ ID NO: 2539659 - DNA, 17 bp, Homo sapiens
cagctcccatttctact

SEQ ID NO: 2539660 - DNA, 13 bp, Homo sapiens
cagctccccaaga

SEQ ID NO: 2539661 - DNA, 16 bp, Homo sapiens
cagctccctctgcctg

SEQ ID NO: 2539662 - DNA, 15 bp, Homo sapiens
cagctcctgtaacat

SEQ ID NO: 2539663 - DNA, 20 bp, Homo sapiens
cagctctagacactgccaca

SEQ ID NO: 2539664 - DNA, 21 bp, Homo sapiens
cagctctgcaagaattgaagc

SEQ ID NO: 2539665 - DNA, 16 bp, Homo sapiens
cagctctggagggggt

SEQ ID NO: 2539666 - DNA, 12 bp, Homo sapiens
cagctctggctt

SEQ ID NO: 2539667 - DNA, 17 bp, Homo sapiens
cagctctggtccataga

SEQ ID NO: 2539668 - DNA, 18 bp, Homo sapiens
cagctctggtccatagag

SEQ ID NO: 2539669 - DNA, 14 bp, Homo sapiens
cagctcttctccag

SEQ ID NO: 2539670 - DNA, 17 bp, Homo sapiens
cagctcttctccaggct

SEQ ID NO: 2539671 - DNA, 18 bp, Homo sapiens
cagctcttctccaggctg

SEQ ID NO: 2539672 - DNA, 19 bp, Homo sapiens
cagctcttctccaggctgt

SEQ ID NO: 2539673 - DNA, 22 bp, Homo sapiens
cagctcttctgccggccctggg

SEQ ID NO: 2539674 - DNA, 15 bp, Homo sapiens
cagctcttgcccttc

SEQ ID NO: 2539675 - DNA, 23 bp, Homo sapiens
cagctcttgcccttccctgtccc

SEQ ID NO: 2539676 - DNA, 14 bp, Homo sapiens
cagctcttgctaat

SEQ ID NO: 2539677 - DNA, 18 bp, Homo sapiens
cagctcttggctccactg

SEQ ID NO: 2539678 - DNA, 17 bp, Homo sapiens
cagctgaccatggaaga

SEQ ID NO: 2539679 - DNA, 18 bp, Homo sapiens
cagctgacctctgttgtc

SEQ ID NO: 2539680 - DNA, 16 bp, Homo sapiens
cagctgacctttgtca

SEQ ID NO: 2539681 - DNA, 17 bp, Homo sapiens
cagctgagagaaaataa

SEQ ID NO: 2539682 - DNA, 12 bp, Homo sapiens
cagctgatttta

SEQ ID NO: 2539683 - DNA, 15 bp, Homo sapiens
cagctgattttaaca

SEQ ID NO: 2539684 - DNA, 17 bp, Homo sapiens
cagctgattttaacaat

SEQ ID NO: 2539685 - DNA, 18 bp, Homo sapiens
cagctgattttaacaata

SEQ ID NO: 2539686 - DNA, 22 bp, Homo sapiens
cagctgcacctgccagcctggc

SEQ ID NO: 2539687 - DNA, 16 bp, Homo sapiens
cagctgccagagaagc

SEQ ID NO: 2539688 - DNA, 15 bp, Homo sapiens
cagctgccccagcca

SEQ ID NO: 2539689 - DNA, 18 bp, Homo sapiens
cagctgccgaccagagcc

SEQ ID NO: 2539690 - DNA, 19 bp, Homo sapiens
cagctgccgaccagagccc

SEQ ID NO: 2539691 - DNA, 12 bp, Homo sapiens
cagctgcctgca

SEQ ID NO: 2539692 - DNA, 13 bp, Homo sapiens
cagctgcctggga

SEQ ID NO: 2539693 - DNA, 15 bp, Homo sapiens
cagctgcctgggatc

SEQ ID NO: 2539694 - DNA, 18 bp, Homo sapiens
cagctgcctgggatccct

SEQ ID NO: 2539695 - DNA, 22 bp, Homo sapiens
cagctgcggtccacccaggagc

SEQ ID NO: 2539696 - DNA, 24 bp, Homo sapiens
cagctgcggtccacccaggagccc

SEQ ID NO: 2539697 - DNA, 21 bp, Homo sapiens
cagctgctgaaacaacaaata

SEQ ID NO: 2539698 - DNA, 14 bp, Homo sapiens
cagctgctggagac

SEQ ID NO: 2539699 - DNA, 23 bp, Homo sapiens
cagctgcttgtgtccctcctggg

SEQ ID NO: 2539700 - DNA, 22 bp, Homo sapiens
cagctgcttttgtctatgggac

SEQ ID NO: 2539701 - DNA, 18 bp, Homo sapiens
cagctggagaaatatggt

SEQ ID NO: 2539702 - DNA, 23 bp, Homo sapiens
cagctggatgagaatttgagtgc

SEQ ID NO: 2539703 - DNA, 21 bp, Homo sapiens
cagctggatgagacttccaaa

SEQ ID NO: 2539704 - DNA, 19 bp, Homo sapiens
cagctggcccgtgacagac

SEQ ID NO: 2539705 - DNA, 17 bp, Homo sapiens
cagctggccgtcacttg

SEQ ID NO: 2539706 - DNA, 15 bp, Homo sapiens
cagctgggcccaacc

SEQ ID NO: 2539707 - DNA, 21 bp, Homo sapiens
cagctgggcccaaccctgtct

SEQ ID NO: 2539708 - DNA, 12 bp, Homo sapiens
cagctgggctgt

SEQ ID NO: 2539709 - DNA, 16 bp, Homo sapiens
cagctgggtggcactg

SEQ ID NO: 2539710 - DNA, 16 bp, Homo sapiens
cagctgggttggaaaa

SEQ ID NO: 2539711 - DNA, 18 bp, Homo sapiens
cagctggttgaggtttca

SEQ ID NO: 2539712 - DNA, 21 bp, Homo sapiens
cagctgtaagaagagactggg

SEQ ID NO: 2539713 - DNA, 22 bp, Homo sapiens
cagctgtaagaagagactggga

SEQ ID NO: 2539714 - DNA, 17 bp, Homo sapiens
cagctgtacttcgtctt

SEQ ID NO: 2539715 - DNA, 18 bp, Homo sapiens
cagctgtgctctggacag

SEQ ID NO: 2539716 - DNA, 15 bp, Homo sapiens
cagctgttcagctgg

SEQ ID NO: 2539717 - DNA, 16 bp, Homo sapiens
cagctgttcagctggt

SEQ ID NO: 2539718 - DNA, 20 bp, Homo sapiens
cagctgttctgtcccttgga

SEQ ID NO: 2539719 - DNA, 15 bp, Homo sapiens
cagcttaaagtaacc

SEQ ID NO: 2539720 - DNA, 16 bp, Homo sapiens
cagcttattcacaaga

SEQ ID NO: 2539721 - DNA, 14 bp, Homo sapiens
cagcttcaggttat

SEQ ID NO: 2539722 - DNA, 15 bp, Homo sapiens
cagcttcatttcctg

SEQ ID NO: 2539723 - DNA, 19 bp, Homo sapiens
cagcttcatttcctgtgtc

SEQ ID NO: 2539724 - DNA, 20 bp, Homo sapiens
cagcttcatttcctgtgtct

SEQ ID NO: 2539725 - DNA, 13 bp, Homo sapiens
cagcttcatttgt

SEQ ID NO: 2539726 - DNA, 17 bp, Homo sapiens
cagcttcatttgtgtca

SEQ ID NO: 2539727 - DNA, 22 bp, Homo sapiens
cagcttcccctctctcctcctg

SEQ ID NO: 2539728 - DNA, 23 bp, Homo sapiens
cagcttcccctctctcctcctgc

SEQ ID NO: 2539729 - DNA, 19 bp, Homo sapiens
cagcttcctacccacacct

SEQ ID NO: 2539730 - DNA, 21 bp, Homo sapiens
cagcttctcatcctgcaggca

SEQ ID NO: 2539731 - DNA, 15 bp, Homo sapiens
cagcttctccaggct

SEQ ID NO: 2539732 - DNA, 19 bp, Homo sapiens
cagcttctggtactctcct

SEQ ID NO: 2539733 - DNA, 19 bp, Homo sapiens
cagcttgagggttgggctg

SEQ ID NO: 2539734 - DNA, 20 bp, Homo sapiens
cagcttgagggttgggctgg

SEQ ID NO: 2539735 - DNA, 20 bp, Homo sapiens
cagcttgggcccagctgggc

SEQ ID NO: 2539736 - DNA, 18 bp, Homo sapiens
cagcttgtaaatagctca

SEQ ID NO: 2539737 - DNA, 21 bp, Homo sapiens
cagcttgtaaatagctcaggt

SEQ ID NO: 2539738 - DNA, 15 bp, Homo sapiens
cagcttgtgcacaat

SEQ ID NO: 2539739 - DNA, 18 bp, Homo sapiens
cagcttgtggagccccac

SEQ ID NO: 2539740 - DNA, 12 bp, Homo sapiens
caggcagcgatg

SEQ ID NO: 2539741 - DNA, 20 bp, Homo sapiens
caggcagctttaaccattaa

SEQ ID NO: 2539742 - DNA, 19 bp, Homo sapiens
caggcaggaagggcaggaa

SEQ ID NO: 2539743 - DNA, 20 bp, Homo sapiens
caggcaggctaaggcgtgga

SEQ ID NO: 2539744 - DNA, 17 bp, Homo sapiens
caggcagggctgactct

SEQ ID NO: 2539745 - DNA, 14 bp, Homo sapiens
caggcaggtccagg

SEQ ID NO: 2539746 - DNA, 19 bp, Homo sapiens
caggcaggtccagggtttg

SEQ ID NO: 2539747 - DNA, 22 bp, Homo sapiens
caggcaggtcttgaactcctgg

SEQ ID NO: 2539748 - DNA, 23 bp, Homo sapiens
caggcaggtcttgaactcctggc

SEQ ID NO: 2539749 - DNA, 14 bp, Homo sapiens
caggcaggtgcctg

SEQ ID NO: 2539750 - DNA, 15 bp, Homo sapiens
caggcataggcctgg

SEQ ID NO: 2539751 - DNA, 18 bp, Homo sapiens
caggcataggcctgggtg

SEQ ID NO: 2539752 - DNA, 19 bp, Homo sapiens
caggcataggcctgggtgc

SEQ ID NO: 2539753 - DNA, 14 bp, Homo sapiens
caggcatcacagct

SEQ ID NO: 2539754 - DNA, 12 bp, Homo sapiens
caggcatgaagt

SEQ ID NO: 2539755 - DNA, 15 bp, Homo sapiens
caggcatgcctgtgt

SEQ ID NO: 2539756 - DNA, 18 bp, Homo sapiens
caggcatgttctctgagg

SEQ ID NO: 2539757 - DNA, 17 bp, Homo sapiens
caggcattccccaggag

SEQ ID NO: 2539758 - DNA, 20 bp, Homo sapiens
caggcattccccaggaggcc

SEQ ID NO: 2539759 - DNA, 23 bp, Homo sapiens
caggcattccccaggaggccagc

SEQ ID NO: 2539760 - DNA, 19 bp, Homo sapiens
caggcattgccaagggctt

SEQ ID NO: 2539761 - DNA, 21 bp, Homo sapiens
caggcatttgactgaagatgc

SEQ ID NO: 2539762 - DNA, 18 bp, Homo sapiens
caggccaagagcagaggc

SEQ ID NO: 2539763 - DNA, 18 bp, Homo sapiens
caggccacaagacccttg

SEQ ID NO: 2539764 - DNA, 23 bp, Homo sapiens
caggccacatggggctgggcagc

SEQ ID NO: 2539765 - DNA, 15 bp, Homo sapiens
caggccaccaggatg

SEQ ID NO: 2539766 - DNA, 23 bp, Homo sapiens
caggccaccatattcagtgctgt

SEQ ID NO: 2539767 - DNA, 18 bp, Homo sapiens
caggccacctccagaaac

SEQ ID NO: 2539768 - DNA, 15 bp, Homo sapiens
caggccacctgcccc

SEQ ID NO: 2539769 - DNA, 19 bp, Homo sapiens
caggccacctgcccccttc

SEQ ID NO: 2539770 - DNA, 22 bp, Homo sapiens
caggccacctgcccccttctcc

SEQ ID NO: 2539771 - DNA, 18 bp, Homo sapiens
caggccaggccaccagga

SEQ ID NO: 2539772 - DNA, 12 bp, Homo sapiens
caggccaggccc

SEQ ID NO: 2539773 - DNA, 13 bp, Homo sapiens
caggccaggccct

SEQ ID NO: 2539774 - DNA, 15 bp, Homo sapiens
caggccaggccctct

SEQ ID NO: 2539775 - DNA, 18 bp, Homo sapiens
caggccaggctccttcct

SEQ ID NO: 2539776 - DNA, 21 bp, Homo sapiens
caggccagtaagggaaataga

SEQ ID NO: 2539777 - DNA, 23 bp, Homo sapiens
caggccagtaagggaaatagaaa

SEQ ID NO: 2539778 - DNA, 18 bp, Homo sapiens
caggccatggaggcagaa

SEQ ID NO: 2539779 - DNA, 20 bp, Homo sapiens
caggcccagcattgctggtt

SEQ ID NO: 2539780 - DNA, 22 bp, Homo sapiens
caggccccaaaaccacagccct

SEQ ID NO: 2539781 - DNA, 23 bp, Homo sapiens
caggccccaaaaccacagccctg

SEQ ID NO: 2539782 - DNA, 17 bp, Homo sapiens
caggccccaggaagccg

SEQ ID NO: 2539783 - DNA, 17 bp, Homo sapiens
caggccccgaggaccca

SEQ ID NO: 2539784 - DNA, 22 bp, Homo sapiens
caggccccttttcactccctcc

SEQ ID NO: 2539785 - DNA, 14 bp, Homo sapiens
caggcccggctcca

SEQ ID NO: 2539786 - DNA, 15 bp, Homo sapiens
caggcccggctccag

SEQ ID NO: 2539787 - DNA, 16 bp, Homo sapiens
caggcccggctccagg

SEQ ID NO: 2539788 - DNA, 22 bp, Homo sapiens
caggcccggctccaggctcctt

SEQ ID NO: 2539789 - DNA, 15 bp, Homo sapiens
caggccctctgccca

SEQ ID NO: 2539790 - DNA, 18 bp, Homo sapiens
caggccgcagctcttgcc

SEQ ID NO: 2539791 - DNA, 22 bp, Homo sapiens
caggccgcagctcttgcccttc

SEQ ID NO: 2539792 - DNA, 22 bp, Homo sapiens
caggccgtcctcccgggccctc

SEQ ID NO: 2539793 - DNA, 16 bp, Homo sapiens
caggcctccctctctc

SEQ ID NO: 2539794 - DNA, 12 bp, Homo sapiens
caggcctcttgg

SEQ ID NO: 2539795 - DNA, 18 bp, Homo sapiens
caggcctcttggcagtca

SEQ ID NO: 2539796 - DNA, 15 bp, Homo sapiens
caggcctgactctca

SEQ ID NO: 2539797 - DNA, 12 bp, Homo sapiens
caggcctgggcc

SEQ ID NO: 2539798 - DNA, 22 bp, Homo sapiens
caggccttatctccaagaccag

SEQ ID NO: 2539799 - DNA, 17 bp, Homo sapiens
caggcgccggcgggcgg

SEQ ID NO: 2539800 - DNA, 16 bp, Homo sapiens
caggcgggctcaagga

SEQ ID NO: 2539801 - DNA, 21 bp, Homo sapiens
caggcggtgggcacccaccct

SEQ ID NO: 2539802 - DNA, 13 bp, Homo sapiens
caggcgttcagct

SEQ ID NO: 2539803 - DNA, 22 bp, Homo sapiens
caggcgttcagctcactgttct

SEQ ID NO: 2539804 - DNA, 14 bp, Homo sapiens
caggctcctttagc

SEQ ID NO: 2539805 - DNA, 14 bp, Homo sapiens
caggctctgccctg

SEQ ID NO: 2539806 - DNA, 14 bp, Homo sapiens
caggctctgtgctg

SEQ ID NO: 2539807 - DNA, 15 bp, Homo sapiens
caggctctgtgctga

SEQ ID NO: 2539808 - DNA, 21 bp, Homo sapiens
caggctctgtgctgaccctcc

SEQ ID NO: 2539809 - DNA, 11 bp, Homo sapiens
caggctgaggt

SEQ ID NO: 2539810 - DNA, 17 bp, Homo sapiens
caggctgctcagggctg

SEQ ID NO: 2539811 - DNA, 12 bp, Homo sapiens
caggctgctggc

SEQ ID NO: 2539812 - DNA, 16 bp, Homo sapiens
caggctgctggcgcct

SEQ ID NO: 2539813 - DNA, 12 bp, Homo sapiens
caggctgcttgg

SEQ ID NO: 2539814 - DNA, 15 bp, Homo sapiens
caggctgcttgggat

SEQ ID NO: 2539815 - DNA, 20 bp, Homo sapiens
caggctggaggtaaggcctt

SEQ ID NO: 2539816 - DNA, 13 bp, Homo sapiens
caggctggcagct

SEQ ID NO: 2539817 - DNA, 17 bp, Homo sapiens
caggctggcgcagccaa

SEQ ID NO: 2539818 - DNA, 15 bp, Homo sapiens
caggctggcgtgcag

SEQ ID NO: 2539819 - DNA, 19 bp, Homo sapiens
caggctggcgtgcagtggt

SEQ ID NO: 2539820 - DNA, 16 bp, Homo sapiens
caggctgggagagcct

SEQ ID NO: 2539821 - DNA, 19 bp, Homo sapiens
caggctgggagagccttcc

SEQ ID NO: 2539822 - DNA, 16 bp, Homo sapiens
caggctgggcttcagt

SEQ ID NO: 2539823 - DNA, 19 bp, Homo sapiens
caggctgggcttcagtggc

SEQ ID NO: 2539824 - DNA, 20 bp, Homo sapiens
caggctgggcttcagtggca

SEQ ID NO: 2539825 - DNA, 12 bp, Homo sapiens
caggctggtctc

SEQ ID NO: 2539826 - DNA, 20 bp, Homo sapiens
caggctggtctcgaactcct

SEQ ID NO: 2539827 - DNA, 21 bp, Homo sapiens
caggctgtatcccatgagcct

SEQ ID NO: 2539828 - DNA, 22 bp, Homo sapiens
caggctgtatcccatgagcctc

SEQ ID NO: 2539829 - DNA, 16 bp, Homo sapiens
caggctgtgggcctca

SEQ ID NO: 2539830 - DNA, 17 bp, Homo sapiens
caggcttagtcactgag

SEQ ID NO: 2539831 - DNA, 15 bp, Homo sapiens
caggcttcaccctga

SEQ ID NO: 2539832 - DNA, 15 bp, Homo sapiens
caggcttgcctgcag

SEQ ID NO: 2539833 - DNA, 18 bp, Homo sapiens
caggcttgcctgcaggca

SEQ ID NO: 2539834 - DNA, 15 bp, Homo sapiens
cagggaaaagcagct

SEQ ID NO: 2539835 - DNA, 14 bp, Homo sapiens
cagggaaaggctct

SEQ ID NO: 2539836 - DNA, 19 bp, Homo sapiens
cagggaaccctgcttgcac

SEQ ID NO: 2539837 - DNA, 22 bp, Homo sapiens
cagggaaccgttattataattg

SEQ ID NO: 2539838 - DNA, 16 bp, Homo sapiens
cagggaagagaaagtg

SEQ ID NO: 2539839 - DNA, 14 bp, Homo sapiens
cagggaagctacag

SEQ ID NO: 2539840 - DNA, 19 bp, Homo sapiens
cagggaagctacaggttac

SEQ ID NO: 2539841 - DNA, 24 bp, Homo sapiens
cagggaagctacaggttacaacag

SEQ ID NO: 2539842 - DNA, 14 bp, Homo sapiens
cagggaagctggcc

SEQ ID NO: 2539843 - DNA, 17 bp, Homo sapiens
cagggaagctggccgag

SEQ ID NO: 2539844 - DNA, 16 bp, Homo sapiens
cagggaagtccccagg

SEQ ID NO: 2539845 - DNA, 17 bp, Homo sapiens
cagggaagtgctctgat

SEQ ID NO: 2539846 - DNA, 21 bp, Homo sapiens
cagggaagtgtaagaaacaca

SEQ ID NO: 2539847 - DNA, 23 bp, Homo sapiens
cagggaatttcaggaactagaga

SEQ ID NO: 2539848 - DNA, 15 bp, Homo sapiens
cagggacaccagcca

SEQ ID NO: 2539849 - DNA, 19 bp, Homo sapiens
cagggacaccagccaggct

SEQ ID NO: 2539850 - DNA, 23 bp, Homo sapiens
cagggacaccagccaggctctgt

SEQ ID NO: 2539851 - DNA, 13 bp, Homo sapiens
cagggacagaggg

SEQ ID NO: 2539852 - DNA, 23 bp, Homo sapiens
cagggacagagggggtggcctcc

SEQ ID NO: 2539853 - DNA, 14 bp, Homo sapiens
cagggaccaaggac

SEQ ID NO: 2539854 - DNA, 15 bp, Homo sapiens
cagggaccaaggacc

SEQ ID NO: 2539855 - DNA, 21 bp, Homo sapiens
cagggactatgaatgggcaaa

SEQ ID NO: 2539856 - DNA, 20 bp, Homo sapiens
cagggactgaaaacctctcc

SEQ ID NO: 2539857 - DNA, 21 bp, Homo sapiens
cagggactgaaaacctctcct

SEQ ID NO: 2539858 - DNA, 18 bp, Homo sapiens
cagggactgttcctgtct

SEQ ID NO: 2539859 - DNA, 23 bp, Homo sapiens
cagggactgttcctgtctcagca

SEQ ID NO: 2539860 - DNA, 19 bp, Homo sapiens
cagggagaccgagcgcttt

SEQ ID NO: 2539861 - DNA, 22 bp, Homo sapiens
cagggagaccgagcgctttctg

SEQ ID NO: 2539862 - DNA, 23 bp, Homo sapiens
cagggagaggagtgactgagctt

SEQ ID NO: 2539863 - DNA, 17 bp, Homo sapiens
cagggagaggccatgat

SEQ ID NO: 2539864 - DNA, 18 bp, Homo sapiens
cagggagcggaaagcagc

SEQ ID NO: 2539865 - DNA, 18 bp, Homo sapiens
cagggaggaggtggcagc

SEQ ID NO: 2539866 - DNA, 19 bp, Homo sapiens
cagggaggaggtggcagcc

SEQ ID NO: 2539867 - DNA, 21 bp, Homo sapiens
cagggaggaggtggcagccct

SEQ ID NO: 2539868 - DNA, 13 bp, Homo sapiens
cagggaggggact

SEQ ID NO: 2539869 - DNA, 16 bp, Homo sapiens
cagggaggtccgggag

SEQ ID NO: 2539870 - DNA, 17 bp, Homo sapiens
cagggaggtggctgggt

SEQ ID NO: 2539871 - DNA, 21 bp, Homo sapiens
cagggatgagcatggagctgg

SEQ ID NO: 2539872 - DNA, 22 bp, Homo sapiens
cagggatgagcatggagctggc

SEQ ID NO: 2539873 - DNA, 15 bp, Homo sapiens
cagggcacaccgggc

SEQ ID NO: 2539874 - DNA, 23 bp, Homo sapiens
cagggcacaccgggcactcagaa

SEQ ID NO: 2539875 - DNA, 17 bp, Homo sapiens
cagggcacttcacagag

SEQ ID NO: 2539876 - DNA, 13 bp, Homo sapiens
cagggcagagtga

SEQ ID NO: 2539877 - DNA, 16 bp, Homo sapiens
cagggcagctgggccc

SEQ ID NO: 2539878 - DNA, 20 bp, Homo sapiens
cagggcagctgggcccaacc

SEQ ID NO: 2539879 - DNA, 13 bp, Homo sapiens
cagggcagggcca

SEQ ID NO: 2539880 - DNA, 13 bp, Homo sapiens
cagggcagggccc

SEQ ID NO: 2539881 - DNA, 17 bp, Homo sapiens
cagggcagggctctgat

SEQ ID NO: 2539882 - DNA, 19 bp, Homo sapiens
cagggcagggctctgatat

SEQ ID NO: 2539883 - DNA, 16 bp, Homo sapiens
cagggcatctccagga

SEQ ID NO: 2539884 - DNA, 21 bp, Homo sapiens
cagtgtgaagttagaattcct

SEQ ID NO: 2539885 - DNA, 17 bp, Homo sapiens
cagtgtgaggccagggc

SEQ ID NO: 2539886 - DNA, 19 bp, Homo sapiens
cagtgtgatcccaagtgcc

SEQ ID NO: 2539887 - DNA, 15 bp, Homo sapiens
cagtgttaaatgaaa

SEQ ID NO: 2539888 - DNA, 20 bp, Homo sapiens
cagtgttgtggatttaacag

SEQ ID NO: 2539889 - DNA, 18 bp, Homo sapiens
cagtgtttcccataattt

SEQ ID NO: 2539890 - DNA, 20 bp, Homo sapiens
cagtgtttcccataattttc

SEQ ID NO: 2539891 - DNA, 15 bp, Homo sapiens
cagtgttttctggga

SEQ ID NO: 2539892 - DNA, 22 bp, Homo sapiens
cagtgttttctgggataagtaa

SEQ ID NO: 2539893 - DNA, 19 bp, Homo sapiens
cagttaactttaagactga

SEQ ID NO: 2539894 - DNA, 22 bp, Homo sapiens
cagttaactttcagaagagatg

SEQ ID NO: 2539895 - DNA, 13 bp, Homo sapiens
cagttacagaaag

SEQ ID NO: 2539896 - DNA, 14 bp, Homo sapiens
cagttacagaaagt

SEQ ID NO: 2539897 - DNA, 15 bp, Homo sapiens
cagttacagaaagtg

SEQ ID NO: 2539898 - DNA, 13 bp, Homo sapiens
cagttatggctat

SEQ ID NO: 2539899 - DNA, 20 bp, Homo sapiens
cagttatggctataggtgct

SEQ ID NO: 2539900 - DNA, 14 bp, Homo sapiens
cagttcaagaaagc

SEQ ID NO: 2539901 - DNA, 22 bp, Homo sapiens
cagttcaatctcccgctgctgc

SEQ ID NO: 2539902 - DNA, 17 bp, Homo sapiens
cagttcaggagtcccaa

SEQ ID NO: 2539903 - DNA, 20 bp, Homo sapiens
cagttcagtacctggaggag

SEQ ID NO: 2539904 - DNA, 22 bp, Homo sapiens
cagttcagtacctggaggagga

SEQ ID NO: 2539905 - DNA, 22 bp, Homo sapiens
cagttcagtggcagggctcagg

SEQ ID NO: 2539906 - DNA, 23 bp, Homo sapiens
cagttcagtggcagggctcagga

SEQ ID NO: 2539907 - DNA, 18 bp, Homo sapiens
cagttcatgtttgcttca

SEQ ID NO: 2539908 - DNA, 18 bp, Homo sapiens
cagttcccccaacctcag

SEQ ID NO: 2539909 - DNA, 14 bp, Homo sapiens
cagttcccttggcc

SEQ ID NO: 2539910 - DNA, 18 bp, Homo sapiens
cagttccgatttcccagg

SEQ ID NO: 2539911 - DNA, 20 bp, Homo sapiens
cagttccggattggcttgtg

SEQ ID NO: 2539912 - DNA, 22 bp, Homo sapiens
cagttccggattggcttgtgtg

SEQ ID NO: 2539913 - DNA, 18 bp, Homo sapiens
cagttctagtttgcattc

SEQ ID NO: 2539914 - DNA, 21 bp, Homo sapiens
cagttctgaatatgctgctca

SEQ ID NO: 2539915 - DNA, 22 bp, Homo sapiens
cagttctgctcctctccaggca

SEQ ID NO: 2539916 - DNA, 20 bp, Homo sapiens
cagttctgggtgctccctac

SEQ ID NO: 2539917 - DNA, 22 bp, Homo sapiens
cagttcttcgggaagagaggag

SEQ ID NO: 2539918 - DNA, 23 bp, Homo sapiens
cagttcttcgggaagagaggagt

SEQ ID NO: 2539919 - DNA, 14 bp, Homo sapiens
cagttgaaaagact

SEQ ID NO: 2539920 - DNA, 21 bp, Homo sapiens
cagttgaaaagactccaaaga

SEQ ID NO: 2539921 - DNA, 14 bp, Homo sapiens
cagttgacagcagg

SEQ ID NO: 2539922 - DNA, 17 bp, Homo sapiens
cagttgcaataatactt

SEQ ID NO: 2539923 - DNA, 23 bp, Homo sapiens
cagttgccagtcaccccggccac

SEQ ID NO: 2539924 - DNA, 16 bp, Homo sapiens
cagttggccttcagaa

SEQ ID NO: 2539925 - DNA, 14 bp, Homo sapiens
cagttgggagcact

SEQ ID NO: 2539926 - DNA, 15 bp, Homo sapiens
cagttgggagcactg

SEQ ID NO: 2539927 - DNA, 18 bp, Homo sapiens
cagttggtcccccttcca

SEQ ID NO: 2539928 - DNA, 20 bp, Homo sapiens
cagttggtcccccttccatg

SEQ ID NO: 2539929 - DNA, 22 bp, Homo sapiens
cagttggtcccccttccatgga

SEQ ID NO: 2539930 - DNA, 20 bp, Homo sapiens
cagtttaacctgatgcagtc

SEQ ID NO: 2539931 - DNA, 16 bp, Homo sapiens
cagtttatcattcaag

SEQ ID NO: 2539932 - DNA, 18 bp, Homo sapiens
cagtttcaattcagtgct

SEQ ID NO: 2539933 - DNA, 23 bp, Homo sapiens
cagtttcactttcacatagatgt

SEQ ID NO: 2539934 - DNA, 22 bp, Homo sapiens
cagtttcaggtgtttagttgca

SEQ ID NO: 2539935 - DNA, 14 bp, Homo sapiens
cagtttctgcctct

SEQ ID NO: 2539936 - DNA, 19 bp, Homo sapiens
cagtttctgtcctgctggt

SEQ ID NO: 2539937 - DNA, 15 bp, Homo sapiens
cagtttcttagcttt

SEQ ID NO: 2539938 - DNA, 12 bp, Homo sapiens
cagtttgctgta

SEQ ID NO: 2539939 - DNA, 13 bp, Homo sapiens
cagtttgtcagac

SEQ ID NO: 2539940 - DNA, 18 bp, Homo sapiens
cagttttatccacagaaa

SEQ ID NO: 2539941 - DNA, 14 bp, Homo sapiens
cagttttctgagaa

SEQ ID NO: 2539942 - DNA, 20 bp, Homo sapiens
cagttttctggctggagcct

SEQ ID NO: 2539943 - DNA, 18 bp, Homo sapiens
cagttttggttgctttaa

SEQ ID NO: 2539944 - DNA, 19 bp, Homo sapiens
cagttttggttgctttaat

SEQ ID NO: 2539945 - DNA, 22 bp, Homo sapiens
cagtttttcagagtggaatgct

SEQ ID NO: 2539946 - DNA, 21 bp, Homo sapiens
cataaaaattagccaagtgtg

SEQ ID NO: 2539947 - DNA, 21 bp, Homo sapiens
cataaacaagaccacgtttct

SEQ ID NO: 2539948 - DNA, 22 bp, Homo sapiens
cataaacaagaccacgtttcta

SEQ ID NO: 2539949 - DNA, 21 bp, Homo sapiens
cataaacccagttgccatctg

SEQ ID NO: 2539950 - DNA, 14 bp, Homo sapiens
cataaaccttaagt

SEQ ID NO: 2539951 - DNA, 23 bp, Homo sapiens
cataaaggtggtatgtgtgtgta

SEQ ID NO: 2539952 - DNA, 15 bp, Homo sapiens
cataaagtcagtgcc

SEQ ID NO: 2539953 - DNA, 13 bp, Homo sapiens
cataaatatgcag

SEQ ID NO: 2539954 - DNA, 14 bp, Homo sapiens
cataaatgaagcag

SEQ ID NO: 2539955 - DNA, 14 bp, Homo sapiens
cataaatgaggaaa

SEQ ID NO: 2539956 - DNA, 16 bp, Homo sapiens
cataacaattcctcta

SEQ ID NO: 2539957 - DNA, 18 bp, Homo sapiens
cataacgtttttccttta

SEQ ID NO: 2539958 - DNA, 14 bp, Homo sapiens
cataactgaaaatg

SEQ ID NO: 2539959 - DNA, 21 bp, Homo sapiens
cataagaatgaataataatta

SEQ ID NO: 2539960 - DNA, 21 bp, Homo sapiens
cataagaccataacagccaac

SEQ ID NO: 2539961 - DNA, 18 bp, Homo sapiens
cataagactttgggatag

SEQ ID NO: 2539962 - DNA, 21 bp, Homo sapiens
cataagcctccatttagttct

SEQ ID NO: 2539963 - DNA, 23 bp, Homo sapiens
cataagcctccatttagttcttt

SEQ ID NO: 2539964 - DNA, 21 bp, Homo sapiens
cataaggtttcgtttctgtat

SEQ ID NO: 2539965 - DNA, 17 bp, Homo sapiens
cataataagctaaagag

SEQ ID NO: 2539966 - DNA, 22 bp, Homo sapiens
cataatagacttcccactctag

SEQ ID NO: 2539967 - DNA, 20 bp, Homo sapiens
cataatctaccaacgaaaga

SEQ ID NO: 2539968 - DNA, 19 bp, Homo sapiens
cataatctggactcctctg

SEQ ID NO: 2539969 - DNA, 15 bp, Homo sapiens
cataatcttctgcct

SEQ ID NO: 2539970 - DNA, 22 bp, Homo sapiens
cataatcttctgccttctcatg

SEQ ID NO: 2539971 - DNA, 17 bp, Homo sapiens
cataatgcgtgcatacc

SEQ ID NO: 2539972 - DNA, 14 bp, Homo sapiens
cataatgctactgt

SEQ ID NO: 2539973 - DNA, 11 bp, Homo sapiens
cataatgtgaa

SEQ ID NO: 2539974 - DNA, 16 bp, Homo sapiens
cataatgtgaagtgtt

SEQ ID NO: 2539975 - DNA, 17 bp, Homo sapiens
cataatgttacattatt

SEQ ID NO: 2539976 - DNA, 18 bp, Homo sapiens
cataatgttacattatta

SEQ ID NO: 2539977 - DNA, 14 bp, Homo sapiens
cataattatgacag

SEQ ID NO: 2539978 - DNA, 18 bp, Homo sapiens
cataattcttgtatatta

SEQ ID NO: 2539979 - DNA, 21 bp, Homo sapiens
cataatttgtacatatgtaaa

SEQ ID NO: 2539980 - DNA, 14 bp, Homo sapiens
catacacacacaca

SEQ ID NO: 2539981 - DNA, 16 bp, Homo sapiens
catacacacacacaca

SEQ ID NO: 2539982 - DNA, 19 bp, Homo sapiens
catacacacacacacacag

SEQ ID NO: 2539983 - DNA, 20 bp, Homo sapiens
catacacacacacacacagc

SEQ ID NO: 2539984 - DNA, 21 bp, Homo sapiens
catacacacacacacacagcc

SEQ ID NO: 2539985 - DNA, 23 bp, Homo sapiens
catacacttattggaactctgct

SEQ ID NO: 2539986 - DNA, 15 bp, Homo sapiens
catacacttccttct

SEQ ID NO: 2539987 - DNA, 21 bp, Homo sapiens
catacaggatttgaactcaga

SEQ ID NO: 2539988 - DNA, 22 bp, Homo sapiens
catacatttataatgtttgcta

SEQ ID NO: 2539989 - DNA, 24 bp, Homo sapiens
catacatttataatgtttgctatt

SEQ ID NO: 2539990 - DNA, 19 bp, Homo sapiens
cataccacttttgttcttg

SEQ ID NO: 2539991 - DNA, 21 bp, Homo sapiens
catacccacccccacccaagg

SEQ ID NO: 2539992 - DNA, 15 bp, Homo sapiens
catacctggccctgt

SEQ ID NO: 2539993 - DNA, 13 bp, Homo sapiens
catacgtccacca

SEQ ID NO: 2539994 - DNA, 15 bp, Homo sapiens
catactcccatctgt

SEQ ID NO: 2539995 - DNA, 18 bp, Homo sapiens
catactcccatctgtgaa

SEQ ID NO: 2539996 - DNA, 20 bp, Homo sapiens
catactccttccatcaaata

SEQ ID NO: 2539997 - DNA, 19 bp, Homo sapiens
catactgagggaccaactg

SEQ ID NO: 2539998 - DNA, 13 bp, Homo sapiens
catactggcctgg

SEQ ID NO: 2539999 - DNA, 22 bp, Homo sapiens
catactggcctggactgttttc

SEQ ID NO: 2540000 - DNA, 19 bp, Homo sapiens
catactgtgctggagccac

SEQ ID NO: 2540001 - DNA, 16 bp, Homo sapiens
catacttatctctctg

SEQ ID NO: 2540002 - DNA, 18 bp, Homo sapiens
catacttcaaaagtattt

SEQ ID NO: 2540003 - DNA, 22 bp, Homo sapiens
catacttcaaaagtattttcct

SEQ ID NO: 2540004 - DNA, 14 bp, Homo sapiens
catactttcatcct

SEQ ID NO: 2540005 - DNA, 17 bp, Homo sapiens
catactttcatcctgac

SEQ ID NO: 2540006 - DNA, 21 bp, Homo sapiens
catactttcatcctgactctg

SEQ ID NO: 2540007 - DNA, 13 bp, Homo sapiens
catactttgtctg

SEQ ID NO: 2540008 - DNA, 14 bp, Homo sapiens
catactttgtctga

SEQ ID NO: 2540009 - DNA, 20 bp, Homo sapiens
catactttttaaatgtaaag

SEQ ID NO: 2540010 - DNA, 22 bp, Homo sapiens
catactttttaaatgtaaagat

SEQ ID NO: 2540011 - DNA, 23 bp, Homo sapiens
catagaaatgtaacttttgtaag

SEQ ID NO: 2540012 - DNA, 23 bp, Homo sapiens
catagagagcaagacgctgtgct

SEQ ID NO: 2540013 - DNA, 18 bp, Homo sapiens
catagattgagaagtttt

SEQ ID NO: 2540014 - DNA, 16 bp, Homo sapiens
catagcagattttaat

SEQ ID NO: 2540015 - DNA, 19 bp, Homo sapiens
catagcagcttattcacaa

SEQ ID NO: 2540016 - DNA, 21 bp, Homo sapiens
catagcatagctagagattgg

SEQ ID NO: 2540017 - DNA, 18 bp, Homo sapiens
catagcccagacacagaa

SEQ ID NO: 2540018 - DNA, 13 bp, Homo sapiens
catagcctatatt

SEQ ID NO: 2540019 - DNA, 16 bp, Homo sapiens
catagctatcaagtgt

SEQ ID NO: 2540020 - DNA, 17 bp, Homo sapiens
catagctccttctctct

SEQ ID NO: 2540021 - DNA, 14 bp, Homo sapiens
catagctgtctaga

SEQ ID NO: 2540022 - DNA, 15 bp, Homo sapiens
catagctgtctagag

SEQ ID NO: 2540023 - DNA, 22 bp, Homo sapiens
catagcttacaagccagctgga

SEQ ID NO: 2540024 - DNA, 20 bp, Homo sapiens
catagcttgataaagggcca

SEQ ID NO: 2540025 - DNA, 14 bp, Homo sapiens
cataggcctgggtg

SEQ ID NO: 2540026 - DNA, 18 bp, Homo sapiens
catccttcctcacaccag

SEQ ID NO: 2540027 - DNA, 17 bp, Homo sapiens
catccttttctgcagag

SEQ ID NO: 2540028 - DNA, 19 bp, Homo sapiens
catccttttctgcagaggg

SEQ ID NO: 2540029 - DNA, 21 bp, Homo sapiens
catcggtgaaactaacagata

SEQ ID NO: 2540030 - DNA, 22 bp, Homo sapiens
catcggtgaaactaacagataa

SEQ ID NO: 2540031 - DNA, 20 bp, Homo sapiens
catcgtgaaaccctgtctct

SEQ ID NO: 2540032 - DNA, 22 bp, Homo sapiens
catcgttttcttcactgtcctc

SEQ ID NO: 2540033 - DNA, 15 bp, Homo sapiens
catctaaatacctgc

SEQ ID NO: 2540034 - DNA, 15 bp, Homo sapiens
catctaacctcatct

SEQ ID NO: 2540035 - DNA, 18 bp, Homo sapiens
catctaacctcatcttct

SEQ ID NO: 2540036 - DNA, 19 bp, Homo sapiens
catctagagcttgatgcca

SEQ ID NO: 2540037 - DNA, 19 bp, Homo sapiens
catctatgtcccttgctgt

SEQ ID NO: 2540038 - DNA, 16 bp, Homo sapiens
catctcaaccatcccc

SEQ ID NO: 2540039 - DNA, 22 bp, Homo sapiens
catctcaaggaataatgggctt

SEQ ID NO: 2540040 - DNA, 17 bp, Homo sapiens
catctcacacatgagca

SEQ ID NO: 2540041 - DNA, 21 bp, Homo sapiens
catctcaggccacctgccccc

SEQ ID NO: 2540042 - DNA, 15 bp, Homo sapiens
catctcaggggccag

SEQ ID NO: 2540043 - DNA, 20 bp, Homo sapiens
catctcatgtatcatctgga

SEQ ID NO: 2540044 - DNA, 20 bp, Homo sapiens
catctccacctgctcccagg

SEQ ID NO: 2540045 - DNA, 14 bp, Homo sapiens
catctccactccag

SEQ ID NO: 2540046 - DNA, 14 bp, Homo sapiens
catctccagggagt

SEQ ID NO: 2540047 - DNA, 17 bp, Homo sapiens
catctccagggagtccc

SEQ ID NO: 2540048 - DNA, 17 bp, Homo sapiens
catctccatcttgaagg

SEQ ID NO: 2540049 - DNA, 20 bp, Homo sapiens
catctcctccatactcagga

SEQ ID NO: 2540050 - DNA, 19 bp, Homo sapiens
catctcctgccttcctcct

SEQ ID NO: 2540051 - DNA, 15 bp, Homo sapiens
catctcctgtgcatg

SEQ ID NO: 2540052 - DNA, 15 bp, Homo sapiens
catctctcagaaggg

SEQ ID NO: 2540053 - DNA, 15 bp, Homo sapiens
catctctccctcccc

SEQ ID NO: 2540054 - DNA, 21 bp, Homo sapiens
catctctctactcctacctca

SEQ ID NO: 2540055 - DNA, 22 bp, Homo sapiens
catctctgcaatcttctcagaa

SEQ ID NO: 2540056 - DNA, 13 bp, Homo sapiens
catctctgcttgg

SEQ ID NO: 2540057 - DNA, 14 bp, Homo sapiens
catctctggatgcc

SEQ ID NO: 2540058 - DNA, 15 bp, Homo sapiens
catctcttgaggcca

SEQ ID NO: 2540059 - DNA, 20 bp, Homo sapiens
catctcttgaggccaggagt

SEQ ID NO: 2540060 - DNA, 15 bp, Homo sapiens
catctctttgaattt

SEQ ID NO: 2540061 - DNA, 19 bp, Homo sapiens
catctctttgaattttctg

SEQ ID NO: 2540062 - DNA, 15 bp, Homo sapiens
catctgaccacgtgc

SEQ ID NO: 2540063 - DNA, 12 bp, Homo sapiens
catctgactcac

SEQ ID NO: 2540064 - DNA, 15 bp, Homo sapiens
catctgcccaggggt

SEQ ID NO: 2540065 - DNA, 23 bp, Homo sapiens
catctgcccaggggtgccccctc

SEQ ID NO: 2540066 - DNA, 17 bp, Homo sapiens
catctgcccctccccca

SEQ ID NO: 2540067 - DNA, 18 bp, Homo sapiens
catctgcccctcccccaa

SEQ ID NO: 2540068 - DNA, 23 bp, Homo sapiens
catctgcgtgacaataaaacatt

SEQ ID NO: 2540069 - DNA, 23 bp, Homo sapiens
catctggataggagcctgctggt

SEQ ID NO: 2540070 - DNA, 21 bp, Homo sapiens
catctgggaagatttctacct

SEQ ID NO: 2540071 - DNA, 15 bp, Homo sapiens
catctgggattccca

SEQ ID NO: 2540072 - DNA, 11 bp, Homo sapiens
catctgggctc

SEQ ID NO: 2540073 - DNA, 13 bp, Homo sapiens
catctgggctcct

SEQ ID NO: 2540074 - DNA, 18 bp, Homo sapiens
catctgggggagtggaat

SEQ ID NO: 2540075 - DNA, 20 bp, Homo sapiens
catctgtcaccaattggtta

SEQ ID NO: 2540076 - DNA, 17 bp, Homo sapiens
catctgtccctccggga

SEQ ID NO: 2540077 - DNA, 14 bp, Homo sapiens
catctgtgtcttgt

SEQ ID NO: 2540078 - DNA, 19 bp, Homo sapiens
catctgtgtttcaagtggg

SEQ ID NO: 2540079 - DNA, 15 bp, Homo sapiens
catcttactgaaggt

SEQ ID NO: 2540080 - DNA, 13 bp, Homo sapiens
catcttccagaag

SEQ ID NO: 2540081 - DNA, 13 bp, Homo sapiens
catcttctcagct

SEQ ID NO: 2540082 - DNA, 14 bp, Homo sapiens
catcttctcagctc

SEQ ID NO: 2540083 - DNA, 21 bp, Homo sapiens
catcttgaccaagcaggaagc

SEQ ID NO: 2540084 - DNA, 22 bp, Homo sapiens
catcttgaccaagcaggaagct

SEQ ID NO: 2540085 - DNA, 23 bp, Homo sapiens
catcttgaccaagcaggaagctc

SEQ ID NO: 2540086 - DNA, 17 bp, Homo sapiens
catcttgctctgctgac

SEQ ID NO: 2540087 - DNA, 16 bp, Homo sapiens
catcttggagggacca

SEQ ID NO: 2540088 - DNA, 18 bp, Homo sapiens
catcttggggacatctct

SEQ ID NO: 2540089 - DNA, 13 bp, Homo sapiens
catctttcacatt

SEQ ID NO: 2540090 - DNA, 19 bp, Homo sapiens
catctttcctgatggcagg

SEQ ID NO: 2540091 - DNA, 13 bp, Homo sapiens
catctttcctgtc

SEQ ID NO: 2540092 - DNA, 15 bp, Homo sapiens
catctttgccttggg

SEQ ID NO: 2540093 - DNA, 23 bp, Homo sapiens
catctttgccttgggctgctcct

SEQ ID NO: 2540094 - DNA, 15 bp, Homo sapiens
catgaaaaagcagct

SEQ ID NO: 2540095 - DNA, 18 bp, Homo sapiens
catgaaaaagcagctacc

SEQ ID NO: 2540096 - DNA, 23 bp, Homo sapiens
catgaaaaagcagctaccaggtg

SEQ ID NO: 2540097 - DNA, 13 bp, Homo sapiens
catgaaaacacat

SEQ ID NO: 2540098 - DNA, 14 bp, Homo sapiens
catgaaaacacatt

SEQ ID NO: 2540099 - DNA, 16 bp, Homo sapiens
catgaaaacacatttt

SEQ ID NO: 2540100 - DNA, 19 bp, Homo sapiens
catgaaaacacatttttct

SEQ ID NO: 2540101 - DNA, 16 bp, Homo sapiens
catgaaaacgttttat

SEQ ID NO: 2540102 - DNA, 24 bp, Homo sapiens
catgaaattgtctagcagagcagg

SEQ ID NO: 2540103 - DNA, 14 bp, Homo sapiens
catgaagacaggac

SEQ ID NO: 2540104 - DNA, 15 bp, Homo sapiens
catgaagacaggaca

SEQ ID NO: 2540105 - DNA, 14 bp, Homo sapiens
catgaagacaggat

SEQ ID NO: 2540106 - DNA, 13 bp, Homo sapiens
catgaagaccaca

SEQ ID NO: 2540107 - DNA, 15 bp, Homo sapiens
catgaaggtttctga

SEQ ID NO: 2540108 - DNA, 19 bp, Homo sapiens
catgaagtaatatgcacac

SEQ ID NO: 2540109 - DNA, 20 bp, Homo sapiens
catgaagtgtgtttccttca

SEQ ID NO: 2540110 - DNA, 15 bp, Homo sapiens
catgaatcgcttctc

SEQ ID NO: 2540111 - DNA, 15 bp, Homo sapiens
catgaatctgcaatg

SEQ ID NO: 2540112 - DNA, 18 bp, Homo sapiens
catgaatgtatcaggaaa

SEQ ID NO: 2540113 - DNA, 19 bp, Homo sapiens
catgacaactttgccagct

SEQ ID NO: 2540114 - DNA, 14 bp, Homo sapiens
catgacaagcccca

SEQ ID NO: 2540115 - DNA, 17 bp, Homo sapiens
catgacatgttatatat

SEQ ID NO: 2540116 - DNA, 19 bp, Homo sapiens
catgacatgttatatattt

SEQ ID NO: 2540117 - DNA, 23 bp, Homo sapiens
catgacattcctaaactatcttt

SEQ ID NO: 2540118 - DNA, 17 bp, Homo sapiens
catgaccacatagcatg

SEQ ID NO: 2540119 - DNA, 18 bp, Homo sapiens
catgaccatactgaggga

SEQ ID NO: 2540120 - DNA, 15 bp, Homo sapiens
catgacccaggctgg

SEQ ID NO: 2540121 - DNA, 19 bp, Homo sapiens
catgacctagttttccatg

SEQ ID NO: 2540122 - DNA, 20 bp, Homo sapiens
catgactcgtatatgtctca

SEQ ID NO: 2540123 - DNA, 22 bp, Homo sapiens
catgacttgagaaacaaataat

SEQ ID NO: 2540124 - DNA, 14 bp, Homo sapiens
catgagacacatct

SEQ ID NO: 2540125 - DNA, 19 bp, Homo sapiens
catgagaccactgttatca

SEQ ID NO: 2540126 - DNA, 20 bp, Homo sapiens
catgagatctaggtgaggat

SEQ ID NO: 2540127 - DNA, 21 bp, Homo sapiens
catgagcaccccaaggctgcg

SEQ ID NO: 2540128 - DNA, 13 bp, Homo sapiens
catgagcatcagg

SEQ ID NO: 2540129 - DNA, 16 bp, Homo sapiens
catgagcatcaggcca

SEQ ID NO: 2540130 - DNA, 23 bp, Homo sapiens
catgagcatcaggccaggccctc

SEQ ID NO: 2540131 - DNA, 19 bp, Homo sapiens
catgagcctcagcatcctg

SEQ ID NO: 2540132 - DNA, 22 bp, Homo sapiens
catgagcctcagcatcctggca

SEQ ID NO: 2540133 - DNA, 23 bp, Homo sapiens
catgagcctcagcatcctggcac

SEQ ID NO: 2540134 - DNA, 13 bp, Homo sapiens
catgagctccaga

SEQ ID NO: 2540135 - DNA, 15 bp, Homo sapiens
catgagctccagacc

SEQ ID NO: 2540136 - DNA, 16 bp, Homo sapiens
catgagctccagaccc

SEQ ID NO: 2540137 - DNA, 23 bp, Homo sapiens
catgagctccagacccccagcaa

SEQ ID NO: 2540138 - DNA, 23 bp, Homo sapiens
catgaggcaatgtcaggaacaga

SEQ ID NO: 2540139 - DNA, 21 bp, Homo sapiens
catgaggcctcagtggacttt

SEQ ID NO: 2540140 - DNA, 17 bp, Homo sapiens
catgagggatcacaggg

SEQ ID NO: 2540141 - DNA, 16 bp, Homo sapiens
catgaggtactgagag

SEQ ID NO: 2540142 - DNA, 13 bp, Homo sapiens
catgagtcccctg

SEQ ID NO: 2540143 - DNA, 18 bp, Homo sapiens
catgagtgcgtgctcagt

SEQ ID NO: 2540144 - DNA, 15 bp, Homo sapiens
catgatctcggctta

SEQ ID NO: 2540145 - DNA, 21 bp, Homo sapiens
catgatcttgtgacatattat

SEQ ID NO: 2540146 - DNA, 18 bp, Homo sapiens
catgatgagctcctcttc

SEQ ID NO: 2540147 - DNA, 15 bp, Homo sapiens
catgatgctgggatt

SEQ ID NO: 2540148 - DNA, 19 bp, Homo sapiens
catgatgttaaccagaata

SEQ ID NO: 2540149 - DNA, 13 bp, Homo sapiens
catgatgttttcc

SEQ ID NO: 2540150 - DNA, 22 bp, Homo sapiens
catgattaaccacttcagctga

SEQ ID NO: 2540151 - DNA, 24 bp, Homo sapiens
catgattaaccacttcagctgact

SEQ ID NO: 2540152 - DNA, 21 bp, Homo sapiens
catgattcgcccaaagccaga

SEQ ID NO: 2540153 - DNA, 15 bp, Homo sapiens
catgcaaaggctggg

SEQ ID NO: 2540154 - DNA, 16 bp, Homo sapiens
catgcaaatgctgtat

SEQ ID NO: 2540155 - DNA, 19 bp, Homo sapiens
catgcaaggggaaaatctc

SEQ ID NO: 2540156 - DNA, 17 bp, Homo sapiens
catgcaaggtcattttt

SEQ ID NO: 2540157 - DNA, 18 bp, Homo sapiens
catgcaaggtcatttttt

SEQ ID NO: 2540158 - DNA, 16 bp, Homo sapiens
catgcaatgacatctt

SEQ ID NO: 2540159 - DNA, 18 bp, Homo sapiens
catgcaatttattaaaat

SEQ ID NO: 2540160 - DNA, 17 bp, Homo sapiens
catgcagccgtgatcaa

SEQ ID NO: 2540161 - DNA, 20 bp, Homo sapiens
catgcagctgcaccctccct

SEQ ID NO: 2540162 - DNA, 12 bp, Homo sapiens
catgcataaata

SEQ ID NO: 2540163 - DNA, 12 bp, Homo sapiens
catgcatacaca

SEQ ID NO: 2540164 - DNA, 21 bp, Homo sapiens
catgcatacttcaaaagtatt

SEQ ID NO: 2540165 - DNA, 14 bp, Homo sapiens
catgcatcaagtta

SEQ ID NO: 2540166 - DNA, 14 bp, Homo sapiens
catgcatcttactg

SEQ ID NO: 2540167 - DNA, 17 bp, Homo sapiens
catgcatcttactgaag

SEQ ID NO: 2540168 - DNA, 15 bp, Homo sapiens
catgcatggaaattc

SEQ ID NO: 2540169 - DNA, 21 bp, Homo sapiens
catgcatgtcctgtaaaggtt

SEQ ID NO: 2540170 - DNA, 13 bp, Homo sapiens
cattgtgggaagg

SEQ ID NO: 2540171 - DNA, 15 bp, Homo sapiens
cattgtgggaagggg

SEQ ID NO: 2540172 - DNA, 18 bp, Homo sapiens
cattgttgaggtggtctg

SEQ ID NO: 2540173 - DNA, 21 bp, Homo sapiens
cattgttgaggtggtctgaat

SEQ ID NO: 2540174 - DNA, 18 bp, Homo sapiens
cattgtttagaaagaata

SEQ ID NO: 2540175 - DNA, 22 bp, Homo sapiens
cattgtttgaaacaaagaaggt

SEQ ID NO: 2540176 - DNA, 14 bp, Homo sapiens
cattgtttgcttat

SEQ ID NO: 2540177 - DNA, 15 bp, Homo sapiens
cattgtttggagaca

SEQ ID NO: 2540178 - DNA, 18 bp, Homo sapiens
cattgtttgtctgtcttc

SEQ ID NO: 2540179 - DNA, 21 bp, Homo sapiens
catttaaaaaaaaaatttgtt

SEQ ID NO: 2540180 - DNA, 15 bp, Homo sapiens
catttaaaaaaaatc

SEQ ID NO: 2540181 - DNA, 16 bp, Homo sapiens
catttaaaagatacag

SEQ ID NO: 2540182 - DNA, 14 bp, Homo sapiens
catttaaaatgatt

SEQ ID NO: 2540183 - DNA, 15 bp, Homo sapiens
catttaaaatgatta

SEQ ID NO: 2540184 - DNA, 18 bp, Homo sapiens
catttaaaatgattagaa

SEQ ID NO: 2540185 - DNA, 20 bp, Homo sapiens
catttaaatacagtcttcca

SEQ ID NO: 2540186 - DNA, 19 bp, Homo sapiens
catttaagagacagtcacc

SEQ ID NO: 2540187 - DNA, 20 bp, Homo sapiens
catttacatgtattatttca

SEQ ID NO: 2540188 - DNA, 21 bp, Homo sapiens
catttactttgtgttcacctt

SEQ ID NO: 2540189 - DNA, 17 bp, Homo sapiens
catttagccaccatctt

SEQ ID NO: 2540190 - DNA, 18 bp, Homo sapiens
catttagccaccatcttt

SEQ ID NO: 2540191 - DNA, 17 bp, Homo sapiens
catttataatgtttgct

SEQ ID NO: 2540192 - DNA, 21 bp, Homo sapiens
catttataatgtttgctattg

SEQ ID NO: 2540193 - DNA, 16 bp, Homo sapiens
catttatgaagcaagc

SEQ ID NO: 2540194 - DNA, 17 bp, Homo sapiens
catttatgatttaataa

SEQ ID NO: 2540195 - DNA, 14 bp, Homo sapiens
catttatgtttatt

SEQ ID NO: 2540196 - DNA, 14 bp, Homo sapiens
catttattctgctc

SEQ ID NO: 2540197 - DNA, 15 bp, Homo sapiens
catttcaactgtttg

SEQ ID NO: 2540198 - DNA, 15 bp, Homo sapiens
catttcatctatttc

SEQ ID NO: 2540199 - DNA, 16 bp, Homo sapiens
catttcatctatttct

SEQ ID NO: 2540200 - DNA, 18 bp, Homo sapiens
catttcatctatttctga

SEQ ID NO: 2540201 - DNA, 18 bp, Homo sapiens
catttcattcctaacaca

SEQ ID NO: 2540202 - DNA, 23 bp, Homo sapiens
catttcattgtatgatgtgttgt

SEQ ID NO: 2540203 - DNA, 19 bp, Homo sapiens
catttccacaccaagcagc

SEQ ID NO: 2540204 - DNA, 12 bp, Homo sapiens
catttcctgtgt

SEQ ID NO: 2540205 - DNA, 17 bp, Homo sapiens
catttcgcccctcattt

SEQ ID NO: 2540206 - DNA, 21 bp, Homo sapiens
catttcgcccctcatttatcc

SEQ ID NO: 2540207 - DNA, 17 bp, Homo sapiens
catttctactctcccat

SEQ ID NO: 2540208 - DNA, 22 bp, Homo sapiens
catttctactctcccatggctt

SEQ ID NO: 2540209 - DNA, 18 bp, Homo sapiens
catttctactgtgactga

SEQ ID NO: 2540210 - DNA, 23 bp, Homo sapiens
catttctagaacatccctgccag

SEQ ID NO: 2540211 - DNA, 13 bp, Homo sapiens
catttctcactga

SEQ ID NO: 2540212 - DNA, 12 bp, Homo sapiens
catttctcatgt

SEQ ID NO: 2540213 - DNA, 21 bp, Homo sapiens
catttctcatgttttccattg

SEQ ID NO: 2540214 - DNA, 20 bp, Homo sapiens
catttctcctttgataaaat

SEQ ID NO: 2540215 - DNA, 14 bp, Homo sapiens
catttctctggggt

SEQ ID NO: 2540216 - DNA, 15 bp, Homo sapiens
catttctcttactgc

SEQ ID NO: 2540217 - DNA, 16 bp, Homo sapiens
catttcttgggccctc

SEQ ID NO: 2540218 - DNA, 17 bp, Homo sapiens
catttcttgggccctcc

SEQ ID NO: 2540219 - DNA, 15 bp, Homo sapiens
catttgaaagaaagg

SEQ ID NO: 2540220 - DNA, 12 bp, Homo sapiens
catttgagaaat

SEQ ID NO: 2540221 - DNA, 23 bp, Homo sapiens
catttgagaaatgcatattgtat

SEQ ID NO: 2540222 - DNA, 20 bp, Homo sapiens
catttgagcagggctcagcg

SEQ ID NO: 2540223 - DNA, 15 bp, Homo sapiens
catttgattctgtgt

SEQ ID NO: 2540224 - DNA, 15 bp, Homo sapiens
catttgcaccctccg

SEQ ID NO: 2540225 - DNA, 12 bp, Homo sapiens
catttgcctatt

SEQ ID NO: 2540226 - DNA, 18 bp, Homo sapiens
catttgcctattcccaca

SEQ ID NO: 2540227 - DNA, 21 bp, Homo sapiens
catttgcgttccatgatgctg

SEQ ID NO: 2540228 - DNA, 19 bp, Homo sapiens
catttgctctttcatctct

SEQ ID NO: 2540229 - DNA, 13 bp, Homo sapiens
catttgctttttg

SEQ ID NO: 2540230 - DNA, 14 bp, Homo sapiens
catttgtgtcaatg

SEQ ID NO: 2540231 - DNA, 19 bp, Homo sapiens
catttgtgtgtgtgcaagt

SEQ ID NO: 2540232 - DNA, 22 bp, Homo sapiens
catttgtgtgtgtgcaagtgtg

SEQ ID NO: 2540233 - DNA, 17 bp, Homo sapiens
catttgtttgaactgat

SEQ ID NO: 2540234 - DNA, 17 bp, Homo sapiens
cattttaaataaaagaa

SEQ ID NO: 2540235 - DNA, 20 bp, Homo sapiens
cattttactttttcctggct

SEQ ID NO: 2540236 - DNA, 22 bp, Homo sapiens
cattttactttttcctggctca

SEQ ID NO: 2540237 - DNA, 20 bp, Homo sapiens
cattttagaagactctacca

SEQ ID NO: 2540238 - DNA, 17 bp, Homo sapiens
cattttagtcacttttt

SEQ ID NO: 2540239 - DNA, 14 bp, Homo sapiens
cattttagttcttt

SEQ ID NO: 2540240 - DNA, 13 bp, Homo sapiens
cattttataaatc

SEQ ID NO: 2540241 - DNA, 17 bp, Homo sapiens
cattttataaatcgctt

SEQ ID NO: 2540242 - DNA, 19 bp, Homo sapiens
cattttattttattatgca

SEQ ID NO: 2540243 - DNA, 22 bp, Homo sapiens
cattttattttattatgcatga

SEQ ID NO: 2540244 - DNA, 20 bp, Homo sapiens
cattttccccccactctccc

SEQ ID NO: 2540245 - DNA, 22 bp, Homo sapiens
cattttccccccactctcccca

SEQ ID NO: 2540246 - DNA, 14 bp, Homo sapiens
cattttgacctact

SEQ ID NO: 2540247 - DNA, 17 bp, Homo sapiens
cattttgagtgactcga

SEQ ID NO: 2540248 - DNA, 13 bp, Homo sapiens
cattttgcaaaat

SEQ ID NO: 2540249 - DNA, 21 bp, Homo sapiens
cattttgctaaatgtgaatga

SEQ ID NO: 2540250 - DNA, 22 bp, Homo sapiens
cattttggggtacccactgctc

SEQ ID NO: 2540251 - DNA, 14 bp, Homo sapiens
cattttgtataatt

SEQ ID NO: 2540252 - DNA, 21 bp, Homo sapiens
cattttgtgaatggattggat

SEQ ID NO: 2540253 - DNA, 20 bp, Homo sapiens
catttttaagtgctgcattt

SEQ ID NO: 2540254 - DNA, 21 bp, Homo sapiens
catttttaagtgctgcattta

SEQ ID NO: 2540255 - DNA, 15 bp, Homo sapiens
catttttaatcatga

SEQ ID NO: 2540256 - DNA, 19 bp, Homo sapiens
catttttaatcatgaaatt

SEQ ID NO: 2540257 - DNA, 17 bp, Homo sapiens
catttttacaataaata

SEQ ID NO: 2540258 - DNA, 20 bp, Homo sapiens
catttttcagatataaaaga

SEQ ID NO: 2540259 - DNA, 18 bp, Homo sapiens
catttttccttcccttct

SEQ ID NO: 2540260 - DNA, 23 bp, Homo sapiens
catttttcttagggaaggataca

SEQ ID NO: 2540261 - DNA, 20 bp, Homo sapiens
catttttgaatacaggcata

SEQ ID NO: 2540262 - DNA, 22 bp, Homo sapiens
catttttgtacagtttgctgta

SEQ ID NO: 2540263 - DNA, 23 bp, Homo sapiens
catttttgtttctacctcccaga

SEQ ID NO: 2540264 - DNA, 16 bp, Homo sapiens
cattttttaaatgcac

SEQ ID NO: 2540265 - DNA, 20 bp, Homo sapiens
catttttttaatttattatt

SEQ ID NO: 2540266 - DNA, 20 bp, Homo sapiens
ccaaaaaattctacaacaca

SEQ ID NO: 2540267 - DNA, 22 bp, Homo sapiens
ccaaaaaattctacaacacaca

SEQ ID NO: 2540268 - DNA, 17 bp, Homo sapiens
ccaaaactctcctctgc

SEQ ID NO: 2540269 - DNA, 16 bp, Homo sapiens
ccaaaagattgctgaa

SEQ ID NO: 2540270 - DNA, 14 bp, Homo sapiens
ccaaaagcacttac

SEQ ID NO: 2540271 - DNA, 18 bp, Homo sapiens
ccaaaataaaacttttta

SEQ ID NO: 2540272 - DNA, 17 bp, Homo sapiens
ccaaaataagaaaagat

SEQ ID NO: 2540273 - DNA, 19 bp, Homo sapiens
ccaaacaccttccagctcc

SEQ ID NO: 2540274 - DNA, 17 bp, Homo sapiens
ccaaacctctgtgagca

SEQ ID NO: 2540275 - DNA, 22 bp, Homo sapiens
ccaaacctgcaagggctcccca

SEQ ID NO: 2540276 - DNA, 17 bp, Homo sapiens
ccaaagaaatgtaaggg

SEQ ID NO: 2540277 - DNA, 21 bp, Homo sapiens
ccaaagagactggagcatctg

SEQ ID NO: 2540278 - DNA, 16 bp, Homo sapiens
ccaaagagcctggaga

SEQ ID NO: 2540279 - DNA, 13 bp, Homo sapiens
ccaaagccaccag

SEQ ID NO: 2540280 - DNA, 15 bp, Homo sapiens
ccaaagccagacagc

SEQ ID NO: 2540281 - DNA, 17 bp, Homo sapiens
ccaaagcctcctccagc

SEQ ID NO: 2540282 - DNA, 15 bp, Homo sapiens
ccaaagctaggcctg

SEQ ID NO: 2540283 - DNA, 21 bp, Homo sapiens
ccaaagctaggcctggccaga

SEQ ID NO: 2540284 - DNA, 19 bp, Homo sapiens
ccaaagctagggtggccct

SEQ ID NO: 2540285 - DNA, 21 bp, Homo sapiens
ccaaagctgttggtctgtccc

SEQ ID NO: 2540286 - DNA, 21 bp, Homo sapiens
ccaaaggactccacccatcct

SEQ ID NO: 2540287 - DNA, 19 bp, Homo sapiens
ccaaaggccatggagagct

SEQ ID NO: 2540288 - DNA, 20 bp, Homo sapiens
ccaaaggccatggagagctg

SEQ ID NO: 2540289 - DNA, 12 bp, Homo sapiens
ccaaaggccccc

SEQ ID NO: 2540290 - DNA, 21 bp, Homo sapiens
ccaaagggtgaagctatttat

SEQ ID NO: 2540291 - DNA, 14 bp, Homo sapiens
ccaaagtgctggga

SEQ ID NO: 2540292 - DNA, 19 bp, Homo sapiens
ccaaagtggtatagaaatg

SEQ ID NO: 2540293 - DNA, 15 bp, Homo sapiens
ccaaataagaaacct

SEQ ID NO: 2540294 - DNA, 17 bp, Homo sapiens
ccaaataagaaacctaa

SEQ ID NO: 2540295 - DNA, 20 bp, Homo sapiens
ccaaatcactgaactttgct

SEQ ID NO: 2540296 - DNA, 21 bp, Homo sapiens
ccaaatccgaacctcctctgt

SEQ ID NO: 2540297 - DNA, 16 bp, Homo sapiens
ccaaatgaatgacctt

SEQ ID NO: 2540298 - DNA, 11 bp, Homo sapiens
ccaaattattt

SEQ ID NO: 2540299 - DNA, 12 bp, Homo sapiens
ccaaattatttg

SEQ ID NO: 2540300 - DNA, 15 bp, Homo sapiens
ccaaattctttcagt

SEQ ID NO: 2540301 - DNA, 20 bp, Homo sapiens
ccaaattgctgggattacag

SEQ ID NO: 2540302 - DNA, 21 bp, Homo sapiens
ccaaattttggccaaagtgtt

SEQ ID NO: 2540303 - DNA, 12 bp, Homo sapiens
ccaacaccaggg

SEQ ID NO: 2540304 - DNA, 18 bp, Homo sapiens
ccaacacccatctgtttt

SEQ ID NO: 2540305 - DNA, 15 bp, Homo sapiens
ccaacactgtgccct

SEQ ID NO: 2540306 - DNA, 16 bp, Homo sapiens
ccaacactgtgccctg

SEQ ID NO: 2540307 - DNA, 17 bp, Homo sapiens
ccaacactgtgccctgg

SEQ ID NO: 2540308 - DNA, 20 bp, Homo sapiens
ccaacagtgagtctgtcagc

SEQ ID NO: 2540309 - DNA, 16 bp, Homo sapiens
ccaacagtgtgaagtt

SEQ ID NO: 2540310 - DNA, 12 bp, Homo sapiens
ccaacagttcct

SEQ ID NO: 2540311 - DNA, 21 bp, Homo sapiens
ccaacatactcccatctgtga

SEQ ID NO: 2540312 - DNA, 15 bp, Homo sapiens
ccaacatggtgaaac

SEQ ID NO: 2540313 - DNA, 17 bp, Homo sapiens
ccaacccccaccccaca

SEQ ID NO: 2540314 - DNA, 14 bp, Homo sapiens
ccactcctgtacac

SEQ ID NO: 2540315 - DNA, 20 bp, Homo sapiens
ccactcgggaggctgagaca

SEQ ID NO: 2540316 - DNA, 23 bp, Homo sapiens
ccactcgggaggctgagacagga

SEQ ID NO: 2540317 - DNA, 18 bp, Homo sapiens
ccactctaccctcccacc

SEQ ID NO: 2540318 - DNA, 20 bp, Homo sapiens
ccactctaccctcccacccc

SEQ ID NO: 2540319 - DNA, 19 bp, Homo sapiens
ccactctagggcagtggag

SEQ ID NO: 2540320 - DNA, 23 bp, Homo sapiens
ccactctccttgctacccagaaa

SEQ ID NO: 2540321 - DNA, 16 bp, Homo sapiens
ccactgacagcctccc

SEQ ID NO: 2540322 - DNA, 19 bp, Homo sapiens
ccactgacagcctcccacc

SEQ ID NO: 2540323 - DNA, 11 bp, Homo sapiens
ccactgagctc

SEQ ID NO: 2540324 - DNA, 14 bp, Homo sapiens
ccactgcacagagc

SEQ ID NO: 2540325 - DNA, 19 bp, Homo sapiens
ccactgcaccgggccacag

SEQ ID NO: 2540326 - DNA, 18 bp, Homo sapiens
ccactgcactccagcctg

SEQ ID NO: 2540327 - DNA, 19 bp, Homo sapiens
ccactgcactccagcctgg

SEQ ID NO: 2540328 - DNA, 18 bp, Homo sapiens
ccactgcagaagacagta

SEQ ID NO: 2540329 - DNA, 15 bp, Homo sapiens
ccactgcctcaggtt

SEQ ID NO: 2540330 - DNA, 16 bp, Homo sapiens
ccactgcctcaggttc

SEQ ID NO: 2540331 - DNA, 11 bp, Homo sapiens
ccactgcctct

SEQ ID NO: 2540332 - DNA, 22 bp, Homo sapiens
ccactgcctttgacctgcctcc

SEQ ID NO: 2540333 - DNA, 13 bp, Homo sapiens
ccactgcgttgtc

SEQ ID NO: 2540334 - DNA, 12 bp, Homo sapiens
ccactgctctgg

SEQ ID NO: 2540335 - DNA, 19 bp, Homo sapiens
ccactgctgcttctccatg

SEQ ID NO: 2540336 - DNA, 16 bp, Homo sapiens
ccactggacttgagct

SEQ ID NO: 2540337 - DNA, 11 bp, Homo sapiens
ccactggccac

SEQ ID NO: 2540338 - DNA, 13 bp, Homo sapiens
ccactggccacca

SEQ ID NO: 2540339 - DNA, 11 bp, Homo sapiens
ccactggccat

SEQ ID NO: 2540340 - DNA, 22 bp, Homo sapiens
ccactggggtccagggagcagg

SEQ ID NO: 2540341 - DNA, 23 bp, Homo sapiens
ccactggtgacatgtcttttctt

SEQ ID NO: 2540342 - DNA, 15 bp, Homo sapiens
ccactggttcttctt

SEQ ID NO: 2540343 - DNA, 14 bp, Homo sapiens
ccactgtaaaatga

SEQ ID NO: 2540344 - DNA, 17 bp, Homo sapiens
ccactgtcaccctccac

SEQ ID NO: 2540345 - DNA, 23 bp, Homo sapiens
ccactgtcactgtttctctgctg

SEQ ID NO: 2540346 - DNA, 24 bp, Homo sapiens
ccactgtcactgtttctctgctgt

SEQ ID NO: 2540347 - DNA, 11 bp, Homo sapiens
ccactgtcctg

SEQ ID NO: 2540348 - DNA, 14 bp, Homo sapiens
ccactgtcttcttc

SEQ ID NO: 2540349 - DNA, 17 bp, Homo sapiens
ccactgtgctgaattct

SEQ ID NO: 2540350 - DNA, 21 bp, Homo sapiens
ccacttaaaaaatgtccatga

SEQ ID NO: 2540351 - DNA, 13 bp, Homo sapiens
ccacttaaaatgt

SEQ ID NO: 2540352 - DNA, 14 bp, Homo sapiens
ccacttaccttcaa

SEQ ID NO: 2540353 - DNA, 21 bp, Homo sapiens
ccacttaccttcaataaagta

SEQ ID NO: 2540354 - DNA, 22 bp, Homo sapiens
ccacttattccccattcttcct

SEQ ID NO: 2540355 - DNA, 13 bp, Homo sapiens
ccacttcaataga

SEQ ID NO: 2540356 - DNA, 14 bp, Homo sapiens
ccacttcagctgac

SEQ ID NO: 2540357 - DNA, 12 bp, Homo sapiens
ccacttccctca

SEQ ID NO: 2540358 - DNA, 20 bp, Homo sapiens
ccacttcttgttccccactg

SEQ ID NO: 2540359 - DNA, 16 bp, Homo sapiens
ccacttcttttataac

SEQ ID NO: 2540360 - DNA, 21 bp, Homo sapiens
ccacttggaggcctttcatcc

SEQ ID NO: 2540361 - DNA, 15 bp, Homo sapiens
ccacttgtccgctgg

SEQ ID NO: 2540362 - DNA, 18 bp, Homo sapiens
ccactttggtcccgtgca

SEQ ID NO: 2540363 - DNA, 15 bp, Homo sapiens
ccactttgttcttta

SEQ ID NO: 2540364 - DNA, 16 bp, Homo sapiens
ccagaaaggagactag

SEQ ID NO: 2540365 - DNA, 13 bp, Homo sapiens
ccagaaattagaa

SEQ ID NO: 2540366 - DNA, 17 bp, Homo sapiens
ccagaacacactccatc

SEQ ID NO: 2540367 - DNA, 17 bp, Homo sapiens
ccagaacagtttgtaca

SEQ ID NO: 2540368 - DNA, 20 bp, Homo sapiens
ccagaagcctctggctagag

SEQ ID NO: 2540369 - DNA, 12 bp, Homo sapiens
ccagaaggcagg

SEQ ID NO: 2540370 - DNA, 22 bp, Homo sapiens
ccagaaggcatatcagtctctg

SEQ ID NO: 2540371 - DNA, 14 bp, Homo sapiens
ccagaaggggtttg

SEQ ID NO: 2540372 - DNA, 19 bp, Homo sapiens
ccagaataagttattgcag

SEQ ID NO: 2540373 - DNA, 16 bp, Homo sapiens
ccagaatctaaagcca

SEQ ID NO: 2540374 - DNA, 23 bp, Homo sapiens
ccagaatggtctttctaatgtgt

SEQ ID NO: 2540375 - DNA, 10 bp, Homo sapiens
ccagacaccc

SEQ ID NO: 2540376 - DNA, 12 bp, Homo sapiens
ccagacagcctg

SEQ ID NO: 2540377 - DNA, 13 bp, Homo sapiens
ccagacagctccc

SEQ ID NO: 2540378 - DNA, 23 bp, Homo sapiens
ccagacatgtggtgggacaggga

SEQ ID NO: 2540379 - DNA, 14 bp, Homo sapiens
ccagacccccaccc

SEQ ID NO: 2540380 - DNA, 19 bp, Homo sapiens
ccagacccccagcaaccct

SEQ ID NO: 2540381 - DNA, 21 bp, Homo sapiens
ccagacccctctggccaggat

SEQ ID NO: 2540382 - DNA, 23 bp, Homo sapiens
ccagacccctctggccaggatgg

SEQ ID NO: 2540383 - DNA, 15 bp, Homo sapiens
ccagacccggctgcg

SEQ ID NO: 2540384 - DNA, 14 bp, Homo sapiens
ccagaccttttatc

SEQ ID NO: 2540385 - DNA, 16 bp, Homo sapiens
ccagacggttcaccag

SEQ ID NO: 2540386 - DNA, 21 bp, Homo sapiens
ccagactttacatgacacagc

SEQ ID NO: 2540387 - DNA, 18 bp, Homo sapiens
ccagagaagccccttccc

SEQ ID NO: 2540388 - DNA, 14 bp, Homo sapiens
ccagagaagtgaca

SEQ ID NO: 2540389 - DNA, 15 bp, Homo sapiens
ccagagaagtgacag

SEQ ID NO: 2540390 - DNA, 16 bp, Homo sapiens
ccagagaagtgacagg

SEQ ID NO: 2540391 - DNA, 17 bp, Homo sapiens
ccagagaagtgacaggg

SEQ ID NO: 2540392 - DNA, 22 bp, Homo sapiens
ccagagaagtgacagggaagct

SEQ ID NO: 2540393 - DNA, 21 bp, Homo sapiens
ccagagagagaagtgcccctg

SEQ ID NO: 2540394 - DNA, 21 bp, Homo sapiens
ccagagagcctggtgctgctg

SEQ ID NO: 2540395 - DNA, 13 bp, Homo sapiens
ccagagagggtgg

SEQ ID NO: 2540396 - DNA, 23 bp, Homo sapiens
ccagagagggtggtgacctctgc

SEQ ID NO: 2540397 - DNA, 13 bp, Homo sapiens
ccagagcaaaata

SEQ ID NO: 2540398 - DNA, 14 bp, Homo sapiens
ccagagcagatgca

SEQ ID NO: 2540399 - DNA, 15 bp, Homo sapiens
ccagagcagatgcag

SEQ ID NO: 2540400 - DNA, 16 bp, Homo sapiens
ccagagcagatgcaga

SEQ ID NO: 2540401 - DNA, 15 bp, Homo sapiens
ccagagcaggaagca

SEQ ID NO: 2540402 - DNA, 20 bp, Homo sapiens
ccagagcatttccaacacca

SEQ ID NO: 2540403 - DNA, 15 bp, Homo sapiens
ccagagccatggact

SEQ ID NO: 2540404 - DNA, 21 bp, Homo sapiens
ccagagccatggactctacac

SEQ ID NO: 2540405 - DNA, 22 bp, Homo sapiens
ccagagcccaccttggctcaag

SEQ ID NO: 2540406 - DNA, 19 bp, Homo sapiens
ccagagcgtgggagacggt

SEQ ID NO: 2540407 - DNA, 22 bp, Homo sapiens
ccagaggaactgtccagagagc

SEQ ID NO: 2540408 - DNA, 13 bp, Homo sapiens
ccagaggagacat

SEQ ID NO: 2540409 - DNA, 19 bp, Homo sapiens
ccagagggagtgacagagg

SEQ ID NO: 2540410 - DNA, 15 bp, Homo sapiens
ccagagggcccaggc

SEQ ID NO: 2540411 - DNA, 13 bp, Homo sapiens
ccagagggcctgc

SEQ ID NO: 2540412 - DNA, 17 bp, Homo sapiens
ccagagggcctgcaagg

SEQ ID NO: 2540413 - DNA, 20 bp, Homo sapiens
ccagagggcctgcaagggag

SEQ ID NO: 2540414 - DNA, 16 bp, Homo sapiens
ccagagggtgggcttc

SEQ ID NO: 2540415 - DNA, 18 bp, Homo sapiens
ccagaggtgggcaggtgg

SEQ ID NO: 2540416 - DNA, 13 bp, Homo sapiens
ccagagtggcctg

SEQ ID NO: 2540417 - DNA, 21 bp, Homo sapiens
ccagagtggcctggccaggag

SEQ ID NO: 2540418 - DNA, 22 bp, Homo sapiens
ccagagtggcctggccaggagc

SEQ ID NO: 2540419 - DNA, 12 bp, Homo sapiens
ccagagtgtgaa

SEQ ID NO: 2540420 - DNA, 21 bp, Homo sapiens
ccagagttccccatgcagaca

SEQ ID NO: 2540421 - DNA, 20 bp, Homo sapiens
ccagataccagcccctgtat

SEQ ID NO: 2540422 - DNA, 21 bp, Homo sapiens
ccagatacttcccattttgga

SEQ ID NO: 2540423 - DNA, 19 bp, Homo sapiens
ccagatcggatctgttgca

SEQ ID NO: 2540424 - DNA, 13 bp, Homo sapiens
ccagatctggtcc

SEQ ID NO: 2540425 - DNA, 19 bp, Homo sapiens
ccagatgaggctggccaag

SEQ ID NO: 2540426 - DNA, 13 bp, Homo sapiens
ccagatgcaccag

SEQ ID NO: 2540427 - DNA, 21 bp, Homo sapiens
ccagatgctgatgttcagtgt

SEQ ID NO: 2540428 - DNA, 22 bp, Homo sapiens
ccagatgctgatgttcagtgta

SEQ ID NO: 2540429 - DNA, 23 bp, Homo sapiens
ccagatgctgatgttcagtgtaa

SEQ ID NO: 2540430 - DNA, 14 bp, Homo sapiens
ccagatggggcctc

SEQ ID NO: 2540431 - DNA, 19 bp, Homo sapiens
ccagatgttttacgtctgg

SEQ ID NO: 2540432 - DNA, 21 bp, Homo sapiens
ccagatgttttacgtctggga

SEQ ID NO: 2540433 - DNA, 18 bp, Homo sapiens
ccagattctttcctgagg

SEQ ID NO: 2540434 - DNA, 20 bp, Homo sapiens
ccagattctttcctgaggct

SEQ ID NO: 2540435 - DNA, 14 bp, Homo sapiens
ccagattgcaacag

SEQ ID NO: 2540436 - DNA, 19 bp, Homo sapiens
ccagatttacactgggaga

SEQ ID NO: 2540437 - DNA, 13 bp, Homo sapiens
ccagcaactgaat

SEQ ID NO: 2540438 - DNA, 16 bp, Homo sapiens
ccagcaactgaataaa

SEQ ID NO: 2540439 - DNA, 16 bp, Homo sapiens
ccagcaagtgagagct

SEQ ID NO: 2540440 - DNA, 21 bp, Homo sapiens
ccagcaagtgagagctgggtg

SEQ ID NO: 2540441 - DNA, 18 bp, Homo sapiens
ccagcactaaagcagtgg

SEQ ID NO: 2540442 - DNA, 24 bp, Homo sapiens
ccagcactaaagcagtggacacca

SEQ ID NO: 2540443 - DNA, 13 bp, Homo sapiens
ccagcactgccca

SEQ ID NO: 2540444 - DNA, 18 bp, Homo sapiens
ccagcactgcttgaggaa

SEQ ID NO: 2540445 - DNA, 19 bp, Homo sapiens
ccagcactgcttgaggaaa

SEQ ID NO: 2540446 - DNA, 11 bp, Homo sapiens
ccagcactttg

SEQ ID NO: 2540447 - DNA, 21 bp, Homo sapiens
ccagcactttgggaggccaag

SEQ ID NO: 2540448 - DNA, 23 bp, Homo sapiens
ccagcactttgggaggccaagga

SEQ ID NO: 2540449 - DNA, 21 bp, Homo sapiens
ccagcactttgggaggctgag

SEQ ID NO: 2540450 - DNA, 22 bp, Homo sapiens
ccagcagaaatgccttaccctc

SEQ ID NO: 2540451 - DNA, 14 bp, Homo sapiens
ccagcagagcacct

SEQ ID NO: 2540452 - DNA, 19 bp, Homo sapiens
ccagcagagcaccttagac

SEQ ID NO: 2540453 - DNA, 18 bp, Homo sapiens
ccagcagatcccagctca

SEQ ID NO: 2540454 - DNA, 16 bp, Homo sapiens
ccagcagccagctctc

SEQ ID NO: 2540455 - DNA, 18 bp, Homo sapiens
ccagcagccagctctcag

SEQ ID NO: 2540456 - DNA, 12 bp, Homo sapiens
ccagcagcccta

SEQ ID NO: 2540457 - DNA, 21 bp, Homo sapiens
ccagcagccctaaggatctct

SEQ ID NO: 2540458 - DNA, 12 bp, Homo sapiens
ccagcagcctgg

SEQ ID NO: 2540459 - DNA, 14 bp, Homo sapiens
ccagtgggaggggc

SEQ ID NO: 2540460 - DNA, 20 bp, Homo sapiens
ccagtgggaggggcaggctg

SEQ ID NO: 2540461 - DNA, 15 bp, Homo sapiens
ccagtggtatcctgt

SEQ ID NO: 2540462 - DNA, 15 bp, Homo sapiens
ccagtgtagccttgc

SEQ ID NO: 2540463 - DNA, 16 bp, Homo sapiens
ccagtgtcccctccac

SEQ ID NO: 2540464 - DNA, 22 bp, Homo sapiens
ccagtgtcccctccactgtcac

SEQ ID NO: 2540465 - DNA, 21 bp, Homo sapiens
ccagtgtctgtcccggggtcc

SEQ ID NO: 2540466 - DNA, 14 bp, Homo sapiens
ccagtgtgacaagg

SEQ ID NO: 2540467 - DNA, 15 bp, Homo sapiens
ccagtgtgatcccaa

SEQ ID NO: 2540468 - DNA, 17 bp, Homo sapiens
ccagtgttagggaaggg

SEQ ID NO: 2540469 - DNA, 14 bp, Homo sapiens
ccagttatggctat

SEQ ID NO: 2540470 - DNA, 21 bp, Homo sapiens
ccagttatggctataggtgct

SEQ ID NO: 2540471 - DNA, 20 bp, Homo sapiens
ccagttattttccgccctca

SEQ ID NO: 2540472 - DNA, 14 bp, Homo sapiens
ccagttcaggagtc

SEQ ID NO: 2540473 - DNA, 18 bp, Homo sapiens
ccagttcattgcactttg

SEQ ID NO: 2540474 - DNA, 15 bp, Homo sapiens
ccagttctgctcctc

SEQ ID NO: 2540475 - DNA, 17 bp, Homo sapiens
ccagttctgctcctctc

SEQ ID NO: 2540476 - DNA, 20 bp, Homo sapiens
ccagttctgctcctctccag

SEQ ID NO: 2540477 - DNA, 19 bp, Homo sapiens
ccagttgggtggatgcctg

SEQ ID NO: 2540478 - DNA, 20 bp, Homo sapiens
ccagttgggtggatgcctgg

SEQ ID NO: 2540479 - DNA, 23 bp, Homo sapiens
ccagttgggtggatgcctggtgg

SEQ ID NO: 2540480 - DNA, 18 bp, Homo sapiens
ccagtttaacctgatgca

SEQ ID NO: 2540481 - DNA, 14 bp, Homo sapiens
ccagtttctgcctc

SEQ ID NO: 2540482 - DNA, 14 bp, Homo sapiens
ccataaacttcatg

SEQ ID NO: 2540483 - DNA, 17 bp, Homo sapiens
ccataaccgctgattct

SEQ ID NO: 2540484 - DNA, 22 bp, Homo sapiens
ccataaccgctgattctcaggg

SEQ ID NO: 2540485 - DNA, 20 bp, Homo sapiens
ccataaggtttcgtttctgt

SEQ ID NO: 2540486 - DNA, 14 bp, Homo sapiens
ccataatctggact

SEQ ID NO: 2540487 - DNA, 21 bp, Homo sapiens
ccataatctggactcctctgt

SEQ ID NO: 2540488 - DNA, 21 bp, Homo sapiens
ccataatgctactgtctcact

SEQ ID NO: 2540489 - DNA, 20 bp, Homo sapiens
ccataattatgacagttata

SEQ ID NO: 2540490 - DNA, 17 bp, Homo sapiens
ccataattttcttcatg

SEQ ID NO: 2540491 - DNA, 23 bp, Homo sapiens
ccatagagagcaagacgctgtgc

SEQ ID NO: 2540492 - DNA, 18 bp, Homo sapiens
ccatagcaagattgctta

SEQ ID NO: 2540493 - DNA, 15 bp, Homo sapiens
ccatagctcctgctc

SEQ ID NO: 2540494 - DNA, 19 bp, Homo sapiens
ccatagctcctgctccaca

SEQ ID NO: 2540495 - DNA, 18 bp, Homo sapiens
ccatatgacctcatgcat

SEQ ID NO: 2540496 - DNA, 22 bp, Homo sapiens
ccatatggattttctattgtta

SEQ ID NO: 2540497 - DNA, 18 bp, Homo sapiens
ccatattctgttggccag

SEQ ID NO: 2540498 - DNA, 17 bp, Homo sapiens
ccatcaacaaaaattgt

SEQ ID NO: 2540499 - DNA, 18 bp, Homo sapiens
ccatcaacaaaaattgtc

SEQ ID NO: 2540500 - DNA, 12 bp, Homo sapiens
ccatcaagccac

SEQ ID NO: 2540501 - DNA, 16 bp, Homo sapiens
ccatcaagccaccaac

SEQ ID NO: 2540502 - DNA, 13 bp, Homo sapiens
ccatcacagggtt

SEQ ID NO: 2540503 - DNA, 20 bp, Homo sapiens
ccatcacagggttgggccca

SEQ ID NO: 2540504 - DNA, 13 bp, Homo sapiens
ccatcaccagaca

SEQ ID NO: 2540505 - DNA, 16 bp, Homo sapiens
ccatcacgcctgtgca

SEQ ID NO: 2540506 - DNA, 23 bp, Homo sapiens
ccatcagaaacaccctcacactg

SEQ ID NO: 2540507 - DNA, 17 bp, Homo sapiens
ccatcaggactcttgtg

SEQ ID NO: 2540508 - DNA, 12 bp, Homo sapiens
ccatcatgtctg

SEQ ID NO: 2540509 - DNA, 13 bp, Homo sapiens
ccatcatgtctgg

SEQ ID NO: 2540510 - DNA, 20 bp, Homo sapiens
ccatcatgtttacagaggac

SEQ ID NO: 2540511 - DNA, 20 bp, Homo sapiens
ccatccaaataagaaaccta

SEQ ID NO: 2540512 - DNA, 17 bp, Homo sapiens
ccatccacatgggagcc

SEQ ID NO: 2540513 - DNA, 12 bp, Homo sapiens
ccatccaggcag

SEQ ID NO: 2540514 - DNA, 13 bp, Homo sapiens
ccatccaggcagt

SEQ ID NO: 2540515 - DNA, 21 bp, Homo sapiens
ccatcccagagggtgggcttc

SEQ ID NO: 2540516 - DNA, 12 bp, Homo sapiens
ccatcccagccc

SEQ ID NO: 2540517 - DNA, 15 bp, Homo sapiens
ccatcccagccccaa

SEQ ID NO: 2540518 - DNA, 15 bp, Homo sapiens
ccatcccagccttgg

SEQ ID NO: 2540519 - DNA, 23 bp, Homo sapiens
ccatcccagccttggcatctaga

SEQ ID NO: 2540520 - DNA, 22 bp, Homo sapiens
ccatccccatcctccagcttct

SEQ ID NO: 2540521 - DNA, 12 bp, Homo sapiens
ccatccccctgc

SEQ ID NO: 2540522 - DNA, 13 bp, Homo sapiens
ccatccccctgcc

SEQ ID NO: 2540523 - DNA, 13 bp, Homo sapiens
ccatcccctggac

SEQ ID NO: 2540524 - DNA, 16 bp, Homo sapiens
ccatcccctgtagagt

SEQ ID NO: 2540525 - DNA, 22 bp, Homo sapiens
ccatcccctgtagagtgggagc

SEQ ID NO: 2540526 - DNA, 14 bp, Homo sapiens
ccatccctgaaggc

SEQ ID NO: 2540527 - DNA, 16 bp, Homo sapiens
ccatccgccagggccc

SEQ ID NO: 2540528 - DNA, 21 bp, Homo sapiens
ccatcctaatcatccaatgct

SEQ ID NO: 2540529 - DNA, 12 bp, Homo sapiens
ccatcctaccct

SEQ ID NO: 2540530 - DNA, 17 bp, Homo sapiens
ccatcctaccctcgggc

SEQ ID NO: 2540531 - DNA, 22 bp, Homo sapiens
ccatcctaccctcgggcccacc

SEQ ID NO: 2540532 - DNA, 13 bp, Homo sapiens
ccatcctcaaaca

SEQ ID NO: 2540533 - DNA, 15 bp, Homo sapiens
ccatcctccagcttc

SEQ ID NO: 2540534 - DNA, 16 bp, Homo sapiens
ccatcctccagcttct

SEQ ID NO: 2540535 - DNA, 17 bp, Homo sapiens
ccatcctccagcttctg

SEQ ID NO: 2540536 - DNA, 19 bp, Homo sapiens
ccatcctctgtacagagcc

SEQ ID NO: 2540537 - DNA, 16 bp, Homo sapiens
ccatcctgtcccacca

SEQ ID NO: 2540538 - DNA, 17 bp, Homo sapiens
ccatcctgtcccaccat

SEQ ID NO: 2540539 - DNA, 12 bp, Homo sapiens
ccatcgccggga

SEQ ID NO: 2540540 - DNA, 22 bp, Homo sapiens
ccatcgccgggactccagaacc

SEQ ID NO: 2540541 - DNA, 22 bp, Homo sapiens
ccatctatgtcccttgctgtga

SEQ ID NO: 2540542 - DNA, 21 bp, Homo sapiens
ccatctcaggccacctgcccc

SEQ ID NO: 2540543 - DNA, 22 bp, Homo sapiens
ccatctccaagaatgctgaaac

SEQ ID NO: 2540544 - DNA, 16 bp, Homo sapiens
ccatctcctttcaggg

SEQ ID NO: 2540545 - DNA, 17 bp, Homo sapiens
ccatctcctttcaggga

SEQ ID NO: 2540546 - DNA, 14 bp, Homo sapiens
ccatctcgccaccc

SEQ ID NO: 2540547 - DNA, 23 bp, Homo sapiens
ccatctcgccacccctccttcct

SEQ ID NO: 2540548 - DNA, 17 bp, Homo sapiens
ccatctctccctcccct

SEQ ID NO: 2540549 - DNA, 16 bp, Homo sapiens
ccatctctctggccct

SEQ ID NO: 2540550 - DNA, 23 bp, Homo sapiens
ccatctctgattttcaaagcttt

SEQ ID NO: 2540551 - DNA, 21 bp, Homo sapiens
ccatctcttcctacccaacca

SEQ ID NO: 2540552 - DNA, 17 bp, Homo sapiens
ccatctgcccaggggtg

SEQ ID NO: 2540553 - DNA, 23 bp, Homo sapiens
ccatctgcccaggggtgccccct

SEQ ID NO: 2540554 - DNA, 20 bp, Homo sapiens
ccatctgcgtgacaataaaa

SEQ ID NO: 2540555 - DNA, 22 bp, Homo sapiens
ccatctgggctcctaaccttcc

SEQ ID NO: 2540556 - DNA, 14 bp, Homo sapiens
ccatctgtccctgc

SEQ ID NO: 2540557 - DNA, 15 bp, Homo sapiens
ccatctgtgaataag

SEQ ID NO: 2540558 - DNA, 19 bp, Homo sapiens
ccatctgtttggtgggggt

SEQ ID NO: 2540559 - DNA, 15 bp, Homo sapiens
ccatcttagtttgga

SEQ ID NO: 2540560 - DNA, 15 bp, Homo sapiens
ccatcttcagcttct

SEQ ID NO: 2540561 - DNA, 18 bp, Homo sapiens
ccatctttgcaggttgct

SEQ ID NO: 2540562 - DNA, 22 bp, Homo sapiens
ccatgaacagaaaacattctga

SEQ ID NO: 2540563 - DNA, 17 bp, Homo sapiens
ccatgaatcaaagacat

SEQ ID NO: 2540564 - DNA, 17 bp, Homo sapiens
ccatgaatcgcttctct

SEQ ID NO: 2540565 - DNA, 18 bp, Homo sapiens
ccatgaatgtatcaggaa

SEQ ID NO: 2540566 - DNA, 17 bp, Homo sapiens
ccatgacccacccctgt

SEQ ID NO: 2540567 - DNA, 18 bp, Homo sapiens
ccatgacccaggctgggc

SEQ ID NO: 2540568 - DNA, 19 bp, Homo sapiens
ccatgagcctcagcatcct

SEQ ID NO: 2540569 - DNA, 14 bp, Homo sapiens
ccatgagtcccctg

SEQ ID NO: 2540570 - DNA, 16 bp, Homo sapiens
ccatgagtcccctgtt

SEQ ID NO: 2540571 - DNA, 17 bp, Homo sapiens
ccatgagtccttgaaaa

SEQ ID NO: 2540572 - DNA, 18 bp, Homo sapiens
ccatgatgttttccatga

SEQ ID NO: 2540573 - DNA, 19 bp, Homo sapiens
ccatgattaaccacttcag

SEQ ID NO: 2540574 - DNA, 18 bp, Homo sapiens
ccatgcccacctgcccat

SEQ ID NO: 2540575 - DNA, 19 bp, Homo sapiens
ccatgcctgtccagcctgg

SEQ ID NO: 2540576 - DNA, 13 bp, Homo sapiens
ccatgctcctggc

SEQ ID NO: 2540577 - DNA, 16 bp, Homo sapiens
ccatgctgaagggacc

SEQ ID NO: 2540578 - DNA, 13 bp, Homo sapiens
ccatgctgccctg

SEQ ID NO: 2540579 - DNA, 17 bp, Homo sapiens
ccatgctgccctgtgag

SEQ ID NO: 2540580 - DNA, 20 bp, Homo sapiens
ccatgctgttgattgctaaa

SEQ ID NO: 2540581 - DNA, 24 bp, Homo sapiens
ccatgctgttgattgctaaatgta

SEQ ID NO: 2540582 - DNA, 14 bp, Homo sapiens
ccatggaatgcttg

SEQ ID NO: 2540583 - DNA, 17 bp, Homo sapiens
ccatggacactccagtg

SEQ ID NO: 2540584 - DNA, 21 bp, Homo sapiens
ccatggacactccagtgccag

SEQ ID NO: 2540585 - DNA, 15 bp, Homo sapiens
ccatggactctacac

SEQ ID NO: 2540586 - DNA, 21 bp, Homo sapiens
ccatggcgtgtccctctcgga

SEQ ID NO: 2540587 - DNA, 21 bp, Homo sapiens
ccatgggaccaaacctagccc

SEQ ID NO: 2540588 - DNA, 14 bp, Homo sapiens
ccatgggcagagcc

SEQ ID NO: 2540589 - DNA, 23 bp, Homo sapiens
ccatggggtaggaggatgggctc

SEQ ID NO: 2540590 - DNA, 22 bp, Homo sapiens
ccatggtgaattaatcactttt

SEQ ID NO: 2540591 - DNA, 14 bp, Homo sapiens
ccatgtactgtagt

SEQ ID NO: 2540592 - DNA, 22 bp, Homo sapiens
ccatgtactgtagtttttcttc

SEQ ID NO: 2540593 - DNA, 15 bp, Homo sapiens
ccatgtagaaaattt

SEQ ID NO: 2540594 - DNA, 12 bp, Homo sapiens
ccatgtcgcctc

SEQ ID NO: 2540595 - DNA, 15 bp, Homo sapiens
ccatgtcgcctctgc

SEQ ID NO: 2540596 - DNA, 17 bp, Homo sapiens
ccatgtctgccccatca

SEQ ID NO: 2540597 - DNA, 17 bp, Homo sapiens
ccatgtgtgagtgtgtg

SEQ ID NO: 2540598 - DNA, 12 bp, Homo sapiens
ccatgtgtgtgc

SEQ ID NO: 2540599 - DNA, 22 bp, Homo sapiens
ccatgttcacaccgctgcactc

SEQ ID NO: 2540600 - DNA, 13 bp, Homo sapiens
ccatgttggccag

SEQ ID NO: 2540601 - DNA, 21 bp, Homo sapiens
ccatgttggccaggctggtct

SEQ ID NO: 2540602 - DNA, 21 bp, Homo sapiens
ccatgtttctctggccccaag

SEQ ID NO: 2540603 - DNA, 22 bp, Homo sapiens
cccagtgacacttcagagagct

SEQ ID NO: 2540604 - DNA, 21 bp, Homo sapiens
cccagtgagcactcccaagtc

SEQ ID NO: 2540605 - DNA, 22 bp, Homo sapiens
cccagtgccaagcacagtgcct

SEQ ID NO: 2540606 - DNA, 20 bp, Homo sapiens
cccagtgcccacaggatcag

SEQ ID NO: 2540607 - DNA, 21 bp, Homo sapiens
cccagtgcccacaggatcagt

SEQ ID NO: 2540608 - DNA, 15 bp, Homo sapiens
cccagtgccgagaag

SEQ ID NO: 2540609 - DNA, 16 bp, Homo sapiens
cccagtggccactcag

SEQ ID NO: 2540610 - DNA, 19 bp, Homo sapiens
cccagtgggaggggcaggc

SEQ ID NO: 2540611 - DNA, 21 bp, Homo sapiens
cccagtgggaggggcaggctg

SEQ ID NO: 2540612 - DNA, 22 bp, Homo sapiens
cccagtgtcaagttgtgcttgt

SEQ ID NO: 2540613 - DNA, 15 bp, Homo sapiens
cccagttgccatctg

SEQ ID NO: 2540614 - DNA, 14 bp, Homo sapiens
cccagttgggtgga

SEQ ID NO: 2540615 - DNA, 23 bp, Homo sapiens
cccataattttttttttcctttt

SEQ ID NO: 2540616 - DNA, 13 bp, Homo sapiens
cccatatttcatc

SEQ ID NO: 2540617 - DNA, 20 bp, Homo sapiens
cccatatttgtacaccaata

SEQ ID NO: 2540618 - DNA, 21 bp, Homo sapiens
cccatcacagggttgggccca

SEQ ID NO: 2540619 - DNA, 23 bp, Homo sapiens
cccatcagtgctccctcacatgt

SEQ ID NO: 2540620 - DNA, 12 bp, Homo sapiens
cccatcatccca

SEQ ID NO: 2540621 - DNA, 14 bp, Homo sapiens
cccatcatcccagc

SEQ ID NO: 2540622 - DNA, 12 bp, Homo sapiens
cccatcattcat

SEQ ID NO: 2540623 - DNA, 20 bp, Homo sapiens
cccatcattcatgctactgc

SEQ ID NO: 2540624 - DNA, 13 bp, Homo sapiens
cccatccaggcag

SEQ ID NO: 2540625 - DNA, 14 bp, Homo sapiens
cccatccaggcagt

SEQ ID NO: 2540626 - DNA, 20 bp, Homo sapiens
cccatccagtctcccaactt

SEQ ID NO: 2540627 - DNA, 15 bp, Homo sapiens
cccatcccacaccct

SEQ ID NO: 2540628 - DNA, 16 bp, Homo sapiens
cccatccccctgccct

SEQ ID NO: 2540629 - DNA, 19 bp, Homo sapiens
cccatcctaccaatgcatg

SEQ ID NO: 2540630 - DNA, 20 bp, Homo sapiens
cccatcctaccaatgcatgc

SEQ ID NO: 2540631 - DNA, 14 bp, Homo sapiens
cccatcctaccctc

SEQ ID NO: 2540632 - DNA, 23 bp, Homo sapiens
cccatcctaccctcgggcccacc

SEQ ID NO: 2540633 - DNA, 12 bp, Homo sapiens
cccatcctcccc

SEQ ID NO: 2540634 - DNA, 15 bp, Homo sapiens
cccatcctctgtaca

SEQ ID NO: 2540635 - DNA, 22 bp, Homo sapiens
cccatctgcacccccctgggct

SEQ ID NO: 2540636 - DNA, 18 bp, Homo sapiens
cccatgaagacaggacag

SEQ ID NO: 2540637 - DNA, 16 bp, Homo sapiens
cccatgaatcaaagac

SEQ ID NO: 2540638 - DNA, 19 bp, Homo sapiens
cccatgacccacccctgtg

SEQ ID NO: 2540639 - DNA, 23 bp, Homo sapiens
cccatgacccacccctgtgctcc

SEQ ID NO: 2540640 - DNA, 18 bp, Homo sapiens
cccatgcccacctgccca

SEQ ID NO: 2540641 - DNA, 14 bp, Homo sapiens
cccatgcctgtcca

SEQ ID NO: 2540642 - DNA, 13 bp, Homo sapiens
cccatgctgccct

SEQ ID NO: 2540643 - DNA, 14 bp, Homo sapiens
cccatgctgccctg

SEQ ID NO: 2540644 - DNA, 21 bp, Homo sapiens
cccatgctgttgattgctaaa

SEQ ID NO: 2540645 - DNA, 22 bp, Homo sapiens
cccatgctgttgattgctaaat

SEQ ID NO: 2540646 - DNA, 15 bp, Homo sapiens
cccatggacactcca

SEQ ID NO: 2540647 - DNA, 15 bp, Homo sapiens
cccatggagccccag

SEQ ID NO: 2540648 - DNA, 17 bp, Homo sapiens
cccatggcttaatgctt

SEQ ID NO: 2540649 - DNA, 17 bp, Homo sapiens
cccatgggctctgacag

SEQ ID NO: 2540650 - DNA, 17 bp, Homo sapiens
cccatgtaacagaaagg

SEQ ID NO: 2540651 - DNA, 23 bp, Homo sapiens
cccatgtatttatctctatttaa

SEQ ID NO: 2540652 - DNA, 21 bp, Homo sapiens
cccattaggacaatcagtccc

SEQ ID NO: 2540653 - DNA, 22 bp, Homo sapiens
cccattcattccattctggaag

SEQ ID NO: 2540654 - DNA, 14 bp, Homo sapiens
cccattcctgggaa

SEQ ID NO: 2540655 - DNA, 19 bp, Homo sapiens
cccattctacacagagcag

SEQ ID NO: 2540656 - DNA, 15 bp, Homo sapiens
cccattctgcctgcc

SEQ ID NO: 2540657 - DNA, 21 bp, Homo sapiens
cccattctgcctgcccaggcc

SEQ ID NO: 2540658 - DNA, 15 bp, Homo sapiens
cccattgtggctcct

SEQ ID NO: 2540659 - DNA, 22 bp, Homo sapiens
cccattgtggtcacaggaagta

SEQ ID NO: 2540660 - DNA, 16 bp, Homo sapiens
cccatttctatttatt

SEQ ID NO: 2540661 - DNA, 17 bp, Homo sapiens
cccatttctatttattt

SEQ ID NO: 2540662 - DNA, 19 bp, Homo sapiens
cccatttctatttatttac

SEQ ID NO: 2540663 - DNA, 14 bp, Homo sapiens
cccattttctgtgg

SEQ ID NO: 2540664 - DNA, 20 bp, Homo sapiens
ccccaaaaccacagccctgt

SEQ ID NO: 2540665 - DNA, 18 bp, Homo sapiens
ccccaaaactctcctctg

SEQ ID NO: 2540666 - DNA, 23 bp, Homo sapiens
ccccaaaactctcctctgctgct

SEQ ID NO: 2540667 - DNA, 18 bp, Homo sapiens
ccccaaacaccttccagc

SEQ ID NO: 2540668 - DNA, 11 bp, Homo sapiens
ccccaaatccg

SEQ ID NO: 2540669 - DNA, 13 bp, Homo sapiens
ccccaacccccac

SEQ ID NO: 2540670 - DNA, 13 bp, Homo sapiens
ccccaaccctgcc

SEQ ID NO: 2540671 - DNA, 17 bp, Homo sapiens
ccccaaccctgcccctg

SEQ ID NO: 2540672 - DNA, 16 bp, Homo sapiens
ccccaagaaagcctca

SEQ ID NO: 2540673 - DNA, 15 bp, Homo sapiens
ccccaaggagggaga

SEQ ID NO: 2540674 - DNA, 22 bp, Homo sapiens
ccccaagggcaaaattcccagg

SEQ ID NO: 2540675 - DNA, 15 bp, Homo sapiens
ccccaattccttgta

SEQ ID NO: 2540676 - DNA, 11 bp, Homo sapiens
ccccacacaca

SEQ ID NO: 2540677 - DNA, 14 bp, Homo sapiens
ccccacacctcagt

SEQ ID NO: 2540678 - DNA, 16 bp, Homo sapiens
ccccacacctcagttc

SEQ ID NO: 2540679 - DNA, 22 bp, Homo sapiens
ccccacacttgttccagctctt

SEQ ID NO: 2540680 - DNA, 14 bp, Homo sapiens
ccccacccaagggc

SEQ ID NO: 2540681 - DNA, 21 bp, Homo sapiens
ccccacccaagggcctggcct

SEQ ID NO: 2540682 - DNA, 20 bp, Homo sapiens
ccccacccccagctcaatgg

SEQ ID NO: 2540683 - DNA, 18 bp, Homo sapiens
ccccaccccttgctctca

SEQ ID NO: 2540684 - DNA, 14 bp, Homo sapiens
ccccaccctgggct

SEQ ID NO: 2540685 - DNA, 16 bp, Homo sapiens
ccccaccctgggctct

SEQ ID NO: 2540686 - DNA, 14 bp, Homo sapiens
ccccaccctttggg

SEQ ID NO: 2540687 - DNA, 11 bp, Homo sapiens
ccccacctggg

SEQ ID NO: 2540688 - DNA, 19 bp, Homo sapiens
ccccacggccgctccaggg

SEQ ID NO: 2540689 - DNA, 21 bp, Homo sapiens
ccccacggggcctcgggacct

SEQ ID NO: 2540690 - DNA, 14 bp, Homo sapiens
ccccactccccacc

SEQ ID NO: 2540691 - DNA, 21 bp, Homo sapiens
ccccactctaggggtcaggct

SEQ ID NO: 2540692 - DNA, 12 bp, Homo sapiens
ccccactctgtg

SEQ ID NO: 2540693 - DNA, 13 bp, Homo sapiens
ccccactctgtgc

SEQ ID NO: 2540694 - DNA, 15 bp, Homo sapiens
ccccactgacagcct

SEQ ID NO: 2540695 - DNA, 16 bp, Homo sapiens
ccccactgcctactgc

SEQ ID NO: 2540696 - DNA, 16 bp, Homo sapiens
ccccactgcctgccca

SEQ ID NO: 2540697 - DNA, 13 bp, Homo sapiens
ccccactggtgac

SEQ ID NO: 2540698 - DNA, 20 bp, Homo sapiens
ccccagaacctgtccttgca

SEQ ID NO: 2540699 - DNA, 18 bp, Homo sapiens
ccccagacaccgccacat

SEQ ID NO: 2540700 - DNA, 21 bp, Homo sapiens
ccccagagactcagagggagg

SEQ ID NO: 2540701 - DNA, 13 bp, Homo sapiens
ccccagagcactg

SEQ ID NO: 2540702 - DNA, 18 bp, Homo sapiens
ccccagataccagcccct

SEQ ID NO: 2540703 - DNA, 18 bp, Homo sapiens
ccccagatcaccagcccg

SEQ ID NO: 2540704 - DNA, 15 bp, Homo sapiens
ccccagattgcaaca

SEQ ID NO: 2540705 - DNA, 17 bp, Homo sapiens
ccccagcaagtgagagc

SEQ ID NO: 2540706 - DNA, 20 bp, Homo sapiens
ccccagcaagtgagagctgg

SEQ ID NO: 2540707 - DNA, 9 bp, Homo sapiens
ccccagcca

SEQ ID NO: 2540708 - DNA, 16 bp, Homo sapiens
ccccagcccaccctcc

SEQ ID NO: 2540709 - DNA, 20 bp, Homo sapiens
ccccagcccaccctcctgtc

SEQ ID NO: 2540710 - DNA, 10 bp, Homo sapiens
ccccagcccc

SEQ ID NO: 2540711 - DNA, 14 bp, Homo sapiens
ccccagccccatcc

SEQ ID NO: 2540712 - DNA, 13 bp, Homo sapiens
ccccagccctggc

SEQ ID NO: 2540713 - DNA, 14 bp, Homo sapiens
ccccagccctgtgg

SEQ ID NO: 2540714 - DNA, 21 bp, Homo sapiens
ccccagcctaagatgaagagg

SEQ ID NO: 2540715 - DNA, 15 bp, Homo sapiens
ccccagcctctggca

SEQ ID NO: 2540716 - DNA, 22 bp, Homo sapiens
ccccagctaccctttttctcca

SEQ ID NO: 2540717 - DNA, 17 bp, Homo sapiens
ccccagctctggcttcc

SEQ ID NO: 2540718 - DNA, 10 bp, Homo sapiens
ccccagctgg

SEQ ID NO: 2540719 - DNA, 21 bp, Homo sapiens
ccccagctgggaggcaagagg

SEQ ID NO: 2540720 - DNA, 12 bp, Homo sapiens
ccccaggaagcc

SEQ ID NO: 2540721 - DNA, 12 bp, Homo sapiens
ccccaggaggcc

SEQ ID NO: 2540722 - DNA, 14 bp, Homo sapiens
ccccaggcaggctg

SEQ ID NO: 2540723 - DNA, 23 bp, Homo sapiens
ccccaggcaggctgtgcgctgac

SEQ ID NO: 2540724 - DNA, 12 bp, Homo sapiens
ccccaggccccg

SEQ ID NO: 2540725 - DNA, 22 bp, Homo sapiens
ccccagggcacttcacagagtg

SEQ ID NO: 2540726 - DNA, 22 bp, Homo sapiens
ccccagggttgaggggaccaag

SEQ ID NO: 2540727 - DNA, 14 bp, Homo sapiens
ccccaggtgccagt

SEQ ID NO: 2540728 - DNA, 23 bp, Homo sapiens
ccccaggtgtgttggggccttgg

SEQ ID NO: 2540729 - DNA, 23 bp, Homo sapiens
ccccagtcagcctctctcccagt

SEQ ID NO: 2540730 - DNA, 14 bp, Homo sapiens
ccccagtgcccaca

SEQ ID NO: 2540731 - DNA, 15 bp, Homo sapiens
ccccagttctgctcc

SEQ ID NO: 2540732 - DNA, 19 bp, Homo sapiens
ccccagttctgctcctctc

SEQ ID NO: 2540733 - DNA, 20 bp, Homo sapiens
ccccagttctgctcctctcc

SEQ ID NO: 2540734 - DNA, 14 bp, Homo sapiens
ccccatatggtcat

SEQ ID NO: 2540735 - DNA, 19 bp, Homo sapiens
ccccatcaggactcttgtg

SEQ ID NO: 2540736 - DNA, 13 bp, Homo sapiens
ccccatcagtgct

SEQ ID NO: 2540737 - DNA, 14 bp, Homo sapiens
ccccatcctccagc

SEQ ID NO: 2540738 - DNA, 18 bp, Homo sapiens
ccccatcctccagcttct

SEQ ID NO: 2540739 - DNA, 13 bp, Homo sapiens
ccccatcctcccc

SEQ ID NO: 2540740 - DNA, 17 bp, Homo sapiens
ccccatcctccccttcc

SEQ ID NO: 2540741 - DNA, 14 bp, Homo sapiens
ccccatcctctgta

SEQ ID NO: 2540742 - DNA, 14 bp, Homo sapiens
ccccatctgtgaat

SEQ ID NO: 2540743 - DNA, 15 bp, Homo sapiens
ccccatgatgtaagt

SEQ ID NO: 2540744 - DNA, 15 bp, Homo sapiens
ccccatgcctgtcca

SEQ ID NO: 2540745 - DNA, 21 bp, Homo sapiens
ccccatgcctgtccagcctgg

SEQ ID NO: 2540746 - DNA, 22 bp, Homo sapiens
ccccatgcctgtccagcctggg

SEQ ID NO: 2540747 - DNA, 23 bp, Homo sapiens
ccccatgcctgtccagcctgggc

SEQ ID NO: 2540748 - DNA, 17 bp, Homo sapiens
ccctgagctgaggcagc

SEQ ID NO: 2540749 - DNA, 19 bp, Homo sapiens
ccctgagctgaggcagcag

SEQ ID NO: 2540750 - DNA, 21 bp, Homo sapiens
ccctgagctgaggcagcagtg

SEQ ID NO: 2540751 - DNA, 12 bp, Homo sapiens
ccctgaggccca

SEQ ID NO: 2540752 - DNA, 15 bp, Homo sapiens
ccctgaggcccagag

SEQ ID NO: 2540753 - DNA, 16 bp, Homo sapiens
ccctgaggcccagagg

SEQ ID NO: 2540754 - DNA, 19 bp, Homo sapiens
ccctgaggtgtgggggctg

SEQ ID NO: 2540755 - DNA, 23 bp, Homo sapiens
ccctgaggtgtgggggctgcagc

SEQ ID NO: 2540756 - DNA, 21 bp, Homo sapiens
ccctgagtggatctccaagga

SEQ ID NO: 2540757 - DNA, 22 bp, Homo sapiens
ccctgagtggatctccaaggac

SEQ ID NO: 2540758 - DNA, 18 bp, Homo sapiens
ccctgataacaacctgga

SEQ ID NO: 2540759 - DNA, 19 bp, Homo sapiens
ccctgataacaacctggag

SEQ ID NO: 2540760 - DNA, 20 bp, Homo sapiens
ccctgatcaagtcaccggag

SEQ ID NO: 2540761 - DNA, 22 bp, Homo sapiens
ccctgatctgacatccccactc

SEQ ID NO: 2540762 - DNA, 23 bp, Homo sapiens
ccctgcaaaatttgatgccagga

SEQ ID NO: 2540763 - DNA, 23 bp, Homo sapiens
ccctgcacaaagcccttccatgt

SEQ ID NO: 2540764 - DNA, 19 bp, Homo sapiens
ccctgcacttgcagactct

SEQ ID NO: 2540765 - DNA, 22 bp, Homo sapiens
ccctgcacttgcagactctaca

SEQ ID NO: 2540766 - DNA, 12 bp, Homo sapiens
ccctgcatcccc

SEQ ID NO: 2540767 - DNA, 12 bp, Homo sapiens
ccctgccaccct

SEQ ID NO: 2540768 - DNA, 14 bp, Homo sapiens
ccctgccaccctgg

SEQ ID NO: 2540769 - DNA, 15 bp, Homo sapiens
ccctgccaccctggg

SEQ ID NO: 2540770 - DNA, 12 bp, Homo sapiens
ccctgccagggc

SEQ ID NO: 2540771 - DNA, 14 bp, Homo sapiens
ccctgccagggcag

SEQ ID NO: 2540772 - DNA, 14 bp, Homo sapiens
ccctgcccacctgg

SEQ ID NO: 2540773 - DNA, 17 bp, Homo sapiens
ccctgcccacctggcct

SEQ ID NO: 2540774 - DNA, 18 bp, Homo sapiens
ccctgcccacctggcctc

SEQ ID NO: 2540775 - DNA, 12 bp, Homo sapiens
ccctgcccatgt

SEQ ID NO: 2540776 - DNA, 21 bp, Homo sapiens
ccctgccccgtcaccatctca

SEQ ID NO: 2540777 - DNA, 13 bp, Homo sapiens
ccctgcccctgcc

SEQ ID NO: 2540778 - DNA, 14 bp, Homo sapiens
ccctgccctagctc

SEQ ID NO: 2540779 - DNA, 14 bp, Homo sapiens
ccctgccctcccct

SEQ ID NO: 2540780 - DNA, 14 bp, Homo sapiens
ccctgccctcgtgg

SEQ ID NO: 2540781 - DNA, 19 bp, Homo sapiens
ccctgccctcgtggccagc

SEQ ID NO: 2540782 - DNA, 21 bp, Homo sapiens
ccctgccctgtgggcccccaa

SEQ ID NO: 2540783 - DNA, 12 bp, Homo sapiens
ccctgcctccac

SEQ ID NO: 2540784 - DNA, 14 bp, Homo sapiens
ccctgcctccaccc

SEQ ID NO: 2540785 - DNA, 21 bp, Homo sapiens
ccctgcctccaccctctgagc

SEQ ID NO: 2540786 - DNA, 22 bp, Homo sapiens
ccctgcctccaccctctgagct

SEQ ID NO: 2540787 - DNA, 14 bp, Homo sapiens
ccctgcctcctttg

SEQ ID NO: 2540788 - DNA, 16 bp, Homo sapiens
ccctgcctcctttgtg

SEQ ID NO: 2540789 - DNA, 16 bp, Homo sapiens
ccctgctcagtaaagc

SEQ ID NO: 2540790 - DNA, 19 bp, Homo sapiens
ccctgctccagaagatagc

SEQ ID NO: 2540791 - DNA, 13 bp, Homo sapiens
ccctgctcctccc

SEQ ID NO: 2540792 - DNA, 17 bp, Homo sapiens
ccctgctcctccctggc

SEQ ID NO: 2540793 - DNA, 22 bp, Homo sapiens
ccctgctcctccctggctgccc

SEQ ID NO: 2540794 - DNA, 21 bp, Homo sapiens
ccctgctctccgaccagacac

SEQ ID NO: 2540795 - DNA, 16 bp, Homo sapiens
ccctgctgcctcccca

SEQ ID NO: 2540796 - DNA, 13 bp, Homo sapiens
ccctgctggccgc

SEQ ID NO: 2540797 - DNA, 17 bp, Homo sapiens
ccctgctggccgcctca

SEQ ID NO: 2540798 - DNA, 21 bp, Homo sapiens
ccctgctggctcttctgccca

SEQ ID NO: 2540799 - DNA, 16 bp, Homo sapiens
ccctgctgggtgtggc

SEQ ID NO: 2540800 - DNA, 20 bp, Homo sapiens
ccctgctggttcagggttgg

SEQ ID NO: 2540801 - DNA, 12 bp, Homo sapiens
ccctggaagccg

SEQ ID NO: 2540802 - DNA, 14 bp, Homo sapiens
ccctggactgggag

SEQ ID NO: 2540803 - DNA, 13 bp, Homo sapiens
ccctggagagaag

SEQ ID NO: 2540804 - DNA, 13 bp, Homo sapiens
ccctggagagttc

SEQ ID NO: 2540805 - DNA, 21 bp, Homo sapiens
ccctggagagttcaatggctg

SEQ ID NO: 2540806 - DNA, 22 bp, Homo sapiens
ccctggagagttcaatggctgc

SEQ ID NO: 2540807 - DNA, 23 bp, Homo sapiens
ccctggagccagactctggtctt

SEQ ID NO: 2540808 - DNA, 15 bp, Homo sapiens
ccctggagtgcagtt

SEQ ID NO: 2540809 - DNA, 20 bp, Homo sapiens
ccctggccaccaccccccac

SEQ ID NO: 2540810 - DNA, 21 bp, Homo sapiens
ccctggcccagcggcccctcc

SEQ ID NO: 2540811 - DNA, 14 bp, Homo sapiens
ccctggccctgagg

SEQ ID NO: 2540812 - DNA, 21 bp, Homo sapiens
ccctggcctccggcgtcagcc

SEQ ID NO: 2540813 - DNA, 14 bp, Homo sapiens
ccctggctcccatg

SEQ ID NO: 2540814 - DNA, 19 bp, Homo sapiens
ccctggctctcagaaggta

SEQ ID NO: 2540815 - DNA, 13 bp, Homo sapiens
ccctggctctgca

SEQ ID NO: 2540816 - DNA, 14 bp, Homo sapiens
ccctggctgaagga

SEQ ID NO: 2540817 - DNA, 23 bp, Homo sapiens
ccctggctgaccccaaagagcct

SEQ ID NO: 2540818 - DNA, 14 bp, Homo sapiens
ccctggctgccctg

SEQ ID NO: 2540819 - DNA, 18 bp, Homo sapiens
ccctggctgccctggccc

SEQ ID NO: 2540820 - DNA, 20 bp, Homo sapiens
ccctggctgccctggccctg

SEQ ID NO: 2540821 - DNA, 22 bp, Homo sapiens
ccctggctgccctggccctgag

SEQ ID NO: 2540822 - DNA, 13 bp, Homo sapiens
ccctggggcctgg

SEQ ID NO: 2540823 - DNA, 21 bp, Homo sapiens
ccctggggctaggctggagcc

SEQ ID NO: 2540824 - DNA, 16 bp, Homo sapiens
ccctgggtgggtggtg

SEQ ID NO: 2540825 - DNA, 22 bp, Homo sapiens
ccctgggttcagaaatgctgcc

SEQ ID NO: 2540826 - DNA, 23 bp, Homo sapiens
ccctgggttcagaaatgctgcct

SEQ ID NO: 2540827 - DNA, 15 bp, Homo sapiens
ccctggtagggcagt

SEQ ID NO: 2540828 - DNA, 13 bp, Homo sapiens
ccctggtccttcc

SEQ ID NO: 2540829 - DNA, 16 bp, Homo sapiens
ccctggtccttccagg

SEQ ID NO: 2540830 - DNA, 17 bp, Homo sapiens
ccctggtctcagcagcg

SEQ ID NO: 2540831 - DNA, 14 bp, Homo sapiens
ccctggtctctggt

SEQ ID NO: 2540832 - DNA, 15 bp, Homo sapiens
ccctggtggcagctc

SEQ ID NO: 2540833 - DNA, 21 bp, Homo sapiens
ccctggtggcagctcacctct

SEQ ID NO: 2540834 - DNA, 16 bp, Homo sapiens
ccctggtggcagtggg

SEQ ID NO: 2540835 - DNA, 19 bp, Homo sapiens
ccctggtggcagtgggagc

SEQ ID NO: 2540836 - DNA, 18 bp, Homo sapiens
ccctgtacaatatttaaa

SEQ ID NO: 2540837 - DNA, 21 bp, Homo sapiens
ccctgtagagtgggagctgag

SEQ ID NO: 2540838 - DNA, 17 bp, Homo sapiens
ccctgtcagtgcagccc

SEQ ID NO: 2540839 - DNA, 22 bp, Homo sapiens
ccctgtcagtgcagcccgtgtg

SEQ ID NO: 2540840 - DNA, 19 bp, Homo sapiens
ccctgtcccccagctctgg

SEQ ID NO: 2540841 - DNA, 13 bp, Homo sapiens
ccctgtccctcta

SEQ ID NO: 2540842 - DNA, 22 bp, Homo sapiens
ccctgtcctgatggtcagctcc

SEQ ID NO: 2540843 - DNA, 15 bp, Homo sapiens
ccctgtcgagacact

SEQ ID NO: 2540844 - DNA, 20 bp, Homo sapiens
ccctgtctcaaaaaaagaaa

SEQ ID NO: 2540845 - DNA, 14 bp, Homo sapiens
ccctgtctctacta

SEQ ID NO: 2540846 - DNA, 20 bp, Homo sapiens
ccctgtctgtagagggccct

SEQ ID NO: 2540847 - DNA, 17 bp, Homo sapiens
ccctgtgatggggccct

SEQ ID NO: 2540848 - DNA, 18 bp, Homo sapiens
ccctgtgatggggccctg

SEQ ID NO: 2540849 - DNA, 21 bp, Homo sapiens
ccctgtgatggggccctgcct

SEQ ID NO: 2540850 - DNA, 20 bp, Homo sapiens
ccctgtgcctaacaccagcg

SEQ ID NO: 2540851 - DNA, 20 bp, Homo sapiens
ccctgtgctccgtgcctcca

SEQ ID NO: 2540852 - DNA, 22 bp, Homo sapiens
ccctgtgctggtgtcctgacca

SEQ ID NO: 2540853 - DNA, 23 bp, Homo sapiens
ccctgtgctggtgtcctgaccac

SEQ ID NO: 2540854 - DNA, 16 bp, Homo sapiens
ccctgtgggcccccaa

SEQ ID NO: 2540855 - DNA, 12 bp, Homo sapiens
ccctgtggggat

SEQ ID NO: 2540856 - DNA, 23 bp, Homo sapiens
ccctgtggggatctcaggggctg

SEQ ID NO: 2540857 - DNA, 20 bp, Homo sapiens
ccctgttgacgaagtctctt

SEQ ID NO: 2540858 - DNA, 19 bp, Homo sapiens
ccctgtttaatatttaaac

SEQ ID NO: 2540859 - DNA, 16 bp, Homo sapiens
ccctgtttgtttctga

SEQ ID NO: 2540860 - DNA, 14 bp, Homo sapiens
ccctgttttatact

SEQ ID NO: 2540861 - DNA, 20 bp, Homo sapiens
ccctgttttctgagcccggg

SEQ ID NO: 2540862 - DNA, 14 bp, Homo sapiens
cccttacacttact

SEQ ID NO: 2540863 - DNA, 14 bp, Homo sapiens
cccttacagtagga

SEQ ID NO: 2540864 - DNA, 17 bp, Homo sapiens
cccttaccccttagcct

SEQ ID NO: 2540865 - DNA, 14 bp, Homo sapiens
cccttagcagggaa

SEQ ID NO: 2540866 - DNA, 23 bp, Homo sapiens
cccttagcagggaaacagctaat

SEQ ID NO: 2540867 - DNA, 15 bp, Homo sapiens
cccttatcaccagct

SEQ ID NO: 2540868 - DNA, 15 bp, Homo sapiens
cccttatccaggact

SEQ ID NO: 2540869 - DNA, 12 bp, Homo sapiens
cccttatttcct

SEQ ID NO: 2540870 - DNA, 18 bp, Homo sapiens
cccttcactgcctttgct

SEQ ID NO: 2540871 - DNA, 17 bp, Homo sapiens
cccttcagtaccctctc

SEQ ID NO: 2540872 - DNA, 16 bp, Homo sapiens
cccttcatgcatggaa

SEQ ID NO: 2540873 - DNA, 11 bp, Homo sapiens
cccttcatttg

SEQ ID NO: 2540874 - DNA, 12 bp, Homo sapiens
cccttccatgga

SEQ ID NO: 2540875 - DNA, 20 bp, Homo sapiens
cccttccatgtcgcctctgc

SEQ ID NO: 2540876 - DNA, 14 bp, Homo sapiens
cccttcccacagga

SEQ ID NO: 2540877 - DNA, 16 bp, Homo sapiens
cccttcccactggagg

SEQ ID NO: 2540878 - DNA, 11 bp, Homo sapiens
cccttccccat

SEQ ID NO: 2540879 - DNA, 13 bp, Homo sapiens
cccttccctgtcc

SEQ ID NO: 2540880 - DNA, 14 bp, Homo sapiens
cccttccctgtccc

SEQ ID NO: 2540881 - DNA, 16 bp, Homo sapiens
cccttctacctgccac

SEQ ID NO: 2540882 - DNA, 23 bp, Homo sapiens
cccttctccatccacatgggagc

SEQ ID NO: 2540883 - DNA, 14 bp, Homo sapiens
cccttctcccacac

SEQ ID NO: 2540884 - DNA, 19 bp, Homo sapiens
cccttctctccagcccctg

SEQ ID NO: 2540885 - DNA, 21 bp, Homo sapiens
cccttctctccagcccctgga

SEQ ID NO: 2540886 - DNA, 22 bp, Homo sapiens
cccttctctccagcccctggat

SEQ ID NO: 2540887 - DNA, 14 bp, Homo sapiens
cccttctctgctcc

SEQ ID NO: 2540888 - DNA, 23 bp, Homo sapiens
cccttctctgctccaccacatcc

SEQ ID NO: 2540889 - DNA, 23 bp, Homo sapiens
cccttctctgtagggaactctgg

SEQ ID NO: 2540890 - DNA, 21 bp, Homo sapiens
cccttctgacccatgctgccc

SEQ ID NO: 2540891 - DNA, 17 bp, Homo sapiens
cccttgagccctctatg

SEQ ID NO: 2540892 - DNA, 19 bp, Homo sapiens
cccttgcagctagttttct

SEQ ID NO: 2540893 - DNA, 24 bp, Homo sapiens
cctcacagtccttaccagcagagc

SEQ ID NO: 2540894 - DNA, 16 bp, Homo sapiens
cctcacatctttcaca

SEQ ID NO: 2540895 - DNA, 17 bp, Homo sapiens
cctcacccccagctttg

SEQ ID NO: 2540896 - DNA, 16 bp, Homo sapiens
cctcacccctgccctg

SEQ ID NO: 2540897 - DNA, 11 bp, Homo sapiens
cctcaccctgc

SEQ ID NO: 2540898 - DNA, 18 bp, Homo sapiens
cctcacctctggactggc

SEQ ID NO: 2540899 - DNA, 22 bp, Homo sapiens
cctcacctctggactggctaga

SEQ ID NO: 2540900 - DNA, 16 bp, Homo sapiens
cctcacctgagagcca

SEQ ID NO: 2540901 - DNA, 14 bp, Homo sapiens
cctcacctgggcac

SEQ ID NO: 2540902 - DNA, 19 bp, Homo sapiens
cctcacctgggcacctggg

SEQ ID NO: 2540903 - DNA, 19 bp, Homo sapiens
cctcaccttgcaacacaca

SEQ ID NO: 2540904 - DNA, 22 bp, Homo sapiens
cctcaccttgcaacacacagac

SEQ ID NO: 2540905 - DNA, 17 bp, Homo sapiens
cctcacctttcccatct

SEQ ID NO: 2540906 - DNA, 17 bp, Homo sapiens
cctcacgcacctcccat

SEQ ID NO: 2540907 - DNA, 14 bp, Homo sapiens
cctcactcccttct

SEQ ID NO: 2540908 - DNA, 20 bp, Homo sapiens
cctcactcccttctacctgc

SEQ ID NO: 2540909 - DNA, 21 bp, Homo sapiens
cctcactcccttctacctgcc

SEQ ID NO: 2540910 - DNA, 13 bp, Homo sapiens
cctcactcctgtt

SEQ ID NO: 2540911 - DNA, 20 bp, Homo sapiens
cctcactggggtcctggggc

SEQ ID NO: 2540912 - DNA, 12 bp, Homo sapiens
cctcactgggtg

SEQ ID NO: 2540913 - DNA, 21 bp, Homo sapiens
cctcagaaacactggggctgg

SEQ ID NO: 2540914 - DNA, 21 bp, Homo sapiens
cctcagaacaaagtgagacag

SEQ ID NO: 2540915 - DNA, 15 bp, Homo sapiens
cctcagagtccaggc

SEQ ID NO: 2540916 - DNA, 18 bp, Homo sapiens
cctcagagtccaggcccc

SEQ ID NO: 2540917 - DNA, 13 bp, Homo sapiens
cctcagcacccct

SEQ ID NO: 2540918 - DNA, 16 bp, Homo sapiens
cctcagcaccccttcc

SEQ ID NO: 2540919 - DNA, 22 bp, Homo sapiens
cctcagcaccccttccatgtgg

SEQ ID NO: 2540920 - DNA, 17 bp, Homo sapiens
cctcagcatcctggcac

SEQ ID NO: 2540921 - DNA, 23 bp, Homo sapiens
cctcagccattcactgcccccag

SEQ ID NO: 2540922 - DNA, 13 bp, Homo sapiens
cctcagcccctct

SEQ ID NO: 2540923 - DNA, 14 bp, Homo sapiens
cctcagcccctctt

SEQ ID NO: 2540924 - DNA, 23 bp, Homo sapiens
cctcagcctcccaaagtgctggg

SEQ ID NO: 2540925 - DNA, 15 bp, Homo sapiens
cctcagcctcctgag

SEQ ID NO: 2540926 - DNA, 17 bp, Homo sapiens
cctcagctctgggagag

SEQ ID NO: 2540927 - DNA, 16 bp, Homo sapiens
cctcagctgcctcact

SEQ ID NO: 2540928 - DNA, 18 bp, Homo sapiens
cctcagctgcctcacttc

SEQ ID NO: 2540929 - DNA, 16 bp, Homo sapiens
cctcaggaatgggctg

SEQ ID NO: 2540930 - DNA, 18 bp, Homo sapiens
cctcaggacaatgtctga

SEQ ID NO: 2540931 - DNA, 19 bp, Homo sapiens
cctcaggcaggaagggcag

SEQ ID NO: 2540932 - DNA, 18 bp, Homo sapiens
cctcaggcaggtgggatg

SEQ ID NO: 2540933 - DNA, 14 bp, Homo sapiens
cctcagggtccctg

SEQ ID NO: 2540934 - DNA, 22 bp, Homo sapiens
cctcagggtccctggtggcagc

SEQ ID NO: 2540935 - DNA, 19 bp, Homo sapiens
cctcaggtcagggtgagga

SEQ ID NO: 2540936 - DNA, 20 bp, Homo sapiens
cctcaggtgagaagcagagg

SEQ ID NO: 2540937 - DNA, 18 bp, Homo sapiens
cctcaggttgctggttgc

SEQ ID NO: 2540938 - DNA, 18 bp, Homo sapiens
cctcagtggactttccac

SEQ ID NO: 2540939 - DNA, 20 bp, Homo sapiens
cctcagtggactttccaccc

SEQ ID NO: 2540940 - DNA, 23 bp, Homo sapiens
cctcagtggactttccaccccct

SEQ ID NO: 2540941 - DNA, 12 bp, Homo sapiens
cctcagtgtcat

SEQ ID NO: 2540942 - DNA, 23 bp, Homo sapiens
cctcagtgtcatttatgaaaaga

SEQ ID NO: 2540943 - DNA, 16 bp, Homo sapiens
cctcagttcccttggc

SEQ ID NO: 2540944 - DNA, 19 bp, Homo sapiens
cctcagttcccttggcctc

SEQ ID NO: 2540945 - DNA, 21 bp, Homo sapiens
cctcagttcccttggcctcag

SEQ ID NO: 2540946 - DNA, 21 bp, Homo sapiens
cctcatagtatggtggctggg

SEQ ID NO: 2540947 - DNA, 13 bp, Homo sapiens
cctcatatttaaa

SEQ ID NO: 2540948 - DNA, 13 bp, Homo sapiens
cctcatcaggatg

SEQ ID NO: 2540949 - DNA, 21 bp, Homo sapiens
cctcatcaggatgaacccagg

SEQ ID NO: 2540950 - DNA, 22 bp, Homo sapiens
cctcatccaccccatccctccc

SEQ ID NO: 2540951 - DNA, 23 bp, Homo sapiens
cctcatccagggctctgaccagt

SEQ ID NO: 2540952 - DNA, 17 bp, Homo sapiens
cctcatccgaggcaggg

SEQ ID NO: 2540953 - DNA, 21 bp, Homo sapiens
cctcatcgcgtcctcctaccg

SEQ ID NO: 2540954 - DNA, 17 bp, Homo sapiens
cctcatcttcttcacca

SEQ ID NO: 2540955 - DNA, 18 bp, Homo sapiens
cctcatcttcttcaccat

SEQ ID NO: 2540956 - DNA, 15 bp, Homo sapiens
cctcatgcatctcca

SEQ ID NO: 2540957 - DNA, 15 bp, Homo sapiens
cctcatggcccctct

SEQ ID NO: 2540958 - DNA, 16 bp, Homo sapiens
cctcatggcccctctg

SEQ ID NO: 2540959 - DNA, 19 bp, Homo sapiens
cctcatgttcttaattctt

SEQ ID NO: 2540960 - DNA, 17 bp, Homo sapiens
cctcattaatgacactt

SEQ ID NO: 2540961 - DNA, 13 bp, Homo sapiens
cctcattcctgaa

SEQ ID NO: 2540962 - DNA, 22 bp, Homo sapiens
cctcatttcaggagcagcctca

SEQ ID NO: 2540963 - DNA, 15 bp, Homo sapiens
cctccaaaagcactt

SEQ ID NO: 2540964 - DNA, 17 bp, Homo sapiens
cctccaagaccttctcc

SEQ ID NO: 2540965 - DNA, 20 bp, Homo sapiens
cctccaaggaggggctgtaa

SEQ ID NO: 2540966 - DNA, 21 bp, Homo sapiens
cctccaaggaggggctgtaaa

SEQ ID NO: 2540967 - DNA, 15 bp, Homo sapiens
cctccaatcctgccc

SEQ ID NO: 2540968 - DNA, 16 bp, Homo sapiens
cctccaatcctgcccc

SEQ ID NO: 2540969 - DNA, 15 bp, Homo sapiens
cctccacagccgcag

SEQ ID NO: 2540970 - DNA, 14 bp, Homo sapiens
cctccacatcctcc

SEQ ID NO: 2540971 - DNA, 17 bp, Homo sapiens
cctccaccccccagaac

SEQ ID NO: 2540972 - DNA, 16 bp, Homo sapiens
cctccaccctctgagc

SEQ ID NO: 2540973 - DNA, 20 bp, Homo sapiens
cctccaccctctgagctttg

SEQ ID NO: 2540974 - DNA, 14 bp, Homo sapiens
cctccaccctgtcc

SEQ ID NO: 2540975 - DNA, 20 bp, Homo sapiens
cctccaccctgtcccccagc

SEQ ID NO: 2540976 - DNA, 24 bp, Homo sapiens
cctccaccctgtcccccagctctg

SEQ ID NO: 2540977 - DNA, 14 bp, Homo sapiens
cctccacctcttca

SEQ ID NO: 2540978 - DNA, 21 bp, Homo sapiens
cctccacgttctgctcatcat

SEQ ID NO: 2540979 - DNA, 13 bp, Homo sapiens
cctccagcctctg

SEQ ID NO: 2540980 - DNA, 20 bp, Homo sapiens
cctccagcttcaggcaggcc

SEQ ID NO: 2540981 - DNA, 21 bp, Homo sapiens
cctccagcttgtggagcccca

SEQ ID NO: 2540982 - DNA, 22 bp, Homo sapiens
cctccaggaatgatctcttctt

SEQ ID NO: 2540983 - DNA, 11 bp, Homo sapiens
cctccaggttt

SEQ ID NO: 2540984 - DNA, 19 bp, Homo sapiens
cctccatattttctttaaa

SEQ ID NO: 2540985 - DNA, 14 bp, Homo sapiens
cctccatcccgaca

SEQ ID NO: 2540986 - DNA, 15 bp, Homo sapiens
cctccatcccgacat

SEQ ID NO: 2540987 - DNA, 14 bp, Homo sapiens
cctccatgctgcct

SEQ ID NO: 2540988 - DNA, 23 bp, Homo sapiens
cctcccaaagtgctgggattaca

SEQ ID NO: 2540989 - DNA, 20 bp, Homo sapiens
cctcccaactcaccccagcc

SEQ ID NO: 2540990 - DNA, 23 bp, Homo sapiens
cctcccaactcaccccagcccca

SEQ ID NO: 2540991 - DNA, 17 bp, Homo sapiens
cctcccaagtggtgcct

SEQ ID NO: 2540992 - DNA, 12 bp, Homo sapiens
cctcccaccaca

SEQ ID NO: 2540993 - DNA, 14 bp, Homo sapiens
cctcccaccacagc

SEQ ID NO: 2540994 - DNA, 15 bp, Homo sapiens
cctcccaccacagca

SEQ ID NO: 2540995 - DNA, 13 bp, Homo sapiens
cctcccacccacc

SEQ ID NO: 2540996 - DNA, 16 bp, Homo sapiens
cctcccacccaccgcc

SEQ ID NO: 2540997 - DNA, 13 bp, Homo sapiens
cctcccaccccct

SEQ ID NO: 2540998 - DNA, 17 bp, Homo sapiens
cctcccagaacacactc

SEQ ID NO: 2540999 - DNA, 19 bp, Homo sapiens
cctcccagccctatggatg

SEQ ID NO: 2541000 - DNA, 20 bp, Homo sapiens
cctcccagccctatggatgt

SEQ ID NO: 2541001 - DNA, 15 bp, Homo sapiens
cctcccaggctctca

SEQ ID NO: 2541002 - DNA, 21 bp, Homo sapiens
cctcccagggccagggccctg

SEQ ID NO: 2541003 - DNA, 14 bp, Homo sapiens
cctcccatcccctg

SEQ ID NO: 2541004 - DNA, 17 bp, Homo sapiens
cctccccagcaggtggg

SEQ ID NO: 2541005 - DNA, 20 bp, Homo sapiens
cctccccagcaggtggggag

SEQ ID NO: 2541006 - DNA, 12 bp, Homo sapiens
cctccccagctc

SEQ ID NO: 2541007 - DNA, 14 bp, Homo sapiens
cctccccctgccag

SEQ ID NO: 2541008 - DNA, 22 bp, Homo sapiens
cctcccccttctcccacccctg

SEQ ID NO: 2541009 - DNA, 15 bp, Homo sapiens
cctccccgcaccccc

SEQ ID NO: 2541010 - DNA, 14 bp, Homo sapiens
cctccccggcccta

SEQ ID NO: 2541011 - DNA, 23 bp, Homo sapiens
cctccccggctcgagcagtcctg

SEQ ID NO: 2541012 - DNA, 16 bp, Homo sapiens
cctcccctctcttgca

SEQ ID NO: 2541013 - DNA, 23 bp, Homo sapiens
cctcccctctcttgcacccgcct

SEQ ID NO: 2541014 - DNA, 22 bp, Homo sapiens
cctcccctgaggctcagggaaa

SEQ ID NO: 2541015 - DNA, 12 bp, Homo sapiens
cctcccctgcca

SEQ ID NO: 2541016 - DNA, 13 bp, Homo sapiens
cctcccctgccag

SEQ ID NO: 2541017 - DNA, 16 bp, Homo sapiens
cctcccctgccctggt

SEQ ID NO: 2541018 - DNA, 17 bp, Homo sapiens
cctccccttccctgcaa

SEQ ID NO: 2541019 - DNA, 14 bp, Homo sapiens
cctccccttgggcg

SEQ ID NO: 2541020 - DNA, 17 bp, Homo sapiens
cctcccgaatagctggg

SEQ ID NO: 2541021 - DNA, 18 bp, Homo sapiens
cctcccgaatagctggga

SEQ ID NO: 2541022 - DNA, 18 bp, Homo sapiens
cctcccgccccttcccac

SEQ ID NO: 2541023 - DNA, 20 bp, Homo sapiens
cctccctcagcccctcttgc

SEQ ID NO: 2541024 - DNA, 21 bp, Homo sapiens
cctccctcctgccgactcctg

SEQ ID NO: 2541025 - DNA, 13 bp, Homo sapiens
cctccctctaatt

SEQ ID NO: 2541026 - DNA, 18 bp, Homo sapiens
cctccctctctcttctgc

SEQ ID NO: 2541027 - DNA, 21 bp, Homo sapiens
cctccctctgaggctgtagga

SEQ ID NO: 2541028 - DNA, 20 bp, Homo sapiens
cctccctgaaccatccctga

SEQ ID NO: 2541029 - DNA, 12 bp, Homo sapiens
cctccctggagt

SEQ ID NO: 2541030 - DNA, 14 bp, Homo sapiens
cctccctggcctgt

SEQ ID NO: 2541031 - DNA, 20 bp, Homo sapiens
cctccctggctcccatgacc

SEQ ID NO: 2541032 - DNA, 14 bp, Homo sapiens
cctccctggctgcc

SEQ ID NO: 2541033 - DNA, 15 bp, Homo sapiens
cctccctggctgccc

SEQ ID NO: 2541034 - DNA, 20 bp, Homo sapiens
cctccctggctgccctggcc

SEQ ID NO: 2541035 - DNA, 10 bp, Homo sapiens
cctccctggg

SEQ ID NO: 2541036 - DNA, 13 bp, Homo sapiens
cctccctgggttc

SEQ ID NO: 2541037 - DNA, 12 bp, Homo sapiens
cctccctgtcaa

SEQ ID NO: 2541038 - DNA, 16 bp, Homo sapiens
cctgattttttttcct

SEQ ID NO: 2541039 - DNA, 18 bp, Homo sapiens
cctgcaaaatgagaccct

SEQ ID NO: 2541040 - DNA, 17 bp, Homo sapiens
cctgcaaactcactgct

SEQ ID NO: 2541041 - DNA, 16 bp, Homo sapiens
cctgcaacctgattgt

SEQ ID NO: 2541042 - DNA, 21 bp, Homo sapiens
cctgcaacctgattgtgtctc

SEQ ID NO: 2541043 - DNA, 12 bp, Homo sapiens
cctgcaaggact

SEQ ID NO: 2541044 - DNA, 20 bp, Homo sapiens
cctgcaatgaagtctctgaa

SEQ ID NO: 2541045 - DNA, 23 bp, Homo sapiens
cctgcacaaagcccttccatgtc

SEQ ID NO: 2541046 - DNA, 14 bp, Homo sapiens
cctgcacctgtgca

SEQ ID NO: 2541047 - DNA, 16 bp, Homo sapiens
cctgcacggtgggcct

SEQ ID NO: 2541048 - DNA, 19 bp, Homo sapiens
cctgcacggtgggccttgc

SEQ ID NO: 2541049 - DNA, 21 bp, Homo sapiens
cctgcacggtgggccttgctg

SEQ ID NO: 2541050 - DNA, 23 bp, Homo sapiens
cctgcacggtgggccttgctggg

SEQ ID NO: 2541051 - DNA, 21 bp, Homo sapiens
cctgcactaatttgatgttta

SEQ ID NO: 2541052 - DNA, 20 bp, Homo sapiens
cctgcactggagtccagtct

SEQ ID NO: 2541053 - DNA, 23 bp, Homo sapiens
cctgcactggagtccagtctctt

SEQ ID NO: 2541054 - DNA, 18 bp, Homo sapiens
cctgcacttgcagactct

SEQ ID NO: 2541055 - DNA, 19 bp, Homo sapiens
cctgcacttgcagactcta

SEQ ID NO: 2541056 - DNA, 22 bp, Homo sapiens
cctgcacttgcagactctacag

SEQ ID NO: 2541057 - DNA, 12 bp, Homo sapiens
cctgcaggcagc

SEQ ID NO: 2541058 - DNA, 14 bp, Homo sapiens
cctgcaggcagcca

SEQ ID NO: 2541059 - DNA, 15 bp, Homo sapiens
cctgcaggcagccag

SEQ ID NO: 2541060 - DNA, 16 bp, Homo sapiens
cctgcaggccaagagc

SEQ ID NO: 2541061 - DNA, 21 bp, Homo sapiens
cctgcaggccaagagcagagg

SEQ ID NO: 2541062 - DNA, 22 bp, Homo sapiens
cctgcaggccaagagcagaggc

SEQ ID NO: 2541063 - DNA, 20 bp, Homo sapiens
cctgcagggtggtgctggga

SEQ ID NO: 2541064 - DNA, 15 bp, Homo sapiens
cctgcaggtgctgct

SEQ ID NO: 2541065 - DNA, 15 bp, Homo sapiens
cctgcagtcatcttg

SEQ ID NO: 2541066 - DNA, 15 bp, Homo sapiens
cctgcattcacccag

SEQ ID NO: 2541067 - DNA, 17 bp, Homo sapiens
cctgcattcacccagac

SEQ ID NO: 2541068 - DNA, 19 bp, Homo sapiens
cctgcattcacccagacag

SEQ ID NO: 2541069 - DNA, 14 bp, Homo sapiens
cctgcatttctgag

SEQ ID NO: 2541070 - DNA, 23 bp, Homo sapiens
cctgcatttgtgaaatgatggtg

SEQ ID NO: 2541071 - DNA, 12 bp, Homo sapiens
cctgccacagcc

SEQ ID NO: 2541072 - DNA, 19 bp, Homo sapiens
cctgccaccagtcactgtc

SEQ ID NO: 2541073 - DNA, 12 bp, Homo sapiens
cctgccaccctg

SEQ ID NO: 2541074 - DNA, 13 bp, Homo sapiens
cctgccaccctgg

SEQ ID NO: 2541075 - DNA, 16 bp, Homo sapiens
cctgccaccctgggga

SEQ ID NO: 2541076 - DNA, 14 bp, Homo sapiens
cctgccactcacac

SEQ ID NO: 2541077 - DNA, 20 bp, Homo sapiens
cctgccactcacacagccag

SEQ ID NO: 2541078 - DNA, 23 bp, Homo sapiens
cctgccactttggtacatggcca

SEQ ID NO: 2541079 - DNA, 11 bp, Homo sapiens
cctgccaggga

SEQ ID NO: 2541080 - DNA, 19 bp, Homo sapiens
cctgccagggagacagagc

SEQ ID NO: 2541081 - DNA, 19 bp, Homo sapiens
cctgccagggcagggcccc

SEQ ID NO: 2541082 - DNA, 14 bp, Homo sapiens
cctgccagtcctag

SEQ ID NO: 2541083 - DNA, 14 bp, Homo sapiens
cctgcccacctggc

SEQ ID NO: 2541084 - DNA, 19 bp, Homo sapiens
cctgcccacctggcctctg

SEQ ID NO: 2541085 - DNA, 20 bp, Homo sapiens
cctgcccacctggcctctgc

SEQ ID NO: 2541086 - DNA, 19 bp, Homo sapiens
cctgcccaggcccctgcca

SEQ ID NO: 2541087 - DNA, 16 bp, Homo sapiens
cctgcccatgggagct

SEQ ID NO: 2541088 - DNA, 17 bp, Homo sapiens
cctgccccagggctccc

SEQ ID NO: 2541089 - DNA, 15 bp, Homo sapiens
cctgcccccaaataa

SEQ ID NO: 2541090 - DNA, 14 bp, Homo sapiens
cctgcccccacttc

SEQ ID NO: 2541091 - DNA, 15 bp, Homo sapiens
cctgcccccacttcc

SEQ ID NO: 2541092 - DNA, 15 bp, Homo sapiens
cctgccccctgaaac

SEQ ID NO: 2541093 - DNA, 14 bp, Homo sapiens
cctgccccctggtg

SEQ ID NO: 2541094 - DNA, 16 bp, Homo sapiens
cctgccccctggtgga

SEQ ID NO: 2541095 - DNA, 12 bp, Homo sapiens
cctgcccccttc

SEQ ID NO: 2541096 - DNA, 17 bp, Homo sapiens
cctgcccccttctccca

SEQ ID NO: 2541097 - DNA, 20 bp, Homo sapiens
cctgcccccttctcccacac

SEQ ID NO: 2541098 - DNA, 21 bp, Homo sapiens
cctgcccccttctcccacact

SEQ ID NO: 2541099 - DNA, 23 bp, Homo sapiens
cctgccccgtcaccatctcaggc

SEQ ID NO: 2541100 - DNA, 17 bp, Homo sapiens
cctgcccgtctctctcc

SEQ ID NO: 2541101 - DNA, 23 bp, Homo sapiens
cctgcccgtctctctcccatgga

SEQ ID NO: 2541102 - DNA, 24 bp, Homo sapiens
cctgccctagagcacactgtagca

SEQ ID NO: 2541103 - DNA, 21 bp, Homo sapiens
cctgccctcatggcccctctg

SEQ ID NO: 2541104 - DNA, 15 bp, Homo sapiens
cctgccctccccaga

SEQ ID NO: 2541105 - DNA, 19 bp, Homo sapiens
cctgccctccccagagcac

SEQ ID NO: 2541106 - DNA, 16 bp, Homo sapiens
cctgccctcgtggcca

SEQ ID NO: 2541107 - DNA, 20 bp, Homo sapiens
cctgccctcgtggccagccc

SEQ ID NO: 2541108 - DNA, 15 bp, Homo sapiens
cctgccctgtgggcc

SEQ ID NO: 2541109 - DNA, 15 bp, Homo sapiens
cctgcccttgtccca

SEQ ID NO: 2541110 - DNA, 16 bp, Homo sapiens
cctgcccttgtcccac

SEQ ID NO: 2541111 - DNA, 14 bp, Homo sapiens
cctgccgactcctg

SEQ ID NO: 2541112 - DNA, 23 bp, Homo sapiens
cctgccgtggacttggggtcaga

SEQ ID NO: 2541113 - DNA, 13 bp, Homo sapiens
cctgcctcagcct

SEQ ID NO: 2541114 - DNA, 13 bp, Homo sapiens
cctgcctccaccc

SEQ ID NO: 2541115 - DNA, 18 bp, Homo sapiens
cctgcctccaccctctga

SEQ ID NO: 2541116 - DNA, 13 bp, Homo sapiens
cctgcctcctttg

SEQ ID NO: 2541117 - DNA, 20 bp, Homo sapiens
cctgcctcctttgtgaggaa

SEQ ID NO: 2541118 - DNA, 23 bp, Homo sapiens
cctgcctcgaactggctgcaaag

SEQ ID NO: 2541119 - DNA, 14 bp, Homo sapiens
cctgcctgagggcc

SEQ ID NO: 2541120 - DNA, 14 bp, Homo sapiens
cctgcctggcaggc

SEQ ID NO: 2541121 - DNA, 11 bp, Homo sapiens
cctgcctggcc

SEQ ID NO: 2541122 - DNA, 14 bp, Homo sapiens
cctgcctggccagg

SEQ ID NO: 2541123 - DNA, 18 bp, Homo sapiens
cctgcctggccaggcaga

SEQ ID NO: 2541124 - DNA, 13 bp, Homo sapiens
cctgcctgtctgt

SEQ ID NO: 2541125 - DNA, 17 bp, Homo sapiens
cctgccttcctcctggg

SEQ ID NO: 2541126 - DNA, 21 bp, Homo sapiens
cctgccttctgtcctggtgtc

SEQ ID NO: 2541127 - DNA, 23 bp, Homo sapiens
cctgccttgaagccactgaagct

SEQ ID NO: 2541128 - DNA, 19 bp, Homo sapiens
cctgcgaaggggccctggt

SEQ ID NO: 2541129 - DNA, 20 bp, Homo sapiens
cctgcgaaggggccctggtc

SEQ ID NO: 2541130 - DNA, 14 bp, Homo sapiens
cctgcgcgcatgtg

SEQ ID NO: 2541131 - DNA, 22 bp, Homo sapiens
cctgcggtgctatctcccccag

SEQ ID NO: 2541132 - DNA, 12 bp, Homo sapiens
cctgcgtgggga

SEQ ID NO: 2541133 - DNA, 17 bp, Homo sapiens
cctgcgtggggacaggg

SEQ ID NO: 2541134 - DNA, 22 bp, Homo sapiens
cctgcgttttggaagctctgaa

SEQ ID NO: 2541135 - DNA, 19 bp, Homo sapiens
cctgctacaacttcagcag

SEQ ID NO: 2541136 - DNA, 20 bp, Homo sapiens
cctgctccacagccatccca

SEQ ID NO: 2541137 - DNA, 12 bp, Homo sapiens
cctgctccagct

SEQ ID NO: 2541138 - DNA, 16 bp, Homo sapiens
cctgctcccaggccag

SEQ ID NO: 2541139 - DNA, 18 bp, Homo sapiens
cctgctctcctcttgcca

SEQ ID NO: 2541140 - DNA, 16 bp, Homo sapiens
cctgctgcagttgcca

SEQ ID NO: 2541141 - DNA, 19 bp, Homo sapiens
cctgctgcagttgccagtc

SEQ ID NO: 2541142 - DNA, 21 bp, Homo sapiens
cctgctgcagttgccagtcac

SEQ ID NO: 2541143 - DNA, 14 bp, Homo sapiens
cctgctgccgcctc

SEQ ID NO: 2541144 - DNA, 15 bp, Homo sapiens
cctgctgccgcctcc

SEQ ID NO: 2541145 - DNA, 18 bp, Homo sapiens
cctgctgccgcctcccag

SEQ ID NO: 2541146 - DNA, 21 bp, Homo sapiens
cctgctgccgcctcccagcct

SEQ ID NO: 2541147 - DNA, 23 bp, Homo sapiens
cctgctgccgcctcccagcctgg

SEQ ID NO: 2541148 - DNA, 19 bp, Homo sapiens
cctgctgcctccccaaccc

SEQ ID NO: 2541149 - DNA, 11 bp, Homo sapiens
cctgctggccc

SEQ ID NO: 2541150 - DNA, 17 bp, Homo sapiens
cctgctggcccctcacc

SEQ ID NO: 2541151 - DNA, 14 bp, Homo sapiens
cctgctggccgcct

SEQ ID NO: 2541152 - DNA, 12 bp, Homo sapiens
cctgctggctct

SEQ ID NO: 2541153 - DNA, 13 bp, Homo sapiens
cctgctggctctt

SEQ ID NO: 2541154 - DNA, 17 bp, Homo sapiens
cctgctggctcttctgc

SEQ ID NO: 2541155 - DNA, 19 bp, Homo sapiens
cctgctggctcttctgccc

SEQ ID NO: 2541156 - DNA, 13 bp, Homo sapiens
cctgctggttcag

SEQ ID NO: 2541157 - DNA, 16 bp, Homo sapiens
cctgcttcatgctcag

SEQ ID NO: 2541158 - DNA, 15 bp, Homo sapiens
cctgcttcctgtctt

SEQ ID NO: 2541159 - DNA, 21 bp, Homo sapiens
cctgcttgggtggagaagcca

SEQ ID NO: 2541160 - DNA, 17 bp, Homo sapiens
cctggaaaggctcagtc

SEQ ID NO: 2541161 - DNA, 21 bp, Homo sapiens
cctggaaaggctcagtctcag

SEQ ID NO: 2541162 - DNA, 13 bp, Homo sapiens
cctggaagacaga

SEQ ID NO: 2541163 - DNA, 14 bp, Homo sapiens
cctggaagacagag

SEQ ID NO: 2541164 - DNA, 15 bp, Homo sapiens
cctggaagacagaga

SEQ ID NO: 2541165 - DNA, 15 bp, Homo sapiens
cctggaagccagctt

SEQ ID NO: 2541166 - DNA, 11 bp, Homo sapiens
cctggaagggc

SEQ ID NO: 2541167 - DNA, 13 bp, Homo sapiens
cctggaagggcta

SEQ ID NO: 2541168 - DNA, 23 bp, Homo sapiens
cctggacatgaagattctttccc

SEQ ID NO: 2541169 - DNA, 21 bp, Homo sapiens
cctggacatttgccttgctgg

SEQ ID NO: 2541170 - DNA, 20 bp, Homo sapiens
cctggacattttttcagtca

SEQ ID NO: 2541171 - DNA, 22 bp, Homo sapiens
cctggacctgcctcctgcctgc

SEQ ID NO: 2541172 - DNA, 13 bp, Homo sapiens
cctggactgggag

SEQ ID NO: 2541173 - DNA, 18 bp, Homo sapiens
cctggactgggaggtaga

SEQ ID NO: 2541174 - DNA, 23 bp, Homo sapiens
cctggagaactagaacctggagg

SEQ ID NO: 2541175 - DNA, 17 bp, Homo sapiens
cctggagaagctgatgc

SEQ ID NO: 2541176 - DNA, 18 bp, Homo sapiens
cctggagactgcccagct

SEQ ID NO: 2541177 - DNA, 14 bp, Homo sapiens
cctggagagccaga

SEQ ID NO: 2541178 - DNA, 21 bp, Homo sapiens
cctggagagccagaacctgga

SEQ ID NO: 2541179 - DNA, 22 bp, Homo sapiens
cctggagagctagaacctggag

SEQ ID NO: 2541180 - DNA, 12 bp, Homo sapiens
cctggagcccct

SEQ ID NO: 2541181 - DNA, 17 bp, Homo sapiens
cctggagcccctgggtg

SEQ ID NO: 2541182 - DNA, 22 bp, Homo sapiens
cctggaggcactgaagtgctta

SEQ ID NO: 2541183 - DNA, 17 bp, Homo sapiens
ccttcctctgcagctga

SEQ ID NO: 2541184 - DNA, 17 bp, Homo sapiens
ccttcctgccaccagtc

SEQ ID NO: 2541185 - DNA, 11 bp, Homo sapiens
ccttcctgccc

SEQ ID NO: 2541186 - DNA, 17 bp, Homo sapiens
ccttcctgtcttcctgc

SEQ ID NO: 2541187 - DNA, 17 bp, Homo sapiens
ccttcctgtttttcaca

SEQ ID NO: 2541188 - DNA, 19 bp, Homo sapiens
ccttcctgtttttcacatt

SEQ ID NO: 2541189 - DNA, 22 bp, Homo sapiens
ccttcctgtttttcacattttc

SEQ ID NO: 2541190 - DNA, 16 bp, Homo sapiens
ccttccttgaccagca

SEQ ID NO: 2541191 - DNA, 19 bp, Homo sapiens
ccttccttgctctgcaccc

SEQ ID NO: 2541192 - DNA, 20 bp, Homo sapiens
ccttccttgctgtcctaggc

SEQ ID NO: 2541193 - DNA, 13 bp, Homo sapiens
ccttcgctcctgt

SEQ ID NO: 2541194 - DNA, 14 bp, Homo sapiens
ccttcgctcctgtg

SEQ ID NO: 2541195 - DNA, 18 bp, Homo sapiens
ccttcgctcctgtgtctt

SEQ ID NO: 2541196 - DNA, 20 bp, Homo sapiens
ccttcggacaactcagtccc

SEQ ID NO: 2541197 - DNA, 20 bp, Homo sapiens
ccttctacctgccactcaca

SEQ ID NO: 2541198 - DNA, 15 bp, Homo sapiens
ccttctccaaatgag

SEQ ID NO: 2541199 - DNA, 22 bp, Homo sapiens
ccttctccatctctctggccct

SEQ ID NO: 2541200 - DNA, 16 bp, Homo sapiens
ccttctcccacactgc

SEQ ID NO: 2541201 - DNA, 12 bp, Homo sapiens
ccttctctccag

SEQ ID NO: 2541202 - DNA, 15 bp, Homo sapiens
ccttctctccagccc

SEQ ID NO: 2541203 - DNA, 17 bp, Homo sapiens
ccttctctccagcccct

SEQ ID NO: 2541204 - DNA, 20 bp, Homo sapiens
ccttctctccagcccctgga

SEQ ID NO: 2541205 - DNA, 20 bp, Homo sapiens
ccttctctctcaatttttgg

SEQ ID NO: 2541206 - DNA, 16 bp, Homo sapiens
ccttctctgctccacc

SEQ ID NO: 2541207 - DNA, 17 bp, Homo sapiens
ccttctctgctccacca

SEQ ID NO: 2541208 - DNA, 17 bp, Homo sapiens
ccttctcttcacagtca

SEQ ID NO: 2541209 - DNA, 21 bp, Homo sapiens
ccttctgacccatgctgccct

SEQ ID NO: 2541210 - DNA, 21 bp, Homo sapiens
ccttctgaggacattccaaga

SEQ ID NO: 2541211 - DNA, 18 bp, Homo sapiens
ccttctggcctcccacag

SEQ ID NO: 2541212 - DNA, 20 bp, Homo sapiens
ccttctggcctcccacagac

SEQ ID NO: 2541213 - DNA, 18 bp, Homo sapiens
ccttctgtcctggtgtca

SEQ ID NO: 2541214 - DNA, 21 bp, Homo sapiens
ccttctgtcctggtgtcactt

SEQ ID NO: 2541215 - DNA, 14 bp, Homo sapiens
ccttcttcacccag

SEQ ID NO: 2541216 - DNA, 19 bp, Homo sapiens
ccttcttcacccagctaat

SEQ ID NO: 2541217 - DNA, 20 bp, Homo sapiens
ccttcttctttttgctgttg

SEQ ID NO: 2541218 - DNA, 13 bp, Homo sapiens
ccttcttggtgct

SEQ ID NO: 2541219 - DNA, 12 bp, Homo sapiens
ccttcttgtagt

SEQ ID NO: 2541220 - DNA, 19 bp, Homo sapiens
ccttgaaaacactgttctc

SEQ ID NO: 2541221 - DNA, 20 bp, Homo sapiens
ccttgaaaactttatgctaa

SEQ ID NO: 2541222 - DNA, 19 bp, Homo sapiens
ccttgaaccacttccctca

SEQ ID NO: 2541223 - DNA, 19 bp, Homo sapiens
ccttgaagccactgaagct

SEQ ID NO: 2541224 - DNA, 22 bp, Homo sapiens
ccttgaagccactgaagctggg

SEQ ID NO: 2541225 - DNA, 21 bp, Homo sapiens
ccttgaagggtaaagaagttt

SEQ ID NO: 2541226 - DNA, 21 bp, Homo sapiens
ccttgaatatcccctcccagt

SEQ ID NO: 2541227 - DNA, 13 bp, Homo sapiens
ccttgacagggca

SEQ ID NO: 2541228 - DNA, 21 bp, Homo sapiens
ccttgacagggcacaccgggc

SEQ ID NO: 2541229 - DNA, 20 bp, Homo sapiens
ccttgaccagcagatcccag

SEQ ID NO: 2541230 - DNA, 22 bp, Homo sapiens
ccttgaccattctccacctgcc

SEQ ID NO: 2541231 - DNA, 14 bp, Homo sapiens
ccttgagaaacctt

SEQ ID NO: 2541232 - DNA, 14 bp, Homo sapiens
ccttgagacagctt

SEQ ID NO: 2541233 - DNA, 16 bp, Homo sapiens
ccttgagaccacaggg

SEQ ID NO: 2541234 - DNA, 16 bp, Homo sapiens
ccttgagagaccaggc

SEQ ID NO: 2541235 - DNA, 20 bp, Homo sapiens
ccttgagagaccaggcaaag

SEQ ID NO: 2541236 - DNA, 12 bp, Homo sapiens
ccttgagctgag

SEQ ID NO: 2541237 - DNA, 16 bp, Homo sapiens
ccttgaggagtcttgt

SEQ ID NO: 2541238 - DNA, 23 bp, Homo sapiens
ccttgaggtcttttgacatgtgg

SEQ ID NO: 2541239 - DNA, 22 bp, Homo sapiens
ccttgagttgattcagctctgc

SEQ ID NO: 2541240 - DNA, 14 bp, Homo sapiens
ccttgattgggact

SEQ ID NO: 2541241 - DNA, 23 bp, Homo sapiens
ccttgcaaagaccataaagtcca

SEQ ID NO: 2541242 - DNA, 22 bp, Homo sapiens
ccttgcacactcccctgcactg

SEQ ID NO: 2541243 - DNA, 14 bp, Homo sapiens
ccttgcacatagta

SEQ ID NO: 2541244 - DNA, 17 bp, Homo sapiens
ccttgcacccctcactc

SEQ ID NO: 2541245 - DNA, 15 bp, Homo sapiens
ccttgcagctagttt

SEQ ID NO: 2541246 - DNA, 23 bp, Homo sapiens
ccttgcagttcagcaccacccta

SEQ ID NO: 2541247 - DNA, 13 bp, Homo sapiens
ccttgccacccca

SEQ ID NO: 2541248 - DNA, 23 bp, Homo sapiens
ccttgccaccccaccctccctgg

SEQ ID NO: 2541249 - DNA, 22 bp, Homo sapiens
ccttgcccagggctcagcctgg

SEQ ID NO: 2541250 - DNA, 13 bp, Homo sapiens
ccttgccctgacc

SEQ ID NO: 2541251 - DNA, 14 bp, Homo sapiens
ccttgccctgacct

SEQ ID NO: 2541252 - DNA, 15 bp, Homo sapiens
ccttgccctgacctc

SEQ ID NO: 2541253 - DNA, 20 bp, Homo sapiens
ccttgccgtctacctgaggg

SEQ ID NO: 2541254 - DNA, 16 bp, Homo sapiens
ccttgcctcctgtgta

SEQ ID NO: 2541255 - DNA, 20 bp, Homo sapiens
ccttgcggtatccgccccca

SEQ ID NO: 2541256 - DNA, 19 bp, Homo sapiens
ccttgctctccctcttctc

SEQ ID NO: 2541257 - DNA, 17 bp, Homo sapiens
ccttgctctgcaggcac

SEQ ID NO: 2541258 - DNA, 23 bp, Homo sapiens
ccttggaaacctgccctgcctga

SEQ ID NO: 2541259 - DNA, 16 bp, Homo sapiens
ccttggaggccagcca

SEQ ID NO: 2541260 - DNA, 23 bp, Homo sapiens
ccttggagggtcccaagctgggc

SEQ ID NO: 2541261 - DNA, 19 bp, Homo sapiens
ccttggattgtccccgacc

SEQ ID NO: 2541262 - DNA, 18 bp, Homo sapiens
ccttggcatctagagctt

SEQ ID NO: 2541263 - DNA, 17 bp, Homo sapiens
ccttggcatgccttcca

SEQ ID NO: 2541264 - DNA, 21 bp, Homo sapiens
ccttggcatgccttccagcac

SEQ ID NO: 2541265 - DNA, 11 bp, Homo sapiens
ccttggcctca

SEQ ID NO: 2541266 - DNA, 13 bp, Homo sapiens
ccttggcctcaga

SEQ ID NO: 2541267 - DNA, 22 bp, Homo sapiens
ccttggcctgtctcatccccag

SEQ ID NO: 2541268 - DNA, 18 bp, Homo sapiens
ccttggctcaatcctcta

SEQ ID NO: 2541269 - DNA, 22 bp, Homo sapiens
ccttggctcaatcctctaagct

SEQ ID NO: 2541270 - DNA, 13 bp, Homo sapiens
ccttggctggtgc

SEQ ID NO: 2541271 - DNA, 21 bp, Homo sapiens
ccttggctgtgaggcccctgg

SEQ ID NO: 2541272 - DNA, 20 bp, Homo sapiens
ccttgggaggccccactggg

SEQ ID NO: 2541273 - DNA, 17 bp, Homo sapiens
ccttgggcggctgagag

SEQ ID NO: 2541274 - DNA, 22 bp, Homo sapiens
ccttggggaatttcctctattg

SEQ ID NO: 2541275 - DNA, 14 bp, Homo sapiens
ccttggggcaggca

SEQ ID NO: 2541276 - DNA, 17 bp, Homo sapiens
ccttggtggcaagagcc

SEQ ID NO: 2541277 - DNA, 18 bp, Homo sapiens
ccttggtgtagttgaact

SEQ ID NO: 2541278 - DNA, 19 bp, Homo sapiens
ccttggtgtgaccctctga

SEQ ID NO: 2541279 - DNA, 16 bp, Homo sapiens
ccttgtatttaaatat

SEQ ID NO: 2541280 - DNA, 15 bp, Homo sapiens
ccttgtccccacact

SEQ ID NO: 2541281 - DNA, 16 bp, Homo sapiens
ccttgtccccacactc

SEQ ID NO: 2541282 - DNA, 21 bp, Homo sapiens
ccttgtccccacactcctaca

SEQ ID NO: 2541283 - DNA, 11 bp, Homo sapiens
ccttgtgcctg

SEQ ID NO: 2541284 - DNA, 22 bp, Homo sapiens
ccttgtggcctgggcctcctca

SEQ ID NO: 2541285 - DNA, 19 bp, Homo sapiens
ccttgtggtcccaccccac

SEQ ID NO: 2541286 - DNA, 20 bp, Homo sapiens
ccttgtggtcccaccccaca

SEQ ID NO: 2541287 - DNA, 23 bp, Homo sapiens
ccttgtgtctacagagaacctgg

SEQ ID NO: 2541288 - DNA, 13 bp, Homo sapiens
ccttgttgcatga

SEQ ID NO: 2541289 - DNA, 23 bp, Homo sapiens
cctttacacattcggctccctgg

SEQ ID NO: 2541290 - DNA, 19 bp, Homo sapiens
cctttacggacaccccctc

SEQ ID NO: 2541291 - DNA, 15 bp, Homo sapiens
cctttacttgacctc

SEQ ID NO: 2541292 - DNA, 19 bp, Homo sapiens
cctttagccaaacccttgt

SEQ ID NO: 2541293 - DNA, 20 bp, Homo sapiens
cctttagcgcccagttgggt

SEQ ID NO: 2541294 - DNA, 22 bp, Homo sapiens
cctttagggcagcttgccccgg

SEQ ID NO: 2541295 - DNA, 13 bp, Homo sapiens
cctttattgtgat

SEQ ID NO: 2541296 - DNA, 22 bp, Homo sapiens
cctttcacaaaattttattcct

SEQ ID NO: 2541297 - DNA, 20 bp, Homo sapiens
cctttcagatgtcttctgcc

SEQ ID NO: 2541298 - DNA, 21 bp, Homo sapiens
cctttcagatgtcttctgcct

SEQ ID NO: 2541299 - DNA, 18 bp, Homo sapiens
cctttcatttactgtggc

SEQ ID NO: 2541300 - DNA, 19 bp, Homo sapiens
cctttcatttactgtggct

SEQ ID NO: 2541301 - DNA, 22 bp, Homo sapiens
cctttcatttactgtggcttct

SEQ ID NO: 2541302 - DNA, 13 bp, Homo sapiens
cctttccagcatg

SEQ ID NO: 2541303 - DNA, 22 bp, Homo sapiens
cctttcctggacactcagacct

SEQ ID NO: 2541304 - DNA, 18 bp, Homo sapiens
cctttctatcatttttgt

SEQ ID NO: 2541305 - DNA, 13 bp, Homo sapiens
cctttctccagcc

SEQ ID NO: 2541306 - DNA, 17 bp, Homo sapiens
cctttctcgattttatc

SEQ ID NO: 2541307 - DNA, 13 bp, Homo sapiens
cctttcttggcca

SEQ ID NO: 2541308 - DNA, 16 bp, Homo sapiens
cctttctttttcttct

SEQ ID NO: 2541309 - DNA, 23 bp, Homo sapiens
cctttctttttcttcttccctcc

SEQ ID NO: 2541310 - DNA, 21 bp, Homo sapiens
cctttgacctgcctcccttca

SEQ ID NO: 2541311 - DNA, 17 bp, Homo sapiens
cctttgacgccatccca

SEQ ID NO: 2541312 - DNA, 18 bp, Homo sapiens
cctttgacgccatcccag

SEQ ID NO: 2541313 - DNA, 13 bp, Homo sapiens
cctttgcactgag

SEQ ID NO: 2541314 - DNA, 19 bp, Homo sapiens
cctttgcactgagggccac

SEQ ID NO: 2541315 - DNA, 15 bp, Homo sapiens
cctttgcatggagtg

SEQ ID NO: 2541316 - DNA, 16 bp, Homo sapiens
cctttggatgaccaga

SEQ ID NO: 2541317 - DNA, 19 bp, Homo sapiens
cctttggatgaccagaaca

SEQ ID NO: 2541318 - DNA, 20 bp, Homo sapiens
cctttggcaggtgcagcccc

SEQ ID NO: 2541319 - DNA, 17 bp, Homo sapiens
cctttgggcccagggac

SEQ ID NO: 2541320 - DNA, 18 bp, Homo sapiens
cctttggggggggcccgc

SEQ ID NO: 2541321 - DNA, 12 bp, Homo sapiens
cctttgtatatt

SEQ ID NO: 2541322 - DNA, 14 bp, Homo sapiens
cctttgtatattat

SEQ ID NO: 2541323 - DNA, 24 bp, Homo sapiens
cctttgtattctctcctgtacctc

SEQ ID NO: 2541324 - DNA, 22 bp, Homo sapiens
cctttgtccccaccgcagacag

SEQ ID NO: 2541325 - DNA, 23 bp, Homo sapiens
cctttgtccccaccgcagacagg

SEQ ID NO: 2541326 - DNA, 13 bp, Homo sapiens
cgggaacagtgtt

SEQ ID NO: 2541327 - DNA, 22 bp, Homo sapiens
cgggaacagtgtttcccataat

SEQ ID NO: 2541328 - DNA, 14 bp, Homo sapiens
cgggaagagaggag

SEQ ID NO: 2541329 - DNA, 18 bp, Homo sapiens
cgggaagagaggagttca

SEQ ID NO: 2541330 - DNA, 22 bp, Homo sapiens
cgggaagagaggagttcaatga

SEQ ID NO: 2541331 - DNA, 24 bp, Homo sapiens
cgggaagagaggagttcaatgatc

SEQ ID NO: 2541332 - DNA, 12 bp, Homo sapiens
cgggaagcggag

SEQ ID NO: 2541333 - DNA, 14 bp, Homo sapiens
cgggaaggagggtt

SEQ ID NO: 2541334 - DNA, 20 bp, Homo sapiens
cgggaagggggctgggacat

SEQ ID NO: 2541335 - DNA, 17 bp, Homo sapiens
cgggaaggtcaccagca

SEQ ID NO: 2541336 - DNA, 13 bp, Homo sapiens
cgggacctggtgc

SEQ ID NO: 2541337 - DNA, 21 bp, Homo sapiens
cgggacgagaccctacaggag

SEQ ID NO: 2541338 - DNA, 16 bp, Homo sapiens
cgggagaatcatgtga

SEQ ID NO: 2541339 - DNA, 17 bp, Homo sapiens
cgggagccgctggcaga

SEQ ID NO: 2541340 - DNA, 20 bp, Homo sapiens
cgggaggatgttctgggaca

SEQ ID NO: 2541341 - DNA, 23 bp, Homo sapiens
cgggaggatgttctgggacacag

SEQ ID NO: 2541342 - DNA, 18 bp, Homo sapiens
cgggaggctgagacagga

SEQ ID NO: 2541343 - DNA, 16 bp, Homo sapiens
cgggaggtcgaggcag

SEQ ID NO: 2541344 - DNA, 18 bp, Homo sapiens
cgggaggtcgaggcagga

SEQ ID NO: 2541345 - DNA, 21 bp, Homo sapiens
cgggcacctatagtcccagct

SEQ ID NO: 2541346 - DNA, 13 bp, Homo sapiens
cgggccagccagg

SEQ ID NO: 2541347 - DNA, 17 bp, Homo sapiens
cgggccagccaggcggg

SEQ ID NO: 2541348 - DNA, 20 bp, Homo sapiens
cgggccagccaggcgggctc

SEQ ID NO: 2541349 - DNA, 21 bp, Homo sapiens
cgggccagccaggcgggctca

SEQ ID NO: 2541350 - DNA, 11 bp, Homo sapiens
cgggcccacct

SEQ ID NO: 2541351 - DNA, 16 bp, Homo sapiens
cgggcccacctggcca

SEQ ID NO: 2541352 - DNA, 20 bp, Homo sapiens
cgggcccacctggccacctg

SEQ ID NO: 2541353 - DNA, 11 bp, Homo sapiens
cgggctcagca

SEQ ID NO: 2541354 - DNA, 12 bp, Homo sapiens
cgggctctgcct

SEQ ID NO: 2541355 - DNA, 14 bp, Homo sapiens
cgggctctgcctcc

SEQ ID NO: 2541356 - DNA, 16 bp, Homo sapiens
cgggctctgcctccca

SEQ ID NO: 2541357 - DNA, 17 bp, Homo sapiens
cgggctctgcctcccat

SEQ ID NO: 2541358 - DNA, 14 bp, Homo sapiens
cgggctgcctgggc

SEQ ID NO: 2541359 - DNA, 16 bp, Homo sapiens
cggggacagaggcctg

SEQ ID NO: 2541360 - DNA, 14 bp, Homo sapiens
cggggacagctcct

SEQ ID NO: 2541361 - DNA, 16 bp, Homo sapiens
cggggagcccccgccc

SEQ ID NO: 2541362 - DNA, 14 bp, Homo sapiens
cggggaggccaagt

SEQ ID NO: 2541363 - DNA, 15 bp, Homo sapiens
cggggagggtgacag

SEQ ID NO: 2541364 - DNA, 22 bp, Homo sapiens
cggggagggtgacagtggccgc

SEQ ID NO: 2541365 - DNA, 17 bp, Homo sapiens
cggggagtttctttcct

SEQ ID NO: 2541366 - DNA, 18 bp, Homo sapiens
cggggagtttctttcctg

SEQ ID NO: 2541367 - DNA, 15 bp, Homo sapiens
cggggcactgcaggg

SEQ ID NO: 2541368 - DNA, 14 bp, Homo sapiens
cggggcagctgcca

SEQ ID NO: 2541369 - DNA, 15 bp, Homo sapiens
cggggccccagggct

SEQ ID NO: 2541370 - DNA, 22 bp, Homo sapiens
cggggccttgcggtatccgccc

SEQ ID NO: 2541371 - DNA, 23 bp, Homo sapiens
cggggcttcaaccttgagacagc

SEQ ID NO: 2541372 - DNA, 20 bp, Homo sapiens
cggggggccccagtcagcct

SEQ ID NO: 2541373 - DNA, 12 bp, Homo sapiens
cggggtggagca

SEQ ID NO: 2541374 - DNA, 13 bp, Homo sapiens
cgggtctgcctct

SEQ ID NO: 2541375 - DNA, 19 bp, Homo sapiens
cgggtggatcacctgaggt

SEQ ID NO: 2541376 - DNA, 19 bp, Homo sapiens
cgggtgggcggcacagcct

SEQ ID NO: 2541377 - DNA, 19 bp, Homo sapiens
cgggtttggcgggccaagg

SEQ ID NO: 2541378 - DNA, 20 bp, Homo sapiens
cggtaaaacaccggagacta

SEQ ID NO: 2541379 - DNA, 14 bp, Homo sapiens
cggtccacccagga

SEQ ID NO: 2541380 - DNA, 22 bp, Homo sapiens
cggtcgggttttattgtttaaa

SEQ ID NO: 2541381 - DNA, 20 bp, Homo sapiens
cggtctgcaagtcagaggat

SEQ ID NO: 2541382 - DNA, 16 bp, Homo sapiens
cggtgagaactctgcc

SEQ ID NO: 2541383 - DNA, 13 bp, Homo sapiens
cggtgcagtctgg

SEQ ID NO: 2541384 - DNA, 14 bp, Homo sapiens
cggtggaggccagg

SEQ ID NO: 2541385 - DNA, 11 bp, Homo sapiens
cggtggctcac

SEQ ID NO: 2541386 - DNA, 15 bp, Homo sapiens
cggtgggcacccacc

SEQ ID NO: 2541387 - DNA, 13 bp, Homo sapiens
cggtgggccttgc

SEQ ID NO: 2541388 - DNA, 18 bp, Homo sapiens
cggtgggccttgctgggg

SEQ ID NO: 2541389 - DNA, 15 bp, Homo sapiens
cggtgtgcaccaggg

SEQ ID NO: 2541390 - DNA, 20 bp, Homo sapiens
cggttatgaaattcaccccc

SEQ ID NO: 2541391 - DNA, 16 bp, Homo sapiens
cgtaattaaaagaatt

SEQ ID NO: 2541392 - DNA, 13 bp, Homo sapiens
cgtacacatttta

SEQ ID NO: 2541393 - DNA, 16 bp, Homo sapiens
cgtacacattttattt

SEQ ID NO: 2541394 - DNA, 22 bp, Homo sapiens
cgtacacattttattttattat

SEQ ID NO: 2541395 - DNA, 14 bp, Homo sapiens
cgtaccccaccctc

SEQ ID NO: 2541396 - DNA, 23 bp, Homo sapiens
cgtagaagtttttgtactgtaaa

SEQ ID NO: 2541397 - DNA, 19 bp, Homo sapiens
cgtagatcaccagaataaa

SEQ ID NO: 2541398 - DNA, 15 bp, Homo sapiens
cgtatagctgtattg

SEQ ID NO: 2541399 - DNA, 16 bp, Homo sapiens
cgtatgtctgttacca

SEQ ID NO: 2541400 - DNA, 18 bp, Homo sapiens
cgtcaccatctcaggcca

SEQ ID NO: 2541401 - DNA, 15 bp, Homo sapiens
cgtcagcctccagcc

SEQ ID NO: 2541402 - DNA, 17 bp, Homo sapiens
cgtcagcctccagcctc

SEQ ID NO: 2541403 - DNA, 20 bp, Homo sapiens
cgtcagggcccaagtccctg

SEQ ID NO: 2541404 - DNA, 15 bp, Homo sapiens
cgtcagtattttccc

SEQ ID NO: 2541405 - DNA, 15 bp, Homo sapiens
cgtcagtgcctaccc

SEQ ID NO: 2541406 - DNA, 19 bp, Homo sapiens
cgtcatcacttttcagtga

SEQ ID NO: 2541407 - DNA, 20 bp, Homo sapiens
cgtcatcatttttccttccc

SEQ ID NO: 2541408 - DNA, 22 bp, Homo sapiens
cgtccaccatggggtcctacca

SEQ ID NO: 2541409 - DNA, 21 bp, Homo sapiens
cgtccagccgccattgccacc

SEQ ID NO: 2541410 - DNA, 15 bp, Homo sapiens
cgtccgcgcgccagc

SEQ ID NO: 2541411 - DNA, 12 bp, Homo sapiens
cgtcctcctctg

SEQ ID NO: 2541412 - DNA, 14 bp, Homo sapiens
cgtcctcctctgtg

SEQ ID NO: 2541413 - DNA, 17 bp, Homo sapiens
cgtcgaggggctctcag

SEQ ID NO: 2541414 - DNA, 18 bp, Homo sapiens
cgtctctctcccatggag

SEQ ID NO: 2541415 - DNA, 23 bp, Homo sapiens
cgtctgctaacttggagccccag

SEQ ID NO: 2541416 - DNA, 21 bp, Homo sapiens
cgtctgggagaaattgacaga

SEQ ID NO: 2541417 - DNA, 14 bp, Homo sapiens
cgtcttcagcctag

SEQ ID NO: 2541418 - DNA, 15 bp, Homo sapiens
cgtcttcagcctagc

SEQ ID NO: 2541419 - DNA, 13 bp, Homo sapiens
cgtgaaaccctgt

SEQ ID NO: 2541420 - DNA, 17 bp, Homo sapiens
cgtgaagtatactgtat

SEQ ID NO: 2541421 - DNA, 15 bp, Homo sapiens
cgtgacaacacttgt

SEQ ID NO: 2541422 - DNA, 16 bp, Homo sapiens
cgtgacagtgcctggg

SEQ ID NO: 2541423 - DNA, 19 bp, Homo sapiens
cgtgacgctgaataaatgt

SEQ ID NO: 2541424 - DNA, 23 bp, Homo sapiens
cgtgagagtgtcttcacggcagg

SEQ ID NO: 2541425 - DNA, 19 bp, Homo sapiens
cgtgagtgaaccatcatta

SEQ ID NO: 2541426 - DNA, 18 bp, Homo sapiens
cgtgagttctcagggctc

SEQ ID NO: 2541427 - DNA, 20 bp, Homo sapiens
cgtgagttctcagggctcct

SEQ ID NO: 2541428 - DNA, 18 bp, Homo sapiens
cgtgatcaaagccacact

SEQ ID NO: 2541429 - DNA, 21 bp, Homo sapiens
cgtgatcaaagccacactctg

SEQ ID NO: 2541430 - DNA, 22 bp, Homo sapiens
cgtgatcaaagccacactctgg

SEQ ID NO: 2541431 - DNA, 17 bp, Homo sapiens
cgtgatgcctccctgtt

SEQ ID NO: 2541432 - DNA, 18 bp, Homo sapiens
cgtgattttgctgtagaa

SEQ ID NO: 2541433 - DNA, 18 bp, Homo sapiens
cgtgcacacaccagagcc

SEQ ID NO: 2541434 - DNA, 21 bp, Homo sapiens
cgtgcacacaccagagcccac

SEQ ID NO: 2541435 - DNA, 15 bp, Homo sapiens
cgtgcacctgtactc

SEQ ID NO: 2541436 - DNA, 22 bp, Homo sapiens
cgtgcacgtggagagctggtgc

SEQ ID NO: 2541437 - DNA, 14 bp, Homo sapiens
cgtgcataccactt

SEQ ID NO: 2541438 - DNA, 22 bp, Homo sapiens
cgtgcattggaagaccccaccc

SEQ ID NO: 2541439 - DNA, 16 bp, Homo sapiens
cgtgcccagtggctgc

SEQ ID NO: 2541440 - DNA, 20 bp, Homo sapiens
cgtgcccagtggctgctcct

SEQ ID NO: 2541441 - DNA, 22 bp, Homo sapiens
cgtgcctccaccaccactggcc

SEQ ID NO: 2541442 - DNA, 19 bp, Homo sapiens
cgtgcctccttccacctcc

SEQ ID NO: 2541443 - DNA, 23 bp, Homo sapiens
cgtgcctccttccacctccctcc

SEQ ID NO: 2541444 - DNA, 17 bp, Homo sapiens
cgtgccttttgcacccc

SEQ ID NO: 2541445 - DNA, 16 bp, Homo sapiens
cgtgctccagcctggc

SEQ ID NO: 2541446 - DNA, 17 bp, Homo sapiens
cgtgctccagcctggct

SEQ ID NO: 2541447 - DNA, 20 bp, Homo sapiens
cgtgcttagcctcctgacct

SEQ ID NO: 2541448 - DNA, 21 bp, Homo sapiens
cgtggaaagggtgctgcttcc

SEQ ID NO: 2541449 - DNA, 20 bp, Homo sapiens
cgtggaacgtttttcctgtt

SEQ ID NO: 2541450 - DNA, 15 bp, Homo sapiens
cgtggaccttcctgc

SEQ ID NO: 2541451 - DNA, 17 bp, Homo sapiens
cgtggaccttcctgcca

SEQ ID NO: 2541452 - DNA, 14 bp, Homo sapiens
cgtggagctgcctg

SEQ ID NO: 2541453 - DNA, 16 bp, Homo sapiens
cgtggcatagcccaga

SEQ ID NO: 2541454 - DNA, 19 bp, Homo sapiens
cgtggcatgtggcctgtgg

SEQ ID NO: 2541455 - DNA, 19 bp, Homo sapiens
cgtggccagcccggctggt

SEQ ID NO: 2541456 - DNA, 22 bp, Homo sapiens
cgtggctaagagtgtcctagga

SEQ ID NO: 2541457 - DNA, 23 bp, Homo sapiens
cgtgggaacccccctcccaccca

SEQ ID NO: 2541458 - DNA, 22 bp, Homo sapiens
cgtgggagacaagaaatccctg

SEQ ID NO: 2541459 - DNA, 22 bp, Homo sapiens
cgtgggaggcgggagtggagtg

SEQ ID NO: 2541460 - DNA, 13 bp, Homo sapiens
cgtgggctccctg

SEQ ID NO: 2541461 - DNA, 23 bp, Homo sapiens
cgtggggagggccgtaccccacc

SEQ ID NO: 2541462 - DNA, 19 bp, Homo sapiens
cgtgggtctgttttccttt

SEQ ID NO: 2541463 - DNA, 15 bp, Homo sapiens
cgtggtcactgctgt

SEQ ID NO: 2541464 - DNA, 16 bp, Homo sapiens
cgtggtcactgctgtc

SEQ ID NO: 2541465 - DNA, 12 bp, Homo sapiens
cgtgtaaaccaa

SEQ ID NO: 2541466 - DNA, 20 bp, Homo sapiens
cgtgtaaccatggacccaat

SEQ ID NO: 2541467 - DNA, 16 bp, Homo sapiens
cgtgtatcctggggct

SEQ ID NO: 2541468 - DNA, 17 bp, Homo sapiens
cgtgtccccggcctcag

SEQ ID NO: 2541469 - DNA, 22 bp, Homo sapiens
cgtgtctgtatttatgtgtgag

SEQ ID NO: 2541470 - DNA, 15 bp, Homo sapiens
ctagcaccagggact

SEQ ID NO: 2541471 - DNA, 13 bp, Homo sapiens
ctagcactggcct

SEQ ID NO: 2541472 - DNA, 14 bp, Homo sapiens
ctagcactggcctg

SEQ ID NO: 2541473 - DNA, 16 bp, Homo sapiens
ctagcactggcctgca

SEQ ID NO: 2541474 - DNA, 23 bp, Homo sapiens
ctagcatacgtacacattttatt

SEQ ID NO: 2541475 - DNA, 13 bp, Homo sapiens
ctagcatccctga

SEQ ID NO: 2541476 - DNA, 17 bp, Homo sapiens
ctagccattcctggtac

SEQ ID NO: 2541477 - DNA, 18 bp, Homo sapiens
ctagcccaatgaaatgaa

SEQ ID NO: 2541478 - DNA, 16 bp, Homo sapiens
ctagcccgaatacaaa

SEQ ID NO: 2541479 - DNA, 13 bp, Homo sapiens
ctagccctctcac

SEQ ID NO: 2541480 - DNA, 14 bp, Homo sapiens
ctagccgacctcag

SEQ ID NO: 2541481 - DNA, 15 bp, Homo sapiens
ctagccgacctcagc

SEQ ID NO: 2541482 - DNA, 18 bp, Homo sapiens
ctagccgacctcagcctt

SEQ ID NO: 2541483 - DNA, 19 bp, Homo sapiens
ctagccgacctcagccttc

SEQ ID NO: 2541484 - DNA, 23 bp, Homo sapiens
ctagccttagaagtcacacagta

SEQ ID NO: 2541485 - DNA, 21 bp, Homo sapiens
ctagctagaaatatgatttta

SEQ ID NO: 2541486 - DNA, 21 bp, Homo sapiens
ctagctcccctcctctcccct

SEQ ID NO: 2541487 - DNA, 19 bp, Homo sapiens
ctagctctgagccagttca

SEQ ID NO: 2541488 - DNA, 20 bp, Homo sapiens
ctagctctgagccagttcag

SEQ ID NO: 2541489 - DNA, 20 bp, Homo sapiens
ctagctgcacagggcagctg

SEQ ID NO: 2541490 - DNA, 18 bp, Homo sapiens
ctagctgctacaaagaag

SEQ ID NO: 2541491 - DNA, 17 bp, Homo sapiens
ctagctggtggtttcac

SEQ ID NO: 2541492 - DNA, 14 bp, Homo sapiens
ctagctgtgggggt

SEQ ID NO: 2541493 - DNA, 20 bp, Homo sapiens
ctagcttgggaggcttcccc

SEQ ID NO: 2541494 - DNA, 13 bp, Homo sapiens
ctaggaacactcc

SEQ ID NO: 2541495 - DNA, 15 bp, Homo sapiens
ctaggaacactcctt

SEQ ID NO: 2541496 - DNA, 15 bp, Homo sapiens
ctaggaagaatttta

SEQ ID NO: 2541497 - DNA, 23 bp, Homo sapiens
ctaggaagaattttaaaaatgaa

SEQ ID NO: 2541498 - DNA, 15 bp, Homo sapiens
ctaggaagactttgg

SEQ ID NO: 2541499 - DNA, 21 bp, Homo sapiens
ctaggaagactttggaaagag

SEQ ID NO: 2541500 - DNA, 22 bp, Homo sapiens
ctaggacccctccatgtgggct

SEQ ID NO: 2541501 - DNA, 18 bp, Homo sapiens
ctaggacgccacccagca

SEQ ID NO: 2541502 - DNA, 22 bp, Homo sapiens
ctaggactctgaggctctttct

SEQ ID NO: 2541503 - DNA, 23 bp, Homo sapiens
ctaggagaaggaggggaaccaga

SEQ ID NO: 2541504 - DNA, 16 bp, Homo sapiens
ctaggagaccaaggcg

SEQ ID NO: 2541505 - DNA, 18 bp, Homo sapiens
ctaggagatatctgaggg

SEQ ID NO: 2541506 - DNA, 21 bp, Homo sapiens
ctaggagatatctgagggagg

SEQ ID NO: 2541507 - DNA, 23 bp, Homo sapiens
ctaggagggagacactggcccct

SEQ ID NO: 2541508 - DNA, 13 bp, Homo sapiens
ctaggatttcatg

SEQ ID NO: 2541509 - DNA, 22 bp, Homo sapiens
ctaggcaggacatgctgaagcc

SEQ ID NO: 2541510 - DNA, 15 bp, Homo sapiens
ctaggcaggacctgt

SEQ ID NO: 2541511 - DNA, 15 bp, Homo sapiens
ctaggcatcccaggg

SEQ ID NO: 2541512 - DNA, 19 bp, Homo sapiens
ctaggccacaccatctcct

SEQ ID NO: 2541513 - DNA, 13 bp, Homo sapiens
ctaggcctggcca

SEQ ID NO: 2541514 - DNA, 18 bp, Homo sapiens
ctaggcctggccagatgc

SEQ ID NO: 2541515 - DNA, 13 bp, Homo sapiens
ctaggcctgggga

SEQ ID NO: 2541516 - DNA, 21 bp, Homo sapiens
ctaggcttaatacctgggtga

SEQ ID NO: 2541517 - DNA, 14 bp, Homo sapiens
ctagggaagataat

SEQ ID NO: 2541518 - DNA, 15 bp, Homo sapiens
ctagggacccctcct

SEQ ID NO: 2541519 - DNA, 21 bp, Homo sapiens
ctagggaggaccttatctgtg

SEQ ID NO: 2541520 - DNA, 17 bp, Homo sapiens
ctagggatccctcatct

SEQ ID NO: 2541521 - DNA, 15 bp, Homo sapiens
ctagggccactgaag

SEQ ID NO: 2541522 - DNA, 14 bp, Homo sapiens
ctagggggaagtga

SEQ ID NO: 2541523 - DNA, 17 bp, Homo sapiens
ctagggtggcccttgca

SEQ ID NO: 2541524 - DNA, 15 bp, Homo sapiens
ctaggtgggccagcc

SEQ ID NO: 2541525 - DNA, 18 bp, Homo sapiens
ctaggtgggccagcccct

SEQ ID NO: 2541526 - DNA, 21 bp, Homo sapiens
ctaggtgggccagcccctccc

SEQ ID NO: 2541527 - DNA, 13 bp, Homo sapiens
ctaggttctaaaa

SEQ ID NO: 2541528 - DNA, 19 bp, Homo sapiens
ctaggtttaactcagatca

SEQ ID NO: 2541529 - DNA, 20 bp, Homo sapiens
ctaggtttaactcagatcac

SEQ ID NO: 2541530 - DNA, 15 bp, Homo sapiens
ctagtatcaaaagaa

SEQ ID NO: 2541531 - DNA, 17 bp, Homo sapiens
ctagtatcaaaagaaag

SEQ ID NO: 2541532 - DNA, 14 bp, Homo sapiens
ctagtccagtgacc

SEQ ID NO: 2541533 - DNA, 20 bp, Homo sapiens
ctagtcccttccacaccccc

SEQ ID NO: 2541534 - DNA, 22 bp, Homo sapiens
ctagtcccttcccctccctggc

SEQ ID NO: 2541535 - DNA, 23 bp, Homo sapiens
ctagtcccttcccctccctggct

SEQ ID NO: 2541536 - DNA, 15 bp, Homo sapiens
ctagtcctttactaa

SEQ ID NO: 2541537 - DNA, 21 bp, Homo sapiens
ctagtcgtggagatgtcttcg

SEQ ID NO: 2541538 - DNA, 21 bp, Homo sapiens
ctagtctcctttgcactgagg

SEQ ID NO: 2541539 - DNA, 14 bp, Homo sapiens
ctagtctctctggg

SEQ ID NO: 2541540 - DNA, 19 bp, Homo sapiens
ctagtgaaagaggcagctt

SEQ ID NO: 2541541 - DNA, 18 bp, Homo sapiens
ctagtgacccggaggcca

SEQ ID NO: 2541542 - DNA, 23 bp, Homo sapiens
ctagtgctttccttttttaaaaa

SEQ ID NO: 2541543 - DNA, 14 bp, Homo sapiens
ctagtggtctttgt

SEQ ID NO: 2541544 - DNA, 20 bp, Homo sapiens
ctagtggtctttgtaagagt

SEQ ID NO: 2541545 - DNA, 21 bp, Homo sapiens
ctagtgtggtgtttcctggca

SEQ ID NO: 2541546 - DNA, 19 bp, Homo sapiens
ctagttcatccaatcctca

SEQ ID NO: 2541547 - DNA, 20 bp, Homo sapiens
ctagtttgattaaattcttg

SEQ ID NO: 2541548 - DNA, 13 bp, Homo sapiens
ctataaaacaggt

SEQ ID NO: 2541549 - DNA, 16 bp, Homo sapiens
ctataaacaattacat

SEQ ID NO: 2541550 - DNA, 23 bp, Homo sapiens
ctataaatggtgtttttttaata

SEQ ID NO: 2541551 - DNA, 18 bp, Homo sapiens
ctataaccccagctccct

SEQ ID NO: 2541552 - DNA, 22 bp, Homo sapiens
ctataaccccagctccctagga

SEQ ID NO: 2541553 - DNA, 21 bp, Homo sapiens
ctatactgcatactttttaaa

SEQ ID NO: 2541554 - DNA, 12 bp, Homo sapiens
ctatagactcta

SEQ ID NO: 2541555 - DNA, 15 bp, Homo sapiens
ctatagcccaggtcc

SEQ ID NO: 2541556 - DNA, 17 bp, Homo sapiens
ctatagcctaggtgaca

SEQ ID NO: 2541557 - DNA, 21 bp, Homo sapiens
ctatagcctaggtgacagagt

SEQ ID NO: 2541558 - DNA, 18 bp, Homo sapiens
ctataggctggagaagct

SEQ ID NO: 2541559 - DNA, 23 bp, Homo sapiens
ctatataggcatcacatttttgt

SEQ ID NO: 2541560 - DNA, 18 bp, Homo sapiens
ctatatatgtgatgatct

SEQ ID NO: 2541561 - DNA, 12 bp, Homo sapiens
ctatatccatgt

SEQ ID NO: 2541562 - DNA, 21 bp, Homo sapiens
ctatatccatgtactgtagtt

SEQ ID NO: 2541563 - DNA, 13 bp, Homo sapiens
ctatatctatata

SEQ ID NO: 2541564 - DNA, 15 bp, Homo sapiens
ctatatctgtatata

SEQ ID NO: 2541565 - DNA, 15 bp, Homo sapiens
ctatatgaatttaaa

SEQ ID NO: 2541566 - DNA, 20 bp, Homo sapiens
ctatatgaatttaaatataa

SEQ ID NO: 2541567 - DNA, 19 bp, Homo sapiens
ctatatggcaagaaagctg

SEQ ID NO: 2541568 - DNA, 12 bp, Homo sapiens
ctatatgtgaat

SEQ ID NO: 2541569 - DNA, 19 bp, Homo sapiens
ctatatgtttgtataatga

SEQ ID NO: 2541570 - DNA, 13 bp, Homo sapiens
ctatattgtacac

SEQ ID NO: 2541571 - DNA, 15 bp, Homo sapiens
ctatattgtacacac

SEQ ID NO: 2541572 - DNA, 15 bp, Homo sapiens
ctatatttacagtga

SEQ ID NO: 2541573 - DNA, 16 bp, Homo sapiens
ctatatttacagtgaa

SEQ ID NO: 2541574 - DNA, 22 bp, Homo sapiens
ctatattttttgttaaatgatt

SEQ ID NO: 2541575 - DNA, 20 bp, Homo sapiens
ctatcaaactgaagccagaa

SEQ ID NO: 2541576 - DNA, 20 bp, Homo sapiens
ctatcaagtattataccttt

SEQ ID NO: 2541577 - DNA, 23 bp, Homo sapiens
ctatcaagtgtgctttagcttga

SEQ ID NO: 2541578 - DNA, 21 bp, Homo sapiens
ctatcaatagtcaagaaaaat

SEQ ID NO: 2541579 - DNA, 18 bp, Homo sapiens
ctatcatttttgtacagt

SEQ ID NO: 2541580 - DNA, 22 bp, Homo sapiens
ctatcatttttgtacagtttgc

SEQ ID NO: 2541581 - DNA, 13 bp, Homo sapiens
ctatccacagaga

SEQ ID NO: 2541582 - DNA, 19 bp, Homo sapiens
ctatccacagagagtccca

SEQ ID NO: 2541583 - DNA, 19 bp, Homo sapiens
ctatcctgaaaattctgta

SEQ ID NO: 2541584 - DNA, 18 bp, Homo sapiens
ctatctcccccagcccca

SEQ ID NO: 2541585 - DNA, 20 bp, Homo sapiens
ctatctcccccagccccatc

SEQ ID NO: 2541586 - DNA, 18 bp, Homo sapiens
ctatctgcttatgcagtt

SEQ ID NO: 2541587 - DNA, 21 bp, Homo sapiens
ctatctggtcaacctcctgga

SEQ ID NO: 2541588 - DNA, 14 bp, Homo sapiens
ctatctgtgttttg

SEQ ID NO: 2541589 - DNA, 14 bp, Homo sapiens
ctatctttgccacc

SEQ ID NO: 2541590 - DNA, 19 bp, Homo sapiens
ctatgaactctgttttctt

SEQ ID NO: 2541591 - DNA, 20 bp, Homo sapiens
ctatgaatctattatactgt

SEQ ID NO: 2541592 - DNA, 14 bp, Homo sapiens
ctatgacacatgca

SEQ ID NO: 2541593 - DNA, 16 bp, Homo sapiens
ctatgactgctcccca

SEQ ID NO: 2541594 - DNA, 16 bp, Homo sapiens
ctatgagaaaagaggc

SEQ ID NO: 2541595 - DNA, 23 bp, Homo sapiens
ctatgatattttctgtgcctgaa

SEQ ID NO: 2541596 - DNA, 21 bp, Homo sapiens
ctatgatcccagcactttggg

SEQ ID NO: 2541597 - DNA, 14 bp, Homo sapiens
ctatgatctcaggt

SEQ ID NO: 2541598 - DNA, 17 bp, Homo sapiens
ctatgatctcaggttct

SEQ ID NO: 2541599 - DNA, 16 bp, Homo sapiens
ctatgatgctgttgcc

SEQ ID NO: 2541600 - DNA, 18 bp, Homo sapiens
ctatgcacatatggactc

SEQ ID NO: 2541601 - DNA, 19 bp, Homo sapiens
ctatggacggtgctccagg

SEQ ID NO: 2541602 - DNA, 11 bp, Homo sapiens
ctatggatgtg

SEQ ID NO: 2541603 - DNA, 18 bp, Homo sapiens
ctatgggactcaatgcac

SEQ ID NO: 2541604 - DNA, 23 bp, Homo sapiens
ctatgggactcaatgcactgaca

SEQ ID NO: 2541605 - DNA, 17 bp, Homo sapiens
ctatggggagaaaagac

SEQ ID NO: 2541606 - DNA, 15 bp, Homo sapiens
ctatggggatggtcc

SEQ ID NO: 2541607 - DNA, 12 bp, Homo sapiens
ctatggtcatct

SEQ ID NO: 2541608 - DNA, 14 bp, Homo sapiens
ctatggtgccaatg

SEQ ID NO: 2541609 - DNA, 22 bp, Homo sapiens
ctatgtaaatgcatctgtcctc

SEQ ID NO: 2541610 - DNA, 18 bp, Homo sapiens
ctatgtaacaaacctgca

SEQ ID NO: 2541611 - DNA, 23 bp, Homo sapiens
ctatgtaggaaagaccatttttc

SEQ ID NO: 2541612 - DNA, 13 bp, Homo sapiens
ctatgtcccttgc

SEQ ID NO: 2541613 - DNA, 20 bp, Homo sapiens
ctatgtcctaaggacacact

SEQ ID NO: 2541614 - DNA, 15 bp, Homo sapiens
ctcataatgtgaagt

SEQ ID NO: 2541615 - DNA, 13 bp, Homo sapiens
ctcatactgtgct

SEQ ID NO: 2541616 - DNA, 16 bp, Homo sapiens
ctcatagcattaacta

SEQ ID NO: 2541617 - DNA, 21 bp, Homo sapiens
ctcataggaaaagtacattta

SEQ ID NO: 2541618 - DNA, 19 bp, Homo sapiens
ctcatagggaagacctgct

SEQ ID NO: 2541619 - DNA, 19 bp, Homo sapiens
ctcatagtatggtggctgg

SEQ ID NO: 2541620 - DNA, 20 bp, Homo sapiens
ctcatagtatggtggctggg

SEQ ID NO: 2541621 - DNA, 23 bp, Homo sapiens
ctcatagtatggtggctgggttg

SEQ ID NO: 2541622 - DNA, 19 bp, Homo sapiens
ctcatatatatctatctta

SEQ ID NO: 2541623 - DNA, 13 bp, Homo sapiens
ctcatatttaaag

SEQ ID NO: 2541624 - DNA, 15 bp, Homo sapiens
ctcatatttaaagac

SEQ ID NO: 2541625 - DNA, 13 bp, Homo sapiens
ctcatattttgta

SEQ ID NO: 2541626 - DNA, 21 bp, Homo sapiens
ctcatcaccaacgtctgtgcc

SEQ ID NO: 2541627 - DNA, 12 bp, Homo sapiens
ctcatcaggatg

SEQ ID NO: 2541628 - DNA, 16 bp, Homo sapiens
ctcatcaggatgaacc

SEQ ID NO: 2541629 - DNA, 20 bp, Homo sapiens
ctcatcaggatgaacccagg

SEQ ID NO: 2541630 - DNA, 14 bp, Homo sapiens
ctcatcataaaata

SEQ ID NO: 2541631 - DNA, 15 bp, Homo sapiens
ctcatcataaaataa

SEQ ID NO: 2541632 - DNA, 16 bp, Homo sapiens
ctcatcataaaataaa

SEQ ID NO: 2541633 - DNA, 19 bp, Homo sapiens
ctcatccaccccatccctc

SEQ ID NO: 2541634 - DNA, 14 bp, Homo sapiens
ctcatccccagggg

SEQ ID NO: 2541635 - DNA, 22 bp, Homo sapiens
ctcatccccaggggtcccagcc

SEQ ID NO: 2541636 - DNA, 19 bp, Homo sapiens
ctcatcccgtgttctcctt

SEQ ID NO: 2541637 - DNA, 15 bp, Homo sapiens
ctcatccgaggcagg

SEQ ID NO: 2541638 - DNA, 13 bp, Homo sapiens
ctcatcctgcagg

SEQ ID NO: 2541639 - DNA, 13 bp, Homo sapiens
ctcatctgtccct

SEQ ID NO: 2541640 - DNA, 13 bp, Homo sapiens
ctcatcttactgt

SEQ ID NO: 2541641 - DNA, 19 bp, Homo sapiens
ctcatgcaaatcaattact

SEQ ID NO: 2541642 - DNA, 20 bp, Homo sapiens
ctcatgcaaatcaattactg

SEQ ID NO: 2541643 - DNA, 17 bp, Homo sapiens
ctcatgcatctccacct

SEQ ID NO: 2541644 - DNA, 22 bp, Homo sapiens
ctcatgccccctttcagatgtc

SEQ ID NO: 2541645 - DNA, 12 bp, Homo sapiens
ctcatgctgaaa

SEQ ID NO: 2541646 - DNA, 13 bp, Homo sapiens
ctcatgctgaaag

SEQ ID NO: 2541647 - DNA, 14 bp, Homo sapiens
ctcatgctgaaagc

SEQ ID NO: 2541648 - DNA, 14 bp, Homo sapiens
ctcatggcccctct

SEQ ID NO: 2541649 - DNA, 16 bp, Homo sapiens
ctcatgtatcatctgg

SEQ ID NO: 2541650 - DNA, 17 bp, Homo sapiens
ctcatgtatcatctgga

SEQ ID NO: 2541651 - DNA, 19 bp, Homo sapiens
ctcatgtatcatctggata

SEQ ID NO: 2541652 - DNA, 14 bp, Homo sapiens
ctcatgtgatcctt

SEQ ID NO: 2541653 - DNA, 9 bp, Homo sapiens
ctcatgtgt

SEQ ID NO: 2541654 - DNA, 16 bp, Homo sapiens
ctcatgttctgctttc

SEQ ID NO: 2541655 - DNA, 13 bp, Homo sapiens
ctcatgttttcca

SEQ ID NO: 2541656 - DNA, 15 bp, Homo sapiens
ctcattaatgacact

SEQ ID NO: 2541657 - DNA, 23 bp, Homo sapiens
ctcattactttaccacccccaca

SEQ ID NO: 2541658 - DNA, 12 bp, Homo sapiens
ctcattcctgcc

SEQ ID NO: 2541659 - DNA, 20 bp, Homo sapiens
ctcattcctgcctgtctcct

SEQ ID NO: 2541660 - DNA, 18 bp, Homo sapiens
ctcattctccttgtgtta

SEQ ID NO: 2541661 - DNA, 19 bp, Homo sapiens
ctcattctgaaggagcccc

SEQ ID NO: 2541662 - DNA, 12 bp, Homo sapiens
ctcattcttctg

SEQ ID NO: 2541663 - DNA, 13 bp, Homo sapiens
ctcattcttctgt

SEQ ID NO: 2541664 - DNA, 23 bp, Homo sapiens
ctcattcttctgtacgtctgaca

SEQ ID NO: 2541665 - DNA, 17 bp, Homo sapiens
ctcattgacaagaactg

SEQ ID NO: 2541666 - DNA, 13 bp, Homo sapiens
ctcattggaccct

SEQ ID NO: 2541667 - DNA, 17 bp, Homo sapiens
ctcattggacccttcca

SEQ ID NO: 2541668 - DNA, 18 bp, Homo sapiens
ctcattggacccttccat

SEQ ID NO: 2541669 - DNA, 15 bp, Homo sapiens
ctccaaaagcactta

SEQ ID NO: 2541670 - DNA, 22 bp, Homo sapiens
ctccaaaatgttggtcatttta

SEQ ID NO: 2541671 - DNA, 17 bp, Homo sapiens
ctccaaaccctcgaggc

SEQ ID NO: 2541672 - DNA, 21 bp, Homo sapiens
ctccaaaccctcgaggcggat

SEQ ID NO: 2541673 - DNA, 14 bp, Homo sapiens
ctccaaaggccccc

SEQ ID NO: 2541674 - DNA, 15 bp, Homo sapiens
ctccaaaggccccct

SEQ ID NO: 2541675 - DNA, 18 bp, Homo sapiens
ctccaagaccttctcctt

SEQ ID NO: 2541676 - DNA, 22 bp, Homo sapiens
ctccaagaccttctccttcacc

SEQ ID NO: 2541677 - DNA, 22 bp, Homo sapiens
ctccaagcaggacatggacaag

SEQ ID NO: 2541678 - DNA, 19 bp, Homo sapiens
ctccaagctccatctccac

SEQ ID NO: 2541679 - DNA, 13 bp, Homo sapiens
ctccaagctccca

SEQ ID NO: 2541680 - DNA, 15 bp, Homo sapiens
ctccaagctcccagg

SEQ ID NO: 2541681 - DNA, 14 bp, Homo sapiens
ctccaaggaccagg

SEQ ID NO: 2541682 - DNA, 20 bp, Homo sapiens
ctccaaggaggggctgtaaa

SEQ ID NO: 2541683 - DNA, 22 bp, Homo sapiens
ctccaaggaggggctgtaaaat

SEQ ID NO: 2541684 - DNA, 18 bp, Homo sapiens
ctccaagggcttctgcac

SEQ ID NO: 2541685 - DNA, 22 bp, Homo sapiens
ctccaagggcttctgcaccctc

SEQ ID NO: 2541686 - DNA, 15 bp, Homo sapiens
ctccaagtctcagtg

SEQ ID NO: 2541687 - DNA, 16 bp, Homo sapiens
ctccaatcctgccccc

SEQ ID NO: 2541688 - DNA, 17 bp, Homo sapiens
ctccaattaaggatttt

SEQ ID NO: 2541689 - DNA, 20 bp, Homo sapiens
ctccacaccctctcccagga

SEQ ID NO: 2541690 - DNA, 16 bp, Homo sapiens
ctccacagccatccca

SEQ ID NO: 2541691 - DNA, 23 bp, Homo sapiens
ctccacagccatcccagccttgg

SEQ ID NO: 2541692 - DNA, 15 bp, Homo sapiens
ctccacagctacctc

SEQ ID NO: 2541693 - DNA, 17 bp, Homo sapiens
ctccacagttcagtggc

SEQ ID NO: 2541694 - DNA, 15 bp, Homo sapiens
ctccacatcctccac

SEQ ID NO: 2541695 - DNA, 19 bp, Homo sapiens
ctccaccaccactggccac

SEQ ID NO: 2541696 - DNA, 21 bp, Homo sapiens
ctccaccaccactggccacca

SEQ ID NO: 2541697 - DNA, 13 bp, Homo sapiens
ctccacccccagc

SEQ ID NO: 2541698 - DNA, 19 bp, Homo sapiens
ctccacccccagctgcttg

SEQ ID NO: 2541699 - DNA, 13 bp, Homo sapiens
ctccaccctctga

SEQ ID NO: 2541700 - DNA, 16 bp, Homo sapiens
ctccacccttggcctg

SEQ ID NO: 2541701 - DNA, 17 bp, Homo sapiens
ctccacccttggcctgt

SEQ ID NO: 2541702 - DNA, 21 bp, Homo sapiens
ctccacccttggcctgtctca

SEQ ID NO: 2541703 - DNA, 22 bp, Homo sapiens
ctccacctcttcaccccccact

SEQ ID NO: 2541704 - DNA, 15 bp, Homo sapiens
ctccacctgccaggg

SEQ ID NO: 2541705 - DNA, 18 bp, Homo sapiens
ctccacctgccagggaca

SEQ ID NO: 2541706 - DNA, 17 bp, Homo sapiens
ctccacctgctcccagg

SEQ ID NO: 2541707 - DNA, 22 bp, Homo sapiens
ctccacctgctcccaggccagt

SEQ ID NO: 2541708 - DNA, 15 bp, Homo sapiens
ctccaccttgcgggg

SEQ ID NO: 2541709 - DNA, 15 bp, Homo sapiens
ctccacgttctgctc

SEQ ID NO: 2541710 - DNA, 9 bp, Homo sapiens
ctccactgt

SEQ ID NO: 2541711 - DNA, 11 bp, Homo sapiens
ctccactgtca

SEQ ID NO: 2541712 - DNA, 18 bp, Homo sapiens
ctccactgtcaccctcca

SEQ ID NO: 2541713 - DNA, 15 bp, Homo sapiens
ctccactttgttgga

SEQ ID NO: 2541714 - DNA, 20 bp, Homo sapiens
ctccagaaccgcagaagcct

SEQ ID NO: 2541715 - DNA, 15 bp, Homo sapiens
ctccagaagcctctg

SEQ ID NO: 2541716 - DNA, 16 bp, Homo sapiens
ctccagaagcctctgg

SEQ ID NO: 2541717 - DNA, 12 bp, Homo sapiens
ctccagaccccc

SEQ ID NO: 2541718 - DNA, 16 bp, Homo sapiens
ctccagacccccaccc

SEQ ID NO: 2541719 - DNA, 21 bp, Homo sapiens
ctccagacccccaccccttcc

SEQ ID NO: 2541720 - DNA, 16 bp, Homo sapiens
ctccagacccccagca

SEQ ID NO: 2541721 - DNA, 15 bp, Homo sapiens
ctccagactctctgt

SEQ ID NO: 2541722 - DNA, 18 bp, Homo sapiens
ctccagactctctgtgaa

SEQ ID NO: 2541723 - DNA, 19 bp, Homo sapiens
ctccagccaacccctgtgg

SEQ ID NO: 2541724 - DNA, 20 bp, Homo sapiens
ctccagccaacccctgtgga

SEQ ID NO: 2541725 - DNA, 16 bp, Homo sapiens
ctccagccagcaatga

SEQ ID NO: 2541726 - DNA, 23 bp, Homo sapiens
ctccagccagcaatgatgtccag

SEQ ID NO: 2541727 - DNA, 11 bp, Homo sapiens
ctccagcccct

SEQ ID NO: 2541728 - DNA, 15 bp, Homo sapiens
ctccagcccctggat

SEQ ID NO: 2541729 - DNA, 12 bp, Homo sapiens
ctccagcctggg

SEQ ID NO: 2541730 - DNA, 20 bp, Homo sapiens
ctccagcctgggcaacacag

SEQ ID NO: 2541731 - DNA, 13 bp, Homo sapiens
ctccagctccaag

SEQ ID NO: 2541732 - DNA, 20 bp, Homo sapiens
ctccagctgctctgtcttct

SEQ ID NO: 2541733 - DNA, 19 bp, Homo sapiens
ctccagctgggttggaaaa

SEQ ID NO: 2541734 - DNA, 19 bp, Homo sapiens
ctccagcttctggtactct

SEQ ID NO: 2541735 - DNA, 21 bp, Homo sapiens
ctccagcttctggtactctcc

SEQ ID NO: 2541736 - DNA, 20 bp, Homo sapiens
ctccagcttgtggagcccca

SEQ ID NO: 2541737 - DNA, 20 bp, Homo sapiens
ctccaggaatgcctcctccc

SEQ ID NO: 2541738 - DNA, 16 bp, Homo sapiens
ctccaggagcagccac

SEQ ID NO: 2541739 - DNA, 18 bp, Homo sapiens
ctccaggagcagccacat

SEQ ID NO: 2541740 - DNA, 16 bp, Homo sapiens
ctccaggcacccttct

SEQ ID NO: 2541741 - DNA, 18 bp, Homo sapiens
ctccaggcgccggcgggc

SEQ ID NO: 2541742 - DNA, 20 bp, Homo sapiens
ctccagggagtcccctcccc

SEQ ID NO: 2541743 - DNA, 15 bp, Homo sapiens
ctccaggggtggctg

SEQ ID NO: 2541744 - DNA, 18 bp, Homo sapiens
ctccaggtgcacaagctc

SEQ ID NO: 2541745 - DNA, 14 bp, Homo sapiens
ctccaggtgtgcac

SEQ ID NO: 2541746 - DNA, 13 bp, Homo sapiens
ctccaggtttttc

SEQ ID NO: 2541747 - DNA, 16 bp, Homo sapiens
ctccaggtttttcaat

SEQ ID NO: 2541748 - DNA, 18 bp, Homo sapiens
ctccaggtttttcaatta

SEQ ID NO: 2541749 - DNA, 14 bp, Homo sapiens
ctccagtattcttg

SEQ ID NO: 2541750 - DNA, 20 bp, Homo sapiens
ctccagtctgctgccctcca

SEQ ID NO: 2541751 - DNA, 21 bp, Homo sapiens
ctccagtgagacagctctgca

SEQ ID NO: 2541752 - DNA, 17 bp, Homo sapiens
ctccagttttcagttga

SEQ ID NO: 2541753 - DNA, 14 bp, Homo sapiens
ctccatactcagga

SEQ ID NO: 2541754 - DNA, 14 bp, Homo sapiens
ctccatctcatgta

SEQ ID NO: 2541755 - DNA, 18 bp, Homo sapiens
ctccatctccaagaatgc

SEQ ID NO: 2541756 - DNA, 21 bp, Homo sapiens
ctccatctccaagaatgctga

SEQ ID NO: 2541757 - DNA, 14 bp, Homo sapiens
ctccatctccactc

SEQ ID NO: 2541758 - DNA, 15 bp, Homo sapiens
ctccatctctctggc

SEQ ID NO: 2541759 - DNA, 17 bp, Homo sapiens
ctccatcttcagcttct

SEQ ID NO: 2541760 - DNA, 21 bp, Homo sapiens
ctcttctgctccacccttggc

SEQ ID NO: 2541761 - DNA, 22 bp, Homo sapiens
ctcttctgggagggcagcaggg

SEQ ID NO: 2541762 - DNA, 19 bp, Homo sapiens
ctcttcttaacttaaattt

SEQ ID NO: 2541763 - DNA, 18 bp, Homo sapiens
ctcttcttcttcagaaga

SEQ ID NO: 2541764 - DNA, 15 bp, Homo sapiens
ctcttcttgaaattt

SEQ ID NO: 2541765 - DNA, 20 bp, Homo sapiens
ctcttcttgaaattttaacc

SEQ ID NO: 2541766 - DNA, 22 bp, Homo sapiens
ctcttctttaaagggatggcaa

SEQ ID NO: 2541767 - DNA, 21 bp, Homo sapiens
ctcttctttatactgtaattt

SEQ ID NO: 2541768 - DNA, 22 bp, Homo sapiens
ctcttctttatactgtaattta

SEQ ID NO: 2541769 - DNA, 24 bp, Homo sapiens
ctcttctttatactgtaatttagt

SEQ ID NO: 2541770 - DNA, 19 bp, Homo sapiens
ctcttcttttggcttccat

SEQ ID NO: 2541771 - DNA, 13 bp, Homo sapiens
ctcttgagcctgg

SEQ ID NO: 2541772 - DNA, 14 bp, Homo sapiens
ctcttgagcctggg

SEQ ID NO: 2541773 - DNA, 15 bp, Homo sapiens
ctcttgagcctggga

SEQ ID NO: 2541774 - DNA, 18 bp, Homo sapiens
ctcttgagccttgaactt

SEQ ID NO: 2541775 - DNA, 14 bp, Homo sapiens
ctcttgaggccagg

SEQ ID NO: 2541776 - DNA, 16 bp, Homo sapiens
ctcttgaggccaggag

SEQ ID NO: 2541777 - DNA, 15 bp, Homo sapiens
ctcttgagggagctt

SEQ ID NO: 2541778 - DNA, 13 bp, Homo sapiens
ctcttgattttca

SEQ ID NO: 2541779 - DNA, 19 bp, Homo sapiens
ctcttgcacccgcctctcc

SEQ ID NO: 2541780 - DNA, 14 bp, Homo sapiens
ctcttgcaggtctc

SEQ ID NO: 2541781 - DNA, 16 bp, Homo sapiens
ctcttgccactgcctc

SEQ ID NO: 2541782 - DNA, 17 bp, Homo sapiens
ctcttgccactgcctct

SEQ ID NO: 2541783 - DNA, 20 bp, Homo sapiens
ctcttgccactgcctcttcc

SEQ ID NO: 2541784 - DNA, 12 bp, Homo sapiens
ctcttgcccccc

SEQ ID NO: 2541785 - DNA, 13 bp, Homo sapiens
ctcttgcccccca

SEQ ID NO: 2541786 - DNA, 15 bp, Homo sapiens
ctcttgcccttccct

SEQ ID NO: 2541787 - DNA, 21 bp, Homo sapiens
ctcttgcccttccctgtccct

SEQ ID NO: 2541788 - DNA, 22 bp, Homo sapiens
ctcttgcccttccctgtccctc

SEQ ID NO: 2541789 - DNA, 14 bp, Homo sapiens
ctcttgctaatcag

SEQ ID NO: 2541790 - DNA, 16 bp, Homo sapiens
ctcttgggctgagact

SEQ ID NO: 2541791 - DNA, 18 bp, Homo sapiens
ctcttgggctgagactgg

SEQ ID NO: 2541792 - DNA, 13 bp, Homo sapiens
ctcttggtcctgc

SEQ ID NO: 2541793 - DNA, 17 bp, Homo sapiens
ctcttggtcctgctgca

SEQ ID NO: 2541794 - DNA, 16 bp, Homo sapiens
ctcttgttttcagttt

SEQ ID NO: 2541795 - DNA, 13 bp, Homo sapiens
ctctttaaaaaca

SEQ ID NO: 2541796 - DNA, 15 bp, Homo sapiens
ctctttaacttctcg

SEQ ID NO: 2541797 - DNA, 18 bp, Homo sapiens
ctctttaatgtcacaggc

SEQ ID NO: 2541798 - DNA, 23 bp, Homo sapiens
ctctttaatgtcacaggcaggtc

SEQ ID NO: 2541799 - DNA, 12 bp, Homo sapiens
ctctttagccag

SEQ ID NO: 2541800 - DNA, 11 bp, Homo sapiens
ctctttcaaag

SEQ ID NO: 2541801 - DNA, 18 bp, Homo sapiens
ctctttctccttagtctt

SEQ ID NO: 2541802 - DNA, 15 bp, Homo sapiens
ctctttctctccttt

SEQ ID NO: 2541803 - DNA, 20 bp, Homo sapiens
ctctttgaattttctgtgtt

SEQ ID NO: 2541804 - DNA, 19 bp, Homo sapiens
ctctttggggtcagccagg

SEQ ID NO: 2541805 - DNA, 20 bp, Homo sapiens
ctctttggggtcagccaggg

SEQ ID NO: 2541806 - DNA, 21 bp, Homo sapiens
ctctttggtctacactgtgct

SEQ ID NO: 2541807 - DNA, 12 bp, Homo sapiens
ctctttgtaaga

SEQ ID NO: 2541808 - DNA, 17 bp, Homo sapiens
ctctttgtctaaaacaa

SEQ ID NO: 2541809 - DNA, 13 bp, Homo sapiens
ctcttttctcttt

SEQ ID NO: 2541810 - DNA, 11 bp, Homo sapiens
ctctttttaag

SEQ ID NO: 2541811 - DNA, 18 bp, Homo sapiens
ctctttttagggccaggc

SEQ ID NO: 2541812 - DNA, 16 bp, Homo sapiens
ctctttttggaggtgc

SEQ ID NO: 2541813 - DNA, 21 bp, Homo sapiens
ctctttttgggctcctttttc

SEQ ID NO: 2541814 - DNA, 14 bp, Homo sapiens
ctctttttgttttt

SEQ ID NO: 2541815 - DNA, 19 bp, Homo sapiens
ctgaaaacctaagtccttt

SEQ ID NO: 2541816 - DNA, 15 bp, Homo sapiens
ctgaaaatataacca

SEQ ID NO: 2541817 - DNA, 22 bp, Homo sapiens
ctgaaaatataaccagccattg

SEQ ID NO: 2541818 - DNA, 15 bp, Homo sapiens
ctgaaaatctaatat

SEQ ID NO: 2541819 - DNA, 17 bp, Homo sapiens
ctgaaaatctaatatta

SEQ ID NO: 2541820 - DNA, 20 bp, Homo sapiens
ctgaaaatctaatattaaaa

SEQ ID NO: 2541821 - DNA, 13 bp, Homo sapiens
ctgaaaatgtgaa

SEQ ID NO: 2541822 - DNA, 21 bp, Homo sapiens
ctgaaaatgtgaataaaatta

SEQ ID NO: 2541823 - DNA, 22 bp, Homo sapiens
ctgaaaatgtttttctgccagg

SEQ ID NO: 2541824 - DNA, 18 bp, Homo sapiens
ctgaaaattcgaaccagg

SEQ ID NO: 2541825 - DNA, 14 bp, Homo sapiens
ctgaaaccagtgtt

SEQ ID NO: 2541826 - DNA, 17 bp, Homo sapiens
ctgaaacttacacacaa

SEQ ID NO: 2541827 - DNA, 14 bp, Homo sapiens
ctgaaagaggccaa

SEQ ID NO: 2541828 - DNA, 23 bp, Homo sapiens
ctgaaagccagctgccgaccaga

SEQ ID NO: 2541829 - DNA, 18 bp, Homo sapiens
ctgaaagccctgagcttt

SEQ ID NO: 2541830 - DNA, 23 bp, Homo sapiens
ctgaaagtgaaagtccagaaact

SEQ ID NO: 2541831 - DNA, 14 bp, Homo sapiens
ctgaaatttcagat

SEQ ID NO: 2541832 - DNA, 22 bp, Homo sapiens
ctgaaattttatatgcttactg

SEQ ID NO: 2541833 - DNA, 21 bp, Homo sapiens
ctgaacaaactatcagaggaa

SEQ ID NO: 2541834 - DNA, 14 bp, Homo sapiens
ctgaacaagaattg

SEQ ID NO: 2541835 - DNA, 16 bp, Homo sapiens
ctgaacaagaattgga

SEQ ID NO: 2541836 - DNA, 16 bp, Homo sapiens
ctgaaccatccctgat

SEQ ID NO: 2541837 - DNA, 21 bp, Homo sapiens
ctgaaccccgtcgaggggctc

SEQ ID NO: 2541838 - DNA, 21 bp, Homo sapiens
ctgaacctgggtaactaggga

SEQ ID NO: 2541839 - DNA, 14 bp, Homo sapiens
ctgaaccttccatc

SEQ ID NO: 2541840 - DNA, 22 bp, Homo sapiens
ctgaactaataaatctgttgcc

SEQ ID NO: 2541841 - DNA, 16 bp, Homo sapiens
ctgaactgggaccttt

SEQ ID NO: 2541842 - DNA, 22 bp, Homo sapiens
ctgaacttcaggataataaagt

SEQ ID NO: 2541843 - DNA, 13 bp, Homo sapiens
ctgaactttgctg

SEQ ID NO: 2541844 - DNA, 21 bp, Homo sapiens
ctgaactttgctgagcctgta

SEQ ID NO: 2541845 - DNA, 19 bp, Homo sapiens
ctgaagactcattcttctg

SEQ ID NO: 2541846 - DNA, 20 bp, Homo sapiens
ctgaagaggcgggccagcca

SEQ ID NO: 2541847 - DNA, 23 bp, Homo sapiens
ctgaagaggcgggccagccaggc

SEQ ID NO: 2541848 - DNA, 16 bp, Homo sapiens
ctgaagagtcctctga

SEQ ID NO: 2541849 - DNA, 18 bp, Homo sapiens
ctgaagagtcctctgaat

SEQ ID NO: 2541850 - DNA, 14 bp, Homo sapiens
ctgaagcagatgca

SEQ ID NO: 2541851 - DNA, 13 bp, Homo sapiens
ctgaagcatgttt

SEQ ID NO: 2541852 - DNA, 23 bp, Homo sapiens
ctgaagcatgtttcatgttttgt

SEQ ID NO: 2541853 - DNA, 13 bp, Homo sapiens
ctgaagcctctgg

SEQ ID NO: 2541854 - DNA, 13 bp, Homo sapiens
ctgaagcctgcag

SEQ ID NO: 2541855 - DNA, 16 bp, Homo sapiens
ctgaagctgcctgctt

SEQ ID NO: 2541856 - DNA, 15 bp, Homo sapiens
ctgaaggactgtgac

SEQ ID NO: 2541857 - DNA, 13 bp, Homo sapiens
ctgaaggagcccc

SEQ ID NO: 2541858 - DNA, 11 bp, Homo sapiens
ctgaagggagg

SEQ ID NO: 2541859 - DNA, 19 bp, Homo sapiens
ctgaaggtaaaattgaaag

SEQ ID NO: 2541860 - DNA, 14 bp, Homo sapiens
ctgaagtcacacag

SEQ ID NO: 2541861 - DNA, 15 bp, Homo sapiens
ctgaagtcacacagt

SEQ ID NO: 2541862 - DNA, 19 bp, Homo sapiens
ctgaagtcacatcacagga

SEQ ID NO: 2541863 - DNA, 14 bp, Homo sapiens
ctgaagtctgaaat

SEQ ID NO: 2541864 - DNA, 19 bp, Homo sapiens
ctgaagtgaaactgcttgt

SEQ ID NO: 2541865 - DNA, 15 bp, Homo sapiens
ctgaataaatacctc

SEQ ID NO: 2541866 - DNA, 21 bp, Homo sapiens
ctgaataaatacctcttagct

SEQ ID NO: 2541867 - DNA, 12 bp, Homo sapiens
ctgaataaatgg

SEQ ID NO: 2541868 - DNA, 14 bp, Homo sapiens
ctgaataaatggta

SEQ ID NO: 2541869 - DNA, 15 bp, Homo sapiens
ctgaataacatttgt

SEQ ID NO: 2541870 - DNA, 16 bp, Homo sapiens
ctgaatacattctgct

SEQ ID NO: 2541871 - DNA, 17 bp, Homo sapiens
ctgaatatacagcaggt

SEQ ID NO: 2541872 - DNA, 21 bp, Homo sapiens
ctgaatatgaacggtgagcat

SEQ ID NO: 2541873 - DNA, 19 bp, Homo sapiens
ctgaatccaaactaatcca

SEQ ID NO: 2541874 - DNA, 19 bp, Homo sapiens
ctgaatcccccttgccacc

SEQ ID NO: 2541875 - DNA, 21 bp, Homo sapiens
ctgaatcccccttgccacccc

SEQ ID NO: 2541876 - DNA, 19 bp, Homo sapiens
ctgaatgaaacccccacac

SEQ ID NO: 2541877 - DNA, 17 bp, Homo sapiens
ctgaatgaaatatcaga

SEQ ID NO: 2541878 - DNA, 15 bp, Homo sapiens
ctgaatggtccaggg

SEQ ID NO: 2541879 - DNA, 16 bp, Homo sapiens
ctgaatggtccagggt

SEQ ID NO: 2541880 - DNA, 18 bp, Homo sapiens
ctgaatggttccatgcct

SEQ ID NO: 2541881 - DNA, 20 bp, Homo sapiens
ctgaatggttttcaaaataa

SEQ ID NO: 2541882 - DNA, 12 bp, Homo sapiens
ctgaatgttctg

SEQ ID NO: 2541883 - DNA, 13 bp, Homo sapiens
ctgaatgttctga

SEQ ID NO: 2541884 - DNA, 15 bp, Homo sapiens
ctgaatgttgggact

SEQ ID NO: 2541885 - DNA, 16 bp, Homo sapiens
ctgaatgttgggactg

SEQ ID NO: 2541886 - DNA, 16 bp, Homo sapiens
ctgaatgtttattcct

SEQ ID NO: 2541887 - DNA, 19 bp, Homo sapiens
ctgaatgtttattccttga

SEQ ID NO: 2541888 - DNA, 17 bp, Homo sapiens
ctgaattagtccttgct

SEQ ID NO: 2541889 - DNA, 24 bp, Homo sapiens
ctgaattataagaggctgataatt

SEQ ID NO: 2541890 - DNA, 14 bp, Homo sapiens
ctgaatttcttttg

SEQ ID NO: 2541891 - DNA, 21 bp, Homo sapiens
ctgaatttggcctgcactaat

SEQ ID NO: 2541892 - DNA, 13 bp, Homo sapiens
ctgacaatcaact

SEQ ID NO: 2541893 - DNA, 21 bp, Homo sapiens
ctgacaatcaactctaatagt

SEQ ID NO: 2541894 - DNA, 18 bp, Homo sapiens
ctgacacaaacctgcctg

SEQ ID NO: 2541895 - DNA, 19 bp, Homo sapiens
ctgacacaaacctgcctgg

SEQ ID NO: 2541896 - DNA, 16 bp, Homo sapiens
ctgacacacagctctg

SEQ ID NO: 2541897 - DNA, 22 bp, Homo sapiens
ctgacacacagctctgtcctgg

SEQ ID NO: 2541898 - DNA, 23 bp, Homo sapiens
ctgacacacagctctgtcctggg

SEQ ID NO: 2541899 - DNA, 18 bp, Homo sapiens
ctgacacaggatgaaggc

SEQ ID NO: 2541900 - DNA, 13 bp, Homo sapiens
ctgacacccatgt

SEQ ID NO: 2541901 - DNA, 14 bp, Homo sapiens
ctgacacccatgtt

SEQ ID NO: 2541902 - DNA, 21 bp, Homo sapiens
ctgacacccatgtttctctgg

SEQ ID NO: 2541903 - DNA, 14 bp, Homo sapiens
ctgacagacacagg

SEQ ID NO: 2541904 - DNA, 18 bp, Homo sapiens
ctgacagacacaggcccg

SEQ ID NO: 2541905 - DNA, 21 bp, Homo sapiens
ctgccctgcccacctggcctc

SEQ ID NO: 2541906 - DNA, 15 bp, Homo sapiens
ctgccctgcctgagg

SEQ ID NO: 2541907 - DNA, 11 bp, Homo sapiens
ctgccctgctg

SEQ ID NO: 2541908 - DNA, 22 bp, Homo sapiens
ctgccctgctgccgcctcccag

SEQ ID NO: 2541909 - DNA, 12 bp, Homo sapiens
ctgccctggccc

SEQ ID NO: 2541910 - DNA, 23 bp, Homo sapiens
ctgccctggccctgaggtgtggg

SEQ ID NO: 2541911 - DNA, 24 bp, Homo sapiens
ctgccctgggatgtccacagatgc

SEQ ID NO: 2541912 - DNA, 20 bp, Homo sapiens
ctgccctggtccagggaagc

SEQ ID NO: 2541913 - DNA, 21 bp, Homo sapiens
ctgccctgtaccccagcactt

SEQ ID NO: 2541914 - DNA, 13 bp, Homo sapiens
ctgccctgtgagt

SEQ ID NO: 2541915 - DNA, 11 bp, Homo sapiens
ctgccctgtgg

SEQ ID NO: 2541916 - DNA, 16 bp, Homo sapiens
ctgcccttcaccccag

SEQ ID NO: 2541917 - DNA, 17 bp, Homo sapiens
ctgcccttgtcccactc

SEQ ID NO: 2541918 - DNA, 18 bp, Homo sapiens
ctgcccttgtcccactca

SEQ ID NO: 2541919 - DNA, 17 bp, Homo sapiens
ctgccgcaacagttttt

SEQ ID NO: 2541920 - DNA, 19 bp, Homo sapiens
ctgccgcaatacaggaacc

SEQ ID NO: 2541921 - DNA, 14 bp, Homo sapiens
ctgccggctctttc

SEQ ID NO: 2541922 - DNA, 20 bp, Homo sapiens
ctgccggctctttccttgct

SEQ ID NO: 2541923 - DNA, 20 bp, Homo sapiens
ctgccgggttctagtctcct

SEQ ID NO: 2541924 - DNA, 15 bp, Homo sapiens
ctgcctaagtgcagc

SEQ ID NO: 2541925 - DNA, 23 bp, Homo sapiens
ctgcctcacagctggccgtcact

SEQ ID NO: 2541926 - DNA, 12 bp, Homo sapiens
ctgcctcagcct

SEQ ID NO: 2541927 - DNA, 14 bp, Homo sapiens
ctgcctcagcctcc

SEQ ID NO: 2541928 - DNA, 18 bp, Homo sapiens
ctgcctccaccctctgag

SEQ ID NO: 2541929 - DNA, 21 bp, Homo sapiens
ctgcctccaccctctgagctt

SEQ ID NO: 2541930 - DNA, 16 bp, Homo sapiens
ctgcctcccatcaccc

SEQ ID NO: 2541931 - DNA, 16 bp, Homo sapiens
ctgcctcccattctga

SEQ ID NO: 2541932 - DNA, 12 bp, Homo sapiens
ctgcctccccaa

SEQ ID NO: 2541933 - DNA, 14 bp, Homo sapiens
ctgcctccccaacc

SEQ ID NO: 2541934 - DNA, 19 bp, Homo sapiens
ctgcctccccaaccctgcc

SEQ ID NO: 2541935 - DNA, 16 bp, Homo sapiens
ctgcctcccctgtgca

SEQ ID NO: 2541936 - DNA, 21 bp, Homo sapiens
ctgcctccctcaccctgagcc

SEQ ID NO: 2541937 - DNA, 17 bp, Homo sapiens
ctgcctcccttcatgca

SEQ ID NO: 2541938 - DNA, 18 bp, Homo sapiens
ctgcctcccttcatgcat

SEQ ID NO: 2541939 - DNA, 21 bp, Homo sapiens
ctgcctcccttcatgcatgga

SEQ ID NO: 2541940 - DNA, 13 bp, Homo sapiens
ctgcctcctcttc

SEQ ID NO: 2541941 - DNA, 14 bp, Homo sapiens
ctgcctcctcttca

SEQ ID NO: 2541942 - DNA, 19 bp, Homo sapiens
ctgcctcctgcctgcccct

SEQ ID NO: 2541943 - DNA, 17 bp, Homo sapiens
ctgcctcgaactggctg

SEQ ID NO: 2541944 - DNA, 19 bp, Homo sapiens
ctgcctcgaactggctgca

SEQ ID NO: 2541945 - DNA, 22 bp, Homo sapiens
ctgcctctcatcaactgaatga

SEQ ID NO: 2541946 - DNA, 15 bp, Homo sapiens
ctgcctctcccatca

SEQ ID NO: 2541947 - DNA, 17 bp, Homo sapiens
ctgcctctccctggccc

SEQ ID NO: 2541948 - DNA, 19 bp, Homo sapiens
ctgcctctccctggccctc

SEQ ID NO: 2541949 - DNA, 23 bp, Homo sapiens
ctgcctctgacacacagctctgt

SEQ ID NO: 2541950 - DNA, 15 bp, Homo sapiens
ctgcctctgagggaa

SEQ ID NO: 2541951 - DNA, 21 bp, Homo sapiens
ctgcctctgagggaaagccca

SEQ ID NO: 2541952 - DNA, 18 bp, Homo sapiens
ctgcctctgcctgcattc

SEQ ID NO: 2541953 - DNA, 20 bp, Homo sapiens
ctgcctctgcctgcattctg

SEQ ID NO: 2541954 - DNA, 15 bp, Homo sapiens
ctgcctcttctctac

SEQ ID NO: 2541955 - DNA, 16 bp, Homo sapiens
ctgcctcttctgggag

SEQ ID NO: 2541956 - DNA, 19 bp, Homo sapiens
ctgcctgaagtcacacagt

SEQ ID NO: 2541957 - DNA, 23 bp, Homo sapiens
ctgcctgaagtcacacagtgagt

SEQ ID NO: 2541958 - DNA, 20 bp, Homo sapiens
ctgcctgacatttggagtgt

SEQ ID NO: 2541959 - DNA, 16 bp, Homo sapiens
ctgcctgagggcccct

SEQ ID NO: 2541960 - DNA, 12 bp, Homo sapiens
ctgcctgcccac

SEQ ID NO: 2541961 - DNA, 15 bp, Homo sapiens
ctgcctgcccacccg

SEQ ID NO: 2541962 - DNA, 16 bp, Homo sapiens
ctgcctgcccacccgt

SEQ ID NO: 2541963 - DNA, 17 bp, Homo sapiens
ctgcctgcccaggcccc

SEQ ID NO: 2541964 - DNA, 22 bp, Homo sapiens
ctgcctgcccaggcccctgcca

SEQ ID NO: 2541965 - DNA, 14 bp, Homo sapiens
ctgcctgcctgtct

SEQ ID NO: 2541966 - DNA, 18 bp, Homo sapiens
ctgcctggactagaggga

SEQ ID NO: 2541967 - DNA, 16 bp, Homo sapiens
ctgcctggccaggcag

SEQ ID NO: 2541968 - DNA, 18 bp, Homo sapiens
ctgcctgggctgttggca

SEQ ID NO: 2541969 - DNA, 15 bp, Homo sapiens
ctgcctgtagttagg

SEQ ID NO: 2541970 - DNA, 16 bp, Homo sapiens
ctgcctgtagttagga

SEQ ID NO: 2541971 - DNA, 19 bp, Homo sapiens
ctgcctgtccctctcaggc

SEQ ID NO: 2541972 - DNA, 20 bp, Homo sapiens
ctgcctgtccctctcaggca

SEQ ID NO: 2541973 - DNA, 15 bp, Homo sapiens
ctgcctgtctgaagc

SEQ ID NO: 2541974 - DNA, 18 bp, Homo sapiens
ctgcctgttataactctg

SEQ ID NO: 2541975 - DNA, 20 bp, Homo sapiens
ctgcctgttataactctgca

SEQ ID NO: 2541976 - DNA, 22 bp, Homo sapiens
ctgcctgttataactctgcact

SEQ ID NO: 2541977 - DNA, 17 bp, Homo sapiens
ctgcctgttcagctcca

SEQ ID NO: 2541978 - DNA, 18 bp, Homo sapiens
ctgcctgttcagctccag

SEQ ID NO: 2541979 - DNA, 19 bp, Homo sapiens
ctgcctgttcagctccagc

SEQ ID NO: 2541980 - DNA, 15 bp, Homo sapiens
ctgcctgttcccatt

SEQ ID NO: 2541981 - DNA, 19 bp, Homo sapiens
ctgcctgttcccattcttg

SEQ ID NO: 2541982 - DNA, 13 bp, Homo sapiens
ctgccttcctcct

SEQ ID NO: 2541983 - DNA, 14 bp, Homo sapiens
ctgccttcctcctg

SEQ ID NO: 2541984 - DNA, 15 bp, Homo sapiens
ctgccttcctcctgg

SEQ ID NO: 2541985 - DNA, 12 bp, Homo sapiens
ctgccttccttg

SEQ ID NO: 2541986 - DNA, 21 bp, Homo sapiens
ctgccttcttctttttgctgt

SEQ ID NO: 2541987 - DNA, 18 bp, Homo sapiens
ctgcgcccaccccgctct

SEQ ID NO: 2541988 - DNA, 17 bp, Homo sapiens
ctgcgcccttaccttcc

SEQ ID NO: 2541989 - DNA, 18 bp, Homo sapiens
ctgcgcccttaccttccc

SEQ ID NO: 2541990 - DNA, 19 bp, Homo sapiens
ctgcggagtgaagaggggc

SEQ ID NO: 2541991 - DNA, 19 bp, Homo sapiens
ctgcgggatggtcctgggg

SEQ ID NO: 2541992 - DNA, 22 bp, Homo sapiens
ctgcgggatggtcctggggctc

SEQ ID NO: 2541993 - DNA, 16 bp, Homo sapiens
ctgcggtccacccagg

SEQ ID NO: 2541994 - DNA, 18 bp, Homo sapiens
ctgcggtccacccaggag

SEQ ID NO: 2541995 - DNA, 15 bp, Homo sapiens
ctgcgtgcctgtgga

SEQ ID NO: 2541996 - DNA, 20 bp, Homo sapiens
ctgcgttttggaagctctga

SEQ ID NO: 2541997 - DNA, 12 bp, Homo sapiens
ctgctaaataaa

SEQ ID NO: 2541998 - DNA, 15 bp, Homo sapiens
ctgctaaataaaatt

SEQ ID NO: 2541999 - DNA, 20 bp, Homo sapiens
ctgctaacttggagccccag

SEQ ID NO: 2542000 - DNA, 12 bp, Homo sapiens
ctgctacaaaga

SEQ ID NO: 2542001 - DNA, 18 bp, Homo sapiens
ctgctacaaagaagacat

SEQ ID NO: 2542002 - DNA, 19 bp, Homo sapiens
ctgctacaaagaagacatg

SEQ ID NO: 2542003 - DNA, 23 bp, Homo sapiens
ctgctacaaatactcttaggaag

SEQ ID NO: 2542004 - DNA, 16 bp, Homo sapiens
ctgctacacatacagg

SEQ ID NO: 2542005 - DNA, 17 bp, Homo sapiens
ctgctacccagaaatca

SEQ ID NO: 2542006 - DNA, 13 bp, Homo sapiens
ctgctacctcact

SEQ ID NO: 2542007 - DNA, 15 bp, Homo sapiens
ctgctacctcactgg

SEQ ID NO: 2542008 - DNA, 17 bp, Homo sapiens
ctgctacctcactgggg

SEQ ID NO: 2542009 - DNA, 22 bp, Homo sapiens
ctgctactctgttccttcacat

SEQ ID NO: 2542010 - DNA, 15 bp, Homo sapiens
ctgctaggcgagtgc

SEQ ID NO: 2542011 - DNA, 23 bp, Homo sapiens
ctgctaggcgagtgccaggactc

SEQ ID NO: 2542012 - DNA, 16 bp, Homo sapiens
ctgctaggtgggccag

SEQ ID NO: 2542013 - DNA, 15 bp, Homo sapiens
ctgctcaatacatct

SEQ ID NO: 2542014 - DNA, 16 bp, Homo sapiens
ctgctcacatatctgt

SEQ ID NO: 2542015 - DNA, 19 bp, Homo sapiens
ctgctcatattgtgattct

SEQ ID NO: 2542016 - DNA, 16 bp, Homo sapiens
ctgctccaccacatcc

SEQ ID NO: 2542017 - DNA, 11 bp, Homo sapiens
ctgctccaccc

SEQ ID NO: 2542018 - DNA, 15 bp, Homo sapiens
ctgctccagctgttc

SEQ ID NO: 2542019 - DNA, 19 bp, Homo sapiens
ctgctccagctgttcagct

SEQ ID NO: 2542020 - DNA, 17 bp, Homo sapiens
ctgctcccagcagccct

SEQ ID NO: 2542021 - DNA, 22 bp, Homo sapiens
ctgctcccagcagccctaagga

SEQ ID NO: 2542022 - DNA, 19 bp, Homo sapiens
ctgctcctccctggctgcc

SEQ ID NO: 2542023 - DNA, 20 bp, Homo sapiens
ctgctcctccctggctgccc

SEQ ID NO: 2542024 - DNA, 13 bp, Homo sapiens
ctgctcctctcca

SEQ ID NO: 2542025 - DNA, 17 bp, Homo sapiens
ctgctcctctccaggca

SEQ ID NO: 2542026 - DNA, 20 bp, Homo sapiens
ctgctcctctccccagcaag

SEQ ID NO: 2542027 - DNA, 15 bp, Homo sapiens
ctgctcctggagcct

SEQ ID NO: 2542028 - DNA, 22 bp, Homo sapiens
ctgctctgaattagtccttgct

SEQ ID NO: 2542029 - DNA, 19 bp, Homo sapiens
ctgctctgaggcttccaga

SEQ ID NO: 2542030 - DNA, 20 bp, Homo sapiens
ctgctctgcgtgtcacctgt

SEQ ID NO: 2542031 - DNA, 13 bp, Homo sapiens
ctgctctggaaaa

SEQ ID NO: 2542032 - DNA, 18 bp, Homo sapiens
ctgctctggaatttgcaa

SEQ ID NO: 2542033 - DNA, 14 bp, Homo sapiens
ctgctcttgtttct

SEQ ID NO: 2542034 - DNA, 12 bp, Homo sapiens
ctgctgaaggct

SEQ ID NO: 2542035 - DNA, 15 bp, Homo sapiens
ctgctgacagacaca

SEQ ID NO: 2542036 - DNA, 19 bp, Homo sapiens
ctgctgacagacacaggcc

SEQ ID NO: 2542037 - DNA, 20 bp, Homo sapiens
ctgctgacagacacaggccc

SEQ ID NO: 2542038 - DNA, 11 bp, Homo sapiens
ctgctgacagt

SEQ ID NO: 2542039 - DNA, 12 bp, Homo sapiens
ctgctgacagtg

SEQ ID NO: 2542040 - DNA, 16 bp, Homo sapiens
ctgctgacctccacag

SEQ ID NO: 2542041 - DNA, 18 bp, Homo sapiens
ctgctgacctccacagct

SEQ ID NO: 2542042 - DNA, 16 bp, Homo sapiens
ctgctgcaaggccttt

SEQ ID NO: 2542043 - DNA, 21 bp, Homo sapiens
ctgctgcaaggcctttctgtg

SEQ ID NO: 2542044 - DNA, 10 bp, Homo sapiens
ctgctgcagt

SEQ ID NO: 2542045 - DNA, 12 bp, Homo sapiens
ctgctgcccagc

SEQ ID NO: 2542046 - DNA, 15 bp, Homo sapiens
ctgctgcccagcctc

SEQ ID NO: 2542047 - DNA, 12 bp, Homo sapiens
ctgctgccctcc

SEQ ID NO: 2542048 - DNA, 17 bp, Homo sapiens
ctgctgccgcctcccag

SEQ ID NO: 2542049 - DNA, 20 bp, Homo sapiens
ctgctgccgcctcccagcct

SEQ ID NO: 2542050 - DNA, 15 bp, Homo sapiens
ctgctgcctccccaa

SEQ ID NO: 2542051 - DNA, 17 bp, Homo sapiens
ctgctgcgcccttacct

SEQ ID NO: 2542052 - DNA, 14 bp, Homo sapiens
ctgctggcccctca

SEQ ID NO: 2542053 - DNA, 15 bp, Homo sapiens
ctgctggccgcctca

SEQ ID NO: 2542054 - DNA, 11 bp, Homo sapiens
ctgctgggctt

SEQ ID NO: 2542055 - DNA, 15 bp, Homo sapiens
ctgctgggtgtggcg

SEQ ID NO: 2542056 - DNA, 18 bp, Homo sapiens
ctgctggtcacagcctcc

SEQ ID NO: 2542057 - DNA, 23 bp, Homo sapiens
ctgctggttcagggttggcccct

SEQ ID NO: 2542058 - DNA, 16 bp, Homo sapiens
ctgctgtccagacagc

SEQ ID NO: 2542059 - DNA, 18 bp, Homo sapiens
ctgctgtccagacagcct

SEQ ID NO: 2542060 - DNA, 15 bp, Homo sapiens
ctgctgtctcagcct

SEQ ID NO: 2542061 - DNA, 23 bp, Homo sapiens
ctgctgtgaatttgtgtaaggat

SEQ ID NO: 2542062 - DNA, 13 bp, Homo sapiens
ctgcttaacttca

SEQ ID NO: 2542063 - DNA, 20 bp, Homo sapiens
ctgcttaacttcacatattg

SEQ ID NO: 2542064 - DNA, 23 bp, Homo sapiens
ctgcttatcaataaacctgtttg

SEQ ID NO: 2542065 - DNA, 21 bp, Homo sapiens
ctgcttcatgctcagccctga

SEQ ID NO: 2542066 - DNA, 16 bp, Homo sapiens
ctgcttccagtgaggc

SEQ ID NO: 2542067 - DNA, 23 bp, Homo sapiens
ctgcttccagtgaggctctgccc

SEQ ID NO: 2542068 - DNA, 19 bp, Homo sapiens
ctgcttcccatcctaccct

SEQ ID NO: 2542069 - DNA, 20 bp, Homo sapiens
ctgcttccctctgcctgtcc

SEQ ID NO: 2542070 - DNA, 13 bp, Homo sapiens
ctgcttgaggaaa

SEQ ID NO: 2542071 - DNA, 21 bp, Homo sapiens
ctgcttgaggcaactcatctt

SEQ ID NO: 2542072 - DNA, 13 bp, Homo sapiens
ctgcttgattttt

SEQ ID NO: 2542073 - DNA, 16 bp, Homo sapiens
ctgctttcccctgtgg

SEQ ID NO: 2542074 - DNA, 21 bp, Homo sapiens
ctgctttcccctgtggggatc

SEQ ID NO: 2542075 - DNA, 13 bp, Homo sapiens
ctgctttggaaat

SEQ ID NO: 2542076 - DNA, 15 bp, Homo sapiens
ctgcttttcactgct

SEQ ID NO: 2542077 - DNA, 23 bp, Homo sapiens
ctgcttttccttggggcaggcag

SEQ ID NO: 2542078 - DNA, 15 bp, Homo sapiens
ctgcttttggtctgt

SEQ ID NO: 2542079 - DNA, 17 bp, Homo sapiens
ctgcttttggtctgtgt

SEQ ID NO: 2542080 - DNA, 19 bp, Homo sapiens
ctggaaaagggtcttggga

SEQ ID NO: 2542081 - DNA, 20 bp, Homo sapiens
ctggaaaattcctattgatt

SEQ ID NO: 2542082 - DNA, 13 bp, Homo sapiens
ctggaaaggctca

SEQ ID NO: 2542083 - DNA, 17 bp, Homo sapiens
ctggaaaggctcagtct

SEQ ID NO: 2542084 - DNA, 23 bp, Homo sapiens
ctggaaaggggggagctggggaa

SEQ ID NO: 2542085 - DNA, 16 bp, Homo sapiens
ctggaaatattaagaa

SEQ ID NO: 2542086 - DNA, 14 bp, Homo sapiens
ctggaacagattca

SEQ ID NO: 2542087 - DNA, 21 bp, Homo sapiens
ctggaactcagtgtgactcct

SEQ ID NO: 2542088 - DNA, 13 bp, Homo sapiens
ctggaagacagag

SEQ ID NO: 2542089 - DNA, 12 bp, Homo sapiens
ctggaagagagg

SEQ ID NO: 2542090 - DNA, 15 bp, Homo sapiens
ctggaagcacatgtt

SEQ ID NO: 2542091 - DNA, 15 bp, Homo sapiens
ctggaagccagcttt

SEQ ID NO: 2542092 - DNA, 17 bp, Homo sapiens
ctggaaggggcccgtgg

SEQ ID NO: 2542093 - DNA, 15 bp, Homo sapiens
ctggaagtgactttg

SEQ ID NO: 2542094 - DNA, 23 bp, Homo sapiens
ctggaatcaagatgtcagactgg

SEQ ID NO: 2542095 - DNA, 20 bp, Homo sapiens
ctggaatggaagggttctgg

SEQ ID NO: 2542096 - DNA, 14 bp, Homo sapiens
ctggaatgtaatca

SEQ ID NO: 2542097 - DNA, 15 bp, Homo sapiens
ctggaatgtaatcaa

SEQ ID NO: 2542098 - DNA, 15 bp, Homo sapiens
ctggacaagcagagg

SEQ ID NO: 2542099 - DNA, 18 bp, Homo sapiens
ctggacaagcagaggtgg

SEQ ID NO: 2542100 - DNA, 21 bp, Homo sapiens
ctggacaagccaacttgtaaa

SEQ ID NO: 2542101 - DNA, 23 bp, Homo sapiens
ctggacaagccaacttgtaaata

SEQ ID NO: 2542102 - DNA, 23 bp, Homo sapiens
ctggaccaaccctgtttcctgag

SEQ ID NO: 2542103 - DNA, 15 bp, Homo sapiens
ctggaccctgtggat

SEQ ID NO: 2542104 - DNA, 15 bp, Homo sapiens
ctggacctgcctcct

SEQ ID NO: 2542105 - DNA, 17 bp, Homo sapiens
ctggacctgcctcctgc

SEQ ID NO: 2542106 - DNA, 17 bp, Homo sapiens
ctggaccttgaactggg

SEQ ID NO: 2542107 - DNA, 21 bp, Homo sapiens
ctggaccttgaactgggtact

SEQ ID NO: 2542108 - DNA, 15 bp, Homo sapiens
ctggactccggccct

SEQ ID NO: 2542109 - DNA, 14 bp, Homo sapiens
ctggactcctctgt

SEQ ID NO: 2542110 - DNA, 22 bp, Homo sapiens
ctggactcctctgtccaggcac

SEQ ID NO: 2542111 - DNA, 23 bp, Homo sapiens
ctggactcctctgtccaggcact

SEQ ID NO: 2542112 - DNA, 17 bp, Homo sapiens
ctggactctcagtctct

SEQ ID NO: 2542113 - DNA, 18 bp, Homo sapiens
ctggactctcagtctctg

SEQ ID NO: 2542114 - DNA, 19 bp, Homo sapiens
ctggactctcagtctctga

SEQ ID NO: 2542115 - DNA, 21 bp, Homo sapiens
ctggactctcagtctctgagc

SEQ ID NO: 2542116 - DNA, 19 bp, Homo sapiens
ctggactgaagcctgcagg

SEQ ID NO: 2542117 - DNA, 22 bp, Homo sapiens
ctggactgaagcctgcaggagt

SEQ ID NO: 2542118 - DNA, 23 bp, Homo sapiens
ctggactgaagcctgcaggagtt

SEQ ID NO: 2542119 - DNA, 20 bp, Homo sapiens
ctggactgccttgaatatcc

SEQ ID NO: 2542120 - DNA, 22 bp, Homo sapiens
ctggactgccttgaatatcccc

SEQ ID NO: 2542121 - DNA, 15 bp, Homo sapiens
ctggactggctagag

SEQ ID NO: 2542122 - DNA, 16 bp, Homo sapiens
ctggactgggaggtag

SEQ ID NO: 2542123 - DNA, 18 bp, Homo sapiens
ctggactgtcatagaaat

SEQ ID NO: 2542124 - DNA, 19 bp, Homo sapiens
ctggactgtcatagaaatt

SEQ ID NO: 2542125 - DNA, 22 bp, Homo sapiens
ctggagaactagaacctggagg

SEQ ID NO: 2542126 - DNA, 15 bp, Homo sapiens
ctggagaagctccca

SEQ ID NO: 2542127 - DNA, 19 bp, Homo sapiens
ctggagaagctcccaggaa

SEQ ID NO: 2542128 - DNA, 22 bp, Homo sapiens
ctggagaagctcccaggaacaa

SEQ ID NO: 2542129 - DNA, 21 bp, Homo sapiens
ctggagacgggtgggcggctg

SEQ ID NO: 2542130 - DNA, 22 bp, Homo sapiens
ctggagagccagaacctggagg

SEQ ID NO: 2542131 - DNA, 12 bp, Homo sapiens
ctggagaggtta

SEQ ID NO: 2542132 - DNA, 13 bp, Homo sapiens
ctggagcagacca

SEQ ID NO: 2542133 - DNA, 18 bp, Homo sapiens
ctggagcagaccaccccg

SEQ ID NO: 2542134 - DNA, 12 bp, Homo sapiens
ctggagcatctg

SEQ ID NO: 2542135 - DNA, 15 bp, Homo sapiens
ctggagccaagtcca

SEQ ID NO: 2542136 - DNA, 17 bp, Homo sapiens
ctggagccaagtccaga

SEQ ID NO: 2542137 - DNA, 22 bp, Homo sapiens
ctggagccagactctggtcttc

SEQ ID NO: 2542138 - DNA, 15 bp, Homo sapiens
ctggagcccaggagt

SEQ ID NO: 2542139 - DNA, 13 bp, Homo sapiens
ctggagccccatc

SEQ ID NO: 2542140 - DNA, 12 bp, Homo sapiens
ctggagcccctg

SEQ ID NO: 2542141 - DNA, 17 bp, Homo sapiens
ctggagcccctgggtgg

SEQ ID NO: 2542142 - DNA, 16 bp, Homo sapiens
ctggagcctggtgccc

SEQ ID NO: 2542143 - DNA, 12 bp, Homo sapiens
ctggagctctgc

SEQ ID NO: 2542144 - DNA, 16 bp, Homo sapiens
ctggagctctgcccat

SEQ ID NO: 2542145 - DNA, 20 bp, Homo sapiens
ctggaggactagaacctgga

SEQ ID NO: 2542146 - DNA, 13 bp, Homo sapiens
ctggaggagagaa

SEQ ID NO: 2542147 - DNA, 17 bp, Homo sapiens
ctggaggagagaagaat

SEQ ID NO: 2542148 - DNA, 20 bp, Homo sapiens
ctggagggctagaacctaga

SEQ ID NO: 2542149 - DNA, 22 bp, Homo sapiens
ctggagggctagaacctggaga

SEQ ID NO: 2542150 - DNA, 22 bp, Homo sapiens
ctggagggctggaatctggaga

SEQ ID NO: 2542151 - DNA, 21 bp, Homo sapiens
ctggaggggctagaacctaga

SEQ ID NO: 2542152 - DNA, 16 bp, Homo sapiens
ctggaggtaaggcctt

SEQ ID NO: 2542153 - DNA, 18 bp, Homo sapiens
ctggaggtggggcctgga

SEQ ID NO: 2542154 - DNA, 22 bp, Homo sapiens
ctggaggtggggcctggagcag

SEQ ID NO: 2542155 - DNA, 15 bp, Homo sapiens
ctggagtctccagtg

SEQ ID NO: 2542156 - DNA, 14 bp, Homo sapiens
ctggagtgcagtgg

SEQ ID NO: 2542157 - DNA, 22 bp, Homo sapiens
ctggagttacattaatgttaat

SEQ ID NO: 2542158 - DNA, 15 bp, Homo sapiens
ctggataggagcctg

SEQ ID NO: 2542159 - DNA, 16 bp, Homo sapiens
ctggatattttcaaat

SEQ ID NO: 2542160 - DNA, 14 bp, Homo sapiens
ctggatcacagctg

SEQ ID NO: 2542161 - DNA, 17 bp, Homo sapiens
ctggatcagtcctttga

SEQ ID NO: 2542162 - DNA, 20 bp, Homo sapiens
ctggatcagtcctttgatca

SEQ ID NO: 2542163 - DNA, 17 bp, Homo sapiens
ctggatccatcaggcca

SEQ ID NO: 2542164 - DNA, 23 bp, Homo sapiens
ctggatctcctcaagtccccaag

SEQ ID NO: 2542165 - DNA, 14 bp, Homo sapiens
ctggatctgtgagg

SEQ ID NO: 2542166 - DNA, 18 bp, Homo sapiens
ctggatgcagcctcacag

SEQ ID NO: 2542167 - DNA, 22 bp, Homo sapiens
ctggatgcagcctcacagtcct

SEQ ID NO: 2542168 - DNA, 23 bp, Homo sapiens
ctggatggcaccagaggctgcag

SEQ ID NO: 2542169 - DNA, 18 bp, Homo sapiens
ctggatgggctgcagcag

SEQ ID NO: 2542170 - DNA, 14 bp, Homo sapiens
ctggattcccagga

SEQ ID NO: 2542171 - DNA, 13 bp, Homo sapiens
ctggattttgtca

SEQ ID NO: 2542172 - DNA, 16 bp, Homo sapiens
ctggcaaacatgaaaa

SEQ ID NO: 2542173 - DNA, 19 bp, Homo sapiens
ctggcaaagggagcagaac

SEQ ID NO: 2542174 - DNA, 22 bp, Homo sapiens
ctggcaagctagaacctggagg

SEQ ID NO: 2542175 - DNA, 18 bp, Homo sapiens
ctggcacaaactcttggt

SEQ ID NO: 2542176 - DNA, 12 bp, Homo sapiens
ctggcacacatc

SEQ ID NO: 2542177 - DNA, 12 bp, Homo sapiens
ctggcacagtct

SEQ ID NO: 2542178 - DNA, 18 bp, Homo sapiens
ctggcacagttttctgag

SEQ ID NO: 2542179 - DNA, 21 bp, Homo sapiens
ctggcacagttttctgagaaa

SEQ ID NO: 2542180 - DNA, 17 bp, Homo sapiens
ctggcacccggcccctg

SEQ ID NO: 2542181 - DNA, 19 bp, Homo sapiens
ctggcacccggcccctgct

SEQ ID NO: 2542182 - DNA, 17 bp, Homo sapiens
ctggcaccgccttctct

SEQ ID NO: 2542183 - DNA, 22 bp, Homo sapiens
ctggcactataatgtaagctct

SEQ ID NO: 2542184 - DNA, 14 bp, Homo sapiens
ctggcactgctgtg

SEQ ID NO: 2542185 - DNA, 16 bp, Homo sapiens
ctggcactgctgtgct

SEQ ID NO: 2542186 - DNA, 19 bp, Homo sapiens
ctggcactgcttccagtga

SEQ ID NO: 2542187 - DNA, 23 bp, Homo sapiens
ctggcactgcttccagtgaggct

SEQ ID NO: 2542188 - DNA, 21 bp, Homo sapiens
ctggcagaaagcaaatgtgac

SEQ ID NO: 2542189 - DNA, 15 bp, Homo sapiens
ctggcagcagagtgt

SEQ ID NO: 2542190 - DNA, 12 bp, Homo sapiens
ctggcagctctc

SEQ ID NO: 2542191 - DNA, 16 bp, Homo sapiens
ctggcagctctccagt

SEQ ID NO: 2542192 - DNA, 23 bp, Homo sapiens
ctggcagctctccagtcaggagg

SEQ ID NO: 2542193 - DNA, 18 bp, Homo sapiens
ctggcaggatgaccctgc

SEQ ID NO: 2542194 - DNA, 15 bp, Homo sapiens
ctgtctgttacactg

SEQ ID NO: 2542195 - DNA, 15 bp, Homo sapiens
ctgtcttcaagggct

SEQ ID NO: 2542196 - DNA, 18 bp, Homo sapiens
ctgtcttcacaacagatt

SEQ ID NO: 2542197 - DNA, 22 bp, Homo sapiens
ctgtcttcacctgattcaacta

SEQ ID NO: 2542198 - DNA, 17 bp, Homo sapiens
ctgtcttctcaggctct

SEQ ID NO: 2542199 - DNA, 23 bp, Homo sapiens
ctgtgaaactggcactgaattaa

SEQ ID NO: 2542200 - DNA, 16 bp, Homo sapiens
ctgtgaaaggaaagag

SEQ ID NO: 2542201 - DNA, 16 bp, Homo sapiens
ctgtgaaatgctggca

SEQ ID NO: 2542202 - DNA, 22 bp, Homo sapiens
ctgtgaacgatttagaaagaag

SEQ ID NO: 2542203 - DNA, 15 bp, Homo sapiens
ctgtgaacttgggga

SEQ ID NO: 2542204 - DNA, 15 bp, Homo sapiens
ctgtgaagagaacca

SEQ ID NO: 2542205 - DNA, 14 bp, Homo sapiens
ctgtgaagtaagga

SEQ ID NO: 2542206 - DNA, 18 bp, Homo sapiens
ctgtgaagtccttcacct

SEQ ID NO: 2542207 - DNA, 24 bp, Homo sapiens
ctgtgaagtccttcacctcactga

SEQ ID NO: 2542208 - DNA, 15 bp, Homo sapiens
ctgtgaattcagatt

SEQ ID NO: 2542209 - DNA, 19 bp, Homo sapiens
ctgtgaatttgtgtaagga

SEQ ID NO: 2542210 - DNA, 13 bp, Homo sapiens
ctgtgacatgtaa

SEQ ID NO: 2542211 - DNA, 16 bp, Homo sapiens
ctgtgaccaatgtctt

SEQ ID NO: 2542212 - DNA, 14 bp, Homo sapiens
ctgtgaccagcact

SEQ ID NO: 2542213 - DNA, 20 bp, Homo sapiens
ctgtgaccagcactgtctca

SEQ ID NO: 2542214 - DNA, 14 bp, Homo sapiens
ctgtgacctgtggg

SEQ ID NO: 2542215 - DNA, 19 bp, Homo sapiens
ctgtgagacccccacacct

SEQ ID NO: 2542216 - DNA, 13 bp, Homo sapiens
ctgtgagattttg

SEQ ID NO: 2542217 - DNA, 16 bp, Homo sapiens
ctgtgagcatcacagt

SEQ ID NO: 2542218 - DNA, 19 bp, Homo sapiens
ctgtgagcatcacagtttt

SEQ ID NO: 2542219 - DNA, 16 bp, Homo sapiens
ctgtgagcccctggtc

SEQ ID NO: 2542220 - DNA, 17 bp, Homo sapiens
ctgtgaggcccctggac

SEQ ID NO: 2542221 - DNA, 18 bp, Homo sapiens
ctgtgaggcccctggaca

SEQ ID NO: 2542222 - DNA, 23 bp, Homo sapiens
ctgtgaggtgcagagtgcccaga

SEQ ID NO: 2542223 - DNA, 19 bp, Homo sapiens
ctgtgagtgtaagtgtgag

SEQ ID NO: 2542224 - DNA, 21 bp, Homo sapiens
ctgtgagtgtaagtgtgagta

SEQ ID NO: 2542225 - DNA, 17 bp, Homo sapiens
ctgtgatggggccctgc

SEQ ID NO: 2542226 - DNA, 18 bp, Homo sapiens
ctgtgatggggccctgcc

SEQ ID NO: 2542227 - DNA, 12 bp, Homo sapiens
ctgtgcacgcag

SEQ ID NO: 2542228 - DNA, 17 bp, Homo sapiens
ctgtgcacgcagtggcc

SEQ ID NO: 2542229 - DNA, 19 bp, Homo sapiens
ctgtgcagccgctgagcga

SEQ ID NO: 2542230 - DNA, 23 bp, Homo sapiens
ctgtgcagcctgtcctgggctgg

SEQ ID NO: 2542231 - DNA, 15 bp, Homo sapiens
ctgtgcagggaggag

SEQ ID NO: 2542232 - DNA, 23 bp, Homo sapiens
ctgtgcagtggcccccacagaaa

SEQ ID NO: 2542233 - DNA, 15 bp, Homo sapiens
ctgtgcatgtatgtc

SEQ ID NO: 2542234 - DNA, 17 bp, Homo sapiens
ctgtgcatgtatgtctt

SEQ ID NO: 2542235 - DNA, 13 bp, Homo sapiens
ctgtgccacccac

SEQ ID NO: 2542236 - DNA, 21 bp, Homo sapiens
ctgtgccactcaccgaagcca

SEQ ID NO: 2542237 - DNA, 14 bp, Homo sapiens
ctgtgccatgtgcc

SEQ ID NO: 2542238 - DNA, 15 bp, Homo sapiens
ctgtgccatgtgcca

SEQ ID NO: 2542239 - DNA, 14 bp, Homo sapiens
ctgtgccattttgt

SEQ ID NO: 2542240 - DNA, 18 bp, Homo sapiens
ctgtgcccacatcccagg

SEQ ID NO: 2542241 - DNA, 23 bp, Homo sapiens
ctgtgcccacatcccaggcttca

SEQ ID NO: 2542242 - DNA, 11 bp, Homo sapiens
ctgtgccctgg

SEQ ID NO: 2542243 - DNA, 12 bp, Homo sapiens
ctgtgccctggt

SEQ ID NO: 2542244 - DNA, 17 bp, Homo sapiens
ctgtgccctggtggaga

SEQ ID NO: 2542245 - DNA, 16 bp, Homo sapiens
ctgtgcctcctcaccc

SEQ ID NO: 2542246 - DNA, 12 bp, Homo sapiens
ctgtgcctctgc

SEQ ID NO: 2542247 - DNA, 14 bp, Homo sapiens
ctgtgcctctgcct

SEQ ID NO: 2542248 - DNA, 15 bp, Homo sapiens
ctgtgcctctgcctg

SEQ ID NO: 2542249 - DNA, 16 bp, Homo sapiens
ctgtgcctctgggact

SEQ ID NO: 2542250 - DNA, 19 bp, Homo sapiens
ctgtgcctgaccttgagga

SEQ ID NO: 2542251 - DNA, 14 bp, Homo sapiens
ctgtgctactttgc

SEQ ID NO: 2542252 - DNA, 17 bp, Homo sapiens
ctgtgctactttgcctt

SEQ ID NO: 2542253 - DNA, 15 bp, Homo sapiens
ctgtgctatgaattt

SEQ ID NO: 2542254 - DNA, 16 bp, Homo sapiens
ctgtgctatgaatttt

SEQ ID NO: 2542255 - DNA, 10 bp, Homo sapiens
ctgtgctccg

SEQ ID NO: 2542256 - DNA, 14 bp, Homo sapiens
ctgtgctctggaca

SEQ ID NO: 2542257 - DNA, 20 bp, Homo sapiens
ctgtgctgcccgtcttcagc

SEQ ID NO: 2542258 - DNA, 12 bp, Homo sapiens
ctgtgctgccct

SEQ ID NO: 2542259 - DNA, 13 bp, Homo sapiens
ctgtgctgccctg

SEQ ID NO: 2542260 - DNA, 14 bp, Homo sapiens
ctgtgctgccctgc

SEQ ID NO: 2542261 - DNA, 15 bp, Homo sapiens
ctgtgctgccctgcc

SEQ ID NO: 2542262 - DNA, 15 bp, Homo sapiens
ctgtgctggagccac

SEQ ID NO: 2542263 - DNA, 20 bp, Homo sapiens
ctgtgctggtgtcctgacca

SEQ ID NO: 2542264 - DNA, 15 bp, Homo sapiens
ctgtgctgtggaagc

SEQ ID NO: 2542265 - DNA, 19 bp, Homo sapiens
ctgtgcttcgggcccttcc

SEQ ID NO: 2542266 - DNA, 20 bp, Homo sapiens
ctgtgcttcgggcccttccc

SEQ ID NO: 2542267 - DNA, 16 bp, Homo sapiens
ctgtgctttgactcac

SEQ ID NO: 2542268 - DNA, 19 bp, Homo sapiens
ctgtgctttgactcacctg

SEQ ID NO: 2542269 - DNA, 17 bp, Homo sapiens
ctgtgcttttaaatgca

SEQ ID NO: 2542270 - DNA, 14 bp, Homo sapiens
ctgtggaaaaatat

SEQ ID NO: 2542271 - DNA, 19 bp, Homo sapiens
ctgtggaaaaatatttaag

SEQ ID NO: 2542272 - DNA, 13 bp, Homo sapiens
ctgtggaaagtgt

SEQ ID NO: 2542273 - DNA, 15 bp, Homo sapiens
ctgtggaaagtgtaa

SEQ ID NO: 2542274 - DNA, 17 bp, Homo sapiens
ctgtggaaagtgtaaag

SEQ ID NO: 2542275 - DNA, 20 bp, Homo sapiens
ctgtggaaagtgtaaagcat

SEQ ID NO: 2542276 - DNA, 21 bp, Homo sapiens
ctgtggaaagtgtaaagcatt

SEQ ID NO: 2542277 - DNA, 12 bp, Homo sapiens
ctgtggaagcaa

SEQ ID NO: 2542278 - DNA, 13 bp, Homo sapiens
ctgtggaagggac

SEQ ID NO: 2542279 - DNA, 18 bp, Homo sapiens
ctgtggaatctggagtga

SEQ ID NO: 2542280 - DNA, 23 bp, Homo sapiens
ctgtggagcccgcacccccaccc

SEQ ID NO: 2542281 - DNA, 14 bp, Homo sapiens
ctgtggaggaagga

SEQ ID NO: 2542282 - DNA, 20 bp, Homo sapiens
ctgtggaggaaggattgtaa

SEQ ID NO: 2542283 - DNA, 22 bp, Homo sapiens
ctgtggaggtacactcttatag

SEQ ID NO: 2542284 - DNA, 17 bp, Homo sapiens
ctgtggatgataaaaca

SEQ ID NO: 2542285 - DNA, 16 bp, Homo sapiens
ctgtggccaagttctt

SEQ ID NO: 2542286 - DNA, 19 bp, Homo sapiens
ctgtggccgttatctggaa

SEQ ID NO: 2542287 - DNA, 20 bp, Homo sapiens
ctgtggccgttatctggaag

SEQ ID NO: 2542288 - DNA, 21 bp, Homo sapiens
ctgtggccgttatctggaagt

SEQ ID NO: 2542289 - DNA, 22 bp, Homo sapiens
ctgtggcctgtgtcccatgacc

SEQ ID NO: 2542290 - DNA, 18 bp, Homo sapiens
ctgtggctttcagcctct

SEQ ID NO: 2542291 - DNA, 14 bp, Homo sapiens
ctgtgggagcctgc

SEQ ID NO: 2542292 - DNA, 16 bp, Homo sapiens
ctgtggggatctcagg

SEQ ID NO: 2542293 - DNA, 20 bp, Homo sapiens
ctgtggggatctcaggggct

SEQ ID NO: 2542294 - DNA, 18 bp, Homo sapiens
ctgtggggatttctccca

SEQ ID NO: 2542295 - DNA, 14 bp, Homo sapiens
ctgtggggctggta

SEQ ID NO: 2542296 - DNA, 17 bp, Homo sapiens
ctgtggggctggtagct

SEQ ID NO: 2542297 - DNA, 15 bp, Homo sapiens
ctgtgggtgacccag

SEQ ID NO: 2542298 - DNA, 22 bp, Homo sapiens
ctgtggtcctgaattctttccc

SEQ ID NO: 2542299 - DNA, 16 bp, Homo sapiens
ctgtggttttcccctc

SEQ ID NO: 2542300 - DNA, 20 bp, Homo sapiens
ctgtggttttcccctccctg

SEQ ID NO: 2542301 - DNA, 16 bp, Homo sapiens
ctgtgtaaaaagagag

SEQ ID NO: 2542302 - DNA, 17 bp, Homo sapiens
ctgtgtaaaaagagagc

SEQ ID NO: 2542303 - DNA, 11 bp, Homo sapiens
ctgtgtaaagt

SEQ ID NO: 2542304 - DNA, 21 bp, Homo sapiens
ctgtgtcaggtggggcagctt

SEQ ID NO: 2542305 - DNA, 13 bp, Homo sapiens
ctgtgtcccatga

SEQ ID NO: 2542306 - DNA, 15 bp, Homo sapiens
ctgtgtcccatgacc

SEQ ID NO: 2542307 - DNA, 21 bp, Homo sapiens
ctgtgtcccatgacccacccc

SEQ ID NO: 2542308 - DNA, 22 bp, Homo sapiens
ctgtgtcccatgacccacccct

SEQ ID NO: 2542309 - DNA, 21 bp, Homo sapiens
ctgtgtcttgcaatggcagcc

SEQ ID NO: 2542310 - DNA, 23 bp, Homo sapiens
ctgtgtcttgcaatggcagcctt

SEQ ID NO: 2542311 - DNA, 13 bp, Homo sapiens
ctgtgtgaaaatg

SEQ ID NO: 2542312 - DNA, 12 bp, Homo sapiens
ctgtgtgaaata

SEQ ID NO: 2542313 - DNA, 21 bp, Homo sapiens
ctgtgtgaaataccagtgtgg

SEQ ID NO: 2542314 - DNA, 18 bp, Homo sapiens
ctgtgtgactcaaaccaa

SEQ ID NO: 2542315 - DNA, 17 bp, Homo sapiens
ctgtgtgcagtgaaggt

SEQ ID NO: 2542316 - DNA, 14 bp, Homo sapiens
ctgtgtgtgtgtat

SEQ ID NO: 2542317 - DNA, 16 bp, Homo sapiens
ctgtgtgtgtgtatgt

SEQ ID NO: 2542318 - DNA, 18 bp, Homo sapiens
ctgtgtgtgtgtatgtgg

SEQ ID NO: 2542319 - DNA, 17 bp, Homo sapiens
ctgtgtgtttatgtgtg

SEQ ID NO: 2542320 - DNA, 12 bp, Homo sapiens
ctgtgttcctgg

SEQ ID NO: 2542321 - DNA, 20 bp, Homo sapiens
ctgtgttcgactcagcctca

SEQ ID NO: 2542322 - DNA, 22 bp, Homo sapiens
ctgtgttcgactcagcctcagg

SEQ ID NO: 2542323 - DNA, 18 bp, Homo sapiens
ctgtgttgcgtgtcgtgg

SEQ ID NO: 2542324 - DNA, 19 bp, Homo sapiens
ctgtgtttcaagtggggct

SEQ ID NO: 2542325 - DNA, 14 bp, Homo sapiens
ctgtgtttgttcct

SEQ ID NO: 2542326 - DNA, 19 bp, Homo sapiens
ctgttaaattgctgtgtat

SEQ ID NO: 2542327 - DNA, 13 bp, Homo sapiens
ctgttacactgga

SEQ ID NO: 2542328 - DNA, 16 bp, Homo sapiens
ctgttacactggagga

SEQ ID NO: 2542329 - DNA, 16 bp, Homo sapiens
ctgttaccatgtcact

SEQ ID NO: 2542330 - DNA, 18 bp, Homo sapiens
ctgttacttgaaatacca

SEQ ID NO: 2542331 - DNA, 15 bp, Homo sapiens
ctgttagtcatttgc

SEQ ID NO: 2542332 - DNA, 14 bp, Homo sapiens
ctgttataactctg

SEQ ID NO: 2542333 - DNA, 13 bp, Homo sapiens
ctgttatataaat

SEQ ID NO: 2542334 - DNA, 22 bp, Homo sapiens
ctgttatataaatggttaaaag

SEQ ID NO: 2542335 - DNA, 13 bp, Homo sapiens
ctgttatccatgg

SEQ ID NO: 2542336 - DNA, 14 bp, Homo sapiens
ctgttatgctgtga

SEQ ID NO: 2542337 - DNA, 16 bp, Homo sapiens
ctgttatttctatttt

SEQ ID NO: 2542338 - DNA, 21 bp, Homo sapiens
ctgttcaagagcacacttggc

SEQ ID NO: 2542339 - DNA, 12 bp, Homo sapiens
ctgttcacagcc

SEQ ID NO: 2542340 - DNA, 18 bp, Homo sapiens
cttccagagagtcctctg

SEQ ID NO: 2542341 - DNA, 16 bp, Homo sapiens
cttccagcaccctgca

SEQ ID NO: 2542342 - DNA, 13 bp, Homo sapiens
cttccagctcctg

SEQ ID NO: 2542343 - DNA, 14 bp, Homo sapiens
cttccagctcctgt

SEQ ID NO: 2542344 - DNA, 15 bp, Homo sapiens
cttccaggctgggag

SEQ ID NO: 2542345 - DNA, 14 bp, Homo sapiens
cttccaggggtggg

SEQ ID NO: 2542346 - DNA, 22 bp, Homo sapiens
cttccaggggtgggacaccctg

SEQ ID NO: 2542347 - DNA, 21 bp, Homo sapiens
cttccagtcttcctgacactt

SEQ ID NO: 2542348 - DNA, 22 bp, Homo sapiens
cttccagtcttcctgacacttt

SEQ ID NO: 2542349 - DNA, 15 bp, Homo sapiens
cttccagtgaggctc

SEQ ID NO: 2542350 - DNA, 17 bp, Homo sapiens
cttccagtgaggctctg

SEQ ID NO: 2542351 - DNA, 21 bp, Homo sapiens
cttccataatctggactcctc

SEQ ID NO: 2542352 - DNA, 14 bp, Homo sapiens
cttccataattatg

SEQ ID NO: 2542353 - DNA, 14 bp, Homo sapiens
cttccatagcctaa

SEQ ID NO: 2542354 - DNA, 22 bp, Homo sapiens
cttccatagcctaatccctggg

SEQ ID NO: 2542355 - DNA, 21 bp, Homo sapiens
cttccatatgacctcatgcat

SEQ ID NO: 2542356 - DNA, 13 bp, Homo sapiens
cttccatcatgtc

SEQ ID NO: 2542357 - DNA, 14 bp, Homo sapiens
cttccatcccagag

SEQ ID NO: 2542358 - DNA, 12 bp, Homo sapiens
cttccatcccta

SEQ ID NO: 2542359 - DNA, 14 bp, Homo sapiens
cttccatccctacc

SEQ ID NO: 2542360 - DNA, 22 bp, Homo sapiens
cttccatctttcctgatggcag

SEQ ID NO: 2542361 - DNA, 17 bp, Homo sapiens
cttccatgagaacagca

SEQ ID NO: 2542362 - DNA, 17 bp, Homo sapiens
cttccatggactttgtt

SEQ ID NO: 2542363 - DNA, 19 bp, Homo sapiens
cttccatggccctcattaa

SEQ ID NO: 2542364 - DNA, 15 bp, Homo sapiens
cttccatgtcgcctc

SEQ ID NO: 2542365 - DNA, 18 bp, Homo sapiens
cttccatgtcggcctcta

SEQ ID NO: 2542366 - DNA, 12 bp, Homo sapiens
cttccatgtgga

SEQ ID NO: 2542367 - DNA, 15 bp, Homo sapiens
cttccatgtggagaa

SEQ ID NO: 2542368 - DNA, 12 bp, Homo sapiens
cttccatttata

SEQ ID NO: 2542369 - DNA, 11 bp, Homo sapiens
cttcccacctc

SEQ ID NO: 2542370 - DNA, 15 bp, Homo sapiens
cttcccactcacccc

SEQ ID NO: 2542371 - DNA, 14 bp, Homo sapiens
cttcccactggagg

SEQ ID NO: 2542372 - DNA, 15 bp, Homo sapiens
cttcccactggaggt

SEQ ID NO: 2542373 - DNA, 14 bp, Homo sapiens
cttcccagtggctg

SEQ ID NO: 2542374 - DNA, 18 bp, Homo sapiens
cttcccagtggctgctgc

SEQ ID NO: 2542375 - DNA, 20 bp, Homo sapiens
cttcccagtggctgctgccc

SEQ ID NO: 2542376 - DNA, 23 bp, Homo sapiens
cttcccagttcaggagtcccaag

SEQ ID NO: 2542377 - DNA, 15 bp, Homo sapiens
cttcccatcgctgtc

SEQ ID NO: 2542378 - DNA, 19 bp, Homo sapiens
cttcccatgacccaggctg

SEQ ID NO: 2542379 - DNA, 21 bp, Homo sapiens
cttcccatgacccaggctggg

SEQ ID NO: 2542380 - DNA, 22 bp, Homo sapiens
cttcccatgacccaggctgggc

SEQ ID NO: 2542381 - DNA, 23 bp, Homo sapiens
cttcccatgacccaggctgggca

SEQ ID NO: 2542382 - DNA, 15 bp, Homo sapiens
cttcccattgtggct

SEQ ID NO: 2542383 - DNA, 18 bp, Homo sapiens
cttcccattgtggctcct

SEQ ID NO: 2542384 - DNA, 23 bp, Homo sapiens
cttccccactgcacacacctcag

SEQ ID NO: 2542385 - DNA, 14 bp, Homo sapiens
cttccccagcctct

SEQ ID NO: 2542386 - DNA, 12 bp, Homo sapiens
cttccccttgcc

SEQ ID NO: 2542387 - DNA, 23 bp, Homo sapiens
cttccccttgcccagggctcagc

SEQ ID NO: 2542388 - DNA, 23 bp, Homo sapiens
cttccccttgcccttgccctgac

SEQ ID NO: 2542389 - DNA, 17 bp, Homo sapiens
cttccctacctcaggca

SEQ ID NO: 2542390 - DNA, 15 bp, Homo sapiens
cttccctctgcctgt

SEQ ID NO: 2542391 - DNA, 16 bp, Homo sapiens
cttccctctgcctgtc

SEQ ID NO: 2542392 - DNA, 13 bp, Homo sapiens
cttccctgactca

SEQ ID NO: 2542393 - DNA, 14 bp, Homo sapiens
cttccctgactcat

SEQ ID NO: 2542394 - DNA, 12 bp, Homo sapiens
cttccctgtccc

SEQ ID NO: 2542395 - DNA, 14 bp, Homo sapiens
cttcccttttacat

SEQ ID NO: 2542396 - DNA, 15 bp, Homo sapiens
cttccggctcctgtg

SEQ ID NO: 2542397 - DNA, 23 bp, Homo sapiens
cttcctacccacacctctgccag

SEQ ID NO: 2542398 - DNA, 16 bp, Homo sapiens
cttcctcactgcccaa

SEQ ID NO: 2542399 - DNA, 13 bp, Homo sapiens
cttcctcacttcc

SEQ ID NO: 2542400 - DNA, 22 bp, Homo sapiens
cttcctcatccaccccatccct

SEQ ID NO: 2542401 - DNA, 23 bp, Homo sapiens
cttcctcatccaccccatccctc

SEQ ID NO: 2542402 - DNA, 23 bp, Homo sapiens
cttcctcccaagtggtgcctaaa

SEQ ID NO: 2542403 - DNA, 17 bp, Homo sapiens
cttcctccgaggccagt

SEQ ID NO: 2542404 - DNA, 18 bp, Homo sapiens
cttcctcctccctcctgc

SEQ ID NO: 2542405 - DNA, 21 bp, Homo sapiens
cttcctcctccctcctgccga

SEQ ID NO: 2542406 - DNA, 12 bp, Homo sapiens
cttcctcctggg

SEQ ID NO: 2542407 - DNA, 14 bp, Homo sapiens
cttcctcctgggcc

SEQ ID NO: 2542408 - DNA, 18 bp, Homo sapiens
cttcctcgcagagaggcc

SEQ ID NO: 2542409 - DNA, 14 bp, Homo sapiens
cttcctctgaggct

SEQ ID NO: 2542410 - DNA, 15 bp, Homo sapiens
cttcctctgaggctg

SEQ ID NO: 2542411 - DNA, 20 bp, Homo sapiens
cttcctctgcagctgacctc

SEQ ID NO: 2542412 - DNA, 11 bp, Homo sapiens
cttcctctgct

SEQ ID NO: 2542413 - DNA, 13 bp, Homo sapiens
cttcctgcaagga

SEQ ID NO: 2542414 - DNA, 17 bp, Homo sapiens
cttcctgcattcaccca

SEQ ID NO: 2542415 - DNA, 20 bp, Homo sapiens
cttcctgcattcacccagac

SEQ ID NO: 2542416 - DNA, 21 bp, Homo sapiens
cttcctgcattcacccagaca

SEQ ID NO: 2542417 - DNA, 13 bp, Homo sapiens
cttcctgccacca

SEQ ID NO: 2542418 - DNA, 17 bp, Homo sapiens
cttcctgccctacagag

SEQ ID NO: 2542419 - DNA, 23 bp, Homo sapiens
cttcctggggcatctggcgaatc

SEQ ID NO: 2542420 - DNA, 16 bp, Homo sapiens
cttcctgtccagagag

SEQ ID NO: 2542421 - DNA, 16 bp, Homo sapiens
cttcctgtgacttcag

SEQ ID NO: 2542422 - DNA, 17 bp, Homo sapiens
cttcctgtttttcacat

SEQ ID NO: 2542423 - DNA, 16 bp, Homo sapiens
cttccttgaccagcag

SEQ ID NO: 2542424 - DNA, 19 bp, Homo sapiens
cttccttggcatcacaggg

SEQ ID NO: 2542425 - DNA, 17 bp, Homo sapiens
cttccttttatcagtag

SEQ ID NO: 2542426 - DNA, 15 bp, Homo sapiens
cttccttttgaggga

SEQ ID NO: 2542427 - DNA, 16 bp, Homo sapiens
cttcgactcaggatcc

SEQ ID NO: 2542428 - DNA, 13 bp, Homo sapiens
cttcgactgtgac

SEQ ID NO: 2542429 - DNA, 15 bp, Homo sapiens
cttcgcatcaaaaga

SEQ ID NO: 2542430 - DNA, 13 bp, Homo sapiens
cttcgctcctgtg

SEQ ID NO: 2542431 - DNA, 15 bp, Homo sapiens
cttcgctcctgtgtc

SEQ ID NO: 2542432 - DNA, 20 bp, Homo sapiens
cttcgggaggtcgaggcagg

SEQ ID NO: 2542433 - DNA, 21 bp, Homo sapiens
cttcgggaggtcgaggcagga

SEQ ID NO: 2542434 - DNA, 12 bp, Homo sapiens
cttcgtacagtt

SEQ ID NO: 2542435 - DNA, 13 bp, Homo sapiens
cttcgtacagttc

SEQ ID NO: 2542436 - DNA, 23 bp, Homo sapiens
cttcgtacagttcttcgggaaga

SEQ ID NO: 2542437 - DNA, 22 bp, Homo sapiens
cttcgtgggatctgcccctccc

SEQ ID NO: 2542438 - DNA, 13 bp, Homo sapiens
cttctaagtaaaa

SEQ ID NO: 2542439 - DNA, 15 bp, Homo sapiens
cttctacctgccact

SEQ ID NO: 2542440 - DNA, 17 bp, Homo sapiens
cttctaccttaaaatgt

SEQ ID NO: 2542441 - DNA, 13 bp, Homo sapiens
cttctacttctgc

SEQ ID NO: 2542442 - DNA, 13 bp, Homo sapiens
cttctacttttaa

SEQ ID NO: 2542443 - DNA, 16 bp, Homo sapiens
cttctaggacgccacc

SEQ ID NO: 2542444 - DNA, 19 bp, Homo sapiens
cttctaggacgccacccag

SEQ ID NO: 2542445 - DNA, 15 bp, Homo sapiens
cttctatcccaggag

SEQ ID NO: 2542446 - DNA, 19 bp, Homo sapiens
cttctattatagccacatc

SEQ ID NO: 2542447 - DNA, 17 bp, Homo sapiens
cttctattttgtaaact

SEQ ID NO: 2542448 - DNA, 22 bp, Homo sapiens
cttctcaaacctgtttaaatat

SEQ ID NO: 2542449 - DNA, 17 bp, Homo sapiens
cttctcaagtgccttaa

SEQ ID NO: 2542450 - DNA, 16 bp, Homo sapiens
cttctcactgccatgc

SEQ ID NO: 2542451 - DNA, 22 bp, Homo sapiens
cttctcagaaggcaaatgactt

SEQ ID NO: 2542452 - DNA, 13 bp, Homo sapiens
cttctcaggctct

SEQ ID NO: 2542453 - DNA, 21 bp, Homo sapiens
cttctcaggctctgccctgcc

SEQ ID NO: 2542454 - DNA, 22 bp, Homo sapiens
cttctcaggctctgccctgccc

SEQ ID NO: 2542455 - DNA, 22 bp, Homo sapiens
cttctcatagcattaactaatc

SEQ ID NO: 2542456 - DNA, 13 bp, Homo sapiens
cttctcatcactc

SEQ ID NO: 2542457 - DNA, 16 bp, Homo sapiens
cttctcatcctgcagg

SEQ ID NO: 2542458 - DNA, 12 bp, Homo sapiens
cttctcatctgt

SEQ ID NO: 2542459 - DNA, 14 bp, Homo sapiens
cttctcatgatcca

SEQ ID NO: 2542460 - DNA, 14 bp, Homo sapiens
cttctccaccctgc

SEQ ID NO: 2542461 - DNA, 13 bp, Homo sapiens
cttctccaggctg

SEQ ID NO: 2542462 - DNA, 16 bp, Homo sapiens
cttctccatccacatg

SEQ ID NO: 2542463 - DNA, 12 bp, Homo sapiens
cttctccccaga

SEQ ID NO: 2542464 - DNA, 19 bp, Homo sapiens
cttctccttcacctttgtc

SEQ ID NO: 2542465 - DNA, 17 bp, Homo sapiens
cttctctagctggtggt

SEQ ID NO: 2542466 - DNA, 20 bp, Homo sapiens
cttctctcagacttacttta

SEQ ID NO: 2542467 - DNA, 13 bp, Homo sapiens
cttctctccagcc

SEQ ID NO: 2542468 - DNA, 15 bp, Homo sapiens
cttctctccagcccc

SEQ ID NO: 2542469 - DNA, 17 bp, Homo sapiens
cttctctccagcccctg

SEQ ID NO: 2542470 - DNA, 18 bp, Homo sapiens
cttctctctctaaaatga

SEQ ID NO: 2542471 - DNA, 12 bp, Homo sapiens
cttctctgaagg

SEQ ID NO: 2542472 - DNA, 13 bp, Homo sapiens
cttctctgaaggg

SEQ ID NO: 2542473 - DNA, 17 bp, Homo sapiens
cttctctgaagggaggt

SEQ ID NO: 2542474 - DNA, 14 bp, Homo sapiens
cttctctgctccac

SEQ ID NO: 2542475 - DNA, 21 bp, Homo sapiens
cttctctggagccaagtccag

SEQ ID NO: 2542476 - DNA, 13 bp, Homo sapiens
cttctctgtctca

SEQ ID NO: 2542477 - DNA, 13 bp, Homo sapiens
cttctcttcctgt

SEQ ID NO: 2542478 - DNA, 18 bp, Homo sapiens
cttctgaactcaaactga

SEQ ID NO: 2542479 - DNA, 21 bp, Homo sapiens
cttctgaccacagcatcattt

SEQ ID NO: 2542480 - DNA, 16 bp, Homo sapiens
cttctgacccatgctg

SEQ ID NO: 2542481 - DNA, 17 bp, Homo sapiens
cttctgacccatgctgc

SEQ ID NO: 2542482 - DNA, 21 bp, Homo sapiens
cttctgacccatgctgccctg

SEQ ID NO: 2542483 - DNA, 22 bp, Homo sapiens
cttctgacccatgctgccctgt

SEQ ID NO: 2542484 - DNA, 20 bp, Homo sapiens
cttctgagctatttcatcta

SEQ ID NO: 2542485 - DNA, 20 bp, Homo sapiens
cttctgaggacattccaaga

SEQ ID NO: 2542486 - DNA, 17 bp, Homo sapiens
ctttggacctaatccaa

SEQ ID NO: 2542487 - DNA, 19 bp, Homo sapiens
ctttggagaccattatcag

SEQ ID NO: 2542488 - DNA, 16 bp, Homo sapiens
ctttggagatcaagga

SEQ ID NO: 2542489 - DNA, 23 bp, Homo sapiens
ctttggagcttttttctttaaga

SEQ ID NO: 2542490 - DNA, 22 bp, Homo sapiens
ctttggagtcccctcacctcct

SEQ ID NO: 2542491 - DNA, 17 bp, Homo sapiens
ctttggcactggggcac

SEQ ID NO: 2542492 - DNA, 18 bp, Homo sapiens
ctttggcactggggcact

SEQ ID NO: 2542493 - DNA, 14 bp, Homo sapiens
ctttggcagagttc

SEQ ID NO: 2542494 - DNA, 13 bp, Homo sapiens
ctttggctcccct

SEQ ID NO: 2542495 - DNA, 15 bp, Homo sapiens
ctttggctcccctgt

SEQ ID NO: 2542496 - DNA, 17 bp, Homo sapiens
ctttgggaggctgaggc

SEQ ID NO: 2542497 - DNA, 13 bp, Homo sapiens
ctttgggcccagg

SEQ ID NO: 2542498 - DNA, 22 bp, Homo sapiens
ctttgggcccagggacaccagc

SEQ ID NO: 2542499 - DNA, 21 bp, Homo sapiens
ctttggggcttttacaccagt

SEQ ID NO: 2542500 - DNA, 21 bp, Homo sapiens
ctttgggtacctattttcatt

SEQ ID NO: 2542501 - DNA, 22 bp, Homo sapiens
ctttgggtacctattttcattg

SEQ ID NO: 2542502 - DNA, 20 bp, Homo sapiens
ctttgggttaagcattacca

SEQ ID NO: 2542503 - DNA, 22 bp, Homo sapiens
ctttgggttaagcattaccact

SEQ ID NO: 2542504 - DNA, 14 bp, Homo sapiens
ctttggtagaaaag

SEQ ID NO: 2542505 - DNA, 20 bp, Homo sapiens
ctttggtctacactgtgctg

SEQ ID NO: 2542506 - DNA, 18 bp, Homo sapiens
ctttgtatattatttcta

SEQ ID NO: 2542507 - DNA, 22 bp, Homo sapiens
ctttgtattctctcctgtacct

SEQ ID NO: 2542508 - DNA, 23 bp, Homo sapiens
ctttgtatttttacttttaaatg

SEQ ID NO: 2542509 - DNA, 18 bp, Homo sapiens
ctttgtcatctttcttct

SEQ ID NO: 2542510 - DNA, 15 bp, Homo sapiens
ctttgtccccaccgc

SEQ ID NO: 2542511 - DNA, 15 bp, Homo sapiens
ctttgtctaaaacaa

SEQ ID NO: 2542512 - DNA, 23 bp, Homo sapiens
ctttgtgactgtatataaaggaa

SEQ ID NO: 2542513 - DNA, 23 bp, Homo sapiens
ctttgtgaggaagccgctggggc

SEQ ID NO: 2542514 - DNA, 18 bp, Homo sapiens
ctttgtgattatttcact

SEQ ID NO: 2542515 - DNA, 17 bp, Homo sapiens
ctttgtgatttttgtaa

SEQ ID NO: 2542516 - DNA, 13 bp, Homo sapiens
ctttgtgctgtgg

SEQ ID NO: 2542517 - DNA, 17 bp, Homo sapiens
ctttgtgctgtggggct

SEQ ID NO: 2542518 - DNA, 15 bp, Homo sapiens
ctttgttctggctct

SEQ ID NO: 2542519 - DNA, 20 bp, Homo sapiens
ctttgtttgttgtcagctga

SEQ ID NO: 2542520 - DNA, 21 bp, Homo sapiens
ctttgtttgttgtcagctgaa

SEQ ID NO: 2542521 - DNA, 23 bp, Homo sapiens
ctttgttttgatgtttgtggcct

SEQ ID NO: 2542522 - DNA, 18 bp, Homo sapiens
cttttaaaacacttccat

SEQ ID NO: 2542523 - DNA, 15 bp, Homo sapiens
cttttaaactgtgta

SEQ ID NO: 2542524 - DNA, 22 bp, Homo sapiens
cttttaaaggggcagaaaaact

SEQ ID NO: 2542525 - DNA, 19 bp, Homo sapiens
cttttaacacctgatgtgt

SEQ ID NO: 2542526 - DNA, 22 bp, Homo sapiens
cttttaataaacttttttttga

SEQ ID NO: 2542527 - DNA, 16 bp, Homo sapiens
cttttaatacagggta

SEQ ID NO: 2542528 - DNA, 19 bp, Homo sapiens
cttttaattaatgaaatat

SEQ ID NO: 2542529 - DNA, 22 bp, Homo sapiens
cttttaattaatgaaatatctg

SEQ ID NO: 2542530 - DNA, 17 bp, Homo sapiens
cttttacatactgctgt

SEQ ID NO: 2542531 - DNA, 16 bp, Homo sapiens
cttttagggagagtca

SEQ ID NO: 2542532 - DNA, 20 bp, Homo sapiens
cttttagggagagtcatatt

SEQ ID NO: 2542533 - DNA, 22 bp, Homo sapiens
cttttagttttagttgcagaaa

SEQ ID NO: 2542534 - DNA, 13 bp, Homo sapiens
cttttataaactt

SEQ ID NO: 2542535 - DNA, 14 bp, Homo sapiens
cttttataaacttt

SEQ ID NO: 2542536 - DNA, 18 bp, Homo sapiens
cttttataaactttacct

SEQ ID NO: 2542537 - DNA, 20 bp, Homo sapiens
cttttataaactttaccttt

SEQ ID NO: 2542538 - DNA, 22 bp, Homo sapiens
cttttataactagtcctttact

SEQ ID NO: 2542539 - DNA, 14 bp, Homo sapiens
cttttatagctatt

SEQ ID NO: 2542540 - DNA, 17 bp, Homo sapiens
cttttatagctattact

SEQ ID NO: 2542541 - DNA, 13 bp, Homo sapiens
cttttatcaaaca

SEQ ID NO: 2542542 - DNA, 14 bp, Homo sapiens
cttttattaatgca

SEQ ID NO: 2542543 - DNA, 17 bp, Homo sapiens
cttttattcatttgagt

SEQ ID NO: 2542544 - DNA, 21 bp, Homo sapiens
cttttattgtataaactatca

SEQ ID NO: 2542545 - DNA, 17 bp, Homo sapiens
cttttatttcttaaaca

SEQ ID NO: 2542546 - DNA, 15 bp, Homo sapiens
cttttcaaaacattt

SEQ ID NO: 2542547 - DNA, 23 bp, Homo sapiens
cttttcaacttggcttcctttct

SEQ ID NO: 2542548 - DNA, 12 bp, Homo sapiens
cttttcacaaat

SEQ ID NO: 2542549 - DNA, 20 bp, Homo sapiens
cttttcacatagctgtctag

SEQ ID NO: 2542550 - DNA, 19 bp, Homo sapiens
cttttcactccctccatca

SEQ ID NO: 2542551 - DNA, 23 bp, Homo sapiens
cttttcagcgatgtatgcagcta

SEQ ID NO: 2542552 - DNA, 20 bp, Homo sapiens
cttttcataacctagcctta

SEQ ID NO: 2542553 - DNA, 18 bp, Homo sapiens
cttttcccactgtttaag

SEQ ID NO: 2542554 - DNA, 15 bp, Homo sapiens
cttttcctcccttgg

SEQ ID NO: 2542555 - DNA, 16 bp, Homo sapiens
cttttcctctctcccg

SEQ ID NO: 2542556 - DNA, 17 bp, Homo sapiens
cttttctaccctagcca

SEQ ID NO: 2542557 - DNA, 22 bp, Homo sapiens
cttttctaccctagccattcct

SEQ ID NO: 2542558 - DNA, 21 bp, Homo sapiens
cttttctagcccgaatacaaa

SEQ ID NO: 2542559 - DNA, 20 bp, Homo sapiens
cttttctattttccctcgct

SEQ ID NO: 2542560 - DNA, 15 bp, Homo sapiens
cttttctccatgagt

SEQ ID NO: 2542561 - DNA, 14 bp, Homo sapiens
cttttctctttctc

SEQ ID NO: 2542562 - DNA, 20 bp, Homo sapiens
cttttctgcattttgctatt

SEQ ID NO: 2542563 - DNA, 18 bp, Homo sapiens
cttttctgtccgagcttt

SEQ ID NO: 2542564 - DNA, 18 bp, Homo sapiens
cttttctgtctctgcctc

SEQ ID NO: 2542565 - DNA, 21 bp, Homo sapiens
cttttctgtctctgcctccct

SEQ ID NO: 2542566 - DNA, 15 bp, Homo sapiens
cttttcttaaacctt

SEQ ID NO: 2542567 - DNA, 14 bp, Homo sapiens
cttttgaaatctgt

SEQ ID NO: 2542568 - DNA, 19 bp, Homo sapiens
cttttgcacccctcccatt

SEQ ID NO: 2542569 - DNA, 17 bp, Homo sapiens
cttttgccattaaactt

SEQ ID NO: 2542570 - DNA, 20 bp, Homo sapiens
cttttgcccttcacagtgtt

SEQ ID NO: 2542571 - DNA, 16 bp, Homo sapiens
cttttgccgttattaa

SEQ ID NO: 2542572 - DNA, 20 bp, Homo sapiens
cttttggcccccgagctggg

SEQ ID NO: 2542573 - DNA, 15 bp, Homo sapiens
cttttggtctgtgtg

SEQ ID NO: 2542574 - DNA, 17 bp, Homo sapiens
cttttgtctatgggact

SEQ ID NO: 2542575 - DNA, 19 bp, Homo sapiens
ctttttaaagtgtttctgt

SEQ ID NO: 2542576 - DNA, 19 bp, Homo sapiens
ctttttaagcttatttaat

SEQ ID NO: 2542577 - DNA, 22 bp, Homo sapiens
ctttttaatattgatatgctta

SEQ ID NO: 2542578 - DNA, 15 bp, Homo sapiens
ctttttaattgttgt

SEQ ID NO: 2542579 - DNA, 23 bp, Homo sapiens
ctttttaattgttgtttctttct

SEQ ID NO: 2542580 - DNA, 19 bp, Homo sapiens
ctttttactccccttgagc

SEQ ID NO: 2542581 - DNA, 13 bp, Homo sapiens
ctttttattgaat

SEQ ID NO: 2542582 - DNA, 18 bp, Homo sapiens
ctttttcatttgcctatt

SEQ ID NO: 2542583 - DNA, 18 bp, Homo sapiens
ctttttctaatgtggtta

SEQ ID NO: 2542584 - DNA, 22 bp, Homo sapiens
ctttttctggactgaagcctgc

SEQ ID NO: 2542585 - DNA, 16 bp, Homo sapiens
ctttttctttataaac

SEQ ID NO: 2542586 - DNA, 20 bp, Homo sapiens
cttttttaagatttttctca

SEQ ID NO: 2542587 - DNA, 15 bp, Homo sapiens
cttttttatacataa

SEQ ID NO: 2542588 - DNA, 16 bp, Homo sapiens
cttttttatacataaa

SEQ ID NO: 2542589 - DNA, 17 bp, Homo sapiens
cttttttatacataaac

SEQ ID NO: 2542590 - DNA, 18 bp, Homo sapiens
cttttttatacataaaca

SEQ ID NO: 2542591 - DNA, 15 bp, Homo sapiens
cttttttcactacat

SEQ ID NO: 2542592 - DNA, 13 bp, Homo sapiens
cttttttcctcct

SEQ ID NO: 2542593 - DNA, 17 bp, Homo sapiens
cttttttgataaagttt

SEQ ID NO: 2542594 - DNA, 19 bp, Homo sapiens
cttttttgataaagtttct

SEQ ID NO: 2542595 - DNA, 15 bp, Homo sapiens
cttttttggctgctg

SEQ ID NO: 2542596 - DNA, 16 bp, Homo sapiens
cttttttggctgctga

SEQ ID NO: 2542597 - DNA, 17 bp, Homo sapiens
cttttttggctgctgaa

SEQ ID NO: 2542598 - DNA, 18 bp, Homo sapiens
ctttttttttctctttct

SEQ ID NO: 2542599 - DNA, 22 bp, Homo sapiens
ctttttttttttttaaagacag

SEQ ID NO: 2542600 - DNA, 21 bp, Homo sapiens
ctttttttttttttttgacaa

SEQ ID NO: 2542601 - DNA, 20 bp, Homo sapiens
gaaaaaaaaaatgctgaaca

SEQ ID NO: 2542602 - DNA, 13 bp, Homo sapiens
gaaaaaaaaagaa

SEQ ID NO: 2542603 - DNA, 19 bp, Homo sapiens
gaaaaaaaagtttcagaga

SEQ ID NO: 2542604 - DNA, 23 bp, Homo sapiens
gaaaaaagttgtaggcgaatcat

SEQ ID NO: 2542605 - DNA, 17 bp, Homo sapiens
gaaaaaataacacacat

SEQ ID NO: 2542606 - DNA, 21 bp, Homo sapiens
gaaaaaataattgatttcaag

SEQ ID NO: 2542607 - DNA, 13 bp, Homo sapiens
gaaaaaatacatt

SEQ ID NO: 2542608 - DNA, 17 bp, Homo sapiens
gaaaaaatacattttat

SEQ ID NO: 2542609 - DNA, 18 bp, Homo sapiens
gaaaaacgtgttgccttg

SEQ ID NO: 2542610 - DNA, 12 bp, Homo sapiens
gaaaaaggagga

SEQ ID NO: 2542611 - DNA, 15 bp, Homo sapiens
gaaaaaggaggaaga

SEQ ID NO: 2542612 - DNA, 17 bp, Homo sapiens
gaaaaaggatgcacaga

SEQ ID NO: 2542613 - DNA, 19 bp, Homo sapiens
gaaaaataacttcaagcaa

SEQ ID NO: 2542614 - DNA, 15 bp, Homo sapiens
gaaaaatatgatatt

SEQ ID NO: 2542615 - DNA, 17 bp, Homo sapiens
gaaaaatccagaaagaa

SEQ ID NO: 2542616 - DNA, 18 bp, Homo sapiens
gaaaaatcctcttcctct

SEQ ID NO: 2542617 - DNA, 16 bp, Homo sapiens
gaaaaatttaagcatt

SEQ ID NO: 2542618 - DNA, 19 bp, Homo sapiens
gaaaaatttaagcattgtt

SEQ ID NO: 2542619 - DNA, 22 bp, Homo sapiens
gaaaaatttaagcattgtttgc

SEQ ID NO: 2542620 - DNA, 14 bp, Homo sapiens
gaaaacaaggaagt

SEQ ID NO: 2542621 - DNA, 14 bp, Homo sapiens
gaaaacacattttt

SEQ ID NO: 2542622 - DNA, 18 bp, Homo sapiens
gaaaacactgttctctgc

SEQ ID NO: 2542623 - DNA, 18 bp, Homo sapiens
gaaaacatgctacacact

SEQ ID NO: 2542624 - DNA, 13 bp, Homo sapiens
gaaaacattccat

SEQ ID NO: 2542625 - DNA, 20 bp, Homo sapiens
gaaaacattctgatttggaa

SEQ ID NO: 2542626 - DNA, 21 bp, Homo sapiens
gaaaacctaagtcctttatgt

SEQ ID NO: 2542627 - DNA, 13 bp, Homo sapiens
gaaaacctctcct

SEQ ID NO: 2542628 - DNA, 14 bp, Homo sapiens
gaaaacgttttatt

SEQ ID NO: 2542629 - DNA, 18 bp, Homo sapiens
gaagtgttgcatggatgt

SEQ ID NO: 2542630 - DNA, 21 bp, Homo sapiens
gaagtgtttcacgagagcccg

SEQ ID NO: 2542631 - DNA, 22 bp, Homo sapiens
gaagtgtttcacgagagcccgg

SEQ ID NO: 2542632 - DNA, 15 bp, Homo sapiens
gaagttaacagagac

SEQ ID NO: 2542633 - DNA, 15 bp, Homo sapiens
gaagttactgaatgc

SEQ ID NO: 2542634 - DNA, 16 bp, Homo sapiens
gaagttactgaatgca

SEQ ID NO: 2542635 - DNA, 22 bp, Homo sapiens
gaagttcaccattaaaagggat

SEQ ID NO: 2542636 - DNA, 21 bp, Homo sapiens
gaagttgatatagaacagtgc

SEQ ID NO: 2542637 - DNA, 20 bp, Homo sapiens
gaagtttgagatcagcctgg

SEQ ID NO: 2542638 - DNA, 12 bp, Homo sapiens
gaagttttgcat

SEQ ID NO: 2542639 - DNA, 13 bp, Homo sapiens
gaataaagttctg

SEQ ID NO: 2542640 - DNA, 12 bp, Homo sapiens
gaataaatatgc

SEQ ID NO: 2542641 - DNA, 14 bp, Homo sapiens
gaataaatgtcttt

SEQ ID NO: 2542642 - DNA, 15 bp, Homo sapiens
gaataactagcacca

SEQ ID NO: 2542643 - DNA, 21 bp, Homo sapiens
gaataactctgtggcattatt

SEQ ID NO: 2542644 - DNA, 13 bp, Homo sapiens
gaataagttattg

SEQ ID NO: 2542645 - DNA, 16 bp, Homo sapiens
gaataagttattgcag

SEQ ID NO: 2542646 - DNA, 19 bp, Homo sapiens
gaataagttattgcagttt

SEQ ID NO: 2542647 - DNA, 12 bp, Homo sapiens
gaataatagaag

SEQ ID NO: 2542648 - DNA, 14 bp, Homo sapiens
gaataatgaatgga

SEQ ID NO: 2542649 - DNA, 21 bp, Homo sapiens
gaataatggtaccagataaaa

SEQ ID NO: 2542650 - DNA, 18 bp, Homo sapiens
gaataattatttatttaa

SEQ ID NO: 2542651 - DNA, 16 bp, Homo sapiens
gaatacaaacatattt

SEQ ID NO: 2542652 - DNA, 23 bp, Homo sapiens
gaatacagggcatgcattttgca

SEQ ID NO: 2542653 - DNA, 20 bp, Homo sapiens
gaatacagtgttattttctt

SEQ ID NO: 2542654 - DNA, 22 bp, Homo sapiens
gaatagctgggactacaggtgt

SEQ ID NO: 2542655 - DNA, 16 bp, Homo sapiens
gaatagtatcctccag

SEQ ID NO: 2542656 - DNA, 17 bp, Homo sapiens
gaatagtatcctccagg

SEQ ID NO: 2542657 - DNA, 19 bp, Homo sapiens
gaatagtatcctccaggtt

SEQ ID NO: 2542658 - DNA, 21 bp, Homo sapiens
gaatagtatcctccaggtttt

SEQ ID NO: 2542659 - DNA, 13 bp, Homo sapiens
gaatataaacact

SEQ ID NO: 2542660 - DNA, 22 bp, Homo sapiens
gaatatacagcaggtgctcaat

SEQ ID NO: 2542661 - DNA, 15 bp, Homo sapiens
gaatatataaccagt

SEQ ID NO: 2542662 - DNA, 15 bp, Homo sapiens
gaatatgacggaaga

SEQ ID NO: 2542663 - DNA, 19 bp, Homo sapiens
gaatatgattagtaaagaa

SEQ ID NO: 2542664 - DNA, 12 bp, Homo sapiens
gaatattagctt

SEQ ID NO: 2542665 - DNA, 12 bp, Homo sapiens
gaatattcagga

SEQ ID NO: 2542666 - DNA, 18 bp, Homo sapiens
gaatatttatatttcact

SEQ ID NO: 2542667 - DNA, 22 bp, Homo sapiens
gaatatttgttatgtagataac

SEQ ID NO: 2542668 - DNA, 16 bp, Homo sapiens
gaatattttaacttcc

SEQ ID NO: 2542669 - DNA, 13 bp, Homo sapiens
gaatcaaaactct

SEQ ID NO: 2542670 - DNA, 18 bp, Homo sapiens
gaatcaaagcaatgcatt

SEQ ID NO: 2542671 - DNA, 19 bp, Homo sapiens
gaatcaaagcaatgcattt

SEQ ID NO: 2542672 - DNA, 16 bp, Homo sapiens
gaatcaagagctgccc

SEQ ID NO: 2542673 - DNA, 17 bp, Homo sapiens
gaatcaagagctgccct

SEQ ID NO: 2542674 - DNA, 19 bp, Homo sapiens
gaatcaagagctgccctcc

SEQ ID NO: 2542675 - DNA, 20 bp, Homo sapiens
gaatcaagctagaaggccac

SEQ ID NO: 2542676 - DNA, 19 bp, Homo sapiens
gaatcactcttgtggatgt

SEQ ID NO: 2542677 - DNA, 20 bp, Homo sapiens
gaatcagtattgggagccgg

SEQ ID NO: 2542678 - DNA, 15 bp, Homo sapiens
gaatcagtgcaaaga

SEQ ID NO: 2542679 - DNA, 19 bp, Homo sapiens
gaatcatacttagcaaagt

SEQ ID NO: 2542680 - DNA, 14 bp, Homo sapiens
gaatcatgtagtat

SEQ ID NO: 2542681 - DNA, 14 bp, Homo sapiens
gaatcatttgttca

SEQ ID NO: 2542682 - DNA, 17 bp, Homo sapiens
gaatccactcccaggca

SEQ ID NO: 2542683 - DNA, 14 bp, Homo sapiens
gaatcccccttgcc

SEQ ID NO: 2542684 - DNA, 18 bp, Homo sapiens
gaatcccccttgccaccc

SEQ ID NO: 2542685 - DNA, 23 bp, Homo sapiens
gaatcctacacacctaagggaca

SEQ ID NO: 2542686 - DNA, 14 bp, Homo sapiens
gaatcgaggaacca

SEQ ID NO: 2542687 - DNA, 15 bp, Homo sapiens
gaatctattatactg

SEQ ID NO: 2542688 - DNA, 16 bp, Homo sapiens
gaatctatttaagtaa

SEQ ID NO: 2542689 - DNA, 18 bp, Homo sapiens
gaatctctgaatttgaga

SEQ ID NO: 2542690 - DNA, 22 bp, Homo sapiens
gaatctggaccccatctgtgaa

SEQ ID NO: 2542691 - DNA, 20 bp, Homo sapiens
gaatctttccaataaaccag

SEQ ID NO: 2542692 - DNA, 14 bp, Homo sapiens
gaatgaaaccccca

SEQ ID NO: 2542693 - DNA, 14 bp, Homo sapiens
gaatgaaagggccc

SEQ ID NO: 2542694 - DNA, 23 bp, Homo sapiens
gaatgaaatcctgcttcagtgta

SEQ ID NO: 2542695 - DNA, 16 bp, Homo sapiens
gaatgaaattgctgaa

SEQ ID NO: 2542696 - DNA, 22 bp, Homo sapiens
gaatgaaccacatcttgctctg

SEQ ID NO: 2542697 - DNA, 15 bp, Homo sapiens
gaatgaaccttctgg

SEQ ID NO: 2542698 - DNA, 15 bp, Homo sapiens
gaatgaatggctaag

SEQ ID NO: 2542699 - DNA, 13 bp, Homo sapiens
gaatgacaaagag

SEQ ID NO: 2542700 - DNA, 16 bp, Homo sapiens
gaatgacaacagaagc

SEQ ID NO: 2542701 - DNA, 22 bp, Homo sapiens
gaatgagcctacgctgaagatg

SEQ ID NO: 2542702 - DNA, 11 bp, Homo sapiens
gaatgagcctc

SEQ ID NO: 2542703 - DNA, 15 bp, Homo sapiens
gaatgaggtcccagg

SEQ ID NO: 2542704 - DNA, 16 bp, Homo sapiens
gaatgaggtcccaggc

SEQ ID NO: 2542705 - DNA, 18 bp, Homo sapiens
gaatgaggtcccaggcag

SEQ ID NO: 2542706 - DNA, 19 bp, Homo sapiens
gaatgaggtcccaggcaga

SEQ ID NO: 2542707 - DNA, 21 bp, Homo sapiens
gaatgaggtcccaggcagaga

SEQ ID NO: 2542708 - DNA, 18 bp, Homo sapiens
gaatgatctttctttcct

SEQ ID NO: 2542709 - DNA, 16 bp, Homo sapiens
gaatgatttttagatg

SEQ ID NO: 2542710 - DNA, 17 bp, Homo sapiens
gaatgcccacaggcaaa

SEQ ID NO: 2542711 - DNA, 22 bp, Homo sapiens
gaatgcccacaggcaaatgcat

SEQ ID NO: 2542712 - DNA, 20 bp, Homo sapiens
gaatgcctcaatgtgaccag

SEQ ID NO: 2542713 - DNA, 22 bp, Homo sapiens
gaatgcctcaatgtgaccaggg

SEQ ID NO: 2542714 - DNA, 19 bp, Homo sapiens
gaatgctcccccatcctcc

SEQ ID NO: 2542715 - DNA, 21 bp, Homo sapiens
gaatgctgcccgctctgcaga

SEQ ID NO: 2542716 - DNA, 17 bp, Homo sapiens
gaatgctggttttccta

SEQ ID NO: 2542717 - DNA, 16 bp, Homo sapiens
gaatgcttcctagaag

SEQ ID NO: 2542718 - DNA, 20 bp, Homo sapiens
gaatgcttgaaaaatgtgca

SEQ ID NO: 2542719 - DNA, 18 bp, Homo sapiens
gaatgctttttgaatgtt

SEQ ID NO: 2542720 - DNA, 21 bp, Homo sapiens
gaatggaagggttctggctgc

SEQ ID NO: 2542721 - DNA, 18 bp, Homo sapiens
gaatggcctcctccctta

SEQ ID NO: 2542722 - DNA, 17 bp, Homo sapiens
gaatggcctgccttgaa

SEQ ID NO: 2542723 - DNA, 14 bp, Homo sapiens
gaatggtccagggt

SEQ ID NO: 2542724 - DNA, 13 bp, Homo sapiens
gaatggttataaa

SEQ ID NO: 2542725 - DNA, 17 bp, Homo sapiens
gaatggttataaaagtg

SEQ ID NO: 2542726 - DNA, 22 bp, Homo sapiens
gaatggttttcaaaataaaaat

SEQ ID NO: 2542727 - DNA, 18 bp, Homo sapiens
gaatgtaactgctgaaaa

SEQ ID NO: 2542728 - DNA, 19 bp, Homo sapiens
gaatgtaatcaatgtttct

SEQ ID NO: 2542729 - DNA, 15 bp, Homo sapiens
gaatgtagctggttt

SEQ ID NO: 2542730 - DNA, 20 bp, Homo sapiens
gaatgtagctggtttcctca

SEQ ID NO: 2542731 - DNA, 15 bp, Homo sapiens
gaatgtatcaggaaa

SEQ ID NO: 2542732 - DNA, 22 bp, Homo sapiens
gaatgtattgtaccttttaaca

SEQ ID NO: 2542733 - DNA, 23 bp, Homo sapiens
gaatgtattgtaccttttaacac

SEQ ID NO: 2542734 - DNA, 18 bp, Homo sapiens
gaatgtcagtatgtggaa

SEQ ID NO: 2542735 - DNA, 22 bp, Homo sapiens
gaatgtctttgttggaaaagaa

SEQ ID NO: 2542736 - DNA, 15 bp, Homo sapiens
gaatgtgcaggtttg

SEQ ID NO: 2542737 - DNA, 20 bp, Homo sapiens
gaatgttacattgtttgtct

SEQ ID NO: 2542738 - DNA, 19 bp, Homo sapiens
gaatgttctgacattaaca

SEQ ID NO: 2542739 - DNA, 20 bp, Homo sapiens
gaatgttctgacattaacag

SEQ ID NO: 2542740 - DNA, 22 bp, Homo sapiens
gaattaaagtggaccaataggg

SEQ ID NO: 2542741 - DNA, 12 bp, Homo sapiens
gaattaaataaa

SEQ ID NO: 2542742 - DNA, 21 bp, Homo sapiens
gaattaaattaggaataaata

SEQ ID NO: 2542743 - DNA, 15 bp, Homo sapiens
gaattaacctggtgc

SEQ ID NO: 2542744 - DNA, 18 bp, Homo sapiens
gaattaagttagggaatg

SEQ ID NO: 2542745 - DNA, 21 bp, Homo sapiens
gaattaatcatctataaagaa

SEQ ID NO: 2542746 - DNA, 19 bp, Homo sapiens
gaattaatgacagagccag

SEQ ID NO: 2542747 - DNA, 22 bp, Homo sapiens
gaattaccttagattagctctg

SEQ ID NO: 2542748 - DNA, 13 bp, Homo sapiens
gaattccaaggag

SEQ ID NO: 2542749 - DNA, 16 bp, Homo sapiens
gaattccttcagggtg

SEQ ID NO: 2542750 - DNA, 17 bp, Homo sapiens
gaattcggtgtgcacca

SEQ ID NO: 2542751 - DNA, 17 bp, Homo sapiens
gaattctcagaatctca

SEQ ID NO: 2542752 - DNA, 17 bp, Homo sapiens
gaattctctagtttgat

SEQ ID NO: 2542753 - DNA, 18 bp, Homo sapiens
gaattctgctacctcact

SEQ ID NO: 2542754 - DNA, 18 bp, Homo sapiens
gaattcttacatgttttc

SEQ ID NO: 2542755 - DNA, 21 bp, Homo sapiens
gaattcttatgcttataatat

SEQ ID NO: 2542756 - DNA, 16 bp, Homo sapiens
gaattcttttggggaa

SEQ ID NO: 2542757 - DNA, 14 bp, Homo sapiens
gaattgaagcagga

SEQ ID NO: 2542758 - DNA, 14 bp, Homo sapiens
gaattgcagagtac

SEQ ID NO: 2542759 - DNA, 16 bp, Homo sapiens
gaattgcctgcagaga

SEQ ID NO: 2542760 - DNA, 17 bp, Homo sapiens
gaattgcttgaacctgg

SEQ ID NO: 2542761 - DNA, 16 bp, Homo sapiens
gaattgggagcttggg

SEQ ID NO: 2542762 - DNA, 18 bp, Homo sapiens
gaatttaaaaataagaaa

SEQ ID NO: 2542763 - DNA, 13 bp, Homo sapiens
gaatttaaatata

SEQ ID NO: 2542764 - DNA, 12 bp, Homo sapiens
gaatttcacctg

SEQ ID NO: 2542765 - DNA, 12 bp, Homo sapiens
gaatttctaaaa

SEQ ID NO: 2542766 - DNA, 19 bp, Homo sapiens
gaatttgaatgaaaaattt

SEQ ID NO: 2542767 - DNA, 13 bp, Homo sapiens
gaatttgctgggg

SEQ ID NO: 2542768 - DNA, 19 bp, Homo sapiens
gaatttggcctgcactaat

SEQ ID NO: 2542769 - DNA, 16 bp, Homo sapiens
gaatttgtaacctcag

SEQ ID NO: 2542770 - DNA, 13 bp, Homo sapiens
gaatttgttatca

SEQ ID NO: 2542771 - DNA, 13 bp, Homo sapiens
gaattttctgtgt

SEQ ID NO: 2542772 - DNA, 21 bp, Homo sapiens
gaattttctttgtgtagcttt

SEQ ID NO: 2542773 - DNA, 22 bp, Homo sapiens
gaattttctttttaataaaaag

SEQ ID NO: 2542774 - DNA, 22 bp, Homo sapiens
gactggcacagttttctgagaa

SEQ ID NO: 2542775 - DNA, 16 bp, Homo sapiens
gactggcccctgggtc

SEQ ID NO: 2542776 - DNA, 23 bp, Homo sapiens
gactggctagagtcctcactccc

SEQ ID NO: 2542777 - DNA, 17 bp, Homo sapiens
gactggctggctgcagt

SEQ ID NO: 2542778 - DNA, 20 bp, Homo sapiens
gactggcttttattaatgca

SEQ ID NO: 2542779 - DNA, 21 bp, Homo sapiens
gactggcttttattaatgcac

SEQ ID NO: 2542780 - DNA, 14 bp, Homo sapiens
gactgggccctgcc

SEQ ID NO: 2542781 - DNA, 17 bp, Homo sapiens
gactgggccctgcctct

SEQ ID NO: 2542782 - DNA, 14 bp, Homo sapiens
gactgggctgaggg

SEQ ID NO: 2542783 - DNA, 15 bp, Homo sapiens
gactgggctgaggga

SEQ ID NO: 2542784 - DNA, 17 bp, Homo sapiens
gactggggatgtgggag

SEQ ID NO: 2542785 - DNA, 18 bp, Homo sapiens
gactggggatgtgggagg

SEQ ID NO: 2542786 - DNA, 14 bp, Homo sapiens
gactgggggccaga

SEQ ID NO: 2542787 - DNA, 23 bp, Homo sapiens
gactgggtctcgctttgttgccc

SEQ ID NO: 2542788 - DNA, 19 bp, Homo sapiens
gactggtgctataggctgg

SEQ ID NO: 2542789 - DNA, 20 bp, Homo sapiens
gactggtgctataggctgga

SEQ ID NO: 2542790 - DNA, 11 bp, Homo sapiens
gactgtagaaa

SEQ ID NO: 2542791 - DNA, 14 bp, Homo sapiens
gactgtatataaag

SEQ ID NO: 2542792 - DNA, 19 bp, Homo sapiens
gactgtatataaaggaaaa

SEQ ID NO: 2542793 - DNA, 17 bp, Homo sapiens
gactgtatttgtgacta

SEQ ID NO: 2542794 - DNA, 19 bp, Homo sapiens
gactgtatttgtgactaat

SEQ ID NO: 2542795 - DNA, 22 bp, Homo sapiens
gactgtatttgtgactaattgt

SEQ ID NO: 2542796 - DNA, 18 bp, Homo sapiens
gactgtctccatggccct

SEQ ID NO: 2542797 - DNA, 18 bp, Homo sapiens
gactgtgacaggcagcag

SEQ ID NO: 2542798 - DNA, 12 bp, Homo sapiens
gactgtggctgc

SEQ ID NO: 2542799 - DNA, 22 bp, Homo sapiens
gactgtgtattctagttttgtc

SEQ ID NO: 2542800 - DNA, 19 bp, Homo sapiens
gactgttcaagagcacact

SEQ ID NO: 2542801 - DNA, 16 bp, Homo sapiens
gactgttttctcttga

SEQ ID NO: 2542802 - DNA, 14 bp, Homo sapiens
gactgttttttcct

SEQ ID NO: 2542803 - DNA, 20 bp, Homo sapiens
gactgttttttcctgagctt

SEQ ID NO: 2542804 - DNA, 16 bp, Homo sapiens
gacttaacggctccag

SEQ ID NO: 2542805 - DNA, 14 bp, Homo sapiens
gacttaccaggaag

SEQ ID NO: 2542806 - DNA, 16 bp, Homo sapiens
gacttactgtacatga

SEQ ID NO: 2542807 - DNA, 22 bp, Homo sapiens
gacttcagggcagggctctgat

SEQ ID NO: 2542808 - DNA, 21 bp, Homo sapiens
gacttcatagatttccttccc

SEQ ID NO: 2542809 - DNA, 17 bp, Homo sapiens
gacttctaagtaaaacc

SEQ ID NO: 2542810 - DNA, 18 bp, Homo sapiens
gacttctaagtaaaacca

SEQ ID NO: 2542811 - DNA, 24 bp, Homo sapiens
gacttctaagtaaaaccacagcag

SEQ ID NO: 2542812 - DNA, 23 bp, Homo sapiens
gacttctgtcttcacaacagatt

SEQ ID NO: 2542813 - DNA, 21 bp, Homo sapiens
gacttctttcaaattgagaga

SEQ ID NO: 2542814 - DNA, 15 bp, Homo sapiens
gacttcttttcacat

SEQ ID NO: 2542815 - DNA, 16 bp, Homo sapiens
gacttgaaagcatcca

SEQ ID NO: 2542816 - DNA, 18 bp, Homo sapiens
gacttgacagaacactgt

SEQ ID NO: 2542817 - DNA, 18 bp, Homo sapiens
gacttgcaatttctacct

SEQ ID NO: 2542818 - DNA, 15 bp, Homo sapiens
gacttgcatttttgc

SEQ ID NO: 2542819 - DNA, 13 bp, Homo sapiens
gacttggaagctc

SEQ ID NO: 2542820 - DNA, 14 bp, Homo sapiens
gacttggaagctcc

SEQ ID NO: 2542821 - DNA, 16 bp, Homo sapiens
gacttggaagctccgc

SEQ ID NO: 2542822 - DNA, 17 bp, Homo sapiens
gacttggcaacagaagc

SEQ ID NO: 2542823 - DNA, 18 bp, Homo sapiens
gacttgtatatttgtaca

SEQ ID NO: 2542824 - DNA, 19 bp, Homo sapiens
gactttattttctggtaga

SEQ ID NO: 2542825 - DNA, 16 bp, Homo sapiens
gactttcctaaatgtt

SEQ ID NO: 2542826 - DNA, 13 bp, Homo sapiens
gactttctgttgg

SEQ ID NO: 2542827 - DNA, 15 bp, Homo sapiens
gactttgcttcccat

SEQ ID NO: 2542828 - DNA, 14 bp, Homo sapiens
gactttggaaagag

SEQ ID NO: 2542829 - DNA, 18 bp, Homo sapiens
gactttgggataggaaaa

SEQ ID NO: 2542830 - DNA, 12 bp, Homo sapiens
gactttgttcac

SEQ ID NO: 2542831 - DNA, 19 bp, Homo sapiens
gacttttcgaccaattcaa

SEQ ID NO: 2542832 - DNA, 21 bp, Homo sapiens
gacttttctttgtggcttcct

SEQ ID NO: 2542833 - DNA, 23 bp, Homo sapiens
gacttttgtataggtagatgttc

SEQ ID NO: 2542834 - DNA, 19 bp, Homo sapiens
gactttttttttttataat

SEQ ID NO: 2542835 - DNA, 11 bp, Homo sapiens
gagaaaaacaa

SEQ ID NO: 2542836 - DNA, 12 bp, Homo sapiens
gagaaaagaaaa

SEQ ID NO: 2542837 - DNA, 17 bp, Homo sapiens
gagaaaataaaaagtta

SEQ ID NO: 2542838 - DNA, 13 bp, Homo sapiens
gagaaacagagac

SEQ ID NO: 2542839 - DNA, 19 bp, Homo sapiens
gagaaacagagacaggccc

SEQ ID NO: 2542840 - DNA, 21 bp, Homo sapiens
gagaaaccttattgtacctct

SEQ ID NO: 2542841 - DNA, 17 bp, Homo sapiens
gagaaactcttgagatc

SEQ ID NO: 2542842 - DNA, 13 bp, Homo sapiens
gagaaagaagaga

SEQ ID NO: 2542843 - DNA, 18 bp, Homo sapiens
gagaaagaagtaggcatg

SEQ ID NO: 2542844 - DNA, 11 bp, Homo sapiens
gagaaattatt

SEQ ID NO: 2542845 - DNA, 19 bp, Homo sapiens
gagaaccactacatgcagc

SEQ ID NO: 2542846 - DNA, 21 bp, Homo sapiens
gagaaccctgcgtggggacag

SEQ ID NO: 2542847 - DNA, 22 bp, Homo sapiens
gagaaccgagcaaagatcaaaa

SEQ ID NO: 2542848 - DNA, 22 bp, Homo sapiens
gagaacctcacgcacctcccat

SEQ ID NO: 2542849 - DNA, 14 bp, Homo sapiens
gagaacctcaggct

SEQ ID NO: 2542850 - DNA, 15 bp, Homo sapiens
gagaactcctagggt

SEQ ID NO: 2542851 - DNA, 23 bp, Homo sapiens
gagaactgcatatgtttcgctga

SEQ ID NO: 2542852 - DNA, 15 bp, Homo sapiens
gagaagagctgttca

SEQ ID NO: 2542853 - DNA, 14 bp, Homo sapiens
gagaagagggcctg

SEQ ID NO: 2542854 - DNA, 21 bp, Homo sapiens
gagaagcatcggagggaattg

SEQ ID NO: 2542855 - DNA, 13 bp, Homo sapiens
gagaagcatgaaa

SEQ ID NO: 2542856 - DNA, 22 bp, Homo sapiens
gagaagccagctttcctcatca

SEQ ID NO: 2542857 - DNA, 20 bp, Homo sapiens
gagaagccagtgcggcaggt

SEQ ID NO: 2542858 - DNA, 22 bp, Homo sapiens
gagaagccccttccccatggga

SEQ ID NO: 2542859 - DNA, 17 bp, Homo sapiens
gagaagctttgccctcc

SEQ ID NO: 2542860 - DNA, 17 bp, Homo sapiens
gagaaggatctagaatg

SEQ ID NO: 2542861 - DNA, 11 bp, Homo sapiens
gagaaggcagc

SEQ ID NO: 2542862 - DNA, 15 bp, Homo sapiens
gagaagtgacaggga

SEQ ID NO: 2542863 - DNA, 17 bp, Homo sapiens
gagaagtgacagggaag

SEQ ID NO: 2542864 - DNA, 21 bp, Homo sapiens
gagaagtgacagggaagctac

SEQ ID NO: 2542865 - DNA, 18 bp, Homo sapiens
gagaagttttgtacagag

SEQ ID NO: 2542866 - DNA, 23 bp, Homo sapiens
gagaatattagctttactgtttg

SEQ ID NO: 2542867 - DNA, 13 bp, Homo sapiens
gagaatcacttga

SEQ ID NO: 2542868 - DNA, 15 bp, Homo sapiens
gagaatcacttgaac

SEQ ID NO: 2542869 - DNA, 20 bp, Homo sapiens
gagaatcccactttctatag

SEQ ID NO: 2542870 - DNA, 22 bp, Homo sapiens
gagaatctatatttaacaagat

SEQ ID NO: 2542871 - DNA, 15 bp, Homo sapiens
gagaatgaaagggcc

SEQ ID NO: 2542872 - DNA, 23 bp, Homo sapiens
gagaatgaaagggcccagagagg

SEQ ID NO: 2542873 - DNA, 13 bp, Homo sapiens
gagaatgagcctc

SEQ ID NO: 2542874 - DNA, 13 bp, Homo sapiens
gagaatgagggtc

SEQ ID NO: 2542875 - DNA, 21 bp, Homo sapiens
gagaatgtagatattgtgaag

SEQ ID NO: 2542876 - DNA, 17 bp, Homo sapiens
gagaatgtcagtatgtg

SEQ ID NO: 2542877 - DNA, 18 bp, Homo sapiens
gagaattcttacatgttt

SEQ ID NO: 2542878 - DNA, 21 bp, Homo sapiens
gagaatttctaccatttcaga

SEQ ID NO: 2542879 - DNA, 16 bp, Homo sapiens
gagaattttaaattat

SEQ ID NO: 2542880 - DNA, 19 bp, Homo sapiens
gagacaaacacctcccagg

SEQ ID NO: 2542881 - DNA, 17 bp, Homo sapiens
gagacaagaaatccctg

SEQ ID NO: 2542882 - DNA, 20 bp, Homo sapiens
gagacacaacaactcctagg

SEQ ID NO: 2542883 - DNA, 12 bp, Homo sapiens
gagacagaagca

SEQ ID NO: 2542884 - DNA, 12 bp, Homo sapiens
gagacagcccgg

SEQ ID NO: 2542885 - DNA, 19 bp, Homo sapiens
gagacagcccgggctctgc

SEQ ID NO: 2542886 - DNA, 21 bp, Homo sapiens
gagacagcccgggctctgcct

SEQ ID NO: 2542887 - DNA, 23 bp, Homo sapiens
gagacagcccgggctctgcctcc

SEQ ID NO: 2542888 - DNA, 15 bp, Homo sapiens
gagacagctctgcat

SEQ ID NO: 2542889 - DNA, 19 bp, Homo sapiens
gagacagcttgatcaaagg

SEQ ID NO: 2542890 - DNA, 16 bp, Homo sapiens
gagacaggacctgact

SEQ ID NO: 2542891 - DNA, 22 bp, Homo sapiens
gagacagggttttgccatgttg

SEQ ID NO: 2542892 - DNA, 18 bp, Homo sapiens
gagacagttcaagaaagc

SEQ ID NO: 2542893 - DNA, 16 bp, Homo sapiens
gagacagtttcttagc

SEQ ID NO: 2542894 - DNA, 18 bp, Homo sapiens
gagacattcctgggcaca

SEQ ID NO: 2542895 - DNA, 19 bp, Homo sapiens
gagacattcctgggcacag

SEQ ID NO: 2542896 - DNA, 13 bp, Homo sapiens
gagaccagcctgg

SEQ ID NO: 2542897 - DNA, 21 bp, Homo sapiens
gagaccagttgggagcactgg

SEQ ID NO: 2542898 - DNA, 12 bp, Homo sapiens
gagacccccaca

SEQ ID NO: 2542899 - DNA, 15 bp, Homo sapiens
gagacccccacacct

SEQ ID NO: 2542900 - DNA, 23 bp, Homo sapiens
gagacctacctcaggttgctggt

SEQ ID NO: 2542901 - DNA, 20 bp, Homo sapiens
gagacctcatcaggatgaac

SEQ ID NO: 2542902 - DNA, 19 bp, Homo sapiens
gagacctgacaagcactgc

SEQ ID NO: 2542903 - DNA, 19 bp, Homo sapiens
gagacctggcactggatgc

SEQ ID NO: 2542904 - DNA, 16 bp, Homo sapiens
gagacgggaccgggcc

SEQ ID NO: 2542905 - DNA, 16 bp, Homo sapiens
gagactagattgcctt

SEQ ID NO: 2542906 - DNA, 20 bp, Homo sapiens
gagactcctgcaggcagcca

SEQ ID NO: 2542907 - DNA, 13 bp, Homo sapiens
gagactctggcct

SEQ ID NO: 2542908 - DNA, 13 bp, Homo sapiens
gagactctgtctc

SEQ ID NO: 2542909 - DNA, 14 bp, Homo sapiens
gagactctgtctca

SEQ ID NO: 2542910 - DNA, 15 bp, Homo sapiens
gagactgcccagcta

SEQ ID NO: 2542911 - DNA, 23 bp, Homo sapiens
gagactgcgggatggtcctgggg

SEQ ID NO: 2542912 - DNA, 14 bp, Homo sapiens
gagactgcttccca

SEQ ID NO: 2542913 - DNA, 20 bp, Homo sapiens
gagactgcttcccatcctac

SEQ ID NO: 2542914 - DNA, 12 bp, Homo sapiens
gagactggagca

SEQ ID NO: 2542915 - DNA, 20 bp, Homo sapiens
gagactgggctgagggagcc

SEQ ID NO: 2542916 - DNA, 23 bp, Homo sapiens
gagactggtcctgtgtgcagtga

SEQ ID NO: 2542917 - DNA, 17 bp, Homo sapiens
gagactgttttgaattt

SEQ ID NO: 2542918 - DNA, 14 bp, Homo sapiens
gaggtgtcaggctg

SEQ ID NO: 2542919 - DNA, 15 bp, Homo sapiens
gaggtgtcaggctgc

SEQ ID NO: 2542920 - DNA, 21 bp, Homo sapiens
gaggtgtttaaagagaggtta

SEQ ID NO: 2542921 - DNA, 15 bp, Homo sapiens
gaggttaaggctgag

SEQ ID NO: 2542922 - DNA, 18 bp, Homo sapiens
gaggttgataactttgct

SEQ ID NO: 2542923 - DNA, 13 bp, Homo sapiens
gaggttgcaggga

SEQ ID NO: 2542924 - DNA, 19 bp, Homo sapiens
gaggttgcagggagccgag

SEQ ID NO: 2542925 - DNA, 14 bp, Homo sapiens
gaggttgggtgggc

SEQ ID NO: 2542926 - DNA, 16 bp, Homo sapiens
gaggtttcaaacctcc

SEQ ID NO: 2542927 - DNA, 15 bp, Homo sapiens
gaggttttaaagtga

SEQ ID NO: 2542928 - DNA, 12 bp, Homo sapiens
gagtaagagctg

SEQ ID NO: 2542929 - DNA, 20 bp, Homo sapiens
gagtactacagtcctcccat

SEQ ID NO: 2542930 - DNA, 21 bp, Homo sapiens
gagtactacagtcctcccatc

SEQ ID NO: 2542931 - DNA, 19 bp, Homo sapiens
gagtagaaactgcagggaa

SEQ ID NO: 2542932 - DNA, 17 bp, Homo sapiens
gagtagaaagacagagc

SEQ ID NO: 2542933 - DNA, 20 bp, Homo sapiens
gagtagaaagacagagctgg

SEQ ID NO: 2542934 - DNA, 18 bp, Homo sapiens
gagtagatggtgaaattt

SEQ ID NO: 2542935 - DNA, 22 bp, Homo sapiens
gagtagctgggactacaggcac

SEQ ID NO: 2542936 - DNA, 17 bp, Homo sapiens
gagtaggaagactttgg

SEQ ID NO: 2542937 - DNA, 20 bp, Homo sapiens
gagtagttgatgttgcattt

SEQ ID NO: 2542938 - DNA, 14 bp, Homo sapiens
gagtattggtctcc

SEQ ID NO: 2542939 - DNA, 20 bp, Homo sapiens
gagtcacccatgaagacagg

SEQ ID NO: 2542940 - DNA, 15 bp, Homo sapiens
gagtcactgcctctc

SEQ ID NO: 2542941 - DNA, 11 bp, Homo sapiens
gagtcagcctt

SEQ ID NO: 2542942 - DNA, 18 bp, Homo sapiens
gagtcagggagagctgaa

SEQ ID NO: 2542943 - DNA, 18 bp, Homo sapiens
gagtcaggtttggggttc

SEQ ID NO: 2542944 - DNA, 15 bp, Homo sapiens
gagtcagtgccaggt

SEQ ID NO: 2542945 - DNA, 18 bp, Homo sapiens
gagtcagtgccaggtcct

SEQ ID NO: 2542946 - DNA, 12 bp, Homo sapiens
gagtcatgccaa

SEQ ID NO: 2542947 - DNA, 14 bp, Homo sapiens
gagtccaggcccca

SEQ ID NO: 2542948 - DNA, 18 bp, Homo sapiens
gagtcccaaggaaagccc

SEQ ID NO: 2542949 - DNA, 16 bp, Homo sapiens
gagtcccaccttggct

SEQ ID NO: 2542950 - DNA, 21 bp, Homo sapiens
gagtcccaccttggctgcagg

SEQ ID NO: 2542951 - DNA, 20 bp, Homo sapiens
gagtcccactgcctcaggtt

SEQ ID NO: 2542952 - DNA, 23 bp, Homo sapiens
gagtcccactgcctcaggttcct

SEQ ID NO: 2542953 - DNA, 21 bp, Homo sapiens
gagtcccagagcaggaggccc

SEQ ID NO: 2542954 - DNA, 16 bp, Homo sapiens
gagtcccagtgggagg

SEQ ID NO: 2542955 - DNA, 11 bp, Homo sapiens
gagtcccctca

SEQ ID NO: 2542956 - DNA, 18 bp, Homo sapiens
gagtcccctcacctcctc

SEQ ID NO: 2542957 - DNA, 14 bp, Homo sapiens
gagtcccgtcagga

SEQ ID NO: 2542958 - DNA, 16 bp, Homo sapiens
gagtcctcactcccag

SEQ ID NO: 2542959 - DNA, 13 bp, Homo sapiens
gagtcctctgaat

SEQ ID NO: 2542960 - DNA, 14 bp, Homo sapiens
gagtcgaggacagg

SEQ ID NO: 2542961 - DNA, 13 bp, Homo sapiens
gagtctgaaggct

SEQ ID NO: 2542962 - DNA, 11 bp, Homo sapiens
gagtctgcaca

SEQ ID NO: 2542963 - DNA, 12 bp, Homo sapiens
gagtctgtctct

SEQ ID NO: 2542964 - DNA, 18 bp, Homo sapiens
gagtctgtctctgtcatg

SEQ ID NO: 2542965 - DNA, 21 bp, Homo sapiens
gagtgaaacctttagggcagc

SEQ ID NO: 2542966 - DNA, 22 bp, Homo sapiens
gagtgaaacctttagggcagct

SEQ ID NO: 2542967 - DNA, 19 bp, Homo sapiens
gagtgaacaaatttacaga

SEQ ID NO: 2542968 - DNA, 16 bp, Homo sapiens
gagtgaacctaccttc

SEQ ID NO: 2542969 - DNA, 18 bp, Homo sapiens
gagtgaagaggggcagcc

SEQ ID NO: 2542970 - DNA, 15 bp, Homo sapiens
gagtgacagaggcag

SEQ ID NO: 2542971 - DNA, 20 bp, Homo sapiens
gagtgacagaggcagcccca

SEQ ID NO: 2542972 - DNA, 22 bp, Homo sapiens
gagtgagacccagccctcatcc

SEQ ID NO: 2542973 - DNA, 13 bp, Homo sapiens
gagtgagaccctg

SEQ ID NO: 2542974 - DNA, 22 bp, Homo sapiens
gagtgaggaatagttgagcccc

SEQ ID NO: 2542975 - DNA, 21 bp, Homo sapiens
gagtgaggggtaaaagctgat

SEQ ID NO: 2542976 - DNA, 19 bp, Homo sapiens
gagtgcaatgacacagtct

SEQ ID NO: 2542977 - DNA, 14 bp, Homo sapiens
gagtgcagtcctga

SEQ ID NO: 2542978 - DNA, 18 bp, Homo sapiens
gagtgcagtcctgatcag

SEQ ID NO: 2542979 - DNA, 12 bp, Homo sapiens
gagtgcagtgag

SEQ ID NO: 2542980 - DNA, 14 bp, Homo sapiens
gagtgcgtgctcag

SEQ ID NO: 2542981 - DNA, 19 bp, Homo sapiens
gagtggaatagtatcctcc

SEQ ID NO: 2542982 - DNA, 22 bp, Homo sapiens
gagtggaatagtatcctccagg

SEQ ID NO: 2542983 - DNA, 17 bp, Homo sapiens
gagtggactggagtgga

SEQ ID NO: 2542984 - DNA, 18 bp, Homo sapiens
gagtggaggaggcctggg

SEQ ID NO: 2542985 - DNA, 13 bp, Homo sapiens
gagtggcctggcc

SEQ ID NO: 2542986 - DNA, 15 bp, Homo sapiens
gagtggcctggccag

SEQ ID NO: 2542987 - DNA, 18 bp, Homo sapiens
gagtggcctggccaggag

SEQ ID NO: 2542988 - DNA, 14 bp, Homo sapiens
gagtggggcagtag

SEQ ID NO: 2542989 - DNA, 22 bp, Homo sapiens
gagtgggggagagcaggctggc

SEQ ID NO: 2542990 - DNA, 23 bp, Homo sapiens
gagtgggggatcacagcctctga

SEQ ID NO: 2542991 - DNA, 14 bp, Homo sapiens
gagtgtaagtgtga

SEQ ID NO: 2542992 - DNA, 13 bp, Homo sapiens
gagtgtacaagta

SEQ ID NO: 2542993 - DNA, 16 bp, Homo sapiens
gagtgtagaagcattc

SEQ ID NO: 2542994 - DNA, 21 bp, Homo sapiens
gagtgtatgtagggcataatg

SEQ ID NO: 2542995 - DNA, 23 bp, Homo sapiens
gagtgtcctaggagtatcctcat

SEQ ID NO: 2542996 - DNA, 22 bp, Homo sapiens
gagtgtctttccacggagccac

SEQ ID NO: 2542997 - DNA, 17 bp, Homo sapiens
gagtgtgcctgaagtcc

SEQ ID NO: 2542998 - DNA, 20 bp, Homo sapiens
gagtgtgcctgaagtcccag

SEQ ID NO: 2542999 - DNA, 16 bp, Homo sapiens
gagtgtggctcccctc

SEQ ID NO: 2543000 - DNA, 21 bp, Homo sapiens
gagtgtgtaatttaaaattgt

SEQ ID NO: 2543001 - DNA, 22 bp, Homo sapiens
gagtgtgtaatttaaaattgtg

SEQ ID NO: 2543002 - DNA, 19 bp, Homo sapiens
gagtgtgtgcatgtgtgtg

SEQ ID NO: 2543003 - DNA, 19 bp, Homo sapiens
gagtgttccccttccactg

SEQ ID NO: 2543004 - DNA, 22 bp, Homo sapiens
gagttaaatagagtatatgcac

SEQ ID NO: 2543005 - DNA, 21 bp, Homo sapiens
gagttaagaagctgttgtaca

SEQ ID NO: 2543006 - DNA, 20 bp, Homo sapiens
gagttacagcgagaggcaga

SEQ ID NO: 2543007 - DNA, 18 bp, Homo sapiens
gagttagaggccagcctg

SEQ ID NO: 2543008 - DNA, 18 bp, Homo sapiens
gagttatatgttcactgt

SEQ ID NO: 2543009 - DNA, 11 bp, Homo sapiens
gagttcaatga

SEQ ID NO: 2543010 - DNA, 12 bp, Homo sapiens
gagttcaatgat

SEQ ID NO: 2543011 - DNA, 15 bp, Homo sapiens
gagttcaatgatcta

SEQ ID NO: 2543012 - DNA, 18 bp, Homo sapiens
gagttcaatgatctaggt

SEQ ID NO: 2543013 - DNA, 21 bp, Homo sapiens
gagttcaatgatctaggttta

SEQ ID NO: 2543014 - DNA, 22 bp, Homo sapiens
gagttcacttcatcttctcagc

SEQ ID NO: 2543015 - DNA, 21 bp, Homo sapiens
gagttcaggtagctgcccctg

SEQ ID NO: 2543016 - DNA, 14 bp, Homo sapiens
gagttcagttttac

SEQ ID NO: 2543017 - DNA, 17 bp, Homo sapiens
gagttccatgaagacca

SEQ ID NO: 2543018 - DNA, 18 bp, Homo sapiens
gagttccccatgcagaca

SEQ ID NO: 2543019 - DNA, 15 bp, Homo sapiens
gagttctcagggctc

SEQ ID NO: 2543020 - DNA, 16 bp, Homo sapiens
gagttctcagggctcc

SEQ ID NO: 2543021 - DNA, 18 bp, Homo sapiens
gagttctcagggctcctg

SEQ ID NO: 2543022 - DNA, 21 bp, Homo sapiens
gagttcttaaggattgtgata

SEQ ID NO: 2543023 - DNA, 22 bp, Homo sapiens
gagttgatagcacagaccctgc

SEQ ID NO: 2543024 - DNA, 18 bp, Homo sapiens
gagttgctgcaaacctga

SEQ ID NO: 2543025 - DNA, 16 bp, Homo sapiens
gagttgtggaaagcct

SEQ ID NO: 2543026 - DNA, 20 bp, Homo sapiens
gagttgtggaaagcctctgc

SEQ ID NO: 2543027 - DNA, 22 bp, Homo sapiens
gagttgttacatttttaagtgc

SEQ ID NO: 2543028 - DNA, 15 bp, Homo sapiens
gagttgttgccctgg

SEQ ID NO: 2543029 - DNA, 18 bp, Homo sapiens
gagtttcattctcctgcc

SEQ ID NO: 2543030 - DNA, 22 bp, Homo sapiens
gagtttgaaggaggtgagggat

SEQ ID NO: 2543031 - DNA, 12 bp, Homo sapiens
gagtttggtccc

SEQ ID NO: 2543032 - DNA, 13 bp, Homo sapiens
gagttttccccac

SEQ ID NO: 2543033 - DNA, 18 bp, Homo sapiens
gataaaatgaggttcaac

SEQ ID NO: 2543034 - DNA, 19 bp, Homo sapiens
gataaaattatagatggga

SEQ ID NO: 2543035 - DNA, 14 bp, Homo sapiens
gataaagtttctca

SEQ ID NO: 2543036 - DNA, 12 bp, Homo sapiens
gataaattataa

SEQ ID NO: 2543037 - DNA, 13 bp, Homo sapiens
gataaattataag

SEQ ID NO: 2543038 - DNA, 17 bp, Homo sapiens
gataacctatatgattt

SEQ ID NO: 2543039 - DNA, 11 bp, Homo sapiens
gataactctcc

SEQ ID NO: 2543040 - DNA, 21 bp, Homo sapiens
gataatacaccactacattct

SEQ ID NO: 2543041 - DNA, 22 bp, Homo sapiens
gataatacaccactacattctg

SEQ ID NO: 2543042 - DNA, 23 bp, Homo sapiens
gataatacaccactacattctgt

SEQ ID NO: 2543043 - DNA, 20 bp, Homo sapiens
gataatgccggtgagaataa

SEQ ID NO: 2543044 - DNA, 12 bp, Homo sapiens
gataatgttaaa

SEQ ID NO: 2543045 - DNA, 13 bp, Homo sapiens
gataatgttaaat

SEQ ID NO: 2543046 - DNA, 18 bp, Homo sapiens
gataattctagctttgag

SEQ ID NO: 2543047 - DNA, 17 bp, Homo sapiens
gatacaaaagcatgtga

SEQ ID NO: 2543048 - DNA, 16 bp, Homo sapiens
gatacaagattagaag

SEQ ID NO: 2543049 - DNA, 18 bp, Homo sapiens
gatacaggaaaagctgct

SEQ ID NO: 2543050 - DNA, 19 bp, Homo sapiens
gatacaggaaaagctgctg

SEQ ID NO: 2543051 - DNA, 20 bp, Homo sapiens
gatacaggaaaagctgctga

SEQ ID NO: 2543052 - DNA, 23 bp, Homo sapiens
gatacaggaaaagctgctgacag

SEQ ID NO: 2543053 - DNA, 18 bp, Homo sapiens
gatacatatgagtgtgga

SEQ ID NO: 2543054 - DNA, 20 bp, Homo sapiens
gatacatatgagtgtggaag

SEQ ID NO: 2543055 - DNA, 22 bp, Homo sapiens
gataccagcgaggaggctccag

SEQ ID NO: 2543056 - DNA, 13 bp, Homo sapiens
gataccagctgga

SEQ ID NO: 2543057 - DNA, 22 bp, Homo sapiens
gatactaaaagttcttctccaa

SEQ ID NO: 2543058 - DNA, 16 bp, Homo sapiens
gatactacagtttgtt

SEQ ID NO: 2543059 - DNA, 17 bp, Homo sapiens
gatactctgtcagatgg

SEQ ID NO: 2543060 - DNA, 16 bp, Homo sapiens
gatagaagaactgcaa

SEQ ID NO: 2543061 - DNA, 20 bp, Homo sapiens
gatagcaagtgaatttttct

SEQ ID NO: 2543062 - DNA, 23 bp, Homo sapiens
gcaatggtgttgccctgagtgga

SEQ ID NO: 2543063 - DNA, 14 bp, Homo sapiens
gcaatgtgctactg

SEQ ID NO: 2543064 - DNA, 15 bp, Homo sapiens
gcaatgtgggcagag

SEQ ID NO: 2543065 - DNA, 14 bp, Homo sapiens
gcaatgttttcctt

SEQ ID NO: 2543066 - DNA, 21 bp, Homo sapiens
gcaattaaagtgatactgaaa

SEQ ID NO: 2543067 - DNA, 21 bp, Homo sapiens
gcaattcccctctgctgctgt

SEQ ID NO: 2543068 - DNA, 16 bp, Homo sapiens
gcaatttatacaatat

SEQ ID NO: 2543069 - DNA, 18 bp, Homo sapiens
gcaatttccttttttgtt

SEQ ID NO: 2543070 - DNA, 13 bp, Homo sapiens
gcacaaatattta

SEQ ID NO: 2543071 - DNA, 16 bp, Homo sapiens
gcacaaatatttattt

SEQ ID NO: 2543072 - DNA, 22 bp, Homo sapiens
gcacaagctccaagctcccagg

SEQ ID NO: 2543073 - DNA, 14 bp, Homo sapiens
gcacaagctgcacc

SEQ ID NO: 2543074 - DNA, 16 bp, Homo sapiens
gcacaataaaaatgtt

SEQ ID NO: 2543075 - DNA, 17 bp, Homo sapiens
gcacaataaaaatgttt

SEQ ID NO: 2543076 - DNA, 20 bp, Homo sapiens
gcacaatattgaactttttt

SEQ ID NO: 2543077 - DNA, 16 bp, Homo sapiens
gcacaattctgtttta

SEQ ID NO: 2543078 - DNA, 16 bp, Homo sapiens
gcacacacacacacag

SEQ ID NO: 2543079 - DNA, 17 bp, Homo sapiens
gcacacacacacacagg

SEQ ID NO: 2543080 - DNA, 16 bp, Homo sapiens
gcacacaccagagccc

SEQ ID NO: 2543081 - DNA, 14 bp, Homo sapiens
gcacaccgggcact

SEQ ID NO: 2543082 - DNA, 20 bp, Homo sapiens
gcacaccgggcactcagaag

SEQ ID NO: 2543083 - DNA, 19 bp, Homo sapiens
gcacacgcctcccactggg

SEQ ID NO: 2543084 - DNA, 14 bp, Homo sapiens
gcacactttgccat

SEQ ID NO: 2543085 - DNA, 22 bp, Homo sapiens
gcacactttgccatattttcac

SEQ ID NO: 2543086 - DNA, 20 bp, Homo sapiens
gcacagaaacacaatatttt

SEQ ID NO: 2543087 - DNA, 16 bp, Homo sapiens
gcacagaccctgccct

SEQ ID NO: 2543088 - DNA, 20 bp, Homo sapiens
gcacagaccctgccctgtgg

SEQ ID NO: 2543089 - DNA, 18 bp, Homo sapiens
gcacagagctctccagct

SEQ ID NO: 2543090 - DNA, 19 bp, Homo sapiens
gcacagagttgttacattt

SEQ ID NO: 2543091 - DNA, 13 bp, Homo sapiens
gcacagatggatt

SEQ ID NO: 2543092 - DNA, 19 bp, Homo sapiens
gcacagatggatttgcctg

SEQ ID NO: 2543093 - DNA, 24 bp, Homo sapiens
gcacagatggatttgcctgtgcca

SEQ ID NO: 2543094 - DNA, 13 bp, Homo sapiens
gcacagcagttcc

SEQ ID NO: 2543095 - DNA, 21 bp, Homo sapiens
gcacagccatacggcactgaa

SEQ ID NO: 2543096 - DNA, 16 bp, Homo sapiens
gcacagcttcatttcc

SEQ ID NO: 2543097 - DNA, 23 bp, Homo sapiens
gcacagcttcatttcctgtgtct

SEQ ID NO: 2543098 - DNA, 12 bp, Homo sapiens
gcacaggcagct

SEQ ID NO: 2543099 - DNA, 14 bp, Homo sapiens
gcacaggccccctt

SEQ ID NO: 2543100 - DNA, 20 bp, Homo sapiens
gcacagggcagctgggccca

SEQ ID NO: 2543101 - DNA, 20 bp, Homo sapiens
gcacaggtgggcttcccagt

SEQ ID NO: 2543102 - DNA, 14 bp, Homo sapiens
gcacagtgcctgca

SEQ ID NO: 2543103 - DNA, 17 bp, Homo sapiens
gcacagtggtggcaggg

SEQ ID NO: 2543104 - DNA, 20 bp, Homo sapiens
gcacagtgttaaatgaaatt

SEQ ID NO: 2543105 - DNA, 12 bp, Homo sapiens
gcacagtttgaa

SEQ ID NO: 2543106 - DNA, 14 bp, Homo sapiens
gcacagtttgaaca

SEQ ID NO: 2543107 - DNA, 14 bp, Homo sapiens
gcacagttttctga

SEQ ID NO: 2543108 - DNA, 18 bp, Homo sapiens
gcacagttttctgagaaa

SEQ ID NO: 2543109 - DNA, 18 bp, Homo sapiens
gcacatatggactctgca

SEQ ID NO: 2543110 - DNA, 21 bp, Homo sapiens
gcacatcagcacgatttctgt

SEQ ID NO: 2543111 - DNA, 21 bp, Homo sapiens
gcacatctgcattttcacccc

SEQ ID NO: 2543112 - DNA, 17 bp, Homo sapiens
gcacatctgtgtcttgt

SEQ ID NO: 2543113 - DNA, 19 bp, Homo sapiens
gcacatgacaactttgcca

SEQ ID NO: 2543114 - DNA, 17 bp, Homo sapiens
gcaccaaaataagaaaa

SEQ ID NO: 2543115 - DNA, 15 bp, Homo sapiens
gcaccaagcaggaaa

SEQ ID NO: 2543116 - DNA, 11 bp, Homo sapiens
gcaccacccta

SEQ ID NO: 2543117 - DNA, 22 bp, Homo sapiens
gcaccaccctagtcccttcccc

SEQ ID NO: 2543118 - DNA, 23 bp, Homo sapiens
gcaccaccctagtcccttcccct

SEQ ID NO: 2543119 - DNA, 15 bp, Homo sapiens
gcaccagaggctgca

SEQ ID NO: 2543120 - DNA, 16 bp, Homo sapiens
gcaccagcagcctgga

SEQ ID NO: 2543121 - DNA, 18 bp, Homo sapiens
gcaccagcgaagggagtg

SEQ ID NO: 2543122 - DNA, 18 bp, Homo sapiens
gcaccagcttctccaggc

SEQ ID NO: 2543123 - DNA, 20 bp, Homo sapiens
gcaccagggactatgaatgg

SEQ ID NO: 2543124 - DNA, 17 bp, Homo sapiens
gcaccatccgccagggc

SEQ ID NO: 2543125 - DNA, 13 bp, Homo sapiens
gcacccaccctgg

SEQ ID NO: 2543126 - DNA, 17 bp, Homo sapiens
gcacccaccctgggacc

SEQ ID NO: 2543127 - DNA, 21 bp, Homo sapiens
gcacccagcctctagggaccc

SEQ ID NO: 2543128 - DNA, 21 bp, Homo sapiens
gcacccagtgagcactcccaa

SEQ ID NO: 2543129 - DNA, 17 bp, Homo sapiens
gcaccccatgctgttga

SEQ ID NO: 2543130 - DNA, 14 bp, Homo sapiens
gcaccccctggaga

SEQ ID NO: 2543131 - DNA, 16 bp, Homo sapiens
gcaccccttccatgtg

SEQ ID NO: 2543132 - DNA, 15 bp, Homo sapiens
gcacccggcccctgc

SEQ ID NO: 2543133 - DNA, 19 bp, Homo sapiens
gcaccctcaggcaggtggg

SEQ ID NO: 2543134 - DNA, 19 bp, Homo sapiens
gcaccctcgatgaagccca

SEQ ID NO: 2543135 - DNA, 14 bp, Homo sapiens
gcaccctggggcct

SEQ ID NO: 2543136 - DNA, 16 bp, Homo sapiens
gcaccggctggcctgg

SEQ ID NO: 2543137 - DNA, 17 bp, Homo sapiens
gcaccggctggcctggc

SEQ ID NO: 2543138 - DNA, 19 bp, Homo sapiens
gcacctaaaccaccagtgc

SEQ ID NO: 2543139 - DNA, 18 bp, Homo sapiens
gcacctacagtgtacagt

SEQ ID NO: 2543140 - DNA, 20 bp, Homo sapiens
gcacctaccatcagggacag

SEQ ID NO: 2543141 - DNA, 23 bp, Homo sapiens
gcacctaccatcagggacaggat

SEQ ID NO: 2543142 - DNA, 16 bp, Homo sapiens
gcacctagtccagtga

SEQ ID NO: 2543143 - DNA, 17 bp, Homo sapiens
gcacctatagtcccagc

SEQ ID NO: 2543144 - DNA, 19 bp, Homo sapiens
gcacctctgacctatcact

SEQ ID NO: 2543145 - DNA, 16 bp, Homo sapiens
gcacctgccagcctgg

SEQ ID NO: 2543146 - DNA, 17 bp, Homo sapiens
gcacctggggagtggga

SEQ ID NO: 2543147 - DNA, 19 bp, Homo sapiens
gcacctgtactcaggaggc

SEQ ID NO: 2543148 - DNA, 17 bp, Homo sapiens
gcaccttagacagtccc

SEQ ID NO: 2543149 - DNA, 15 bp, Homo sapiens
gcaccttcctcactt

SEQ ID NO: 2543150 - DNA, 16 bp, Homo sapiens
gcaccttcctcacttc

SEQ ID NO: 2543151 - DNA, 23 bp, Homo sapiens
gcacgatgtggaaaaatgagaga

SEQ ID NO: 2543152 - DNA, 12 bp, Homo sapiens
gcacgatttctg

SEQ ID NO: 2543153 - DNA, 15 bp, Homo sapiens
gcacgatttctgttt

SEQ ID NO: 2543154 - DNA, 12 bp, Homo sapiens
gcacgcacacac

SEQ ID NO: 2543155 - DNA, 13 bp, Homo sapiens
gcacgcacacaca

SEQ ID NO: 2543156 - DNA, 15 bp, Homo sapiens
gcacgcacacacaca

SEQ ID NO: 2543157 - DNA, 19 bp, Homo sapiens
gcacgcttgcgtatgtctg

SEQ ID NO: 2543158 - DNA, 20 bp, Homo sapiens
gcacgcttgcgtatgtctgt

SEQ ID NO: 2543159 - DNA, 12 bp, Homo sapiens
gcacggactctt

SEQ ID NO: 2543160 - DNA, 15 bp, Homo sapiens
gcacgtggagagctg

SEQ ID NO: 2543161 - DNA, 16 bp, Homo sapiens
gcacgtggagagctgg

SEQ ID NO: 2543162 - DNA, 18 bp, Homo sapiens
gcacgtggagagctggtg

SEQ ID NO: 2543163 - DNA, 19 bp, Homo sapiens
gcactaaagtatgtaaagt

SEQ ID NO: 2543164 - DNA, 19 bp, Homo sapiens
gcactaacgttgagcccct

SEQ ID NO: 2543165 - DNA, 20 bp, Homo sapiens
gcactaacgttgagcccctg

SEQ ID NO: 2543166 - DNA, 19 bp, Homo sapiens
gcactaaggtgtgctctga

SEQ ID NO: 2543167 - DNA, 20 bp, Homo sapiens
gcactaaggtgtgctctgat

SEQ ID NO: 2543168 - DNA, 19 bp, Homo sapiens
gcactaatttgatgtttac

SEQ ID NO: 2543169 - DNA, 13 bp, Homo sapiens
gcactacatgtgg

SEQ ID NO: 2543170 - DNA, 13 bp, Homo sapiens
gcactactcctct

SEQ ID NO: 2543171 - DNA, 15 bp, Homo sapiens
gcactactctgtgcc

SEQ ID NO: 2543172 - DNA, 20 bp, Homo sapiens
gcactataatgtaagctcta

SEQ ID NO: 2543173 - DNA, 13 bp, Homo sapiens
gcactcaacatga

SEQ ID NO: 2543174 - DNA, 22 bp, Homo sapiens
gcactcacacaggacccccttc

SEQ ID NO: 2543175 - DNA, 17 bp, Homo sapiens
gcactcacagacctgga

SEQ ID NO: 2543176 - DNA, 19 bp, Homo sapiens
gcactcacagacctggagc

SEQ ID NO: 2543177 - DNA, 17 bp, Homo sapiens
gcactcacccatgtgcc

SEQ ID NO: 2543178 - DNA, 13 bp, Homo sapiens
gcactcccctgct

SEQ ID NO: 2543179 - DNA, 16 bp, Homo sapiens
gcactcccctgctggg

SEQ ID NO: 2543180 - DNA, 21 bp, Homo sapiens
gcactcgggaaacctggggct

SEQ ID NO: 2543181 - DNA, 21 bp, Homo sapiens
gcactctaaaaggttcaggga

SEQ ID NO: 2543182 - DNA, 16 bp, Homo sapiens
gcactgactgggcata

SEQ ID NO: 2543183 - DNA, 17 bp, Homo sapiens
gcactgactgggcatag

SEQ ID NO: 2543184 - DNA, 15 bp, Homo sapiens
gcactgacttctaag

SEQ ID NO: 2543185 - DNA, 14 bp, Homo sapiens
gcactgagcccccc

SEQ ID NO: 2543186 - DNA, 15 bp, Homo sapiens
gcactgagggccaca

SEQ ID NO: 2543187 - DNA, 20 bp, Homo sapiens
gcactgagggccacactatt

SEQ ID NO: 2543188 - DNA, 19 bp, Homo sapiens
gcactgatttcacaacaga

SEQ ID NO: 2543189 - DNA, 20 bp, Homo sapiens
gcactgctaggcgagtgcca

SEQ ID NO: 2543190 - DNA, 22 bp, Homo sapiens
gcactgctaggcgagtgccagg

SEQ ID NO: 2543191 - DNA, 12 bp, Homo sapiens
gcactgctgccc

SEQ ID NO: 2543192 - DNA, 20 bp, Homo sapiens
gcactgctgcccagcctcca

SEQ ID NO: 2543193 - DNA, 22 bp, Homo sapiens
gcactgcttccagtgaggctct

SEQ ID NO: 2543194 - DNA, 17 bp, Homo sapiens
gcactggagtccagtct

SEQ ID NO: 2543195 - DNA, 14 bp, Homo sapiens
gcactggagtgcag

SEQ ID NO: 2543196 - DNA, 19 bp, Homo sapiens
gcactggcattgtccctgt

SEQ ID NO: 2543197 - DNA, 16 bp, Homo sapiens
gcactgtatgctggac

SEQ ID NO: 2543198 - DNA, 19 bp, Homo sapiens
gcactgtctcagtttcact

SEQ ID NO: 2543199 - DNA, 13 bp, Homo sapiens
gcactgtgctcag

SEQ ID NO: 2543200 - DNA, 19 bp, Homo sapiens
gcactgttccccctgtgca

SEQ ID NO: 2543201 - DNA, 19 bp, Homo sapiens
gcacttagctatcagaaga

SEQ ID NO: 2543202 - DNA, 13 bp, Homo sapiens
gcacttggagcca

SEQ ID NO: 2543203 - DNA, 16 bp, Homo sapiens
gcactttcctcctggc

SEQ ID NO: 2543204 - DNA, 16 bp, Homo sapiens
gcactttgggaggcct

SEQ ID NO: 2543205 - DNA, 20 bp, Homo sapiens
gcactttttaattcaccaaa

SEQ ID NO: 2543206 - DNA, 18 bp, Homo sapiens
gcagaaaaatgtcattga

SEQ ID NO: 2543207 - DNA, 16 bp, Homo sapiens
gccactgcccgagctg

SEQ ID NO: 2543208 - DNA, 12 bp, Homo sapiens
gccactggccat

SEQ ID NO: 2543209 - DNA, 17 bp, Homo sapiens
gccactggccatctcca

SEQ ID NO: 2543210 - DNA, 18 bp, Homo sapiens
gccactgtgaagagaacc

SEQ ID NO: 2543211 - DNA, 19 bp, Homo sapiens
gccactttgcaaaggagct

SEQ ID NO: 2543212 - DNA, 23 bp, Homo sapiens
gccacttttgactagggattcag

SEQ ID NO: 2543213 - DNA, 20 bp, Homo sapiens
gccagaaaaacgtgttgcct

SEQ ID NO: 2543214 - DNA, 18 bp, Homo sapiens
gccagaacagtttgtaca

SEQ ID NO: 2543215 - DNA, 17 bp, Homo sapiens
gccagaacctggagggc

SEQ ID NO: 2543216 - DNA, 18 bp, Homo sapiens
gccagaagatcccctcag

SEQ ID NO: 2543217 - DNA, 19 bp, Homo sapiens
gccagaagatcccctcagg

SEQ ID NO: 2543218 - DNA, 18 bp, Homo sapiens
gccagaagggggccatga

SEQ ID NO: 2543219 - DNA, 11 bp, Homo sapiens
gccagagaagt

SEQ ID NO: 2543220 - DNA, 15 bp, Homo sapiens
gccagagaagtgaca

SEQ ID NO: 2543221 - DNA, 17 bp, Homo sapiens
gccagagaagtgacagg

SEQ ID NO: 2543222 - DNA, 19 bp, Homo sapiens
gccagagaagtgacaggga

SEQ ID NO: 2543223 - DNA, 21 bp, Homo sapiens
gccagagagcctggtgctgct

SEQ ID NO: 2543224 - DNA, 14 bp, Homo sapiens
gccagaggaactgt

SEQ ID NO: 2543225 - DNA, 22 bp, Homo sapiens
gccagaggaactgtccagagag

SEQ ID NO: 2543226 - DNA, 17 bp, Homo sapiens
gccagagggagtgacag

SEQ ID NO: 2543227 - DNA, 22 bp, Homo sapiens
gccagagggagtgacagaggca

SEQ ID NO: 2543228 - DNA, 12 bp, Homo sapiens
gccagaggtggg

SEQ ID NO: 2543229 - DNA, 15 bp, Homo sapiens
gccagaggtgggcag

SEQ ID NO: 2543230 - DNA, 17 bp, Homo sapiens
gccagaggtgggcaggt

SEQ ID NO: 2543231 - DNA, 19 bp, Homo sapiens
gccagaggtgggcaggtgg

SEQ ID NO: 2543232 - DNA, 17 bp, Homo sapiens
gccagagtcctttccaa

SEQ ID NO: 2543233 - DNA, 15 bp, Homo sapiens
gccagatgcaccagc

SEQ ID NO: 2543234 - DNA, 17 bp, Homo sapiens
gccagatgcaccagccc

SEQ ID NO: 2543235 - DNA, 16 bp, Homo sapiens
gccagatgctgatgtt

SEQ ID NO: 2543236 - DNA, 19 bp, Homo sapiens
gccagatgctgatgttcag

SEQ ID NO: 2543237 - DNA, 21 bp, Homo sapiens
gccagatgctgatgttcagtg

SEQ ID NO: 2543238 - DNA, 17 bp, Homo sapiens
gccagatggggcctctg

SEQ ID NO: 2543239 - DNA, 17 bp, Homo sapiens
gccagattctttcctga

SEQ ID NO: 2543240 - DNA, 20 bp, Homo sapiens
gccagcaatgacatctcagg

SEQ ID NO: 2543241 - DNA, 23 bp, Homo sapiens
gccagcaatgacatctcaggggc

SEQ ID NO: 2543242 - DNA, 22 bp, Homo sapiens
gccagcaatgatgtccagaaga

SEQ ID NO: 2543243 - DNA, 22 bp, Homo sapiens
gccagcacagaaacagaggaga

SEQ ID NO: 2543244 - DNA, 12 bp, Homo sapiens
gccagcagccag

SEQ ID NO: 2543245 - DNA, 22 bp, Homo sapiens
gccagcagccagctctcagcca

SEQ ID NO: 2543246 - DNA, 12 bp, Homo sapiens
gccagccagcag

SEQ ID NO: 2543247 - DNA, 19 bp, Homo sapiens
gccagccagcagccagctc

SEQ ID NO: 2543248 - DNA, 19 bp, Homo sapiens
gccagccagtgacctgagg

SEQ ID NO: 2543249 - DNA, 13 bp, Homo sapiens
gccagccccaccc

SEQ ID NO: 2543250 - DNA, 14 bp, Homo sapiens
gccagccccaccca

SEQ ID NO: 2543251 - DNA, 17 bp, Homo sapiens
gccagccccggccctgg

SEQ ID NO: 2543252 - DNA, 19 bp, Homo sapiens
gccagccccggccctgggc

SEQ ID NO: 2543253 - DNA, 12 bp, Homo sapiens
gccagcccctcc

SEQ ID NO: 2543254 - DNA, 18 bp, Homo sapiens
gccagccgtgatgctcag

SEQ ID NO: 2543255 - DNA, 19 bp, Homo sapiens
gccagcctgctccttccca

SEQ ID NO: 2543256 - DNA, 11 bp, Homo sapiens
gccagcctggc

SEQ ID NO: 2543257 - DNA, 19 bp, Homo sapiens
gccagcctggcttctggag

SEQ ID NO: 2543258 - DNA, 22 bp, Homo sapiens
gccagcctggcttctggagccc

SEQ ID NO: 2543259 - DNA, 20 bp, Homo sapiens
gccagcctgtcccatggaca

SEQ ID NO: 2543260 - DNA, 12 bp, Homo sapiens
gccagccttgac

SEQ ID NO: 2543261 - DNA, 21 bp, Homo sapiens
gccagccttgaccattctcca

SEQ ID NO: 2543262 - DNA, 13 bp, Homo sapiens
gccagcgtcctcc

SEQ ID NO: 2543263 - DNA, 15 bp, Homo sapiens
gccagctctcagcca

SEQ ID NO: 2543264 - DNA, 13 bp, Homo sapiens
gccagctctgtat

SEQ ID NO: 2543265 - DNA, 20 bp, Homo sapiens
gccagctgccgaccagagcc

SEQ ID NO: 2543266 - DNA, 14 bp, Homo sapiens
gccagctgctcccc

SEQ ID NO: 2543267 - DNA, 14 bp, Homo sapiens
gccagctggcagca

SEQ ID NO: 2543268 - DNA, 17 bp, Homo sapiens
gccagctggcagcagag

SEQ ID NO: 2543269 - DNA, 18 bp, Homo sapiens
gccagcttgttatttata

SEQ ID NO: 2543270 - DNA, 17 bp, Homo sapiens
gccagcttttcctccct

SEQ ID NO: 2543271 - DNA, 15 bp, Homo sapiens
gccaggactccccag

SEQ ID NO: 2543272 - DNA, 22 bp, Homo sapiens
gccaggactccccaggccaggc

SEQ ID NO: 2543273 - DNA, 22 bp, Homo sapiens
gccaggagctcttcaggcctcc

SEQ ID NO: 2543274 - DNA, 17 bp, Homo sapiens
gccaggatcatggtgta

SEQ ID NO: 2543275 - DNA, 19 bp, Homo sapiens
gccaggcaccccctggaga

SEQ ID NO: 2543276 - DNA, 15 bp, Homo sapiens
gccaggcagatctgt

SEQ ID NO: 2543277 - DNA, 18 bp, Homo sapiens
gccaggcaggtgcctgga

SEQ ID NO: 2543278 - DNA, 13 bp, Homo sapiens
gccaggccacaag

SEQ ID NO: 2543279 - DNA, 23 bp, Homo sapiens
gccaggccacaagacccttgtgg

SEQ ID NO: 2543280 - DNA, 13 bp, Homo sapiens
gccaggccagagg

SEQ ID NO: 2543281 - DNA, 12 bp, Homo sapiens
gccaggccagct

SEQ ID NO: 2543282 - DNA, 23 bp, Homo sapiens
gccaggcccccaagcctgcagtc

SEQ ID NO: 2543283 - DNA, 13 bp, Homo sapiens
gccaggccctctg

SEQ ID NO: 2543284 - DNA, 14 bp, Homo sapiens
gccaggcctgggtc

SEQ ID NO: 2543285 - DNA, 16 bp, Homo sapiens
gccaggcgagatgggg

SEQ ID NO: 2543286 - DNA, 14 bp, Homo sapiens
gccaggctccttcc

SEQ ID NO: 2543287 - DNA, 19 bp, Homo sapiens
gccaggctccttcctgtct

SEQ ID NO: 2543288 - DNA, 12 bp, Homo sapiens
gccaggctctgt

SEQ ID NO: 2543289 - DNA, 13 bp, Homo sapiens
gccaggctggtct

SEQ ID NO: 2543290 - DNA, 16 bp, Homo sapiens
gccagggacagagggg

SEQ ID NO: 2543291 - DNA, 11 bp, Homo sapiens
gccagggagct

SEQ ID NO: 2543292 - DNA, 16 bp, Homo sapiens
gccagggcagagtgag

SEQ ID NO: 2543293 - DNA, 19 bp, Homo sapiens
gccagggccctgcagaggg

SEQ ID NO: 2543294 - DNA, 22 bp, Homo sapiens
gccagggcctggaagacagaga

SEQ ID NO: 2543295 - DNA, 11 bp, Homo sapiens
gccagggctgc

SEQ ID NO: 2543296 - DNA, 21 bp, Homo sapiens
gccaggggaaaatcagcctgc

SEQ ID NO: 2543297 - DNA, 21 bp, Homo sapiens
gccaggggtctccctggagtg

SEQ ID NO: 2543298 - DNA, 15 bp, Homo sapiens
gccagggtgagagct

SEQ ID NO: 2543299 - DNA, 16 bp, Homo sapiens
gccaggtaatgaggga

SEQ ID NO: 2543300 - DNA, 21 bp, Homo sapiens
gccaggtaatgtgaataaatt

SEQ ID NO: 2543301 - DNA, 13 bp, Homo sapiens
gccaggtgcagtg

SEQ ID NO: 2543302 - DNA, 17 bp, Homo sapiens
gccaggtttttggtctg

SEQ ID NO: 2543303 - DNA, 23 bp, Homo sapiens
gccagtaaatgggggtgcatttg

SEQ ID NO: 2543304 - DNA, 21 bp, Homo sapiens
gccagtcaccccggccacctg

SEQ ID NO: 2543305 - DNA, 19 bp, Homo sapiens
gccagtcctagctgcacag

SEQ ID NO: 2543306 - DNA, 17 bp, Homo sapiens
gccagtcctgcctggcc

SEQ ID NO: 2543307 - DNA, 20 bp, Homo sapiens
gccagtcctgcctggccagg

SEQ ID NO: 2543308 - DNA, 16 bp, Homo sapiens
gccagtgactccagga

SEQ ID NO: 2543309 - DNA, 17 bp, Homo sapiens
gccagtgactccaggag

SEQ ID NO: 2543310 - DNA, 18 bp, Homo sapiens
gccagtgactccaggaga

SEQ ID NO: 2543311 - DNA, 21 bp, Homo sapiens
gccagtgactccaggagagga

SEQ ID NO: 2543312 - DNA, 13 bp, Homo sapiens
gccagttggtccc

SEQ ID NO: 2543313 - DNA, 18 bp, Homo sapiens
gccagttggtcccccttc

SEQ ID NO: 2543314 - DNA, 21 bp, Homo sapiens
gccagttggtcccccttccat

SEQ ID NO: 2543315 - DNA, 20 bp, Homo sapiens
gccagttttgtttcctttca

SEQ ID NO: 2543316 - DNA, 21 bp, Homo sapiens
gccatacttatctctctgtgc

SEQ ID NO: 2543317 - DNA, 22 bp, Homo sapiens
gccatacttatctctctgtgct

SEQ ID NO: 2543318 - DNA, 15 bp, Homo sapiens
gccatagctcctgct

SEQ ID NO: 2543319 - DNA, 18 bp, Homo sapiens
gccatagctcctgctcca

SEQ ID NO: 2543320 - DNA, 23 bp, Homo sapiens
gccatagctcctgctccacagcc

SEQ ID NO: 2543321 - DNA, 16 bp, Homo sapiens
gccatagtcacatggc

SEQ ID NO: 2543322 - DNA, 18 bp, Homo sapiens
gccatataagtttgaagg

SEQ ID NO: 2543323 - DNA, 19 bp, Homo sapiens
gccatataagtttgaagga

SEQ ID NO: 2543324 - DNA, 22 bp, Homo sapiens
gccatataagtttgaaggaaac

SEQ ID NO: 2543325 - DNA, 19 bp, Homo sapiens
gccatatactcttcaagga

SEQ ID NO: 2543326 - DNA, 19 bp, Homo sapiens
gccatcataggaagggacc

SEQ ID NO: 2543327 - DNA, 19 bp, Homo sapiens
gccatcatcagtggagcca

SEQ ID NO: 2543328 - DNA, 17 bp, Homo sapiens
gccatcatgtttacaga

SEQ ID NO: 2543329 - DNA, 21 bp, Homo sapiens
gccatccaaataagaaaccta

SEQ ID NO: 2543330 - DNA, 20 bp, Homo sapiens
gccatccaggttcagcttgt

SEQ ID NO: 2543331 - DNA, 14 bp, Homo sapiens
gccatcccagcccc

SEQ ID NO: 2543332 - DNA, 17 bp, Homo sapiens
gccatcccagccccaat

SEQ ID NO: 2543333 - DNA, 17 bp, Homo sapiens
gccatcccagccttggc

SEQ ID NO: 2543334 - DNA, 22 bp, Homo sapiens
gccatccggcccccagagcgcc

SEQ ID NO: 2543335 - DNA, 18 bp, Homo sapiens
gccatcctcaaacactgc

SEQ ID NO: 2543336 - DNA, 19 bp, Homo sapiens
gccatcctcaaacactgca

SEQ ID NO: 2543337 - DNA, 20 bp, Homo sapiens
gccatcctcaaacactgcag

SEQ ID NO: 2543338 - DNA, 23 bp, Homo sapiens
gccatcctcaaacactgcaggca

SEQ ID NO: 2543339 - DNA, 22 bp, Homo sapiens
gccatctccacccccagctgct

SEQ ID NO: 2543340 - DNA, 12 bp, Homo sapiens
gccatctctgga

SEQ ID NO: 2543341 - DNA, 16 bp, Homo sapiens
gccatctctggatgcc

SEQ ID NO: 2543342 - DNA, 13 bp, Homo sapiens
gccatctgcccag

SEQ ID NO: 2543343 - DNA, 14 bp, Homo sapiens
gccatgagctccag

SEQ ID NO: 2543344 - DNA, 15 bp, Homo sapiens
gccatgagctccaga

SEQ ID NO: 2543345 - DNA, 17 bp, Homo sapiens
gccatgagctccagacc

SEQ ID NO: 2543346 - DNA, 23 bp, Homo sapiens
gccatgagctccagacccccagc

SEQ ID NO: 2543347 - DNA, 17 bp, Homo sapiens
gccatgatgtggagtgg

SEQ ID NO: 2543348 - DNA, 14 bp, Homo sapiens
gccatgccaccctg

SEQ ID NO: 2543349 - DNA, 18 bp, Homo sapiens
gccatgccagcttatctc

SEQ ID NO: 2543350 - DNA, 19 bp, Homo sapiens
gccatgccagcttatctca

SEQ ID NO: 2543351 - DNA, 19 bp, Homo sapiens
gcctcaaccctccctcagc

SEQ ID NO: 2543352 - DNA, 22 bp, Homo sapiens
gcctcaaccctccctcagcccc

SEQ ID NO: 2543353 - DNA, 17 bp, Homo sapiens
gcctcaacctcctgggc

SEQ ID NO: 2543354 - DNA, 19 bp, Homo sapiens
gcctcaacctcctgggcta

SEQ ID NO: 2543355 - DNA, 18 bp, Homo sapiens
gcctcaagtcactcccaa

SEQ ID NO: 2543356 - DNA, 20 bp, Homo sapiens
gcctcaagtgattctcctgc

SEQ ID NO: 2543357 - DNA, 18 bp, Homo sapiens
gcctcaataagccttgtc

SEQ ID NO: 2543358 - DNA, 23 bp, Homo sapiens
gcctcacacggtttgaagcctgg

SEQ ID NO: 2543359 - DNA, 21 bp, Homo sapiens
gcctcacagtccttaccagca

SEQ ID NO: 2543360 - DNA, 23 bp, Homo sapiens
gcctcaccccctcgggtctcctc

SEQ ID NO: 2543361 - DNA, 23 bp, Homo sapiens
gcctcagaattgatcattttccc

SEQ ID NO: 2543362 - DNA, 16 bp, Homo sapiens
gcctcagccattcact

SEQ ID NO: 2543363 - DNA, 15 bp, Homo sapiens
gcctcagctgcctca

SEQ ID NO: 2543364 - DNA, 21 bp, Homo sapiens
gcctcagtctcccttctccca

SEQ ID NO: 2543365 - DNA, 17 bp, Homo sapiens
gcctccaaatgccaact

SEQ ID NO: 2543366 - DNA, 17 bp, Homo sapiens
gcctccaagctccatct

SEQ ID NO: 2543367 - DNA, 12 bp, Homo sapiens
gcctccaccacc

SEQ ID NO: 2543368 - DNA, 18 bp, Homo sapiens
gcctccaccccccagaac

SEQ ID NO: 2543369 - DNA, 16 bp, Homo sapiens
gcctccaccctctgag

SEQ ID NO: 2543370 - DNA, 19 bp, Homo sapiens
gcctccaccctctgagctt

SEQ ID NO: 2543371 - DNA, 22 bp, Homo sapiens
gcctccaccctctgagctttgc

SEQ ID NO: 2543372 - DNA, 11 bp, Homo sapiens
gcctccagcct

SEQ ID NO: 2543373 - DNA, 12 bp, Homo sapiens
gcctccaggcca

SEQ ID NO: 2543374 - DNA, 21 bp, Homo sapiens
gcctccaggccacatggggct

SEQ ID NO: 2543375 - DNA, 22 bp, Homo sapiens
gcctccaggccacatggggctg

SEQ ID NO: 2543376 - DNA, 12 bp, Homo sapiens
gcctccaggtgt

SEQ ID NO: 2543377 - DNA, 16 bp, Homo sapiens
gcctccattctgacca

SEQ ID NO: 2543378 - DNA, 16 bp, Homo sapiens
gcctcccaaagtgctg

SEQ ID NO: 2543379 - DNA, 18 bp, Homo sapiens
gcctcccaaagtgctggg

SEQ ID NO: 2543380 - DNA, 17 bp, Homo sapiens
gcctcccaactcacccc

SEQ ID NO: 2543381 - DNA, 19 bp, Homo sapiens
gcctcccaactcaccccag

SEQ ID NO: 2543382 - DNA, 12 bp, Homo sapiens
gcctcccacccc

SEQ ID NO: 2543383 - DNA, 17 bp, Homo sapiens
gcctcccatcacccgct

SEQ ID NO: 2543384 - DNA, 19 bp, Homo sapiens
gcctccccaaccctgcccc

SEQ ID NO: 2543385 - DNA, 21 bp, Homo sapiens
gcctccccacggccgctccag

SEQ ID NO: 2543386 - DNA, 17 bp, Homo sapiens
gcctccccagctcaccc

SEQ ID NO: 2543387 - DNA, 17 bp, Homo sapiens
gcctcccctgccagggc

SEQ ID NO: 2543388 - DNA, 20 bp, Homo sapiens
gcctcccctgctgaaggtgg

SEQ ID NO: 2543389 - DNA, 21 bp, Homo sapiens
gcctcccgaatagctgggact

SEQ ID NO: 2543390 - DNA, 14 bp, Homo sapiens
gcctccctcaaccc

SEQ ID NO: 2543391 - DNA, 20 bp, Homo sapiens
gcctccctcaccctgagccc

SEQ ID NO: 2543392 - DNA, 23 bp, Homo sapiens
gcctccctctctcttctgctcca

SEQ ID NO: 2543393 - DNA, 11 bp, Homo sapiens
gcctccctgaa

SEQ ID NO: 2543394 - DNA, 22 bp, Homo sapiens
gcctccctgaaaatgtttttct

SEQ ID NO: 2543395 - DNA, 21 bp, Homo sapiens
gcctccctgttgaagctctgg

SEQ ID NO: 2543396 - DNA, 20 bp, Homo sapiens
gcctcccttcatgcatggaa

SEQ ID NO: 2543397 - DNA, 17 bp, Homo sapiens
gcctccggcgtcagcct

SEQ ID NO: 2543398 - DNA, 16 bp, Homo sapiens
gcctccgtatttcaga

SEQ ID NO: 2543399 - DNA, 17 bp, Homo sapiens
gcctcctcacccccagc

SEQ ID NO: 2543400 - DNA, 21 bp, Homo sapiens
gcctcctcacccccagctttg

SEQ ID NO: 2543401 - DNA, 17 bp, Homo sapiens
gcctcctcatcccgtgt

SEQ ID NO: 2543402 - DNA, 14 bp, Homo sapiens
gcctcctcatctgg

SEQ ID NO: 2543403 - DNA, 13 bp, Homo sapiens
gcctcctccagcc

SEQ ID NO: 2543404 - DNA, 13 bp, Homo sapiens
gcctcctctgtcc

SEQ ID NO: 2543405 - DNA, 17 bp, Homo sapiens
gcctcctctgtctgccc

SEQ ID NO: 2543406 - DNA, 19 bp, Homo sapiens
gcctcctctgtctgccctt

SEQ ID NO: 2543407 - DNA, 17 bp, Homo sapiens
gcctcctgacctgaggc

SEQ ID NO: 2543408 - DNA, 13 bp, Homo sapiens
gcctcctgtgtaa

SEQ ID NO: 2543409 - DNA, 20 bp, Homo sapiens
gcctccttccacctccctcc

SEQ ID NO: 2543410 - DNA, 19 bp, Homo sapiens
gcctcctttgtgaggaagc

SEQ ID NO: 2543411 - DNA, 13 bp, Homo sapiens
gcctcgaactggc

SEQ ID NO: 2543412 - DNA, 17 bp, Homo sapiens
gcctcgaactggctgca

SEQ ID NO: 2543413 - DNA, 20 bp, Homo sapiens
gcctcgaactggctgcaaag

SEQ ID NO: 2543414 - DNA, 22 bp, Homo sapiens
gcctcgggacacctgccctgcc

SEQ ID NO: 2543415 - DNA, 13 bp, Homo sapiens
gcctcgggacctc

SEQ ID NO: 2543416 - DNA, 15 bp, Homo sapiens
gcctctaaccccagg

SEQ ID NO: 2543417 - DNA, 21 bp, Homo sapiens
gcctctaaccccaggccccga

SEQ ID NO: 2543418 - DNA, 23 bp, Homo sapiens
gcctctacctgacactcccttgg

SEQ ID NO: 2543419 - DNA, 17 bp, Homo sapiens
gcctctagggacccctc

SEQ ID NO: 2543420 - DNA, 19 bp, Homo sapiens
gcctctagggacccctcct

SEQ ID NO: 2543421 - DNA, 19 bp, Homo sapiens
gcctctcattccagaggaa

SEQ ID NO: 2543422 - DNA, 15 bp, Homo sapiens
gcctctcccatcact

SEQ ID NO: 2543423 - DNA, 23 bp, Homo sapiens
gcctctcccgtcagggcccaagt

SEQ ID NO: 2543424 - DNA, 16 bp, Homo sapiens
gcctctccctggccct

SEQ ID NO: 2543425 - DNA, 20 bp, Homo sapiens
gcctctccttgtggcctggg

SEQ ID NO: 2543426 - DNA, 14 bp, Homo sapiens
gcctctcctttgta

SEQ ID NO: 2543427 - DNA, 17 bp, Homo sapiens
gcctctctcccagtcta

SEQ ID NO: 2543428 - DNA, 13 bp, Homo sapiens
gcctctctggcct

SEQ ID NO: 2543429 - DNA, 23 bp, Homo sapiens
gcctctctggcctcccacccgat

SEQ ID NO: 2543430 - DNA, 16 bp, Homo sapiens
gcctctgacacacagc

SEQ ID NO: 2543431 - DNA, 17 bp, Homo sapiens
gcctctgacacacagct

SEQ ID NO: 2543432 - DNA, 21 bp, Homo sapiens
gcctctgacacacagctctgt

SEQ ID NO: 2543433 - DNA, 15 bp, Homo sapiens
gcctctgagatttgg

SEQ ID NO: 2543434 - DNA, 14 bp, Homo sapiens
gcctctgcactccc

SEQ ID NO: 2543435 - DNA, 11 bp, Homo sapiens
gcctctgctgc

SEQ ID NO: 2543436 - DNA, 21 bp, Homo sapiens
gcctctggctagaggccagcc

SEQ ID NO: 2543437 - DNA, 23 bp, Homo sapiens
gcctctggtttggggcgaggcag

SEQ ID NO: 2543438 - DNA, 20 bp, Homo sapiens
gcctctgtcactgcaggcac

SEQ ID NO: 2543439 - DNA, 15 bp, Homo sapiens
gcctctgtgtccttc

SEQ ID NO: 2543440 - DNA, 17 bp, Homo sapiens
gcctctgtttgacaaac

SEQ ID NO: 2543441 - DNA, 18 bp, Homo sapiens
gcctcttaaagctgcctg

SEQ ID NO: 2543442 - DNA, 23 bp, Homo sapiens
gcctcttaaagctgcctgtagtt

SEQ ID NO: 2543443 - DNA, 18 bp, Homo sapiens
gcctcttagacttctgct

SEQ ID NO: 2543444 - DNA, 19 bp, Homo sapiens
gcctcttagacttctgctt

SEQ ID NO: 2543445 - DNA, 21 bp, Homo sapiens
gcctcttatgggctgggttct

SEQ ID NO: 2543446 - DNA, 21 bp, Homo sapiens
gcctcttccagtcttcctgac

SEQ ID NO: 2543447 - DNA, 15 bp, Homo sapiens
gcctcttcttcttca

SEQ ID NO: 2543448 - DNA, 18 bp, Homo sapiens
gcctcttggacctctgct

SEQ ID NO: 2543449 - DNA, 20 bp, Homo sapiens
gcctcttggacctctgctct

SEQ ID NO: 2543450 - DNA, 23 bp, Homo sapiens
gcctctttgtctaaaacaataaa

SEQ ID NO: 2543451 - DNA, 12 bp, Homo sapiens
gcctcttttctc

SEQ ID NO: 2543452 - DNA, 16 bp, Homo sapiens
gcctgaagtcacacag

SEQ ID NO: 2543453 - DNA, 13 bp, Homo sapiens
gcctgaccttgag

SEQ ID NO: 2543454 - DNA, 21 bp, Homo sapiens
gcctgagagtatttaggcaga

SEQ ID NO: 2543455 - DNA, 22 bp, Homo sapiens
gcctgagcaacagagtgagacc

SEQ ID NO: 2543456 - DNA, 20 bp, Homo sapiens
gcctgagcgacagtgagact

SEQ ID NO: 2543457 - DNA, 23 bp, Homo sapiens
gcctgagctcactcggcaccctg

SEQ ID NO: 2543458 - DNA, 14 bp, Homo sapiens
gcctgaggatgagc

SEQ ID NO: 2543459 - DNA, 14 bp, Homo sapiens
gcctgaggctgaga

SEQ ID NO: 2543460 - DNA, 15 bp, Homo sapiens
gcctgaggctgagac

SEQ ID NO: 2543461 - DNA, 18 bp, Homo sapiens
gcctgaggctgagactgc

SEQ ID NO: 2543462 - DNA, 10 bp, Homo sapiens
gcctgaggga

SEQ ID NO: 2543463 - DNA, 22 bp, Homo sapiens
gcctgagggcccctctgcccag

SEQ ID NO: 2543464 - DNA, 12 bp, Homo sapiens
gcctgagggtgg

SEQ ID NO: 2543465 - DNA, 13 bp, Homo sapiens
gcctgagtctcct

SEQ ID NO: 2543466 - DNA, 18 bp, Homo sapiens
gcctgatccagcctctcc

SEQ ID NO: 2543467 - DNA, 19 bp, Homo sapiens
gcctgatgctccctcccct

SEQ ID NO: 2543468 - DNA, 20 bp, Homo sapiens
gcctgatgctccctcccctg

SEQ ID NO: 2543469 - DNA, 16 bp, Homo sapiens
gcctgcacaataaaaa

SEQ ID NO: 2543470 - DNA, 21 bp, Homo sapiens
gcctgcacggtgggccttgct

SEQ ID NO: 2543471 - DNA, 14 bp, Homo sapiens
gcctgcagagagaa

SEQ ID NO: 2543472 - DNA, 10 bp, Homo sapiens
gcctgcagcc

SEQ ID NO: 2543473 - DNA, 21 bp, Homo sapiens
gcctgcatgctgggttctgca

SEQ ID NO: 2543474 - DNA, 20 bp, Homo sapiens
gcctgccagtcctagctgca

SEQ ID NO: 2543475 - DNA, 23 bp, Homo sapiens
gcctgccagtcctagctgcacag

SEQ ID NO: 2543476 - DNA, 13 bp, Homo sapiens
gcctgcccacccg

SEQ ID NO: 2543477 - DNA, 15 bp, Homo sapiens
gcctgcccaggcccc

SEQ ID NO: 2543478 - DNA, 14 bp, Homo sapiens
gcctgcccctccca

SEQ ID NO: 2543479 - DNA, 14 bp, Homo sapiens
gcctgcccctctcc

SEQ ID NO: 2543480 - DNA, 18 bp, Homo sapiens
gcctgcccgtctctctcc

SEQ ID NO: 2543481 - DNA, 20 bp, Homo sapiens
gcctgccctcatggcccctc

SEQ ID NO: 2543482 - DNA, 21 bp, Homo sapiens
gcctgccctcatggcccctct

SEQ ID NO: 2543483 - DNA, 15 bp, Homo sapiens
gcctgccctccccag

SEQ ID NO: 2543484 - DNA, 18 bp, Homo sapiens
gcctgccctccccagagc

SEQ ID NO: 2543485 - DNA, 19 bp, Homo sapiens
gcctgccctccccagagca

SEQ ID NO: 2543486 - DNA, 22 bp, Homo sapiens
gcctgccctccccagagcactg

SEQ ID NO: 2543487 - DNA, 12 bp, Homo sapiens
gcctgcctggag

SEQ ID NO: 2543488 - DNA, 13 bp, Homo sapiens
gcctgcctggcag

SEQ ID NO: 2543489 - DNA, 16 bp, Homo sapiens
gcctgcctgtctgtct

SEQ ID NO: 2543490 - DNA, 22 bp, Homo sapiens
gcctgcctgtctgtctctccat

SEQ ID NO: 2543491 - DNA, 22 bp, Homo sapiens
gcctgcgcccaccccgctctgc

SEQ ID NO: 2543492 - DNA, 23 bp, Homo sapiens
gcctgcgcccaccccgctctgca

SEQ ID NO: 2543493 - DNA, 17 bp, Homo sapiens
gcctgcggcctgctgga

SEQ ID NO: 2543494 - DNA, 15 bp, Homo sapiens
gcctgctccagctgt

SEQ ID NO: 2543495 - DNA, 16 bp, Homo sapiens
gctcctgtctgccagc

SEQ ID NO: 2543496 - DNA, 23 bp, Homo sapiens
gctccttcctggagactgcccag

SEQ ID NO: 2543497 - DNA, 15 bp, Homo sapiens
gctccttccttcacc

SEQ ID NO: 2543498 - DNA, 13 bp, Homo sapiens
gctccttctgtcc

SEQ ID NO: 2543499 - DNA, 21 bp, Homo sapiens
gctccttctgtcctactctgt

SEQ ID NO: 2543500 - DNA, 13 bp, Homo sapiens
gctccttgggagg

SEQ ID NO: 2543501 - DNA, 21 bp, Homo sapiens
gctccttgggaggccccactg

SEQ ID NO: 2543502 - DNA, 22 bp, Homo sapiens
gctccttgggaggccccactgg

SEQ ID NO: 2543503 - DNA, 19 bp, Homo sapiens
gctccttgggccctttgag

SEQ ID NO: 2543504 - DNA, 14 bp, Homo sapiens
gctcctttctccag

SEQ ID NO: 2543505 - DNA, 21 bp, Homo sapiens
gctcgagcagtcctgcctcag

SEQ ID NO: 2543506 - DNA, 19 bp, Homo sapiens
gctcgagcatgcctggatg

SEQ ID NO: 2543507 - DNA, 21 bp, Homo sapiens
gctcgagcatgcctggatggg

SEQ ID NO: 2543508 - DNA, 23 bp, Homo sapiens
gctcggaggctgcccccggcccc

SEQ ID NO: 2543509 - DNA, 12 bp, Homo sapiens
gctcggtggacc

SEQ ID NO: 2543510 - DNA, 21 bp, Homo sapiens
gctcgtcggggggacagctcc

SEQ ID NO: 2543511 - DNA, 18 bp, Homo sapiens
gctcgtgtatcctggggc

SEQ ID NO: 2543512 - DNA, 23 bp, Homo sapiens
gctcgtgtatcctggggctccct

SEQ ID NO: 2543513 - DNA, 16 bp, Homo sapiens
gctctacatcttctgc

SEQ ID NO: 2543514 - DNA, 19 bp, Homo sapiens
gctctacatcttctgcctt

SEQ ID NO: 2543515 - DNA, 21 bp, Homo sapiens
gctctactggtcttgtggaat

SEQ ID NO: 2543516 - DNA, 14 bp, Homo sapiens
gctctaggtggggc

SEQ ID NO: 2543517 - DNA, 18 bp, Homo sapiens
gctctatgggcagatcta

SEQ ID NO: 2543518 - DNA, 19 bp, Homo sapiens
gctctcaacccaggagcat

SEQ ID NO: 2543519 - DNA, 11 bp, Homo sapiens
gctctcagaag

SEQ ID NO: 2543520 - DNA, 18 bp, Homo sapiens
gctctcagctcagcgcca

SEQ ID NO: 2543521 - DNA, 19 bp, Homo sapiens
gctctccagtcaggaggca

SEQ ID NO: 2543522 - DNA, 16 bp, Homo sapiens
gctctcccctgccctg

SEQ ID NO: 2543523 - DNA, 15 bp, Homo sapiens
gctctccctcttctc

SEQ ID NO: 2543524 - DNA, 21 bp, Homo sapiens
gctctccctcttctcaagtgc

SEQ ID NO: 2543525 - DNA, 23 bp, Homo sapiens
gctctccctcttctcaagtgcct

SEQ ID NO: 2543526 - DNA, 17 bp, Homo sapiens
gctctccgaccagacac

SEQ ID NO: 2543527 - DNA, 19 bp, Homo sapiens
gctctcctcttgccactgc

SEQ ID NO: 2543528 - DNA, 19 bp, Homo sapiens
gctctcgggttgtgtgtct

SEQ ID NO: 2543529 - DNA, 12 bp, Homo sapiens
gctctctccagg

SEQ ID NO: 2543530 - DNA, 13 bp, Homo sapiens
gctctctccagga

SEQ ID NO: 2543531 - DNA, 13 bp, Homo sapiens
gctctctgctgta

SEQ ID NO: 2543532 - DNA, 16 bp, Homo sapiens
gctctgaaaccagtgt

SEQ ID NO: 2543533 - DNA, 21 bp, Homo sapiens
gctctgaattagtccttgctt

SEQ ID NO: 2543534 - DNA, 15 bp, Homo sapiens
gctctgacccagtga

SEQ ID NO: 2543535 - DNA, 16 bp, Homo sapiens
gctctgagccagttca

SEQ ID NO: 2543536 - DNA, 17 bp, Homo sapiens
gctctgatcatccactg

SEQ ID NO: 2543537 - DNA, 23 bp, Homo sapiens
gctctgatcatccactgtgccat

SEQ ID NO: 2543538 - DNA, 23 bp, Homo sapiens
gctctgcaatgggcactgggatg

SEQ ID NO: 2543539 - DNA, 17 bp, Homo sapiens
gctctgcaattcccctc

SEQ ID NO: 2543540 - DNA, 13 bp, Homo sapiens
gctctgcagccca

SEQ ID NO: 2543541 - DNA, 15 bp, Homo sapiens
gctctgcagcccagg

SEQ ID NO: 2543542 - DNA, 19 bp, Homo sapiens
gctctgcagcccagggacc

SEQ ID NO: 2543543 - DNA, 16 bp, Homo sapiens
gctctgcaggcacctt

SEQ ID NO: 2543544 - DNA, 19 bp, Homo sapiens
gctctgcatgcggcccagc

SEQ ID NO: 2543545 - DNA, 22 bp, Homo sapiens
gctctgcatgcggcccagcccg

SEQ ID NO: 2543546 - DNA, 23 bp, Homo sapiens
gctctgccaacttcttcagagct

SEQ ID NO: 2543547 - DNA, 18 bp, Homo sapiens
gctctgccaccctacctg

SEQ ID NO: 2543548 - DNA, 22 bp, Homo sapiens
gctctgccaccctacctgttca

SEQ ID NO: 2543549 - DNA, 15 bp, Homo sapiens
gctctgcccatcctg

SEQ ID NO: 2543550 - DNA, 16 bp, Homo sapiens
gctctgccccagaggc

SEQ ID NO: 2543551 - DNA, 20 bp, Homo sapiens
gctctgccccagaggcctct

SEQ ID NO: 2543552 - DNA, 18 bp, Homo sapiens
gctctgccccagctctgg

SEQ ID NO: 2543553 - DNA, 19 bp, Homo sapiens
gctctgccccagctctggc

SEQ ID NO: 2543554 - DNA, 20 bp, Homo sapiens
gctctgccccagctctggct

SEQ ID NO: 2543555 - DNA, 15 bp, Homo sapiens
gctctgccctgccct

SEQ ID NO: 2543556 - DNA, 14 bp, Homo sapiens
gctctgcccttggt

SEQ ID NO: 2543557 - DNA, 11 bp, Homo sapiens
gctctgcctcc

SEQ ID NO: 2543558 - DNA, 23 bp, Homo sapiens
gctctgctgacagacacaggccc

SEQ ID NO: 2543559 - DNA, 19 bp, Homo sapiens
gctctgctggcctggccgg

SEQ ID NO: 2543560 - DNA, 14 bp, Homo sapiens
gctctggacaggca

SEQ ID NO: 2543561 - DNA, 15 bp, Homo sapiens
gctctggtccataga

SEQ ID NO: 2543562 - DNA, 16 bp, Homo sapiens
gctctggtccatagag

SEQ ID NO: 2543563 - DNA, 23 bp, Homo sapiens
gctctggtccatagagagcaaga

SEQ ID NO: 2543564 - DNA, 20 bp, Homo sapiens
gctctggtgacaccagcctt

SEQ ID NO: 2543565 - DNA, 18 bp, Homo sapiens
gctctgtaatctcgtttc

SEQ ID NO: 2543566 - DNA, 18 bp, Homo sapiens
gctctgtatcaggaccca

SEQ ID NO: 2543567 - DNA, 22 bp, Homo sapiens
gctctgtatcaggacccagagg

SEQ ID NO: 2543568 - DNA, 13 bp, Homo sapiens
gctcttctgacta

SEQ ID NO: 2543569 - DNA, 14 bp, Homo sapiens
gctcttcttctttc

SEQ ID NO: 2543570 - DNA, 17 bp, Homo sapiens
gctcttgatacccccct

SEQ ID NO: 2543571 - DNA, 20 bp, Homo sapiens
gctcttgatacccccctctg

SEQ ID NO: 2543572 - DNA, 19 bp, Homo sapiens
gctcttgctaatcagtgtc

SEQ ID NO: 2543573 - DNA, 22 bp, Homo sapiens
gctcttgtggtacacacagatt

SEQ ID NO: 2543574 - DNA, 13 bp, Homo sapiens
gctctttcagggg

SEQ ID NO: 2543575 - DNA, 16 bp, Homo sapiens
gctctttccttgctca

SEQ ID NO: 2543576 - DNA, 14 bp, Homo sapiens
gctctttggagatc

SEQ ID NO: 2543577 - DNA, 16 bp, Homo sapiens
gctgaaacaacaaata

SEQ ID NO: 2543578 - DNA, 12 bp, Homo sapiens
gctgaaatactg

SEQ ID NO: 2543579 - DNA, 21 bp, Homo sapiens
gctgaacactccaattaagga

SEQ ID NO: 2543580 - DNA, 17 bp, Homo sapiens
gctgaacattgcatata

SEQ ID NO: 2543581 - DNA, 15 bp, Homo sapiens
gctgaactcatgaga

SEQ ID NO: 2543582 - DNA, 13 bp, Homo sapiens
gctgaagatggca

SEQ ID NO: 2543583 - DNA, 13 bp, Homo sapiens
gctgaaggactgt

SEQ ID NO: 2543584 - DNA, 14 bp, Homo sapiens
gctgaaggactgtg

SEQ ID NO: 2543585 - DNA, 22 bp, Homo sapiens
gctgaaggactgtgacaggcag

SEQ ID NO: 2543586 - DNA, 15 bp, Homo sapiens
gctgaaggttgaaga

SEQ ID NO: 2543587 - DNA, 16 bp, Homo sapiens
gctgaaggttgaagag

SEQ ID NO: 2543588 - DNA, 13 bp, Homo sapiens
gctgaataaatgt

SEQ ID NO: 2543589 - DNA, 22 bp, Homo sapiens
gctgaatacagaggcaactgca

SEQ ID NO: 2543590 - DNA, 17 bp, Homo sapiens
gctgaatggttttcaaa

SEQ ID NO: 2543591 - DNA, 17 bp, Homo sapiens
gctgaatgttgggactg

SEQ ID NO: 2543592 - DNA, 21 bp, Homo sapiens
gctgacagacacaggcccggc

SEQ ID NO: 2543593 - DNA, 16 bp, Homo sapiens
gctgacatctgtgttt

SEQ ID NO: 2543594 - DNA, 19 bp, Homo sapiens
gctgacatctgtgtttcaa

SEQ ID NO: 2543595 - DNA, 14 bp, Homo sapiens
gctgaccaagagag

SEQ ID NO: 2543596 - DNA, 16 bp, Homo sapiens
gctgacctccacagct

SEQ ID NO: 2543597 - DNA, 16 bp, Homo sapiens
gctgacctctggtggc

SEQ ID NO: 2543598 - DNA, 19 bp, Homo sapiens
gctgacctctgttgtcctc

SEQ ID NO: 2543599 - DNA, 17 bp, Homo sapiens
gctgaccttcctcgcag

SEQ ID NO: 2543600 - DNA, 19 bp, Homo sapiens
gctgaccttcctcgcagag

SEQ ID NO: 2543601 - DNA, 15 bp, Homo sapiens
gctgacgaacttcca

SEQ ID NO: 2543602 - DNA, 19 bp, Homo sapiens
gctgacgaacttccatggc

SEQ ID NO: 2543603 - DNA, 15 bp, Homo sapiens
gctgagagaaaataa

SEQ ID NO: 2543604 - DNA, 14 bp, Homo sapiens
gctgagagaacctc

SEQ ID NO: 2543605 - DNA, 19 bp, Homo sapiens
gctgagagaccaggagggc

SEQ ID NO: 2543606 - DNA, 22 bp, Homo sapiens
gctgagagaccaggagggcact

SEQ ID NO: 2543607 - DNA, 17 bp, Homo sapiens
gctgagagccccagctg

SEQ ID NO: 2543608 - DNA, 18 bp, Homo sapiens
gctgagagccccagctga

SEQ ID NO: 2543609 - DNA, 17 bp, Homo sapiens
gctgagcaccaggggat

SEQ ID NO: 2543610 - DNA, 14 bp, Homo sapiens
gctgagcccctacc

SEQ ID NO: 2543611 - DNA, 14 bp, Homo sapiens
gctgagcctctcac

SEQ ID NO: 2543612 - DNA, 16 bp, Homo sapiens
gctgaggaaaggccag

SEQ ID NO: 2543613 - DNA, 23 bp, Homo sapiens
gctgaggaaaggccagctggcag

SEQ ID NO: 2543614 - DNA, 16 bp, Homo sapiens
gctgaggaggcctcca

SEQ ID NO: 2543615 - DNA, 15 bp, Homo sapiens
gctgaggcaattcta

SEQ ID NO: 2543616 - DNA, 22 bp, Homo sapiens
gctgaggccccttctaggtggc

SEQ ID NO: 2543617 - DNA, 14 bp, Homo sapiens
gctgagggagcctg

SEQ ID NO: 2543618 - DNA, 21 bp, Homo sapiens
gctgaggtgtcttaagccttt

SEQ ID NO: 2543619 - DNA, 18 bp, Homo sapiens
gctgatatatgtgttttt

SEQ ID NO: 2543620 - DNA, 20 bp, Homo sapiens
gctgatatatgtgtttttca

SEQ ID NO: 2543621 - DNA, 16 bp, Homo sapiens
gctgatcagtgggcct

SEQ ID NO: 2543622 - DNA, 21 bp, Homo sapiens
gctgatgaacttattctgtag

SEQ ID NO: 2543623 - DNA, 20 bp, Homo sapiens
gctgatgatttgtttttgta

SEQ ID NO: 2543624 - DNA, 13 bp, Homo sapiens
gctgatgttcagt

SEQ ID NO: 2543625 - DNA, 15 bp, Homo sapiens
gctgatgttcagtgt

SEQ ID NO: 2543626 - DNA, 20 bp, Homo sapiens
gctgatgttggaagagaaag

SEQ ID NO: 2543627 - DNA, 21 bp, Homo sapiens
gctgattaaaccaaggctaga

SEQ ID NO: 2543628 - DNA, 21 bp, Homo sapiens
gctgattctcagggtctctgc

SEQ ID NO: 2543629 - DNA, 14 bp, Homo sapiens
gctgattttaacaa

SEQ ID NO: 2543630 - DNA, 15 bp, Homo sapiens
gctgattttaacaat

SEQ ID NO: 2543631 - DNA, 17 bp, Homo sapiens
gctgcaaaagtgagggc

SEQ ID NO: 2543632 - DNA, 16 bp, Homo sapiens
gctgcaaggcctttct

SEQ ID NO: 2543633 - DNA, 22 bp, Homo sapiens
gctgcaaggtggctccagcacc

SEQ ID NO: 2543634 - DNA, 20 bp, Homo sapiens
gctgcaagtgacatctcttt

SEQ ID NO: 2543635 - DNA, 17 bp, Homo sapiens
gctgcacagggcagctg

SEQ ID NO: 2543636 - DNA, 13 bp, Homo sapiens
gctgcaccctcag

SEQ ID NO: 2543637 - DNA, 13 bp, Homo sapiens
gctgcaccggctg

SEQ ID NO: 2543638 - DNA, 14 bp, Homo sapiens
gctgcaccggctgg

SEQ ID NO: 2543639 - DNA, 17 bp, Homo sapiens
ggagctggcgtctgtct

SEQ ID NO: 2543640 - DNA, 18 bp, Homo sapiens
ggagctgggcagaaggcc

SEQ ID NO: 2543641 - DNA, 18 bp, Homo sapiens
ggagctggttagaaatgc

SEQ ID NO: 2543642 - DNA, 23 bp, Homo sapiens
ggagctggttagaaatgcagaat

SEQ ID NO: 2543643 - DNA, 20 bp, Homo sapiens
ggagcttcatggcagaaggc

SEQ ID NO: 2543644 - DNA, 15 bp, Homo sapiens
ggagcttgggaatgg

SEQ ID NO: 2543645 - DNA, 12 bp, Homo sapiens
ggaggaaagcaa

SEQ ID NO: 2543646 - DNA, 20 bp, Homo sapiens
ggaggaaggaaacccagctc

SEQ ID NO: 2543647 - DNA, 23 bp, Homo sapiens
ggaggaaggaaacccagctctgg

SEQ ID NO: 2543648 - DNA, 22 bp, Homo sapiens
ggaggaatcgaggaaccagagc

SEQ ID NO: 2543649 - DNA, 18 bp, Homo sapiens
ggaggaatgctcccccat

SEQ ID NO: 2543650 - DNA, 13 bp, Homo sapiens
ggaggacaattca

SEQ ID NO: 2543651 - DNA, 14 bp, Homo sapiens
ggaggacaattcat

SEQ ID NO: 2543652 - DNA, 19 bp, Homo sapiens
ggaggacaattcatgaact

SEQ ID NO: 2543653 - DNA, 19 bp, Homo sapiens
ggaggaggccacctctcca

SEQ ID NO: 2543654 - DNA, 22 bp, Homo sapiens
ggaggaggcctgggggcaggga

SEQ ID NO: 2543655 - DNA, 23 bp, Homo sapiens
ggaggaggtttaggtcaagaaga

SEQ ID NO: 2543656 - DNA, 17 bp, Homo sapiens
ggaggatcactggagcc

SEQ ID NO: 2543657 - DNA, 20 bp, Homo sapiens
ggaggatcactggagcccag

SEQ ID NO: 2543658 - DNA, 21 bp, Homo sapiens
ggaggatcactggagcccagg

SEQ ID NO: 2543659 - DNA, 22 bp, Homo sapiens
ggaggatcactggagcccagga

SEQ ID NO: 2543660 - DNA, 13 bp, Homo sapiens
ggaggatggagag

SEQ ID NO: 2543661 - DNA, 21 bp, Homo sapiens
ggaggatggagagaggggaat

SEQ ID NO: 2543662 - DNA, 20 bp, Homo sapiens
ggaggattgcttgagcccag

SEQ ID NO: 2543663 - DNA, 18 bp, Homo sapiens
ggaggccaaggtgggagg

SEQ ID NO: 2543664 - DNA, 16 bp, Homo sapiens
ggaggccagccagtga

SEQ ID NO: 2543665 - DNA, 13 bp, Homo sapiens
ggaggccagcctt

SEQ ID NO: 2543666 - DNA, 16 bp, Homo sapiens
ggaggcccctggccca

SEQ ID NO: 2543667 - DNA, 19 bp, Homo sapiens
ggaggcccctggcccagcg

SEQ ID NO: 2543668 - DNA, 12 bp, Homo sapiens
ggaggcgcgagc

SEQ ID NO: 2543669 - DNA, 20 bp, Homo sapiens
ggaggcggagcttgcagtga

SEQ ID NO: 2543670 - DNA, 20 bp, Homo sapiens
ggaggcggatgttgaagtga

SEQ ID NO: 2543671 - DNA, 20 bp, Homo sapiens
ggaggctaaagcccagagac

SEQ ID NO: 2543672 - DNA, 14 bp, Homo sapiens
ggaggctgagacag

SEQ ID NO: 2543673 - DNA, 15 bp, Homo sapiens
ggaggctgagacagg

SEQ ID NO: 2543674 - DNA, 15 bp, Homo sapiens
ggaggctgagatggg

SEQ ID NO: 2543675 - DNA, 12 bp, Homo sapiens
ggaggctgaggc

SEQ ID NO: 2543676 - DNA, 14 bp, Homo sapiens
ggaggctgaggcag

SEQ ID NO: 2543677 - DNA, 17 bp, Homo sapiens
ggaggctgaggcaggag

SEQ ID NO: 2543678 - DNA, 19 bp, Homo sapiens
ggaggctgaggcaggagga

SEQ ID NO: 2543679 - DNA, 10 bp, Homo sapiens
ggaggctgcc

SEQ ID NO: 2543680 - DNA, 16 bp, Homo sapiens
ggaggcttgggaccgc

SEQ ID NO: 2543681 - DNA, 16 bp, Homo sapiens
ggaggcttgtcagagc

SEQ ID NO: 2543682 - DNA, 18 bp, Homo sapiens
ggaggcttgtcagagctg

SEQ ID NO: 2543683 - DNA, 22 bp, Homo sapiens
ggaggcttgtcagagctgggag

SEQ ID NO: 2543684 - DNA, 21 bp, Homo sapiens
ggagggaatgaacctggaggg

SEQ ID NO: 2543685 - DNA, 17 bp, Homo sapiens
ggagggaattgaggtct

SEQ ID NO: 2543686 - DNA, 13 bp, Homo sapiens
ggagggagatgga

SEQ ID NO: 2543687 - DNA, 12 bp, Homo sapiens
ggagggagggct

SEQ ID NO: 2543688 - DNA, 16 bp, Homo sapiens
ggagggagggctccag

SEQ ID NO: 2543689 - DNA, 17 bp, Homo sapiens
ggagggagggctccaga

SEQ ID NO: 2543690 - DNA, 20 bp, Homo sapiens
ggagggattggccgcttggc

SEQ ID NO: 2543691 - DNA, 12 bp, Homo sapiens
ggagggatttgg

SEQ ID NO: 2543692 - DNA, 21 bp, Homo sapiens
ggagggcaagggccatgctga

SEQ ID NO: 2543693 - DNA, 21 bp, Homo sapiens
ggagggcacattccttgcctg

SEQ ID NO: 2543694 - DNA, 15 bp, Homo sapiens
ggagggcagcagggc

SEQ ID NO: 2543695 - DNA, 19 bp, Homo sapiens
ggagggccacatgggaggc

SEQ ID NO: 2543696 - DNA, 16 bp, Homo sapiens
ggagggctagaacctg

SEQ ID NO: 2543697 - DNA, 19 bp, Homo sapiens
ggagggctagaacctggag

SEQ ID NO: 2543698 - DNA, 20 bp, Homo sapiens
ggagggctagaacctggcag

SEQ ID NO: 2543699 - DNA, 20 bp, Homo sapiens
ggagggctagaatctggaga

SEQ ID NO: 2543700 - DNA, 13 bp, Homo sapiens
ggagggctccaga

SEQ ID NO: 2543701 - DNA, 19 bp, Homo sapiens
ggaggggagcatgggaagt

SEQ ID NO: 2543702 - DNA, 13 bp, Homo sapiens
ggaggggcaggct

SEQ ID NO: 2543703 - DNA, 14 bp, Homo sapiens
ggaggggcaggctg

SEQ ID NO: 2543704 - DNA, 23 bp, Homo sapiens
ggagggtaaatgatgtggtgcct

SEQ ID NO: 2543705 - DNA, 16 bp, Homo sapiens
ggagggtcaggaagga

SEQ ID NO: 2543706 - DNA, 14 bp, Homo sapiens
ggagggtcccaagc

SEQ ID NO: 2543707 - DNA, 21 bp, Homo sapiens
ggagggtcccaagctgggccc

SEQ ID NO: 2543708 - DNA, 22 bp, Homo sapiens
ggaggtcgaccccaaagcccct

SEQ ID NO: 2543709 - DNA, 14 bp, Homo sapiens
ggaggtcgaggcag

SEQ ID NO: 2543710 - DNA, 14 bp, Homo sapiens
ggaggtgaccccag

SEQ ID NO: 2543711 - DNA, 13 bp, Homo sapiens
ggaggtgagggat

SEQ ID NO: 2543712 - DNA, 19 bp, Homo sapiens
ggaggtggaggttgcagtg

SEQ ID NO: 2543713 - DNA, 21 bp, Homo sapiens
ggaggtgtttaaagagaggtt

SEQ ID NO: 2543714 - DNA, 14 bp, Homo sapiens
ggaggttgcaggga

SEQ ID NO: 2543715 - DNA, 14 bp, Homo sapiens
ggagtcagtgccag

SEQ ID NO: 2543716 - DNA, 15 bp, Homo sapiens
ggagtcagtgccagg

SEQ ID NO: 2543717 - DNA, 21 bp, Homo sapiens
ggagtccaggccatggaggca

SEQ ID NO: 2543718 - DNA, 20 bp, Homo sapiens
ggagtcccaccttggctgca

SEQ ID NO: 2543719 - DNA, 22 bp, Homo sapiens
ggagtcccaccttggctgcagg

SEQ ID NO: 2543720 - DNA, 21 bp, Homo sapiens
ggagtctccagtggttgctgt

SEQ ID NO: 2543721 - DNA, 23 bp, Homo sapiens
ggagtgaaacctttagggcagct

SEQ ID NO: 2543722 - DNA, 12 bp, Homo sapiens
ggagtgaagagg

SEQ ID NO: 2543723 - DNA, 15 bp, Homo sapiens
ggagtgaagaggggc

SEQ ID NO: 2543724 - DNA, 19 bp, Homo sapiens
ggagtgaagaggggcagcc

SEQ ID NO: 2543725 - DNA, 18 bp, Homo sapiens
ggagtgacagaggcagcc

SEQ ID NO: 2543726 - DNA, 15 bp, Homo sapiens
ggagtgagatgcctg

SEQ ID NO: 2543727 - DNA, 20 bp, Homo sapiens
ggagtgcaatgacacagtct

SEQ ID NO: 2543728 - DNA, 18 bp, Homo sapiens
ggagtgcagggaggagag

SEQ ID NO: 2543729 - DNA, 12 bp, Homo sapiens
ggagtgcagtgg

SEQ ID NO: 2543730 - DNA, 17 bp, Homo sapiens
ggagtgggacagagtct

SEQ ID NO: 2543731 - DNA, 18 bp, Homo sapiens
ggagtgggacagagtctg

SEQ ID NO: 2543732 - DNA, 22 bp, Homo sapiens
ggagtgggcccaatgcactttg

SEQ ID NO: 2543733 - DNA, 22 bp, Homo sapiens
ggagtgtggctgaggaggcctc

SEQ ID NO: 2543734 - DNA, 17 bp, Homo sapiens
ggagtgtgtattgttcc

SEQ ID NO: 2543735 - DNA, 12 bp, Homo sapiens
ggagttcaatga

SEQ ID NO: 2543736 - DNA, 15 bp, Homo sapiens
ggagttcaatgatct

SEQ ID NO: 2543737 - DNA, 15 bp, Homo sapiens
ggagttccatgaaga

SEQ ID NO: 2543738 - DNA, 20 bp, Homo sapiens
ggagttcgaggctgcagtca

SEQ ID NO: 2543739 - DNA, 22 bp, Homo sapiens
ggagttgtcaagtctctgctgg

SEQ ID NO: 2543740 - DNA, 14 bp, Homo sapiens
ggataacctatatg

SEQ ID NO: 2543741 - DNA, 18 bp, Homo sapiens
ggatacaaaagcatgtga

SEQ ID NO: 2543742 - DNA, 13 bp, Homo sapiens
ggatattttcaaa

SEQ ID NO: 2543743 - DNA, 22 bp, Homo sapiens
ggatcaaaccccgaccacctgc

SEQ ID NO: 2543744 - DNA, 16 bp, Homo sapiens
ggatcacagcctctga

SEQ ID NO: 2543745 - DNA, 13 bp, Homo sapiens
ggatcacagggcc

SEQ ID NO: 2543746 - DNA, 16 bp, Homo sapiens
ggatcagatgaactct

SEQ ID NO: 2543747 - DNA, 19 bp, Homo sapiens
ggatcagccctcattttgt

SEQ ID NO: 2543748 - DNA, 21 bp, Homo sapiens
ggatcagtctgattcccaagc

SEQ ID NO: 2543749 - DNA, 21 bp, Homo sapiens
ggatcatggtgtaataagaca

SEQ ID NO: 2543750 - DNA, 13 bp, Homo sapiens
ggatccctcatcc

SEQ ID NO: 2543751 - DNA, 17 bp, Homo sapiens
ggatccctcatcctcat

SEQ ID NO: 2543752 - DNA, 22 bp, Homo sapiens
ggatccctcatcctcataccca

SEQ ID NO: 2543753 - DNA, 13 bp, Homo sapiens
ggatccctcatct

SEQ ID NO: 2543754 - DNA, 18 bp, Homo sapiens
ggatccctctgggcactg

SEQ ID NO: 2543755 - DNA, 20 bp, Homo sapiens
ggatcctagccttatcctct

SEQ ID NO: 2543756 - DNA, 12 bp, Homo sapiens
ggatcctccagg

SEQ ID NO: 2543757 - DNA, 13 bp, Homo sapiens
ggatcctccaggt

SEQ ID NO: 2543758 - DNA, 12 bp, Homo sapiens
ggatctaccagc

SEQ ID NO: 2543759 - DNA, 13 bp, Homo sapiens
ggatctccaagga

SEQ ID NO: 2543760 - DNA, 14 bp, Homo sapiens
ggatctccaaggac

SEQ ID NO: 2543761 - DNA, 13 bp, Homo sapiens
ggatctctcagga

SEQ ID NO: 2543762 - DNA, 16 bp, Homo sapiens
ggatctctcaggagca

SEQ ID NO: 2543763 - DNA, 14 bp, Homo sapiens
ggatctgcccctcc

SEQ ID NO: 2543764 - DNA, 20 bp, Homo sapiens
ggatctgcccctccctgctt

SEQ ID NO: 2543765 - DNA, 15 bp, Homo sapiens
ggatcttcaatggct

SEQ ID NO: 2543766 - DNA, 17 bp, Homo sapiens
ggatcttgcattcccag

SEQ ID NO: 2543767 - DNA, 22 bp, Homo sapiens
ggatctttggacagaagcagct

SEQ ID NO: 2543768 - DNA, 18 bp, Homo sapiens
ggatgaaataactccttc

SEQ ID NO: 2543769 - DNA, 16 bp, Homo sapiens
ggatgacatgtcccta

SEQ ID NO: 2543770 - DNA, 18 bp, Homo sapiens
ggatgactagaggcaggg

SEQ ID NO: 2543771 - DNA, 18 bp, Homo sapiens
ggatgagagcccagaggt

SEQ ID NO: 2543772 - DNA, 15 bp, Homo sapiens
ggatgagctggaagg

SEQ ID NO: 2543773 - DNA, 21 bp, Homo sapiens
ggatgaggccgctagaggcct

SEQ ID NO: 2543774 - DNA, 18 bp, Homo sapiens
ggatgcagagtcagcaga

SEQ ID NO: 2543775 - DNA, 13 bp, Homo sapiens
ggatgcagcatta

SEQ ID NO: 2543776 - DNA, 16 bp, Homo sapiens
ggatgcagcctcacag

SEQ ID NO: 2543777 - DNA, 15 bp, Homo sapiens
ggatgcatttctctg

SEQ ID NO: 2543778 - DNA, 19 bp, Homo sapiens
ggatgccaagaagtttaag

SEQ ID NO: 2543779 - DNA, 13 bp, Homo sapiens
ggatgcctggtgg

SEQ ID NO: 2543780 - DNA, 16 bp, Homo sapiens
ggatggagagagggga

SEQ ID NO: 2543781 - DNA, 18 bp, Homo sapiens
ggatggatttccagccaa

SEQ ID NO: 2543782 - DNA, 12 bp, Homo sapiens
ggatggcaagat

SEQ ID NO: 2543783 - DNA, 13 bp, Homo sapiens
ggatggccagtgt

SEQ ID NO: 2543784 - DNA, 21 bp, Homo sapiens
ggccccagccagagttcctgc

SEQ ID NO: 2543785 - DNA, 12 bp, Homo sapiens
ggccccagccca

SEQ ID NO: 2543786 - DNA, 13 bp, Homo sapiens
ggccccagcccac

SEQ ID NO: 2543787 - DNA, 14 bp, Homo sapiens
ggccccagcccacc

SEQ ID NO: 2543788 - DNA, 15 bp, Homo sapiens
ggccccagcccaccc

SEQ ID NO: 2543789 - DNA, 13 bp, Homo sapiens
ggccccaggaagc

SEQ ID NO: 2543790 - DNA, 14 bp, Homo sapiens
ggccccaggaagcc

SEQ ID NO: 2543791 - DNA, 22 bp, Homo sapiens
ggccccaggcattgccaagggc

SEQ ID NO: 2543792 - DNA, 13 bp, Homo sapiens
ggccccagtcagc

SEQ ID NO: 2543793 - DNA, 16 bp, Homo sapiens
ggccccagtcagcctc

SEQ ID NO: 2543794 - DNA, 12 bp, Homo sapiens
ggcccccagagc

SEQ ID NO: 2543795 - DNA, 17 bp, Homo sapiens
ggcccccagagcgcccc

SEQ ID NO: 2543796 - DNA, 13 bp, Homo sapiens
ggcccccgagctg

SEQ ID NO: 2543797 - DNA, 19 bp, Homo sapiens
ggccccgaggacccagacc

SEQ ID NO: 2543798 - DNA, 15 bp, Homo sapiens
ggccccgccgcctgg

SEQ ID NO: 2543799 - DNA, 14 bp, Homo sapiens
ggccccggccccag

SEQ ID NO: 2543800 - DNA, 21 bp, Homo sapiens
ggccccggccccagccagagt

SEQ ID NO: 2543801 - DNA, 16 bp, Homo sapiens
ggcccctcagggtccc

SEQ ID NO: 2543802 - DNA, 19 bp, Homo sapiens
ggcccctcagggtccctgg

SEQ ID NO: 2543803 - DNA, 20 bp, Homo sapiens
ggcccctcagggtccctggt

SEQ ID NO: 2543804 - DNA, 23 bp, Homo sapiens
ggcccctcatctgctcagcagct

SEQ ID NO: 2543805 - DNA, 17 bp, Homo sapiens
ggcccctccagcttgtg

SEQ ID NO: 2543806 - DNA, 14 bp, Homo sapiens
ggcccctctgccca

SEQ ID NO: 2543807 - DNA, 12 bp, Homo sapiens
ggcccctgccac

SEQ ID NO: 2543808 - DNA, 18 bp, Homo sapiens
ggcccctgccaccctggg

SEQ ID NO: 2543809 - DNA, 13 bp, Homo sapiens
ggcccctgctggt

SEQ ID NO: 2543810 - DNA, 15 bp, Homo sapiens
ggcccctggcccagc

SEQ ID NO: 2543811 - DNA, 17 bp, Homo sapiens
ggcccctggcccagcgg

SEQ ID NO: 2543812 - DNA, 20 bp, Homo sapiens
ggcccctggcccagcggccc

SEQ ID NO: 2543813 - DNA, 23 bp, Homo sapiens
ggcccctgggtcagtctggtggg

SEQ ID NO: 2543814 - DNA, 21 bp, Homo sapiens
ggccccttcacttctgaccac

SEQ ID NO: 2543815 - DNA, 22 bp, Homo sapiens
ggccccttcacttctgaccaca

SEQ ID NO: 2543816 - DNA, 19 bp, Homo sapiens
ggcccctttttactcccct

SEQ ID NO: 2543817 - DNA, 15 bp, Homo sapiens
ggcccgcctggcaga

SEQ ID NO: 2543818 - DNA, 23 bp, Homo sapiens
ggcccgcctggcagaactgagct

SEQ ID NO: 2543819 - DNA, 15 bp, Homo sapiens
ggcccggctccaggc

SEQ ID NO: 2543820 - DNA, 21 bp, Homo sapiens
ggccctaccagcgcccgctgg

SEQ ID NO: 2543821 - DNA, 14 bp, Homo sapiens
ggccctcccagtac

SEQ ID NO: 2543822 - DNA, 15 bp, Homo sapiens
ggccctccgacagcc

SEQ ID NO: 2543823 - DNA, 16 bp, Homo sapiens
ggccctcctaccctgc

SEQ ID NO: 2543824 - DNA, 15 bp, Homo sapiens
ggccctcgctgccag

SEQ ID NO: 2543825 - DNA, 21 bp, Homo sapiens
ggccctcgctgccagctctgt

SEQ ID NO: 2543826 - DNA, 23 bp, Homo sapiens
ggccctcgctgccagctctgtat

SEQ ID NO: 2543827 - DNA, 18 bp, Homo sapiens
ggccctcgggcccagccc

SEQ ID NO: 2543828 - DNA, 15 bp, Homo sapiens
ggccctctctgctct

SEQ ID NO: 2543829 - DNA, 21 bp, Homo sapiens
ggccctctctgctctgcgtgt

SEQ ID NO: 2543830 - DNA, 13 bp, Homo sapiens
ggccctctgccca

SEQ ID NO: 2543831 - DNA, 15 bp, Homo sapiens
ggccctctgcccact

SEQ ID NO: 2543832 - DNA, 19 bp, Homo sapiens
ggccctctgcccactccct

SEQ ID NO: 2543833 - DNA, 14 bp, Homo sapiens
ggccctgagctcgg

SEQ ID NO: 2543834 - DNA, 13 bp, Homo sapiens
ggccctgagctga

SEQ ID NO: 2543835 - DNA, 17 bp, Homo sapiens
ggccctgaggtgtgggg

SEQ ID NO: 2543836 - DNA, 19 bp, Homo sapiens
ggccctgaggtgtgggggc

SEQ ID NO: 2543837 - DNA, 22 bp, Homo sapiens
ggccctgaggtgtgggggctgc

SEQ ID NO: 2543838 - DNA, 18 bp, Homo sapiens
ggccctgggctcggaggc

SEQ ID NO: 2543839 - DNA, 11 bp, Homo sapiens
ggccctggggc

SEQ ID NO: 2543840 - DNA, 15 bp, Homo sapiens
ggccctggtccttcc

SEQ ID NO: 2543841 - DNA, 17 bp, Homo sapiens
ggccctggtccttccag

SEQ ID NO: 2543842 - DNA, 21 bp, Homo sapiens
ggcccttcactgcctttgctc

SEQ ID NO: 2543843 - DNA, 19 bp, Homo sapiens
ggcccttcccacaggacat

SEQ ID NO: 2543844 - DNA, 19 bp, Homo sapiens
ggccgatcggggcactgca

SEQ ID NO: 2543845 - DNA, 23 bp, Homo sapiens
ggccgcagctcttgcccttccct

SEQ ID NO: 2543846 - DNA, 12 bp, Homo sapiens
ggccgccccctg

SEQ ID NO: 2543847 - DNA, 19 bp, Homo sapiens
ggccgccccctgcccccca

SEQ ID NO: 2543848 - DNA, 22 bp, Homo sapiens
ggccgccccctgccccccagcc

SEQ ID NO: 2543849 - DNA, 13 bp, Homo sapiens
ggccgctagaggc

SEQ ID NO: 2543850 - DNA, 17 bp, Homo sapiens
ggccgctagaggcctga

SEQ ID NO: 2543851 - DNA, 18 bp, Homo sapiens
ggccgctagaggcctgag

SEQ ID NO: 2543852 - DNA, 20 bp, Homo sapiens
ggccgctagaggcctgagga

SEQ ID NO: 2543853 - DNA, 19 bp, Homo sapiens
ggccgctagatgggcatgg

SEQ ID NO: 2543854 - DNA, 13 bp, Homo sapiens
ggccgctccaggg

SEQ ID NO: 2543855 - DNA, 16 bp, Homo sapiens
ggccgctccaggggtg

SEQ ID NO: 2543856 - DNA, 22 bp, Homo sapiens
ggccggcttcatgccagctact

SEQ ID NO: 2543857 - DNA, 22 bp, Homo sapiens
ggccgggaccccgagcctggct

SEQ ID NO: 2543858 - DNA, 13 bp, Homo sapiens
ggccggggccggg

SEQ ID NO: 2543859 - DNA, 23 bp, Homo sapiens
ggccggtctgcaagtcagaggat

SEQ ID NO: 2543860 - DNA, 23 bp, Homo sapiens
ggccggtttcgaagttgatgcaa

SEQ ID NO: 2543861 - DNA, 15 bp, Homo sapiens
ggccgtcctcccggg

SEQ ID NO: 2543862 - DNA, 20 bp, Homo sapiens
ggccgtcctcccgggccctc

SEQ ID NO: 2543863 - DNA, 20 bp, Homo sapiens
ggccgtcttcactcgccccc

SEQ ID NO: 2543864 - DNA, 14 bp, Homo sapiens
ggccgtgggcctgg

SEQ ID NO: 2543865 - DNA, 21 bp, Homo sapiens
ggccgttgatgttggctggga

SEQ ID NO: 2543866 - DNA, 17 bp, Homo sapiens
ggcctaaaagtaaacat

SEQ ID NO: 2543867 - DNA, 18 bp, Homo sapiens
ggcctacatgctttgtga

SEQ ID NO: 2543868 - DNA, 19 bp, Homo sapiens
ggcctagctgctacaaaga

SEQ ID NO: 2543869 - DNA, 16 bp, Homo sapiens
ggcctatctaaactgg

SEQ ID NO: 2543870 - DNA, 20 bp, Homo sapiens
ggcctcaaaggcccgctcta

SEQ ID NO: 2543871 - DNA, 17 bp, Homo sapiens
ggcctcaaccctccctc

SEQ ID NO: 2543872 - DNA, 23 bp, Homo sapiens
ggcctcaaccctccctcagcccc

SEQ ID NO: 2543873 - DNA, 12 bp, Homo sapiens
ggcctcaagatc

SEQ ID NO: 2543874 - DNA, 23 bp, Homo sapiens
ggcctcaagtgattctcctgcct

SEQ ID NO: 2543875 - DNA, 19 bp, Homo sapiens
ggcctcaccgagtgggggc

SEQ ID NO: 2543876 - DNA, 13 bp, Homo sapiens
ggcctcagctgcc

SEQ ID NO: 2543877 - DNA, 22 bp, Homo sapiens
ggcctcagctgcctcacttcct

SEQ ID NO: 2543878 - DNA, 11 bp, Homo sapiens
ggcctcagtct

SEQ ID NO: 2543879 - DNA, 13 bp, Homo sapiens
ggcctcccaaagt

SEQ ID NO: 2543880 - DNA, 13 bp, Homo sapiens
ggcctcccaactc

SEQ ID NO: 2543881 - DNA, 18 bp, Homo sapiens
ggcctcccaactcacccc

SEQ ID NO: 2543882 - DNA, 19 bp, Homo sapiens
ggcctcccaactcacccca

SEQ ID NO: 2543883 - DNA, 21 bp, Homo sapiens
ggcctcccacccgatgctgct

SEQ ID NO: 2543884 - DNA, 14 bp, Homo sapiens
ggcctcccctgctg

SEQ ID NO: 2543885 - DNA, 23 bp, Homo sapiens
ggcctccctctctcttctgctcc

SEQ ID NO: 2543886 - DNA, 14 bp, Homo sapiens
ggcctccggcctcc

SEQ ID NO: 2543887 - DNA, 19 bp, Homo sapiens
ggcctcctctgtccagggc

SEQ ID NO: 2543888 - DNA, 13 bp, Homo sapiens
ggcctcggagcct

SEQ ID NO: 2543889 - DNA, 23 bp, Homo sapiens
ggcctcgggacacctgccctgcc

SEQ ID NO: 2543890 - DNA, 20 bp, Homo sapiens
ggcctcggtgtggagaagcg

SEQ ID NO: 2543891 - DNA, 17 bp, Homo sapiens
ggcctctaaccccaggc

SEQ ID NO: 2543892 - DNA, 14 bp, Homo sapiens
ggcctctgcactcc

SEQ ID NO: 2543893 - DNA, 15 bp, Homo sapiens
ggcctctgcactccc

SEQ ID NO: 2543894 - DNA, 18 bp, Homo sapiens
ggcctctgcactcccctg

SEQ ID NO: 2543895 - DNA, 20 bp, Homo sapiens
ggcctctgtgtccttccctg

SEQ ID NO: 2543896 - DNA, 17 bp, Homo sapiens
ggcctcttatgggctgg

SEQ ID NO: 2543897 - DNA, 17 bp, Homo sapiens
ggcctcttggacctctg

SEQ ID NO: 2543898 - DNA, 22 bp, Homo sapiens
ggcctgaatgcttataggtggc

SEQ ID NO: 2543899 - DNA, 16 bp, Homo sapiens
ggcctgactctcagca

SEQ ID NO: 2543900 - DNA, 15 bp, Homo sapiens
ggcctgagctgggat

SEQ ID NO: 2543901 - DNA, 18 bp, Homo sapiens
ggcctgaggatgagctgg

SEQ ID NO: 2543902 - DNA, 22 bp, Homo sapiens
ggcctgatgctccctcccctgc

SEQ ID NO: 2543903 - DNA, 23 bp, Homo sapiens
ggcctgatgctccctcccctgcc

SEQ ID NO: 2543904 - DNA, 16 bp, Homo sapiens
ggcctgccctcaggga

SEQ ID NO: 2543905 - DNA, 11 bp, Homo sapiens
ggcctgcctgt

SEQ ID NO: 2543906 - DNA, 15 bp, Homo sapiens
ggcctggacctgcct

SEQ ID NO: 2543907 - DNA, 21 bp, Homo sapiens
ggcctggagcaggccttgcgc

SEQ ID NO: 2543908 - DNA, 19 bp, Homo sapiens
ggcctggaggtggggttgg

SEQ ID NO: 2543909 - DNA, 17 bp, Homo sapiens
ggcctggccaggagctc

SEQ ID NO: 2543910 - DNA, 23 bp, Homo sapiens
ggcctggccaggagctcttcagg

SEQ ID NO: 2543911 - DNA, 23 bp, Homo sapiens
ggcctggcccacagcaggtgctg

SEQ ID NO: 2543912 - DNA, 14 bp, Homo sapiens
ggcctggcccctca

SEQ ID NO: 2543913 - DNA, 15 bp, Homo sapiens
ggcctggcctgagct

SEQ ID NO: 2543914 - DNA, 16 bp, Homo sapiens
ggcctggcctgagctg

SEQ ID NO: 2543915 - DNA, 19 bp, Homo sapiens
ggcctggcctgagctggga

SEQ ID NO: 2543916 - DNA, 14 bp, Homo sapiens
ggcctgggccagag

SEQ ID NO: 2543917 - DNA, 16 bp, Homo sapiens
ggcctggggctccttt

SEQ ID NO: 2543918 - DNA, 19 bp, Homo sapiens
ggcctgggtctgtgtctct

SEQ ID NO: 2543919 - DNA, 21 bp, Homo sapiens
ggcctgggtgctggctgccca

SEQ ID NO: 2543920 - DNA, 19 bp, Homo sapiens
ggcctggtgttctgtggga

SEQ ID NO: 2543921 - DNA, 19 bp, Homo sapiens
ggcctgtctcatccccagg

SEQ ID NO: 2543922 - DNA, 20 bp, Homo sapiens
ggcctgtctcatccccaggg

SEQ ID NO: 2543923 - DNA, 17 bp, Homo sapiens
ggcctgtgggagcctgc

SEQ ID NO: 2543924 - DNA, 20 bp, Homo sapiens
ggcctgtgggagcctgcaaa

SEQ ID NO: 2543925 - DNA, 20 bp, Homo sapiens
ggcctgtgtcccatgaccca

SEQ ID NO: 2543926 - DNA, 21 bp, Homo sapiens
ggcctgtgtctagttgtttga

SEQ ID NO: 2543927 - DNA, 21 bp, Homo sapiens
ggcctgttttagaaggttctc

SEQ ID NO: 2543928 - DNA, 17 bp, Homo sapiens
gggctagaacctggaga

SEQ ID NO: 2543929 - DNA, 11 bp, Homo sapiens
gggctcagcct

SEQ ID NO: 2543930 - DNA, 12 bp, Homo sapiens
gggctcagcctg

SEQ ID NO: 2543931 - DNA, 20 bp, Homo sapiens
gggctcagcctggtgggcct

SEQ ID NO: 2543932 - DNA, 18 bp, Homo sapiens
gggctccctgactgggag

SEQ ID NO: 2543933 - DNA, 14 bp, Homo sapiens
gggctcccttccca

SEQ ID NO: 2543934 - DNA, 11 bp, Homo sapiens
gggctcctgga

SEQ ID NO: 2543935 - DNA, 20 bp, Homo sapiens
gggctcctttctccagccag

SEQ ID NO: 2543936 - DNA, 20 bp, Homo sapiens
gggctcgccatgccgggggt

SEQ ID NO: 2543937 - DNA, 19 bp, Homo sapiens
gggctctctgctgtacata

SEQ ID NO: 2543938 - DNA, 17 bp, Homo sapiens
gggctctgcctcccatc

SEQ ID NO: 2543939 - DNA, 21 bp, Homo sapiens
gggctgaccttcctcgcagag

SEQ ID NO: 2543940 - DNA, 14 bp, Homo sapiens
gggctgagccccta

SEQ ID NO: 2543941 - DNA, 15 bp, Homo sapiens
gggctgagcccctac

SEQ ID NO: 2543942 - DNA, 14 bp, Homo sapiens
gggctgagggagcc

SEQ ID NO: 2543943 - DNA, 14 bp, Homo sapiens
gggctgcaccggct

SEQ ID NO: 2543944 - DNA, 22 bp, Homo sapiens
gggctgcaccggctggcctggc

SEQ ID NO: 2543945 - DNA, 11 bp, Homo sapiens
gggctgcagca

SEQ ID NO: 2543946 - DNA, 14 bp, Homo sapiens
gggctgcctgggct

SEQ ID NO: 2543947 - DNA, 19 bp, Homo sapiens
gggctgcctgggctgttgg

SEQ ID NO: 2543948 - DNA, 17 bp, Homo sapiens
gggctgctgacctccac

SEQ ID NO: 2543949 - DNA, 18 bp, Homo sapiens
gggctggaatctggagag

SEQ ID NO: 2543950 - DNA, 21 bp, Homo sapiens
gggctggaatctggagagcta

SEQ ID NO: 2543951 - DNA, 13 bp, Homo sapiens
gggctggcctagg

SEQ ID NO: 2543952 - DNA, 19 bp, Homo sapiens
gggctggcctctggctctc

SEQ ID NO: 2543953 - DNA, 15 bp, Homo sapiens
gggctggccttcctg

SEQ ID NO: 2543954 - DNA, 13 bp, Homo sapiens
gggctggctccct

SEQ ID NO: 2543955 - DNA, 16 bp, Homo sapiens
gggctgggagctctgc

SEQ ID NO: 2543956 - DNA, 17 bp, Homo sapiens
gggctgggttctaccca

SEQ ID NO: 2543957 - DNA, 20 bp, Homo sapiens
gggctgggttctacccaggt

SEQ ID NO: 2543958 - DNA, 18 bp, Homo sapiens
gggctggtagctcaggtg

SEQ ID NO: 2543959 - DNA, 21 bp, Homo sapiens
gggctggtgacccagtcagag

SEQ ID NO: 2543960 - DNA, 16 bp, Homo sapiens
gggctggtgccagcct

SEQ ID NO: 2543961 - DNA, 21 bp, Homo sapiens
gggcttcaaccttgagacagc

SEQ ID NO: 2543962 - DNA, 16 bp, Homo sapiens
gggcttcactgtataa

SEQ ID NO: 2543963 - DNA, 23 bp, Homo sapiens
gggcttccatttgtgtgtgtgca

SEQ ID NO: 2543964 - DNA, 21 bp, Homo sapiens
gggcttcccagtggctgctgc

SEQ ID NO: 2543965 - DNA, 22 bp, Homo sapiens
gggcttcccagtggctgctgcc

SEQ ID NO: 2543966 - DNA, 23 bp, Homo sapiens
gggcttcccagtggctgctgccc

SEQ ID NO: 2543967 - DNA, 14 bp, Homo sapiens
gggcttctgcaccc

SEQ ID NO: 2543968 - DNA, 18 bp, Homo sapiens
gggcttctgcaccctcca

SEQ ID NO: 2543969 - DNA, 19 bp, Homo sapiens
gggcttctgcaccctccac

SEQ ID NO: 2543970 - DNA, 16 bp, Homo sapiens
gggcttgacttttgta

SEQ ID NO: 2543971 - DNA, 16 bp, Homo sapiens
ggggaaaatcagcctg

SEQ ID NO: 2543972 - DNA, 13 bp, Homo sapiens
ggggaaagcacag

SEQ ID NO: 2543973 - DNA, 16 bp, Homo sapiens
ggggaagagtgtactg

SEQ ID NO: 2543974 - DNA, 19 bp, Homo sapiens
ggggacagggctggcccag

SEQ ID NO: 2543975 - DNA, 18 bp, Homo sapiens
ggggacccccgccccctg

SEQ ID NO: 2543976 - DNA, 18 bp, Homo sapiens
ggggacggggggccccag

SEQ ID NO: 2543977 - DNA, 11 bp, Homo sapiens
ggggagaaagt

SEQ ID NO: 2543978 - DNA, 17 bp, Homo sapiens
ggggagactgggctgag

SEQ ID NO: 2543979 - DNA, 14 bp, Homo sapiens
ggggagcagagaca

SEQ ID NO: 2543980 - DNA, 19 bp, Homo sapiens
ggggaggatcactggagcc

SEQ ID NO: 2543981 - DNA, 14 bp, Homo sapiens
ggggaggcagccgg

SEQ ID NO: 2543982 - DNA, 14 bp, Homo sapiens
ggggagggtgacag

SEQ ID NO: 2543983 - DNA, 20 bp, Homo sapiens
ggggagggtgacagtggccg

SEQ ID NO: 2543984 - DNA, 13 bp, Homo sapiens
ggggagtggaata

SEQ ID NO: 2543985 - DNA, 20 bp, Homo sapiens
ggggagtgggacagagtctg

SEQ ID NO: 2543986 - DNA, 21 bp, Homo sapiens
ggggatgactagaggcaggga

SEQ ID NO: 2543987 - DNA, 20 bp, Homo sapiens
ggggatgagagggtgctatc

SEQ ID NO: 2543988 - DNA, 21 bp, Homo sapiens
ggggatttccagccagggctg

SEQ ID NO: 2543989 - DNA, 14 bp, Homo sapiens
ggggatttctccca

SEQ ID NO: 2543990 - DNA, 13 bp, Homo sapiens
ggggcagaacagc

SEQ ID NO: 2543991 - DNA, 21 bp, Homo sapiens
ggggcagccaaacccatgagg

SEQ ID NO: 2543992 - DNA, 15 bp, Homo sapiens
ggggcagcccttgct

SEQ ID NO: 2543993 - DNA, 23 bp, Homo sapiens
ggggcagcttctattagccagtc

SEQ ID NO: 2543994 - DNA, 12 bp, Homo sapiens
ggggcaggctga

SEQ ID NO: 2543995 - DNA, 18 bp, Homo sapiens
ggggcatgtattggcctg

SEQ ID NO: 2543996 - DNA, 23 bp, Homo sapiens
ggggcatgtattggcctggaggt

SEQ ID NO: 2543997 - DNA, 17 bp, Homo sapiens
ggggccagttggtcccc

SEQ ID NO: 2543998 - DNA, 19 bp, Homo sapiens
ggggcccaaggcggcccct

SEQ ID NO: 2543999 - DNA, 16 bp, Homo sapiens
ggggccccagtcagcc

SEQ ID NO: 2544000 - DNA, 18 bp, Homo sapiens
ggggccccagtcagcctc

SEQ ID NO: 2544001 - DNA, 16 bp, Homo sapiens
ggggcccgcctggcag

SEQ ID NO: 2544002 - DNA, 16 bp, Homo sapiens
ggggccctgcctcctt

SEQ ID NO: 2544003 - DNA, 19 bp, Homo sapiens
ggggccctgcctcctttgt

SEQ ID NO: 2544004 - DNA, 23 bp, Homo sapiens
ggggccctgcctcctttgtgagg

SEQ ID NO: 2544005 - DNA, 15 bp, Homo sapiens
ggggcctcagtgcca

SEQ ID NO: 2544006 - DNA, 14 bp, Homo sapiens
ggggcctggacctg

SEQ ID NO: 2544007 - DNA, 14 bp, Homo sapiens
ggggcgctggccca

SEQ ID NO: 2544008 - DNA, 21 bp, Homo sapiens
ggggctagaacctagagaagc

SEQ ID NO: 2544009 - DNA, 13 bp, Homo sapiens
ggggctcctggaa

SEQ ID NO: 2544010 - DNA, 21 bp, Homo sapiens
ggggctcctggaaaggctcag

SEQ ID NO: 2544011 - DNA, 22 bp, Homo sapiens
ggggctcctttctccagccagc

SEQ ID NO: 2544012 - DNA, 21 bp, Homo sapiens
ggggctgcaccggctggcctg

SEQ ID NO: 2544013 - DNA, 12 bp, Homo sapiens
ggggcttatttt

SEQ ID NO: 2544014 - DNA, 23 bp, Homo sapiens
gggggacagggctggcccagccc

SEQ ID NO: 2544015 - DNA, 13 bp, Homo sapiens
gggggagtggaat

SEQ ID NO: 2544016 - DNA, 15 bp, Homo sapiens
gggggccaacaccag

SEQ ID NO: 2544017 - DNA, 21 bp, Homo sapiens
gggggccatgaggcctcagtg

SEQ ID NO: 2544018 - DNA, 19 bp, Homo sapiens
gggggccccagtcagcctc

SEQ ID NO: 2544019 - DNA, 20 bp, Homo sapiens
gggggccccagtcagcctct

SEQ ID NO: 2544020 - DNA, 21 bp, Homo sapiens
gggggccccagtcagcctctc

SEQ ID NO: 2544021 - DNA, 18 bp, Homo sapiens
gggggcctcagtgccact

SEQ ID NO: 2544022 - DNA, 13 bp, Homo sapiens
gggggctggtgcc

SEQ ID NO: 2544023 - DNA, 14 bp, Homo sapiens
gggggctggtgcca

SEQ ID NO: 2544024 - DNA, 19 bp, Homo sapiens
gggggctggtgccagcctt

SEQ ID NO: 2544025 - DNA, 21 bp, Homo sapiens
gggggctggtgccagccttcc

SEQ ID NO: 2544026 - DNA, 15 bp, Homo sapiens
gggggtagagctgat

SEQ ID NO: 2544027 - DNA, 18 bp, Homo sapiens
gggggtcccagtgggagg

SEQ ID NO: 2544028 - DNA, 17 bp, Homo sapiens
ggggtaggcagagcctt

SEQ ID NO: 2544029 - DNA, 22 bp, Homo sapiens
ggggtcactcaattctgcagta

SEQ ID NO: 2544030 - DNA, 21 bp, Homo sapiens
ggggtcactctggcagctcag

SEQ ID NO: 2544031 - DNA, 15 bp, Homo sapiens
ggggtcaggctccat

SEQ ID NO: 2544032 - DNA, 23 bp, Homo sapiens
ggggtccccatcatcccagctgc

SEQ ID NO: 2544033 - DNA, 15 bp, Homo sapiens
ggggtctccaggagg

SEQ ID NO: 2544034 - DNA, 13 bp, Homo sapiens
ggggtgaggacca

SEQ ID NO: 2544035 - DNA, 17 bp, Homo sapiens
ggggtgatttcagagag

SEQ ID NO: 2544036 - DNA, 18 bp, Homo sapiens
ggggtgatttcagagagg

SEQ ID NO: 2544037 - DNA, 13 bp, Homo sapiens
ggggtgccccctc

SEQ ID NO: 2544038 - DNA, 23 bp, Homo sapiens
ggggtgccccctcctctcccatc

SEQ ID NO: 2544039 - DNA, 15 bp, Homo sapiens
ggggtgggagaggtc

SEQ ID NO: 2544040 - DNA, 14 bp, Homo sapiens
ggggtgggcctctg

SEQ ID NO: 2544041 - DNA, 15 bp, Homo sapiens
ggggtgggcctctgg

SEQ ID NO: 2544042 - DNA, 20 bp, Homo sapiens
ggggttcataggtcactggc

SEQ ID NO: 2544043 - DNA, 20 bp, Homo sapiens
ggggttctttcttcctctgc

SEQ ID NO: 2544044 - DNA, 13 bp, Homo sapiens
ggggttggctggg

SEQ ID NO: 2544045 - DNA, 19 bp, Homo sapiens
gggtacatttccctgtgct

SEQ ID NO: 2544046 - DNA, 19 bp, Homo sapiens
gggtacttgtggacacagc

SEQ ID NO: 2544047 - DNA, 18 bp, Homo sapiens
gggtagcccgcctgccag

SEQ ID NO: 2544048 - DNA, 21 bp, Homo sapiens
gggtagcccgcctgccagtcc

SEQ ID NO: 2544049 - DNA, 22 bp, Homo sapiens
gggtagcccgcctgccagtcct

SEQ ID NO: 2544050 - DNA, 13 bp, Homo sapiens
gggtatattcatt

SEQ ID NO: 2544051 - DNA, 20 bp, Homo sapiens
gggtatcaggtgctgccatc

SEQ ID NO: 2544052 - DNA, 13 bp, Homo sapiens
gggtcaggaagga

SEQ ID NO: 2544053 - DNA, 21 bp, Homo sapiens
gggtcagtctggtgggaggac

SEQ ID NO: 2544054 - DNA, 21 bp, Homo sapiens
gggtcatctgtacctctgcct

SEQ ID NO: 2544055 - DNA, 13 bp, Homo sapiens
gggtccaaataaa

SEQ ID NO: 2544056 - DNA, 20 bp, Homo sapiens
gggtccacccagcaaagagt

SEQ ID NO: 2544057 - DNA, 19 bp, Homo sapiens
gggtccaggggatgggagg

SEQ ID NO: 2544058 - DNA, 15 bp, Homo sapiens
gggtcccaagctggg

SEQ ID NO: 2544059 - DNA, 13 bp, Homo sapiens
gggtcctggctcc

SEQ ID NO: 2544060 - DNA, 23 bp, Homo sapiens
gggtcctgtggcaggcagcgcca

SEQ ID NO: 2544061 - DNA, 20 bp, Homo sapiens
gggtcgtcaccacctctcct

SEQ ID NO: 2544062 - DNA, 22 bp, Homo sapiens
gggtctcactatgttgcccagg

SEQ ID NO: 2544063 - DNA, 19 bp, Homo sapiens
gggtctccaggaggagact

SEQ ID NO: 2544064 - DNA, 20 bp, Homo sapiens
gggtctgccaccatcctgct

SEQ ID NO: 2544065 - DNA, 19 bp, Homo sapiens
gggtgaagagaaccgagca

SEQ ID NO: 2544066 - DNA, 13 bp, Homo sapiens
gggtgaagggaga

SEQ ID NO: 2544067 - DNA, 14 bp, Homo sapiens
gggtgaagggagag

SEQ ID NO: 2544068 - DNA, 15 bp, Homo sapiens
gggtgaggaccactc

SEQ ID NO: 2544069 - DNA, 17 bp, Homo sapiens
gggtgagggtcccatgt

SEQ ID NO: 2544070 - DNA, 18 bp, Homo sapiens
gggtgcccaagctcagaa

SEQ ID NO: 2544071 - DNA, 19 bp, Homo sapiens
gggtgctggctgcccagac

SEQ ID NO: 2544072 - DNA, 17 bp, Homo sapiens
gtacaggcagcacagag

SEQ ID NO: 2544073 - DNA, 12 bp, Homo sapiens
gtacagtctgtc

SEQ ID NO: 2544074 - DNA, 16 bp, Homo sapiens
gtacagtgtgtaaagt

SEQ ID NO: 2544075 - DNA, 21 bp, Homo sapiens
gtacagttatttatgcctctg

SEQ ID NO: 2544076 - DNA, 14 bp, Homo sapiens
gtacagtttgctgt

SEQ ID NO: 2544077 - DNA, 16 bp, Homo sapiens
gtacagtttgctgtac

SEQ ID NO: 2544078 - DNA, 14 bp, Homo sapiens
gtacataactgaaa

SEQ ID NO: 2544079 - DNA, 20 bp, Homo sapiens
gtacataatgcgtgcatacc

SEQ ID NO: 2544080 - DNA, 13 bp, Homo sapiens
gtacatagcctat

SEQ ID NO: 2544081 - DNA, 22 bp, Homo sapiens
gtacatagcctatatttacagt

SEQ ID NO: 2544082 - DNA, 18 bp, Homo sapiens
gtacatagttatttattt

SEQ ID NO: 2544083 - DNA, 18 bp, Homo sapiens
gtacatatgtaaaataaa

SEQ ID NO: 2544084 - DNA, 17 bp, Homo sapiens
gtacatatttgtggaat

SEQ ID NO: 2544085 - DNA, 19 bp, Homo sapiens
gtacatatttgtggaataa

SEQ ID NO: 2544086 - DNA, 20 bp, Homo sapiens
gtacatatttgtggaataat

SEQ ID NO: 2544087 - DNA, 17 bp, Homo sapiens
gtacatcccatgtaaca

SEQ ID NO: 2544088 - DNA, 17 bp, Homo sapiens
gtacatgaaaacacatt

SEQ ID NO: 2544089 - DNA, 20 bp, Homo sapiens
gtacatgaaaacacattttt

SEQ ID NO: 2544090 - DNA, 16 bp, Homo sapiens
gtacatggcagagttt

SEQ ID NO: 2544091 - DNA, 10 bp, Homo sapiens
gtacatgtat

SEQ ID NO: 2544092 - DNA, 19 bp, Homo sapiens
gtacatgtgtagcctgtgc

SEQ ID NO: 2544093 - DNA, 20 bp, Homo sapiens
gtacatgtgtagcctgtgca

SEQ ID NO: 2544094 - DNA, 20 bp, Homo sapiens
gtacatttatgatttaataa

SEQ ID NO: 2544095 - DNA, 22 bp, Homo sapiens
gtacatttatgatttaataaaa

SEQ ID NO: 2544096 - DNA, 14 bp, Homo sapiens
gtaccatttgcatg

SEQ ID NO: 2544097 - DNA, 18 bp, Homo sapiens
gtacccaaaagctcagcc

SEQ ID NO: 2544098 - DNA, 14 bp, Homo sapiens
gtacccactgctct

SEQ ID NO: 2544099 - DNA, 12 bp, Homo sapiens
gtacccagccat

SEQ ID NO: 2544100 - DNA, 13 bp, Homo sapiens
gtaccccaccctc

SEQ ID NO: 2544101 - DNA, 19 bp, Homo sapiens
gtaccctctcagctccagg

SEQ ID NO: 2544102 - DNA, 21 bp, Homo sapiens
gtacctataaagtaaagctaa

SEQ ID NO: 2544103 - DNA, 14 bp, Homo sapiens
gtacctattttcat

SEQ ID NO: 2544104 - DNA, 18 bp, Homo sapiens
gtacctattttcattgta

SEQ ID NO: 2544105 - DNA, 17 bp, Homo sapiens
gtacctgcccccaatcc

SEQ ID NO: 2544106 - DNA, 13 bp, Homo sapiens
gtacctttgtcac

SEQ ID NO: 2544107 - DNA, 14 bp, Homo sapiens
gtacgtctgacagg

SEQ ID NO: 2544108 - DNA, 16 bp, Homo sapiens
gtacgttgtgcatttg

SEQ ID NO: 2544109 - DNA, 12 bp, Homo sapiens
gtactacaattt

SEQ ID NO: 2544110 - DNA, 15 bp, Homo sapiens
gtactacaatttaaa

SEQ ID NO: 2544111 - DNA, 17 bp, Homo sapiens
gtactacagtcctccca

SEQ ID NO: 2544112 - DNA, 18 bp, Homo sapiens
gtactacagtcctcccat

SEQ ID NO: 2544113 - DNA, 15 bp, Homo sapiens
gtactactagatgtc

SEQ ID NO: 2544114 - DNA, 22 bp, Homo sapiens
gtactagagatctggttttgct

SEQ ID NO: 2544115 - DNA, 22 bp, Homo sapiens
gtactagggggaagtgacaagg

SEQ ID NO: 2544116 - DNA, 15 bp, Homo sapiens
gtactatgtatcaat

SEQ ID NO: 2544117 - DNA, 21 bp, Homo sapiens
gtactatttagatataacact

SEQ ID NO: 2544118 - DNA, 15 bp, Homo sapiens
gtactcaaatgtagc

SEQ ID NO: 2544119 - DNA, 20 bp, Homo sapiens
gtactcatcatcaaccctaa

SEQ ID NO: 2544120 - DNA, 14 bp, Homo sapiens
gtactcattaaaaa

SEQ ID NO: 2544121 - DNA, 11 bp, Homo sapiens
gtactctccta

SEQ ID NO: 2544122 - DNA, 15 bp, Homo sapiens
gtactctcctagaga

SEQ ID NO: 2544123 - DNA, 23 bp, Homo sapiens
gtactctcctagagacagaagca

SEQ ID NO: 2544124 - DNA, 13 bp, Homo sapiens
gtactcttccgaa

SEQ ID NO: 2544125 - DNA, 23 bp, Homo sapiens
gtactcttccgaaaaatcctctt

SEQ ID NO: 2544126 - DNA, 14 bp, Homo sapiens
gtacttctccaccc

SEQ ID NO: 2544127 - DNA, 16 bp, Homo sapiens
gtacttgtcaaagaag

SEQ ID NO: 2544128 - DNA, 21 bp, Homo sapiens
gtagaaagacagagctgggat

SEQ ID NO: 2544129 - DNA, 20 bp, Homo sapiens
gtagaaatatctgaaaatgt

SEQ ID NO: 2544130 - DNA, 20 bp, Homo sapiens
gtagaagatttgatgctgga

SEQ ID NO: 2544131 - DNA, 18 bp, Homo sapiens
gtagaagcattccttctt

SEQ ID NO: 2544132 - DNA, 21 bp, Homo sapiens
gtagaagcattccttctttga

SEQ ID NO: 2544133 - DNA, 22 bp, Homo sapiens
gtagaagcattccttctttgat

SEQ ID NO: 2544134 - DNA, 15 bp, Homo sapiens
gtagaaggagacaga

SEQ ID NO: 2544135 - DNA, 15 bp, Homo sapiens
gtagaaggtcggagg

SEQ ID NO: 2544136 - DNA, 21 bp, Homo sapiens
gtagaagtcttagatgtatat

SEQ ID NO: 2544137 - DNA, 14 bp, Homo sapiens
gtagaagtttttgt

SEQ ID NO: 2544138 - DNA, 15 bp, Homo sapiens
gtagaagtttttgta

SEQ ID NO: 2544139 - DNA, 19 bp, Homo sapiens
gtagaagtttttgtactgt

SEQ ID NO: 2544140 - DNA, 19 bp, Homo sapiens
gtagacacgctcttctatt

SEQ ID NO: 2544141 - DNA, 15 bp, Homo sapiens
gtagacatttctctt

SEQ ID NO: 2544142 - DNA, 16 bp, Homo sapiens
gtagacctagggagga

SEQ ID NO: 2544143 - DNA, 13 bp, Homo sapiens
gtagagaaacact

SEQ ID NO: 2544144 - DNA, 21 bp, Homo sapiens
gtagagctagaacatggagag

SEQ ID NO: 2544145 - DNA, 15 bp, Homo sapiens
gtagagtgggagctg

SEQ ID NO: 2544146 - DNA, 15 bp, Homo sapiens
gtagagtgtgcctga

SEQ ID NO: 2544147 - DNA, 14 bp, Homo sapiens
gtagagttaagaag

SEQ ID NO: 2544148 - DNA, 14 bp, Homo sapiens
gtagatagaaataa

SEQ ID NO: 2544149 - DNA, 13 bp, Homo sapiens
gtagattttcttt

SEQ ID NO: 2544150 - DNA, 15 bp, Homo sapiens
gtagattttctttaa

SEQ ID NO: 2544151 - DNA, 11 bp, Homo sapiens
gtagcagctgg

SEQ ID NO: 2544152 - DNA, 14 bp, Homo sapiens
gtagcagctggact

SEQ ID NO: 2544153 - DNA, 16 bp, Homo sapiens
gtagcatcttctggag

SEQ ID NO: 2544154 - DNA, 15 bp, Homo sapiens
gtagcatttcattct

SEQ ID NO: 2544155 - DNA, 14 bp, Homo sapiens
gtagccaaaggttc

SEQ ID NO: 2544156 - DNA, 17 bp, Homo sapiens
gtagcccgcctgccagt

SEQ ID NO: 2544157 - DNA, 20 bp, Homo sapiens
gtagcccgcctgccagtcct

SEQ ID NO: 2544158 - DNA, 22 bp, Homo sapiens
gtagcctggatattattcttgt

SEQ ID NO: 2544159 - DNA, 23 bp, Homo sapiens
gtagccttgcccggattctggga

SEQ ID NO: 2544160 - DNA, 17 bp, Homo sapiens
gtagctagaggaaccaa

SEQ ID NO: 2544161 - DNA, 13 bp, Homo sapiens
gtagctatatcta

SEQ ID NO: 2544162 - DNA, 14 bp, Homo sapiens
gtagctcaggtggg

SEQ ID NO: 2544163 - DNA, 19 bp, Homo sapiens
gtagctgggactacaggca

SEQ ID NO: 2544164 - DNA, 17 bp, Homo sapiens
gtagcttaccagaagct

SEQ ID NO: 2544165 - DNA, 18 bp, Homo sapiens
gtaggaacggtaaatttc

SEQ ID NO: 2544166 - DNA, 16 bp, Homo sapiens
gtaggaactgctgggc

SEQ ID NO: 2544167 - DNA, 15 bp, Homo sapiens
gtaggaagactttgg

SEQ ID NO: 2544168 - DNA, 15 bp, Homo sapiens
gtaggactgtagaaa

SEQ ID NO: 2544169 - DNA, 14 bp, Homo sapiens
gtaggaggtttgga

SEQ ID NO: 2544170 - DNA, 23 bp, Homo sapiens
gtaggctcctgccagtgtggaac

SEQ ID NO: 2544171 - DNA, 21 bp, Homo sapiens
gtagggcgggaggatgttctg

SEQ ID NO: 2544172 - DNA, 22 bp, Homo sapiens
gtagggcgggaggatgttctgg

SEQ ID NO: 2544173 - DNA, 20 bp, Homo sapiens
gtaggggtcaaagaaatgct

SEQ ID NO: 2544174 - DNA, 15 bp, Homo sapiens
gtaggggtgtgtgtg

SEQ ID NO: 2544175 - DNA, 22 bp, Homo sapiens
gtagggtaattagtaacatgtg

SEQ ID NO: 2544176 - DNA, 23 bp, Homo sapiens
gtaggtatcattttctgcattta

SEQ ID NO: 2544177 - DNA, 19 bp, Homo sapiens
gtagtaaaaattaaaaaaa

SEQ ID NO: 2544178 - DNA, 20 bp, Homo sapiens
gtagtagccctttctgtgtg

SEQ ID NO: 2544179 - DNA, 21 bp, Homo sapiens
gtagtagccctttctgtgtgc

SEQ ID NO: 2544180 - DNA, 14 bp, Homo sapiens
gtagtatcaaatat

SEQ ID NO: 2544181 - DNA, 11 bp, Homo sapiens
gtagttaggaa

SEQ ID NO: 2544182 - DNA, 20 bp, Homo sapiens
gtagttaggaaataaaacct

SEQ ID NO: 2544183 - DNA, 22 bp, Homo sapiens
gtagttaggaaataaaaccttt

SEQ ID NO: 2544184 - DNA, 13 bp, Homo sapiens
gtagttagtagca

SEQ ID NO: 2544185 - DNA, 16 bp, Homo sapiens
gtagttagtagcatgt

SEQ ID NO: 2544186 - DNA, 13 bp, Homo sapiens
gtataaactatca

SEQ ID NO: 2544187 - DNA, 12 bp, Homo sapiens
gtataaagaaca

SEQ ID NO: 2544188 - DNA, 18 bp, Homo sapiens
gtataaagcaactgttat

SEQ ID NO: 2544189 - DNA, 20 bp, Homo sapiens
gtataaagcaactgttatga

SEQ ID NO: 2544190 - DNA, 12 bp, Homo sapiens
gtataaatggtt

SEQ ID NO: 2544191 - DNA, 13 bp, Homo sapiens
gtataaatttatt

SEQ ID NO: 2544192 - DNA, 13 bp, Homo sapiens
gtataacaggtta

SEQ ID NO: 2544193 - DNA, 20 bp, Homo sapiens
gtataacttcttaaaagttg

SEQ ID NO: 2544194 - DNA, 12 bp, Homo sapiens
gtataatatttt

SEQ ID NO: 2544195 - DNA, 15 bp, Homo sapiens
gtataatatttttaa

SEQ ID NO: 2544196 - DNA, 19 bp, Homo sapiens
gtataatggttgactgggt

SEQ ID NO: 2544197 - DNA, 21 bp, Homo sapiens
gtataatggttgactgggttt

SEQ ID NO: 2544198 - DNA, 23 bp, Homo sapiens
gtataatggttgactgggtttct

SEQ ID NO: 2544199 - DNA, 21 bp, Homo sapiens
gtatacagtggattaattaaa

SEQ ID NO: 2544200 - DNA, 14 bp, Homo sapiens
gtatagaaatgctg

SEQ ID NO: 2544201 - DNA, 16 bp, Homo sapiens
gtatagatgcaagata

SEQ ID NO: 2544202 - DNA, 17 bp, Homo sapiens
gtatagctgtattgaat

SEQ ID NO: 2544203 - DNA, 23 bp, Homo sapiens
gtatagctgtattgaatcatgta

SEQ ID NO: 2544204 - DNA, 19 bp, Homo sapiens
gtatagtactggcatggta

SEQ ID NO: 2544205 - DNA, 14 bp, Homo sapiens
gtatatatagaatc

SEQ ID NO: 2544206 - DNA, 18 bp, Homo sapiens
gtatatctggacaagcca

SEQ ID NO: 2544207 - DNA, 21 bp, Homo sapiens
gtatatgtctcaggtccctgc

SEQ ID NO: 2544208 - DNA, 21 bp, Homo sapiens
gtatattatgtatttatattt

SEQ ID NO: 2544209 - DNA, 23 bp, Homo sapiens
gtatattatgtatttatattttg

SEQ ID NO: 2544210 - DNA, 11 bp, Homo sapiens
gtatattattt

SEQ ID NO: 2544211 - DNA, 15 bp, Homo sapiens
gtatattcatatatt

SEQ ID NO: 2544212 - DNA, 16 bp, Homo sapiens
gtatattcatttcaaa

SEQ ID NO: 2544213 - DNA, 13 bp, Homo sapiens
gtatatttatagt

SEQ ID NO: 2544214 - DNA, 15 bp, Homo sapiens
gtatatttgtacaaa

SEQ ID NO: 2544215 - DNA, 16 bp, Homo sapiens
gtatattttatatcaa

SEQ ID NO: 2544216 - DNA, 24 bp, Homo sapiens
gtatcaaatattagatgtgattta

SEQ ID NO: 2544217 - DNA, 14 bp, Homo sapiens
gtgcacagtgattt

SEQ ID NO: 2544218 - DNA, 21 bp, Homo sapiens
gtgcacctgtactcaggaggc

SEQ ID NO: 2544219 - DNA, 20 bp, Homo sapiens
gtgcaccttaccaactttct

SEQ ID NO: 2544220 - DNA, 15 bp, Homo sapiens
gtgcacgtggagagc

SEQ ID NO: 2544221 - DNA, 23 bp, Homo sapiens
gtgcagaggaagtggaaggcatc

SEQ ID NO: 2544222 - DNA, 16 bp, Homo sapiens
gtgcagagtgcccaga

SEQ ID NO: 2544223 - DNA, 15 bp, Homo sapiens
gtgcagcatatgagg

SEQ ID NO: 2544224 - DNA, 15 bp, Homo sapiens
gtgcagcctgtcctg

SEQ ID NO: 2544225 - DNA, 12 bp, Homo sapiens
gtgcagctgatt

SEQ ID NO: 2544226 - DNA, 18 bp, Homo sapiens
gtgcagctgattttaaca

SEQ ID NO: 2544227 - DNA, 23 bp, Homo sapiens
gtgcagctgattttaacaataac

SEQ ID NO: 2544228 - DNA, 17 bp, Homo sapiens
gtgcagcttctgtcctg

SEQ ID NO: 2544229 - DNA, 18 bp, Homo sapiens
gtgcaggcctgctcaggg

SEQ ID NO: 2544230 - DNA, 12 bp, Homo sapiens
gtgcagtcctgg

SEQ ID NO: 2544231 - DNA, 22 bp, Homo sapiens
gtgcagtcctgggatgtggctg

SEQ ID NO: 2544232 - DNA, 14 bp, Homo sapiens
gtgcagtctgggtg

SEQ ID NO: 2544233 - DNA, 23 bp, Homo sapiens
gtgcagtggtgcgatctgggttc

SEQ ID NO: 2544234 - DNA, 20 bp, Homo sapiens
gtgcagttgacagcaggtgg

SEQ ID NO: 2544235 - DNA, 13 bp, Homo sapiens
gtgcataccactt

SEQ ID NO: 2544236 - DNA, 14 bp, Homo sapiens
gtgcatattgtaca

SEQ ID NO: 2544237 - DNA, 22 bp, Homo sapiens
gtgcatgaaggtttctgaaaat

SEQ ID NO: 2544238 - DNA, 18 bp, Homo sapiens
gtgcatgggtgaagggag

SEQ ID NO: 2544239 - DNA, 15 bp, Homo sapiens
gtgcatgtgtgtgct

SEQ ID NO: 2544240 - DNA, 18 bp, Homo sapiens
gtgcatgtgtgtgctcag

SEQ ID NO: 2544241 - DNA, 16 bp, Homo sapiens
gtgcattacagagagg

SEQ ID NO: 2544242 - DNA, 15 bp, Homo sapiens
gtgcattatctagat

SEQ ID NO: 2544243 - DNA, 21 bp, Homo sapiens
gtgcattggaagaccccaccc

SEQ ID NO: 2544244 - DNA, 19 bp, Homo sapiens
gtgcatttgaggtctgttc

SEQ ID NO: 2544245 - DNA, 15 bp, Homo sapiens
gtgcatttggtggtt

SEQ ID NO: 2544246 - DNA, 18 bp, Homo sapiens
gtgcatttttgtgaaatg

SEQ ID NO: 2544247 - DNA, 23 bp, Homo sapiens
gtgccaacactcaagaagcaggc

SEQ ID NO: 2544248 - DNA, 16 bp, Homo sapiens
gtgccaagcacagtgc

SEQ ID NO: 2544249 - DNA, 14 bp, Homo sapiens
gtgccaatttcaag

SEQ ID NO: 2544250 - DNA, 18 bp, Homo sapiens
gtgccacccaccagggcg

SEQ ID NO: 2544251 - DNA, 18 bp, Homo sapiens
gtgccactgcccgagctg

SEQ ID NO: 2544252 - DNA, 19 bp, Homo sapiens
gtgccactgcccgagctgg

SEQ ID NO: 2544253 - DNA, 20 bp, Homo sapiens
gtgccactgcccgagctggt

SEQ ID NO: 2544254 - DNA, 21 bp, Homo sapiens
gtgccactgcccgagctggtg

SEQ ID NO: 2544255 - DNA, 15 bp, Homo sapiens
gtgccagaggtgggc

SEQ ID NO: 2544256 - DNA, 18 bp, Homo sapiens
gtgccagaggtgggcagg

SEQ ID NO: 2544257 - DNA, 16 bp, Homo sapiens
gtgccagcaactgaat

SEQ ID NO: 2544258 - DNA, 18 bp, Homo sapiens
gtgccagccttcctctgc

SEQ ID NO: 2544259 - DNA, 19 bp, Homo sapiens
gtgccagccttcctctgca

SEQ ID NO: 2544260 - DNA, 23 bp, Homo sapiens
gtgccaggactccccaggccagg

SEQ ID NO: 2544261 - DNA, 21 bp, Homo sapiens
gtgccaggatggaatgatggg

SEQ ID NO: 2544262 - DNA, 16 bp, Homo sapiens
gtgccaggtccttgcc

SEQ ID NO: 2544263 - DNA, 20 bp, Homo sapiens
gtgccaggttttctgggtgt

SEQ ID NO: 2544264 - DNA, 18 bp, Homo sapiens
gtgccagtcttgtgtctg

SEQ ID NO: 2544265 - DNA, 23 bp, Homo sapiens
gtgccatagagtttaacacaagt

SEQ ID NO: 2544266 - DNA, 20 bp, Homo sapiens
gtgcccaagctcagaaggct

SEQ ID NO: 2544267 - DNA, 22 bp, Homo sapiens
gtgcccagaactggactcagga

SEQ ID NO: 2544268 - DNA, 18 bp, Homo sapiens
gtgcccagcccggacctt

SEQ ID NO: 2544269 - DNA, 23 bp, Homo sapiens
gtgcccagctagctgcagagcca

SEQ ID NO: 2544270 - DNA, 13 bp, Homo sapiens
gtgccccccttgc

SEQ ID NO: 2544271 - DNA, 19 bp, Homo sapiens
gtgcccctgctgcctcccc

SEQ ID NO: 2544272 - DNA, 12 bp, Homo sapiens
gtgccctgcccc

SEQ ID NO: 2544273 - DNA, 22 bp, Homo sapiens
gtgccgagaaggaagcctccca

SEQ ID NO: 2544274 - DNA, 13 bp, Homo sapiens
gtgccgcctgccc

SEQ ID NO: 2544275 - DNA, 21 bp, Homo sapiens
gtgcctaggattgtgcctgta

SEQ ID NO: 2544276 - DNA, 21 bp, Homo sapiens
gtgcctccaccaccactggcc

SEQ ID NO: 2544277 - DNA, 22 bp, Homo sapiens
gtgcctccaccaccactggcca

SEQ ID NO: 2544278 - DNA, 12 bp, Homo sapiens
gtgcctctgcct

SEQ ID NO: 2544279 - DNA, 13 bp, Homo sapiens
gtgcctctgggac

SEQ ID NO: 2544280 - DNA, 15 bp, Homo sapiens
gtgcctctgggactg

SEQ ID NO: 2544281 - DNA, 12 bp, Homo sapiens
gtgcctgagagt

SEQ ID NO: 2544282 - DNA, 20 bp, Homo sapiens
gtgcctgatccagcctctcc

SEQ ID NO: 2544283 - DNA, 23 bp, Homo sapiens
gtgcctgatccagcctctcccct

SEQ ID NO: 2544284 - DNA, 16 bp, Homo sapiens
gtgcctggctcagagc

SEQ ID NO: 2544285 - DNA, 22 bp, Homo sapiens
gtgcctgggtggacatggcccc

SEQ ID NO: 2544286 - DNA, 15 bp, Homo sapiens
gtgccttccataatt

SEQ ID NO: 2544287 - DNA, 21 bp, Homo sapiens
gtgccttccatgtcggcctct

SEQ ID NO: 2544288 - DNA, 15 bp, Homo sapiens
gtgccttttgcaccc

SEQ ID NO: 2544289 - DNA, 22 bp, Homo sapiens
gtgcgctgacaaccaccgctcc

SEQ ID NO: 2544290 - DNA, 15 bp, Homo sapiens
gtgcggtggctcacg

SEQ ID NO: 2544291 - DNA, 15 bp, Homo sapiens
gtgcgtccacgagct

SEQ ID NO: 2544292 - DNA, 21 bp, Homo sapiens
gtgcgtgaaacacaccaggct

SEQ ID NO: 2544293 - DNA, 12 bp, Homo sapiens
gtgcgtgctcag

SEQ ID NO: 2544294 - DNA, 13 bp, Homo sapiens
gtgctaaaaatgg

SEQ ID NO: 2544295 - DNA, 14 bp, Homo sapiens
gtgctaaaaatggg

SEQ ID NO: 2544296 - DNA, 22 bp, Homo sapiens
gtgctaaatggtcgcccaggag

SEQ ID NO: 2544297 - DNA, 13 bp, Homo sapiens
gtgctaaattttc

SEQ ID NO: 2544298 - DNA, 17 bp, Homo sapiens
gtgctaataacagtgca

SEQ ID NO: 2544299 - DNA, 18 bp, Homo sapiens
gtgctaggaacactcctt

SEQ ID NO: 2544300 - DNA, 22 bp, Homo sapiens
gtgctatctcccccagccccat

SEQ ID NO: 2544301 - DNA, 13 bp, Homo sapiens
gtgctcagggcta

SEQ ID NO: 2544302 - DNA, 13 bp, Homo sapiens
gtgctccaggcag

SEQ ID NO: 2544303 - DNA, 16 bp, Homo sapiens
gtgctccgtgcctcca

SEQ ID NO: 2544304 - DNA, 14 bp, Homo sapiens
gtgctctggacagg

SEQ ID NO: 2544305 - DNA, 15 bp, Homo sapiens
gtgctctggacaggc

SEQ ID NO: 2544306 - DNA, 16 bp, Homo sapiens
gtgctctggacaggca

SEQ ID NO: 2544307 - DNA, 20 bp, Homo sapiens
gtgctgaatggttttcaaaa

SEQ ID NO: 2544308 - DNA, 19 bp, Homo sapiens
gtgctgaatgttgggactg

SEQ ID NO: 2544309 - DNA, 14 bp, Homo sapiens
gtgctgaccctcct

SEQ ID NO: 2544310 - DNA, 16 bp, Homo sapiens
gtgctgaccctcctgt

SEQ ID NO: 2544311 - DNA, 15 bp, Homo sapiens
gtgctgacctctggt

SEQ ID NO: 2544312 - DNA, 17 bp, Homo sapiens
gtgctgagtctgaaggc

SEQ ID NO: 2544313 - DNA, 20 bp, Homo sapiens
gtgctgatcgtgctaaattt

SEQ ID NO: 2544314 - DNA, 12 bp, Homo sapiens
gtgctgcattta

SEQ ID NO: 2544315 - DNA, 22 bp, Homo sapiens
gtgctgccatccaggttcagct

SEQ ID NO: 2544316 - DNA, 19 bp, Homo sapiens
gtgctgcccgtcttcagcc

SEQ ID NO: 2544317 - DNA, 21 bp, Homo sapiens
gtgctgccctgcccacctggc

SEQ ID NO: 2544318 - DNA, 14 bp, Homo sapiens
gtgctgctgctgct

SEQ ID NO: 2544319 - DNA, 13 bp, Homo sapiens
gtgctgcttccct

SEQ ID NO: 2544320 - DNA, 12 bp, Homo sapiens
gtgctggagcca

SEQ ID NO: 2544321 - DNA, 19 bp, Homo sapiens
gtgctggagccactaacta

SEQ ID NO: 2544322 - DNA, 15 bp, Homo sapiens
gtgctggctgcccag

SEQ ID NO: 2544323 - DNA, 18 bp, Homo sapiens
gtgctggctgcccagacc

SEQ ID NO: 2544324 - DNA, 20 bp, Homo sapiens
gtgctgggactgagccagtc

SEQ ID NO: 2544325 - DNA, 16 bp, Homo sapiens
gtgctggtgtcctgac

SEQ ID NO: 2544326 - DNA, 20 bp, Homo sapiens
gtgctggtgtcctgaccacc

SEQ ID NO: 2544327 - DNA, 12 bp, Homo sapiens
gtgctgtgaaaa

SEQ ID NO: 2544328 - DNA, 16 bp, Homo sapiens
gtgctgtgcccaagtt

SEQ ID NO: 2544329 - DNA, 17 bp, Homo sapiens
gtgctgtggccagggtg

SEQ ID NO: 2544330 - DNA, 16 bp, Homo sapiens
gtgctgtggcctgggc

SEQ ID NO: 2544331 - DNA, 19 bp, Homo sapiens
gtgctgtggcctgggcaag

SEQ ID NO: 2544332 - DNA, 12 bp, Homo sapiens
gtgctgtgtaaa

SEQ ID NO: 2544333 - DNA, 18 bp, Homo sapiens
gtgctgtgtaaagttagt

SEQ ID NO: 2544334 - DNA, 22 bp, Homo sapiens
gtgctgtgtaaagttagtctac

SEQ ID NO: 2544335 - DNA, 15 bp, Homo sapiens
gtgcttggaggaagg

SEQ ID NO: 2544336 - DNA, 19 bp, Homo sapiens
gtgcttgtttacagcacta

SEQ ID NO: 2544337 - DNA, 14 bp, Homo sapiens
gtgctttccagctc

SEQ ID NO: 2544338 - DNA, 18 bp, Homo sapiens
gtgctttccagctcaccc

SEQ ID NO: 2544339 - DNA, 20 bp, Homo sapiens
gtgctttccttttttaaaaa

SEQ ID NO: 2544340 - DNA, 19 bp, Homo sapiens
gtggaaaaatgagagaagg

SEQ ID NO: 2544341 - DNA, 15 bp, Homo sapiens
gtggaaagcctctgc

SEQ ID NO: 2544342 - DNA, 23 bp, Homo sapiens
gtggaaagcctctgctgccatgg

SEQ ID NO: 2544343 - DNA, 20 bp, Homo sapiens
gtggaaagggtgctgcttcc

SEQ ID NO: 2544344 - DNA, 13 bp, Homo sapiens
gtggaaagtgtaa

SEQ ID NO: 2544345 - DNA, 15 bp, Homo sapiens
gtggaaagtgtaaag

SEQ ID NO: 2544346 - DNA, 18 bp, Homo sapiens
gtggaaagtgtaaagcat

SEQ ID NO: 2544347 - DNA, 20 bp, Homo sapiens
gtggaaagtgtaaagcattc

SEQ ID NO: 2544348 - DNA, 17 bp, Homo sapiens
gtggaaattaagaagaa

SEQ ID NO: 2544349 - DNA, 20 bp, Homo sapiens
gtggaaggcatcagtcccta

SEQ ID NO: 2544350 - DNA, 14 bp, Homo sapiens
gtggaagtgtgggt

SEQ ID NO: 2544351 - DNA, 15 bp, Homo sapiens
gtggaagtgtgggtc

SEQ ID NO: 2544352 - DNA, 18 bp, Homo sapiens
gtggaatataaggaaagc

SEQ ID NO: 2544353 - DNA, 14 bp, Homo sapiens
gtggacacagctct

SEQ ID NO: 2544354 - DNA, 18 bp, Homo sapiens
gtggacacagctcttctc

SEQ ID NO: 2544355 - DNA, 24 bp, Homo sapiens
gtggacacagctcttctccaggct

SEQ ID NO: 2544356 - DNA, 15 bp, Homo sapiens
gtggacaccaggagt

SEQ ID NO: 2544357 - DNA, 22 bp, Homo sapiens
gtggacaccaggagtccctggt

SEQ ID NO: 2544358 - DNA, 14 bp, Homo sapiens
gtggacagtcctgg

SEQ ID NO: 2544359 - DNA, 15 bp, Homo sapiens
gtggaccttcctgcc

SEQ ID NO: 2544360 - DNA, 14 bp, Homo sapiens
gtggactccagact

SEQ ID NO: 2544361 - DNA, 17 bp, Homo sapiens
gtggactctgcacatgt

SEQ ID NO: 2544362 - DNA, 13 bp, Homo sapiens
gttaatcaattta

SEQ ID NO: 2544363 - DNA, 16 bp, Homo sapiens
gttaatgaaaatgtca

SEQ ID NO: 2544364 - DNA, 20 bp, Homo sapiens
gttaatgtaatctgatggct

SEQ ID NO: 2544365 - DNA, 21 bp, Homo sapiens
gttacaacagatttgtgaact

SEQ ID NO: 2544366 - DNA, 21 bp, Homo sapiens
gttacacactttttaagaaat

SEQ ID NO: 2544367 - DNA, 22 bp, Homo sapiens
gttacactggaggagagaagaa

SEQ ID NO: 2544368 - DNA, 21 bp, Homo sapiens
gttacagaaagtggtgctcag

SEQ ID NO: 2544369 - DNA, 17 bp, Homo sapiens
gttacatcacagtgttt

SEQ ID NO: 2544370 - DNA, 16 bp, Homo sapiens
gttacattaatgttaa

SEQ ID NO: 2544371 - DNA, 18 bp, Homo sapiens
gttaccatgtcactgtgg

SEQ ID NO: 2544372 - DNA, 13 bp, Homo sapiens
gttacccagagaa

SEQ ID NO: 2544373 - DNA, 15 bp, Homo sapiens
gttacctcctataaa

SEQ ID NO: 2544374 - DNA, 21 bp, Homo sapiens
gttacctgatcaatgacagag

SEQ ID NO: 2544375 - DNA, 23 bp, Homo sapiens
gttacgcacacgtacttaaatga

SEQ ID NO: 2544376 - DNA, 22 bp, Homo sapiens
gttactccagtgccaacaatcc

SEQ ID NO: 2544377 - DNA, 14 bp, Homo sapiens
gttactctgaaggg

SEQ ID NO: 2544378 - DNA, 18 bp, Homo sapiens
gttactgatcatgcattg

SEQ ID NO: 2544379 - DNA, 13 bp, Homo sapiens
gttacttcctatc

SEQ ID NO: 2544380 - DNA, 16 bp, Homo sapiens
gttacttgaaatacca

SEQ ID NO: 2544381 - DNA, 22 bp, Homo sapiens
gttagaggttttaaagtgatta

SEQ ID NO: 2544382 - DNA, 17 bp, Homo sapiens
gttagccaatatttttc

SEQ ID NO: 2544383 - DNA, 11 bp, Homo sapiens
gttagctggag

SEQ ID NO: 2544384 - DNA, 23 bp, Homo sapiens
gttagggtgctctggaagagagg

SEQ ID NO: 2544385 - DNA, 18 bp, Homo sapiens
gttaggtagagggagttg

SEQ ID NO: 2544386 - DNA, 16 bp, Homo sapiens
gttagtagcatgttga

SEQ ID NO: 2544387 - DNA, 19 bp, Homo sapiens
gttagtttctccaagcagg

SEQ ID NO: 2544388 - DNA, 15 bp, Homo sapiens
gttataaagatacag

SEQ ID NO: 2544389 - DNA, 17 bp, Homo sapiens
gttataaatcaatgtca

SEQ ID NO: 2544390 - DNA, 22 bp, Homo sapiens
gttatagagggtctaagattca

SEQ ID NO: 2544391 - DNA, 19 bp, Homo sapiens
gttatagtatatctggaca

SEQ ID NO: 2544392 - DNA, 10 bp, Homo sapiens
gttatataaa

SEQ ID NO: 2544393 - DNA, 13 bp, Homo sapiens
gttatataaatgg

SEQ ID NO: 2544394 - DNA, 20 bp, Homo sapiens
gttatcaccgtgggctccct

SEQ ID NO: 2544395 - DNA, 21 bp, Homo sapiens
gttatcccttccttttagcct

SEQ ID NO: 2544396 - DNA, 12 bp, Homo sapiens
gttatctctgtg

SEQ ID NO: 2544397 - DNA, 14 bp, Homo sapiens
gttatctctgtgtt

SEQ ID NO: 2544398 - DNA, 20 bp, Homo sapiens
gttatgaaattcaccccctt

SEQ ID NO: 2544399 - DNA, 14 bp, Homo sapiens
gttatgtgtgtata

SEQ ID NO: 2544400 - DNA, 19 bp, Homo sapiens
gttatgtgtgtatatgtat

SEQ ID NO: 2544401 - DNA, 14 bp, Homo sapiens
gttattataattgt

SEQ ID NO: 2544402 - DNA, 14 bp, Homo sapiens
gttattgcagttta

SEQ ID NO: 2544403 - DNA, 16 bp, Homo sapiens
gttattgcagtttatc

SEQ ID NO: 2544404 - DNA, 23 bp, Homo sapiens
gttattgcagtttatcattcaag

SEQ ID NO: 2544405 - DNA, 10 bp, Homo sapiens
gttatttaaa

SEQ ID NO: 2544406 - DNA, 15 bp, Homo sapiens
gttatttaaatgagt

SEQ ID NO: 2544407 - DNA, 12 bp, Homo sapiens
gttatttagact

SEQ ID NO: 2544408 - DNA, 14 bp, Homo sapiens
gttatttatatatt

SEQ ID NO: 2544409 - DNA, 19 bp, Homo sapiens
gttatttcttacaggcaca

SEQ ID NO: 2544410 - DNA, 18 bp, Homo sapiens
gttatttgttattttcag

SEQ ID NO: 2544411 - DNA, 17 bp, Homo sapiens
gttatttgtttaccact

SEQ ID NO: 2544412 - DNA, 13 bp, Homo sapiens
gttattttagttt

SEQ ID NO: 2544413 - DNA, 15 bp, Homo sapiens
gttattttagtttct

SEQ ID NO: 2544414 - DNA, 14 bp, Homo sapiens
gttattttcagtat

SEQ ID NO: 2544415 - DNA, 15 bp, Homo sapiens
gttattttcagtatt

SEQ ID NO: 2544416 - DNA, 14 bp, Homo sapiens
gttcaaaaagtcta

SEQ ID NO: 2544417 - DNA, 20 bp, Homo sapiens
gttcaaagatattttgcttt

SEQ ID NO: 2544418 - DNA, 20 bp, Homo sapiens
gttcaagcgattcttctgct

SEQ ID NO: 2544419 - DNA, 18 bp, Homo sapiens
gttcaatctcccgctgct

SEQ ID NO: 2544420 - DNA, 10 bp, Homo sapiens
gttcaatgat

SEQ ID NO: 2544421 - DNA, 17 bp, Homo sapiens
gttcaatggctgctgaa

SEQ ID NO: 2544422 - DNA, 11 bp, Homo sapiens
gttcaccagcc

SEQ ID NO: 2544423 - DNA, 19 bp, Homo sapiens
gttcactgcaacctccgcc

SEQ ID NO: 2544424 - DNA, 22 bp, Homo sapiens
gttcagctaagctaggaatgaa

SEQ ID NO: 2544425 - DNA, 18 bp, Homo sapiens
gttcagctccagctcacc

SEQ ID NO: 2544426 - DNA, 23 bp, Homo sapiens
gttcagcttgtaaatagctcagg

SEQ ID NO: 2544427 - DNA, 15 bp, Homo sapiens
gttcaggagtcccaa

SEQ ID NO: 2544428 - DNA, 18 bp, Homo sapiens
gttcaggagtcccaagga

SEQ ID NO: 2544429 - DNA, 15 bp, Homo sapiens
gttcaggggactcag

SEQ ID NO: 2544430 - DNA, 18 bp, Homo sapiens
gttcaggggactcagccc

SEQ ID NO: 2544431 - DNA, 20 bp, Homo sapiens
gttcaggggactcagccctg

SEQ ID NO: 2544432 - DNA, 20 bp, Homo sapiens
gttcagggttggcccctgcc

SEQ ID NO: 2544433 - DNA, 22 bp, Homo sapiens
gttcagggttggcccctgcccg

SEQ ID NO: 2544434 - DNA, 18 bp, Homo sapiens
gttcaggtaacaggcaga

SEQ ID NO: 2544435 - DNA, 14 bp, Homo sapiens
gttcagtacctgga

SEQ ID NO: 2544436 - DNA, 17 bp, Homo sapiens
gttcagtacctggagga

SEQ ID NO: 2544437 - DNA, 13 bp, Homo sapiens
gttcagtgtaatt

SEQ ID NO: 2544438 - DNA, 19 bp, Homo sapiens
gttcagtgtaatttctttg

SEQ ID NO: 2544439 - DNA, 15 bp, Homo sapiens
gttcagttacagaaa

SEQ ID NO: 2544440 - DNA, 12 bp, Homo sapiens
gttcataaatga

SEQ ID NO: 2544441 - DNA, 22 bp, Homo sapiens
gttcatagggtctcttcaggtt

SEQ ID NO: 2544442 - DNA, 20 bp, Homo sapiens
gttcataggtcactggctct

SEQ ID NO: 2544443 - DNA, 19 bp, Homo sapiens
gttcatatgtaccatgtac

SEQ ID NO: 2544444 - DNA, 17 bp, Homo sapiens
gttcatcatcctaagct

SEQ ID NO: 2544445 - DNA, 18 bp, Homo sapiens
gttcatccaatcctcact

SEQ ID NO: 2544446 - DNA, 20 bp, Homo sapiens
gttcatccaatcctcactgg

SEQ ID NO: 2544447 - DNA, 17 bp, Homo sapiens
gttcatcgtataacaca

SEQ ID NO: 2544448 - DNA, 20 bp, Homo sapiens
gttcatctgagcaagagctg

SEQ ID NO: 2544449 - DNA, 20 bp, Homo sapiens
gttcattaaagcatgaatgg

SEQ ID NO: 2544450 - DNA, 15 bp, Homo sapiens
gttcattattggaat

SEQ ID NO: 2544451 - DNA, 16 bp, Homo sapiens
gttcattgcactttga

SEQ ID NO: 2544452 - DNA, 18 bp, Homo sapiens
gttcattgtaatgttact

SEQ ID NO: 2544453 - DNA, 21 bp, Homo sapiens
gttcattgtaatgttactgat

SEQ ID NO: 2544454 - DNA, 22 bp, Homo sapiens
gttcattgtaatgttactgatc

SEQ ID NO: 2544455 - DNA, 19 bp, Homo sapiens
gttccaaatgaatgttgtc

SEQ ID NO: 2544456 - DNA, 18 bp, Homo sapiens
gttccactgagctccatg

SEQ ID NO: 2544457 - DNA, 14 bp, Homo sapiens
gttccagctctttg

SEQ ID NO: 2544458 - DNA, 21 bp, Homo sapiens
gttccattgtttggagacatt

SEQ ID NO: 2544459 - DNA, 21 bp, Homo sapiens
gttcccagtgacacttcagag

SEQ ID NO: 2544460 - DNA, 22 bp, Homo sapiens
gttcccagtgacacttcagaga

SEQ ID NO: 2544461 - DNA, 14 bp, Homo sapiens
gttcccatgttaaa

SEQ ID NO: 2544462 - DNA, 19 bp, Homo sapiens
gttccccatctgggtcctt

SEQ ID NO: 2544463 - DNA, 20 bp, Homo sapiens
gttcccccagccctgtggaa

SEQ ID NO: 2544464 - DNA, 15 bp, Homo sapiens
gttccccttccactg

SEQ ID NO: 2544465 - DNA, 16 bp, Homo sapiens
gttcccgtttctccac

SEQ ID NO: 2544466 - DNA, 18 bp, Homo sapiens
gttcccgtttctccacct

SEQ ID NO: 2544467 - DNA, 17 bp, Homo sapiens
gttccctctccctgttg

SEQ ID NO: 2544468 - DNA, 14 bp, Homo sapiens
gttccctctgagaa

SEQ ID NO: 2544469 - DNA, 19 bp, Homo sapiens
gttcccttggcctcagaat

SEQ ID NO: 2544470 - DNA, 21 bp, Homo sapiens
gttcccttttttggctgctga

SEQ ID NO: 2544471 - DNA, 22 bp, Homo sapiens
gttcccttttttggctgctgaa

SEQ ID NO: 2544472 - DNA, 22 bp, Homo sapiens
gttcctcattagcattttgcta

SEQ ID NO: 2544473 - DNA, 13 bp, Homo sapiens
gttcctggcaata

SEQ ID NO: 2544474 - DNA, 16 bp, Homo sapiens
gttcgactcagcctca

SEQ ID NO: 2544475 - DNA, 19 bp, Homo sapiens
gttcgagaccagcctggcc

SEQ ID NO: 2544476 - DNA, 20 bp, Homo sapiens
gttctaaagatggaaaaacc

SEQ ID NO: 2544477 - DNA, 17 bp, Homo sapiens
gttctaagtctttccat

SEQ ID NO: 2544478 - DNA, 21 bp, Homo sapiens
gttctacctcaggcagctcaa

SEQ ID NO: 2544479 - DNA, 14 bp, Homo sapiens
gttctagtctcctt

SEQ ID NO: 2544480 - DNA, 23 bp, Homo sapiens
gttctagtctcctttgcactgag

SEQ ID NO: 2544481 - DNA, 14 bp, Homo sapiens
gttctagttgcttg

SEQ ID NO: 2544482 - DNA, 14 bp, Homo sapiens
gttctagtttgcat

SEQ ID NO: 2544483 - DNA, 15 bp, Homo sapiens
gttctagtttgcatt

SEQ ID NO: 2544484 - DNA, 16 bp, Homo sapiens
gttctcactgttccct

SEQ ID NO: 2544485 - DNA, 19 bp, Homo sapiens
gttctcactgttccctctg

SEQ ID NO: 2544486 - DNA, 16 bp, Homo sapiens
gttctctgaggacact

SEQ ID NO: 2544487 - DNA, 22 bp, Homo sapiens
gttctgagattattttaatcta

SEQ ID NO: 2544488 - DNA, 18 bp, Homo sapiens
gttctgatgatgtgcctg

SEQ ID NO: 2544489 - DNA, 18 bp, Homo sapiens
gttctgattagaaatgac

SEQ ID NO: 2544490 - DNA, 20 bp, Homo sapiens
gttctgattagaaatgacca

SEQ ID NO: 2544491 - DNA, 18 bp, Homo sapiens
gttctgctcatcattctc

SEQ ID NO: 2544492 - DNA, 11 bp, Homo sapiens
gttctgctcct

SEQ ID NO: 2544493 - DNA, 16 bp, Homo sapiens
gttctgctcctctcca

SEQ ID NO: 2544494 - DNA, 21 bp, Homo sapiens
gttctggccctcacccctgcc

SEQ ID NO: 2544495 - DNA, 22 bp, Homo sapiens
gttctggctgccccaacctgct

SEQ ID NO: 2544496 - DNA, 16 bp, Homo sapiens
gttctgggacacagtt

SEQ ID NO: 2544497 - DNA, 15 bp, Homo sapiens
gttctggtgtgaact

SEQ ID NO: 2544498 - DNA, 18 bp, Homo sapiens
gttctgtcccttggagct

SEQ ID NO: 2544499 - DNA, 11 bp, Homo sapiens
gttctgtggaa

SEQ ID NO: 2544500 - DNA, 19 bp, Homo sapiens
gttctgtggttttcccctc

SEQ ID NO: 2544501 - DNA, 13 bp, Homo sapiens
gttctgtgtcttt

SEQ ID NO: 2544502 - DNA, 16 bp, Homo sapiens
gttctgttttgcctga

SEQ ID NO: 2544503 - DNA, 14 bp, Homo sapiens
gttcttaattctta

SEQ ID NO: 2544504 - DNA, 19 bp, Homo sapiens
gttcttaattgcactctaa

SEQ ID NO: 2544505 - DNA, 17 bp, Homo sapiens
gttcttagttctcactg

SEQ ID NO: 2544506 - DNA, 17 bp, Homo sapiens
gttcttcttcctgaagc

SEQ ID NO: 2544507 - DNA, 19 bp, Homo sapiens
taagttcaaattcttctga

SEQ ID NO: 2544508 - DNA, 14 bp, Homo sapiens
taagttccactgag

SEQ ID NO: 2544509 - DNA, 15 bp, Homo sapiens
taagttccactgagc

SEQ ID NO: 2544510 - DNA, 17 bp, Homo sapiens
taagttccactgagctc

SEQ ID NO: 2544511 - DNA, 23 bp, Homo sapiens
taagttctggatgcatttctctg

SEQ ID NO: 2544512 - DNA, 19 bp, Homo sapiens
taagtttcaggtgacatgt

SEQ ID NO: 2544513 - DNA, 17 bp, Homo sapiens
taagtttcagttgattt

SEQ ID NO: 2544514 - DNA, 14 bp, Homo sapiens
taagtttctcagct

SEQ ID NO: 2544515 - DNA, 18 bp, Homo sapiens
taagtttctcagctccca

SEQ ID NO: 2544516 - DNA, 12 bp, Homo sapiens
taagtttgaagg

SEQ ID NO: 2544517 - DNA, 13 bp, Homo sapiens
taataaaaagatt

SEQ ID NO: 2544518 - DNA, 14 bp, Homo sapiens
taataaaaaggcac

SEQ ID NO: 2544519 - DNA, 16 bp, Homo sapiens
taataaaataattcta

SEQ ID NO: 2544520 - DNA, 18 bp, Homo sapiens
taataaaataattctaaa

SEQ ID NO: 2544521 - DNA, 19 bp, Homo sapiens
taataaaataattctaaag

SEQ ID NO: 2544522 - DNA, 22 bp, Homo sapiens
taataaacatccttcaagaact

SEQ ID NO: 2544523 - DNA, 12 bp, Homo sapiens
taataacattac

SEQ ID NO: 2544524 - DNA, 15 bp, Homo sapiens
taataacattacctt

SEQ ID NO: 2544525 - DNA, 20 bp, Homo sapiens
taataacattaccttactgt

SEQ ID NO: 2544526 - DNA, 14 bp, Homo sapiens
taataagacataac

SEQ ID NO: 2544527 - DNA, 15 bp, Homo sapiens
taataaggttgaaca

SEQ ID NO: 2544528 - DNA, 13 bp, Homo sapiens
taataatgtgaat

SEQ ID NO: 2544529 - DNA, 17 bp, Homo sapiens
taataattattattaaa

SEQ ID NO: 2544530 - DNA, 23 bp, Homo sapiens
taatacaccactacattctgtta

SEQ ID NO: 2544531 - DNA, 18 bp, Homo sapiens
taatacagcaacaattta

SEQ ID NO: 2544532 - DNA, 16 bp, Homo sapiens
taatagaaaactgaaa

SEQ ID NO: 2544533 - DNA, 18 bp, Homo sapiens
taatagaaaactgaaaat

SEQ ID NO: 2544534 - DNA, 16 bp, Homo sapiens
taatagacaatttatt

SEQ ID NO: 2544535 - DNA, 19 bp, Homo sapiens
taatagtttacatgtagta

SEQ ID NO: 2544536 - DNA, 18 bp, Homo sapiens
taatataagaagctttca

SEQ ID NO: 2544537 - DNA, 17 bp, Homo sapiens
taatatatcccagaaat

SEQ ID NO: 2544538 - DNA, 13 bp, Homo sapiens
taatatattttct

SEQ ID NO: 2544539 - DNA, 22 bp, Homo sapiens
taatatatttttatatttagtt

SEQ ID NO: 2544540 - DNA, 23 bp, Homo sapiens
taatatcatcagtattgaagcat

SEQ ID NO: 2544541 - DNA, 12 bp, Homo sapiens
taatatgagaat

SEQ ID NO: 2544542 - DNA, 16 bp, Homo sapiens
taatatgcacacattt

SEQ ID NO: 2544543 - DNA, 16 bp, Homo sapiens
taatatggcaaaaatg

SEQ ID NO: 2544544 - DNA, 17 bp, Homo sapiens
taatatgggttcttttt

SEQ ID NO: 2544545 - DNA, 20 bp, Homo sapiens
taatatgttaacctcagtgt

SEQ ID NO: 2544546 - DNA, 23 bp, Homo sapiens
taatatgttaacctcagtgtcat

SEQ ID NO: 2544547 - DNA, 16 bp, Homo sapiens
taatattcattgtata

SEQ ID NO: 2544548 - DNA, 16 bp, Homo sapiens
taatattcctcagttc

SEQ ID NO: 2544549 - DNA, 16 bp, Homo sapiens
taatattgtggtgcca

SEQ ID NO: 2544550 - DNA, 23 bp, Homo sapiens
taatatttatgtctatttaagcc

SEQ ID NO: 2544551 - DNA, 15 bp, Homo sapiens
taatatttttaatta

SEQ ID NO: 2544552 - DNA, 16 bp, Homo sapiens
taatcaataaacgatt

SEQ ID NO: 2544553 - DNA, 17 bp, Homo sapiens
taatcacgctttcctga

SEQ ID NO: 2544554 - DNA, 16 bp, Homo sapiens
taatcacttttttcca

SEQ ID NO: 2544555 - DNA, 13 bp, Homo sapiens
taatcagcctctt

SEQ ID NO: 2544556 - DNA, 14 bp, Homo sapiens
taatcagcctctta

SEQ ID NO: 2544557 - DNA, 22 bp, Homo sapiens
taatcaggtcctcagagaattt

SEQ ID NO: 2544558 - DNA, 13 bp, Homo sapiens
taatcatgaatgt

SEQ ID NO: 2544559 - DNA, 16 bp, Homo sapiens
taatcatgaatgtgta

SEQ ID NO: 2544560 - DNA, 19 bp, Homo sapiens
taatccctgggcattgctt

SEQ ID NO: 2544561 - DNA, 19 bp, Homo sapiens
taatccgaatctctttttg

SEQ ID NO: 2544562 - DNA, 19 bp, Homo sapiens
taatctattgggttcatta

SEQ ID NO: 2544563 - DNA, 17 bp, Homo sapiens
taatctcgtttcaaaaa

SEQ ID NO: 2544564 - DNA, 21 bp, Homo sapiens
taatctgatggcttctccagg

SEQ ID NO: 2544565 - DNA, 21 bp, Homo sapiens
taatctgcaaagaatgagaag

SEQ ID NO: 2544566 - DNA, 19 bp, Homo sapiens
taatctggactcctctgtc

SEQ ID NO: 2544567 - DNA, 20 bp, Homo sapiens
taatctggactcctctgtcc

SEQ ID NO: 2544568 - DNA, 17 bp, Homo sapiens
taatctgggaagggaag

SEQ ID NO: 2544569 - DNA, 20 bp, Homo sapiens
taatctgtagggctggacct

SEQ ID NO: 2544570 - DNA, 19 bp, Homo sapiens
taatctgtgtacaaagaaa

SEQ ID NO: 2544571 - DNA, 18 bp, Homo sapiens
taatctttctttacctga

SEQ ID NO: 2544572 - DNA, 23 bp, Homo sapiens
taatctttctttacctgagacca

SEQ ID NO: 2544573 - DNA, 12 bp, Homo sapiens
taatctttgggt

SEQ ID NO: 2544574 - DNA, 15 bp, Homo sapiens
taatcttttcacaaa

SEQ ID NO: 2544575 - DNA, 19 bp, Homo sapiens
taatcttttcacaaataaa

SEQ ID NO: 2544576 - DNA, 23 bp, Homo sapiens
taatgaaagactgtacaaagtag

SEQ ID NO: 2544577 - DNA, 14 bp, Homo sapiens
taatgaaatatctg

SEQ ID NO: 2544578 - DNA, 16 bp, Homo sapiens
taatgaagaaagtgga

SEQ ID NO: 2544579 - DNA, 17 bp, Homo sapiens
taatgaagaaagtggaa

SEQ ID NO: 2544580 - DNA, 18 bp, Homo sapiens
taatgaatctaagcagca

SEQ ID NO: 2544581 - DNA, 17 bp, Homo sapiens
taatgaatgaaacattt

SEQ ID NO: 2544582 - DNA, 15 bp, Homo sapiens
taatgaatgcataaa

SEQ ID NO: 2544583 - DNA, 15 bp, Homo sapiens
taatgaatggactca

SEQ ID NO: 2544584 - DNA, 16 bp, Homo sapiens
taatgaatttttatga

SEQ ID NO: 2544585 - DNA, 21 bp, Homo sapiens
taatgaatttttatgatattc

SEQ ID NO: 2544586 - DNA, 15 bp, Homo sapiens
taatgccttactctt

SEQ ID NO: 2544587 - DNA, 16 bp, Homo sapiens
taatgctacgtgtgat

SEQ ID NO: 2544588 - DNA, 15 bp, Homo sapiens
taatgctactgtctc

SEQ ID NO: 2544589 - DNA, 19 bp, Homo sapiens
taatgcttagagaatgttc

SEQ ID NO: 2544590 - DNA, 21 bp, Homo sapiens
taatgcttctttcattttctg

SEQ ID NO: 2544591 - DNA, 18 bp, Homo sapiens
taatgggcttagagcagt

SEQ ID NO: 2544592 - DNA, 15 bp, Homo sapiens
taatggggcggtgag

SEQ ID NO: 2544593 - DNA, 20 bp, Homo sapiens
taatgggggtagcagctgga

SEQ ID NO: 2544594 - DNA, 21 bp, Homo sapiens
taatgggggtagcagctggac

SEQ ID NO: 2544595 - DNA, 14 bp, Homo sapiens
taatggtaccagat

SEQ ID NO: 2544596 - DNA, 21 bp, Homo sapiens
taatggtcccatccaggcagt

SEQ ID NO: 2544597 - DNA, 17 bp, Homo sapiens
taatgtaaaatgttgaa

SEQ ID NO: 2544598 - DNA, 15 bp, Homo sapiens
taatgtacatctggc

SEQ ID NO: 2544599 - DNA, 17 bp, Homo sapiens
taatgtcacaggcaggt

SEQ ID NO: 2544600 - DNA, 13 bp, Homo sapiens
taatgtcttcatt

SEQ ID NO: 2544601 - DNA, 21 bp, Homo sapiens
taatgtcttcatttcattgta

SEQ ID NO: 2544602 - DNA, 13 bp, Homo sapiens
taatgtgaagtgt

SEQ ID NO: 2544603 - DNA, 12 bp, Homo sapiens
taatgtgctgtg

SEQ ID NO: 2544604 - DNA, 19 bp, Homo sapiens
taatgtgctgtgtaaagtt

SEQ ID NO: 2544605 - DNA, 21 bp, Homo sapiens
taatgtgctgtgtaaagttag

SEQ ID NO: 2544606 - DNA, 19 bp, Homo sapiens
taatgtgtattacaaatat

SEQ ID NO: 2544607 - DNA, 18 bp, Homo sapiens
taatgttaaatttgtaag

SEQ ID NO: 2544608 - DNA, 22 bp, Homo sapiens
taatgttaaatttgtaagtttc

SEQ ID NO: 2544609 - DNA, 15 bp, Homo sapiens
taatgttaattcagc

SEQ ID NO: 2544610 - DNA, 12 bp, Homo sapiens
taatgttactga

SEQ ID NO: 2544611 - DNA, 21 bp, Homo sapiens
taatgttactgatcatgcatt

SEQ ID NO: 2544612 - DNA, 23 bp, Homo sapiens
taatgttactgatcatgcattgt

SEQ ID NO: 2544613 - DNA, 14 bp, Homo sapiens
taatgttgttattt

SEQ ID NO: 2544614 - DNA, 13 bp, Homo sapiens
taatgtttgctat

SEQ ID NO: 2544615 - DNA, 14 bp, Homo sapiens
taattaagtactat

SEQ ID NO: 2544616 - DNA, 17 bp, Homo sapiens
taattacatatttgcat

SEQ ID NO: 2544617 - DNA, 17 bp, Homo sapiens
taattaccaacctgtta

SEQ ID NO: 2544618 - DNA, 18 bp, Homo sapiens
taattatcgggaacagtg

SEQ ID NO: 2544619 - DNA, 20 bp, Homo sapiens
taattatcgggaacagtgtt

SEQ ID NO: 2544620 - DNA, 13 bp, Homo sapiens
taattatgacagt

SEQ ID NO: 2544621 - DNA, 12 bp, Homo sapiens
taattcaaagca

SEQ ID NO: 2544622 - DNA, 21 bp, Homo sapiens
taattcaaagcaccaaaataa

SEQ ID NO: 2544623 - DNA, 22 bp, Homo sapiens
taattcaaagctctattaagat

SEQ ID NO: 2544624 - DNA, 18 bp, Homo sapiens
taattcaccaaagtattt

SEQ ID NO: 2544625 - DNA, 15 bp, Homo sapiens
taattcatgtttctt

SEQ ID NO: 2544626 - DNA, 10 bp, Homo sapiens
taattccatg

SEQ ID NO: 2544627 - DNA, 18 bp, Homo sapiens
taattcccattttgcaaa

SEQ ID NO: 2544628 - DNA, 15 bp, Homo sapiens
taattccctatcttt

SEQ ID NO: 2544629 - DNA, 12 bp, Homo sapiens
taattctaaagg

SEQ ID NO: 2544630 - DNA, 13 bp, Homo sapiens
taattctaaggaa

SEQ ID NO: 2544631 - DNA, 21 bp, Homo sapiens
taattctaaggaatatgagct

SEQ ID NO: 2544632 - DNA, 12 bp, Homo sapiens
taattctcaggc

SEQ ID NO: 2544633 - DNA, 12 bp, Homo sapiens
taattctcttga

SEQ ID NO: 2544634 - DNA, 13 bp, Homo sapiens
taattctcttgaa

SEQ ID NO: 2544635 - DNA, 16 bp, Homo sapiens
taattctctttcaaag

SEQ ID NO: 2544636 - DNA, 10 bp, Homo sapiens
taattctgta

SEQ ID NO: 2544637 - DNA, 12 bp, Homo sapiens
taattctgtaaa

SEQ ID NO: 2544638 - DNA, 12 bp, Homo sapiens
taattctgtaca

SEQ ID NO: 2544639 - DNA, 14 bp, Homo sapiens
taattctgtactga

SEQ ID NO: 2544640 - DNA, 17 bp, Homo sapiens
taattctgtactgattt

SEQ ID NO: 2544641 - DNA, 23 bp, Homo sapiens
taattctgtactgatttttgtaa

SEQ ID NO: 2544642 - DNA, 14 bp, Homo sapiens
taattgatttcaag

SEQ ID NO: 2544643 - DNA, 16 bp, Homo sapiens
taattgcttacatttt

SEQ ID NO: 2544644 - DNA, 21 bp, Homo sapiens
taattgcttacatttttacaa

SEQ ID NO: 2544645 - DNA, 20 bp, Homo sapiens
taattggaagaaattcctgt

SEQ ID NO: 2544646 - DNA, 18 bp, Homo sapiens
taattggtccgatctttg

SEQ ID NO: 2544647 - DNA, 13 bp, Homo sapiens
taattgtatcgta

SEQ ID NO: 2544648 - DNA, 23 bp, Homo sapiens
taattgtatcgtatagctgtatt

SEQ ID NO: 2544649 - DNA, 21 bp, Homo sapiens
taattgtgaaaaagttaaaca

SEQ ID NO: 2544650 - DNA, 15 bp, Homo sapiens
taattgttgtttgta

SEQ ID NO: 2544651 - DNA, 15 bp, Homo sapiens
taatttaaaaaataa

SEQ ID NO: 2544652 - DNA, 15 bp, Homo sapiens
taatttaaaattgtg

SEQ ID NO: 2544653 - DNA, 23 bp, Homo sapiens
tagagggaggagaatgagcctcg

SEQ ID NO: 2544654 - DNA, 23 bp, Homo sapiens
tagaggggggatttccagccagg

SEQ ID NO: 2544655 - DNA, 13 bp, Homo sapiens
tagagggttcctg

SEQ ID NO: 2544656 - DNA, 16 bp, Homo sapiens
tagaggttcaaagata

SEQ ID NO: 2544657 - DNA, 19 bp, Homo sapiens
tagaggttttgttgtttta

SEQ ID NO: 2544658 - DNA, 21 bp, Homo sapiens
tagagtagaagatttgatgct

SEQ ID NO: 2544659 - DNA, 16 bp, Homo sapiens
tagagtgttgttgaga

SEQ ID NO: 2544660 - DNA, 19 bp, Homo sapiens
tagagttaagaagctgttg

SEQ ID NO: 2544661 - DNA, 17 bp, Homo sapiens
tagagttgatactacag

SEQ ID NO: 2544662 - DNA, 18 bp, Homo sapiens
tagataaataaatatatg

SEQ ID NO: 2544663 - DNA, 18 bp, Homo sapiens
tagatacatgctttttaa

SEQ ID NO: 2544664 - DNA, 16 bp, Homo sapiens
tagataggtaaatacc

SEQ ID NO: 2544665 - DNA, 19 bp, Homo sapiens
tagatatatgctctgcatg

SEQ ID NO: 2544666 - DNA, 19 bp, Homo sapiens
tagatatccacttgagaca

SEQ ID NO: 2544667 - DNA, 14 bp, Homo sapiens
tagatcaaatactt

SEQ ID NO: 2544668 - DNA, 23 bp, Homo sapiens
tagatcaaatactttaaaggaaa

SEQ ID NO: 2544669 - DNA, 16 bp, Homo sapiens
tagatcaccagaataa

SEQ ID NO: 2544670 - DNA, 20 bp, Homo sapiens
tagatgctgatgatttgttt

SEQ ID NO: 2544671 - DNA, 13 bp, Homo sapiens
tagatgggaatga

SEQ ID NO: 2544672 - DNA, 15 bp, Homo sapiens
tagatgggaatgaag

SEQ ID NO: 2544673 - DNA, 22 bp, Homo sapiens
tagatgggaatgaagcttgtgt

SEQ ID NO: 2544674 - DNA, 22 bp, Homo sapiens
tagatgggtctggctgagctga

SEQ ID NO: 2544675 - DNA, 23 bp, Homo sapiens
tagatgtagataaactcagaaat

SEQ ID NO: 2544676 - DNA, 18 bp, Homo sapiens
tagatgtccctttcttgg

SEQ ID NO: 2544677 - DNA, 21 bp, Homo sapiens
tagatgtccctttcttggcca

SEQ ID NO: 2544678 - DNA, 22 bp, Homo sapiens
tagatgtccctttcttggccag

SEQ ID NO: 2544679 - DNA, 15 bp, Homo sapiens
tagatgtgatttaat

SEQ ID NO: 2544680 - DNA, 19 bp, Homo sapiens
tagatgtgatttaatagtg

SEQ ID NO: 2544681 - DNA, 11 bp, Homo sapiens
tagatgtgtgg

SEQ ID NO: 2544682 - DNA, 18 bp, Homo sapiens
tagattagctctggacca

SEQ ID NO: 2544683 - DNA, 23 bp, Homo sapiens
tagattccccattgcctcctcct

SEQ ID NO: 2544684 - DNA, 15 bp, Homo sapiens
tagatttatttcatc

SEQ ID NO: 2544685 - DNA, 22 bp, Homo sapiens
tagattttagaccctattgctg

SEQ ID NO: 2544686 - DNA, 19 bp, Homo sapiens
tagattttctttaaaagaa

SEQ ID NO: 2544687 - DNA, 22 bp, Homo sapiens
tagcaaaacgcatggagtgtgt

SEQ ID NO: 2544688 - DNA, 23 bp, Homo sapiens
tagcaaaacgcatggagtgtgta

SEQ ID NO: 2544689 - DNA, 21 bp, Homo sapiens
tagcaaaattcttaagtatgt

SEQ ID NO: 2544690 - DNA, 12 bp, Homo sapiens
tagcaaatacat

SEQ ID NO: 2544691 - DNA, 21 bp, Homo sapiens
tagcaaatgttttgacatgaa

SEQ ID NO: 2544692 - DNA, 18 bp, Homo sapiens
tagcaagttacagtgatg

SEQ ID NO: 2544693 - DNA, 17 bp, Homo sapiens
tagcaatcacaacactg

SEQ ID NO: 2544694 - DNA, 15 bp, Homo sapiens
tagcacagaccctgc

SEQ ID NO: 2544695 - DNA, 16 bp, Homo sapiens
tagcacagaccctgcc

SEQ ID NO: 2544696 - DNA, 20 bp, Homo sapiens
tagcacagaccctgccctgt

SEQ ID NO: 2544697 - DNA, 21 bp, Homo sapiens
tagcacagaccctgccctgtg

SEQ ID NO: 2544698 - DNA, 18 bp, Homo sapiens
tagcacaggggggccgcc

SEQ ID NO: 2544699 - DNA, 13 bp, Homo sapiens
tagcaccagggac

SEQ ID NO: 2544700 - DNA, 16 bp, Homo sapiens
tagcactttgggaggc

SEQ ID NO: 2544701 - DNA, 23 bp, Homo sapiens
tagcagagaatgaaagggcccag

SEQ ID NO: 2544702 - DNA, 14 bp, Homo sapiens
tagcagattttaat

SEQ ID NO: 2544703 - DNA, 18 bp, Homo sapiens
tagcagattttaattttg

SEQ ID NO: 2544704 - DNA, 14 bp, Homo sapiens
tagcagctatctct

SEQ ID NO: 2544705 - DNA, 11 bp, Homo sapiens
tagcagctgga

SEQ ID NO: 2544706 - DNA, 12 bp, Homo sapiens
tagcagctggac

SEQ ID NO: 2544707 - DNA, 17 bp, Homo sapiens
tagcaggagaggagagc

SEQ ID NO: 2544708 - DNA, 19 bp, Homo sapiens
tagcatacgtacacatttt

SEQ ID NO: 2544709 - DNA, 12 bp, Homo sapiens
tagcatatcaat

SEQ ID NO: 2544710 - DNA, 22 bp, Homo sapiens
tagcatcttctggagtctccag

SEQ ID NO: 2544711 - DNA, 16 bp, Homo sapiens
tagcatgacaagcccc

SEQ ID NO: 2544712 - DNA, 17 bp, Homo sapiens
tagcatgacaagcccca

SEQ ID NO: 2544713 - DNA, 20 bp, Homo sapiens
tagcatgacaagccccaggc

SEQ ID NO: 2544714 - DNA, 16 bp, Homo sapiens
tagcatgtttgctgaa

SEQ ID NO: 2544715 - DNA, 12 bp, Homo sapiens
tagcattaacta

SEQ ID NO: 2544716 - DNA, 22 bp, Homo sapiens
tagcatttagtccaatgtcttt

SEQ ID NO: 2544717 - DNA, 16 bp, Homo sapiens
tagcatttcattcttc

SEQ ID NO: 2544718 - DNA, 20 bp, Homo sapiens
tagccaaggtgggctgagcc

SEQ ID NO: 2544719 - DNA, 21 bp, Homo sapiens
tagccaaggtgggctgagccc

SEQ ID NO: 2544720 - DNA, 20 bp, Homo sapiens
tagccacaaaattgggaaag

SEQ ID NO: 2544721 - DNA, 19 bp, Homo sapiens
tagccagcacttgtatata

SEQ ID NO: 2544722 - DNA, 14 bp, Homo sapiens
tagccagctgctcc

SEQ ID NO: 2544723 - DNA, 13 bp, Homo sapiens
tagccaggatcat

SEQ ID NO: 2544724 - DNA, 15 bp, Homo sapiens
tagccaggatcatgg

SEQ ID NO: 2544725 - DNA, 18 bp, Homo sapiens
tagccaggatcatggtgt

SEQ ID NO: 2544726 - DNA, 23 bp, Homo sapiens
tagccaggatcatggtgtaataa

SEQ ID NO: 2544727 - DNA, 13 bp, Homo sapiens
tagccatgggacc

SEQ ID NO: 2544728 - DNA, 14 bp, Homo sapiens
tagccatgggacca

SEQ ID NO: 2544729 - DNA, 18 bp, Homo sapiens
tagccattcctggtaccc

SEQ ID NO: 2544730 - DNA, 19 bp, Homo sapiens
tagccattcctggtaccca

SEQ ID NO: 2544731 - DNA, 22 bp, Homo sapiens
tagccattcctggtacccagcc

SEQ ID NO: 2544732 - DNA, 18 bp, Homo sapiens
tagcccccaggctgctgg

SEQ ID NO: 2544733 - DNA, 16 bp, Homo sapiens
tagcccgaatacaaac

SEQ ID NO: 2544734 - DNA, 19 bp, Homo sapiens
tagcccgcctgccagtcct

SEQ ID NO: 2544735 - DNA, 20 bp, Homo sapiens
tagcccgcctgccagtccta

SEQ ID NO: 2544736 - DNA, 15 bp, Homo sapiens
tagccctttctgtgt

SEQ ID NO: 2544737 - DNA, 13 bp, Homo sapiens
tagccgacctcag

SEQ ID NO: 2544738 - DNA, 15 bp, Homo sapiens
tagccgacctcagcc

SEQ ID NO: 2544739 - DNA, 20 bp, Homo sapiens
tagcctaatacaacatgtag

SEQ ID NO: 2544740 - DNA, 16 bp, Homo sapiens
tagcctaggtgacaga

SEQ ID NO: 2544741 - DNA, 12 bp, Homo sapiens
tagcctccctga

SEQ ID NO: 2544742 - DNA, 17 bp, Homo sapiens
tagcctcctgacctgag

SEQ ID NO: 2544743 - DNA, 22 bp, Homo sapiens
tagcctggatattattcttgta

SEQ ID NO: 2544744 - DNA, 15 bp, Homo sapiens
tagctacaggaagca

SEQ ID NO: 2544745 - DNA, 14 bp, Homo sapiens
tagctagaggaacc

SEQ ID NO: 2544746 - DNA, 15 bp, Homo sapiens
tagctagaggaacca

SEQ ID NO: 2544747 - DNA, 16 bp, Homo sapiens
tagctatatccatgta

SEQ ID NO: 2544748 - DNA, 21 bp, Homo sapiens
tagctatatccatgtactgta

SEQ ID NO: 2544749 - DNA, 15 bp, Homo sapiens
tagctatatctatat

SEQ ID NO: 2544750 - DNA, 16 bp, Homo sapiens
tagctatcagaagacc

SEQ ID NO: 2544751 - DNA, 16 bp, Homo sapiens
tagctcaggtgtccct

SEQ ID NO: 2544752 - DNA, 21 bp, Homo sapiens
tagctcaggtgtccctgcact

SEQ ID NO: 2544753 - DNA, 12 bp, Homo sapiens
tagctcagttta

SEQ ID NO: 2544754 - DNA, 14 bp, Homo sapiens
tagctcccctcctc

SEQ ID NO: 2544755 - DNA, 20 bp, Homo sapiens
tagctcccctcctctcccct

SEQ ID NO: 2544756 - DNA, 21 bp, Homo sapiens
tagctctaggagggctggcaa

SEQ ID NO: 2544757 - DNA, 23 bp, Homo sapiens
tagctgacccagccccttgagaa

SEQ ID NO: 2544758 - DNA, 16 bp, Homo sapiens
tagctgctacaaagaa

SEQ ID NO: 2544759 - DNA, 23 bp, Homo sapiens
tagctgctacaaagaagacatgt

SEQ ID NO: 2544760 - DNA, 19 bp, Homo sapiens
tagctggaactacaggctc

SEQ ID NO: 2544761 - DNA, 12 bp, Homo sapiens
tagctgggacta

SEQ ID NO: 2544762 - DNA, 19 bp, Homo sapiens
tagctgggactacaggcac

SEQ ID NO: 2544763 - DNA, 22 bp, Homo sapiens
tagctggtcttatttgtaaagc

SEQ ID NO: 2544764 - DNA, 13 bp, Homo sapiens
tagctgtgggggt

SEQ ID NO: 2544765 - DNA, 17 bp, Homo sapiens
tagctgttatttctatt

SEQ ID NO: 2544766 - DNA, 13 bp, Homo sapiens
tagctgttgagct

SEQ ID NO: 2544767 - DNA, 15 bp, Homo sapiens
tagcttagacctcag

SEQ ID NO: 2544768 - DNA, 13 bp, Homo sapiens
tagcttagagcct

SEQ ID NO: 2544769 - DNA, 17 bp, Homo sapiens
tagcttagagcctccct

SEQ ID NO: 2544770 - DNA, 21 bp, Homo sapiens
tagcttcaccccaatcccagc

SEQ ID NO: 2544771 - DNA, 12 bp, Homo sapiens
tagcttccatga

SEQ ID NO: 2544772 - DNA, 19 bp, Homo sapiens
tagcttgaaggatctgttt

SEQ ID NO: 2544773 - DNA, 19 bp, Homo sapiens
tagcttgcgcattctcatg

SEQ ID NO: 2544774 - DNA, 17 bp, Homo sapiens
tagcttgtatagtgtaa

SEQ ID NO: 2544775 - DNA, 15 bp, Homo sapiens
tagcttgttccctgt

SEQ ID NO: 2544776 - DNA, 19 bp, Homo sapiens
tagctttcccaaataaact

SEQ ID NO: 2544777 - DNA, 14 bp, Homo sapiens
tagctttgctctgc

SEQ ID NO: 2544778 - DNA, 16 bp, Homo sapiens
tagctttgctctgcca

SEQ ID NO: 2544779 - DNA, 14 bp, Homo sapiens
tagcttttattgta

SEQ ID NO: 2544780 - DNA, 13 bp, Homo sapiens
tagcttttccctt

SEQ ID NO: 2544781 - DNA, 16 bp, Homo sapiens
tagctttttaattgtt

SEQ ID NO: 2544782 - DNA, 17 bp, Homo sapiens
taggaaaagtacattta

SEQ ID NO: 2544783 - DNA, 17 bp, Homo sapiens
taggaaataaaaccttt

SEQ ID NO: 2544784 - DNA, 19 bp, Homo sapiens
taggaaataaaacctttca

SEQ ID NO: 2544785 - DNA, 13 bp, Homo sapiens
taggaagaatttt

SEQ ID NO: 2544786 - DNA, 17 bp, Homo sapiens
taggaagaattttaaaa

SEQ ID NO: 2544787 - DNA, 18 bp, Homo sapiens
taggaagaattttaaaaa

SEQ ID NO: 2544788 - DNA, 15 bp, Homo sapiens
taggaagactttgga

SEQ ID NO: 2544789 - DNA, 15 bp, Homo sapiens
taggaagagaaacca

SEQ ID NO: 2544790 - DNA, 15 bp, Homo sapiens
taggaaggttaatgt

SEQ ID NO: 2544791 - DNA, 20 bp, Homo sapiens
taggaagtgtaacagctgag

SEQ ID NO: 2544792 - DNA, 14 bp, Homo sapiens
taggaatcagcaag

SEQ ID NO: 2544793 - DNA, 21 bp, Homo sapiens
taggaattcccagcccaaagc

SEQ ID NO: 2544794 - DNA, 14 bp, Homo sapiens
taggactctgaggc

SEQ ID NO: 2544795 - DNA, 15 bp, Homo sapiens
taggactctgaggct

SEQ ID NO: 2544796 - DNA, 11 bp, Homo sapiens
taggagcctgc

SEQ ID NO: 2544797 - DNA, 15 bp, Homo sapiens
taggagcctgctggt

SEQ ID NO: 2544798 - DNA, 21 bp, Homo sapiens
tatggtaggaactgctgggct

SEQ ID NO: 2544799 - DNA, 20 bp, Homo sapiens
tatggtataatggttgactg

SEQ ID NO: 2544800 - DNA, 20 bp, Homo sapiens
tatggtcatctttttctcta

SEQ ID NO: 2544801 - DNA, 22 bp, Homo sapiens
tatgtaaaaggccaaacctctg

SEQ ID NO: 2544802 - DNA, 23 bp, Homo sapiens
tatgtaaaaggccaaacctctgt

SEQ ID NO: 2544803 - DNA, 17 bp, Homo sapiens
tatgtaaaatgttttag

SEQ ID NO: 2544804 - DNA, 18 bp, Homo sapiens
tatgtaaagtatgtaaac

SEQ ID NO: 2544805 - DNA, 12 bp, Homo sapiens
tatgtaacatgt

SEQ ID NO: 2544806 - DNA, 15 bp, Homo sapiens
tatgtaagagcacct

SEQ ID NO: 2544807 - DNA, 16 bp, Homo sapiens
tatgtaagagcacctt

SEQ ID NO: 2544808 - DNA, 16 bp, Homo sapiens
tatgtacgtttgtatg

SEQ ID NO: 2544809 - DNA, 20 bp, Homo sapiens
tatgtactcctctttacact

SEQ ID NO: 2544810 - DNA, 21 bp, Homo sapiens
tatgtactcctctttacactg

SEQ ID NO: 2544811 - DNA, 21 bp, Homo sapiens
tatgtagcaggaaataaagta

SEQ ID NO: 2544812 - DNA, 17 bp, Homo sapiens
tatgtatgtttacatat

SEQ ID NO: 2544813 - DNA, 19 bp, Homo sapiens
tatgtattaatattcattg

SEQ ID NO: 2544814 - DNA, 18 bp, Homo sapiens
tatgtattgtaaacatgt

SEQ ID NO: 2544815 - DNA, 15 bp, Homo sapiens
tatgtcatcatacat

SEQ ID NO: 2544816 - DNA, 23 bp, Homo sapiens
tatgtcatttccttcaaggcatc

SEQ ID NO: 2544817 - DNA, 15 bp, Homo sapiens
tatgtcccttgctgt

SEQ ID NO: 2544818 - DNA, 15 bp, Homo sapiens
tatgtctatttaagc

SEQ ID NO: 2544819 - DNA, 14 bp, Homo sapiens
tatgtctcttctga

SEQ ID NO: 2544820 - DNA, 17 bp, Homo sapiens
tatgtcttggacactgt

SEQ ID NO: 2544821 - DNA, 22 bp, Homo sapiens
tatgtgaatatggactcagttt

SEQ ID NO: 2544822 - DNA, 22 bp, Homo sapiens
tatgtgaatgatctctctgaat

SEQ ID NO: 2544823 - DNA, 21 bp, Homo sapiens
tatgtgattttaactctgtct

SEQ ID NO: 2544824 - DNA, 19 bp, Homo sapiens
tatgtgggggtctgtgtgt

SEQ ID NO: 2544825 - DNA, 12 bp, Homo sapiens
tatgtgtatgta

SEQ ID NO: 2544826 - DNA, 12 bp, Homo sapiens
tatgtgtgtata

SEQ ID NO: 2544827 - DNA, 19 bp, Homo sapiens
tatgtgtgtatatgtatgt

SEQ ID NO: 2544828 - DNA, 12 bp, Homo sapiens
tatgtgtgtgta

SEQ ID NO: 2544829 - DNA, 19 bp, Homo sapiens
tatgtgtgtgtatgctact

SEQ ID NO: 2544830 - DNA, 17 bp, Homo sapiens
tatgtgtgtttaaataa

SEQ ID NO: 2544831 - DNA, 19 bp, Homo sapiens
tatgttacatctgttttaa

SEQ ID NO: 2544832 - DNA, 13 bp, Homo sapiens
tatgttcactgtc

SEQ ID NO: 2544833 - DNA, 14 bp, Homo sapiens
tatgttgataaaag

SEQ ID NO: 2544834 - DNA, 15 bp, Homo sapiens
tatgttgatgaaaaa

SEQ ID NO: 2544835 - DNA, 20 bp, Homo sapiens
tatgttgcccaggcaggtct

SEQ ID NO: 2544836 - DNA, 21 bp, Homo sapiens
tatgttgcccaggcaggtctt

SEQ ID NO: 2544837 - DNA, 14 bp, Homo sapiens
tatgttgcctttat

SEQ ID NO: 2544838 - DNA, 18 bp, Homo sapiens
tatgttgcctttatggtt

SEQ ID NO: 2544839 - DNA, 14 bp, Homo sapiens
tatgttgctcagtc

SEQ ID NO: 2544840 - DNA, 18 bp, Homo sapiens
tatgtttatttactaatt

SEQ ID NO: 2544841 - DNA, 17 bp, Homo sapiens
tatgttttaagaggcag

SEQ ID NO: 2544842 - DNA, 14 bp, Homo sapiens
tatgtttttgtgta

SEQ ID NO: 2544843 - DNA, 18 bp, Homo sapiens
tatgtttttgtgtatttg

SEQ ID NO: 2544844 - DNA, 16 bp, Homo sapiens
tatgtttttgttcaaa

SEQ ID NO: 2544845 - DNA, 16 bp, Homo sapiens
tattaaaaatctcaaa

SEQ ID NO: 2544846 - DNA, 22 bp, Homo sapiens
tattaaaaatctcaaatttcta

SEQ ID NO: 2544847 - DNA, 10 bp, Homo sapiens
tattaaaatc

SEQ ID NO: 2544848 - DNA, 18 bp, Homo sapiens
tattaaaatgattgtaaa

SEQ ID NO: 2544849 - DNA, 19 bp, Homo sapiens
tattaaaatgattgtaaaa

SEQ ID NO: 2544850 - DNA, 20 bp, Homo sapiens
tattaaaatgattgtaaaat

SEQ ID NO: 2544851 - DNA, 12 bp, Homo sapiens
tattaaagacag

SEQ ID NO: 2544852 - DNA, 13 bp, Homo sapiens
tattaaatacaga

SEQ ID NO: 2544853 - DNA, 21 bp, Homo sapiens
tattaaatacagacactaagt

SEQ ID NO: 2544854 - DNA, 15 bp, Homo sapiens
tattaaatgcccagc

SEQ ID NO: 2544855 - DNA, 12 bp, Homo sapiens
tattaaattatg

SEQ ID NO: 2544856 - DNA, 16 bp, Homo sapiens
tattaacaaattatgt

SEQ ID NO: 2544857 - DNA, 24 bp, Homo sapiens
tattaagaaagactatctaaatgt

SEQ ID NO: 2544858 - DNA, 13 bp, Homo sapiens
tattaagaatgaa

SEQ ID NO: 2544859 - DNA, 14 bp, Homo sapiens
tattaagagtgaaa

SEQ ID NO: 2544860 - DNA, 13 bp, Homo sapiens
tattaagatggat

SEQ ID NO: 2544861 - DNA, 20 bp, Homo sapiens
tattaagatggattctcaga

SEQ ID NO: 2544862 - DNA, 20 bp, Homo sapiens
tattaatattcattgtataa

SEQ ID NO: 2544863 - DNA, 12 bp, Homo sapiens
tattaatgcact

SEQ ID NO: 2544864 - DNA, 17 bp, Homo sapiens
tattaatgcactttcta

SEQ ID NO: 2544865 - DNA, 12 bp, Homo sapiens
tattacatcttt

SEQ ID NO: 2544866 - DNA, 16 bp, Homo sapiens
tattacatggcagtgt

SEQ ID NO: 2544867 - DNA, 16 bp, Homo sapiens
tattaccacagacata

SEQ ID NO: 2544868 - DNA, 14 bp, Homo sapiens
tattacctctgata

SEQ ID NO: 2544869 - DNA, 19 bp, Homo sapiens
tattacctctgatacctca

SEQ ID NO: 2544870 - DNA, 22 bp, Homo sapiens
tattactaaggagtaatctgtg

SEQ ID NO: 2544871 - DNA, 21 bp, Homo sapiens
tattactagaagatgaataca

SEQ ID NO: 2544872 - DNA, 21 bp, Homo sapiens
tattactgtttgtcttctccc

SEQ ID NO: 2544873 - DNA, 15 bp, Homo sapiens
tattagatgtgattt

SEQ ID NO: 2544874 - DNA, 13 bp, Homo sapiens
tattagccaggat

SEQ ID NO: 2544875 - DNA, 19 bp, Homo sapiens
tattagccaggatcatggt

SEQ ID NO: 2544876 - DNA, 16 bp, Homo sapiens
tattagctttactgtt

SEQ ID NO: 2544877 - DNA, 21 bp, Homo sapiens
tattagtactgctcttgtttc

SEQ ID NO: 2544878 - DNA, 16 bp, Homo sapiens
tattagtgatgtcatc

SEQ ID NO: 2544879 - DNA, 20 bp, Homo sapiens
tattataaattatgtttata

SEQ ID NO: 2544880 - DNA, 16 bp, Homo sapiens
tattataacttaaaaa

SEQ ID NO: 2544881 - DNA, 19 bp, Homo sapiens
tattataatttttttcaat

SEQ ID NO: 2544882 - DNA, 14 bp, Homo sapiens
tattataccttttt

SEQ ID NO: 2544883 - DNA, 14 bp, Homo sapiens
tattatactgtatt

SEQ ID NO: 2544884 - DNA, 19 bp, Homo sapiens
tattattacttatttttga

SEQ ID NO: 2544885 - DNA, 16 bp, Homo sapiens
tattattcccattcta

SEQ ID NO: 2544886 - DNA, 13 bp, Homo sapiens
tattattctgcag

SEQ ID NO: 2544887 - DNA, 15 bp, Homo sapiens
tattattgaaattgt

SEQ ID NO: 2544888 - DNA, 16 bp, Homo sapiens
tattatttcaatgtga

SEQ ID NO: 2544889 - DNA, 22 bp, Homo sapiens
tattatttctaggaagaatttt

SEQ ID NO: 2544890 - DNA, 16 bp, Homo sapiens
tattattttcacctgt

SEQ ID NO: 2544891 - DNA, 17 bp, Homo sapiens
tattattttttccacat

SEQ ID NO: 2544892 - DNA, 15 bp, Homo sapiens
tattcaaacagtctc

SEQ ID NO: 2544893 - DNA, 16 bp, Homo sapiens
tattcaagttattgta

SEQ ID NO: 2544894 - DNA, 18 bp, Homo sapiens
tattcaattcctctggga

SEQ ID NO: 2544895 - DNA, 18 bp, Homo sapiens
tattcagacaagcaacag

SEQ ID NO: 2544896 - DNA, 22 bp, Homo sapiens
tattcagacaagcaacaggttt

SEQ ID NO: 2544897 - DNA, 18 bp, Homo sapiens
tattcaggaagctcaggg

SEQ ID NO: 2544898 - DNA, 14 bp, Homo sapiens
tattcagtaaaaaa

SEQ ID NO: 2544899 - DNA, 20 bp, Homo sapiens
tattcagtaataactctacc

SEQ ID NO: 2544900 - DNA, 15 bp, Homo sapiens
tattcagtgctgtgg

SEQ ID NO: 2544901 - DNA, 22 bp, Homo sapiens
tattcagtgctgtggcctgggc

SEQ ID NO: 2544902 - DNA, 15 bp, Homo sapiens
tattcatttaaaatg

SEQ ID NO: 2544903 - DNA, 17 bp, Homo sapiens
tattccaagacatgtct

SEQ ID NO: 2544904 - DNA, 17 bp, Homo sapiens
tattccatgaatgtatc

SEQ ID NO: 2544905 - DNA, 12 bp, Homo sapiens
tattcccatgag

SEQ ID NO: 2544906 - DNA, 23 bp, Homo sapiens
tattccccagcagggtcttttca

SEQ ID NO: 2544907 - DNA, 20 bp, Homo sapiens
tattcctatatagtttattg

SEQ ID NO: 2544908 - DNA, 19 bp, Homo sapiens
tattcctgcatttgtgaaa

SEQ ID NO: 2544909 - DNA, 20 bp, Homo sapiens
tattcctgcatttgtgaaat

SEQ ID NO: 2544910 - DNA, 21 bp, Homo sapiens
tattcctgcatttgtgaaatg

SEQ ID NO: 2544911 - DNA, 22 bp, Homo sapiens
tattccttgatactaaaagttc

SEQ ID NO: 2544912 - DNA, 13 bp, Homo sapiens
tattctattaact

SEQ ID NO: 2544913 - DNA, 17 bp, Homo sapiens
tattctctcctgtacct

SEQ ID NO: 2544914 - DNA, 24 bp, Homo sapiens
tattctctcctgtacctcttgagc

SEQ ID NO: 2544915 - DNA, 19 bp, Homo sapiens
tattctctgagctgtgcag

SEQ ID NO: 2544916 - DNA, 16 bp, Homo sapiens
tattctgttggccagt

SEQ ID NO: 2544917 - DNA, 22 bp, Homo sapiens
tattcttaagggaacttccaca

SEQ ID NO: 2544918 - DNA, 20 bp, Homo sapiens
tattctttgatgttaacaca

SEQ ID NO: 2544919 - DNA, 19 bp, Homo sapiens
tattgaagcattttataaa

SEQ ID NO: 2544920 - DNA, 22 bp, Homo sapiens
tattgaatataatatatttgtg

SEQ ID NO: 2544921 - DNA, 11 bp, Homo sapiens
tattgaatcta

SEQ ID NO: 2544922 - DNA, 15 bp, Homo sapiens
tattgacaaactctc

SEQ ID NO: 2544923 - DNA, 19 bp, Homo sapiens
tattgacttcaatgatagt

SEQ ID NO: 2544924 - DNA, 21 bp, Homo sapiens
tattgcaaaggttccaactgt

SEQ ID NO: 2544925 - DNA, 22 bp, Homo sapiens
tattgcagcgattaataacagg

SEQ ID NO: 2544926 - DNA, 13 bp, Homo sapiens
tattgcccacgct

SEQ ID NO: 2544927 - DNA, 15 bp, Homo sapiens
tattgcccacgctgg

SEQ ID NO: 2544928 - DNA, 15 bp, Homo sapiens
tattgcttgcacaaa

SEQ ID NO: 2544929 - DNA, 15 bp, Homo sapiens
tattggaattaacct

SEQ ID NO: 2544930 - DNA, 23 bp, Homo sapiens
tattggctaaattgaaacctgga

SEQ ID NO: 2544931 - DNA, 15 bp, Homo sapiens
tattgtaaacatgtg

SEQ ID NO: 2544932 - DNA, 16 bp, Homo sapiens
tattgtaaacatgtgt

SEQ ID NO: 2544933 - DNA, 17 bp, Homo sapiens
tattgtaaacatgtgtt

SEQ ID NO: 2544934 - DNA, 18 bp, Homo sapiens
tattgtaaacatgtgttt

SEQ ID NO: 2544935 - DNA, 15 bp, Homo sapiens
tattgtaaatatgtt

SEQ ID NO: 2544936 - DNA, 13 bp, Homo sapiens
tattgtacacttt

SEQ ID NO: 2544937 - DNA, 11 bp, Homo sapiens
tattgtacagt

SEQ ID NO: 2544938 - DNA, 14 bp, Homo sapiens
tattgtacctctct

SEQ ID NO: 2544939 - DNA, 13 bp, Homo sapiens
tattgtacctttt

SEQ ID NO: 2544940 - DNA, 22 bp, Homo sapiens
tattgtataagattagaatgaa

SEQ ID NO: 2544941 - DNA, 18 bp, Homo sapiens
tattgtattactagaaga

SEQ ID NO: 2544942 - DNA, 17 bp, Homo sapiens
tattgtcattaaaggta

SEQ ID NO: 2544943 - DNA, 22 bp, Homo sapiens
tcactctggcagctcagagagg

SEQ ID NO: 2544944 - DNA, 13 bp, Homo sapiens
tcactctggcctc

SEQ ID NO: 2544945 - DNA, 14 bp, Homo sapiens
tcactctggcctca

SEQ ID NO: 2544946 - DNA, 12 bp, Homo sapiens
tcactctgtcgc

SEQ ID NO: 2544947 - DNA, 19 bp, Homo sapiens
tcactctgtcgcccagtct

SEQ ID NO: 2544948 - DNA, 17 bp, Homo sapiens
tcactcttattgcccac

SEQ ID NO: 2544949 - DNA, 20 bp, Homo sapiens
tcactcttattgcccacgct

SEQ ID NO: 2544950 - DNA, 21 bp, Homo sapiens
tcactcttattgcccacgctg

SEQ ID NO: 2544951 - DNA, 17 bp, Homo sapiens
tcactgaaaacatctgg

SEQ ID NO: 2544952 - DNA, 15 bp, Homo sapiens
tcactgagacagccc

SEQ ID NO: 2544953 - DNA, 23 bp, Homo sapiens
tcactgagacagcccgggctctg

SEQ ID NO: 2544954 - DNA, 18 bp, Homo sapiens
tcactgcaacctccgcct

SEQ ID NO: 2544955 - DNA, 17 bp, Homo sapiens
tcactgcaacttctgcc

SEQ ID NO: 2544956 - DNA, 21 bp, Homo sapiens
tcactgcaggcactcaatgca

SEQ ID NO: 2544957 - DNA, 17 bp, Homo sapiens
tcactgcttaacttcac

SEQ ID NO: 2544958 - DNA, 18 bp, Homo sapiens
tcactgcttaacttcaca

SEQ ID NO: 2544959 - DNA, 15 bp, Homo sapiens
tcactggagcccagg

SEQ ID NO: 2544960 - DNA, 17 bp, Homo sapiens
tcactggagcccaggag

SEQ ID NO: 2544961 - DNA, 15 bp, Homo sapiens
tcactggctctccaa

SEQ ID NO: 2544962 - DNA, 19 bp, Homo sapiens
tcactggctctccaagtgc

SEQ ID NO: 2544963 - DNA, 20 bp, Homo sapiens
tcactggggtcctggggcct

SEQ ID NO: 2544964 - DNA, 18 bp, Homo sapiens
tcactgggtggggtgagg

SEQ ID NO: 2544965 - DNA, 20 bp, Homo sapiens
tcactggtagaccaaaataa

SEQ ID NO: 2544966 - DNA, 23 bp, Homo sapiens
tcactgtataaataggagaggat

SEQ ID NO: 2544967 - DNA, 24 bp, Homo sapiens
tcactgtataaataggagaggatg

SEQ ID NO: 2544968 - DNA, 16 bp, Homo sapiens
tcactgttccctctgc

SEQ ID NO: 2544969 - DNA, 17 bp, Homo sapiens
tcactgttgcccaggct

SEQ ID NO: 2544970 - DNA, 17 bp, Homo sapiens
tcactgtttctctgctg

SEQ ID NO: 2544971 - DNA, 18 bp, Homo sapiens
tcactgtttctctgctgt

SEQ ID NO: 2544972 - DNA, 16 bp, Homo sapiens
tcacttcataatccag

SEQ ID NO: 2544973 - DNA, 14 bp, Homo sapiens
tcacttcatcttct

SEQ ID NO: 2544974 - DNA, 15 bp, Homo sapiens
tcacttcatcttctc

SEQ ID NO: 2544975 - DNA, 16 bp, Homo sapiens
tcacttcgtgggatct

SEQ ID NO: 2544976 - DNA, 17 bp, Homo sapiens
tcacttctgaccacact

SEQ ID NO: 2544977 - DNA, 17 bp, Homo sapiens
tcacttctgagaactca

SEQ ID NO: 2544978 - DNA, 12 bp, Homo sapiens
tcacttgagacc

SEQ ID NO: 2544979 - DNA, 20 bp, Homo sapiens
tcacttgatgtgccatttta

SEQ ID NO: 2544980 - DNA, 16 bp, Homo sapiens
tcacttgtacaaaata

SEQ ID NO: 2544981 - DNA, 12 bp, Homo sapiens
tcacttgtgggg

SEQ ID NO: 2544982 - DNA, 15 bp, Homo sapiens
tcactttaattctca

SEQ ID NO: 2544983 - DNA, 14 bp, Homo sapiens
tcactttagatgct

SEQ ID NO: 2544984 - DNA, 17 bp, Homo sapiens
tcactttagatgctgat

SEQ ID NO: 2544985 - DNA, 17 bp, Homo sapiens
tcactttcacatagatg

SEQ ID NO: 2544986 - DNA, 14 bp, Homo sapiens
tcacttttcagtga

SEQ ID NO: 2544987 - DNA, 16 bp, Homo sapiens
tcacttttcagtgatg

SEQ ID NO: 2544988 - DNA, 13 bp, Homo sapiens
tcacttttcctcc

SEQ ID NO: 2544989 - DNA, 18 bp, Homo sapiens
tcacttttgacaaaggca

SEQ ID NO: 2544990 - DNA, 16 bp, Homo sapiens
tcacttttttccacat

SEQ ID NO: 2544991 - DNA, 17 bp, Homo sapiens
tcactttttttttccaa

SEQ ID NO: 2544992 - DNA, 21 bp, Homo sapiens
tcagaaacaccctcacactgg

SEQ ID NO: 2544993 - DNA, 18 bp, Homo sapiens
tcagaaacactggggctg

SEQ ID NO: 2544994 - DNA, 22 bp, Homo sapiens
tcagaaaccagttatgtgaatg

SEQ ID NO: 2544995 - DNA, 12 bp, Homo sapiens
tcagaaactgtt

SEQ ID NO: 2544996 - DNA, 15 bp, Homo sapiens
tcagaaacttgtgaa

SEQ ID NO: 2544997 - DNA, 18 bp, Homo sapiens
tcagaaacttgtgaagtg

SEQ ID NO: 2544998 - DNA, 14 bp, Homo sapiens
tcagaaatttaatt

SEQ ID NO: 2544999 - DNA, 21 bp, Homo sapiens
tcagaaatttaattcatgttt

SEQ ID NO: 2545000 - DNA, 15 bp, Homo sapiens
tcagaacctcttccc

SEQ ID NO: 2545001 - DNA, 20 bp, Homo sapiens
tcagaacctcttccccagaa

SEQ ID NO: 2545002 - DNA, 14 bp, Homo sapiens
tcagaagacactga

SEQ ID NO: 2545003 - DNA, 14 bp, Homo sapiens
tcagaagataactt

SEQ ID NO: 2545004 - DNA, 13 bp, Homo sapiens
tcagaagcctgag

SEQ ID NO: 2545005 - DNA, 14 bp, Homo sapiens
tcagaagcctttgg

SEQ ID NO: 2545006 - DNA, 18 bp, Homo sapiens
tcagaaggcaaatgactt

SEQ ID NO: 2545007 - DNA, 19 bp, Homo sapiens
tcagaaggcaaatgacttt

SEQ ID NO: 2545008 - DNA, 16 bp, Homo sapiens
tcagaagggaggctgg

SEQ ID NO: 2545009 - DNA, 17 bp, Homo sapiens
tcagaatcacttctgag

SEQ ID NO: 2545010 - DNA, 19 bp, Homo sapiens
tcagaatctcaaataacta

SEQ ID NO: 2545011 - DNA, 16 bp, Homo sapiens
tcagaattctctagtt

SEQ ID NO: 2545012 - DNA, 11 bp, Homo sapiens
tcagacaagca

SEQ ID NO: 2545013 - DNA, 14 bp, Homo sapiens
tcagacactctggc

SEQ ID NO: 2545014 - DNA, 15 bp, Homo sapiens
tcagacactctggct

SEQ ID NO: 2545015 - DNA, 17 bp, Homo sapiens
tcagacactctggctgg

SEQ ID NO: 2545016 - DNA, 17 bp, Homo sapiens
tcagacagctgcctggg

SEQ ID NO: 2545017 - DNA, 15 bp, Homo sapiens
tcagaccataatgtt

SEQ ID NO: 2545018 - DNA, 20 bp, Homo sapiens
tcagaccttggatcagatga

SEQ ID NO: 2545019 - DNA, 14 bp, Homo sapiens
tcagactgaacatg

SEQ ID NO: 2545020 - DNA, 14 bp, Homo sapiens
tcagactgcatgta

SEQ ID NO: 2545021 - DNA, 13 bp, Homo sapiens
tcagactgctggg

SEQ ID NO: 2545022 - DNA, 14 bp, Homo sapiens
tcagactgctggga

SEQ ID NO: 2545023 - DNA, 17 bp, Homo sapiens
tcagactgctgggactg

SEQ ID NO: 2545024 - DNA, 23 bp, Homo sapiens
tcagactgctgggactggccagg

SEQ ID NO: 2545025 - DNA, 23 bp, Homo sapiens
tcagactttaaagaataatatgc

SEQ ID NO: 2545026 - DNA, 15 bp, Homo sapiens
tcagactttggaaaa

SEQ ID NO: 2545027 - DNA, 19 bp, Homo sapiens
tcagactttggaaaatgca

SEQ ID NO: 2545028 - DNA, 21 bp, Homo sapiens
tcagactttggaaaatgcatt

SEQ ID NO: 2545029 - DNA, 17 bp, Homo sapiens
tcagagactcagggccc

SEQ ID NO: 2545030 - DNA, 16 bp, Homo sapiens
tcagagactcctgcag

SEQ ID NO: 2545031 - DNA, 17 bp, Homo sapiens
tcagagactcctgcagg

SEQ ID NO: 2545032 - DNA, 21 bp, Homo sapiens
tcagagactcctgcaggcagc

SEQ ID NO: 2545033 - DNA, 20 bp, Homo sapiens
tcagagaggagtcagagaga

SEQ ID NO: 2545034 - DNA, 21 bp, Homo sapiens
tcagagaggccttttggaatg

SEQ ID NO: 2545035 - DNA, 21 bp, Homo sapiens
tcagagagggtgggagtgggc

SEQ ID NO: 2545036 - DNA, 17 bp, Homo sapiens
tcagagatgtgcaccca

SEQ ID NO: 2545037 - DNA, 14 bp, Homo sapiens
tcagagcaggggtc

SEQ ID NO: 2545038 - DNA, 16 bp, Homo sapiens
tcagagccgtggtcct

SEQ ID NO: 2545039 - DNA, 12 bp, Homo sapiens
tcagagcctgca

SEQ ID NO: 2545040 - DNA, 15 bp, Homo sapiens
tcagagcctgcagtt

SEQ ID NO: 2545041 - DNA, 18 bp, Homo sapiens
tcagagcctgcagttatt

SEQ ID NO: 2545042 - DNA, 16 bp, Homo sapiens
tcagagctacttgggc

SEQ ID NO: 2545043 - DNA, 17 bp, Homo sapiens
tcagagctacttgggcc

SEQ ID NO: 2545044 - DNA, 18 bp, Homo sapiens
tcagagctgacacaggat

SEQ ID NO: 2545045 - DNA, 15 bp, Homo sapiens
tcagagctgggaggg

SEQ ID NO: 2545046 - DNA, 20 bp, Homo sapiens
tcagaggatggccagtgtct

SEQ ID NO: 2545047 - DNA, 22 bp, Homo sapiens
tcagaggccctcgctgccagct

SEQ ID NO: 2545048 - DNA, 15 bp, Homo sapiens
tcagagtatggagct

SEQ ID NO: 2545049 - DNA, 17 bp, Homo sapiens
tcagagtccaggcccca

SEQ ID NO: 2545050 - DNA, 21 bp, Homo sapiens
tcagagttgctgcaaacctga

SEQ ID NO: 2545051 - DNA, 14 bp, Homo sapiens
tcagatataaaaga

SEQ ID NO: 2545052 - DNA, 16 bp, Homo sapiens
tcagatatatttttca

SEQ ID NO: 2545053 - DNA, 23 bp, Homo sapiens
tcagatatatttttcacagtttt

SEQ ID NO: 2545054 - DNA, 13 bp, Homo sapiens
tcagatatttata

SEQ ID NO: 2545055 - DNA, 18 bp, Homo sapiens
tcagatcactactgcagt

SEQ ID NO: 2545056 - DNA, 16 bp, Homo sapiens
tcagatcatggcatcc

SEQ ID NO: 2545057 - DNA, 20 bp, Homo sapiens
tcagatcattatcagcctgt

SEQ ID NO: 2545058 - DNA, 21 bp, Homo sapiens
tcagatcatttcaaaactcat

SEQ ID NO: 2545059 - DNA, 15 bp, Homo sapiens
tcagatctctaactt

SEQ ID NO: 2545060 - DNA, 14 bp, Homo sapiens
tcagatctgtctga

SEQ ID NO: 2545061 - DNA, 21 bp, Homo sapiens
tcagatgaactcttagaaatg

SEQ ID NO: 2545062 - DNA, 14 bp, Homo sapiens
tcagatgcccagag

SEQ ID NO: 2545063 - DNA, 22 bp, Homo sapiens
tcagatgcccagagggcccagg

SEQ ID NO: 2545064 - DNA, 13 bp, Homo sapiens
tcagatgcttctg

SEQ ID NO: 2545065 - DNA, 14 bp, Homo sapiens
tcagatgcttctgg

SEQ ID NO: 2545066 - DNA, 20 bp, Homo sapiens
tcagatggaaccgcaggaag

SEQ ID NO: 2545067 - DNA, 21 bp, Homo sapiens
tcagatggaaccgcaggaagc

SEQ ID NO: 2545068 - DNA, 18 bp, Homo sapiens
tcagatgggaagacatga

SEQ ID NO: 2545069 - DNA, 13 bp, Homo sapiens
tcagatgtcttct

SEQ ID NO: 2545070 - DNA, 22 bp, Homo sapiens
tcagattgcatgtgactctgaa

SEQ ID NO: 2545071 - DNA, 21 bp, Homo sapiens
tcagatttgaactcttcaatc

SEQ ID NO: 2545072 - DNA, 16 bp, Homo sapiens
tcagcaactcgcttta

SEQ ID NO: 2545073 - DNA, 14 bp, Homo sapiens
tcagcaccacccta

SEQ ID NO: 2545074 - DNA, 15 bp, Homo sapiens
tcagcaccaccctag

SEQ ID NO: 2545075 - DNA, 13 bp, Homo sapiens
tcagcaccccttc

SEQ ID NO: 2545076 - DNA, 17 bp, Homo sapiens
tcagcacgatttctgtt

SEQ ID NO: 2545077 - DNA, 20 bp, Homo sapiens
tcagcagcgaccacccctgc

SEQ ID NO: 2545078 - DNA, 17 bp, Homo sapiens
tcagcaggaagcaacga

SEQ ID NO: 2545079 - DNA, 15 bp, Homo sapiens
tcagcatcctggcac

SEQ ID NO: 2545080 - DNA, 12 bp, Homo sapiens
tcagcatgtcta

SEQ ID NO: 2545081 - DNA, 21 bp, Homo sapiens
tcagcatgtctattcagcttc

SEQ ID NO: 2545082 - DNA, 19 bp, Homo sapiens
tcagcatttccacaccaag

SEQ ID NO: 2545083 - DNA, 22 bp, Homo sapiens
tcagccaaatgtaattgaataa

SEQ ID NO: 2545084 - DNA, 21 bp, Homo sapiens
tcagccaacgagtaatttatt

SEQ ID NO: 2545085 - DNA, 15 bp, Homo sapiens
tcagccaagcacagt

SEQ ID NO: 2545086 - DNA, 20 bp, Homo sapiens
tcagccaagcacagtggtgg

SEQ ID NO: 2545087 - DNA, 15 bp, Homo sapiens
tcagccagccccatc

SEQ ID NO: 2545088 - DNA, 12 bp, Homo sapiens
tctgcaagtcag

SEQ ID NO: 2545089 - DNA, 16 bp, Homo sapiens
tctgcaattcccctct

SEQ ID NO: 2545090 - DNA, 22 bp, Homo sapiens
tctgcaattcccctctgctgct

SEQ ID NO: 2545091 - DNA, 14 bp, Homo sapiens
tctgcacaagctgc

SEQ ID NO: 2545092 - DNA, 20 bp, Homo sapiens
tctgcacatgcagctgcacc

SEQ ID NO: 2545093 - DNA, 15 bp, Homo sapiens
tctgcacatgtcttg

SEQ ID NO: 2545094 - DNA, 17 bp, Homo sapiens
tctgcacatgtcttgta

SEQ ID NO: 2545095 - DNA, 19 bp, Homo sapiens
tctgcacatgtcttgtaca

SEQ ID NO: 2545096 - DNA, 22 bp, Homo sapiens
tctgcacatgtcttgtacatgt

SEQ ID NO: 2545097 - DNA, 13 bp, Homo sapiens
tctgcacccaggg

SEQ ID NO: 2545098 - DNA, 15 bp, Homo sapiens
tctgcacccaggggt

SEQ ID NO: 2545099 - DNA, 18 bp, Homo sapiens
tctgcacccccctgggct

SEQ ID NO: 2545100 - DNA, 13 bp, Homo sapiens
tctgcaccctcca

SEQ ID NO: 2545101 - DNA, 24 bp, Homo sapiens
tctgcaccctggggcctggacctg

SEQ ID NO: 2545102 - DNA, 18 bp, Homo sapiens
tctgcaccgtactgtgga

SEQ ID NO: 2545103 - DNA, 13 bp, Homo sapiens
tctgcactcccct

SEQ ID NO: 2545104 - DNA, 14 bp, Homo sapiens
tctgcagctgacct

SEQ ID NO: 2545105 - DNA, 14 bp, Homo sapiens
tctgcaggcacctt

SEQ ID NO: 2545106 - DNA, 19 bp, Homo sapiens
tctgcagggggtgtgtctg

SEQ ID NO: 2545107 - DNA, 18 bp, Homo sapiens
tctgcagtagtctctgtg

SEQ ID NO: 2545108 - DNA, 13 bp, Homo sapiens
tctgcagtgcctt

SEQ ID NO: 2545109 - DNA, 22 bp, Homo sapiens
tctgcatcttggggacatctct

SEQ ID NO: 2545110 - DNA, 15 bp, Homo sapiens
tctgcatgcggccca

SEQ ID NO: 2545111 - DNA, 17 bp, Homo sapiens
tctgcatgcggcccagc

SEQ ID NO: 2545112 - DNA, 18 bp, Homo sapiens
tctgcatgcggcccagcc

SEQ ID NO: 2545113 - DNA, 20 bp, Homo sapiens
tctgcatgcggcccagcccg

SEQ ID NO: 2545114 - DNA, 21 bp, Homo sapiens
tctgcatgcggcccagcccgg

SEQ ID NO: 2545115 - DNA, 22 bp, Homo sapiens
tctgcatgcggcccagcccggc

SEQ ID NO: 2545116 - DNA, 19 bp, Homo sapiens
tctgcattttgctattgta

SEQ ID NO: 2545117 - DNA, 16 bp, Homo sapiens
tctgccaccaaaggcc

SEQ ID NO: 2545118 - DNA, 17 bp, Homo sapiens
tctgccaccatcctgct

SEQ ID NO: 2545119 - DNA, 14 bp, Homo sapiens
tctgccaccctacc

SEQ ID NO: 2545120 - DNA, 18 bp, Homo sapiens
tctgccaccctacctgtt

SEQ ID NO: 2545121 - DNA, 23 bp, Homo sapiens
tctgccaggcccccaagcctgca

SEQ ID NO: 2545122 - DNA, 18 bp, Homo sapiens
tctgcccaattggaggaa

SEQ ID NO: 2545123 - DNA, 16 bp, Homo sapiens
tctgcccactccctgc

SEQ ID NO: 2545124 - DNA, 18 bp, Homo sapiens
tctgcccactccctgcaa

SEQ ID NO: 2545125 - DNA, 16 bp, Homo sapiens
tctgcccagcttgggc

SEQ ID NO: 2545126 - DNA, 19 bp, Homo sapiens
tctgcccagcttgggccca

SEQ ID NO: 2545127 - DNA, 14 bp, Homo sapiens
tctgccccagctct

SEQ ID NO: 2545128 - DNA, 16 bp, Homo sapiens
tctgccccctgctggc

SEQ ID NO: 2545129 - DNA, 15 bp, Homo sapiens
tctgcccctccccca

SEQ ID NO: 2545130 - DNA, 15 bp, Homo sapiens
tctgcccctccctgc

SEQ ID NO: 2545131 - DNA, 18 bp, Homo sapiens
tctgcccctccctgcttc

SEQ ID NO: 2545132 - DNA, 18 bp, Homo sapiens
tctgcccttgccaacgga

SEQ ID NO: 2545133 - DNA, 12 bp, Homo sapiens
tctgcccttggt

SEQ ID NO: 2545134 - DNA, 13 bp, Homo sapiens
tctgccggctctt

SEQ ID NO: 2545135 - DNA, 20 bp, Homo sapiens
tctgcctcacatagcttaca

SEQ ID NO: 2545136 - DNA, 13 bp, Homo sapiens
tctgcctcccatc

SEQ ID NO: 2545137 - DNA, 15 bp, Homo sapiens
tctgcctcccatcac

SEQ ID NO: 2545138 - DNA, 16 bp, Homo sapiens
tctgcctcccatcacc

SEQ ID NO: 2545139 - DNA, 15 bp, Homo sapiens
tctgcctccctcacc

SEQ ID NO: 2545140 - DNA, 14 bp, Homo sapiens
tctgcctctgcctg

SEQ ID NO: 2545141 - DNA, 16 bp, Homo sapiens
tctgcctctgcctgca

SEQ ID NO: 2545142 - DNA, 15 bp, Homo sapiens
tctgcctgcccaggc

SEQ ID NO: 2545143 - DNA, 18 bp, Homo sapiens
tctgcctgcccaggcccc

SEQ ID NO: 2545144 - DNA, 22 bp, Homo sapiens
tctgcctgcccaggcccctgcc

SEQ ID NO: 2545145 - DNA, 17 bp, Homo sapiens
tctgcctgtccctctca

SEQ ID NO: 2545146 - DNA, 14 bp, Homo sapiens
tctgccttccttgc

SEQ ID NO: 2545147 - DNA, 16 bp, Homo sapiens
tctgccttccttgcta

SEQ ID NO: 2545148 - DNA, 20 bp, Homo sapiens
tctgccttctcatgatccaa

SEQ ID NO: 2545149 - DNA, 15 bp, Homo sapiens
tctgcgtctgtgttg

SEQ ID NO: 2545150 - DNA, 20 bp, Homo sapiens
tctgcgtgtcacctgtgctt

SEQ ID NO: 2545151 - DNA, 14 bp, Homo sapiens
tctgctacctcact

SEQ ID NO: 2545152 - DNA, 16 bp, Homo sapiens
tctgctatgtgacttg

SEQ ID NO: 2545153 - DNA, 16 bp, Homo sapiens
tctgctcacatatctg

SEQ ID NO: 2545154 - DNA, 19 bp, Homo sapiens
tctgctcacatatctgtca

SEQ ID NO: 2545155 - DNA, 13 bp, Homo sapiens
tctgctcagcagc

SEQ ID NO: 2545156 - DNA, 14 bp, Homo sapiens
tctgctccaccaca

SEQ ID NO: 2545157 - DNA, 14 bp, Homo sapiens
tctgctccaccctt

SEQ ID NO: 2545158 - DNA, 15 bp, Homo sapiens
tctgctcctctccag

SEQ ID NO: 2545159 - DNA, 18 bp, Homo sapiens
tctgctcctctccaggca

SEQ ID NO: 2545160 - DNA, 20 bp, Homo sapiens
tctgctcctctccaggcacc

SEQ ID NO: 2545161 - DNA, 18 bp, Homo sapiens
tctgctcctctccccagc

SEQ ID NO: 2545162 - DNA, 15 bp, Homo sapiens
tctgctcggccgtct

SEQ ID NO: 2545163 - DNA, 18 bp, Homo sapiens
tctgctcggccgtcttca

SEQ ID NO: 2545164 - DNA, 20 bp, Homo sapiens
tctgctctgaggcttccaga

SEQ ID NO: 2545165 - DNA, 13 bp, Homo sapiens
tctgctgaaggaa

SEQ ID NO: 2545166 - DNA, 22 bp, Homo sapiens
tctgctgacagacacaggcccg

SEQ ID NO: 2545167 - DNA, 14 bp, Homo sapiens
tctgctgccctcca

SEQ ID NO: 2545168 - DNA, 13 bp, Homo sapiens
tctgctgctggct

SEQ ID NO: 2545169 - DNA, 17 bp, Homo sapiens
tctgctgctggctggtt

SEQ ID NO: 2545170 - DNA, 15 bp, Homo sapiens
tctgctggcctggcc

SEQ ID NO: 2545171 - DNA, 21 bp, Homo sapiens
tctgctgtccagacagcctgt

SEQ ID NO: 2545172 - DNA, 15 bp, Homo sapiens
tctgctgtctcagcc

SEQ ID NO: 2545173 - DNA, 19 bp, Homo sapiens
tctgcttacaattccctgc

SEQ ID NO: 2545174 - DNA, 17 bp, Homo sapiens
tctgcttaggagagacc

SEQ ID NO: 2545175 - DNA, 21 bp, Homo sapiens
tctgcttatgcagtttttcag

SEQ ID NO: 2545176 - DNA, 13 bp, Homo sapiens
tctgcttcagtgg

SEQ ID NO: 2545177 - DNA, 15 bp, Homo sapiens
tctgctttatgttgc

SEQ ID NO: 2545178 - DNA, 13 bp, Homo sapiens
tctggaaaagagg

SEQ ID NO: 2545179 - DNA, 20 bp, Homo sapiens
tctggaagagaggaatgcct

SEQ ID NO: 2545180 - DNA, 18 bp, Homo sapiens
tctggaagtgactttggc

SEQ ID NO: 2545181 - DNA, 19 bp, Homo sapiens
tctggaagtgactttggct

SEQ ID NO: 2545182 - DNA, 14 bp, Homo sapiens
tctggaatacatga

SEQ ID NO: 2545183 - DNA, 15 bp, Homo sapiens
tctggaatgcagtgg

SEQ ID NO: 2545184 - DNA, 21 bp, Homo sapiens
tctggacaagccaacttgtaa

SEQ ID NO: 2545185 - DNA, 17 bp, Homo sapiens
tctggaccccatctgtg

SEQ ID NO: 2545186 - DNA, 23 bp, Homo sapiens
tctggaccccatctgtgaataag

SEQ ID NO: 2545187 - DNA, 22 bp, Homo sapiens
tctggactcctctgtccaggca

SEQ ID NO: 2545188 - DNA, 20 bp, Homo sapiens
tctggactgaagcctgcagg

SEQ ID NO: 2545189 - DNA, 15 bp, Homo sapiens
tctggactggctaga

SEQ ID NO: 2545190 - DNA, 19 bp, Homo sapiens
tctggagaagctcccagga

SEQ ID NO: 2545191 - DNA, 20 bp, Homo sapiens
tctggagaagctcccaggaa

SEQ ID NO: 2545192 - DNA, 13 bp, Homo sapiens
tctggagagctag

SEQ ID NO: 2545193 - DNA, 12 bp, Homo sapiens
tctggagccctt

SEQ ID NO: 2545194 - DNA, 21 bp, Homo sapiens
tctggagtctcacttgtctca

SEQ ID NO: 2545195 - DNA, 19 bp, Homo sapiens
tctggagtctccagtggtt

SEQ ID NO: 2545196 - DNA, 24 bp, Homo sapiens
tctggagtttttgtttggagagca

SEQ ID NO: 2545197 - DNA, 14 bp, Homo sapiens
tctggataggagcc

SEQ ID NO: 2545198 - DNA, 20 bp, Homo sapiens
tctggataggagcctgctgg

SEQ ID NO: 2545199 - DNA, 17 bp, Homo sapiens
tctggattcccaggatg

SEQ ID NO: 2545200 - DNA, 22 bp, Homo sapiens
tctggattcccaggatgagcat

SEQ ID NO: 2545201 - DNA, 15 bp, Homo sapiens
tctggcaacatcttt

SEQ ID NO: 2545202 - DNA, 11 bp, Homo sapiens
tctggccctat

SEQ ID NO: 2545203 - DNA, 19 bp, Homo sapiens
tctggccctcacccctgcc

SEQ ID NO: 2545204 - DNA, 14 bp, Homo sapiens
tctggcctcccaca

SEQ ID NO: 2545205 - DNA, 21 bp, Homo sapiens
tctggctagaggccagcccca

SEQ ID NO: 2545206 - DNA, 14 bp, Homo sapiens
tctggctatgcatt

SEQ ID NO: 2545207 - DNA, 22 bp, Homo sapiens
tctggctatgcatttgaaaatt

SEQ ID NO: 2545208 - DNA, 17 bp, Homo sapiens
tctggctcttccaggct

SEQ ID NO: 2545209 - DNA, 18 bp, Homo sapiens
tctggctcttccaggctg

SEQ ID NO: 2545210 - DNA, 14 bp, Homo sapiens
tctggctgaaccct

SEQ ID NO: 2545211 - DNA, 16 bp, Homo sapiens
tctggctgagccctgc

SEQ ID NO: 2545212 - DNA, 21 bp, Homo sapiens
tctggctgagctgaacccatt

SEQ ID NO: 2545213 - DNA, 21 bp, Homo sapiens
tctggctgccccaacctgctg

SEQ ID NO: 2545214 - DNA, 22 bp, Homo sapiens
tctggctgccccaacctgctga

SEQ ID NO: 2545215 - DNA, 22 bp, Homo sapiens
tctggctggtttggaatgcttc

SEQ ID NO: 2545216 - DNA, 23 bp, Homo sapiens
tctggctttctccgactgctagg

SEQ ID NO: 2545217 - DNA, 17 bp, Homo sapiens
tctgggaaaatacccca

SEQ ID NO: 2545218 - DNA, 18 bp, Homo sapiens
tctgggaaataagagaga

SEQ ID NO: 2545219 - DNA, 16 bp, Homo sapiens
tctgggacctcagttt

SEQ ID NO: 2545220 - DNA, 13 bp, Homo sapiens
tctgggacttcct

SEQ ID NO: 2545221 - DNA, 21 bp, Homo sapiens
tctgggcaggactcagctccc

SEQ ID NO: 2545222 - DNA, 23 bp, Homo sapiens
tctgggccaagttcctctagtgc

SEQ ID NO: 2545223 - DNA, 13 bp, Homo sapiens
tctgggctccaga

SEQ ID NO: 2545224 - DNA, 19 bp, Homo sapiens
tctgggctgtctattctag

SEQ ID NO: 2545225 - DNA, 19 bp, Homo sapiens
tctgggcttggggcttcct

SEQ ID NO: 2545226 - DNA, 21 bp, Homo sapiens
tctgggcttggggcttcctaa

SEQ ID NO: 2545227 - DNA, 15 bp, Homo sapiens
tctgggggagtggaa

SEQ ID NO: 2545228 - DNA, 22 bp, Homo sapiens
tctggggtctttttatgcattt

SEQ ID NO: 2545229 - DNA, 18 bp, Homo sapiens
tctgggtgctccctacca

SEQ ID NO: 2545230 - DNA, 13 bp, Homo sapiens
tctgggtggcctc

SEQ ID NO: 2545231 - DNA, 14 bp, Homo sapiens
tctgggttcactgc

SEQ ID NO: 2545232 - DNA, 16 bp, Homo sapiens
tctggtgacaccagcc

SEQ ID NO: 2545233 - DNA, 14 bp, Homo sapiens
tctttgccaccctc

SEQ ID NO: 2545234 - DNA, 18 bp, Homo sapiens
tctttgccaccctcatgc

SEQ ID NO: 2545235 - DNA, 22 bp, Homo sapiens
tctttgccaccctcatgctgtg

SEQ ID NO: 2545236 - DNA, 14 bp, Homo sapiens
tctttgccttgggc

SEQ ID NO: 2545237 - DNA, 20 bp, Homo sapiens
tctttgccttgggctgctcc

SEQ ID NO: 2545238 - DNA, 17 bp, Homo sapiens
tctttgctttgcccagc

SEQ ID NO: 2545239 - DNA, 13 bp, Homo sapiens
tctttggaccctg

SEQ ID NO: 2545240 - DNA, 15 bp, Homo sapiens
tctttggaccctgag

SEQ ID NO: 2545241 - DNA, 19 bp, Homo sapiens
tctttgtaagagtgtagaa

SEQ ID NO: 2545242 - DNA, 23 bp, Homo sapiens
tctttgtaatcgttatgtgtgta

SEQ ID NO: 2545243 - DNA, 15 bp, Homo sapiens
tctttgtgtagcttt

SEQ ID NO: 2545244 - DNA, 18 bp, Homo sapiens
tctttgtgtagctttgct

SEQ ID NO: 2545245 - DNA, 19 bp, Homo sapiens
tcttttaaaaattcaaatg

SEQ ID NO: 2545246 - DNA, 14 bp, Homo sapiens
tcttttacattctg

SEQ ID NO: 2545247 - DNA, 18 bp, Homo sapiens
tcttttagttttagttgc

SEQ ID NO: 2545248 - DNA, 19 bp, Homo sapiens
tcttttataactagtcctt

SEQ ID NO: 2545249 - DNA, 12 bp, Homo sapiens
tcttttcacaaa

SEQ ID NO: 2545250 - DNA, 15 bp, Homo sapiens
tcttttcacaaataa

SEQ ID NO: 2545251 - DNA, 16 bp, Homo sapiens
tcttttcacattctta

SEQ ID NO: 2545252 - DNA, 18 bp, Homo sapiens
tcttttcacattcttata

SEQ ID NO: 2545253 - DNA, 22 bp, Homo sapiens
tcttttcacattcttataaata

SEQ ID NO: 2545254 - DNA, 18 bp, Homo sapiens
tcttttcatctgggaaag

SEQ ID NO: 2545255 - DNA, 17 bp, Homo sapiens
tcttttctaccctagcc

SEQ ID NO: 2545256 - DNA, 18 bp, Homo sapiens
tcttttctaccctagcca

SEQ ID NO: 2545257 - DNA, 13 bp, Homo sapiens
tcttttctctgtg

SEQ ID NO: 2545258 - DNA, 13 bp, Homo sapiens
tcttttgacatgt

SEQ ID NO: 2545259 - DNA, 17 bp, Homo sapiens
tcttttgacatgtggaa

SEQ ID NO: 2545260 - DNA, 20 bp, Homo sapiens
tcttttgacatgtggaaagt

SEQ ID NO: 2545261 - DNA, 21 bp, Homo sapiens
tcttttgcccttcacagtgtt

SEQ ID NO: 2545262 - DNA, 13 bp, Homo sapiens
tcttttggcttcc

SEQ ID NO: 2545263 - DNA, 15 bp, Homo sapiens
tctttttaataaaaa

SEQ ID NO: 2545264 - DNA, 13 bp, Homo sapiens
tctttttattgaa

SEQ ID NO: 2545265 - DNA, 15 bp, Homo sapiens
tctttttattgaatc

SEQ ID NO: 2545266 - DNA, 14 bp, Homo sapiens
tctttttctggact

SEQ ID NO: 2545267 - DNA, 15 bp, Homo sapiens
tcttttttagcataa

SEQ ID NO: 2545268 - DNA, 16 bp, Homo sapiens
tcttttttagcataaa

SEQ ID NO: 2545269 - DNA, 13 bp, Homo sapiens
tcttttttcaaaa

SEQ ID NO: 2545270 - DNA, 14 bp, Homo sapiens
tctttttttgtgat

SEQ ID NO: 2545271 - DNA, 16 bp, Homo sapiens
tctttttttgtgatgt

SEQ ID NO: 2545272 - DNA, 20 bp, Homo sapiens
tcttttttttaatgtgctgt

SEQ ID NO: 2545273 - DNA, 20 bp, Homo sapiens
tgaaaaaaaaaatgctgaac

SEQ ID NO: 2545274 - DNA, 17 bp, Homo sapiens
tgaaaaaaagtttacaa

SEQ ID NO: 2545275 - DNA, 18 bp, Homo sapiens
tgaaaaaaggacaatttc

SEQ ID NO: 2545276 - DNA, 12 bp, Homo sapiens
tgaaaaattcct

SEQ ID NO: 2545277 - DNA, 20 bp, Homo sapiens
tgaaaaattcctattgtgat

SEQ ID NO: 2545278 - DNA, 19 bp, Homo sapiens
tgaaaaattcctttgtgtt

SEQ ID NO: 2545279 - DNA, 19 bp, Homo sapiens
tgaaaaatttaagcattgt

SEQ ID NO: 2545280 - DNA, 16 bp, Homo sapiens
tgaaaacaagtgctgg

SEQ ID NO: 2545281 - DNA, 12 bp, Homo sapiens
tgaaaacacatt

SEQ ID NO: 2545282 - DNA, 13 bp, Homo sapiens
tgaaaacacattt

SEQ ID NO: 2545283 - DNA, 14 bp, Homo sapiens
tgaaaacacatttt

SEQ ID NO: 2545284 - DNA, 20 bp, Homo sapiens
tgaaaacacatttttcttag

SEQ ID NO: 2545285 - DNA, 21 bp, Homo sapiens
tgaaaacacatttttcttagg

SEQ ID NO: 2545286 - DNA, 19 bp, Homo sapiens
tgaaaacatggtagaattg

SEQ ID NO: 2545287 - DNA, 14 bp, Homo sapiens
tgaaaacatgtaat

SEQ ID NO: 2545288 - DNA, 19 bp, Homo sapiens
tgaaaagaaaaatgagcct

SEQ ID NO: 2545289 - DNA, 19 bp, Homo sapiens
tgaaaagactccaaagaaa

SEQ ID NO: 2545290 - DNA, 23 bp, Homo sapiens
tgaaaaggtgaccttgcaacttc

SEQ ID NO: 2545291 - DNA, 20 bp, Homo sapiens
tgaaaataaaaagatcactt

SEQ ID NO: 2545292 - DNA, 14 bp, Homo sapiens
tgaaaatataacca

SEQ ID NO: 2545293 - DNA, 22 bp, Homo sapiens
tgaaaatatttgtatcacaaat

SEQ ID NO: 2545294 - DNA, 17 bp, Homo sapiens
tgaaaatctaatattaa

SEQ ID NO: 2545295 - DNA, 21 bp, Homo sapiens
tgaaaatctaatattaaaaat

SEQ ID NO: 2545296 - DNA, 18 bp, Homo sapiens
tgaaaatgcaacaacatg

SEQ ID NO: 2545297 - DNA, 16 bp, Homo sapiens
tgaaaatgtactgaga

SEQ ID NO: 2545298 - DNA, 14 bp, Homo sapiens
tgaaaatgtcaaag

SEQ ID NO: 2545299 - DNA, 21 bp, Homo sapiens
tgaaaatgtcagaaaccagtt

SEQ ID NO: 2545300 - DNA, 13 bp, Homo sapiens
tgaaaatgtgaat

SEQ ID NO: 2545301 - DNA, 15 bp, Homo sapiens
tgaaaattatttgaa

SEQ ID NO: 2545302 - DNA, 16 bp, Homo sapiens
tgaaaattatttgaaa

SEQ ID NO: 2545303 - DNA, 16 bp, Homo sapiens
tgaaaattattttaaa

SEQ ID NO: 2545304 - DNA, 18 bp, Homo sapiens
tgaaaattattttaaaca

SEQ ID NO: 2545305 - DNA, 21 bp, Homo sapiens
tgaaaattattttaaacaaaa

SEQ ID NO: 2545306 - DNA, 18 bp, Homo sapiens
tgaaaattcaaaaagtgt

SEQ ID NO: 2545307 - DNA, 23 bp, Homo sapiens
tgaaaattcaaaaagtgtttatt

SEQ ID NO: 2545308 - DNA, 13 bp, Homo sapiens
tgaaaattttgat

SEQ ID NO: 2545309 - DNA, 14 bp, Homo sapiens
tgaaacaaagctgc

SEQ ID NO: 2545310 - DNA, 17 bp, Homo sapiens
tgaaacaagaagccaca

SEQ ID NO: 2545311 - DNA, 19 bp, Homo sapiens
tgaaacacaccaggctgtg

SEQ ID NO: 2545312 - DNA, 16 bp, Homo sapiens
tgaaacaccttctctg

SEQ ID NO: 2545313 - DNA, 18 bp, Homo sapiens
tgaaacaccttctctgga

SEQ ID NO: 2545314 - DNA, 19 bp, Homo sapiens
tgaaacaccttctctggag

SEQ ID NO: 2545315 - DNA, 14 bp, Homo sapiens
tgaaacagaaacaa

SEQ ID NO: 2545316 - DNA, 20 bp, Homo sapiens
tgaaaccagtgttagggaag

SEQ ID NO: 2545317 - DNA, 16 bp, Homo sapiens
tgaaacccccacacac

SEQ ID NO: 2545318 - DNA, 23 bp, Homo sapiens
tgaaaccctgtctctactaaaaa

SEQ ID NO: 2545319 - DNA, 18 bp, Homo sapiens
tgaaacctttagggcagc

SEQ ID NO: 2545320 - DNA, 17 bp, Homo sapiens
tgaaaccttttttaaga

SEQ ID NO: 2545321 - DNA, 19 bp, Homo sapiens
tgaaaccttttttaagatt

SEQ ID NO: 2545322 - DNA, 21 bp, Homo sapiens
tgaaaccttttttaagatttt

SEQ ID NO: 2545323 - DNA, 12 bp, Homo sapiens
tgaaacttattt

SEQ ID NO: 2545324 - DNA, 13 bp, Homo sapiens
tgaaagactgtac

SEQ ID NO: 2545325 - DNA, 18 bp, Homo sapiens
tgaaagactgtacaaagt

SEQ ID NO: 2545326 - DNA, 16 bp, Homo sapiens
tgaaagagaaccagtt

SEQ ID NO: 2545327 - DNA, 18 bp, Homo sapiens
tgaaagaggcagcttgaa

SEQ ID NO: 2545328 - DNA, 23 bp, Homo sapiens
tgaaagatggctgtgcctctgcc

SEQ ID NO: 2545329 - DNA, 18 bp, Homo sapiens
tgaaagcagggacttgaa

SEQ ID NO: 2545330 - DNA, 11 bp, Homo sapiens
tgaaagctgtg

SEQ ID NO: 2545331 - DNA, 17 bp, Homo sapiens
tgaaaggcattctctga

SEQ ID NO: 2545332 - DNA, 22 bp, Homo sapiens
tgaaagggagctatcaggaaca

SEQ ID NO: 2545333 - DNA, 15 bp, Homo sapiens
tgaaaggtttacatt

SEQ ID NO: 2545334 - DNA, 15 bp, Homo sapiens
tgaaagtataactga

SEQ ID NO: 2545335 - DNA, 16 bp, Homo sapiens
tgaaagtccagaaact

SEQ ID NO: 2545336 - DNA, 16 bp, Homo sapiens
tgaaataacatggcct

SEQ ID NO: 2545337 - DNA, 18 bp, Homo sapiens
tgaaataagccagacatc

SEQ ID NO: 2545338 - DNA, 20 bp, Homo sapiens
tgaaataagccagacatcaa

SEQ ID NO: 2545339 - DNA, 23 bp, Homo sapiens
tgaaataagccagacatcaacag

SEQ ID NO: 2545340 - DNA, 19 bp, Homo sapiens
tgaaatacacaagtaaaca

SEQ ID NO: 2545341 - DNA, 23 bp, Homo sapiens
tgaaataccagtgaaccaaagag

SEQ ID NO: 2545342 - DNA, 16 bp, Homo sapiens
tgaaatatacacacag

SEQ ID NO: 2545343 - DNA, 12 bp, Homo sapiens
tgaaatatgcat

SEQ ID NO: 2545344 - DNA, 19 bp, Homo sapiens
tgaaatcttacagctgggt

SEQ ID NO: 2545345 - DNA, 14 bp, Homo sapiens
tgaaatgaaaacat

SEQ ID NO: 2545346 - DNA, 19 bp, Homo sapiens
tgaaatgaaaacatgtaat

SEQ ID NO: 2545347 - DNA, 16 bp, Homo sapiens
tgaaatgctggcattt

SEQ ID NO: 2545348 - DNA, 16 bp, Homo sapiens
tgaaatggaggtcctt

SEQ ID NO: 2545349 - DNA, 14 bp, Homo sapiens
tgaaattaacctct

SEQ ID NO: 2545350 - DNA, 17 bp, Homo sapiens
tgaaattaacctctcac

SEQ ID NO: 2545351 - DNA, 14 bp, Homo sapiens
tgaaattgtacata

SEQ ID NO: 2545352 - DNA, 21 bp, Homo sapiens
tgaaatttattagttaatata

SEQ ID NO: 2545353 - DNA, 20 bp, Homo sapiens
tgaaattttaacctatgata

SEQ ID NO: 2545354 - DNA, 16 bp, Homo sapiens
tgaaattttatatgct

SEQ ID NO: 2545355 - DNA, 18 bp, Homo sapiens
tgaaattttatatgctta

SEQ ID NO: 2545356 - DNA, 19 bp, Homo sapiens
tgaaattttctagactttc

SEQ ID NO: 2545357 - DNA, 19 bp, Homo sapiens
tgaaatttttattaaatta

SEQ ID NO: 2545358 - DNA, 18 bp, Homo sapiens
tgaacaaattgaactctt

SEQ ID NO: 2545359 - DNA, 21 bp, Homo sapiens
tgaacaaattgaactctttga

SEQ ID NO: 2545360 - DNA, 14 bp, Homo sapiens
tgaacaagaattgg

SEQ ID NO: 2545361 - DNA, 18 bp, Homo sapiens
tgaacaagaattggaagc

SEQ ID NO: 2545362 - DNA, 14 bp, Homo sapiens
tgaacacatcagct

SEQ ID NO: 2545363 - DNA, 18 bp, Homo sapiens
tgaacactggcaacaaca

SEQ ID NO: 2545364 - DNA, 16 bp, Homo sapiens
tgaacactgggggagg

SEQ ID NO: 2545365 - DNA, 17 bp, Homo sapiens
tgaacactgggggaggg

SEQ ID NO: 2545366 - DNA, 13 bp, Homo sapiens
tgaacatgtactg

SEQ ID NO: 2545367 - DNA, 13 bp, Homo sapiens
tgaacattccaga

SEQ ID NO: 2545368 - DNA, 22 bp, Homo sapiens
tgaacattgcatataacttata

SEQ ID NO: 2545369 - DNA, 14 bp, Homo sapiens
tgaacatttatcaa

SEQ ID NO: 2545370 - DNA, 20 bp, Homo sapiens
tgaaccaccacacccagccc

SEQ ID NO: 2545371 - DNA, 15 bp, Homo sapiens
tgaaccacttccctc

SEQ ID NO: 2545372 - DNA, 16 bp, Homo sapiens
tgaaccacttccctca

SEQ ID NO: 2545373 - DNA, 21 bp, Homo sapiens
tgaaccatcattataaacgtg

SEQ ID NO: 2545374 - DNA, 17 bp, Homo sapiens
tgaaccattaaagtcga

SEQ ID NO: 2545375 - DNA, 20 bp, Homo sapiens
tgaacccaggacgcttctga

SEQ ID NO: 2545376 - DNA, 22 bp, Homo sapiens
tgaacccaggacgcttctgaat

SEQ ID NO: 2545377 - DNA, 22 bp, Homo sapiens
tgaacccatatttgtacaccaa

SEQ ID NO: 2545378 - DNA, 18 bp, Homo sapiens
tgagttttttctcttggg

SEQ ID NO: 2545379 - DNA, 16 bp, Homo sapiens
tgataaaaccatgtag

SEQ ID NO: 2545380 - DNA, 13 bp, Homo sapiens
tgataaagtttct

SEQ ID NO: 2545381 - DNA, 16 bp, Homo sapiens
tgataaagtttctcag

SEQ ID NO: 2545382 - DNA, 17 bp, Homo sapiens
tgataacaacctggaga

SEQ ID NO: 2545383 - DNA, 14 bp, Homo sapiens
tgataactttgctt

SEQ ID NO: 2545384 - DNA, 19 bp, Homo sapiens
tgataagagggcacacact

SEQ ID NO: 2545385 - DNA, 16 bp, Homo sapiens
tgataaggatcagaac

SEQ ID NO: 2545386 - DNA, 24 bp, Homo sapiens
tgataatcaactgggctgaacact

SEQ ID NO: 2545387 - DNA, 13 bp, Homo sapiens
tgataatgttaaa

SEQ ID NO: 2545388 - DNA, 18 bp, Homo sapiens
tgataatgttaaatttgt

SEQ ID NO: 2545389 - DNA, 16 bp, Homo sapiens
tgataattgcattcat

SEQ ID NO: 2545390 - DNA, 19 bp, Homo sapiens
tgataattgcattcatctt

SEQ ID NO: 2545391 - DNA, 14 bp, Homo sapiens
tgatacaatgctgt

SEQ ID NO: 2545392 - DNA, 18 bp, Homo sapiens
tgatacaatgctgtgccc

SEQ ID NO: 2545393 - DNA, 13 bp, Homo sapiens
tgatacccagagc

SEQ ID NO: 2545394 - DNA, 18 bp, Homo sapiens
tgatacccatagcttcca

SEQ ID NO: 2545395 - DNA, 18 bp, Homo sapiens
tgatacccccctctgtct

SEQ ID NO: 2545396 - DNA, 17 bp, Homo sapiens
tgatactaaaagttctt

SEQ ID NO: 2545397 - DNA, 14 bp, Homo sapiens
tgatactacagttt

SEQ ID NO: 2545398 - DNA, 15 bp, Homo sapiens
tgatacttttgacaa

SEQ ID NO: 2545399 - DNA, 21 bp, Homo sapiens
tgatagaaggctatggggata

SEQ ID NO: 2545400 - DNA, 16 bp, Homo sapiens
tgatagcacagaccct

SEQ ID NO: 2545401 - DNA, 18 bp, Homo sapiens
tgatagcacagaccctgc

SEQ ID NO: 2545402 - DNA, 16 bp, Homo sapiens
tgatagctaacatttt

SEQ ID NO: 2545403 - DNA, 18 bp, Homo sapiens
tgatagctaacattttaa

SEQ ID NO: 2545404 - DNA, 16 bp, Homo sapiens
tgatagttactgttgt

SEQ ID NO: 2545405 - DNA, 17 bp, Homo sapiens
tgatagttactgttgtg

SEQ ID NO: 2545406 - DNA, 21 bp, Homo sapiens
tgatagttactgttgtgacct

SEQ ID NO: 2545407 - DNA, 22 bp, Homo sapiens
tgatatacttttttcttattta

SEQ ID NO: 2545408 - DNA, 11 bp, Homo sapiens
tgatatgaaaa

SEQ ID NO: 2545409 - DNA, 15 bp, Homo sapiens
tgatatgaaaaatat

SEQ ID NO: 2545410 - DNA, 19 bp, Homo sapiens
tgatatgaaaaatatgata

SEQ ID NO: 2545411 - DNA, 19 bp, Homo sapiens
tgatatggcagaagacacc

SEQ ID NO: 2545412 - DNA, 15 bp, Homo sapiens
tgatatgtaaacata

SEQ ID NO: 2545413 - DNA, 13 bp, Homo sapiens
tgatattaaagga

SEQ ID NO: 2545414 - DNA, 18 bp, Homo sapiens
tgatattccatgaatgta

SEQ ID NO: 2545415 - DNA, 22 bp, Homo sapiens
tgatattccatgaatgtatcag

SEQ ID NO: 2545416 - DNA, 17 bp, Homo sapiens
tgatattgcatatgcat

SEQ ID NO: 2545417 - DNA, 19 bp, Homo sapiens
tgatattttacctcttatt

SEQ ID NO: 2545418 - DNA, 22 bp, Homo sapiens
tgatcaagggaatgtaactgct

SEQ ID NO: 2545419 - DNA, 16 bp, Homo sapiens
tgatcaataaaatgtg

SEQ ID NO: 2545420 - DNA, 14 bp, Homo sapiens
tgatcaatgacaga

SEQ ID NO: 2545421 - DNA, 16 bp, Homo sapiens
tgatcaattaaatgta

SEQ ID NO: 2545422 - DNA, 13 bp, Homo sapiens
tgatcacggctca

SEQ ID NO: 2545423 - DNA, 19 bp, Homo sapiens
tgatcacggctcactgcag

SEQ ID NO: 2545424 - DNA, 21 bp, Homo sapiens
tgatcacggctcactgcagcc

SEQ ID NO: 2545425 - DNA, 18 bp, Homo sapiens
tgatcagaccataatgtt

SEQ ID NO: 2545426 - DNA, 23 bp, Homo sapiens
tgatcagagccgtggtcctttgg

SEQ ID NO: 2545427 - DNA, 18 bp, Homo sapiens
tgatcagctgtttgtcat

SEQ ID NO: 2545428 - DNA, 21 bp, Homo sapiens
tgatcataagtctaaataaat

SEQ ID NO: 2545429 - DNA, 19 bp, Homo sapiens
tgatcataggtatttcaaa

SEQ ID NO: 2545430 - DNA, 24 bp, Homo sapiens
tgatcatccactgtgccatgtgcc

SEQ ID NO: 2545431 - DNA, 16 bp, Homo sapiens
tgatcatgcattgttg

SEQ ID NO: 2545432 - DNA, 16 bp, Homo sapiens
tgatcattttcccccc

SEQ ID NO: 2545433 - DNA, 18 bp, Homo sapiens
tgatcattttccccccac

SEQ ID NO: 2545434 - DNA, 21 bp, Homo sapiens
tgatccacccacctcagcctc

SEQ ID NO: 2545435 - DNA, 22 bp, Homo sapiens
tgatccacccacctcagcctcc

SEQ ID NO: 2545436 - DNA, 13 bp, Homo sapiens
tgatcccagcact

SEQ ID NO: 2545437 - DNA, 16 bp, Homo sapiens
tgatcctagttccacc

SEQ ID NO: 2545438 - DNA, 18 bp, Homo sapiens
tgatcctcatatggccca

SEQ ID NO: 2545439 - DNA, 17 bp, Homo sapiens
tgatcctccaacttcat

SEQ ID NO: 2545440 - DNA, 16 bp, Homo sapiens
tgatcctcccacctca

SEQ ID NO: 2545441 - DNA, 21 bp, Homo sapiens
tgatcctcccacctcagcctc

SEQ ID NO: 2545442 - DNA, 22 bp, Homo sapiens
tgatcctcccacctcagcctcc

SEQ ID NO: 2545443 - DNA, 14 bp, Homo sapiens
tgatcctgtgaagt

SEQ ID NO: 2545444 - DNA, 20 bp, Homo sapiens
tgatccttttatgttattta

SEQ ID NO: 2545445 - DNA, 19 bp, Homo sapiens
tgatcgtgacgctgaataa

SEQ ID NO: 2545446 - DNA, 22 bp, Homo sapiens
tgatcgtgctaaattttcagta

SEQ ID NO: 2545447 - DNA, 15 bp, Homo sapiens
tgatctaggaagact

SEQ ID NO: 2545448 - DNA, 19 bp, Homo sapiens
tgatctaggaagactttgg

SEQ ID NO: 2545449 - DNA, 15 bp, Homo sapiens
tgatctcatttaatc

SEQ ID NO: 2545450 - DNA, 22 bp, Homo sapiens
tgatctcatttaatcctctcaa

SEQ ID NO: 2545451 - DNA, 16 bp, Homo sapiens
tgatctccatatgtta

SEQ ID NO: 2545452 - DNA, 20 bp, Homo sapiens
tgatctccatggcttcctcc

SEQ ID NO: 2545453 - DNA, 18 bp, Homo sapiens
tgatctcggctcactgca

SEQ ID NO: 2545454 - DNA, 17 bp, Homo sapiens
tgatctgacatccccac

SEQ ID NO: 2545455 - DNA, 13 bp, Homo sapiens
tgatctgtatata

SEQ ID NO: 2545456 - DNA, 15 bp, Homo sapiens
tgatctgtatataca

SEQ ID NO: 2545457 - DNA, 20 bp, Homo sapiens
tgatctgtgctttccagctc

SEQ ID NO: 2545458 - DNA, 15 bp, Homo sapiens
tgatctgtgggcaca

SEQ ID NO: 2545459 - DNA, 20 bp, Homo sapiens
tgatcttctttataattcta

SEQ ID NO: 2545460 - DNA, 15 bp, Homo sapiens
tgatcttgtgacata

SEQ ID NO: 2545461 - DNA, 21 bp, Homo sapiens
tgatctttgcagacaggcaag

SEQ ID NO: 2545462 - DNA, 23 bp, Homo sapiens
tgatctttgcagacaggcaagca

SEQ ID NO: 2545463 - DNA, 22 bp, Homo sapiens
tgatgaaatgaggtcagagcct

SEQ ID NO: 2545464 - DNA, 18 bp, Homo sapiens
tgatgaactcttaatcaa

SEQ ID NO: 2545465 - DNA, 17 bp, Homo sapiens
tgatgaacttattctgt

SEQ ID NO: 2545466 - DNA, 13 bp, Homo sapiens
tgatgaactttct

SEQ ID NO: 2545467 - DNA, 15 bp, Homo sapiens
tgatgaactttctct

SEQ ID NO: 2545468 - DNA, 14 bp, Homo sapiens
tgatgaatactgta

SEQ ID NO: 2545469 - DNA, 14 bp, Homo sapiens
tgatgacagacact

SEQ ID NO: 2545470 - DNA, 15 bp, Homo sapiens
tgatgacagagcgag

SEQ ID NO: 2545471 - DNA, 20 bp, Homo sapiens
tgatgatgaaatgaggtcag

SEQ ID NO: 2545472 - DNA, 16 bp, Homo sapiens
tgatgatgtgcctggg

SEQ ID NO: 2545473 - DNA, 19 bp, Homo sapiens
tgatgccaagttgtttgag

SEQ ID NO: 2545474 - DNA, 21 bp, Homo sapiens
tgatgccaagttgtttgagaa

SEQ ID NO: 2545475 - DNA, 18 bp, Homo sapiens
tgatgccacacagagtgg

SEQ ID NO: 2545476 - DNA, 11 bp, Homo sapiens
tgatgctaaat

SEQ ID NO: 2545477 - DNA, 14 bp, Homo sapiens
tgatgctccctccc

SEQ ID NO: 2545478 - DNA, 15 bp, Homo sapiens
tgatgctccctcccc

SEQ ID NO: 2545479 - DNA, 17 bp, Homo sapiens
tgatgctccctcccctg

SEQ ID NO: 2545480 - DNA, 16 bp, Homo sapiens
tgatgctggagaggtt

SEQ ID NO: 2545481 - DNA, 23 bp, Homo sapiens
tgatgcttcttcagagactcctg

SEQ ID NO: 2545482 - DNA, 15 bp, Homo sapiens
tgatggcttctccag

SEQ ID NO: 2545483 - DNA, 14 bp, Homo sapiens
tgatggggaaggag

SEQ ID NO: 2545484 - DNA, 13 bp, Homo sapiens
tgatggggccctg

SEQ ID NO: 2545485 - DNA, 14 bp, Homo sapiens
tgatggggccctgc

SEQ ID NO: 2545486 - DNA, 16 bp, Homo sapiens
tgatggggccctgcct

SEQ ID NO: 2545487 - DNA, 22 bp, Homo sapiens
tgatggggccctgcctcctttg

SEQ ID NO: 2545488 - DNA, 16 bp, Homo sapiens
tgatggtcagctccct

SEQ ID NO: 2545489 - DNA, 22 bp, Homo sapiens
tgatggtgttttggggatgaga

SEQ ID NO: 2545490 - DNA, 21 bp, Homo sapiens
tgatgtgccattttaaaaaaa

SEQ ID NO: 2545491 - DNA, 13 bp, Homo sapiens
tgatgtgcctggg

SEQ ID NO: 2545492 - DNA, 17 bp, Homo sapiens
tgatgttaaaattccat

SEQ ID NO: 2545493 - DNA, 17 bp, Homo sapiens
tgatgttaacacatttt

SEQ ID NO: 2545494 - DNA, 22 bp, Homo sapiens
tgatgttaacacattttgtata

SEQ ID NO: 2545495 - DNA, 22 bp, Homo sapiens
tgatgttaaccagaataaagtt

SEQ ID NO: 2545496 - DNA, 13 bp, Homo sapiens
tgatgttcagtgt

SEQ ID NO: 2545497 - DNA, 14 bp, Homo sapiens
tgatgttcagtgta

SEQ ID NO: 2545498 - DNA, 21 bp, Homo sapiens
tgatgttcagtgtaatttctt

SEQ ID NO: 2545499 - DNA, 16 bp, Homo sapiens
tgatgttggctgggaa

SEQ ID NO: 2545500 - DNA, 11 bp, Homo sapiens
tgatgtttgtg

SEQ ID NO: 2545501 - DNA, 18 bp, Homo sapiens
tgatgtttgtggcctcag

SEQ ID NO: 2545502 - DNA, 20 bp, Homo sapiens
tgatgtttgtggcctcagaa

SEQ ID NO: 2545503 - DNA, 21 bp, Homo sapiens
tgatgttttaaggatgcttgt

SEQ ID NO: 2545504 - DNA, 13 bp, Homo sapiens
tgattaatccaga

SEQ ID NO: 2545505 - DNA, 17 bp, Homo sapiens
tgattaatccagaataa

SEQ ID NO: 2545506 - DNA, 21 bp, Homo sapiens
tgattaattcaccttccagtg

SEQ ID NO: 2545507 - DNA, 17 bp, Homo sapiens
tgattacacaaaacaaa

SEQ ID NO: 2545508 - DNA, 16 bp, Homo sapiens
tgattactctttgaga

SEQ ID NO: 2545509 - DNA, 13 bp, Homo sapiens
tgattagcaagtt

SEQ ID NO: 2545510 - DNA, 17 bp, Homo sapiens
tgattagtaaagaaatg

SEQ ID NO: 2545511 - DNA, 16 bp, Homo sapiens
tgattattcagtgtca

SEQ ID NO: 2545512 - DNA, 14 bp, Homo sapiens
tgattcaactaaaa

SEQ ID NO: 2545513 - DNA, 16 bp, Homo sapiens
tgattcaatctgtaaa

SEQ ID NO: 2545514 - DNA, 22 bp, Homo sapiens
tgattcaatctgtaaactgtgt

SEQ ID NO: 2545515 - DNA, 17 bp, Homo sapiens
tgattcactgcatggct

SEQ ID NO: 2545516 - DNA, 23 bp, Homo sapiens
tgattcagacagctgcctgggat

SEQ ID NO: 2545517 - DNA, 13 bp, Homo sapiens
tgattcagctctg

SEQ ID NO: 2545518 - DNA, 21 bp, Homo sapiens
tgattcagtgttaaatgtgat

SEQ ID NO: 2545519 - DNA, 24 bp, Homo sapiens
tgattcagtgttaaatgtgatgaa

SEQ ID NO: 2545520 - DNA, 15 bp, Homo sapiens
tgattcccaagctct

SEQ ID NO: 2545521 - DNA, 16 bp, Homo sapiens
tgattcccaagctctg

SEQ ID NO: 2545522 - DNA, 18 bp, Homo sapiens
tgattcccaagctctgct

SEQ ID NO: 2545523 - DNA, 14 bp, Homo sapiens
tgccttccataatt

SEQ ID NO: 2545524 - DNA, 20 bp, Homo sapiens
tgccttccatgtcggcctct

SEQ ID NO: 2545525 - DNA, 21 bp, Homo sapiens
tgccttccatgtcggcctcta

SEQ ID NO: 2545526 - DNA, 14 bp, Homo sapiens
tgccttcctcctgg

SEQ ID NO: 2545527 - DNA, 15 bp, Homo sapiens
tgccttcctcctggg

SEQ ID NO: 2545528 - DNA, 16 bp, Homo sapiens
tgccttcctcctgggc

SEQ ID NO: 2545529 - DNA, 12 bp, Homo sapiens
tgccttccttgc

SEQ ID NO: 2545530 - DNA, 16 bp, Homo sapiens
tgccttctacttttaa

SEQ ID NO: 2545531 - DNA, 20 bp, Homo sapiens
tgccttctgtcctggtgtca

SEQ ID NO: 2545532 - DNA, 17 bp, Homo sapiens
tgccttgaaccacttcc

SEQ ID NO: 2545533 - DNA, 15 bp, Homo sapiens
tgccttgaagccact

SEQ ID NO: 2545534 - DNA, 20 bp, Homo sapiens
tgccttggagggtcccaagc

SEQ ID NO: 2545535 - DNA, 16 bp, Homo sapiens
tgccttgggctgctcc

SEQ ID NO: 2545536 - DNA, 20 bp, Homo sapiens
tgccttggggaatttcctct

SEQ ID NO: 2545537 - DNA, 19 bp, Homo sapiens
tgccttgtgaaggaattat

SEQ ID NO: 2545538 - DNA, 15 bp, Homo sapiens
tgcctttaaatctgt

SEQ ID NO: 2545539 - DNA, 19 bp, Homo sapiens
tgcctttaaatctgtgatg

SEQ ID NO: 2545540 - DNA, 17 bp, Homo sapiens
tgcctttgagacagttt

SEQ ID NO: 2545541 - DNA, 19 bp, Homo sapiens
tgcctttgagacagtttct

SEQ ID NO: 2545542 - DNA, 17 bp, Homo sapiens
tgccttttatagctatt

SEQ ID NO: 2545543 - DNA, 14 bp, Homo sapiens
tgccttttgcaccc

SEQ ID NO: 2545544 - DNA, 15 bp, Homo sapiens
tgccttttgcacccc

SEQ ID NO: 2545545 - DNA, 19 bp, Homo sapiens
tgcgaaaggatgaaagtga

SEQ ID NO: 2545546 - DNA, 18 bp, Homo sapiens
tgcgaaggggccctggtc

SEQ ID NO: 2545547 - DNA, 22 bp, Homo sapiens
tgcgaatggttccattctctct

SEQ ID NO: 2545548 - DNA, 14 bp, Homo sapiens
tgcgagtatgtgtt

SEQ ID NO: 2545549 - DNA, 20 bp, Homo sapiens
tgcgagtgctcatttcagga

SEQ ID NO: 2545550 - DNA, 19 bp, Homo sapiens
tgcgagtgtgtgcatgtgt

SEQ ID NO: 2545551 - DNA, 22 bp, Homo sapiens
tgcgagtgtgtgcatgtgtgtg

SEQ ID NO: 2545552 - DNA, 16 bp, Homo sapiens
tgcgatcttcagagca

SEQ ID NO: 2545553 - DNA, 23 bp, Homo sapiens
tgcgcattctcatggagaagtta

SEQ ID NO: 2545554 - DNA, 13 bp, Homo sapiens
tgcgcccaccccg

SEQ ID NO: 2545555 - DNA, 22 bp, Homo sapiens
tgcgcctacaggagtgagcact

SEQ ID NO: 2545556 - DNA, 15 bp, Homo sapiens
tgcggacaagtttta

SEQ ID NO: 2545557 - DNA, 18 bp, Homo sapiens
tgcggacagccacggcca

SEQ ID NO: 2545558 - DNA, 13 bp, Homo sapiens
tgcggagaacaaa

SEQ ID NO: 2545559 - DNA, 21 bp, Homo sapiens
tgcggagtgaagaggggcagc

SEQ ID NO: 2545560 - DNA, 15 bp, Homo sapiens
tgcggcccagcccgg

SEQ ID NO: 2545561 - DNA, 18 bp, Homo sapiens
tgcggcccagcccggctc

SEQ ID NO: 2545562 - DNA, 21 bp, Homo sapiens
tgcggcccagcccggctccca

SEQ ID NO: 2545563 - DNA, 17 bp, Homo sapiens
tgcggtccacccaggag

SEQ ID NO: 2545564 - DNA, 18 bp, Homo sapiens
tgcggtccacccaggagc

SEQ ID NO: 2545565 - DNA, 14 bp, Homo sapiens
tgcggtctagggaa

SEQ ID NO: 2545566 - DNA, 21 bp, Homo sapiens
tgcggtgctatctcccccagc

SEQ ID NO: 2545567 - DNA, 23 bp, Homo sapiens
tgcggtgctatctcccccagccc

SEQ ID NO: 2545568 - DNA, 16 bp, Homo sapiens
tgcgtaactggctgtg

SEQ ID NO: 2545569 - DNA, 23 bp, Homo sapiens
tgcgtacgtttcctgagaagtgt

SEQ ID NO: 2545570 - DNA, 19 bp, Homo sapiens
tgcgtatgtctgttaccat

SEQ ID NO: 2545571 - DNA, 22 bp, Homo sapiens
tgcgtgaaacacaccaggctgt

SEQ ID NO: 2545572 - DNA, 15 bp, Homo sapiens
tgcgtgcataccact

SEQ ID NO: 2545573 - DNA, 16 bp, Homo sapiens
tgcgtggactctgcac

SEQ ID NO: 2545574 - DNA, 17 bp, Homo sapiens
tgcgtggactctgcaca

SEQ ID NO: 2545575 - DNA, 22 bp, Homo sapiens
tgcgtggactctgcacatgtct

SEQ ID NO: 2545576 - DNA, 14 bp, Homo sapiens
tgcgtgtgtagagt

SEQ ID NO: 2545577 - DNA, 19 bp, Homo sapiens
tgcgtgtgtagagttaaga

SEQ ID NO: 2545578 - DNA, 20 bp, Homo sapiens
tgcgtgtgtagagttaagaa

SEQ ID NO: 2545579 - DNA, 17 bp, Homo sapiens
tgcgtgtgtccatgtgt

SEQ ID NO: 2545580 - DNA, 19 bp, Homo sapiens
tgcgtgtgtccatgtgtgt

SEQ ID NO: 2545581 - DNA, 14 bp, Homo sapiens
tgcgtgtttgcacg

SEQ ID NO: 2545582 - DNA, 13 bp, Homo sapiens
tgcgttactaatt

SEQ ID NO: 2545583 - DNA, 17 bp, Homo sapiens
tgcgttccatgatgctg

SEQ ID NO: 2545584 - DNA, 13 bp, Homo sapiens
tgcgttttggaag

SEQ ID NO: 2545585 - DNA, 15 bp, Homo sapiens
tgctaaaaatgggac

SEQ ID NO: 2545586 - DNA, 21 bp, Homo sapiens
tgctaaataaaatttgttgca

SEQ ID NO: 2545587 - DNA, 20 bp, Homo sapiens
tgctaaatggtcgcccagga

SEQ ID NO: 2545588 - DNA, 15 bp, Homo sapiens
tgctaaatgtaacag

SEQ ID NO: 2545589 - DNA, 19 bp, Homo sapiens
tgctaaatgtaacagtctg

SEQ ID NO: 2545590 - DNA, 15 bp, Homo sapiens
tgctaaatgtgaatg

SEQ ID NO: 2545591 - DNA, 15 bp, Homo sapiens
tgctaaattttcagt

SEQ ID NO: 2545592 - DNA, 17 bp, Homo sapiens
tgctaacttggagcccc

SEQ ID NO: 2545593 - DNA, 12 bp, Homo sapiens
tgctaataaaac

SEQ ID NO: 2545594 - DNA, 23 bp, Homo sapiens
tgctaatcagggaggtcattttg

SEQ ID NO: 2545595 - DNA, 18 bp, Homo sapiens
tgctaatttatcctgaaa

SEQ ID NO: 2545596 - DNA, 16 bp, Homo sapiens
tgctacaaaaacacag

SEQ ID NO: 2545597 - DNA, 18 bp, Homo sapiens
tgctacaaaaacacagca

SEQ ID NO: 2545598 - DNA, 12 bp, Homo sapiens
tgctacaaagaa

SEQ ID NO: 2545599 - DNA, 16 bp, Homo sapiens
tgctacaaagaagaca

SEQ ID NO: 2545600 - DNA, 17 bp, Homo sapiens
tgctacaaagaagacat

SEQ ID NO: 2545601 - DNA, 13 bp, Homo sapiens
tgctaccaaagca

SEQ ID NO: 2545602 - DNA, 13 bp, Homo sapiens
tgctacgtgtgat

SEQ ID NO: 2545603 - DNA, 16 bp, Homo sapiens
tgctactctgttcctt

SEQ ID NO: 2545604 - DNA, 20 bp, Homo sapiens
tgctactgattgtttcattg

SEQ ID NO: 2545605 - DNA, 20 bp, Homo sapiens
tgctagatgtgcaaatgcaa

SEQ ID NO: 2545606 - DNA, 16 bp, Homo sapiens
tgctagctctgagcca

SEQ ID NO: 2545607 - DNA, 19 bp, Homo sapiens
tgctaggaacactccttca

SEQ ID NO: 2545608 - DNA, 22 bp, Homo sapiens
tgctaggaacactccttcacag

SEQ ID NO: 2545609 - DNA, 14 bp, Homo sapiens
tgctaggtgggcca

SEQ ID NO: 2545610 - DNA, 19 bp, Homo sapiens
tgctaggtgggccagcccc

SEQ ID NO: 2545611 - DNA, 23 bp, Homo sapiens
tgctaggtgggccagcccctccc

SEQ ID NO: 2545612 - DNA, 23 bp, Homo sapiens
tgctataggctggagaagctcac

SEQ ID NO: 2545613 - DNA, 19 bp, Homo sapiens
tgctatccagctattttta

SEQ ID NO: 2545614 - DNA, 20 bp, Homo sapiens
tgctatctctgtgtgcacaa

SEQ ID NO: 2545615 - DNA, 18 bp, Homo sapiens
tgctatcttaattttggt

SEQ ID NO: 2545616 - DNA, 16 bp, Homo sapiens
tgctatgagctgggga

SEQ ID NO: 2545617 - DNA, 20 bp, Homo sapiens
tgctatgttttgacattttt

SEQ ID NO: 2545618 - DNA, 17 bp, Homo sapiens
tgctattgtaaatatgt

SEQ ID NO: 2545619 - DNA, 22 bp, Homo sapiens
tgctattgtagagccagaggtc

SEQ ID NO: 2545620 - DNA, 18 bp, Homo sapiens
tgctcaaaatttgaagaa

SEQ ID NO: 2545621 - DNA, 19 bp, Homo sapiens
tgctcaaatctattcagac

SEQ ID NO: 2545622 - DNA, 14 bp, Homo sapiens
tgctcaagaaacaa

SEQ ID NO: 2545623 - DNA, 14 bp, Homo sapiens
tgctcagaccagct

SEQ ID NO: 2545624 - DNA, 16 bp, Homo sapiens
tgctcagaccagctct

SEQ ID NO: 2545625 - DNA, 19 bp, Homo sapiens
tgctcaggcttgaaatgca

SEQ ID NO: 2545626 - DNA, 22 bp, Homo sapiens
tgctcagggaaaagcagctctc

SEQ ID NO: 2545627 - DNA, 19 bp, Homo sapiens
tgctcaggggcgtgtggct

SEQ ID NO: 2545628 - DNA, 20 bp, Homo sapiens
tgctcagggtcaatttcttt

SEQ ID NO: 2545629 - DNA, 16 bp, Homo sapiens
tgctcagtctcccttt

SEQ ID NO: 2545630 - DNA, 17 bp, Homo sapiens
tgctcagttcagaatca

SEQ ID NO: 2545631 - DNA, 18 bp, Homo sapiens
tgctcagttcagaatcac

SEQ ID NO: 2545632 - DNA, 23 bp, Homo sapiens
tgctcagttcagaatcacttctg

SEQ ID NO: 2545633 - DNA, 13 bp, Homo sapiens
tgctcagttgtag

SEQ ID NO: 2545634 - DNA, 16 bp, Homo sapiens
tgctcagttgtagaat

SEQ ID NO: 2545635 - DNA, 19 bp, Homo sapiens
tgctcagttgtagaatgta

SEQ ID NO: 2545636 - DNA, 22 bp, Homo sapiens
tgctcatattgtgattctgcct

SEQ ID NO: 2545637 - DNA, 21 bp, Homo sapiens
tgctcatcattctctgtctca

SEQ ID NO: 2545638 - DNA, 14 bp, Homo sapiens
tgctcatttcagga

SEQ ID NO: 2545639 - DNA, 14 bp, Homo sapiens
tgctccaccacatc

SEQ ID NO: 2545640 - DNA, 18 bp, Homo sapiens
tgctccacccttggcctg

SEQ ID NO: 2545641 - DNA, 18 bp, Homo sapiens
tgctccagccaacccctg

SEQ ID NO: 2545642 - DNA, 17 bp, Homo sapiens
tgctccagcctggctcc

SEQ ID NO: 2545643 - DNA, 19 bp, Homo sapiens
tgctccagctgttcagctg

SEQ ID NO: 2545644 - DNA, 22 bp, Homo sapiens
tgctccaggcaggctaaggcgt

SEQ ID NO: 2545645 - DNA, 18 bp, Homo sapiens
tgctccccagccctggct

SEQ ID NO: 2545646 - DNA, 20 bp, Homo sapiens
tgctcccccatcctcccctt

SEQ ID NO: 2545647 - DNA, 23 bp, Homo sapiens
tgctcccccatcctccccttccc

SEQ ID NO: 2545648 - DNA, 15 bp, Homo sapiens
tgctccctcacatgt

SEQ ID NO: 2545649 - DNA, 17 bp, Homo sapiens
tgctccctcccctgccc

SEQ ID NO: 2545650 - DNA, 19 bp, Homo sapiens
tgctccctcccctgccctg

SEQ ID NO: 2545651 - DNA, 18 bp, Homo sapiens
tgctccctggttctgatg

SEQ ID NO: 2545652 - DNA, 13 bp, Homo sapiens
tgctcctccctgg

SEQ ID NO: 2545653 - DNA, 22 bp, Homo sapiens
tgctcctccctggctgccctgg

SEQ ID NO: 2545654 - DNA, 11 bp, Homo sapiens
tgctcctctcc

SEQ ID NO: 2545655 - DNA, 12 bp, Homo sapiens
tgctcctctcca

SEQ ID NO: 2545656 - DNA, 14 bp, Homo sapiens
tgctcctctccagg

SEQ ID NO: 2545657 - DNA, 17 bp, Homo sapiens
tgctcctctccccagca

SEQ ID NO: 2545658 - DNA, 19 bp, Homo sapiens
tgctcctggcccactgcat

SEQ ID NO: 2545659 - DNA, 14 bp, Homo sapiens
tgctccttgggccc

SEQ ID NO: 2545660 - DNA, 15 bp, Homo sapiens
tgctccttgggccct

SEQ ID NO: 2545661 - DNA, 16 bp, Homo sapiens
tgctccttgggccctt

SEQ ID NO: 2545662 - DNA, 23 bp, Homo sapiens
tgctcgattattccctgtacaat

SEQ ID NO: 2545663 - DNA, 14 bp, Homo sapiens
tgctctatcttgct

SEQ ID NO: 2545664 - DNA, 20 bp, Homo sapiens
tgctctccaagtctcagtgg

SEQ ID NO: 2545665 - DNA, 12 bp, Homo sapiens
tgctctcccctg

SEQ ID NO: 2545666 - DNA, 15 bp, Homo sapiens
tgctctcccctgccc

SEQ ID NO: 2545667 - DNA, 15 bp, Homo sapiens
tggcactcaacatga

SEQ ID NO: 2545668 - DNA, 19 bp, Homo sapiens
tggcactcacagacctgga

SEQ ID NO: 2545669 - DNA, 17 bp, Homo sapiens
tggcactgagccccccc

SEQ ID NO: 2545670 - DNA, 18 bp, Homo sapiens
tggcactgcttccagtga

SEQ ID NO: 2545671 - DNA, 22 bp, Homo sapiens
tggcactgcttccagtgaggct

SEQ ID NO: 2545672 - DNA, 14 bp, Homo sapiens
tggcacttgcatct

SEQ ID NO: 2545673 - DNA, 17 bp, Homo sapiens
tggcacttgcatctgtg

SEQ ID NO: 2545674 - DNA, 16 bp, Homo sapiens
tggcactttgaagggg

SEQ ID NO: 2545675 - DNA, 20 bp, Homo sapiens
tggcagaagacaccagagca

SEQ ID NO: 2545676 - DNA, 21 bp, Homo sapiens
tggcagataatcagcctctta

SEQ ID NO: 2545677 - DNA, 20 bp, Homo sapiens
tggcagcagagtgtggcctt

SEQ ID NO: 2545678 - DNA, 11 bp, Homo sapiens
tggcagccctg

SEQ ID NO: 2545679 - DNA, 14 bp, Homo sapiens
tggcagccctgtag

SEQ ID NO: 2545680 - DNA, 14 bp, Homo sapiens
tggcagccgagctc

SEQ ID NO: 2545681 - DNA, 15 bp, Homo sapiens
tggcagctcacctct

SEQ ID NO: 2545682 - DNA, 19 bp, Homo sapiens
tggcagctcacctctccct

SEQ ID NO: 2545683 - DNA, 18 bp, Homo sapiens
tggcagctcagagagggt

SEQ ID NO: 2545684 - DNA, 17 bp, Homo sapiens
tggcagctgcggtccac

SEQ ID NO: 2545685 - DNA, 23 bp, Homo sapiens
tggcagctgcggtccacccagga

SEQ ID NO: 2545686 - DNA, 14 bp, Homo sapiens
tggcaggaccagga

SEQ ID NO: 2545687 - DNA, 22 bp, Homo sapiens
tggcaggatgaccctgcgaagg

SEQ ID NO: 2545688 - DNA, 20 bp, Homo sapiens
tggcaggatggcctggccag

SEQ ID NO: 2545689 - DNA, 23 bp, Homo sapiens
tggcaggcagcgccaagcaacct

SEQ ID NO: 2545690 - DNA, 15 bp, Homo sapiens
tggcagggcctagct

SEQ ID NO: 2545691 - DNA, 11 bp, Homo sapiens
tggcagggctc

SEQ ID NO: 2545692 - DNA, 22 bp, Homo sapiens
tggcaggtggaggtgtcaggct

SEQ ID NO: 2545693 - DNA, 16 bp, Homo sapiens
tggcagtctgaatttt

SEQ ID NO: 2545694 - DNA, 14 bp, Homo sapiens
tggcagtgggagct

SEQ ID NO: 2545695 - DNA, 20 bp, Homo sapiens
tggcagtgggagctgcctgt

SEQ ID NO: 2545696 - DNA, 17 bp, Homo sapiens
tggcatcctgtgaagtc

SEQ ID NO: 2545697 - DNA, 16 bp, Homo sapiens
tggcatctttgccttg

SEQ ID NO: 2545698 - DNA, 21 bp, Homo sapiens
tggcatctttgccttgggctg

SEQ ID NO: 2545699 - DNA, 23 bp, Homo sapiens
tggcatctttgccttgggctgct

SEQ ID NO: 2545700 - DNA, 15 bp, Homo sapiens
tggcatggctccagt

SEQ ID NO: 2545701 - DNA, 17 bp, Homo sapiens
tggcatggctccagtct

SEQ ID NO: 2545702 - DNA, 23 bp, Homo sapiens
tggccaaagccaaagctaggcct

SEQ ID NO: 2545703 - DNA, 20 bp, Homo sapiens
tggccaaattatttgtgtaa

SEQ ID NO: 2545704 - DNA, 22 bp, Homo sapiens
tggccaacatcgtgaaaccctg

SEQ ID NO: 2545705 - DNA, 15 bp, Homo sapiens
tggccaccaggctgg

SEQ ID NO: 2545706 - DNA, 17 bp, Homo sapiens
tggccaccaggctggcg

SEQ ID NO: 2545707 - DNA, 23 bp, Homo sapiens
tggccaccaggctggcgcagcca

SEQ ID NO: 2545708 - DNA, 12 bp, Homo sapiens
tggccactcagc

SEQ ID NO: 2545709 - DNA, 14 bp, Homo sapiens
tggccactgcacag

SEQ ID NO: 2545710 - DNA, 20 bp, Homo sapiens
tggccactgcacagagctct

SEQ ID NO: 2545711 - DNA, 24 bp, Homo sapiens
tggccagagctgggaggcatggcc

SEQ ID NO: 2545712 - DNA, 19 bp, Homo sapiens
tggccagatgcaccagccc

SEQ ID NO: 2545713 - DNA, 21 bp, Homo sapiens
tggccagccaacttttgcatg

SEQ ID NO: 2545714 - DNA, 15 bp, Homo sapiens
tggccagcccggctg

SEQ ID NO: 2545715 - DNA, 20 bp, Homo sapiens
tggccagcccggctggtttt

SEQ ID NO: 2545716 - DNA, 14 bp, Homo sapiens
tggccagcctggat

SEQ ID NO: 2545717 - DNA, 14 bp, Homo sapiens
tggccaggagctct

SEQ ID NO: 2545718 - DNA, 12 bp, Homo sapiens
tggccaggatgg

SEQ ID NO: 2545719 - DNA, 14 bp, Homo sapiens
tggccaggatggag

SEQ ID NO: 2545720 - DNA, 12 bp, Homo sapiens
tggccaggcaga

SEQ ID NO: 2545721 - DNA, 17 bp, Homo sapiens
tggccaggcagatctgt

SEQ ID NO: 2545722 - DNA, 20 bp, Homo sapiens
tggccaggcagatctgtgcc

SEQ ID NO: 2545723 - DNA, 23 bp, Homo sapiens
tggccaggcagatctgtgcccca

SEQ ID NO: 2545724 - DNA, 23 bp, Homo sapiens
tggccagggcctggaagacagag

SEQ ID NO: 2545725 - DNA, 19 bp, Homo sapiens
tggccagggtgagagctgc

SEQ ID NO: 2545726 - DNA, 14 bp, Homo sapiens
tggccagtggctgg

SEQ ID NO: 2545727 - DNA, 16 bp, Homo sapiens
tggccagtggctggat

SEQ ID NO: 2545728 - DNA, 23 bp, Homo sapiens
tggccagtggctggatctgtgag

SEQ ID NO: 2545729 - DNA, 16 bp, Homo sapiens
tggccagtgtgatccc

SEQ ID NO: 2545730 - DNA, 17 bp, Homo sapiens
tggccattctattgtgg

SEQ ID NO: 2545731 - DNA, 14 bp, Homo sapiens
tggccatttgcttt

SEQ ID NO: 2545732 - DNA, 19 bp, Homo sapiens
tggcccacagcaggtgctg

SEQ ID NO: 2545733 - DNA, 19 bp, Homo sapiens
tggcccacgcacttcggga

SEQ ID NO: 2545734 - DNA, 20 bp, Homo sapiens
tggcccacgcctgtaatccc

SEQ ID NO: 2545735 - DNA, 10 bp, Homo sapiens
tggcccagcc

SEQ ID NO: 2545736 - DNA, 19 bp, Homo sapiens
tggcccagccctgctggcc

SEQ ID NO: 2545737 - DNA, 11 bp, Homo sapiens
tggcccagccg

SEQ ID NO: 2545738 - DNA, 13 bp, Homo sapiens
tggcccagtgtca

SEQ ID NO: 2545739 - DNA, 14 bp, Homo sapiens
tggcccccgagctg

SEQ ID NO: 2545740 - DNA, 16 bp, Homo sapiens
tggcccccgagctggg

SEQ ID NO: 2545741 - DNA, 13 bp, Homo sapiens
tggccccgccgcc

SEQ ID NO: 2545742 - DNA, 15 bp, Homo sapiens
tggccccgccgcctg

SEQ ID NO: 2545743 - DNA, 20 bp, Homo sapiens
tggccccgccgcctggtact

SEQ ID NO: 2545744 - DNA, 13 bp, Homo sapiens
tggcccctcacct

SEQ ID NO: 2545745 - DNA, 20 bp, Homo sapiens
tggcccctcagggtccctgg

SEQ ID NO: 2545746 - DNA, 21 bp, Homo sapiens
tggcccctcagggtccctggt

SEQ ID NO: 2545747 - DNA, 22 bp, Homo sapiens
tggcccctcagggtccctggtg

SEQ ID NO: 2545748 - DNA, 18 bp, Homo sapiens
tggcccctctgacctgca

SEQ ID NO: 2545749 - DNA, 14 bp, Homo sapiens
tggcccctgcccgg

SEQ ID NO: 2545750 - DNA, 13 bp, Homo sapiens
tggccccttcact

SEQ ID NO: 2545751 - DNA, 15 bp, Homo sapiens
tggcccgtgacagac

SEQ ID NO: 2545752 - DNA, 20 bp, Homo sapiens
tggcccgtgacagactcctg

SEQ ID NO: 2545753 - DNA, 20 bp, Homo sapiens
tggccctcacccctgccctg

SEQ ID NO: 2545754 - DNA, 14 bp, Homo sapiens
tggccctctacccc

SEQ ID NO: 2545755 - DNA, 15 bp, Homo sapiens
tggccctctgtgttg

SEQ ID NO: 2545756 - DNA, 19 bp, Homo sapiens
tggcccttcccactggagg

SEQ ID NO: 2545757 - DNA, 23 bp, Homo sapiens
tggcccttgcagttcagcaccac

SEQ ID NO: 2545758 - DNA, 12 bp, Homo sapiens
tggccgcctcac

SEQ ID NO: 2545759 - DNA, 18 bp, Homo sapiens
tggccgcctcaccccctc

SEQ ID NO: 2545760 - DNA, 24 bp, Homo sapiens
tggccggcaaccccagttctgctc

SEQ ID NO: 2545761 - DNA, 15 bp, Homo sapiens
tggccgggaccccga

SEQ ID NO: 2545762 - DNA, 17 bp, Homo sapiens
tggccgggaccccgagc

SEQ ID NO: 2545763 - DNA, 17 bp, Homo sapiens
tggccgggtgcggtggc

SEQ ID NO: 2545764 - DNA, 20 bp, Homo sapiens
tggcctagcatacgtacaca

SEQ ID NO: 2545765 - DNA, 23 bp, Homo sapiens
tggcctagcatacgtacacattt

SEQ ID NO: 2545766 - DNA, 13 bp, Homo sapiens
tggcctatgcaca

SEQ ID NO: 2545767 - DNA, 14 bp, Homo sapiens
tggcctatgcacat

SEQ ID NO: 2545768 - DNA, 20 bp, Homo sapiens
tggcctattatattaaaata

SEQ ID NO: 2545769 - DNA, 16 bp, Homo sapiens
tggcctcaaccctccc

SEQ ID NO: 2545770 - DNA, 21 bp, Homo sapiens
tggcctcaagatcaatgaaat

SEQ ID NO: 2545771 - DNA, 17 bp, Homo sapiens
tggcctcagaattcaca

SEQ ID NO: 2545772 - DNA, 14 bp, Homo sapiens
tggcctcagctgcc

SEQ ID NO: 2545773 - DNA, 14 bp, Homo sapiens
tggcctcccaactc

SEQ ID NO: 2545774 - DNA, 21 bp, Homo sapiens
tggcctcccaactcaccccag

SEQ ID NO: 2545775 - DNA, 23 bp, Homo sapiens
tggcctcccaactcaccccagcc

SEQ ID NO: 2545776 - DNA, 13 bp, Homo sapiens
tggcctcccaccc

SEQ ID NO: 2545777 - DNA, 21 bp, Homo sapiens
tggcctcccacccgatgctgc

SEQ ID NO: 2545778 - DNA, 22 bp, Homo sapiens
tggcctcccacccgatgctgct

SEQ ID NO: 2545779 - DNA, 18 bp, Homo sapiens
tggcctccggcctcccct

SEQ ID NO: 2545780 - DNA, 19 bp, Homo sapiens
tggcctccggcgtcagcct

SEQ ID NO: 2545781 - DNA, 21 bp, Homo sapiens
tggcctctccttgtggcctgg

SEQ ID NO: 2545782 - DNA, 13 bp, Homo sapiens
tggcctctgcact

SEQ ID NO: 2545783 - DNA, 14 bp, Homo sapiens
tggcctctgcactc

SEQ ID NO: 2545784 - DNA, 16 bp, Homo sapiens
tggcctctggctctca

SEQ ID NO: 2545785 - DNA, 13 bp, Homo sapiens
tggcctcttcaga

SEQ ID NO: 2545786 - DNA, 21 bp, Homo sapiens
tggcctgcacggtgggccttg

SEQ ID NO: 2545787 - DNA, 23 bp, Homo sapiens
tggcctgcacggtgggccttgct

SEQ ID NO: 2545788 - DNA, 14 bp, Homo sapiens
tggcctgcactaat

SEQ ID NO: 2545789 - DNA, 16 bp, Homo sapiens
tggcctgcactaattt

SEQ ID NO: 2545790 - DNA, 16 bp, Homo sapiens
tggcctggaggtgggg

SEQ ID NO: 2545791 - DNA, 18 bp, Homo sapiens
tggcctggaggtggggtt

SEQ ID NO: 2545792 - DNA, 21 bp, Homo sapiens
tggcctggatctccccactct

SEQ ID NO: 2545793 - DNA, 12 bp, Homo sapiens
tggcctggcaca

SEQ ID NO: 2545794 - DNA, 18 bp, Homo sapiens
tggcctggcacacatcag

SEQ ID NO: 2545795 - DNA, 17 bp, Homo sapiens
tggcctggccaggagct

SEQ ID NO: 2545796 - DNA, 12 bp, Homo sapiens
tggcctggcccc

SEQ ID NO: 2545797 - DNA, 14 bp, Homo sapiens
tggcctgtctcatc

SEQ ID NO: 2545798 - DNA, 16 bp, Homo sapiens
tggcctgtctcatccc

SEQ ID NO: 2545799 - DNA, 20 bp, Homo sapiens
tggcctgtctcatccccagg

SEQ ID NO: 2545800 - DNA, 20 bp, Homo sapiens
tggcctgtgtcccatgaccc

SEQ ID NO: 2545801 - DNA, 21 bp, Homo sapiens
tggcctgttcttctatgggtt

SEQ ID NO: 2545802 - DNA, 18 bp, Homo sapiens
tggccttccatttatatg

SEQ ID NO: 2545803 - DNA, 16 bp, Homo sapiens
tggccttcctgcccta

SEQ ID NO: 2545804 - DNA, 23 bp, Homo sapiens
tggccttgcagcactcacacagg

SEQ ID NO: 2545805 - DNA, 16 bp, Homo sapiens
tggccttttcctattt

SEQ ID NO: 2545806 - DNA, 22 bp, Homo sapiens
tggcgcagcatattcaggaagc

SEQ ID NO: 2545807 - DNA, 23 bp, Homo sapiens
tggcgcagcatattcaggaagct

SEQ ID NO: 2545808 - DNA, 23 bp, Homo sapiens
tggcggcagcagccatcatagga

SEQ ID NO: 2545809 - DNA, 22 bp, Homo sapiens
tggcgtctgtcttcaagggctt

SEQ ID NO: 2545810 - DNA, 21 bp, Homo sapiens
tggctaactatatttgctttt

SEQ ID NO: 2545811 - DNA, 16 bp, Homo sapiens
tggttataaaagtgat

SEQ ID NO: 2545812 - DNA, 22 bp, Homo sapiens
tggttatttagggaactgcttg

SEQ ID NO: 2545813 - DNA, 23 bp, Homo sapiens
tggttcagggttggcccctgccc

SEQ ID NO: 2545814 - DNA, 16 bp, Homo sapiens
tggttcataaatgaat

SEQ ID NO: 2545815 - DNA, 13 bp, Homo sapiens
tggttccaagccc

SEQ ID NO: 2545816 - DNA, 17 bp, Homo sapiens
tggttccaagccctgga

SEQ ID NO: 2545817 - DNA, 15 bp, Homo sapiens
tggttccatgcctga

SEQ ID NO: 2545818 - DNA, 21 bp, Homo sapiens
tggttccattgtttggagaca

SEQ ID NO: 2545819 - DNA, 18 bp, Homo sapiens
tggttcccgtttctccac

SEQ ID NO: 2545820 - DNA, 16 bp, Homo sapiens
tggttctatttaatgg

SEQ ID NO: 2545821 - DNA, 12 bp, Homo sapiens
tggttgaataaa

SEQ ID NO: 2545822 - DNA, 18 bp, Homo sapiens
tggttgaataaactagat

SEQ ID NO: 2545823 - DNA, 17 bp, Homo sapiens
tggttgccttaaagaaa

SEQ ID NO: 2545824 - DNA, 18 bp, Homo sapiens
tggttgccttaaagaaag

SEQ ID NO: 2545825 - DNA, 11 bp, Homo sapiens
tggttgtattc

SEQ ID NO: 2545826 - DNA, 15 bp, Homo sapiens
tggttgtattctttg

SEQ ID NO: 2545827 - DNA, 16 bp, Homo sapiens
tggttgtattctttga

SEQ ID NO: 2545828 - DNA, 17 bp, Homo sapiens
tggttgtattctttgat

SEQ ID NO: 2545829 - DNA, 17 bp, Homo sapiens
tggttgtcaatattaaa

SEQ ID NO: 2545830 - DNA, 11 bp, Homo sapiens
tggtttataga

SEQ ID NO: 2545831 - DNA, 11 bp, Homo sapiens
tggtttatgtc

SEQ ID NO: 2545832 - DNA, 16 bp, Homo sapiens
tggtttcaaagattca

SEQ ID NO: 2545833 - DNA, 14 bp, Homo sapiens
tggtttcagaaatg

SEQ ID NO: 2545834 - DNA, 20 bp, Homo sapiens
tggtttcccccttctacatt

SEQ ID NO: 2545835 - DNA, 12 bp, Homo sapiens
tggtttctccag

SEQ ID NO: 2545836 - DNA, 23 bp, Homo sapiens
tggtttcttcaacaggagaattt

SEQ ID NO: 2545837 - DNA, 15 bp, Homo sapiens
tggtttgcaaggaag

SEQ ID NO: 2545838 - DNA, 15 bp, Homo sapiens
tggtttgcagagctt

SEQ ID NO: 2545839 - DNA, 14 bp, Homo sapiens
tggtttgcagatga

SEQ ID NO: 2545840 - DNA, 16 bp, Homo sapiens
tggtttggaatgcttc

SEQ ID NO: 2545841 - DNA, 22 bp, Homo sapiens
tggtttggaatgcttcttctca

SEQ ID NO: 2545842 - DNA, 19 bp, Homo sapiens
tggtttggggcgaggcaga

SEQ ID NO: 2545843 - DNA, 15 bp, Homo sapiens
tggtttgtaaattaa

SEQ ID NO: 2545844 - DNA, 18 bp, Homo sapiens
tggttttaacaatttcct

SEQ ID NO: 2545845 - DNA, 18 bp, Homo sapiens
tggttttcccctccctgg

SEQ ID NO: 2545846 - DNA, 22 bp, Homo sapiens
tggttttcccctccctgggttc

SEQ ID NO: 2545847 - DNA, 22 bp, Homo sapiens
tggttttcctaaatgcagtgaa

SEQ ID NO: 2545848 - DNA, 15 bp, Homo sapiens
tggttttctgttctt

SEQ ID NO: 2545849 - DNA, 19 bp, Homo sapiens
tgtaaaaaaaaatgccttt

SEQ ID NO: 2545850 - DNA, 19 bp, Homo sapiens
tgtaaaaacagcattgctt

SEQ ID NO: 2545851 - DNA, 23 bp, Homo sapiens
tgtaaaacaaaaatgtaatgatc

SEQ ID NO: 2545852 - DNA, 18 bp, Homo sapiens
tgtaaaacctgtcaatga

SEQ ID NO: 2545853 - DNA, 19 bp, Homo sapiens
tgtaaaagaacagtaaaca

SEQ ID NO: 2545854 - DNA, 22 bp, Homo sapiens
tgtaaaaggccaaacctctgtt

SEQ ID NO: 2545855 - DNA, 14 bp, Homo sapiens
tgtaaaataaaatt

SEQ ID NO: 2545856 - DNA, 18 bp, Homo sapiens
tgtaaaatatacttaaat

SEQ ID NO: 2545857 - DNA, 19 bp, Homo sapiens
tgtaaaatattttgaatca

SEQ ID NO: 2545858 - DNA, 15 bp, Homo sapiens
tgtaaaatgaaatta

SEQ ID NO: 2545859 - DNA, 12 bp, Homo sapiens
tgtaaaatggtg

SEQ ID NO: 2545860 - DNA, 17 bp, Homo sapiens
tgtaaaatgttgaataa

SEQ ID NO: 2545861 - DNA, 21 bp, Homo sapiens
tgtaaacaaaatttagttttt

SEQ ID NO: 2545862 - DNA, 21 bp, Homo sapiens
tgtaaactcaaaacttaacat

SEQ ID NO: 2545863 - DNA, 22 bp, Homo sapiens
tgtaaactcaaaacttaacata

SEQ ID NO: 2545864 - DNA, 23 bp, Homo sapiens
tgtaaactcaaaatatttgtaca

SEQ ID NO: 2545865 - DNA, 18 bp, Homo sapiens
tgtaaactgcattagaaa

SEQ ID NO: 2545866 - DNA, 13 bp, Homo sapiens
tgtaaactgtgta

SEQ ID NO: 2545867 - DNA, 13 bp, Homo sapiens
tgtaaactttttg

SEQ ID NO: 2545868 - DNA, 18 bp, Homo sapiens
tgtaaagaaagagagaaa

SEQ ID NO: 2545869 - DNA, 20 bp, Homo sapiens
tgtaaagaaagagagaaaat

SEQ ID NO: 2545870 - DNA, 21 bp, Homo sapiens
tgtaaagaaagagagaaaata

SEQ ID NO: 2545871 - DNA, 23 bp, Homo sapiens
tgtaaagaaagagagaaaataaa

SEQ ID NO: 2545872 - DNA, 18 bp, Homo sapiens
tgtaaagccaacaccctg

SEQ ID NO: 2545873 - DNA, 18 bp, Homo sapiens
tgtaaagtatgtaaacag

SEQ ID NO: 2545874 - DNA, 13 bp, Homo sapiens
tgtaaagtgtggt

SEQ ID NO: 2545875 - DNA, 12 bp, Homo sapiens
tgtaaagttagt

SEQ ID NO: 2545876 - DNA, 21 bp, Homo sapiens
tgtaaatacacatagcatgta

SEQ ID NO: 2545877 - DNA, 12 bp, Homo sapiens
tgtaaatacacc

SEQ ID NO: 2545878 - DNA, 16 bp, Homo sapiens
tgtaaatagctcaggt

SEQ ID NO: 2545879 - DNA, 16 bp, Homo sapiens
tgtaaatattctatat

SEQ ID NO: 2545880 - DNA, 20 bp, Homo sapiens
tgtaaatattctatatgaat

SEQ ID NO: 2545881 - DNA, 19 bp, Homo sapiens
tgtaaatcctttttcttta

SEQ ID NO: 2545882 - DNA, 22 bp, Homo sapiens
tgtaaatcctttttctttataa

SEQ ID NO: 2545883 - DNA, 16 bp, Homo sapiens
tgtaaatggtgtacat

SEQ ID NO: 2545884 - DNA, 17 bp, Homo sapiens
tgtaaatggtgtacata

SEQ ID NO: 2545885 - DNA, 13 bp, Homo sapiens
tgtaaattaactt

SEQ ID NO: 2545886 - DNA, 14 bp, Homo sapiens
tgtaacaagccacc

SEQ ID NO: 2545887 - DNA, 16 bp, Homo sapiens
tgtaacacaagccaca

SEQ ID NO: 2545888 - DNA, 20 bp, Homo sapiens
tgtaacacaagccacagaag

SEQ ID NO: 2545889 - DNA, 21 bp, Homo sapiens
tgtaacacaagccacagaagc

SEQ ID NO: 2545890 - DNA, 15 bp, Homo sapiens
tgtaacagctgaggt

SEQ ID NO: 2545891 - DNA, 18 bp, Homo sapiens
tgtaacaggtctcctctt

SEQ ID NO: 2545892 - DNA, 21 bp, Homo sapiens
tgtaacaggtctcctcttaaa

SEQ ID NO: 2545893 - DNA, 17 bp, Homo sapiens
tgtaacatactggcctg

SEQ ID NO: 2545894 - DNA, 11 bp, Homo sapiens
tgtaacatgta

SEQ ID NO: 2545895 - DNA, 19 bp, Homo sapiens
tgtaacctcagctctggga

SEQ ID NO: 2545896 - DNA, 19 bp, Homo sapiens
tgtaacctcttcagaggcc

SEQ ID NO: 2545897 - DNA, 18 bp, Homo sapiens
tgtaactaggctcagaga

SEQ ID NO: 2545898 - DNA, 21 bp, Homo sapiens
tgtaactaggctcagagatgt

SEQ ID NO: 2545899 - DNA, 17 bp, Homo sapiens
tgtaactttctgaaata

SEQ ID NO: 2545900 - DNA, 21 bp, Homo sapiens
tgtaagaagagactgggaaga

SEQ ID NO: 2545901 - DNA, 15 bp, Homo sapiens
tgtaagagtgtagaa

SEQ ID NO: 2545902 - DNA, 14 bp, Homo sapiens
tgtaagatgctggg

SEQ ID NO: 2545903 - DNA, 18 bp, Homo sapiens
tgtaagggaaactgccag

SEQ ID NO: 2545904 - DNA, 14 bp, Homo sapiens
tgtaagtaattatc

SEQ ID NO: 2545905 - DNA, 14 bp, Homo sapiens
tgtaagtgtgagta

SEQ ID NO: 2545906 - DNA, 16 bp, Homo sapiens
tgtaagtttcaggtga

SEQ ID NO: 2545907 - DNA, 23 bp, Homo sapiens
tgtaagtttcaggtgacatgtga

SEQ ID NO: 2545908 - DNA, 13 bp, Homo sapiens
tgtaataagacat

SEQ ID NO: 2545909 - DNA, 13 bp, Homo sapiens
tgtaatcaataaa

SEQ ID NO: 2545910 - DNA, 15 bp, Homo sapiens
tgtaatcacagctac

SEQ ID NO: 2545911 - DNA, 21 bp, Homo sapiens
tgtaatcatttcttgggccct

SEQ ID NO: 2545912 - DNA, 16 bp, Homo sapiens
tgtaatcccagcactt

SEQ ID NO: 2545913 - DNA, 23 bp, Homo sapiens
tgtaatcccagcactttgggagg

SEQ ID NO: 2545914 - DNA, 20 bp, Homo sapiens
tgtaatcccagctactcggg

SEQ ID NO: 2545915 - DNA, 17 bp, Homo sapiens
tgtaatcccagctactt

SEQ ID NO: 2545916 - DNA, 18 bp, Homo sapiens
tgtaatcgttatgtgtgt

SEQ ID NO: 2545917 - DNA, 17 bp, Homo sapiens
tgtaatgaaacaccttc

SEQ ID NO: 2545918 - DNA, 17 bp, Homo sapiens
tgtaatgttactgatca

SEQ ID NO: 2545919 - DNA, 13 bp, Homo sapiens
tgtaattctaaat

SEQ ID NO: 2545920 - DNA, 14 bp, Homo sapiens
tgtaattctaaatg

SEQ ID NO: 2545921 - DNA, 16 bp, Homo sapiens
tgtaattgttgtttgt

SEQ ID NO: 2545922 - DNA, 17 bp, Homo sapiens
tgtaattgttgtttgta

SEQ ID NO: 2545923 - DNA, 19 bp, Homo sapiens
tgtaattgttgtttgtatg

SEQ ID NO: 2545924 - DNA, 21 bp, Homo sapiens
tgtaatttaaacaggcccagc

SEQ ID NO: 2545925 - DNA, 23 bp, Homo sapiens
tgtaatttaaacaggcccagcat

SEQ ID NO: 2545926 - DNA, 21 bp, Homo sapiens
tgtaatttctttgcctgttca

SEQ ID NO: 2545927 - DNA, 14 bp, Homo sapiens
tgtaatttgtgata

SEQ ID NO: 2545928 - DNA, 21 bp, Homo sapiens
tgtaatttgtgatacaatgct

SEQ ID NO: 2545929 - DNA, 21 bp, Homo sapiens
tgtaattttaaataaaagtga

SEQ ID NO: 2545930 - DNA, 22 bp, Homo sapiens
tgtacaaaataaacaaataaca

SEQ ID NO: 2545931 - DNA, 18 bp, Homo sapiens
tgtacaatgactttattg

SEQ ID NO: 2545932 - DNA, 13 bp, Homo sapiens
tgtacacgggact

SEQ ID NO: 2545933 - DNA, 16 bp, Homo sapiens
tgtacacgtgtcctgt

SEQ ID NO: 2545934 - DNA, 12 bp, Homo sapiens
tgtacactgaat

SEQ ID NO: 2545935 - DNA, 14 bp, Homo sapiens
tgtacactgaatat

SEQ ID NO: 2545936 - DNA, 19 bp, Homo sapiens
tgtacactgaatatttata

SEQ ID NO: 2545937 - DNA, 19 bp, Homo sapiens
tgtacagacgtatgcttat

SEQ ID NO: 2545938 - DNA, 12 bp, Homo sapiens
tgtacagagccc

SEQ ID NO: 2545939 - DNA, 16 bp, Homo sapiens
tgtacagagcccacgc

SEQ ID NO: 2545940 - DNA, 17 bp, Homo sapiens
tgtacagagcccacgcc

SEQ ID NO: 2545941 - DNA, 21 bp, Homo sapiens
tgtacagagcccacgccccca

SEQ ID NO: 2545942 - DNA, 22 bp, Homo sapiens
tgtacagcaaggagatttacaa

SEQ ID NO: 2545943 - DNA, 18 bp, Homo sapiens
tgtacagtctgtcatgaa

SEQ ID NO: 2545944 - DNA, 14 bp, Homo sapiens
tgtacagtcttgta

SEQ ID NO: 2545945 - DNA, 17 bp, Homo sapiens
tgtacagtcttgtatta

SEQ ID NO: 2545946 - DNA, 21 bp, Homo sapiens
tgtacagtcttgtattaagtt

SEQ ID NO: 2545947 - DNA, 16 bp, Homo sapiens
tgtacagtttgctgta

SEQ ID NO: 2545948 - DNA, 12 bp, Homo sapiens
tgtacagttttt

SEQ ID NO: 2545949 - DNA, 15 bp, Homo sapiens
tgtacataactgaaa

SEQ ID NO: 2545950 - DNA, 18 bp, Homo sapiens
tgtacataactgaaaatg

SEQ ID NO: 2545951 - DNA, 11 bp, Homo sapiens
tgtacatagcc

SEQ ID NO: 2545952 - DNA, 16 bp, Homo sapiens
tgtacatagcctatat

SEQ ID NO: 2545953 - DNA, 23 bp, Homo sapiens
tgtacatagcctatatttacagt

SEQ ID NO: 2545954 - DNA, 18 bp, Homo sapiens
tgtacatatgtaaaataa

SEQ ID NO: 2545955 - DNA, 18 bp, Homo sapiens
tgtacatcccatgtaaca

SEQ ID NO: 2545956 - DNA, 20 bp, Homo sapiens
tgtgctgcccgtcttcagcc

SEQ ID NO: 2545957 - DNA, 19 bp, Homo sapiens
tgtgctgccctgcccacct

SEQ ID NO: 2545958 - DNA, 15 bp, Homo sapiens
tgtgctggaggactg

SEQ ID NO: 2545959 - DNA, 16 bp, Homo sapiens
tgtgctgtgtaaagtt

SEQ ID NO: 2545960 - DNA, 14 bp, Homo sapiens
tgtgcttgtttaca

SEQ ID NO: 2545961 - DNA, 22 bp, Homo sapiens
tgtgctttccctgaactgggac

SEQ ID NO: 2545962 - DNA, 17 bp, Homo sapiens
tgtgctttgcattccta

SEQ ID NO: 2545963 - DNA, 14 bp, Homo sapiens
tgtggaaaaatatt

SEQ ID NO: 2545964 - DNA, 19 bp, Homo sapiens
tgtggaaaaatgagagaag

SEQ ID NO: 2545965 - DNA, 19 bp, Homo sapiens
tgtggaaagcctctgctgc

SEQ ID NO: 2545966 - DNA, 20 bp, Homo sapiens
tgtggaaagtgtaaagcatt

SEQ ID NO: 2545967 - DNA, 21 bp, Homo sapiens
tgtggaaagtgtaaagcattc

SEQ ID NO: 2545968 - DNA, 14 bp, Homo sapiens
tgtggaagggacta

SEQ ID NO: 2545969 - DNA, 18 bp, Homo sapiens
tgtggaagggactaggag

SEQ ID NO: 2545970 - DNA, 12 bp, Homo sapiens
tgtggagaagcg

SEQ ID NO: 2545971 - DNA, 19 bp, Homo sapiens
tgtggagagtgcaacagta

SEQ ID NO: 2545972 - DNA, 13 bp, Homo sapiens
tgtggagggcaca

SEQ ID NO: 2545973 - DNA, 19 bp, Homo sapiens
tgtggagggcacattcctt

SEQ ID NO: 2545974 - DNA, 12 bp, Homo sapiens
tgtggagtgggg

SEQ ID NO: 2545975 - DNA, 15 bp, Homo sapiens
tgtggatgtcttcct

SEQ ID NO: 2545976 - DNA, 19 bp, Homo sapiens
tgtggatgttttaattcca

SEQ ID NO: 2545977 - DNA, 19 bp, Homo sapiens
tgtggatttaacagaaatg

SEQ ID NO: 2545978 - DNA, 20 bp, Homo sapiens
tgtggatttaacagaaatgt

SEQ ID NO: 2545979 - DNA, 14 bp, Homo sapiens
tgtggcacattctt

SEQ ID NO: 2545980 - DNA, 23 bp, Homo sapiens
tgtggcaggcagcgccaagcaac

SEQ ID NO: 2545981 - DNA, 24 bp, Homo sapiens
tgtggccaaaggagggtcaggaag

SEQ ID NO: 2545982 - DNA, 19 bp, Homo sapiens
tgtggccagggtgagagct

SEQ ID NO: 2545983 - DNA, 15 bp, Homo sapiens
tgtggcctgtggcct

SEQ ID NO: 2545984 - DNA, 17 bp, Homo sapiens
tgtggcctgtggcctgt

SEQ ID NO: 2545985 - DNA, 13 bp, Homo sapiens
tgtggctcccctc

SEQ ID NO: 2545986 - DNA, 21 bp, Homo sapiens
tgtggctcctgggggttcttt

SEQ ID NO: 2545987 - DNA, 16 bp, Homo sapiens
tgtggctgaggaggcc

SEQ ID NO: 2545988 - DNA, 22 bp, Homo sapiens
tgtggctgaggaggcctccatc

SEQ ID NO: 2545989 - DNA, 14 bp, Homo sapiens
tgtggctgcagcag

SEQ ID NO: 2545990 - DNA, 21 bp, Homo sapiens
tgtggctgggggcaggagggc

SEQ ID NO: 2545991 - DNA, 15 bp, Homo sapiens
tgtggctgtcagcag

SEQ ID NO: 2545992 - DNA, 19 bp, Homo sapiens
tgtggctgtcagcaggaag

SEQ ID NO: 2545993 - DNA, 17 bp, Homo sapiens
tgtggctttctttcttt

SEQ ID NO: 2545994 - DNA, 15 bp, Homo sapiens
tgtgggaaggccagc

SEQ ID NO: 2545995 - DNA, 19 bp, Homo sapiens
tgtgggcctcaaggacttg

SEQ ID NO: 2545996 - DNA, 21 bp, Homo sapiens
tgtgggcctcaaggacttgaa

SEQ ID NO: 2545997 - DNA, 15 bp, Homo sapiens
tgtggggtgaaaagt

SEQ ID NO: 2545998 - DNA, 15 bp, Homo sapiens
tgtgggtcaaggaat

SEQ ID NO: 2545999 - DNA, 15 bp, Homo sapiens
tgtggtcccacccca

SEQ ID NO: 2546000 - DNA, 16 bp, Homo sapiens
tgtggtcccaccccac

SEQ ID NO: 2546001 - DNA, 17 bp, Homo sapiens
tgtggtctccttggaaa

SEQ ID NO: 2546002 - DNA, 22 bp, Homo sapiens
tgtggtgggttctttggaagga

SEQ ID NO: 2546003 - DNA, 14 bp, Homo sapiens
tgtggttaatgcca

SEQ ID NO: 2546004 - DNA, 17 bp, Homo sapiens
tgtggttatttctctga

SEQ ID NO: 2546005 - DNA, 21 bp, Homo sapiens
tgtggttttcccctccctggg

SEQ ID NO: 2546006 - DNA, 16 bp, Homo sapiens
tgtgtaatagaaaact

SEQ ID NO: 2546007 - DNA, 21 bp, Homo sapiens
tgtgtaatcatttcttgggcc

SEQ ID NO: 2546008 - DNA, 23 bp, Homo sapiens
tgtgtaatcatttcttgggccct

SEQ ID NO: 2546009 - DNA, 14 bp, Homo sapiens
tgtgtacaaagaaa

SEQ ID NO: 2546010 - DNA, 21 bp, Homo sapiens
tgtgtacagatgaatgataaa

SEQ ID NO: 2546011 - DNA, 21 bp, Homo sapiens
tgtgtagacaaatatttggag

SEQ ID NO: 2546012 - DNA, 16 bp, Homo sapiens
tgtgtagcctgtgcat

SEQ ID NO: 2546013 - DNA, 17 bp, Homo sapiens
tgtgtagctttgctctt

SEQ ID NO: 2546014 - DNA, 16 bp, Homo sapiens
tgtgtagggcgggagg

SEQ ID NO: 2546015 - DNA, 21 bp, Homo sapiens
tgtgtatagatgcaagatatt

SEQ ID NO: 2546016 - DNA, 19 bp, Homo sapiens
tgtgtatccattatcatgt

SEQ ID NO: 2546017 - DNA, 22 bp, Homo sapiens
tgtgtatccattatcatgtgta

SEQ ID NO: 2546018 - DNA, 21 bp, Homo sapiens
tgtgtatcgtaaccagccaga

SEQ ID NO: 2546019 - DNA, 19 bp, Homo sapiens
tgtgtatgtgcgtgtgtgc

SEQ ID NO: 2546020 - DNA, 14 bp, Homo sapiens
tgtgtatgtggggg

SEQ ID NO: 2546021 - DNA, 14 bp, Homo sapiens
tgtgtattgttccc

SEQ ID NO: 2546022 - DNA, 15 bp, Homo sapiens
tgtgtattgttccca

SEQ ID NO: 2546023 - DNA, 18 bp, Homo sapiens
tgtgtatttaacagggag

SEQ ID NO: 2546024 - DNA, 20 bp, Homo sapiens
tgtgtatttaacagggaggg

SEQ ID NO: 2546025 - DNA, 22 bp, Homo sapiens
tgtgtatttaacagggagggga

SEQ ID NO: 2546026 - DNA, 16 bp, Homo sapiens
tgtgtcaatgggcaat

SEQ ID NO: 2546027 - DNA, 17 bp, Homo sapiens
tgtgtccacgactgtct

SEQ ID NO: 2546028 - DNA, 19 bp, Homo sapiens
tgtgtccacgactgtctcc

SEQ ID NO: 2546029 - DNA, 14 bp, Homo sapiens
tgtgtccatgtgtg

SEQ ID NO: 2546030 - DNA, 16 bp, Homo sapiens
tgtgtccatgtgtgtg

SEQ ID NO: 2546031 - DNA, 21 bp, Homo sapiens
tgtgtcccatgacccacccct

SEQ ID NO: 2546032 - DNA, 16 bp, Homo sapiens
tgtgtccccctctgtc

SEQ ID NO: 2546033 - DNA, 14 bp, Homo sapiens
tgtgtcctggttcc

SEQ ID NO: 2546034 - DNA, 14 bp, Homo sapiens
tgtgtctacagaga

SEQ ID NO: 2546035 - DNA, 21 bp, Homo sapiens
tgtgtctcttggtcctgctgc

SEQ ID NO: 2546036 - DNA, 14 bp, Homo sapiens
tgtgtctgctcagt

SEQ ID NO: 2546037 - DNA, 14 bp, Homo sapiens
tgtgtcttaattat

SEQ ID NO: 2546038 - DNA, 22 bp, Homo sapiens
tgtgtctttcacagctcctccc

SEQ ID NO: 2546039 - DNA, 20 bp, Homo sapiens
tgtgtgaaataccagtgtgg

SEQ ID NO: 2546040 - DNA, 17 bp, Homo sapiens
tgtgtgaggagctgctg

SEQ ID NO: 2546041 - DNA, 19 bp, Homo sapiens
tgtgtgcagactcaataaa

SEQ ID NO: 2546042 - DNA, 14 bp, Homo sapiens
tgtgtgcatgtgtg

SEQ ID NO: 2546043 - DNA, 24 bp, Homo sapiens
tgtgtgccatagagtttaacacaa

SEQ ID NO: 2546044 - DNA, 18 bp, Homo sapiens
tgtgtgcgagtgtgtgca

SEQ ID NO: 2546045 - DNA, 19 bp, Homo sapiens
tgtgtggactgtgatgcca

SEQ ID NO: 2546046 - DNA, 13 bp, Homo sapiens
tgtgtgggtctat

SEQ ID NO: 2546047 - DNA, 20 bp, Homo sapiens
tgtgtggtgggttctttgga

SEQ ID NO: 2546048 - DNA, 20 bp, Homo sapiens
tgtgtggtttggtgtgttcc

SEQ ID NO: 2546049 - DNA, 22 bp, Homo sapiens
tgtgtgtccacgactgtctcca

SEQ ID NO: 2546050 - DNA, 12 bp, Homo sapiens
tgtgtgtgggag

SEQ ID NO: 2546051 - DNA, 20 bp, Homo sapiens
tgtgtgtgggagtgtgtaat

SEQ ID NO: 2546052 - DNA, 12 bp, Homo sapiens
tgtgtgtgtgca

SEQ ID NO: 2546053 - DNA, 14 bp, Homo sapiens
tgtgtgtgtgcgtg

SEQ ID NO: 2546054 - DNA, 13 bp, Homo sapiens
tgtgtgtgtgtat

SEQ ID NO: 2546055 - DNA, 15 bp, Homo sapiens
tgtgtgtgtgtatga

SEQ ID NO: 2546056 - DNA, 18 bp, Homo sapiens
tgtgtgttgtcttgaaag

SEQ ID NO: 2546057 - DNA, 18 bp, Homo sapiens
tgtgtgttgtgtgtggga

SEQ ID NO: 2546058 - DNA, 18 bp, Homo sapiens
tgtgtgtttaaataaagt

SEQ ID NO: 2546059 - DNA, 19 bp, Homo sapiens
tgtgtgtttaaataaagta

SEQ ID NO: 2546060 - DNA, 22 bp, Homo sapiens
tgtgtgtttaaataaagtatca

SEQ ID NO: 2546061 - DNA, 15 bp, Homo sapiens
tgtgtgtttcacttt

SEQ ID NO: 2546062 - DNA, 19 bp, Homo sapiens
tgtgttaccctcctgtaaa

SEQ ID NO: 2546063 - DNA, 23 bp, Homo sapiens
tgtgttacctgaaaacactgtgc

SEQ ID NO: 2546064 - DNA, 14 bp, Homo sapiens
tgtgttatgaagca

SEQ ID NO: 2546065 - DNA, 19 bp, Homo sapiens
tgtgttcccatttcagctg

SEQ ID NO: 2546066 - DNA, 15 bp, Homo sapiens
tgtgttccccaaagg

SEQ ID NO: 2546067 - DNA, 19 bp, Homo sapiens
tgtgttggggccttggcct

SEQ ID NO: 2546068 - DNA, 14 bp, Homo sapiens
tgtgttgtcttgaa

SEQ ID NO: 2546069 - DNA, 18 bp, Homo sapiens
tgtgttgtcttgaaagat

SEQ ID NO: 2546070 - DNA, 13 bp, Homo sapiens
tgtgttgtgatag

SEQ ID NO: 2546071 - DNA, 13 bp, Homo sapiens
tgtgtttcacttt

SEQ ID NO: 2546072 - DNA, 20 bp, Homo sapiens
tgtgtttctatgtgacaatt

SEQ ID NO: 2546073 - DNA, 14 bp, Homo sapiens
tgtgtttgttccta

SEQ ID NO: 2546074 - DNA, 23 bp, Homo sapiens
tgtgttttctgaataacatttgt

SEQ ID NO: 2546075 - DNA, 12 bp, Homo sapiens
tgttaaaataac

SEQ ID NO: 2546076 - DNA, 21 bp, Homo sapiens
tgttaacacattttgtataat

SEQ ID NO: 2546077 - DNA, 17 bp, Homo sapiens
tgttaaggaaactctta

SEQ ID NO: 2546078 - DNA, 20 bp, Homo sapiens
tgttaaggaaactcttatct

SEQ ID NO: 2546079 - DNA, 23 bp, Homo sapiens
tgttaaggaaactcttatctcag

SEQ ID NO: 2546080 - DNA, 15 bp, Homo sapiens
tgttaagtattttca

SEQ ID NO: 2546081 - DNA, 18 bp, Homo sapiens
tgttaataaaagtacatg

SEQ ID NO: 2546082 - DNA, 14 bp, Homo sapiens
tgttaatcaattta

SEQ ID NO: 2546083 - DNA, 17 bp, Homo sapiens
tgttaatggtttgaata

SEQ ID NO: 2546084 - DNA, 15 bp, Homo sapiens
tgttaattcagcact

SEQ ID NO: 2546085 - DNA, 23 bp, Homo sapiens
tgttacaggcaccgagaatgttg

SEQ ID NO: 2546086 - DNA, 12 bp, Homo sapiens
tgttacatcaca

SEQ ID NO: 2546087 - DNA, 19 bp, Homo sapiens
tgttaccatgtcactgtgg

SEQ ID NO: 2546088 - DNA, 16 bp, Homo sapiens
tgttacctactttgac

SEQ ID NO: 2546089 - DNA, 23 bp, Homo sapiens
tgttacctgaaaacactgtgcac

SEQ ID NO: 2546090 - DNA, 21 bp, Homo sapiens
tgttacctgatcaatgacaga

SEQ ID NO: 2546091 - DNA, 17 bp, Homo sapiens
tgttactaaagaaaata

SEQ ID NO: 2546092 - DNA, 15 bp, Homo sapiens
tgttactatctgctt

SEQ ID NO: 2546093 - DNA, 15 bp, Homo sapiens
tgttactctggttct

SEQ ID NO: 2546094 - DNA, 17 bp, Homo sapiens
tgttactctggttcttt

SEQ ID NO: 2546095 - DNA, 15 bp, Homo sapiens
tgttactgtcttcag

SEQ ID NO: 2546096 - DNA, 16 bp, Homo sapiens
tgttactgtcttcagt

SEQ ID NO: 2546097 - DNA, 12 bp, Homo sapiens
tgttacttacct

SEQ ID NO: 2546098 - DNA, 16 bp, Homo sapiens
tgttaggaaaatttca

SEQ ID NO: 2546099 - DNA, 20 bp, Homo sapiens
tgttagtatgaggcatttgt

SEQ ID NO: 2546100 - DNA, 13 bp, Homo sapiens
ttacccaagcaaa

SEQ ID NO: 2546101 - DNA, 21 bp, Homo sapiens
ttacccagagaatatatacat

SEQ ID NO: 2546102 - DNA, 22 bp, Homo sapiens
ttacccagagaatatatacatt

SEQ ID NO: 2546103 - DNA, 16 bp, Homo sapiens
ttacccatatcccctc

SEQ ID NO: 2546104 - DNA, 14 bp, Homo sapiens
ttaccgtttcttcc

SEQ ID NO: 2546105 - DNA, 16 bp, Homo sapiens
ttaccgtttcttccct

SEQ ID NO: 2546106 - DNA, 16 bp, Homo sapiens
ttacctaaacagatat

SEQ ID NO: 2546107 - DNA, 21 bp, Homo sapiens
ttacctaaacagatataaatg

SEQ ID NO: 2546108 - DNA, 23 bp, Homo sapiens
ttacctactttgactttttgcat

SEQ ID NO: 2546109 - DNA, 19 bp, Homo sapiens
ttacctcctgagaaaaaag

SEQ ID NO: 2546110 - DNA, 21 bp, Homo sapiens
ttacctctgatacctcaaccc

SEQ ID NO: 2546111 - DNA, 20 bp, Homo sapiens
ttacctcttaacaatttctg

SEQ ID NO: 2546112 - DNA, 12 bp, Homo sapiens
ttacctctttaa

SEQ ID NO: 2546113 - DNA, 20 bp, Homo sapiens
ttacctgaaaacactgtgca

SEQ ID NO: 2546114 - DNA, 17 bp, Homo sapiens
ttacctgatcaatgaca

SEQ ID NO: 2546115 - DNA, 19 bp, Homo sapiens
ttacctgatcaatgacaga

SEQ ID NO: 2546116 - DNA, 20 bp, Homo sapiens
ttacctgatcaatgacagag

SEQ ID NO: 2546117 - DNA, 18 bp, Homo sapiens
ttacctgggcattcttgt

SEQ ID NO: 2546118 - DNA, 23 bp, Homo sapiens
ttacctgttttcgcacctaccat

SEQ ID NO: 2546119 - DNA, 22 bp, Homo sapiens
ttaccttagattagctctggac

SEQ ID NO: 2546120 - DNA, 15 bp, Homo sapiens
ttaccttattgcact

SEQ ID NO: 2546121 - DNA, 19 bp, Homo sapiens
ttaccttttaattaatgaa

SEQ ID NO: 2546122 - DNA, 20 bp, Homo sapiens
ttacctttttatttgcatgt

SEQ ID NO: 2546123 - DNA, 22 bp, Homo sapiens
ttaccttttttatacataaaca

SEQ ID NO: 2546124 - DNA, 15 bp, Homo sapiens
ttaccttttttgata

SEQ ID NO: 2546125 - DNA, 23 bp, Homo sapiens
ttaccttttttgataaagtttct

SEQ ID NO: 2546126 - DNA, 18 bp, Homo sapiens
ttacgcccaacccttccc

SEQ ID NO: 2546127 - DNA, 20 bp, Homo sapiens
ttacggttttccaggtttaa

SEQ ID NO: 2546128 - DNA, 12 bp, Homo sapiens
ttacgtgagcca

SEQ ID NO: 2546129 - DNA, 22 bp, Homo sapiens
ttactaagatgacattgctaag

SEQ ID NO: 2546130 - DNA, 23 bp, Homo sapiens
ttactaagatgacattgctaaga

SEQ ID NO: 2546131 - DNA, 14 bp, Homo sapiens
ttactaagctttgc

SEQ ID NO: 2546132 - DNA, 14 bp, Homo sapiens
ttactaagttttta

SEQ ID NO: 2546133 - DNA, 14 bp, Homo sapiens
ttactacaaaattt

SEQ ID NO: 2546134 - DNA, 23 bp, Homo sapiens
ttactagggatccctcatctgtc

SEQ ID NO: 2546135 - DNA, 17 bp, Homo sapiens
ttactagtttcccttgc

SEQ ID NO: 2546136 - DNA, 19 bp, Homo sapiens
ttactatcatgtcaaacgt

SEQ ID NO: 2546137 - DNA, 16 bp, Homo sapiens
ttactatgcacaattt

SEQ ID NO: 2546138 - DNA, 17 bp, Homo sapiens
ttactcatgatcttgtg

SEQ ID NO: 2546139 - DNA, 20 bp, Homo sapiens
ttactgaaggtaaaattgaa

SEQ ID NO: 2546140 - DNA, 14 bp, Homo sapiens
ttactgagcttctc

SEQ ID NO: 2546141 - DNA, 16 bp, Homo sapiens
ttactgagcttctctg

SEQ ID NO: 2546142 - DNA, 17 bp, Homo sapiens
ttactgagcttctctgt

SEQ ID NO: 2546143 - DNA, 18 bp, Homo sapiens
ttactgagcttctctgtg

SEQ ID NO: 2546144 - DNA, 14 bp, Homo sapiens
ttactgatatattt

SEQ ID NO: 2546145 - DNA, 23 bp, Homo sapiens
ttactgatatattttacaatttt

SEQ ID NO: 2546146 - DNA, 15 bp, Homo sapiens
ttactgatcatgcat

SEQ ID NO: 2546147 - DNA, 18 bp, Homo sapiens
ttactgatcatgcattgt

SEQ ID NO: 2546148 - DNA, 19 bp, Homo sapiens
ttactgatcatgcattgtt

SEQ ID NO: 2546149 - DNA, 22 bp, Homo sapiens
ttactgcagcctttgcctcccc

SEQ ID NO: 2546150 - DNA, 21 bp, Homo sapiens
ttactgccaaagggaaatatc

SEQ ID NO: 2546151 - DNA, 11 bp, Homo sapiens
ttactgccact

SEQ ID NO: 2546152 - DNA, 17 bp, Homo sapiens
ttactggtccaaaagat

SEQ ID NO: 2546153 - DNA, 18 bp, Homo sapiens
ttactggtccaaaagatt

SEQ ID NO: 2546154 - DNA, 14 bp, Homo sapiens
ttactgtacatgaa

SEQ ID NO: 2546155 - DNA, 23 bp, Homo sapiens
ttactgtacatgaaaacacattt

SEQ ID NO: 2546156 - DNA, 22 bp, Homo sapiens
ttactgtctggttttaacaatt

SEQ ID NO: 2546157 - DNA, 14 bp, Homo sapiens
ttactgtgaaactg

SEQ ID NO: 2546158 - DNA, 14 bp, Homo sapiens
ttactgtggaggaa

SEQ ID NO: 2546159 - DNA, 16 bp, Homo sapiens
ttactgtggaggaagg

SEQ ID NO: 2546160 - DNA, 16 bp, Homo sapiens
ttactgtttctgtcag

SEQ ID NO: 2546161 - DNA, 15 bp, Homo sapiens
ttactgtttgttatg

SEQ ID NO: 2546162 - DNA, 19 bp, Homo sapiens
ttacttaaagatttatcaa

SEQ ID NO: 2546163 - DNA, 22 bp, Homo sapiens
ttacttaaagatttatcaaatc

SEQ ID NO: 2546164 - DNA, 13 bp, Homo sapiens
ttacttacctaaa

SEQ ID NO: 2546165 - DNA, 23 bp, Homo sapiens
ttacttcttatacatttgataaa

SEQ ID NO: 2546166 - DNA, 18 bp, Homo sapiens
ttactttaaaaggagcca

SEQ ID NO: 2546167 - DNA, 15 bp, Homo sapiens
ttactttaccacccc

SEQ ID NO: 2546168 - DNA, 20 bp, Homo sapiens
ttactttaccacccccacac

SEQ ID NO: 2546169 - DNA, 11 bp, Homo sapiens
ttactttctgt

SEQ ID NO: 2546170 - DNA, 18 bp, Homo sapiens
ttactttctgttgccaca

SEQ ID NO: 2546171 - DNA, 14 bp, Homo sapiens
ttactttgtgttca

SEQ ID NO: 2546172 - DNA, 22 bp, Homo sapiens
ttacttttataataaaaggaaa

SEQ ID NO: 2546173 - DNA, 14 bp, Homo sapiens
ttagaaatataatt

SEQ ID NO: 2546174 - DNA, 18 bp, Homo sapiens
ttagaaatgaccaatatt

SEQ ID NO: 2546175 - DNA, 16 bp, Homo sapiens
ttagaaatgcagaatc

SEQ ID NO: 2546176 - DNA, 18 bp, Homo sapiens
ttagaacaggcaagtgaa

SEQ ID NO: 2546177 - DNA, 14 bp, Homo sapiens
ttagaagaagtgtg

SEQ ID NO: 2546178 - DNA, 16 bp, Homo sapiens
ttagaagaagtgtgtc

SEQ ID NO: 2546179 - DNA, 15 bp, Homo sapiens
ttagaattatttaaa

SEQ ID NO: 2546180 - DNA, 16 bp, Homo sapiens
ttagaattatttaaac

SEQ ID NO: 2546181 - DNA, 15 bp, Homo sapiens
ttagacaaatactca

SEQ ID NO: 2546182 - DNA, 21 bp, Homo sapiens
ttagacaaatactcatgtgta

SEQ ID NO: 2546183 - DNA, 22 bp, Homo sapiens
ttagacaaatactcatgtgtat

SEQ ID NO: 2546184 - DNA, 13 bp, Homo sapiens
ttagacagtccct

SEQ ID NO: 2546185 - DNA, 16 bp, Homo sapiens
ttagacagtccctgcc

SEQ ID NO: 2546186 - DNA, 17 bp, Homo sapiens
ttagacagtccctgcca

SEQ ID NO: 2546187 - DNA, 15 bp, Homo sapiens
ttagaccacaaatag

SEQ ID NO: 2546188 - DNA, 11 bp, Homo sapiens
ttagacctcag

SEQ ID NO: 2546189 - DNA, 18 bp, Homo sapiens
ttagactacatttagaga

SEQ ID NO: 2546190 - DNA, 13 bp, Homo sapiens
ttagactcctcct

SEQ ID NO: 2546191 - DNA, 21 bp, Homo sapiens
ttagacttcgactcaggatcc

SEQ ID NO: 2546192 - DNA, 13 bp, Homo sapiens
ttagagcctccct

SEQ ID NO: 2546193 - DNA, 21 bp, Homo sapiens
ttagagctgacacaaacctgc

SEQ ID NO: 2546194 - DNA, 20 bp, Homo sapiens
ttagatgtgatttaatagtg

SEQ ID NO: 2546195 - DNA, 14 bp, Homo sapiens
ttagattagctctg

SEQ ID NO: 2546196 - DNA, 16 bp, Homo sapiens
ttagattagctctgga

SEQ ID NO: 2546197 - DNA, 23 bp, Homo sapiens
ttagattgaaaacttttctcaga

SEQ ID NO: 2546198 - DNA, 15 bp, Homo sapiens
ttagcaaatacatat

SEQ ID NO: 2546199 - DNA, 23 bp, Homo sapiens
ttagcaggagaggagagccagag

SEQ ID NO: 2546200 - DNA, 17 bp, Homo sapiens
ttagcatgtgttgaaaa

SEQ ID NO: 2546201 - DNA, 18 bp, Homo sapiens
ttagccaagtgtggtaga

SEQ ID NO: 2546202 - DNA, 17 bp, Homo sapiens
ttagccaggatcatggt

SEQ ID NO: 2546203 - DNA, 14 bp, Homo sapiens
ttagccccataatt

SEQ ID NO: 2546204 - DNA, 21 bp, Homo sapiens
ttagcgtagctaagtgaaaag

SEQ ID NO: 2546205 - DNA, 16 bp, Homo sapiens
ttagctactatatatg

SEQ ID NO: 2546206 - DNA, 23 bp, Homo sapiens
ttagctgatgaacttattctgta

SEQ ID NO: 2546207 - DNA, 16 bp, Homo sapiens
ttagctggcattacag

SEQ ID NO: 2546208 - DNA, 15 bp, Homo sapiens
ttagctgtgtgaaat

SEQ ID NO: 2546209 - DNA, 19 bp, Homo sapiens
ttagctgttatttctattt

SEQ ID NO: 2546210 - DNA, 17 bp, Homo sapiens
ttagcttagacctcagc

SEQ ID NO: 2546211 - DNA, 15 bp, Homo sapiens
ttagctttgctctgc

SEQ ID NO: 2546212 - DNA, 19 bp, Homo sapiens
ttagctttgctctgccaac

SEQ ID NO: 2546213 - DNA, 18 bp, Homo sapiens
ttaggaaataaaaccttt

SEQ ID NO: 2546214 - DNA, 23 bp, Homo sapiens
ttaggaattaagttatctttaaa

SEQ ID NO: 2546215 - DNA, 21 bp, Homo sapiens
ttaggacaatcagtcccctcc

SEQ ID NO: 2546216 - DNA, 23 bp, Homo sapiens
ttaggagattttaggtgttgatt

SEQ ID NO: 2546217 - DNA, 21 bp, Homo sapiens
ttaggagttcgagaccagcct

SEQ ID NO: 2546218 - DNA, 16 bp, Homo sapiens
ttaggatgtgtgcatg

SEQ ID NO: 2546219 - DNA, 15 bp, Homo sapiens
ttaggctattcacaa

SEQ ID NO: 2546220 - DNA, 15 bp, Homo sapiens
ttagggaaaacattc

SEQ ID NO: 2546221 - DNA, 21 bp, Homo sapiens
ttagggagagtcatattttga

SEQ ID NO: 2546222 - DNA, 12 bp, Homo sapiens
ttagggcagctt

SEQ ID NO: 2546223 - DNA, 18 bp, Homo sapiens
ttaggtggcaagctgtga

SEQ ID NO: 2546224 - DNA, 20 bp, Homo sapiens
ttaggttaaaaaaaggcatt

SEQ ID NO: 2546225 - DNA, 18 bp, Homo sapiens
ttaggttggcaaaaaggc

SEQ ID NO: 2546226 - DNA, 19 bp, Homo sapiens
ttaggtttttttgtatagt

SEQ ID NO: 2546227 - DNA, 12 bp, Homo sapiens
ttagtaatgcta

SEQ ID NO: 2546228 - DNA, 15 bp, Homo sapiens
ttagtatctaacatg

SEQ ID NO: 2546229 - DNA, 16 bp, Homo sapiens
ttagtatgaggcattt

SEQ ID NO: 2546230 - DNA, 13 bp, Homo sapiens
ttagtatttgcat

SEQ ID NO: 2546231 - DNA, 20 bp, Homo sapiens
ttagtctactcttaagccat

SEQ ID NO: 2546232 - DNA, 21 bp, Homo sapiens
ttagtctactcttaagccatc

SEQ ID NO: 2546233 - DNA, 16 bp, Homo sapiens
ttagtggctcaacatt

SEQ ID NO: 2546234 - DNA, 23 bp, Homo sapiens
ttagtggctcaacattgtgttcc

SEQ ID NO: 2546235 - DNA, 14 bp, Homo sapiens
ttagtgtcacttac

SEQ ID NO: 2546236 - DNA, 15 bp, Homo sapiens
ttagttatagtttca

SEQ ID NO: 2546237 - DNA, 15 bp, Homo sapiens
ttagttctttgttat

SEQ ID NO: 2546238 - DNA, 20 bp, Homo sapiens
ttagttgtatctcttttgaa

SEQ ID NO: 2546239 - DNA, 19 bp, Homo sapiens
ttagtttctgttctgtgga

SEQ ID NO: 2546240 - DNA, 18 bp, Homo sapiens
ttagtttggattcttatg

SEQ ID NO: 2546241 - DNA, 13 bp, Homo sapiens
ttataaactttac

SEQ ID NO: 2546242 - DNA, 21 bp, Homo sapiens
ttataaatatgaagctcacct

SEQ ID NO: 2546243 - DNA, 22 bp, Homo sapiens
ttataactcatcataaaataaa

SEQ ID NO: 2546244 - DNA, 14 bp, Homo sapiens
ttccccttccactg

SEQ ID NO: 2546245 - DNA, 15 bp, Homo sapiens
ttccccttccactga

SEQ ID NO: 2546246 - DNA, 22 bp, Homo sapiens
ttccccttgcccagggctcagc

SEQ ID NO: 2546247 - DNA, 13 bp, Homo sapiens
ttccccttgccct

SEQ ID NO: 2546248 - DNA, 23 bp, Homo sapiens
ttccccttgcccttgccctgacc

SEQ ID NO: 2546249 - DNA, 14 bp, Homo sapiens
ttcccctttcccca

SEQ ID NO: 2546250 - DNA, 17 bp, Homo sapiens
ttcccctttccccactc

SEQ ID NO: 2546251 - DNA, 14 bp, Homo sapiens
ttcccgtttctcca

SEQ ID NO: 2546252 - DNA, 17 bp, Homo sapiens
ttcccgtttctccacct

SEQ ID NO: 2546253 - DNA, 14 bp, Homo sapiens
ttccctacctcagg

SEQ ID NO: 2546254 - DNA, 14 bp, Homo sapiens
ttccctacttcctg

SEQ ID NO: 2546255 - DNA, 22 bp, Homo sapiens
ttccctagaaacttccaaatcc

SEQ ID NO: 2546256 - DNA, 16 bp, Homo sapiens
ttccctatctttgcca

SEQ ID NO: 2546257 - DNA, 14 bp, Homo sapiens
ttccctctccctgt

SEQ ID NO: 2546258 - DNA, 15 bp, Homo sapiens
ttccctctctctgac

SEQ ID NO: 2546259 - DNA, 11 bp, Homo sapiens
ttccctctgag

SEQ ID NO: 2546260 - DNA, 19 bp, Homo sapiens
ttccctctgctcctggagc

SEQ ID NO: 2546261 - DNA, 15 bp, Homo sapiens
ttccctgaatgtatt

SEQ ID NO: 2546262 - DNA, 10 bp, Homo sapiens
ttccctgcaa

SEQ ID NO: 2546263 - DNA, 12 bp, Homo sapiens
ttccctgcctgg

SEQ ID NO: 2546264 - DNA, 12 bp, Homo sapiens
ttccctggcctt

SEQ ID NO: 2546265 - DNA, 17 bp, Homo sapiens
ttccctggcctttcata

SEQ ID NO: 2546266 - DNA, 22 bp, Homo sapiens
ttcccttcagtaccctctcagc

SEQ ID NO: 2546267 - DNA, 23 bp, Homo sapiens
ttcccttcagtaccctctcagct

SEQ ID NO: 2546268 - DNA, 14 bp, Homo sapiens
ttcccttcatctgg

SEQ ID NO: 2546269 - DNA, 15 bp, Homo sapiens
ttcccttcatctgga

SEQ ID NO: 2546270 - DNA, 16 bp, Homo sapiens
ttcccttcatctggaa

SEQ ID NO: 2546271 - DNA, 22 bp, Homo sapiens
ttcccttcttggtttccaaagg

SEQ ID NO: 2546272 - DNA, 14 bp, Homo sapiens
ttcccttgagccct

SEQ ID NO: 2546273 - DNA, 11 bp, Homo sapiens
ttcccttggcc

SEQ ID NO: 2546274 - DNA, 14 bp, Homo sapiens
ttcccttggcctca

SEQ ID NO: 2546275 - DNA, 15 bp, Homo sapiens
ttccctttccttcca

SEQ ID NO: 2546276 - DNA, 20 bp, Homo sapiens
ttccctttgacgccatccca

SEQ ID NO: 2546277 - DNA, 23 bp, Homo sapiens
ttccgaaaaatcctcttcctctg

SEQ ID NO: 2546278 - DNA, 22 bp, Homo sapiens
ttccgacaaccgatgctccagc

SEQ ID NO: 2546279 - DNA, 14 bp, Homo sapiens
ttccgttaaaatac

SEQ ID NO: 2546280 - DNA, 16 bp, Homo sapiens
ttccgttaaaatacca

SEQ ID NO: 2546281 - DNA, 16 bp, Homo sapiens
ttcctacaaagatgtt

SEQ ID NO: 2546282 - DNA, 23 bp, Homo sapiens
ttcctacaagagcagcctgtggc

SEQ ID NO: 2546283 - DNA, 17 bp, Homo sapiens
ttcctacccaaccactc

SEQ ID NO: 2546284 - DNA, 13 bp, Homo sapiens
ttcctatacgcag

SEQ ID NO: 2546285 - DNA, 22 bp, Homo sapiens
ttcctatatagtttattgacaa

SEQ ID NO: 2546286 - DNA, 14 bp, Homo sapiens
ttcctatgtaactg

SEQ ID NO: 2546287 - DNA, 20 bp, Homo sapiens
ttcctattgtgatttgactg

SEQ ID NO: 2546288 - DNA, 22 bp, Homo sapiens
ttcctattgtgatttgactgtt

SEQ ID NO: 2546289 - DNA, 15 bp, Homo sapiens
ttcctatttcttata

SEQ ID NO: 2546290 - DNA, 23 bp, Homo sapiens
ttcctatttgccatgggcttcac

SEQ ID NO: 2546291 - DNA, 21 bp, Homo sapiens
ttcctcacaccaggcttgcct

SEQ ID NO: 2546292 - DNA, 14 bp, Homo sapiens
ttcctcatgaatta

SEQ ID NO: 2546293 - DNA, 13 bp, Homo sapiens
ttcctcattagca

SEQ ID NO: 2546294 - DNA, 11 bp, Homo sapiens
ttcctccccag

SEQ ID NO: 2546295 - DNA, 16 bp, Homo sapiens
ttcctcctccccactt

SEQ ID NO: 2546296 - DNA, 15 bp, Homo sapiens
ttcctcctccctcct

SEQ ID NO: 2546297 - DNA, 14 bp, Homo sapiens
ttcctcctggcaga

SEQ ID NO: 2546298 - DNA, 14 bp, Homo sapiens
ttcctcctgggccc

SEQ ID NO: 2546299 - DNA, 15 bp, Homo sapiens
ttcctcctgggccct

SEQ ID NO: 2546300 - DNA, 13 bp, Homo sapiens
ttcctcctgtgta

SEQ ID NO: 2546301 - DNA, 17 bp, Homo sapiens
ttcctcctgtgtacagg

SEQ ID NO: 2546302 - DNA, 19 bp, Homo sapiens
ttcctctagtgccctccac

SEQ ID NO: 2546303 - DNA, 17 bp, Homo sapiens
ttcctctattgatgtac

SEQ ID NO: 2546304 - DNA, 23 bp, Homo sapiens
ttcctctattgatgtacagtctg

SEQ ID NO: 2546305 - DNA, 19 bp, Homo sapiens
ttcctctcactaaacttta

SEQ ID NO: 2546306 - DNA, 10 bp, Homo sapiens
ttcctctgca

SEQ ID NO: 2546307 - DNA, 17 bp, Homo sapiens
ttcctctgcagctgacc

SEQ ID NO: 2546308 - DNA, 12 bp, Homo sapiens
ttcctctgggaa

SEQ ID NO: 2546309 - DNA, 18 bp, Homo sapiens
ttcctgaaagaaacagtt

SEQ ID NO: 2546310 - DNA, 14 bp, Homo sapiens
ttcctgaatgaaat

SEQ ID NO: 2546311 - DNA, 22 bp, Homo sapiens
ttcctgacactttaattaccaa

SEQ ID NO: 2546312 - DNA, 14 bp, Homo sapiens
ttcctgacccaggc

SEQ ID NO: 2546313 - DNA, 15 bp, Homo sapiens
ttcctgacccaggcc

SEQ ID NO: 2546314 - DNA, 16 bp, Homo sapiens
ttcctgacccaggccg

SEQ ID NO: 2546315 - DNA, 13 bp, Homo sapiens
ttcctgagcttgg

SEQ ID NO: 2546316 - DNA, 20 bp, Homo sapiens
ttcctgagcttggccagaag

SEQ ID NO: 2546317 - DNA, 21 bp, Homo sapiens
ttcctgaggaagagggactgt

SEQ ID NO: 2546318 - DNA, 18 bp, Homo sapiens
ttcctgatgcttcttcag

SEQ ID NO: 2546319 - DNA, 23 bp, Homo sapiens
ttcctgatgcttcttcagagact

SEQ ID NO: 2546320 - DNA, 21 bp, Homo sapiens
ttcctgcaggccaggccagct

SEQ ID NO: 2546321 - DNA, 15 bp, Homo sapiens
ttcctgccaccagtc

SEQ ID NO: 2546322 - DNA, 17 bp, Homo sapiens
ttcctgccaggcatggt

SEQ ID NO: 2546323 - DNA, 18 bp, Homo sapiens
ttcctgccgcaacagttt

SEQ ID NO: 2546324 - DNA, 18 bp, Homo sapiens
ttcctgcctgtctccttt

SEQ ID NO: 2546325 - DNA, 23 bp, Homo sapiens
ttcctgccttcttctttttgctg

SEQ ID NO: 2546326 - DNA, 24 bp, Homo sapiens
ttcctggacatcctcttctgctta

SEQ ID NO: 2546327 - DNA, 23 bp, Homo sapiens
ttcctggcaatagtgtgttctga

SEQ ID NO: 2546328 - DNA, 20 bp, Homo sapiens
ttcctggcactgcttccagt

SEQ ID NO: 2546329 - DNA, 15 bp, Homo sapiens
ttcctggtacccagc

SEQ ID NO: 2546330 - DNA, 16 bp, Homo sapiens
ttcctggtacccagcc

SEQ ID NO: 2546331 - DNA, 14 bp, Homo sapiens
ttcctggtctgtag

SEQ ID NO: 2546332 - DNA, 20 bp, Homo sapiens
ttcctggtgccaatttcaag

SEQ ID NO: 2546333 - DNA, 23 bp, Homo sapiens
ttcctgtaacacaagccacagaa

SEQ ID NO: 2546334 - DNA, 11 bp, Homo sapiens
ttcctgtgtct

SEQ ID NO: 2546335 - DNA, 20 bp, Homo sapiens
ttcctgttcttaagacgtga

SEQ ID NO: 2546336 - DNA, 15 bp, Homo sapiens
ttccttaaactgtgt

SEQ ID NO: 2546337 - DNA, 13 bp, Homo sapiens
ttccttacctttt

SEQ ID NO: 2546338 - DNA, 22 bp, Homo sapiens
ttccttagcttagacctcagcc

SEQ ID NO: 2546339 - DNA, 17 bp, Homo sapiens
ttccttcacatcctgtg

SEQ ID NO: 2546340 - DNA, 15 bp, Homo sapiens
ttccttcagcttcca

SEQ ID NO: 2546341 - DNA, 14 bp, Homo sapiens
ttccttctcatctg

SEQ ID NO: 2546342 - DNA, 13 bp, Homo sapiens
ttccttgctctcc

SEQ ID NO: 2546343 - DNA, 16 bp, Homo sapiens
ttccttgctctgcacc

SEQ ID NO: 2546344 - DNA, 21 bp, Homo sapiens
ttccttggcatgccttccagc

SEQ ID NO: 2546345 - DNA, 15 bp, Homo sapiens
ttccttggggcaggc

SEQ ID NO: 2546346 - DNA, 15 bp, Homo sapiens
ttccttgtatttaaa

SEQ ID NO: 2546347 - DNA, 21 bp, Homo sapiens
ttccttgtccccacactccta

SEQ ID NO: 2546348 - DNA, 23 bp, Homo sapiens
ttcctttaaaaaaatttaagtgc

SEQ ID NO: 2546349 - DNA, 21 bp, Homo sapiens
ttcctttcatttactgtggct

SEQ ID NO: 2546350 - DNA, 12 bp, Homo sapiens
ttcctttctcac

SEQ ID NO: 2546351 - DNA, 14 bp, Homo sapiens
ttcctttctcaccg

SEQ ID NO: 2546352 - DNA, 18 bp, Homo sapiens
ttcctttgtgtttctatt

SEQ ID NO: 2546353 - DNA, 20 bp, Homo sapiens
ttccttttaaaacacttcca

SEQ ID NO: 2546354 - DNA, 21 bp, Homo sapiens
ttccttttaaaacacttccat

SEQ ID NO: 2546355 - DNA, 17 bp, Homo sapiens
ttccttttgtgtacagt

SEQ ID NO: 2546356 - DNA, 21 bp, Homo sapiens
ttccttttttaaaaatgcaaa

SEQ ID NO: 2546357 - DNA, 16 bp, Homo sapiens
ttcgaagctcagccca

SEQ ID NO: 2546358 - DNA, 20 bp, Homo sapiens
ttcgagaagctgctctggaa

SEQ ID NO: 2546359 - DNA, 21 bp, Homo sapiens
ttcgagaagctgctctggaat

SEQ ID NO: 2546360 - DNA, 14 bp, Homo sapiens
ttcgagaccagcct

SEQ ID NO: 2546361 - DNA, 16 bp, Homo sapiens
ttcgagaccagcctgg

SEQ ID NO: 2546362 - DNA, 20 bp, Homo sapiens
ttcgatgggcccaattctta

SEQ ID NO: 2546363 - DNA, 21 bp, Homo sapiens
ttcgatgggcccaattcttac

SEQ ID NO: 2546364 - DNA, 22 bp, Homo sapiens
ttcgcatcaaaagacaattctt

SEQ ID NO: 2546365 - DNA, 19 bp, Homo sapiens
ttcgcgtgccctcgctgct

SEQ ID NO: 2546366 - DNA, 13 bp, Homo sapiens
ttcgctcctgtgt

SEQ ID NO: 2546367 - DNA, 19 bp, Homo sapiens
ttcgctcctgtgtcttgca

SEQ ID NO: 2546368 - DNA, 18 bp, Homo sapiens
ttcggaaaccttggtgta

SEQ ID NO: 2546369 - DNA, 15 bp, Homo sapiens
ttcggagttgggggt

SEQ ID NO: 2546370 - DNA, 20 bp, Homo sapiens
ttcgggaggtcgaggcagga

SEQ ID NO: 2546371 - DNA, 14 bp, Homo sapiens
ttcgggccctgcct

SEQ ID NO: 2546372 - DNA, 20 bp, Homo sapiens
ttcgtacagttcttcgggaa

SEQ ID NO: 2546373 - DNA, 19 bp, Homo sapiens
ttcgtagctttcccaaata

SEQ ID NO: 2546374 - DNA, 17 bp, Homo sapiens
ttcgtggtgatcaatta

SEQ ID NO: 2546375 - DNA, 18 bp, Homo sapiens
ttctaaaaattgtgatca

SEQ ID NO: 2546376 - DNA, 22 bp, Homo sapiens
ttctaaacaagaatcagtctat

SEQ ID NO: 2546377 - DNA, 20 bp, Homo sapiens
ttctaaaggctacctttgta

SEQ ID NO: 2546378 - DNA, 12 bp, Homo sapiens
ttctaaatgaat

SEQ ID NO: 2546379 - DNA, 15 bp, Homo sapiens
ttctaaatgaatgtt

SEQ ID NO: 2546380 - DNA, 18 bp, Homo sapiens
ttctaaggaatatgagct

SEQ ID NO: 2546381 - DNA, 17 bp, Homo sapiens
ttctaagtaaaaccaca

SEQ ID NO: 2546382 - DNA, 24 bp, Homo sapiens
ttctaagtaaaaccacagcagttg

SEQ ID NO: 2546383 - DNA, 15 bp, Homo sapiens
ttctaagtctttcca

SEQ ID NO: 2546384 - DNA, 14 bp, Homo sapiens
ttctaatagtttta

SEQ ID NO: 2546385 - DNA, 22 bp, Homo sapiens
ttctaatatatttttatattta

SEQ ID NO: 2546386 - DNA, 18 bp, Homo sapiens
ttctacaaaatcctgatg

SEQ ID NO: 2546387 - DNA, 15 bp, Homo sapiens
ttctacatagatgct

SEQ ID NO: 2546388 - DNA, 14 bp, Homo sapiens
ttctaccctagcca

SEQ ID NO: 2546389 - DNA, 18 bp, Homo sapiens
ttgcgtggactctgcaca

SEQ ID NO: 2546390 - DNA, 12 bp, Homo sapiens
ttgctaaatgta

SEQ ID NO: 2546391 - DNA, 20 bp, Homo sapiens
ttgctactacttacctacca

SEQ ID NO: 2546392 - DNA, 14 bp, Homo sapiens
ttgctatcttaatt

SEQ ID NO: 2546393 - DNA, 18 bp, Homo sapiens
ttgctatcttaattttgg

SEQ ID NO: 2546394 - DNA, 22 bp, Homo sapiens
ttgctattagactgtaggaaga

SEQ ID NO: 2546395 - DNA, 13 bp, Homo sapiens
ttgctcacctggg

SEQ ID NO: 2546396 - DNA, 17 bp, Homo sapiens
ttgctcctaatgttgaa

SEQ ID NO: 2546397 - DNA, 21 bp, Homo sapiens
ttgctctcccctgccctgctg

SEQ ID NO: 2546398 - DNA, 13 bp, Homo sapiens
ttgctctccctct

SEQ ID NO: 2546399 - DNA, 15 bp, Homo sapiens
ttgctctgcaggcac

SEQ ID NO: 2546400 - DNA, 17 bp, Homo sapiens
ttgctctgcaggcacct

SEQ ID NO: 2546401 - DNA, 14 bp, Homo sapiens
ttgctctgggtgga

SEQ ID NO: 2546402 - DNA, 19 bp, Homo sapiens
ttgctcttaagttgtggag

SEQ ID NO: 2546403 - DNA, 17 bp, Homo sapiens
ttgctgaaaatggtatt

SEQ ID NO: 2546404 - DNA, 14 bp, Homo sapiens
ttgctgaaagatct

SEQ ID NO: 2546405 - DNA, 19 bp, Homo sapiens
ttgctgaatacagaggcaa

SEQ ID NO: 2546406 - DNA, 15 bp, Homo sapiens
ttgctgcaaacctga

SEQ ID NO: 2546407 - DNA, 14 bp, Homo sapiens
ttgctgcttgaggc

SEQ ID NO: 2546408 - DNA, 16 bp, Homo sapiens
ttgctgcttgaggcaa

SEQ ID NO: 2546409 - DNA, 12 bp, Homo sapiens
ttgctgggcttt

SEQ ID NO: 2546410 - DNA, 15 bp, Homo sapiens
ttgctggttgctgtg

SEQ ID NO: 2546411 - DNA, 16 bp, Homo sapiens
ttgctggttgctgtgt

SEQ ID NO: 2546412 - DNA, 14 bp, Homo sapiens
ttgctgtactagag

SEQ ID NO: 2546413 - DNA, 12 bp, Homo sapiens
ttgctgtgggaa

SEQ ID NO: 2546414 - DNA, 15 bp, Homo sapiens
ttgctgtgggaacga

SEQ ID NO: 2546415 - DNA, 13 bp, Homo sapiens
ttgcttacatttt

SEQ ID NO: 2546416 - DNA, 18 bp, Homo sapiens
ttgcttacatttttacaa

SEQ ID NO: 2546417 - DNA, 20 bp, Homo sapiens
ttgcttaggatgtgtgcatg

SEQ ID NO: 2546418 - DNA, 14 bp, Homo sapiens
ttgcttcataaatg

SEQ ID NO: 2546419 - DNA, 15 bp, Homo sapiens
ttgcttcataaatga

SEQ ID NO: 2546420 - DNA, 17 bp, Homo sapiens
ttgcttcataaatgaag

SEQ ID NO: 2546421 - DNA, 20 bp, Homo sapiens
ttgcttcataaatgaagcag

SEQ ID NO: 2546422 - DNA, 22 bp, Homo sapiens
ttgcttgaaagaaaatatgcat

SEQ ID NO: 2546423 - DNA, 16 bp, Homo sapiens
ttgcttgcctctctgt

SEQ ID NO: 2546424 - DNA, 14 bp, Homo sapiens
ttgcttggctgctt

SEQ ID NO: 2546425 - DNA, 19 bp, Homo sapiens
ttgcttggctgcttggcct

SEQ ID NO: 2546426 - DNA, 23 bp, Homo sapiens
ttgcttgttgggattcctgaccc

SEQ ID NO: 2546427 - DNA, 16 bp, Homo sapiens
ttgctttaattgttaa

SEQ ID NO: 2546428 - DNA, 22 bp, Homo sapiens
ttgctttactgtcaaaataatt

SEQ ID NO: 2546429 - DNA, 22 bp, Homo sapiens
ttgctttgaagcagttgtgtca

SEQ ID NO: 2546430 - DNA, 20 bp, Homo sapiens
ttgctttgtgatttttgtaa

SEQ ID NO: 2546431 - DNA, 19 bp, Homo sapiens
ttgcttttccactgcctgg

SEQ ID NO: 2546432 - DNA, 22 bp, Homo sapiens
ttgctttttctaatgtggttat

SEQ ID NO: 2546433 - DNA, 21 bp, Homo sapiens
ttggaaaaatccagaaagaaa

SEQ ID NO: 2546434 - DNA, 15 bp, Homo sapiens
ttggaaaataaatca

SEQ ID NO: 2546435 - DNA, 18 bp, Homo sapiens
ttggaaacctgccctgcc

SEQ ID NO: 2546436 - DNA, 17 bp, Homo sapiens
ttggaaagagtaggaag

SEQ ID NO: 2546437 - DNA, 20 bp, Homo sapiens
ttggaaagcatcacctcagg

SEQ ID NO: 2546438 - DNA, 22 bp, Homo sapiens
ttggaaatagaaatttccagag

SEQ ID NO: 2546439 - DNA, 23 bp, Homo sapiens
ttggaaatagaaatttccagaga

SEQ ID NO: 2546440 - DNA, 13 bp, Homo sapiens
ttggaacagaatg

SEQ ID NO: 2546441 - DNA, 14 bp, Homo sapiens
ttggaacagaatgt

SEQ ID NO: 2546442 - DNA, 13 bp, Homo sapiens
ttggaagagaaag

SEQ ID NO: 2546443 - DNA, 19 bp, Homo sapiens
ttggaagctccgctttcta

SEQ ID NO: 2546444 - DNA, 17 bp, Homo sapiens
ttggaagctctgaagtc

SEQ ID NO: 2546445 - DNA, 20 bp, Homo sapiens
ttggaattaacctggtgctg

SEQ ID NO: 2546446 - DNA, 19 bp, Homo sapiens
ttggaatttgtaacctcag

SEQ ID NO: 2546447 - DNA, 16 bp, Homo sapiens
ttggacaactgcatgg

SEQ ID NO: 2546448 - DNA, 19 bp, Homo sapiens
ttggaccccagctgggagg

SEQ ID NO: 2546449 - DNA, 20 bp, Homo sapiens
ttggaccccagctgggaggc

SEQ ID NO: 2546450 - DNA, 22 bp, Homo sapiens
ttggaccccagctgggaggcaa

SEQ ID NO: 2546451 - DNA, 13 bp, Homo sapiens
ttggacccttcca

SEQ ID NO: 2546452 - DNA, 13 bp, Homo sapiens
ttggacctctgct

SEQ ID NO: 2546453 - DNA, 21 bp, Homo sapiens
ttggacggcctgatgctccct

SEQ ID NO: 2546454 - DNA, 15 bp, Homo sapiens
ttggactcttgctct

SEQ ID NO: 2546455 - DNA, 15 bp, Homo sapiens
ttggactggatgcat

SEQ ID NO: 2546456 - DNA, 13 bp, Homo sapiens
ttggagactctgt

SEQ ID NO: 2546457 - DNA, 15 bp, Homo sapiens
ttggagactctgtgg

SEQ ID NO: 2546458 - DNA, 20 bp, Homo sapiens
ttggagactctgtggggcct

SEQ ID NO: 2546459 - DNA, 22 bp, Homo sapiens
ttggagggtcccaagctgggcc

SEQ ID NO: 2546460 - DNA, 23 bp, Homo sapiens
ttggagggtcccaagctgggccc

SEQ ID NO: 2546461 - DNA, 22 bp, Homo sapiens
ttggagggtgggagagcccagc

SEQ ID NO: 2546462 - DNA, 23 bp, Homo sapiens
ttggaggtgcttaagcagaagca

SEQ ID NO: 2546463 - DNA, 20 bp, Homo sapiens
ttggagtgagtgtggctccc

SEQ ID NO: 2546464 - DNA, 22 bp, Homo sapiens
ttggagtgagtgtggctcccct

SEQ ID NO: 2546465 - DNA, 19 bp, Homo sapiens
ttggagtgttccccttcca

SEQ ID NO: 2546466 - DNA, 13 bp, Homo sapiens
ttggattattcat

SEQ ID NO: 2546467 - DNA, 15 bp, Homo sapiens
ttggattcttatgta

SEQ ID NO: 2546468 - DNA, 17 bp, Homo sapiens
ttggcaaaaaggcagga

SEQ ID NO: 2546469 - DNA, 14 bp, Homo sapiens
ttggcaacagaagc

SEQ ID NO: 2546470 - DNA, 16 bp, Homo sapiens
ttggcaatagtttgca

SEQ ID NO: 2546471 - DNA, 20 bp, Homo sapiens
ttggcaatagtttgcataga

SEQ ID NO: 2546472 - DNA, 16 bp, Homo sapiens
ttggcacagaaacaca

SEQ ID NO: 2546473 - DNA, 22 bp, Homo sapiens
ttggcactcacagacctggagc

SEQ ID NO: 2546474 - DNA, 15 bp, Homo sapiens
ttggccaaagtgtta

SEQ ID NO: 2546475 - DNA, 14 bp, Homo sapiens
ttggccaggctggt

SEQ ID NO: 2546476 - DNA, 16 bp, Homo sapiens
ttggcccaagctcttg

SEQ ID NO: 2546477 - DNA, 22 bp, Homo sapiens
ttggcctctgcaaaggaaatac

SEQ ID NO: 2546478 - DNA, 12 bp, Homo sapiens
ttggcctggagg

SEQ ID NO: 2546479 - DNA, 16 bp, Homo sapiens
ttggcctgtctcatcc

SEQ ID NO: 2546480 - DNA, 22 bp, Homo sapiens
ttggccttcagaaccatccata

SEQ ID NO: 2546481 - DNA, 16 bp, Homo sapiens
ttggctatttaaaact

SEQ ID NO: 2546482 - DNA, 17 bp, Homo sapiens
ttggctatttaaaactt

SEQ ID NO: 2546483 - DNA, 22 bp, Homo sapiens
ttggctcacccaagcaaggcca

SEQ ID NO: 2546484 - DNA, 23 bp, Homo sapiens
ttggctgagatatgaacatattg

SEQ ID NO: 2546485 - DNA, 14 bp, Homo sapiens
ttggctgcagggag

SEQ ID NO: 2546486 - DNA, 23 bp, Homo sapiens
ttggctggatgaaattttctaga

SEQ ID NO: 2546487 - DNA, 18 bp, Homo sapiens
ttggctgggggcctcagt

SEQ ID NO: 2546488 - DNA, 21 bp, Homo sapiens
ttggctgggggcctcagtgcc

SEQ ID NO: 2546489 - DNA, 22 bp, Homo sapiens
ttggctgggggcctcagtgcca

SEQ ID NO: 2546490 - DNA, 17 bp, Homo sapiens
ttggctgtgaggcccct

SEQ ID NO: 2546491 - DNA, 21 bp, Homo sapiens
ttggcttccatgatggttatt

SEQ ID NO: 2546492 - DNA, 17 bp, Homo sapiens
ttgggaataaatatgcc

SEQ ID NO: 2546493 - DNA, 23 bp, Homo sapiens
ttgggactgggtttggaccccag

SEQ ID NO: 2546494 - DNA, 15 bp, Homo sapiens
ttgggagtgagatgc

SEQ ID NO: 2546495 - DNA, 21 bp, Homo sapiens
ttgggattcctgacccaggcc

SEQ ID NO: 2546496 - DNA, 16 bp, Homo sapiens
ttgggattgggggctg

SEQ ID NO: 2546497 - DNA, 20 bp, Homo sapiens
ttgggcagaagggagaagga

SEQ ID NO: 2546498 - DNA, 13 bp, Homo sapiens
ttgggctgagact

SEQ ID NO: 2546499 - DNA, 15 bp, Homo sapiens
ttgggctgagactgg

SEQ ID NO: 2546500 - DNA, 22 bp, Homo sapiens
ttgggctgtgcggatctctgga

SEQ ID NO: 2546501 - DNA, 14 bp, Homo sapiens
ttggggatattttt

SEQ ID NO: 2546502 - DNA, 18 bp, Homo sapiens
ttgggggacagggctggc

SEQ ID NO: 2546503 - DNA, 23 bp, Homo sapiens
ttgggggacagggctggcccagc

SEQ ID NO: 2546504 - DNA, 16 bp, Homo sapiens
ttggggtcagccaggg

SEQ ID NO: 2546505 - DNA, 16 bp, Homo sapiens
ttggggtctgccacca

SEQ ID NO: 2546506 - DNA, 15 bp, Homo sapiens
ttggggttgtgttgt

SEQ ID NO: 2546507 - DNA, 16 bp, Homo sapiens
ttggggttttttaata

SEQ ID NO: 2546508 - DNA, 14 bp, Homo sapiens
ttgggtcctgggtc

SEQ ID NO: 2546509 - DNA, 15 bp, Homo sapiens
ttgggtggagaagcc

SEQ ID NO: 2546510 - DNA, 16 bp, Homo sapiens
ttgggtggagaagcca

SEQ ID NO: 2546511 - DNA, 21 bp, Homo sapiens
ttgggtgtaacaggtctcctc

SEQ ID NO: 2546512 - DNA, 19 bp, Homo sapiens
ttggtaaagactggctttt

SEQ ID NO: 2546513 - DNA, 23 bp, Homo sapiens
ttggtaaatttccccaacagtgt

SEQ ID NO: 2546514 - DNA, 19 bp, Homo sapiens
ttggtaacacaaattttca

SEQ ID NO: 2546515 - DNA, 16 bp, Homo sapiens
ttggtaacatcctttc

SEQ ID NO: 2546516 - DNA, 23 bp, Homo sapiens
ttggtcccgtgcagcttctgtcc

SEQ ID NO: 2546517 - DNA, 20 bp, Homo sapiens
ttggtctgacccactgcttt

SEQ ID NO: 2546518 - DNA, 13 bp, Homo sapiens
ttggtgcctggcc

SEQ ID NO: 2546519 - DNA, 20 bp, Homo sapiens
ttggtgtaaagccaacaccc

SEQ ID NO: 2546520 - DNA, 19 bp, Homo sapiens
ttggttaggcattgtggga

SEQ ID NO: 2546521 - DNA, 14 bp, Homo sapiens
ttggttcccttgtg

SEQ ID NO: 2546522 - DNA, 15 bp, Homo sapiens
ttggttctaatagaa

SEQ ID NO: 2546523 - DNA, 19 bp, Homo sapiens
ttggttctaatagaactca

SEQ ID NO: 2546524 - DNA, 16 bp, Homo sapiens
ttggttgaataaacta

SEQ ID NO: 2546525 - DNA, 15 bp, Homo sapiens
ttggttggctggcct

SEQ ID NO: 2546526 - DNA, 16 bp, Homo sapiens
ttggttgtattctttg

SEQ ID NO: 2546527 - DNA, 22 bp, Homo sapiens
ttggttgtcaatattaaataca

SEQ ID NO: 2546528 - DNA, 20 bp, Homo sapiens
ttggtttggccatctctgga

SEQ ID NO: 2546529 - DNA, 14 bp, Homo sapiens
ttggtttgtaaatt

SEQ ID NO: 2546530 - DNA, 13 bp, Homo sapiens
ttggttttgactg

SEQ ID NO: 2546531 - DNA, 18 bp, Homo sapiens
ttggtttttaaaacccag

SEQ ID NO: 2546532 - DNA, 15 bp, Homo sapiens
ttgtaaaaaaaaatg

SEQ ID NO: 2546533 - DNA, 19 bp, Homo sapiens
tttgctgtactagagatct

SEQ ID NO: 2546534 - DNA, 15 bp, Homo sapiens
tttgctttgcccagc

SEQ ID NO: 2546535 - DNA, 14 bp, Homo sapiens
tttgctttttgcta

SEQ ID NO: 2546536 - DNA, 16 bp, Homo sapiens
tttggaatacatttct

SEQ ID NO: 2546537 - DNA, 12 bp, Homo sapiens
tttggaatgctt

SEQ ID NO: 2546538 - DNA, 11 bp, Homo sapiens
tttggaatgtg

SEQ ID NO: 2546539 - DNA, 17 bp, Homo sapiens
tttggaccccagctggg

SEQ ID NO: 2546540 - DNA, 15 bp, Homo sapiens
tttggaccctgaggc

SEQ ID NO: 2546541 - DNA, 19 bp, Homo sapiens
tttggaccctgaggcccag

SEQ ID NO: 2546542 - DNA, 17 bp, Homo sapiens
tttggagtcccctcacc

SEQ ID NO: 2546543 - DNA, 20 bp, Homo sapiens
tttggagtcccctcacctcc

SEQ ID NO: 2546544 - DNA, 22 bp, Homo sapiens
tttggattggatgaattccaaa

SEQ ID NO: 2546545 - DNA, 17 bp, Homo sapiens
tttggcaatgccatcat

SEQ ID NO: 2546546 - DNA, 23 bp, Homo sapiens
tttggccatctctggatgcctga

SEQ ID NO: 2546547 - DNA, 20 bp, Homo sapiens
tttggcccccgagctggggg

SEQ ID NO: 2546548 - DNA, 21 bp, Homo sapiens
tttggcccccgagctgggggc

SEQ ID NO: 2546549 - DNA, 18 bp, Homo sapiens
tttggcctcattacttta

SEQ ID NO: 2546550 - DNA, 12 bp, Homo sapiens
tttggctgctga

SEQ ID NO: 2546551 - DNA, 22 bp, Homo sapiens
tttgggaggccaaggtgggagg

SEQ ID NO: 2546552 - DNA, 17 bp, Homo sapiens
tttgggaggctgaggcg

SEQ ID NO: 2546553 - DNA, 20 bp, Homo sapiens
tttgggcagaagggagaagg

SEQ ID NO: 2546554 - DNA, 14 bp, Homo sapiens
tttgggcccaggga

SEQ ID NO: 2546555 - DNA, 15 bp, Homo sapiens
tttgggcccctctcc

SEQ ID NO: 2546556 - DNA, 20 bp, Homo sapiens
tttggggagcagagacacta

SEQ ID NO: 2546557 - DNA, 16 bp, Homo sapiens
tttggggatatgctta

SEQ ID NO: 2546558 - DNA, 14 bp, Homo sapiens
tttggggatatttt

SEQ ID NO: 2546559 - DNA, 14 bp, Homo sapiens
tttggggcgaggca

SEQ ID NO: 2546560 - DNA, 19 bp, Homo sapiens
tttggggcgaggcagagga

SEQ ID NO: 2546561 - DNA, 20 bp, Homo sapiens
tttggtaaaatacttcttga

SEQ ID NO: 2546562 - DNA, 19 bp, Homo sapiens
tttggtatctgttctttaa

SEQ ID NO: 2546563 - DNA, 22 bp, Homo sapiens
tttggtattacactgtatttgt

SEQ ID NO: 2546564 - DNA, 15 bp, Homo sapiens
tttggtggagataaa

SEQ ID NO: 2546565 - DNA, 15 bp, Homo sapiens
tttggtggctttgca

SEQ ID NO: 2546566 - DNA, 18 bp, Homo sapiens
tttggttaagtctgtttt

SEQ ID NO: 2546567 - DNA, 19 bp, Homo sapiens
tttggttaagtctgtttta

SEQ ID NO: 2546568 - DNA, 20 bp, Homo sapiens
tttggttaagtctgttttat

SEQ ID NO: 2546569 - DNA, 15 bp, Homo sapiens
tttggttgaataaac

SEQ ID NO: 2546570 - DNA, 18 bp, Homo sapiens
tttggttgtattctttga

SEQ ID NO: 2546571 - DNA, 23 bp, Homo sapiens
tttgtaaaagaacagtaaacatt

SEQ ID NO: 2546572 - DNA, 16 bp, Homo sapiens
tttgtaaactcaaaat

SEQ ID NO: 2546573 - DNA, 17 bp, Homo sapiens
tttgtaaagtgtggtcc

SEQ ID NO: 2546574 - DNA, 16 bp, Homo sapiens
tttgtaagagtgtaga

SEQ ID NO: 2546575 - DNA, 17 bp, Homo sapiens
tttgtaagagtgtagaa

SEQ ID NO: 2546576 - DNA, 19 bp, Homo sapiens
tttgtaagagtgtagaagc

SEQ ID NO: 2546577 - DNA, 21 bp, Homo sapiens
tttgtaagagtgtagaagcat

SEQ ID NO: 2546578 - DNA, 21 bp, Homo sapiens
tttgtaagtttcaggtgacat

SEQ ID NO: 2546579 - DNA, 18 bp, Homo sapiens
tttgtaatcgttatgtgt

SEQ ID NO: 2546580 - DNA, 18 bp, Homo sapiens
tttgtacagacgtatgct

SEQ ID NO: 2546581 - DNA, 14 bp, Homo sapiens
tttgtaccatggtg

SEQ ID NO: 2546582 - DNA, 17 bp, Homo sapiens
tttgtaccatggtgtga

SEQ ID NO: 2546583 - DNA, 13 bp, Homo sapiens
tttgtactgtaaa

SEQ ID NO: 2546584 - DNA, 19 bp, Homo sapiens
tttgtaggggtcaaagaaa

SEQ ID NO: 2546585 - DNA, 20 bp, Homo sapiens
tttgtaggggtcaaagaaat

SEQ ID NO: 2546586 - DNA, 19 bp, Homo sapiens
tttgtataacttcttaaaa

SEQ ID NO: 2546587 - DNA, 16 bp, Homo sapiens
tttgtatattatttct

SEQ ID NO: 2546588 - DNA, 20 bp, Homo sapiens
tttgtatctctgaagcatgt

SEQ ID NO: 2546589 - DNA, 13 bp, Homo sapiens
tttgtatgtgtgt

SEQ ID NO: 2546590 - DNA, 14 bp, Homo sapiens
tttgtatttttaat

SEQ ID NO: 2546591 - DNA, 16 bp, Homo sapiens
tttgtcaaactgtaga

SEQ ID NO: 2546592 - DNA, 17 bp, Homo sapiens
tttgtcaaactgtagaa

SEQ ID NO: 2546593 - DNA, 23 bp, Homo sapiens
tttgtcaaactgtagaaatgatg

SEQ ID NO: 2546594 - DNA, 22 bp, Homo sapiens
tttgtcagaactagaatttgat

SEQ ID NO: 2546595 - DNA, 17 bp, Homo sapiens
tttgtcatcagccacca

SEQ ID NO: 2546596 - DNA, 13 bp, Homo sapiens
tttgtccccaccg

SEQ ID NO: 2546597 - DNA, 19 bp, Homo sapiens
tttgtctaaaacaataaaa

SEQ ID NO: 2546598 - DNA, 14 bp, Homo sapiens
tttgtctgaaaaat

SEQ ID NO: 2546599 - DNA, 22 bp, Homo sapiens
tttgtgaaatgatggtgaaagt

SEQ ID NO: 2546600 - DNA, 22 bp, Homo sapiens
tttgtgaacaagtccctgtaat

SEQ ID NO: 2546601 - DNA, 19 bp, Homo sapiens
tttgtgaatggattggatt

SEQ ID NO: 2546602 - DNA, 22 bp, Homo sapiens
tttgtgactaattgtataacag

SEQ ID NO: 2546603 - DNA, 22 bp, Homo sapiens
tttgtgcattatctagatactg

SEQ ID NO: 2546604 - DNA, 17 bp, Homo sapiens
tttgtggatgtcttcct

SEQ ID NO: 2546605 - DNA, 12 bp, Homo sapiens
tttgtggcctca

SEQ ID NO: 2546606 - DNA, 15 bp, Homo sapiens
tttgtggcctcagaa

SEQ ID NO: 2546607 - DNA, 12 bp, Homo sapiens
tttgtggctggg

SEQ ID NO: 2546608 - DNA, 22 bp, Homo sapiens
tttgtggtacgacctttagatt

SEQ ID NO: 2546609 - DNA, 12 bp, Homo sapiens
tttgtgtgagag

SEQ ID NO: 2546610 - DNA, 17 bp, Homo sapiens
tttgtgtgttgtcttga

SEQ ID NO: 2546611 - DNA, 20 bp, Homo sapiens
tttgtgttgttggaaaaagt

SEQ ID NO: 2546612 - DNA, 16 bp, Homo sapiens
tttgttattttgcaac

SEQ ID NO: 2546613 - DNA, 21 bp, Homo sapiens
tttgttctggctcttccaggc

SEQ ID NO: 2546614 - DNA, 16 bp, Homo sapiens
tttgttgtcagctgaa

SEQ ID NO: 2546615 - DNA, 13 bp, Homo sapiens
tttgtttcatatt

SEQ ID NO: 2546616 - DNA, 16 bp, Homo sapiens
tttgtttcttccaaag

SEQ ID NO: 2546617 - DNA, 18 bp, Homo sapiens
tttgtttgaactgataaa

SEQ ID NO: 2546618 - DNA, 15 bp, Homo sapiens
tttgtttgctatctt

SEQ ID NO: 2546619 - DNA, 13 bp, Homo sapiens
tttgtttgtgcat

SEQ ID NO: 2546620 - DNA, 15 bp, Homo sapiens
tttgttttaaaatta

SEQ ID NO: 2546621 - DNA, 14 bp, Homo sapiens
tttgttttcatggt

SEQ ID NO: 2546622 - DNA, 13 bp, Homo sapiens
tttgtttttaatt

SEQ ID NO: 2546623 - DNA, 12 bp, Homo sapiens
tttgtttttcat

SEQ ID NO: 2546624 - DNA, 18 bp, Homo sapiens
ttttaaaaaactgctgac

SEQ ID NO: 2546625 - DNA, 22 bp, Homo sapiens
ttttaaaaagaaacaagatgct

SEQ ID NO: 2546626 - DNA, 23 bp, Homo sapiens
ttttaaaaatcataaactgtgtg

SEQ ID NO: 2546627 - DNA, 14 bp, Homo sapiens
ttttaaaaatgaat

SEQ ID NO: 2546628 - DNA, 15 bp, Homo sapiens
ttttaaaaatgaatc

SEQ ID NO: 2546629 - DNA, 14 bp, Homo sapiens
ttttaaaaatgcaa

SEQ ID NO: 2546630 - DNA, 16 bp, Homo sapiens
ttttaaaacacttcca

SEQ ID NO: 2546631 - DNA, 12 bp, Homo sapiens
ttttaaaagttt

SEQ ID NO: 2546632 - DNA, 15 bp, Homo sapiens
ttttaaaagtttcaa

SEQ ID NO: 2546633 - DNA, 19 bp, Homo sapiens
ttttaaaagtttcaatgtg

SEQ ID NO: 2546634 - DNA, 18 bp, Homo sapiens
ttttaaaatcttttctat

SEQ ID NO: 2546635 - DNA, 19 bp, Homo sapiens
ttttaaaatgagagtcact

SEQ ID NO: 2546636 - DNA, 16 bp, Homo sapiens
ttttaaacaaaataga

SEQ ID NO: 2546637 - DNA, 19 bp, Homo sapiens
ttttaaacagtgagcctga

SEQ ID NO: 2546638 - DNA, 20 bp, Homo sapiens
ttttaaaccctattggtaaa

SEQ ID NO: 2546639 - DNA, 14 bp, Homo sapiens
ttttaaagtgatta

SEQ ID NO: 2546640 - DNA, 15 bp, Homo sapiens
ttttaaataaaagca

SEQ ID NO: 2546641 - DNA, 18 bp, Homo sapiens
ttttaaatattttttctt

SEQ ID NO: 2546642 - DNA, 21 bp, Homo sapiens
ttttaaatgcacctggaatat

SEQ ID NO: 2546643 - DNA, 19 bp, Homo sapiens
ttttaaatgcataaatgca

SEQ ID NO: 2546644 - DNA, 19 bp, Homo sapiens
ttttaaatgggtagagaaa

SEQ ID NO: 2546645 - DNA, 22 bp, Homo sapiens
ttttaacaataactactgtgtt

SEQ ID NO: 2546646 - DNA, 13 bp, Homo sapiens
ttttaactcaata

SEQ ID NO: 2546647 - DNA, 14 bp, Homo sapiens
ttttaactctgtct

SEQ ID NO: 2546648 - DNA, 19 bp, Homo sapiens
ttttaagacgtgtttgtgt

SEQ ID NO: 2546649 - DNA, 15 bp, Homo sapiens
ttttaagaggcaggg

SEQ ID NO: 2546650 - DNA, 18 bp, Homo sapiens
ttttaagatttttctcaa

SEQ ID NO: 2546651 - DNA, 12 bp, Homo sapiens
ttttaaggaaac

SEQ ID NO: 2546652 - DNA, 20 bp, Homo sapiens
ttttaagggtttgtggaaaa

SEQ ID NO: 2546653 - DNA, 17 bp, Homo sapiens
ttttaagtgctgcattt

SEQ ID NO: 2546654 - DNA, 17 bp, Homo sapiens
ttttaagtgctttgtaa

SEQ ID NO: 2546655 - DNA, 22 bp, Homo sapiens
ttttaagttacacatttttcag

SEQ ID NO: 2546656 - DNA, 14 bp, Homo sapiens
ttttaagttgctga

SEQ ID NO: 2546657 - DNA, 16 bp, Homo sapiens
ttttaagttgtttgca

SEQ ID NO: 2546658 - DNA, 18 bp, Homo sapiens
ttttaagttgtttgcatg

SEQ ID NO: 2546659 - DNA, 15 bp, Homo sapiens
ttttaataaactttt

SEQ ID NO: 2546660 - DNA, 14 bp, Homo sapiens
ttttaatcatgaaa

SEQ ID NO: 2546661 - DNA, 17 bp, Homo sapiens
ttttaatgctccaaatg

SEQ ID NO: 2546662 - DNA, 13 bp, Homo sapiens
ttttaattaaata

SEQ ID NO: 2546663 - DNA, 20 bp, Homo sapiens
ttttaattattatttatata

SEQ ID NO: 2546664 - DNA, 23 bp, Homo sapiens
ttttaattattatttatatatgt

SEQ ID NO: 2546665 - DNA, 20 bp, Homo sapiens
ttttaattcaccaaagtatt

SEQ ID NO: 2546666 - DNA, 21 bp, Homo sapiens
ttttaattccatgaatcgctt

SEQ ID NO: 2546667 - DNA, 15 bp, Homo sapiens
ttttaattgattatt

SEQ ID NO: 2546668 - DNA, 23 bp, Homo sapiens
ttttaatttatgagtttttgata

SEQ ID NO: 2546669 - DNA, 15 bp, Homo sapiens
ttttacatactgctg

SEQ ID NO: 2546670 - DNA, 13 bp, Homo sapiens
ttttaccaagttt

SEQ ID NO: 2546671 - DNA, 18 bp, Homo sapiens
ttttaccgtttcttccct

SEQ ID NO: 2546672 - DNA, 20 bp, Homo sapiens
ttttacctaccacagtgtct

SEQ ID NO: 2546673 - DNA, 15 bp, Homo sapiens
ttttactaatagaca

SEQ ID NO: 2546674 - DNA, 15 bp, Homo sapiens
ttttactactgtgga

SEQ ID NO: 2546675 - DNA, 13 bp, Homo sapiens
ttttactcccctt

SEQ ID NO: 2546676 - DNA, 14 bp, Homo sapiens
ttttactgaacaat

SEQ ID NO: 2546677 - DNA, 22 bp, Homo sapiens
ttttacttgcattgaatatatt

SEQ ID NO: 2546678 - DNA, 17 bp, Homo sapiens
aaaacaatattgtttct

SEQ ID NO: 2546679 - DNA, 13 bp, Homo sapiens
aaaacaatgaaga

SEQ ID NO: 2546680 - DNA, 14 bp, Homo sapiens
aaaacaattgtaat

SEQ ID NO: 2546681 - DNA, 21 bp, Homo sapiens
aaaacacagtgtttttgtaaa

SEQ ID NO: 2546682 - DNA, 15 bp, Homo sapiens
aaaacacatttttct

SEQ ID NO: 2546683 - DNA, 13 bp, Homo sapiens
aaaacactgtgca

SEQ ID NO: 2546684 - DNA, 15 bp, Homo sapiens
aaaacagactcaggt

SEQ ID NO: 2546685 - DNA, 18 bp, Homo sapiens
aaaacaggtggagaaatt

SEQ ID NO: 2546686 - DNA, 20 bp, Homo sapiens
aaaacagtccttcaaacttc

SEQ ID NO: 2546687 - DNA, 17 bp, Homo sapiens
aaaacataatcttctgc

SEQ ID NO: 2546688 - DNA, 13 bp, Homo sapiens
aaaacatgctaca

SEQ ID NO: 2546689 - DNA, 16 bp, Homo sapiens
aaaacattccatcctt

SEQ ID NO: 2546690 - DNA, 14 bp, Homo sapiens
aaaaccaagaagat

SEQ ID NO: 2546691 - DNA, 12 bp, Homo sapiens
aaaaccacagca

SEQ ID NO: 2546692 - DNA, 11 bp, Homo sapiens
aaaaccaggcc

SEQ ID NO: 2546693 - DNA, 22 bp, Homo sapiens
aaaacccaccttgttggagcct

SEQ ID NO: 2546694 - DNA, 22 bp, Homo sapiens
aaaaccccactacacagtctgc

SEQ ID NO: 2546695 - DNA, 13 bp, Homo sapiens
aaaacctttcaaa

SEQ ID NO: 2546696 - DNA, 14 bp, Homo sapiens
aaaaccttttgaaa

SEQ ID NO: 2546697 - DNA, 14 bp, Homo sapiens
aaaacgcatggagt

SEQ ID NO: 2546698 - DNA, 19 bp, Homo sapiens
aaaacgttttattgtgttt

SEQ ID NO: 2546699 - DNA, 18 bp, Homo sapiens
aaaactaaatctctaata

SEQ ID NO: 2546700 - DNA, 19 bp, Homo sapiens
aaaactaaatctctaatat

SEQ ID NO: 2546701 - DNA, 22 bp, Homo sapiens
aaaactcgaggactgtatttgt

SEQ ID NO: 2546702 - DNA, 18 bp, Homo sapiens
aaaactctcctctgctgc

SEQ ID NO: 2546703 - DNA, 17 bp, Homo sapiens
aaaactgaattataaga

SEQ ID NO: 2546704 - DNA, 22 bp, Homo sapiens
aaaactgctgactgttttctct

SEQ ID NO: 2546705 - DNA, 19 bp, Homo sapiens
aaaacttaacatatttact

SEQ ID NO: 2546706 - DNA, 19 bp, Homo sapiens
aaaactttactaagatgac

SEQ ID NO: 2546707 - DNA, 16 bp, Homo sapiens
aaaagaaaaaaaaaga

SEQ ID NO: 2546708 - DNA, 15 bp, Homo sapiens
aaaagaaaataaaaa

SEQ ID NO: 2546709 - DNA, 16 bp, Homo sapiens
aaaagaatacagaaag

SEQ ID NO: 2546710 - DNA, 20 bp, Homo sapiens
aaaagaatgggcagttacat

SEQ ID NO: 2546711 - DNA, 14 bp, Homo sapiens
aaaagacaattctt

SEQ ID NO: 2546712 - DNA, 19 bp, Homo sapiens
aaaagacaattctttatac

SEQ ID NO: 2546713 - DNA, 14 bp, Homo sapiens
aaaagagaaaagaa

SEQ ID NO: 2546714 - DNA, 16 bp, Homo sapiens
aaaagagaaaagaaaa

SEQ ID NO: 2546715 - DNA, 16 bp, Homo sapiens
aaaagagatattttaa

SEQ ID NO: 2546716 - DNA, 16 bp, Homo sapiens
aaaagagatttcaaga

SEQ ID NO: 2546717 - DNA, 14 bp, Homo sapiens
aaaagataaagatg

SEQ ID NO: 2546718 - DNA, 20 bp, Homo sapiens
aaaagataaagatgatctac

SEQ ID NO: 2546719 - DNA, 13 bp, Homo sapiens
aaaagatgtagat

SEQ ID NO: 2546720 - DNA, 11 bp, Homo sapiens
aaaagattcat

SEQ ID NO: 2546721 - DNA, 13 bp, Homo sapiens
aaaagctgctcag

SEQ ID NO: 2546722 - DNA, 14 bp, Homo sapiens
aaaaggaagactag

SEQ ID NO: 2546723 - DNA, 22 bp, Homo sapiens
aaaaggagccaatttaaagaaa

SEQ ID NO: 2546724 - DNA, 18 bp, Homo sapiens
aaaaggatttttatcttt

SEQ ID NO: 2546725 - DNA, 11 bp, Homo sapiens
aaaaggcagga

SEQ ID NO: 2546726 - DNA, 19 bp, Homo sapiens
aaaaggccaaacctctgtt

SEQ ID NO: 2546727 - DNA, 19 bp, Homo sapiens
aaaagggaagttgtgcctt

SEQ ID NO: 2546728 - DNA, 18 bp, Homo sapiens
aaaagggattacccaagc

SEQ ID NO: 2546729 - DNA, 23 bp, Homo sapiens
aaaagggcagggcatctcctgtg

SEQ ID NO: 2546730 - DNA, 19 bp, Homo sapiens
aaaagggtcttgggaaata

SEQ ID NO: 2546731 - DNA, 16 bp, Homo sapiens
aaaaggttaataaagt

SEQ ID NO: 2546732 - DNA, 11 bp, Homo sapiens
aaaagtaaaca

SEQ ID NO: 2546733 - DNA, 12 bp, Homo sapiens
aaaagtaacttg

SEQ ID NO: 2546734 - DNA, 22 bp, Homo sapiens
aaaagtaagtaccactcaggcc

SEQ ID NO: 2546735 - DNA, 14 bp, Homo sapiens
aaaagtatatgtta

SEQ ID NO: 2546736 - DNA, 15 bp, Homo sapiens
aaaagtatatgttag

SEQ ID NO: 2546737 - DNA, 14 bp, Homo sapiens
aaaagtattatttt

SEQ ID NO: 2546738 - DNA, 20 bp, Homo sapiens
aaaagtattattttccaaaa

SEQ ID NO: 2546739 - DNA, 14 bp, Homo sapiens
aaaagtattttcct

SEQ ID NO: 2546740 - DNA, 19 bp, Homo sapiens
aaaagtcagactgctggga

SEQ ID NO: 2546741 - DNA, 21 bp, Homo sapiens
aaaagtgatcaataaaatgtg

SEQ ID NO: 2546742 - DNA, 16 bp, Homo sapiens
aaaagtggcctctttg

SEQ ID NO: 2546743 - DNA, 14 bp, Homo sapiens
aaaagttagctgag

SEQ ID NO: 2546744 - DNA, 23 bp, Homo sapiens
aaaagttgggttttctccattca

SEQ ID NO: 2546745 - DNA, 21 bp, Homo sapiens
aaaataaaaagcgggcacggg

SEQ ID NO: 2546746 - DNA, 14 bp, Homo sapiens
aaaataaaaagtta

SEQ ID NO: 2546747 - DNA, 19 bp, Homo sapiens
aaaataaaaagttaaaaag

SEQ ID NO: 2546748 - DNA, 18 bp, Homo sapiens
aaaataaaaataaattca

SEQ ID NO: 2546749 - DNA, 17 bp, Homo sapiens
aaaataaaactttttaa

SEQ ID NO: 2546750 - DNA, 19 bp, Homo sapiens
aaaataaaattaaagctga

SEQ ID NO: 2546751 - DNA, 15 bp, Homo sapiens
aaaataacttatatc

SEQ ID NO: 2546752 - DNA, 14 bp, Homo sapiens
aaaataagaaaaga

SEQ ID NO: 2546753 - DNA, 15 bp, Homo sapiens
aaaataagaaaagat

SEQ ID NO: 2546754 - DNA, 21 bp, Homo sapiens
aaaataatctatttctatgag

SEQ ID NO: 2546755 - DNA, 23 bp, Homo sapiens
aaaataatctatttctatgagaa

SEQ ID NO: 2546756 - DNA, 20 bp, Homo sapiens
aaaataattttaaacaaagg

SEQ ID NO: 2546757 - DNA, 21 bp, Homo sapiens
aaaatacagtttgtcacatga

SEQ ID NO: 2546758 - DNA, 12 bp, Homo sapiens
aaaatacatttt

SEQ ID NO: 2546759 - DNA, 19 bp, Homo sapiens
aaaatactgccagatgctg

SEQ ID NO: 2546760 - DNA, 15 bp, Homo sapiens
aaaatagaagctgta

SEQ ID NO: 2546761 - DNA, 12 bp, Homo sapiens
aaaatagcctgc

SEQ ID NO: 2546762 - DNA, 12 bp, Homo sapiens
aaaatagcttgt

SEQ ID NO: 2546763 - DNA, 18 bp, Homo sapiens
aaaatagtggtgtgattt

SEQ ID NO: 2546764 - DNA, 14 bp, Homo sapiens
aaaatatactgtaa

SEQ ID NO: 2546765 - DNA, 20 bp, Homo sapiens
aaaatatgggttgcatttgg

SEQ ID NO: 2546766 - DNA, 16 bp, Homo sapiens
aaaatattataactta

SEQ ID NO: 2546767 - DNA, 19 bp, Homo sapiens
aaaatattataacttaaaa

SEQ ID NO: 2546768 - DNA, 11 bp, Homo sapiens
aaaatatttat

SEQ ID NO: 2546769 - DNA, 15 bp, Homo sapiens
aaaatatttgtacat

SEQ ID NO: 2546770 - DNA, 13 bp, Homo sapiens
aaaatattttata

SEQ ID NO: 2546771 - DNA, 17 bp, Homo sapiens
aaaatattttataattt

SEQ ID NO: 2546772 - DNA, 12 bp, Homo sapiens
aaaatattttca

SEQ ID NO: 2546773 - DNA, 13 bp, Homo sapiens
aaaatattttgaa

SEQ ID NO: 2546774 - DNA, 13 bp, Homo sapiens
aaaatcataaact

SEQ ID NO: 2546775 - DNA, 19 bp, Homo sapiens
aaaatcatggaatggttat

SEQ ID NO: 2546776 - DNA, 22 bp, Homo sapiens
aaaatcatggaatggttataaa

SEQ ID NO: 2546777 - DNA, 15 bp, Homo sapiens
aaaatcatgtacatt

SEQ ID NO: 2546778 - DNA, 11 bp, Homo sapiens
aaaatcatttc

SEQ ID NO: 2546779 - DNA, 21 bp, Homo sapiens
aaaatcatttctgcatcagct

SEQ ID NO: 2546780 - DNA, 22 bp, Homo sapiens
aaaatcccttacctcggtgcct

SEQ ID NO: 2546781 - DNA, 16 bp, Homo sapiens
aaaatcctcttcctct

SEQ ID NO: 2546782 - DNA, 23 bp, Homo sapiens
aaaatctaatattaaaaatatgg

SEQ ID NO: 2546783 - DNA, 21 bp, Homo sapiens
aaaatctacactccagtgaga

SEQ ID NO: 2546784 - DNA, 17 bp, Homo sapiens
aaaatctaccttctgta

SEQ ID NO: 2546785 - DNA, 19 bp, Homo sapiens
aaaatctcaaatttctaaa

SEQ ID NO: 2546786 - DNA, 22 bp, Homo sapiens
aaaatctcaaatttctaaatct

SEQ ID NO: 2546787 - DNA, 16 bp, Homo sapiens
aaaatctgtggtggtc

SEQ ID NO: 2546788 - DNA, 17 bp, Homo sapiens
aaaatcttggcacagaa

SEQ ID NO: 2546789 - DNA, 20 bp, Homo sapiens
aaaatgaaggttaggattta

SEQ ID NO: 2546790 - DNA, 13 bp, Homo sapiens
aaaatgacagatg

SEQ ID NO: 2546791 - DNA, 14 bp, Homo sapiens
aaaatgacatccca

SEQ ID NO: 2546792 - DNA, 14 bp, Homo sapiens
aaaatgagcctggc

SEQ ID NO: 2546793 - DNA, 21 bp, Homo sapiens
aaaatgagttacctacatttt

SEQ ID NO: 2546794 - DNA, 16 bp, Homo sapiens
aaaatgattgtaaaat

SEQ ID NO: 2546795 - DNA, 14 bp, Homo sapiens
aaaatgattttatc

SEQ ID NO: 2546796 - DNA, 14 bp, Homo sapiens
aaaatgcaaatcct

SEQ ID NO: 2546797 - DNA, 14 bp, Homo sapiens
aaaatgcattgtat

SEQ ID NO: 2546798 - DNA, 22 bp, Homo sapiens
aaaatgcctttgagacagtttc

SEQ ID NO: 2546799 - DNA, 23 bp, Homo sapiens
aaaatgcctttgagacagtttct

SEQ ID NO: 2546800 - DNA, 12 bp, Homo sapiens
aaaatggaaaga

SEQ ID NO: 2546801 - DNA, 22 bp, Homo sapiens
aaaatggaggccattgtgtgag

SEQ ID NO: 2546802 - DNA, 15 bp, Homo sapiens
aaaatgggacttctt

SEQ ID NO: 2546803 - DNA, 19 bp, Homo sapiens
aaaatgggacttcttttca

SEQ ID NO: 2546804 - DNA, 11 bp, Homo sapiens
aaaatgtaaat

SEQ ID NO: 2546805 - DNA, 18 bp, Homo sapiens
aaaatgtactgagatttt

SEQ ID NO: 2546806 - DNA, 14 bp, Homo sapiens
aaaatgtatatgca

SEQ ID NO: 2546807 - DNA, 18 bp, Homo sapiens
aaaatgtcttgtgttacc

SEQ ID NO: 2546808 - DNA, 18 bp, Homo sapiens
aaaatgtgaataaaatta

SEQ ID NO: 2546809 - DNA, 13 bp, Homo sapiens
aaaatgtgatttt

SEQ ID NO: 2546810 - DNA, 22 bp, Homo sapiens
aaaatgttggatttataaatgc

SEQ ID NO: 2546811 - DNA, 21 bp, Homo sapiens
aaaatgttggtcattttatgt

SEQ ID NO: 2546812 - DNA, 16 bp, Homo sapiens
aaactaatattttatg

SEQ ID NO: 2546813 - DNA, 22 bp, Homo sapiens
aaactacacatccctaatgtgt

SEQ ID NO: 2546814 - DNA, 18 bp, Homo sapiens
aaactagggccaagccca

SEQ ID NO: 2546815 - DNA, 16 bp, Homo sapiens
aaactatcagtttgtc

SEQ ID NO: 2546816 - DNA, 13 bp, Homo sapiens
aaactatttatct

SEQ ID NO: 2546817 - DNA, 20 bp, Homo sapiens
aaactatttgtctttcagga

SEQ ID NO: 2546818 - DNA, 13 bp, Homo sapiens
aaactcaaaactt

SEQ ID NO: 2546819 - DNA, 19 bp, Homo sapiens
aaactcaaaacttaacata

SEQ ID NO: 2546820 - DNA, 19 bp, Homo sapiens
aaactcacctgctggcccc

SEQ ID NO: 2546821 - DNA, 20 bp, Homo sapiens
aaactcacctgctggcccct

SEQ ID NO: 2546822 - DNA, 22 bp, Homo sapiens
aaactcacctgctggcccctca

SEQ ID NO: 2546823 - DNA, 14 bp, Homo sapiens
aaactcctgcccct

SEQ ID NO: 2546824 - DNA, 22 bp, Homo sapiens
aaactcctgcccctgttctctt

SEQ ID NO: 2546825 - DNA, 22 bp, Homo sapiens
aaactcgaggactgtatttgtg

SEQ ID NO: 2546826 - DNA, 23 bp, Homo sapiens
aaactcgaggactgtatttgtga

SEQ ID NO: 2546827 - DNA, 24 bp, Homo sapiens
aaactcgaggactgtatttgtgac

SEQ ID NO: 2546828 - DNA, 14 bp, Homo sapiens
aaactctgccagcc

SEQ ID NO: 2546829 - DNA, 17 bp, Homo sapiens
aaactcttgacctcagg

SEQ ID NO: 2546830 - DNA, 14 bp, Homo sapiens
aaactgaaaatcta

SEQ ID NO: 2546831 - DNA, 18 bp, Homo sapiens
aaactgaaaatctaatat

SEQ ID NO: 2546832 - DNA, 19 bp, Homo sapiens
aaactgaagtctgaaattt

SEQ ID NO: 2546833 - DNA, 12 bp, Homo sapiens
aaactgacttta

SEQ ID NO: 2546834 - DNA, 23 bp, Homo sapiens
aaactgagatgtgaacacatcag

SEQ ID NO: 2546835 - DNA, 19 bp, Homo sapiens
aaactgaggaatttcacct

SEQ ID NO: 2546836 - DNA, 19 bp, Homo sapiens
aaactgcttgtttcctagc

SEQ ID NO: 2546837 - DNA, 20 bp, Homo sapiens
aaactggcaaacttcagact

SEQ ID NO: 2546838 - DNA, 18 bp, Homo sapiens
aaactgtgtattccaaga

SEQ ID NO: 2546839 - DNA, 19 bp, Homo sapiens
aaactgtgtggactgtgat

SEQ ID NO: 2546840 - DNA, 16 bp, Homo sapiens
aaacttaatctaaatg

SEQ ID NO: 2546841 - DNA, 19 bp, Homo sapiens
aaacttatttttttctgat

SEQ ID NO: 2546842 - DNA, 20 bp, Homo sapiens
aaacttatttttttctgatt

SEQ ID NO: 2546843 - DNA, 23 bp, Homo sapiens
aaacttatttttttctgattgta

SEQ ID NO: 2546844 - DNA, 19 bp, Homo sapiens
aaacttcagacatagaatt

SEQ ID NO: 2546845 - DNA, 23 bp, Homo sapiens
aaacttccagtgcaacactgaag

SEQ ID NO: 2546846 - DNA, 20 bp, Homo sapiens
aaagggcccagagagggtgg

SEQ ID NO: 2546847 - DNA, 21 bp, Homo sapiens
aaagggggtcccagtgggagg

SEQ ID NO: 2546848 - DNA, 23 bp, Homo sapiens
aaagggggtcccagtgggagggg

SEQ ID NO: 2546849 - DNA, 17 bp, Homo sapiens
aaagggtcttgggaaat

SEQ ID NO: 2546850 - DNA, 14 bp, Homo sapiens
aaagggtgaagcta

SEQ ID NO: 2546851 - DNA, 18 bp, Homo sapiens
aaagggtgctgcttccct

SEQ ID NO: 2546852 - DNA, 17 bp, Homo sapiens
aaaggtggtatgtgtgt

SEQ ID NO: 2546853 - DNA, 12 bp, Homo sapiens
aaaggtgtcttc

SEQ ID NO: 2546854 - DNA, 18 bp, Homo sapiens
aaaggtgtcttcctccca

SEQ ID NO: 2546855 - DNA, 13 bp, Homo sapiens
aaagtaaagctaa

SEQ ID NO: 2546856 - DNA, 19 bp, Homo sapiens
aaagtacactgtttcaaac

SEQ ID NO: 2546857 - DNA, 21 bp, Homo sapiens
aaagtacttctccaccctgct

SEQ ID NO: 2546858 - DNA, 14 bp, Homo sapiens
aaagtagtaaaaat

SEQ ID NO: 2546859 - DNA, 22 bp, Homo sapiens
aaagtatatatatatattatat

SEQ ID NO: 2546860 - DNA, 12 bp, Homo sapiens
aaagtatcatgc

SEQ ID NO: 2546861 - DNA, 16 bp, Homo sapiens
aaagtattattttcca

SEQ ID NO: 2546862 - DNA, 17 bp, Homo sapiens
aaagtattattttccaa

SEQ ID NO: 2546863 - DNA, 14 bp, Homo sapiens
aaagtattttcctg

SEQ ID NO: 2546864 - DNA, 15 bp, Homo sapiens
aaagtcgaattaata

SEQ ID NO: 2546865 - DNA, 22 bp, Homo sapiens
aaagtctgtgtgatgaactttc

SEQ ID NO: 2546866 - DNA, 20 bp, Homo sapiens
aaagtcttcactctctgaag

SEQ ID NO: 2546867 - DNA, 13 bp, Homo sapiens
aaagtgaagcaaa

SEQ ID NO: 2546868 - DNA, 12 bp, Homo sapiens
aaagtgaatttg

SEQ ID NO: 2546869 - DNA, 19 bp, Homo sapiens
aaagtgaatttgaatgaaa

SEQ ID NO: 2546870 - DNA, 20 bp, Homo sapiens
aaagtgaatttgaatgaaaa

SEQ ID NO: 2546871 - DNA, 14 bp, Homo sapiens
aaccactgcaacgg

SEQ ID NO: 2546872 - DNA, 13 bp, Homo sapiens
aaccacttccctc

SEQ ID NO: 2546873 - DNA, 21 bp, Homo sapiens
aaccacttccctcatctctcc

SEQ ID NO: 2546874 - DNA, 18 bp, Homo sapiens
aaccagaataaagttctg

SEQ ID NO: 2546875 - DNA, 22 bp, Homo sapiens
aaccagctgtaacacagctgag

SEQ ID NO: 2546876 - DNA, 17 bp, Homo sapiens
aaccagtgttgtggatt

SEQ ID NO: 2546877 - DNA, 19 bp, Homo sapiens
aaccatcccctccgtggca

SEQ ID NO: 2546878 - DNA, 16 bp, Homo sapiens
aaccatgaagacagga

SEQ ID NO: 2546879 - DNA, 23 bp, Homo sapiens
aaccatgaagagatttttcatga

SEQ ID NO: 2546880 - DNA, 24 bp, Homo sapiens
aaccatgaagagatttttcatgat

SEQ ID NO: 2546881 - DNA, 23 bp, Homo sapiens
aaccatgagtggcatggccacca

SEQ ID NO: 2546882 - DNA, 20 bp, Homo sapiens
aaccatgtaaagaacataaa

SEQ ID NO: 2546883 - DNA, 23 bp, Homo sapiens
aacccaaatgttcatcaatgaat

SEQ ID NO: 2546884 - DNA, 22 bp, Homo sapiens
aacccaaattacgtgtactaca

SEQ ID NO: 2546885 - DNA, 18 bp, Homo sapiens
aacccaaggactgaggga

SEQ ID NO: 2546886 - DNA, 22 bp, Homo sapiens
aacccaccttgttggagcctgc

SEQ ID NO: 2546887 - DNA, 17 bp, Homo sapiens
aacccagctctggtcca

SEQ ID NO: 2546888 - DNA, 18 bp, Homo sapiens
aacccaggacgcttctga

SEQ ID NO: 2546889 - DNA, 22 bp, Homo sapiens
aacccaggagcatccacctcct

SEQ ID NO: 2546890 - DNA, 16 bp, Homo sapiens
aaccccaactccagta

SEQ ID NO: 2546891 - DNA, 11 bp, Homo sapiens
aacccccaccc

SEQ ID NO: 2546892 - DNA, 12 bp, Homo sapiens
aacccccacccc

SEQ ID NO: 2546893 - DNA, 15 bp, Homo sapiens
aacccccaccccaca

SEQ ID NO: 2546894 - DNA, 17 bp, Homo sapiens
aacccccaccccacact

SEQ ID NO: 2546895 - DNA, 14 bp, Homo sapiens
aacccccagcctgc

SEQ ID NO: 2546896 - DNA, 22 bp, Homo sapiens
aaccccgtcgaggggctctcag

SEQ ID NO: 2546897 - DNA, 15 bp, Homo sapiens
aaccctccctcagcc

SEQ ID NO: 2546898 - DNA, 20 bp, Homo sapiens
aaccctccctcagcccctct

SEQ ID NO: 2546899 - DNA, 21 bp, Homo sapiens
aaccctccctcagcccctctt

SEQ ID NO: 2546900 - DNA, 23 bp, Homo sapiens
aaccctccctcagcccctcttgc

SEQ ID NO: 2546901 - DNA, 21 bp, Homo sapiens
aaccctcctatcacctcccct

SEQ ID NO: 2546902 - DNA, 17 bp, Homo sapiens
aaccctgcccccaaata

SEQ ID NO: 2546903 - DNA, 17 bp, Homo sapiens
aaccctgcgtggggaca

SEQ ID NO: 2546904 - DNA, 12 bp, Homo sapiens
aaccctgtgctg

SEQ ID NO: 2546905 - DNA, 14 bp, Homo sapiens
aaccctgtgctggt

SEQ ID NO: 2546906 - DNA, 19 bp, Homo sapiens
aaccctgtgctggtgtcct

SEQ ID NO: 2546907 - DNA, 13 bp, Homo sapiens
aaccctgtttcct

SEQ ID NO: 2546908 - DNA, 23 bp, Homo sapiens
aaccctgttttatactgtactta

SEQ ID NO: 2546909 - DNA, 23 bp, Homo sapiens
aacccttaccccttagcctccct

SEQ ID NO: 2546910 - DNA, 20 bp, Homo sapiens
aacccttccccactgcacac

SEQ ID NO: 2546911 - DNA, 14 bp, Homo sapiens
aacccttgaaaaga

SEQ ID NO: 2546912 - DNA, 15 bp, Homo sapiens
aacccttgaaaagac

SEQ ID NO: 2546913 - DNA, 21 bp, Homo sapiens
aacccttgtcagtgacagtat

SEQ ID NO: 2546914 - DNA, 17 bp, Homo sapiens
aaccgagcaaagatcaa

SEQ ID NO: 2546915 - DNA, 21 bp, Homo sapiens
aaccgatgctccagccaaccc

SEQ ID NO: 2546916 - DNA, 14 bp, Homo sapiens
aaccgcaggaagct

SEQ ID NO: 2546917 - DNA, 21 bp, Homo sapiens
aaccgcaggaagctgctccgt

SEQ ID NO: 2546918 - DNA, 18 bp, Homo sapiens
aaccgtctgttatgctgt

SEQ ID NO: 2546919 - DNA, 19 bp, Homo sapiens
aacctaccaccccttcctg

SEQ ID NO: 2546920 - DNA, 23 bp, Homo sapiens
aacctaccttcatttcaggaggg

SEQ ID NO: 2546921 - DNA, 22 bp, Homo sapiens
aacctatgatattttctgtgcc

SEQ ID NO: 2546922 - DNA, 15 bp, Homo sapiens
aacctcaaagtgact

SEQ ID NO: 2546923 - DNA, 16 bp, Homo sapiens
aacctcaactgcctac

SEQ ID NO: 2546924 - DNA, 21 bp, Homo sapiens
aacctcacccgaggctgccca

SEQ ID NO: 2546925 - DNA, 22 bp, Homo sapiens
aacctcagacttaccaggaagc

SEQ ID NO: 2546926 - DNA, 18 bp, Homo sapiens
aacctcaggcttccttgg

SEQ ID NO: 2546927 - DNA, 13 bp, Homo sapiens
aacctcagtgtca

SEQ ID NO: 2546928 - DNA, 14 bp, Homo sapiens
aacctcctctgtga

SEQ ID NO: 2546929 - DNA, 14 bp, Homo sapiens
aacctcctgggcta

SEQ ID NO: 2546930 - DNA, 21 bp, Homo sapiens
aacctcctgttagctgttatt

SEQ ID NO: 2546931 - DNA, 13 bp, Homo sapiens
aacctctgttcag

SEQ ID NO: 2546932 - DNA, 20 bp, Homo sapiens
aacctgacagatgtcagccg

SEQ ID NO: 2546933 - DNA, 23 bp, Homo sapiens
aacctgacagatgtcagccgagc

SEQ ID NO: 2546934 - DNA, 19 bp, Homo sapiens
aacctgacccctgctcagt

SEQ ID NO: 2546935 - DNA, 18 bp, Homo sapiens
aacctgagccccaaaagg

SEQ ID NO: 2546936 - DNA, 20 bp, Homo sapiens
aacctgagccccaaaaggta

SEQ ID NO: 2546937 - DNA, 20 bp, Homo sapiens
aacctgagtcgtacagaaag

SEQ ID NO: 2546938 - DNA, 17 bp, Homo sapiens
aacctgatgcagtcacg

SEQ ID NO: 2546939 - DNA, 17 bp, Homo sapiens
aacctgatgttaaaatt

SEQ ID NO: 2546940 - DNA, 18 bp, Homo sapiens
aacctgattgtgtctctt

SEQ ID NO: 2546941 - DNA, 19 bp, Homo sapiens
aacctgcaagggctcccca

SEQ ID NO: 2546942 - DNA, 15 bp, Homo sapiens
aacctgccagggaga

SEQ ID NO: 2546943 - DNA, 11 bp, Homo sapiens
aacctgccctg

SEQ ID NO: 2546944 - DNA, 19 bp, Homo sapiens
aacctgccctgcctgaggg

SEQ ID NO: 2546945 - DNA, 19 bp, Homo sapiens
aacctgcctgacatttgga

SEQ ID NO: 2546946 - DNA, 23 bp, Homo sapiens
aacctgcttgggtggagaagcca

SEQ ID NO: 2546947 - DNA, 10 bp, Homo sapiens
aacctggaga

SEQ ID NO: 2546948 - DNA, 19 bp, Homo sapiens
aacctggagggctagaacc

SEQ ID NO: 2546949 - DNA, 19 bp, Homo sapiens
aacctgggtccaaataaaa

SEQ ID NO: 2546950 - DNA, 23 bp, Homo sapiens
aacctgtacttcaagttaaagtg

SEQ ID NO: 2546951 - DNA, 24 bp, Homo sapiens
aacctgttacctactttgactttt

SEQ ID NO: 2546952 - DNA, 17 bp, Homo sapiens
aaccttattgtacctct

SEQ ID NO: 2546953 - DNA, 13 bp, Homo sapiens
aaccttccatctc

SEQ ID NO: 2546954 - DNA, 12 bp, Homo sapiens
aaccttctggcc

SEQ ID NO: 2546955 - DNA, 15 bp, Homo sapiens
aaccttgagacagct

SEQ ID NO: 2546956 - DNA, 23 bp, Homo sapiens
aaccttgtctctatgccagctca

SEQ ID NO: 2546957 - DNA, 17 bp, Homo sapiens
aaccttgttatttctca

SEQ ID NO: 2546958 - DNA, 18 bp, Homo sapiens
aacgactgggcactgcca

SEQ ID NO: 2546959 - DNA, 12 bp, Homo sapiens
aacgaggaagcc

SEQ ID NO: 2546960 - DNA, 22 bp, Homo sapiens
aacgcagccctagagcctgcct

SEQ ID NO: 2546961 - DNA, 22 bp, Homo sapiens
aacgcatggagtgtgtattgtt

SEQ ID NO: 2546962 - DNA, 23 bp, Homo sapiens
aacgcatggagtgtgtattgttc

SEQ ID NO: 2546963 - DNA, 17 bp, Homo sapiens
aacggattattttttca

SEQ ID NO: 2546964 - DNA, 20 bp, Homo sapiens
aacggattattttttcagac

SEQ ID NO: 2546965 - DNA, 22 bp, Homo sapiens
aacggattattttttcagaccg

SEQ ID NO: 2546966 - DNA, 14 bp, Homo sapiens
aacggctccaggat

SEQ ID NO: 2546967 - DNA, 21 bp, Homo sapiens
aacgtatgcatgtgaagaaag

SEQ ID NO: 2546968 - DNA, 13 bp, Homo sapiens
aacgtctgtgcca

SEQ ID NO: 2546969 - DNA, 12 bp, Homo sapiens
aacgtgaaaatg

SEQ ID NO: 2546970 - DNA, 13 bp, Homo sapiens
aacgttgctgtgg

SEQ ID NO: 2546971 - DNA, 16 bp, Homo sapiens
aacgttgctgtgggaa

SEQ ID NO: 2546972 - DNA, 13 bp, Homo sapiens
aacgttttattgt

SEQ ID NO: 2546973 - DNA, 23 bp, Homo sapiens
aacgtttttcctttaaaaaaatt

SEQ ID NO: 2546974 - DNA, 23 bp, Homo sapiens
aactaagaaatatgcacaatagc

SEQ ID NO: 2546975 - DNA, 15 bp, Homo sapiens
aactaatgccttact

SEQ ID NO: 2546976 - DNA, 19 bp, Homo sapiens
aactacgcttgctcatttt

SEQ ID NO: 2546977 - DNA, 15 bp, Homo sapiens
aactactgtgttcct

SEQ ID NO: 2546978 - DNA, 16 bp, Homo sapiens
aactagaaatctgcca

SEQ ID NO: 2546979 - DNA, 16 bp, Homo sapiens
aactagacattctgtc

SEQ ID NO: 2546980 - DNA, 23 bp, Homo sapiens
aactagactcccaagctggacta

SEQ ID NO: 2546981 - DNA, 14 bp, Homo sapiens
aactagcaccaggg

SEQ ID NO: 2546982 - DNA, 15 bp, Homo sapiens
aactagccaccaact

SEQ ID NO: 2546983 - DNA, 17 bp, Homo sapiens
aactagggaagataata

SEQ ID NO: 2546984 - DNA, 17 bp, Homo sapiens
aactagggccaagccca

SEQ ID NO: 2546985 - DNA, 22 bp, Homo sapiens
aactaggtctgatattcaaatg

SEQ ID NO: 2546986 - DNA, 16 bp, Homo sapiens
aactatattttcttta

SEQ ID NO: 2546987 - DNA, 18 bp, Homo sapiens
aactatttcttatatatg

SEQ ID NO: 2546988 - DNA, 16 bp, Homo sapiens
aactcaaaatatttgt

SEQ ID NO: 2546989 - DNA, 12 bp, Homo sapiens
aactcaatattt

SEQ ID NO: 2546990 - DNA, 14 bp, Homo sapiens
aactcaatattttc

SEQ ID NO: 2546991 - DNA, 15 bp, Homo sapiens
aactcaccccagccc

SEQ ID NO: 2546992 - DNA, 16 bp, Homo sapiens
aactcaccccagcccc

SEQ ID NO: 2546993 - DNA, 17 bp, Homo sapiens
aactcacctaatgttta

SEQ ID NO: 2546994 - DNA, 12 bp, Homo sapiens
aactcacctgct

SEQ ID NO: 2546995 - DNA, 16 bp, Homo sapiens
aactcacctgctggcc

SEQ ID NO: 2546996 - DNA, 22 bp, Homo sapiens
aactcacctgctggcccctcac

SEQ ID NO: 2546997 - DNA, 20 bp, Homo sapiens
aactcacctggggctgctgg

SEQ ID NO: 2546998 - DNA, 21 bp, Homo sapiens
aactcagaaacatcagttact

SEQ ID NO: 2546999 - DNA, 18 bp, Homo sapiens
aactcagatcactactgc

SEQ ID NO: 2547000 - DNA, 20 bp, Homo sapiens
aactcagatcactactgcag

SEQ ID NO: 2547001 - DNA, 13 bp, Homo sapiens
aactcagatctgt

SEQ ID NO: 2547002 - DNA, 16 bp, Homo sapiens
aactcagccaagcaca

SEQ ID NO: 2547003 - DNA, 18 bp, Homo sapiens
aactcagccaagcacagt

SEQ ID NO: 2547004 - DNA, 18 bp, Homo sapiens
aactcagggacagagcca

SEQ ID NO: 2547005 - DNA, 19 bp, Homo sapiens
aaggtctttggttcagcta

SEQ ID NO: 2547006 - DNA, 11 bp, Homo sapiens
aaggtgggagg

SEQ ID NO: 2547007 - DNA, 16 bp, Homo sapiens
aaggtggtatgtgtgt

SEQ ID NO: 2547008 - DNA, 20 bp, Homo sapiens
aaggtggtatgtgtgtgtat

SEQ ID NO: 2547009 - DNA, 16 bp, Homo sapiens
aaggtgtcttcctccc

SEQ ID NO: 2547010 - DNA, 22 bp, Homo sapiens
aaggtgttcattcacttgcatt

SEQ ID NO: 2547011 - DNA, 16 bp, Homo sapiens
aaggttaataaagtaa

SEQ ID NO: 2547012 - DNA, 17 bp, Homo sapiens
aaggttcactaaagcag

SEQ ID NO: 2547013 - DNA, 18 bp, Homo sapiens
aaggttccaactgtatat

SEQ ID NO: 2547014 - DNA, 21 bp, Homo sapiens
aaggttccaactgtatatatt

SEQ ID NO: 2547015 - DNA, 22 bp, Homo sapiens
aaggttccaatcagatctttat

SEQ ID NO: 2547016 - DNA, 16 bp, Homo sapiens
aaggttgggcagggtg

SEQ ID NO: 2547017 - DNA, 17 bp, Homo sapiens
aaggttgtattgcatat

SEQ ID NO: 2547018 - DNA, 22 bp, Homo sapiens
aaggtttaaacttctctgaagg

SEQ ID NO: 2547019 - DNA, 20 bp, Homo sapiens
aaggttttcctcttctattt

SEQ ID NO: 2547020 - DNA, 14 bp, Homo sapiens
aaggttttctccac

SEQ ID NO: 2547021 - DNA, 16 bp, Homo sapiens
aagtaaaaccacagca

SEQ ID NO: 2547022 - DNA, 12 bp, Homo sapiens
aagtaaaacttg

SEQ ID NO: 2547023 - DNA, 21 bp, Homo sapiens
aagtaaagctaaaatgatttt

SEQ ID NO: 2547024 - DNA, 18 bp, Homo sapiens
aagtaagaaagtgaagca

SEQ ID NO: 2547025 - DNA, 21 bp, Homo sapiens
aagtaagaaagtgaagcaaat

SEQ ID NO: 2547026 - DNA, 20 bp, Homo sapiens
aagtaagaagacatgaacca

SEQ ID NO: 2547027 - DNA, 17 bp, Homo sapiens
aagtaagcaacagcata

SEQ ID NO: 2547028 - DNA, 21 bp, Homo sapiens
aagtaagtaccactcaggcca

SEQ ID NO: 2547029 - DNA, 12 bp, Homo sapiens
aagtaatatgca

SEQ ID NO: 2547030 - DNA, 18 bp, Homo sapiens
aagtaatatgcacacatt

SEQ ID NO: 2547031 - DNA, 20 bp, Homo sapiens
aagtaatatgcacacatttt

SEQ ID NO: 2547032 - DNA, 21 bp, Homo sapiens
aagtaatatgcacacattttt

SEQ ID NO: 2547033 - DNA, 11 bp, Homo sapiens
aagtaattatc

SEQ ID NO: 2547034 - DNA, 13 bp, Homo sapiens
aagtacactgttt

SEQ ID NO: 2547035 - DNA, 20 bp, Homo sapiens
aagtacatattaggaaaata

SEQ ID NO: 2547036 - DNA, 20 bp, Homo sapiens
aagtacccgttcacattttt

SEQ ID NO: 2547037 - DNA, 16 bp, Homo sapiens
aagtacgttattgttg

SEQ ID NO: 2547038 - DNA, 13 bp, Homo sapiens
aagtactatgtat

SEQ ID NO: 2547039 - DNA, 18 bp, Homo sapiens
aagtacttctccaccctg

SEQ ID NO: 2547040 - DNA, 20 bp, Homo sapiens
aagtacttctccaccctgct

SEQ ID NO: 2547041 - DNA, 22 bp, Homo sapiens
aagtacttctccaccctgctct

SEQ ID NO: 2547042 - DNA, 19 bp, Homo sapiens
aagtagaagtcttagatgt

SEQ ID NO: 2547043 - DNA, 15 bp, Homo sapiens
aagtaggcatgaggg

SEQ ID NO: 2547044 - DNA, 21 bp, Homo sapiens
aagtagggacttctgtcttca

SEQ ID NO: 2547045 - DNA, 15 bp, Homo sapiens
aagtagggggtctaa

SEQ ID NO: 2547046 - DNA, 15 bp, Homo sapiens
aagtagtgtgcagtt

SEQ ID NO: 2547047 - DNA, 18 bp, Homo sapiens
aagtatactgtattttta

SEQ ID NO: 2547048 - DNA, 23 bp, Homo sapiens
aagtatataatggtttcaaagat

SEQ ID NO: 2547049 - DNA, 18 bp, Homo sapiens
aagtatatatatatatta

SEQ ID NO: 2547050 - DNA, 13 bp, Homo sapiens
aagtatatattta

SEQ ID NO: 2547051 - DNA, 16 bp, Homo sapiens
aagtatccctactgta

SEQ ID NO: 2547052 - DNA, 17 bp, Homo sapiens
aagtatccctactgtaa

SEQ ID NO: 2547053 - DNA, 13 bp, Homo sapiens
aagtatgtgagtg

SEQ ID NO: 2547054 - DNA, 13 bp, Homo sapiens
aagtattataaat

SEQ ID NO: 2547055 - DNA, 17 bp, Homo sapiens
aagtattataaattatg

SEQ ID NO: 2547056 - DNA, 15 bp, Homo sapiens
aagtattataccttt

SEQ ID NO: 2547057 - DNA, 19 bp, Homo sapiens
aagtattcttatttaatga

SEQ ID NO: 2547058 - DNA, 23 bp, Homo sapiens
aagtattcttatttaatgaaaga

SEQ ID NO: 2547059 - DNA, 16 bp, Homo sapiens
aagtatttaggttttt

SEQ ID NO: 2547060 - DNA, 13 bp, Homo sapiens
aagtatttatata

SEQ ID NO: 2547061 - DNA, 20 bp, Homo sapiens
aagtatttatatatttataa

SEQ ID NO: 2547062 - DNA, 21 bp, Homo sapiens
aagtatttcaaattggagctt

SEQ ID NO: 2547063 - DNA, 22 bp, Homo sapiens
aagtattttcataagtatttca

SEQ ID NO: 2547064 - DNA, 15 bp, Homo sapiens
aagtgttagatagaa

SEQ ID NO: 2547065 - DNA, 17 bp, Homo sapiens
aagtgttgtaaatattt

SEQ ID NO: 2547066 - DNA, 18 bp, Homo sapiens
aagtgttgtaaatattta

SEQ ID NO: 2547067 - DNA, 23 bp, Homo sapiens
aagtgtttctgttattaacaaac

SEQ ID NO: 2547068 - DNA, 14 bp, Homo sapiens
aagttaaataaatc

SEQ ID NO: 2547069 - DNA, 11 bp, Homo sapiens
aagttaagaat

SEQ ID NO: 2547070 - DNA, 14 bp, Homo sapiens
aagttacacatttt

SEQ ID NO: 2547071 - DNA, 17 bp, Homo sapiens
aagttacacatttttca

SEQ ID NO: 2547072 - DNA, 15 bp, Homo sapiens
aagttactgaatgca

SEQ ID NO: 2547073 - DNA, 19 bp, Homo sapiens
aagttactttgtcagaggc

SEQ ID NO: 2547074 - DNA, 21 bp, Homo sapiens
aagttagaattccttcagggt

SEQ ID NO: 2547075 - DNA, 22 bp, Homo sapiens
aagttagaattccttcagggtg

SEQ ID NO: 2547076 - DNA, 14 bp, Homo sapiens
aagttagctcagga

SEQ ID NO: 2547077 - DNA, 11 bp, Homo sapiens
aagttagtcta

SEQ ID NO: 2547078 - DNA, 18 bp, Homo sapiens
aagttataaatcaatgtc

SEQ ID NO: 2547079 - DNA, 19 bp, Homo sapiens
aagttataaatcaatgtca

SEQ ID NO: 2547080 - DNA, 23 bp, Homo sapiens
aagttatataggttttgtttgct

SEQ ID NO: 2547081 - DNA, 14 bp, Homo sapiens
aagttattaatatt

SEQ ID NO: 2547082 - DNA, 20 bp, Homo sapiens
aagttattgtacagctgttt

SEQ ID NO: 2547083 - DNA, 22 bp, Homo sapiens
aagttcatattccatatttatt

SEQ ID NO: 2547084 - DNA, 19 bp, Homo sapiens
aagttccagtgttctctct

SEQ ID NO: 2547085 - DNA, 18 bp, Homo sapiens
aagttctagagaagaggc

SEQ ID NO: 2547086 - DNA, 21 bp, Homo sapiens
aagttctagagaagaggctgg

SEQ ID NO: 2547087 - DNA, 19 bp, Homo sapiens
aagttctggatgcatttct

SEQ ID NO: 2547088 - DNA, 19 bp, Homo sapiens
aagttctgtactcaaatgt

SEQ ID NO: 2547089 - DNA, 20 bp, Homo sapiens
aagttgaaagagtcctattt

SEQ ID NO: 2547090 - DNA, 17 bp, Homo sapiens
aagttgaagctaagatt

SEQ ID NO: 2547091 - DNA, 18 bp, Homo sapiens
aagttgaagctaagattt

SEQ ID NO: 2547092 - DNA, 15 bp, Homo sapiens
aagttgcacggctgc

SEQ ID NO: 2547093 - DNA, 16 bp, Homo sapiens
aagttgcacggctgct

SEQ ID NO: 2547094 - DNA, 20 bp, Homo sapiens
aagttgcactgatattttac

SEQ ID NO: 2547095 - DNA, 22 bp, Homo sapiens
aagttgtaggcataaagtcagg

SEQ ID NO: 2547096 - DNA, 19 bp, Homo sapiens
aagttgtgccttttatagc

SEQ ID NO: 2547097 - DNA, 16 bp, Homo sapiens
aagttgtggtgctgac

SEQ ID NO: 2547098 - DNA, 15 bp, Homo sapiens
aagttgttaataaaa

SEQ ID NO: 2547099 - DNA, 21 bp, Homo sapiens
aagttgtttgagaaattaagt

SEQ ID NO: 2547100 - DNA, 13 bp, Homo sapiens
aagttgtttgcat

SEQ ID NO: 2547101 - DNA, 15 bp, Homo sapiens
aagtttaaggaatat

SEQ ID NO: 2547102 - DNA, 18 bp, Homo sapiens
aagtttacaatcaaagga

SEQ ID NO: 2547103 - DNA, 12 bp, Homo sapiens
aagtttcaggtg

SEQ ID NO: 2547104 - DNA, 21 bp, Homo sapiens
aagtttcaggtgacatgtgaa

SEQ ID NO: 2547105 - DNA, 22 bp, Homo sapiens
aagtttcaggtgacatgtgaaa

SEQ ID NO: 2547106 - DNA, 16 bp, Homo sapiens
aagtttctcagctccc

SEQ ID NO: 2547107 - DNA, 17 bp, Homo sapiens
aagtttctcagctccca

SEQ ID NO: 2547108 - DNA, 20 bp, Homo sapiens
aagtttgagatcagcctggg

SEQ ID NO: 2547109 - DNA, 12 bp, Homo sapiens
aagtttgcaatt

SEQ ID NO: 2547110 - DNA, 19 bp, Homo sapiens
aagtttggcaatagtttgc

SEQ ID NO: 2547111 - DNA, 23 bp, Homo sapiens
aagttttcagaacctcttcccca

SEQ ID NO: 2547112 - DNA, 15 bp, Homo sapiens
aagttttgaaaagct

SEQ ID NO: 2547113 - DNA, 18 bp, Homo sapiens
aagttttgaaaagctatt

SEQ ID NO: 2547114 - DNA, 15 bp, Homo sapiens
aagttttgcatttat

SEQ ID NO: 2547115 - DNA, 17 bp, Homo sapiens
aagtttttgtactgtaa

SEQ ID NO: 2547116 - DNA, 13 bp, Homo sapiens
aataaaaaaaaga

SEQ ID NO: 2547117 - DNA, 18 bp, Homo sapiens
aataaaaaaaagaaaaaa

SEQ ID NO: 2547118 - DNA, 13 bp, Homo sapiens
aataaaaaatgga

SEQ ID NO: 2547119 - DNA, 21 bp, Homo sapiens
aataaaaactgactccttaga

SEQ ID NO: 2547120 - DNA, 19 bp, Homo sapiens
aataaaaagatcactttct

SEQ ID NO: 2547121 - DNA, 18 bp, Homo sapiens
aataaaaaggcacctata

SEQ ID NO: 2547122 - DNA, 15 bp, Homo sapiens
aataaaaataaattc

SEQ ID NO: 2547123 - DNA, 16 bp, Homo sapiens
aataaaaataaatttg

SEQ ID NO: 2547124 - DNA, 13 bp, Homo sapiens
aataaaaatggat

SEQ ID NO: 2547125 - DNA, 13 bp, Homo sapiens
aataaaaccagct

SEQ ID NO: 2547126 - DNA, 14 bp, Homo sapiens
aataaaacctttca

SEQ ID NO: 2547127 - DNA, 14 bp, Homo sapiens
aataaaacttttta

SEQ ID NO: 2547128 - DNA, 18 bp, Homo sapiens
aataaaagcagcatctgc

SEQ ID NO: 2547129 - DNA, 12 bp, Homo sapiens
aataaaaggaaa

SEQ ID NO: 2547130 - DNA, 14 bp, Homo sapiens
aataaaataaaaat

SEQ ID NO: 2547131 - DNA, 15 bp, Homo sapiens
aataaaataattcta

SEQ ID NO: 2547132 - DNA, 16 bp, Homo sapiens
aataaaataattctaa

SEQ ID NO: 2547133 - DNA, 11 bp, Homo sapiens
aataaaatcat

SEQ ID NO: 2547134 - DNA, 18 bp, Homo sapiens
aatactcataatgtgaag

SEQ ID NO: 2547135 - DNA, 12 bp, Homo sapiens
aatactcatgtg

SEQ ID NO: 2547136 - DNA, 22 bp, Homo sapiens
aatactctaccctcttagaaaa

SEQ ID NO: 2547137 - DNA, 18 bp, Homo sapiens
aatactgccagatgctga

SEQ ID NO: 2547138 - DNA, 20 bp, Homo sapiens
aatactgccagatgctgatg

SEQ ID NO: 2547139 - DNA, 12 bp, Homo sapiens
aatactgtttga

SEQ ID NO: 2547140 - DNA, 21 bp, Homo sapiens
aatacttctcaaacctgttta

SEQ ID NO: 2547141 - DNA, 10 bp, Homo sapiens
aatacttgtc

SEQ ID NO: 2547142 - DNA, 20 bp, Homo sapiens
aatacttgtcaatatttaaa

SEQ ID NO: 2547143 - DNA, 15 bp, Homo sapiens
aatactttaaaggaa

SEQ ID NO: 2547144 - DNA, 17 bp, Homo sapiens
aatactttaaaggaaaa

SEQ ID NO: 2547145 - DNA, 21 bp, Homo sapiens
aatagaaactcaccatgtaaa

SEQ ID NO: 2547146 - DNA, 16 bp, Homo sapiens
aatagaaataagtggt

SEQ ID NO: 2547147 - DNA, 17 bp, Homo sapiens
aatagaaatggggaact

SEQ ID NO: 2547148 - DNA, 20 bp, Homo sapiens
aatagaaggatgtacatttc

SEQ ID NO: 2547149 - DNA, 22 bp, Homo sapiens
aatagaaggatgtacatttcca

SEQ ID NO: 2547150 - DNA, 13 bp, Homo sapiens
aatagacaattta

SEQ ID NO: 2547151 - DNA, 18 bp, Homo sapiens
aatagagtatatgcactt

SEQ ID NO: 2547152 - DNA, 18 bp, Homo sapiens
aatagctatatccatgta

SEQ ID NO: 2547153 - DNA, 21 bp, Homo sapiens
aatagctatatccatgtactg

SEQ ID NO: 2547154 - DNA, 14 bp, Homo sapiens
aatagctgggacta

SEQ ID NO: 2547155 - DNA, 13 bp, Homo sapiens
aataggagaggat

SEQ ID NO: 2547156 - DNA, 21 bp, Homo sapiens
aatagggctgagctctctgtg

SEQ ID NO: 2547157 - DNA, 22 bp, Homo sapiens
aatagtaaaagataacaagatc

SEQ ID NO: 2547158 - DNA, 17 bp, Homo sapiens
aatagtatcctccaggt

SEQ ID NO: 2547159 - DNA, 18 bp, Homo sapiens
aatagtatcctccaggtt

SEQ ID NO: 2547160 - DNA, 20 bp, Homo sapiens
aatagtatcctccaggtttt

SEQ ID NO: 2547161 - DNA, 21 bp, Homo sapiens
aatagtatcctccaggttttt

SEQ ID NO: 2547162 - DNA, 16 bp, Homo sapiens
aatagtcaagaaaaat

SEQ ID NO: 2547163 - DNA, 14 bp, Homo sapiens
aatagtctgtgtga

SEQ ID NO: 2547164 - DNA, 22 bp, Homo sapiens
aatagtgtggaaattaagaaga

SEQ ID NO: 2547165 - DNA, 14 bp, Homo sapiens
aatagtgtgttctg

SEQ ID NO: 2547166 - DNA, 23 bp, Homo sapiens
aatagtgtgttctgattagaaat

SEQ ID NO: 2547167 - DNA, 15 bp, Homo sapiens
aatagttactccagt

SEQ ID NO: 2547168 - DNA, 13 bp, Homo sapiens
aatagttggctag

SEQ ID NO: 2547169 - DNA, 14 bp, Homo sapiens
aatagttgttgatt

SEQ ID NO: 2547170 - DNA, 20 bp, Homo sapiens
aatagttttattaataaaca

SEQ ID NO: 2547171 - DNA, 21 bp, Homo sapiens
aatagttttattaataaacat

SEQ ID NO: 2547172 - DNA, 21 bp, Homo sapiens
aatataaagatggctgacttt

SEQ ID NO: 2547173 - DNA, 19 bp, Homo sapiens
aatataaggaaagcaataa

SEQ ID NO: 2547174 - DNA, 23 bp, Homo sapiens
aatataaggaaagcaataaatga

SEQ ID NO: 2547175 - DNA, 16 bp, Homo sapiens
aatataattctgtaaa

SEQ ID NO: 2547176 - DNA, 18 bp, Homo sapiens
aatatacattcaaactta

SEQ ID NO: 2547177 - DNA, 19 bp, Homo sapiens
aatatacattcaaacttaa

SEQ ID NO: 2547178 - DNA, 17 bp, Homo sapiens
aatatactatatttatg

SEQ ID NO: 2547179 - DNA, 12 bp, Homo sapiens
aatatactgtaa

SEQ ID NO: 2547180 - DNA, 15 bp, Homo sapiens
aatatactgtaaaga

SEQ ID NO: 2547181 - DNA, 17 bp, Homo sapiens
aatatactgtaaagaaa

SEQ ID NO: 2547182 - DNA, 22 bp, Homo sapiens
aatatactgtaaagaaagagag

SEQ ID NO: 2547183 - DNA, 13 bp, Homo sapiens
aatatagaaacac

SEQ ID NO: 2547184 - DNA, 21 bp, Homo sapiens
aatatagatcagttataagta

SEQ ID NO: 2547185 - DNA, 15 bp, Homo sapiens
aatatagctattttt

SEQ ID NO: 2547186 - DNA, 18 bp, Homo sapiens
aatatatctaaattgaat

SEQ ID NO: 2547187 - DNA, 23 bp, Homo sapiens
aatatatgtttaccttttaatta

SEQ ID NO: 2547188 - DNA, 16 bp, Homo sapiens
aatatattataatctt

SEQ ID NO: 2547189 - DNA, 21 bp, Homo sapiens
aatatatttgtgtatttaaca

SEQ ID NO: 2547190 - DNA, 15 bp, Homo sapiens
aatatattttctgtt

SEQ ID NO: 2547191 - DNA, 15 bp, Homo sapiens
aatatcagactagtg

SEQ ID NO: 2547192 - DNA, 16 bp, Homo sapiens
aatatcatcagtattg

SEQ ID NO: 2547193 - DNA, 13 bp, Homo sapiens
aatatcatttatt

SEQ ID NO: 2547194 - DNA, 23 bp, Homo sapiens
aatatcatttattttttacatta

SEQ ID NO: 2547195 - DNA, 18 bp, Homo sapiens
aatatctaataaaaagtc

SEQ ID NO: 2547196 - DNA, 13 bp, Homo sapiens
aatatctgggatt

SEQ ID NO: 2547197 - DNA, 23 bp, Homo sapiens
aatatctgtatttaattttgaca

SEQ ID NO: 2547198 - DNA, 19 bp, Homo sapiens
aatatcttttttttaataa

SEQ ID NO: 2547199 - DNA, 19 bp, Homo sapiens
aatatgaacggtgagcatt

SEQ ID NO: 2547200 - DNA, 12 bp, Homo sapiens
aatatgaatgcc

SEQ ID NO: 2547201 - DNA, 17 bp, Homo sapiens
aatatgacggaagaaca

SEQ ID NO: 2547202 - DNA, 22 bp, Homo sapiens
aatatgattagtaaagaaatga

SEQ ID NO: 2547203 - DNA, 16 bp, Homo sapiens
aatatgcctctccttt

SEQ ID NO: 2547204 - DNA, 23 bp, Homo sapiens
aatatgcctctcctttgtatatt

SEQ ID NO: 2547205 - DNA, 11 bp, Homo sapiens
aatatgcttac

SEQ ID NO: 2547206 - DNA, 14 bp, Homo sapiens
aatatggaacttct

SEQ ID NO: 2547207 - DNA, 18 bp, Homo sapiens
aatatggctataaatata

SEQ ID NO: 2547208 - DNA, 21 bp, Homo sapiens
aatatgttaacctcagtgtca

SEQ ID NO: 2547209 - DNA, 22 bp, Homo sapiens
aatatgttgatgaaaaatagca

SEQ ID NO: 2547210 - DNA, 21 bp, Homo sapiens
aatatgttttttagatcaaat

SEQ ID NO: 2547211 - DNA, 22 bp, Homo sapiens
aatatgttttttagatcaaata

SEQ ID NO: 2547212 - DNA, 13 bp, Homo sapiens
aatattaaataca

SEQ ID NO: 2547213 - DNA, 19 bp, Homo sapiens
aatcatttctatttctcct

SEQ ID NO: 2547214 - DNA, 20 bp, Homo sapiens
aatcattttaattattattc

SEQ ID NO: 2547215 - DNA, 17 bp, Homo sapiens
aatccactcccaggcag

SEQ ID NO: 2547216 - DNA, 17 bp, Homo sapiens
aatccagacccggctgc

SEQ ID NO: 2547217 - DNA, 15 bp, Homo sapiens
aatccatgcttgggt

SEQ ID NO: 2547218 - DNA, 16 bp, Homo sapiens
aatccatgtaaggtat

SEQ ID NO: 2547219 - DNA, 19 bp, Homo sapiens
aatccatgttagtttttac

SEQ ID NO: 2547220 - DNA, 20 bp, Homo sapiens
aatcccattcataactttca

SEQ ID NO: 2547221 - DNA, 17 bp, Homo sapiens
aatcccatttaaaaaaa

SEQ ID NO: 2547222 - DNA, 11 bp, Homo sapiens
aatcccctcct

SEQ ID NO: 2547223 - DNA, 19 bp, Homo sapiens
aatccctgggcattgcttt

SEQ ID NO: 2547224 - DNA, 20 bp, Homo sapiens
aatccgaacctcctctgtga

SEQ ID NO: 2547225 - DNA, 16 bp, Homo sapiens
aatcctaacacattat

SEQ ID NO: 2547226 - DNA, 20 bp, Homo sapiens
aatcctatgtgattttaact

SEQ ID NO: 2547227 - DNA, 14 bp, Homo sapiens
aatcctcttcctct

SEQ ID NO: 2547228 - DNA, 11 bp, Homo sapiens
aatcctgcccc

SEQ ID NO: 2547229 - DNA, 19 bp, Homo sapiens
aatcctggccctctgtgtt

SEQ ID NO: 2547230 - DNA, 13 bp, Homo sapiens
aatcctttactgt

SEQ ID NO: 2547231 - DNA, 23 bp, Homo sapiens
aatcgcttctcttttgaaacaat

SEQ ID NO: 2547232 - DNA, 23 bp, Homo sapiens
aatcggatctggggctctgggat

SEQ ID NO: 2547233 - DNA, 16 bp, Homo sapiens
aatcgttatgtgtgta

SEQ ID NO: 2547234 - DNA, 12 bp, Homo sapiens
aatctaaatgga

SEQ ID NO: 2547235 - DNA, 18 bp, Homo sapiens
aatctaaatggaaccact

SEQ ID NO: 2547236 - DNA, 20 bp, Homo sapiens
aatctaaccacatcaatatt

SEQ ID NO: 2547237 - DNA, 22 bp, Homo sapiens
aatctaagcagcatttctgaag

SEQ ID NO: 2547238 - DNA, 19 bp, Homo sapiens
aatctagtatttcatgctg

SEQ ID NO: 2547239 - DNA, 14 bp, Homo sapiens
aatctatgaagtat

SEQ ID NO: 2547240 - DNA, 17 bp, Homo sapiens
aatctatgaagtatata

SEQ ID NO: 2547241 - DNA, 19 bp, Homo sapiens
aatctatgaagtatataat

SEQ ID NO: 2547242 - DNA, 22 bp, Homo sapiens
aatctattaatagctgccttaa

SEQ ID NO: 2547243 - DNA, 18 bp, Homo sapiens
aatctattcagacaagca

SEQ ID NO: 2547244 - DNA, 15 bp, Homo sapiens
aatctattgggttca

SEQ ID NO: 2547245 - DNA, 18 bp, Homo sapiens
aatctattgggttcatta

SEQ ID NO: 2547246 - DNA, 12 bp, Homo sapiens
aatctatttaag

SEQ ID NO: 2547247 - DNA, 14 bp, Homo sapiens
aatctattttgtaa

SEQ ID NO: 2547248 - DNA, 13 bp, Homo sapiens
aatctcaaataac

SEQ ID NO: 2547249 - DNA, 15 bp, Homo sapiens
aatctcaaatttcta

SEQ ID NO: 2547250 - DNA, 13 bp, Homo sapiens
aatctcaccccat

SEQ ID NO: 2547251 - DNA, 18 bp, Homo sapiens
aatctccaaaataaaact

SEQ ID NO: 2547252 - DNA, 15 bp, Homo sapiens
aatctcctcttttat

SEQ ID NO: 2547253 - DNA, 18 bp, Homo sapiens
aatctcgtttcaaaaaca

SEQ ID NO: 2547254 - DNA, 15 bp, Homo sapiens
aatctctttttgact

SEQ ID NO: 2547255 - DNA, 20 bp, Homo sapiens
aatctctttttgctttcgaa

SEQ ID NO: 2547256 - DNA, 22 bp, Homo sapiens
aatctgctttttaaagaatgct

SEQ ID NO: 2547257 - DNA, 23 bp, Homo sapiens
aatctggaccccatctgtgaata

SEQ ID NO: 2547258 - DNA, 20 bp, Homo sapiens
aatctggactcctctgtcca

SEQ ID NO: 2547259 - DNA, 19 bp, Homo sapiens
aatctggagagctagaacc

SEQ ID NO: 2547260 - DNA, 16 bp, Homo sapiens
aatctgggaagggaag

SEQ ID NO: 2547261 - DNA, 14 bp, Homo sapiens
aatctgtaaactgt

SEQ ID NO: 2547262 - DNA, 13 bp, Homo sapiens
aatctgtacaatg

SEQ ID NO: 2547263 - DNA, 19 bp, Homo sapiens
aatctgtagggctggacct

SEQ ID NO: 2547264 - DNA, 22 bp, Homo sapiens
aatctgtcacgtagaacttgga

SEQ ID NO: 2547265 - DNA, 13 bp, Homo sapiens
aatcttgaaaatg

SEQ ID NO: 2547266 - DNA, 22 bp, Homo sapiens
aatcttgactacagtcaggaaa

SEQ ID NO: 2547267 - DNA, 22 bp, Homo sapiens
aatctttctttacctgagacca

SEQ ID NO: 2547268 - DNA, 14 bp, Homo sapiens
aatcttttcacaaa

SEQ ID NO: 2547269 - DNA, 18 bp, Homo sapiens
aatcttttcacaaataaa

SEQ ID NO: 2547270 - DNA, 14 bp, Homo sapiens
aatgaaaaaatgta

SEQ ID NO: 2547271 - DNA, 19 bp, Homo sapiens
aatgaaaaatttaagcatt

SEQ ID NO: 2547272 - DNA, 16 bp, Homo sapiens
aatgaaaatgtcttgt

SEQ ID NO: 2547273 - DNA, 20 bp, Homo sapiens
aatgaaaattgtatgttaag

SEQ ID NO: 2547274 - DNA, 17 bp, Homo sapiens
aatgaaacaccttctct

SEQ ID NO: 2547275 - DNA, 20 bp, Homo sapiens
aatgaaacaccttctctgga

SEQ ID NO: 2547276 - DNA, 19 bp, Homo sapiens
aatgaaacccccacacaca

SEQ ID NO: 2547277 - DNA, 21 bp, Homo sapiens
aatgaaataatgtacatctgg

SEQ ID NO: 2547278 - DNA, 23 bp, Homo sapiens
aatgaaattactacaaaatttga

SEQ ID NO: 2547279 - DNA, 14 bp, Homo sapiens
aatgaaattgtaaa

SEQ ID NO: 2547280 - DNA, 11 bp, Homo sapiens
aatgaactgaa

SEQ ID NO: 2547281 - DNA, 11 bp, Homo sapiens
aatgaagaaag

SEQ ID NO: 2547282 - DNA, 19 bp, Homo sapiens
aatgaagcagctttaaaca

SEQ ID NO: 2547283 - DNA, 15 bp, Homo sapiens
aatgaagccttagcc

SEQ ID NO: 2547284 - DNA, 16 bp, Homo sapiens
aatgaagtctctgaag

SEQ ID NO: 2547285 - DNA, 23 bp, Homo sapiens
aatgaagtctctgaagtgaaact

SEQ ID NO: 2547286 - DNA, 16 bp, Homo sapiens
aatgaataatttccca

SEQ ID NO: 2547287 - DNA, 14 bp, Homo sapiens
aatgaatgaaacat

SEQ ID NO: 2547288 - DNA, 22 bp, Homo sapiens
aatgacatctcaggggccagag

SEQ ID NO: 2547289 - DNA, 18 bp, Homo sapiens
aatgacatttatatcaca

SEQ ID NO: 2547290 - DNA, 16 bp, Homo sapiens
aatgacccaaagacca

SEQ ID NO: 2547291 - DNA, 17 bp, Homo sapiens
aatgactaaaaaacaaa

SEQ ID NO: 2547292 - DNA, 17 bp, Homo sapiens
aatgactaaaaatatta

SEQ ID NO: 2547293 - DNA, 17 bp, Homo sapiens
aatgacttactgtacat

SEQ ID NO: 2547294 - DNA, 18 bp, Homo sapiens
aatgacttactgtacatg

SEQ ID NO: 2547295 - DNA, 15 bp, Homo sapiens
aatgagaaggcagcc

SEQ ID NO: 2547296 - DNA, 16 bp, Homo sapiens
aatgagacttgctctc

SEQ ID NO: 2547297 - DNA, 23 bp, Homo sapiens
aatgagagaataagtcatgttcc

SEQ ID NO: 2547298 - DNA, 16 bp, Homo sapiens
aatgagatagtagcat

SEQ ID NO: 2547299 - DNA, 16 bp, Homo sapiens
aatgagatcaggctct

SEQ ID NO: 2547300 - DNA, 16 bp, Homo sapiens
aatgagctatgtatta

SEQ ID NO: 2547301 - DNA, 13 bp, Homo sapiens
aatgaggcttgct

SEQ ID NO: 2547302 - DNA, 18 bp, Homo sapiens
aatgaggcttgctgagag

SEQ ID NO: 2547303 - DNA, 21 bp, Homo sapiens
aatgagggactggaaccaggg

SEQ ID NO: 2547304 - DNA, 14 bp, Homo sapiens
aatgagggccaaga

SEQ ID NO: 2547305 - DNA, 18 bp, Homo sapiens
aatgaggtcagagcctgc

SEQ ID NO: 2547306 - DNA, 15 bp, Homo sapiens
aatgaggtcagcatg

SEQ ID NO: 2547307 - DNA, 15 bp, Homo sapiens
aatgaggtcccaggc

SEQ ID NO: 2547308 - DNA, 16 bp, Homo sapiens
aatgaggtcccaggca

SEQ ID NO: 2547309 - DNA, 18 bp, Homo sapiens
aatgataccctgaatttg

SEQ ID NO: 2547310 - DNA, 19 bp, Homo sapiens
aatgatccccagctgttta

SEQ ID NO: 2547311 - DNA, 14 bp, Homo sapiens
aatgatctaggttt

SEQ ID NO: 2547312 - DNA, 17 bp, Homo sapiens
aatgatctaggtttaac

SEQ ID NO: 2547313 - DNA, 22 bp, Homo sapiens
aatgatctctctgaatcctaag

SEQ ID NO: 2547314 - DNA, 16 bp, Homo sapiens
aatgatctcttctttt

SEQ ID NO: 2547315 - DNA, 21 bp, Homo sapiens
aatgatgatgtggaagaactt

SEQ ID NO: 2547316 - DNA, 14 bp, Homo sapiens
aatgatggcaattt

SEQ ID NO: 2547317 - DNA, 17 bp, Homo sapiens
aatgatggcaattttgt

SEQ ID NO: 2547318 - DNA, 18 bp, Homo sapiens
aatgatggcaattttgta

SEQ ID NO: 2547319 - DNA, 15 bp, Homo sapiens
aatgatgtccagaag

SEQ ID NO: 2547320 - DNA, 13 bp, Homo sapiens
aatgattgtaaaa

SEQ ID NO: 2547321 - DNA, 14 bp, Homo sapiens
aatgattgtaaaat

SEQ ID NO: 2547322 - DNA, 19 bp, Homo sapiens
aatgattttatctgtgaat

SEQ ID NO: 2547323 - DNA, 17 bp, Homo sapiens
aatgcaagctagtggct

SEQ ID NO: 2547324 - DNA, 22 bp, Homo sapiens
aatgcactttctatcctctgta

SEQ ID NO: 2547325 - DNA, 20 bp, Homo sapiens
aatgcactttgttctggctc

SEQ ID NO: 2547326 - DNA, 21 bp, Homo sapiens
aatgcactttgttctggctct

SEQ ID NO: 2547327 - DNA, 17 bp, Homo sapiens
aatgcagtgaattgtga

SEQ ID NO: 2547328 - DNA, 19 bp, Homo sapiens
aatgcatatcctgagccat

SEQ ID NO: 2547329 - DNA, 18 bp, Homo sapiens
aatgcattgtatcgatgt

SEQ ID NO: 2547330 - DNA, 22 bp, Homo sapiens
aatgccagagacggaagccttt

SEQ ID NO: 2547331 - DNA, 21 bp, Homo sapiens
aatgccatcctcaaacactgc

SEQ ID NO: 2547332 - DNA, 22 bp, Homo sapiens
aatgccatcctcaaacactgca

SEQ ID NO: 2547333 - DNA, 21 bp, Homo sapiens
aatgccatggacagaagaagg

SEQ ID NO: 2547334 - DNA, 14 bp, Homo sapiens
aatgcccagcccct

SEQ ID NO: 2547335 - DNA, 22 bp, Homo sapiens
aatgcccagccccttctgaccc

SEQ ID NO: 2547336 - DNA, 15 bp, Homo sapiens
aatgcccccagctgg

SEQ ID NO: 2547337 - DNA, 17 bp, Homo sapiens
aatgcccccagctggcc

SEQ ID NO: 2547338 - DNA, 14 bp, Homo sapiens
aatgcctcctccct

SEQ ID NO: 2547339 - DNA, 15 bp, Homo sapiens
aatgcctcctccctg

SEQ ID NO: 2547340 - DNA, 19 bp, Homo sapiens
aatgcctgagtgcctggcc

SEQ ID NO: 2547341 - DNA, 23 bp, Homo sapiens
aatgccttaccctcatgttctta

SEQ ID NO: 2547342 - DNA, 17 bp, Homo sapiens
aatgcctttgagacagt

SEQ ID NO: 2547343 - DNA, 16 bp, Homo sapiens
aatgctacgtgtgatt

SEQ ID NO: 2547344 - DNA, 17 bp, Homo sapiens
aatgctacgtgtgattt

SEQ ID NO: 2547345 - DNA, 19 bp, Homo sapiens
aatgctacgtgtgattttt

SEQ ID NO: 2547346 - DNA, 23 bp, Homo sapiens
aatgctacgtgtgatttttctgg

SEQ ID NO: 2547347 - DNA, 20 bp, Homo sapiens
aatgctcccccatcctcccc

SEQ ID NO: 2547348 - DNA, 14 bp, Homo sapiens
aatgctctcctttc

SEQ ID NO: 2547349 - DNA, 15 bp, Homo sapiens
aatgctgcctgcctg

SEQ ID NO: 2547350 - DNA, 18 bp, Homo sapiens
aatgctgcctgcctgtct

SEQ ID NO: 2547351 - DNA, 21 bp, Homo sapiens
aatgctggctgttggctgggg

SEQ ID NO: 2547352 - DNA, 12 bp, Homo sapiens
aatgctgggctg

SEQ ID NO: 2547353 - DNA, 15 bp, Homo sapiens
aatgtttctgcagta

SEQ ID NO: 2547354 - DNA, 23 bp, Homo sapiens
aatgtttcttctaggttctaaaa

SEQ ID NO: 2547355 - DNA, 19 bp, Homo sapiens
aatgtttgcctctgcctct

SEQ ID NO: 2547356 - DNA, 17 bp, Homo sapiens
aatgttttatactgttt

SEQ ID NO: 2547357 - DNA, 21 bp, Homo sapiens
aatgtttttctgccagggagc

SEQ ID NO: 2547358 - DNA, 20 bp, Homo sapiens
aattaaaaaaaaaaaacttt

SEQ ID NO: 2547359 - DNA, 18 bp, Homo sapiens
aattaaaagttgaatttt

SEQ ID NO: 2547360 - DNA, 15 bp, Homo sapiens
aattaaacggattat

SEQ ID NO: 2547361 - DNA, 14 bp, Homo sapiens
aattaaattaggaa

SEQ ID NO: 2547362 - DNA, 15 bp, Homo sapiens
aattaacctggtgct

SEQ ID NO: 2547363 - DNA, 18 bp, Homo sapiens
aattaacctggtgctgga

SEQ ID NO: 2547364 - DNA, 13 bp, Homo sapiens
aattaacttttat

SEQ ID NO: 2547365 - DNA, 12 bp, Homo sapiens
aattaagaagaa

SEQ ID NO: 2547366 - DNA, 16 bp, Homo sapiens
aattaagaagaaacta

SEQ ID NO: 2547367 - DNA, 14 bp, Homo sapiens
aattaatagctttt

SEQ ID NO: 2547368 - DNA, 21 bp, Homo sapiens
aattaccttagattagctctg

SEQ ID NO: 2547369 - DNA, 16 bp, Homo sapiens
aattactacaaaattt

SEQ ID NO: 2547370 - DNA, 14 bp, Homo sapiens
aattactggtccaa

SEQ ID NO: 2547371 - DNA, 12 bp, Homo sapiens
aattagcaattg

SEQ ID NO: 2547372 - DNA, 15 bp, Homo sapiens
aattagccaagtgtg

SEQ ID NO: 2547373 - DNA, 21 bp, Homo sapiens
aattatataggttgtgcaaat

SEQ ID NO: 2547374 - DNA, 20 bp, Homo sapiens
aattatcgggaacagtgttt

SEQ ID NO: 2547375 - DNA, 12 bp, Homo sapiens
aattatgacagt

SEQ ID NO: 2547376 - DNA, 17 bp, Homo sapiens
aattatgccttttttga

SEQ ID NO: 2547377 - DNA, 15 bp, Homo sapiens
aattatgtatgttta

SEQ ID NO: 2547378 - DNA, 16 bp, Homo sapiens
aattatgtatgtttac

SEQ ID NO: 2547379 - DNA, 18 bp, Homo sapiens
aattatgtatgtttacat

SEQ ID NO: 2547380 - DNA, 17 bp, Homo sapiens
aattattaatgaaaata

SEQ ID NO: 2547381 - DNA, 21 bp, Homo sapiens
aattattattcttcataacaa

SEQ ID NO: 2547382 - DNA, 11 bp, Homo sapiens
aattattattt

SEQ ID NO: 2547383 - DNA, 21 bp, Homo sapiens
aattattatttatatatgtat

SEQ ID NO: 2547384 - DNA, 22 bp, Homo sapiens
aattattatttatatatgtatt

SEQ ID NO: 2547385 - DNA, 21 bp, Homo sapiens
aattattgtacatttatagtt

SEQ ID NO: 2547386 - DNA, 12 bp, Homo sapiens
aattatttcaga

SEQ ID NO: 2547387 - DNA, 14 bp, Homo sapiens
aattatttgtgtaa

SEQ ID NO: 2547388 - DNA, 15 bp, Homo sapiens
aattatttgtgtaat

SEQ ID NO: 2547389 - DNA, 21 bp, Homo sapiens
aattatttgtgtaatagaaaa

SEQ ID NO: 2547390 - DNA, 18 bp, Homo sapiens
aattattttaaacaaaat

SEQ ID NO: 2547391 - DNA, 11 bp, Homo sapiens
aattattttgg

SEQ ID NO: 2547392 - DNA, 20 bp, Homo sapiens
aattattttggtacttttat

SEQ ID NO: 2547393 - DNA, 16 bp, Homo sapiens
aatttgggagatatat

SEQ ID NO: 2547394 - DNA, 22 bp, Homo sapiens
aatttgtaaaaacagcattgct

SEQ ID NO: 2547395 - DNA, 15 bp, Homo sapiens
aatttgtaacctcag

SEQ ID NO: 2547396 - DNA, 18 bp, Homo sapiens
aatttgtaagtttcaggt

SEQ ID NO: 2547397 - DNA, 16 bp, Homo sapiens
aatttgtcttgcctta

SEQ ID NO: 2547398 - DNA, 17 bp, Homo sapiens
aatttgtgatacaatgc

SEQ ID NO: 2547399 - DNA, 16 bp, Homo sapiens
aatttgttataatgaa

SEQ ID NO: 2547400 - DNA, 12 bp, Homo sapiens
aatttgttgcat

SEQ ID NO: 2547401 - DNA, 21 bp, Homo sapiens
aattttaaaaatgaatcctac

SEQ ID NO: 2547402 - DNA, 14 bp, Homo sapiens
aattttaaacaaag

SEQ ID NO: 2547403 - DNA, 19 bp, Homo sapiens
aattttaagtgctttgtaa

SEQ ID NO: 2547404 - DNA, 16 bp, Homo sapiens
aattttaatgaagaaa

SEQ ID NO: 2547405 - DNA, 17 bp, Homo sapiens
aattttaccctttagac

SEQ ID NO: 2547406 - DNA, 20 bp, Homo sapiens
aattttatagctcagtttat

SEQ ID NO: 2547407 - DNA, 19 bp, Homo sapiens
aattttcacacacgtgaga

SEQ ID NO: 2547408 - DNA, 20 bp, Homo sapiens
aattttcagtataatttaac

SEQ ID NO: 2547409 - DNA, 15 bp, Homo sapiens
aattttctagacttt

SEQ ID NO: 2547410 - DNA, 19 bp, Homo sapiens
aattttgacactatatctg

SEQ ID NO: 2547411 - DNA, 17 bp, Homo sapiens
aattttggccaaagtgt

SEQ ID NO: 2547412 - DNA, 16 bp, Homo sapiens
aattttggttgtattc

SEQ ID NO: 2547413 - DNA, 23 bp, Homo sapiens
aattttggttgtattctttgatg

SEQ ID NO: 2547414 - DNA, 13 bp, Homo sapiens
aattttgtacaaa

SEQ ID NO: 2547415 - DNA, 22 bp, Homo sapiens
aatttttctctaactcagaaac

SEQ ID NO: 2547416 - DNA, 21 bp, Homo sapiens
aatttttcttatttcatttct

SEQ ID NO: 2547417 - DNA, 17 bp, Homo sapiens
aatttttgccttcatta

SEQ ID NO: 2547418 - DNA, 16 bp, Homo sapiens
aatttttggttgaata

SEQ ID NO: 2547419 - DNA, 18 bp, Homo sapiens
aatttttttaattttgta

SEQ ID NO: 2547420 - DNA, 15 bp, Homo sapiens
aatttttttcaatat

SEQ ID NO: 2547421 - DNA, 18 bp, Homo sapiens
acaggatgacctggataa

SEQ ID NO: 2547422 - DNA, 16 bp, Homo sapiens
acaggcaagcacctcc

SEQ ID NO: 2547423 - DNA, 19 bp, Homo sapiens
acaggcaagcacctcctgc

SEQ ID NO: 2547424 - DNA, 15 bp, Homo sapiens
acaggcaatgctggc

SEQ ID NO: 2547425 - DNA, 18 bp, Homo sapiens
acaggcaatgctggctgt

SEQ ID NO: 2547426 - DNA, 23 bp, Homo sapiens
acaggcacccaccatcatgtctg

SEQ ID NO: 2547427 - DNA, 17 bp, Homo sapiens
acaggcagcacagagac

SEQ ID NO: 2547428 - DNA, 13 bp, Homo sapiens
acaggcagcagag

SEQ ID NO: 2547429 - DNA, 20 bp, Homo sapiens
acaggcagctttaaccatta

SEQ ID NO: 2547430 - DNA, 16 bp, Homo sapiens
acaggcaggtccaggg

SEQ ID NO: 2547431 - DNA, 18 bp, Homo sapiens
acaggcatgttctctgag

SEQ ID NO: 2547432 - DNA, 20 bp, Homo sapiens
acaggcatgttctctgagga

SEQ ID NO: 2547433 - DNA, 18 bp, Homo sapiens
acaggcccaagagatgaa

SEQ ID NO: 2547434 - DNA, 13 bp, Homo sapiens
acaggcccagcat

SEQ ID NO: 2547435 - DNA, 12 bp, Homo sapiens
acaggccccctt

SEQ ID NO: 2547436 - DNA, 20 bp, Homo sapiens
acaggcccggctccaggctc

SEQ ID NO: 2547437 - DNA, 22 bp, Homo sapiens
acaggcccggctccaggctcct

SEQ ID NO: 2547438 - DNA, 22 bp, Homo sapiens
acaggctgggcttcagtggcag

SEQ ID NO: 2547439 - DNA, 23 bp, Homo sapiens
acaggctgggcttcagtggcagc

SEQ ID NO: 2547440 - DNA, 14 bp, Homo sapiens
acagggaagctaca

SEQ ID NO: 2547441 - DNA, 12 bp, Homo sapiens
acagggacccac

SEQ ID NO: 2547442 - DNA, 16 bp, Homo sapiens
acagggagctgggaca

SEQ ID NO: 2547443 - DNA, 10 bp, Homo sapiens
acagggaggg

SEQ ID NO: 2547444 - DNA, 13 bp, Homo sapiens
acagggatgagca

SEQ ID NO: 2547445 - DNA, 14 bp, Homo sapiens
acagggctggccca

SEQ ID NO: 2547446 - DNA, 15 bp, Homo sapiens
acagggctggcccag

SEQ ID NO: 2547447 - DNA, 16 bp, Homo sapiens
acagggctggcccagc

SEQ ID NO: 2547448 - DNA, 19 bp, Homo sapiens
acagggctggcccagccct

SEQ ID NO: 2547449 - DNA, 21 bp, Homo sapiens
acagggtctctagtgctgtga

SEQ ID NO: 2547450 - DNA, 19 bp, Homo sapiens
acagggttttgccatgttg

SEQ ID NO: 2547451 - DNA, 18 bp, Homo sapiens
acaggtaaactatcttgg

SEQ ID NO: 2547452 - DNA, 19 bp, Homo sapiens
acaggtaacgtctgtaagc

SEQ ID NO: 2547453 - DNA, 19 bp, Homo sapiens
acaggtctcctcttaaaaa

SEQ ID NO: 2547454 - DNA, 15 bp, Homo sapiens
acaggtggcaggacc

SEQ ID NO: 2547455 - DNA, 19 bp, Homo sapiens
acaggtggcaggaccagga

SEQ ID NO: 2547456 - DNA, 13 bp, Homo sapiens
acaggttacaaca

SEQ ID NO: 2547457 - DNA, 14 bp, Homo sapiens
acaggttattttag

SEQ ID NO: 2547458 - DNA, 22 bp, Homo sapiens
acaggttattttagtttctgtt

SEQ ID NO: 2547459 - DNA, 15 bp, Homo sapiens
acagtaactttatgt

SEQ ID NO: 2547460 - DNA, 14 bp, Homo sapiens
acagtacaggcagc

SEQ ID NO: 2547461 - DNA, 18 bp, Homo sapiens
acagtacaggcagcacag

SEQ ID NO: 2547462 - DNA, 20 bp, Homo sapiens
acagtacaggcagcacagag

SEQ ID NO: 2547463 - DNA, 19 bp, Homo sapiens
acagtatgagtcaatgtgc

SEQ ID NO: 2547464 - DNA, 21 bp, Homo sapiens
acagtatgagtcaatgtgcag

SEQ ID NO: 2547465 - DNA, 23 bp, Homo sapiens
acagtatgagtcaatgtgcagtg

SEQ ID NO: 2547466 - DNA, 16 bp, Homo sapiens
acagtattacttctgc

SEQ ID NO: 2547467 - DNA, 17 bp, Homo sapiens
acagtcaaaacagagat

SEQ ID NO: 2547468 - DNA, 13 bp, Homo sapiens
acagtcatttaaa

SEQ ID NO: 2547469 - DNA, 17 bp, Homo sapiens
acagtccctaaagaaaa

SEQ ID NO: 2547470 - DNA, 15 bp, Homo sapiens
acagtccctgccaat

SEQ ID NO: 2547471 - DNA, 18 bp, Homo sapiens
acagtcctaactggtata

SEQ ID NO: 2547472 - DNA, 19 bp, Homo sapiens
acagtcctaactggtatag

SEQ ID NO: 2547473 - DNA, 15 bp, Homo sapiens
acagtcctcccatct

SEQ ID NO: 2547474 - DNA, 12 bp, Homo sapiens
acagtcctggga

SEQ ID NO: 2547475 - DNA, 21 bp, Homo sapiens
acagtccttaccagcagagca

SEQ ID NO: 2547476 - DNA, 15 bp, Homo sapiens
acagtctcaggaaat

SEQ ID NO: 2547477 - DNA, 14 bp, Homo sapiens
acagtctctttaat

SEQ ID NO: 2547478 - DNA, 19 bp, Homo sapiens
acagtctgatcgtgacgct

SEQ ID NO: 2547479 - DNA, 14 bp, Homo sapiens
acagtgaaaatgta

SEQ ID NO: 2547480 - DNA, 17 bp, Homo sapiens
acagtgaaggctgtcct

SEQ ID NO: 2547481 - DNA, 15 bp, Homo sapiens
acagtgatctccata

SEQ ID NO: 2547482 - DNA, 18 bp, Homo sapiens
acagtgatctccatatgt

SEQ ID NO: 2547483 - DNA, 21 bp, Homo sapiens
acagtgattaccagggactga

SEQ ID NO: 2547484 - DNA, 10 bp, Homo sapiens
acagtgattt

SEQ ID NO: 2547485 - DNA, 21 bp, Homo sapiens
acagtgcatattcctttctat

SEQ ID NO: 2547486 - DNA, 14 bp, Homo sapiens
acagtgctaaaaat

SEQ ID NO: 2547487 - DNA, 12 bp, Homo sapiens
acagtgggaaat

SEQ ID NO: 2547488 - DNA, 15 bp, Homo sapiens
acagtgggtggtgga

SEQ ID NO: 2547489 - DNA, 17 bp, Homo sapiens
acagtggtggcagggcc

SEQ ID NO: 2547490 - DNA, 23 bp, Homo sapiens
acagtggtggcagggcctagctg

SEQ ID NO: 2547491 - DNA, 17 bp, Homo sapiens
acagtgtacagtcttgt

SEQ ID NO: 2547492 - DNA, 24 bp, Homo sapiens
acagtgtctgtatcggagacagtg

SEQ ID NO: 2547493 - DNA, 18 bp, Homo sapiens
acagtgtttttgtaaagt

SEQ ID NO: 2547494 - DNA, 13 bp, Homo sapiens
acagttaactttc

SEQ ID NO: 2547495 - DNA, 12 bp, Homo sapiens
acagttcaagaa

SEQ ID NO: 2547496 - DNA, 20 bp, Homo sapiens
acagttcaattctcatttgt

SEQ ID NO: 2547497 - DNA, 23 bp, Homo sapiens
acagttcagtggcagggctcagg

SEQ ID NO: 2547498 - DNA, 13 bp, Homo sapiens
acagttccttcag

SEQ ID NO: 2547499 - DNA, 15 bp, Homo sapiens
acagttctgaagaat

SEQ ID NO: 2547500 - DNA, 15 bp, Homo sapiens
acagttcttcgggaa

SEQ ID NO: 2547501 - DNA, 19 bp, Homo sapiens
acagttcttcgggaagaga

SEQ ID NO: 2547502 - DNA, 20 bp, Homo sapiens
acagttcttcgggaagagag

SEQ ID NO: 2547503 - DNA, 16 bp, Homo sapiens
acagttgaaaaacagc

SEQ ID NO: 2547504 - DNA, 15 bp, Homo sapiens
acagttgtttgatgc

SEQ ID NO: 2547505 - DNA, 12 bp, Homo sapiens
acagtttcttag

SEQ ID NO: 2547506 - DNA, 14 bp, Homo sapiens
acagtttcttagct

SEQ ID NO: 2547507 - DNA, 19 bp, Homo sapiens
acagtttcttttttcttac

SEQ ID NO: 2547508 - DNA, 13 bp, Homo sapiens
acagtttgctgta

SEQ ID NO: 2547509 - DNA, 14 bp, Homo sapiens
acagtttgtcacat

SEQ ID NO: 2547510 - DNA, 12 bp, Homo sapiens
acagttttccat

SEQ ID NO: 2547511 - DNA, 18 bp, Homo sapiens
acagttttccatgaaaac

SEQ ID NO: 2547512 - DNA, 23 bp, Homo sapiens
acagttttccatgaaaacgtttt

SEQ ID NO: 2547513 - DNA, 16 bp, Homo sapiens
acagttttctgagaaa

SEQ ID NO: 2547514 - DNA, 17 bp, Homo sapiens
acagttttctgagaaag

SEQ ID NO: 2547515 - DNA, 18 bp, Homo sapiens
acagttttctgagaaaga

SEQ ID NO: 2547516 - DNA, 21 bp, Homo sapiens
acagttttctgagaaagacta

SEQ ID NO: 2547517 - DNA, 18 bp, Homo sapiens
acagttttggttgcttta

SEQ ID NO: 2547518 - DNA, 24 bp, Homo sapiens
acagttttggttgctttaatatca

SEQ ID NO: 2547519 - DNA, 13 bp, Homo sapiens
acataaattagag

SEQ ID NO: 2547520 - DNA, 16 bp, Homo sapiens
acataacgtttttcct

SEQ ID NO: 2547521 - DNA, 18 bp, Homo sapiens
acataacgtttttccttt

SEQ ID NO: 2547522 - DNA, 20 bp, Homo sapiens
acataacgtttttcctttaa

SEQ ID NO: 2547523 - DNA, 22 bp, Homo sapiens
acataacgtttttcctttaaaa

SEQ ID NO: 2547524 - DNA, 15 bp, Homo sapiens
acataagataaatgt

SEQ ID NO: 2547525 - DNA, 20 bp, Homo sapiens
acataatgtattgttggtaa

SEQ ID NO: 2547526 - DNA, 21 bp, Homo sapiens
acataattttttttttttaac

SEQ ID NO: 2547527 - DNA, 22 bp, Homo sapiens
acatacaattatttttacagtt

SEQ ID NO: 2547528 - DNA, 15 bp, Homo sapiens
acataccagcttaga

SEQ ID NO: 2547529 - DNA, 21 bp, Homo sapiens
acataccctggccgccccctg

SEQ ID NO: 2547530 - DNA, 13 bp, Homo sapiens
acatactcccatc

SEQ ID NO: 2547531 - DNA, 17 bp, Homo sapiens
acatactcccatctgtg

SEQ ID NO: 2547532 - DNA, 24 bp, Homo sapiens
acatactccttccatcaaatagaa

SEQ ID NO: 2547533 - DNA, 12 bp, Homo sapiens
acatacttcagc

SEQ ID NO: 2547534 - DNA, 23 bp, Homo sapiens
acatactttcatcctgactctgc

SEQ ID NO: 2547535 - DNA, 18 bp, Homo sapiens
acatagaattaacacatg

SEQ ID NO: 2547536 - DNA, 13 bp, Homo sapiens
acatagatgtccc

SEQ ID NO: 2547537 - DNA, 13 bp, Homo sapiens
acatagcctatat

SEQ ID NO: 2547538 - DNA, 16 bp, Homo sapiens
acatagcctatattta

SEQ ID NO: 2547539 - DNA, 15 bp, Homo sapiens
acatagttatttatt

SEQ ID NO: 2547540 - DNA, 23 bp, Homo sapiens
acatataatgttgttatttaaag

SEQ ID NO: 2547541 - DNA, 15 bp, Homo sapiens
acatatgaaaataca

SEQ ID NO: 2547542 - DNA, 16 bp, Homo sapiens
acatatgcaccttgtg

SEQ ID NO: 2547543 - DNA, 17 bp, Homo sapiens
acatatgcaccttgtgt

SEQ ID NO: 2547544 - DNA, 20 bp, Homo sapiens
acatatgcaccttgtgtctg

SEQ ID NO: 2547545 - DNA, 14 bp, Homo sapiens
acatatgtaaaata

SEQ ID NO: 2547546 - DNA, 18 bp, Homo sapiens
acatattaggaaaatatg

SEQ ID NO: 2547547 - DNA, 20 bp, Homo sapiens
acatattcatttggaaataa

SEQ ID NO: 2547548 - DNA, 14 bp, Homo sapiens
acatattgatttcc

SEQ ID NO: 2547549 - DNA, 18 bp, Homo sapiens
acatattttatagaactt

SEQ ID NO: 2547550 - DNA, 13 bp, Homo sapiens
acatcaacagata

SEQ ID NO: 2547551 - DNA, 14 bp, Homo sapiens
acatcaagcacaga

SEQ ID NO: 2547552 - DNA, 18 bp, Homo sapiens
acatcaagcacagaagga

SEQ ID NO: 2547553 - DNA, 18 bp, Homo sapiens
acatcaatattgtcattc

SEQ ID NO: 2547554 - DNA, 23 bp, Homo sapiens
acatcaatattgtcattcctgta

SEQ ID NO: 2547555 - DNA, 14 bp, Homo sapiens
acatcaatgttcat

SEQ ID NO: 2547556 - DNA, 17 bp, Homo sapiens
acatcaatgttcattgt

SEQ ID NO: 2547557 - DNA, 20 bp, Homo sapiens
acatcaatgttcattgtaat

SEQ ID NO: 2547558 - DNA, 13 bp, Homo sapiens
acatcacaggaca

SEQ ID NO: 2547559 - DNA, 19 bp, Homo sapiens
acatcactctgctgcttag

SEQ ID NO: 2547560 - DNA, 16 bp, Homo sapiens
acatcacttgtacaaa

SEQ ID NO: 2547561 - DNA, 17 bp, Homo sapiens
acatcagcacgatttct

SEQ ID NO: 2547562 - DNA, 12 bp, Homo sapiens
acccttcttttc

SEQ ID NO: 2547563 - DNA, 17 bp, Homo sapiens
acccttgccgtctacct

SEQ ID NO: 2547564 - DNA, 12 bp, Homo sapiens
acccttggcctg

SEQ ID NO: 2547565 - DNA, 13 bp, Homo sapiens
acccttggcctgt

SEQ ID NO: 2547566 - DNA, 17 bp, Homo sapiens
acccttggctcaatcct

SEQ ID NO: 2547567 - DNA, 19 bp, Homo sapiens
acccttgtggtcccacccc

SEQ ID NO: 2547568 - DNA, 20 bp, Homo sapiens
accctttagccaaacccttg

SEQ ID NO: 2547569 - DNA, 12 bp, Homo sapiens
accctttgcccc

SEQ ID NO: 2547570 - DNA, 14 bp, Homo sapiens
acccttttggcccc

SEQ ID NO: 2547571 - DNA, 21 bp, Homo sapiens
accgaagtggactggcccctg

SEQ ID NO: 2547572 - DNA, 19 bp, Homo sapiens
accgagcaaagatcaaaat

SEQ ID NO: 2547573 - DNA, 21 bp, Homo sapiens
accgagtgaacctaccttcat

SEQ ID NO: 2547574 - DNA, 23 bp, Homo sapiens
accgcagaagcctccccagctca

SEQ ID NO: 2547575 - DNA, 16 bp, Homo sapiens
accgcagacaggacca

SEQ ID NO: 2547576 - DNA, 20 bp, Homo sapiens
accgcagacaggaccaggga

SEQ ID NO: 2547577 - DNA, 14 bp, Homo sapiens
accgcaggaagctg

SEQ ID NO: 2547578 - DNA, 21 bp, Homo sapiens
accgccacacacacaggagca

SEQ ID NO: 2547579 - DNA, 14 bp, Homo sapiens
accgccccctcctc

SEQ ID NO: 2547580 - DNA, 19 bp, Homo sapiens
accgccccctcctctagct

SEQ ID NO: 2547581 - DNA, 15 bp, Homo sapiens
accgcgtctggtgac

SEQ ID NO: 2547582 - DNA, 15 bp, Homo sapiens
accgctccccagccc

SEQ ID NO: 2547583 - DNA, 22 bp, Homo sapiens
accgcttccggctcctgtgctt

SEQ ID NO: 2547584 - DNA, 16 bp, Homo sapiens
accggatcctgggtgg

SEQ ID NO: 2547585 - DNA, 14 bp, Homo sapiens
accggatggcggac

SEQ ID NO: 2547586 - DNA, 17 bp, Homo sapiens
accggctggcctggccc

SEQ ID NO: 2547587 - DNA, 12 bp, Homo sapiens
accgggcactca

SEQ ID NO: 2547588 - DNA, 14 bp, Homo sapiens
accgggcactcaga

SEQ ID NO: 2547589 - DNA, 19 bp, Homo sapiens
accgggccacagagaaagt

SEQ ID NO: 2547590 - DNA, 20 bp, Homo sapiens
accgggccacagagaaagta

SEQ ID NO: 2547591 - DNA, 22 bp, Homo sapiens
accgtcatggcttaatgtttat

SEQ ID NO: 2547592 - DNA, 15 bp, Homo sapiens
accgtccgccctgct

SEQ ID NO: 2547593 - DNA, 14 bp, Homo sapiens
accgtgggctccct

SEQ ID NO: 2547594 - DNA, 16 bp, Homo sapiens
accgtgggctccctga

SEQ ID NO: 2547595 - DNA, 22 bp, Homo sapiens
acctaaaatttgccctcccatc

SEQ ID NO: 2547596 - DNA, 15 bp, Homo sapiens
acctaagggacatgt

SEQ ID NO: 2547597 - DNA, 20 bp, Homo sapiens
acctaagtttcagttgattt

SEQ ID NO: 2547598 - DNA, 16 bp, Homo sapiens
acctaatcaggctgag

SEQ ID NO: 2547599 - DNA, 17 bp, Homo sapiens
acctaatcaggctgagg

SEQ ID NO: 2547600 - DNA, 11 bp, Homo sapiens
acctaatccaa

SEQ ID NO: 2547601 - DNA, 19 bp, Homo sapiens
acctaatgtttatgagcca

SEQ ID NO: 2547602 - DNA, 20 bp, Homo sapiens
acctaatgtttatgagccag

SEQ ID NO: 2547603 - DNA, 14 bp, Homo sapiens
acctacatgtattt

SEQ ID NO: 2547604 - DNA, 15 bp, Homo sapiens
acctacatgtatttg

SEQ ID NO: 2547605 - DNA, 17 bp, Homo sapiens
acctaccacagtgtctg

SEQ ID NO: 2547606 - DNA, 15 bp, Homo sapiens
acctaccacatgcca

SEQ ID NO: 2547607 - DNA, 19 bp, Homo sapiens
acctaccaccccttcctgt

SEQ ID NO: 2547608 - DNA, 21 bp, Homo sapiens
acctaccaccccttcctgtcc

SEQ ID NO: 2547609 - DNA, 12 bp, Homo sapiens
acctacctcagg

SEQ ID NO: 2547610 - DNA, 15 bp, Homo sapiens
acctacctcaggttg

SEQ ID NO: 2547611 - DNA, 18 bp, Homo sapiens
acctaccttcatttcagg

SEQ ID NO: 2547612 - DNA, 20 bp, Homo sapiens
acctagagacttcacccggg

SEQ ID NO: 2547613 - DNA, 17 bp, Homo sapiens
acctaggatatcttctc

SEQ ID NO: 2547614 - DNA, 24 bp, Homo sapiens
acctagggaggaccttatctgtgc

SEQ ID NO: 2547615 - DNA, 15 bp, Homo sapiens
acctataaaacaggt

SEQ ID NO: 2547616 - DNA, 22 bp, Homo sapiens
acctatgtcctaaggacacact

SEQ ID NO: 2547617 - DNA, 23 bp, Homo sapiens
acctatgtcctaaggacacacta

SEQ ID NO: 2547618 - DNA, 16 bp, Homo sapiens
acctcaaccaatgcca

SEQ ID NO: 2547619 - DNA, 19 bp, Homo sapiens
acctcaacccccatttcta

SEQ ID NO: 2547620 - DNA, 16 bp, Homo sapiens
acctcaacctgtgatg

SEQ ID NO: 2547621 - DNA, 16 bp, Homo sapiens
acctcaactgcctact

SEQ ID NO: 2547622 - DNA, 15 bp, Homo sapiens
acctcaagggggact

SEQ ID NO: 2547623 - DNA, 21 bp, Homo sapiens
acctcaagggggactgtcttt

SEQ ID NO: 2547624 - DNA, 19 bp, Homo sapiens
acctcaagtttttgttttg

SEQ ID NO: 2547625 - DNA, 20 bp, Homo sapiens
acctcactgaaaacatctgg

SEQ ID NO: 2547626 - DNA, 23 bp, Homo sapiens
acctcactggggtcctggggcct

SEQ ID NO: 2547627 - DNA, 18 bp, Homo sapiens
acctcagagtatggagct

SEQ ID NO: 2547628 - DNA, 17 bp, Homo sapiens
acctcagagtccaggcc

SEQ ID NO: 2547629 - DNA, 13 bp, Homo sapiens
acctcagcctaga

SEQ ID NO: 2547630 - DNA, 19 bp, Homo sapiens
acctcagcctgtgctgccc

SEQ ID NO: 2547631 - DNA, 12 bp, Homo sapiens
acctcagctctg

SEQ ID NO: 2547632 - DNA, 23 bp, Homo sapiens
acctcagctctgggagaggattt

SEQ ID NO: 2547633 - DNA, 12 bp, Homo sapiens
acctcaggcagc

SEQ ID NO: 2547634 - DNA, 17 bp, Homo sapiens
acctcaggcagctcaag

SEQ ID NO: 2547635 - DNA, 15 bp, Homo sapiens
acctcaggcaggaag

SEQ ID NO: 2547636 - DNA, 21 bp, Homo sapiens
acctcaggccaggtgcagtgg

SEQ ID NO: 2547637 - DNA, 18 bp, Homo sapiens
acctcaggcttccttggc

SEQ ID NO: 2547638 - DNA, 19 bp, Homo sapiens
acctcaggcttccttggca

SEQ ID NO: 2547639 - DNA, 17 bp, Homo sapiens
acctcaggttgctggtt

SEQ ID NO: 2547640 - DNA, 23 bp, Homo sapiens
acctcagtgccttcctgtttttc

SEQ ID NO: 2547641 - DNA, 16 bp, Homo sapiens
acctcagtgtcattta

SEQ ID NO: 2547642 - DNA, 21 bp, Homo sapiens
acctcagtgtcatttatgaaa

SEQ ID NO: 2547643 - DNA, 20 bp, Homo sapiens
acctcagttcccttggcctc

SEQ ID NO: 2547644 - DNA, 21 bp, Homo sapiens
acctcagttcccttggcctca

SEQ ID NO: 2547645 - DNA, 19 bp, Homo sapiens
acctcatgcatctccacct

SEQ ID NO: 2547646 - DNA, 20 bp, Homo sapiens
acctcatgcatctccacctg

SEQ ID NO: 2547647 - DNA, 19 bp, Homo sapiens
acctccaaaactcctgccc

SEQ ID NO: 2547648 - DNA, 11 bp, Homo sapiens
acctccacagc

SEQ ID NO: 2547649 - DNA, 19 bp, Homo sapiens
acctccacagttcagtggc

SEQ ID NO: 2547650 - DNA, 20 bp, Homo sapiens
acctcccagccctatggatg

SEQ ID NO: 2547651 - DNA, 21 bp, Homo sapiens
acctccccctcccccttctcc

SEQ ID NO: 2547652 - DNA, 15 bp, Homo sapiens
acctccccctgcccc

SEQ ID NO: 2547653 - DNA, 13 bp, Homo sapiens
acctcccctcctt

SEQ ID NO: 2547654 - DNA, 20 bp, Homo sapiens
acctcccctccttgcctcct

SEQ ID NO: 2547655 - DNA, 20 bp, Homo sapiens
acctccctgaaccatccctg

SEQ ID NO: 2547656 - DNA, 14 bp, Homo sapiens
acctcctctgtgaa

SEQ ID NO: 2547657 - DNA, 13 bp, Homo sapiens
acctcctgagaaa

SEQ ID NO: 2547658 - DNA, 12 bp, Homo sapiens
acctgccaggga

SEQ ID NO: 2547659 - DNA, 16 bp, Homo sapiens
acctgccagggacaga

SEQ ID NO: 2547660 - DNA, 15 bp, Homo sapiens
acctgccatttgcac

SEQ ID NO: 2547661 - DNA, 12 bp, Homo sapiens
acctgccccctt

SEQ ID NO: 2547662 - DNA, 15 bp, Homo sapiens
acctgcccccttctc

SEQ ID NO: 2547663 - DNA, 16 bp, Homo sapiens
acctgcccccttctcc

SEQ ID NO: 2547664 - DNA, 17 bp, Homo sapiens
acctgccctgcccccac

SEQ ID NO: 2547665 - DNA, 14 bp, Homo sapiens
acctgccctgcctg

SEQ ID NO: 2547666 - DNA, 20 bp, Homo sapiens
acctgccctgcctgagggcc

SEQ ID NO: 2547667 - DNA, 23 bp, Homo sapiens
acctgcctcccttcatgcatgga

SEQ ID NO: 2547668 - DNA, 14 bp, Homo sapiens
acctgcctcctgcc

SEQ ID NO: 2547669 - DNA, 22 bp, Homo sapiens
acctgcggctgctgtgtgcctt

SEQ ID NO: 2547670 - DNA, 22 bp, Homo sapiens
acctgcggtgctatctccccca

SEQ ID NO: 2547671 - DNA, 23 bp, Homo sapiens
acctgcggtgctatctcccccag

SEQ ID NO: 2547672 - DNA, 13 bp, Homo sapiens
acctgctcccagg

SEQ ID NO: 2547673 - DNA, 19 bp, Homo sapiens
acctgctctcctcttgcca

SEQ ID NO: 2547674 - DNA, 19 bp, Homo sapiens
acctgctggcccctcacct

SEQ ID NO: 2547675 - DNA, 23 bp, Homo sapiens
acctgcttcatgctcagccctga

SEQ ID NO: 2547676 - DNA, 21 bp, Homo sapiens
acctggaagggctagaacctg

SEQ ID NO: 2547677 - DNA, 20 bp, Homo sapiens
acctggaatatataaccagt

SEQ ID NO: 2547678 - DNA, 19 bp, Homo sapiens
acctggaattgtggggcaa

SEQ ID NO: 2547679 - DNA, 21 bp, Homo sapiens
acctggagagctagaacctag

SEQ ID NO: 2547680 - DNA, 20 bp, Homo sapiens
acctggagagctagaacctg

SEQ ID NO: 2547681 - DNA, 14 bp, Homo sapiens
acctggagcccctg

SEQ ID NO: 2547682 - DNA, 17 bp, Homo sapiens
acctggagcccctgggt

SEQ ID NO: 2547683 - DNA, 18 bp, Homo sapiens
acctggagcccctgggtg

SEQ ID NO: 2547684 - DNA, 22 bp, Homo sapiens
acctggagggctagaacctgga

SEQ ID NO: 2547685 - DNA, 23 bp, Homo sapiens
acctggagggctagaacctggag

SEQ ID NO: 2547686 - DNA, 15 bp, Homo sapiens
acctggagggctgga

SEQ ID NO: 2547687 - DNA, 22 bp, Homo sapiens
acctggaggggctagaacctag

SEQ ID NO: 2547688 - DNA, 23 bp, Homo sapiens
acctggcaagctagaacctggag

SEQ ID NO: 2547689 - DNA, 14 bp, Homo sapiens
acctggcactgctg

SEQ ID NO: 2547690 - DNA, 17 bp, Homo sapiens
acctggcactgctgtgc

SEQ ID NO: 2547691 - DNA, 16 bp, Homo sapiens
acctggccacctgagg

SEQ ID NO: 2547692 - DNA, 20 bp, Homo sapiens
acctggccacctgaggtggg

SEQ ID NO: 2547693 - DNA, 17 bp, Homo sapiens
acctggcctctgcactc

SEQ ID NO: 2547694 - DNA, 14 bp, Homo sapiens
acctgggcacctgg

SEQ ID NO: 2547695 - DNA, 18 bp, Homo sapiens
acctgggcacctggggag

SEQ ID NO: 2547696 - DNA, 15 bp, Homo sapiens
acctgggcatatcca

SEQ ID NO: 2547697 - DNA, 14 bp, Homo sapiens
acctggggagccag

SEQ ID NO: 2547698 - DNA, 19 bp, Homo sapiens
acctgggtaaatgcagcgt

SEQ ID NO: 2547699 - DNA, 16 bp, Homo sapiens
acctgggtccaaataa

SEQ ID NO: 2547700 - DNA, 22 bp, Homo sapiens
acctgggttccctttccttcca

SEQ ID NO: 2547701 - DNA, 13 bp, Homo sapiens
acctggtgctgga

SEQ ID NO: 2547702 - DNA, 15 bp, Homo sapiens
acctgtaatcccagc

SEQ ID NO: 2547703 - DNA, 18 bp, Homo sapiens
acctgtagtcccagctac

SEQ ID NO: 2547704 - DNA, 17 bp, Homo sapiens
acctgtatgtctccagt

SEQ ID NO: 2547705 - DNA, 19 bp, Homo sapiens
acctgtcaaacaaagccag

SEQ ID NO: 2547706 - DNA, 23 bp, Homo sapiens
acctgtcacgattgtcatcagga

SEQ ID NO: 2547707 - DNA, 19 bp, Homo sapiens
acctgtcatgcccccctca

SEQ ID NO: 2547708 - DNA, 16 bp, Homo sapiens
acctgtccccctgaca

SEQ ID NO: 2547709 - DNA, 14 bp, Homo sapiens
acctgtctcagcct

SEQ ID NO: 2547710 - DNA, 14 bp, Homo sapiens
acctgtgaccagca

SEQ ID NO: 2547711 - DNA, 18 bp, Homo sapiens
acctgtgagtttaaagca

SEQ ID NO: 2547712 - DNA, 19 bp, Homo sapiens
acctgtgatgaggggagga

SEQ ID NO: 2547713 - DNA, 19 bp, Homo sapiens
acctgtggccaagttctta

SEQ ID NO: 2547714 - DNA, 23 bp, Homo sapiens
acctgtggggatttctcccagct

SEQ ID NO: 2547715 - DNA, 18 bp, Homo sapiens
acctgttacctactttga

SEQ ID NO: 2547716 - DNA, 17 bp, Homo sapiens
acctgttcagtgtcccg

SEQ ID NO: 2547717 - DNA, 19 bp, Homo sapiens
acctgttcagtgtcccggg

SEQ ID NO: 2547718 - DNA, 22 bp, Homo sapiens
acctgttcagtgtcccgggccc

SEQ ID NO: 2547719 - DNA, 16 bp, Homo sapiens
acctgttggttccaag

SEQ ID NO: 2547720 - DNA, 15 bp, Homo sapiens
accttaccaactttc

SEQ ID NO: 2547721 - DNA, 20 bp, Homo sapiens
accttagacagtccctgcca

SEQ ID NO: 2547722 - DNA, 22 bp, Homo sapiens
accttagatgttctaagtcttt

SEQ ID NO: 2547723 - DNA, 21 bp, Homo sapiens
accttagctggcattacagct

SEQ ID NO: 2547724 - DNA, 20 bp, Homo sapiens
accttagtgtttctgtgcat

SEQ ID NO: 2547725 - DNA, 11 bp, Homo sapiens
accttatctgt

SEQ ID NO: 2547726 - DNA, 22 bp, Homo sapiens
accttatctgtgcgtgaaacac

SEQ ID NO: 2547727 - DNA, 12 bp, Homo sapiens
accttcaataaa

SEQ ID NO: 2547728 - DNA, 13 bp, Homo sapiens
accttcaataaag

SEQ ID NO: 2547729 - DNA, 19 bp, Homo sapiens
accttcaataaagtatcta

SEQ ID NO: 2547730 - DNA, 16 bp, Homo sapiens
accttcaattcctggg

SEQ ID NO: 2547731 - DNA, 17 bp, Homo sapiens
accttcagactttgctt

SEQ ID NO: 2547732 - DNA, 19 bp, Homo sapiens
accttcagttatgattttt

SEQ ID NO: 2547733 - DNA, 12 bp, Homo sapiens
accttcctcact

SEQ ID NO: 2547734 - DNA, 17 bp, Homo sapiens
accttctccccattctg

SEQ ID NO: 2547735 - DNA, 23 bp, Homo sapiens
accttctccctcatttcaggagc

SEQ ID NO: 2547736 - DNA, 13 bp, Homo sapiens
accttctccttca

SEQ ID NO: 2547737 - DNA, 17 bp, Homo sapiens
accttctctggagccaa

SEQ ID NO: 2547738 - DNA, 18 bp, Homo sapiens
accttctggcctcccaca

SEQ ID NO: 2547739 - DNA, 20 bp, Homo sapiens
accttcttcagccacctctc

SEQ ID NO: 2547740 - DNA, 15 bp, Homo sapiens
accttgcaacttcat

SEQ ID NO: 2547741 - DNA, 23 bp, Homo sapiens
accttggtgtagttgaactgata

SEQ ID NO: 2547742 - DNA, 19 bp, Homo sapiens
acgctggagtgcagtgagc

SEQ ID NO: 2547743 - DNA, 20 bp, Homo sapiens
acgctgtctccagaccccca

SEQ ID NO: 2547744 - DNA, 22 bp, Homo sapiens
acgctgtctccagacccccacc

SEQ ID NO: 2547745 - DNA, 23 bp, Homo sapiens
acgctgtctccagacccccaccc

SEQ ID NO: 2547746 - DNA, 17 bp, Homo sapiens
acgctgtgctgccctgc

SEQ ID NO: 2547747 - DNA, 21 bp, Homo sapiens
acgcttaaaggtgtcttcctc

SEQ ID NO: 2547748 - DNA, 13 bp, Homo sapiens
acgcttcttcttt

SEQ ID NO: 2547749 - DNA, 19 bp, Homo sapiens
acggaatagttggctagga

SEQ ID NO: 2547750 - DNA, 15 bp, Homo sapiens
acggacaccccctcg

SEQ ID NO: 2547751 - DNA, 19 bp, Homo sapiens
acggagagcgcctgcccct

SEQ ID NO: 2547752 - DNA, 18 bp, Homo sapiens
acggagccactcctctga

SEQ ID NO: 2547753 - DNA, 20 bp, Homo sapiens
acggagccactcctctgact

SEQ ID NO: 2547754 - DNA, 18 bp, Homo sapiens
acggagccccaggcctct

SEQ ID NO: 2547755 - DNA, 21 bp, Homo sapiens
acggagtcccaccttggctgc

SEQ ID NO: 2547756 - DNA, 23 bp, Homo sapiens
acggagtcccaccttggctgcag

SEQ ID NO: 2547757 - DNA, 23 bp, Homo sapiens
acggattagggcatttgagaaat

SEQ ID NO: 2547758 - DNA, 16 bp, Homo sapiens
acggattattttttca

SEQ ID NO: 2547759 - DNA, 17 bp, Homo sapiens
acggattattttttcag

SEQ ID NO: 2547760 - DNA, 12 bp, Homo sapiens
acggccaggcca

SEQ ID NO: 2547761 - DNA, 15 bp, Homo sapiens
acggccgctccaggg

SEQ ID NO: 2547762 - DNA, 15 bp, Homo sapiens
acggcctgatgctcc

SEQ ID NO: 2547763 - DNA, 19 bp, Homo sapiens
acggcctgatgctccctcc

SEQ ID NO: 2547764 - DNA, 14 bp, Homo sapiens
acggctcactgcag

SEQ ID NO: 2547765 - DNA, 15 bp, Homo sapiens
acggctcactgcagc

SEQ ID NO: 2547766 - DNA, 18 bp, Homo sapiens
acgggcatgggcactccc

SEQ ID NO: 2547767 - DNA, 14 bp, Homo sapiens
acggggggccccag

SEQ ID NO: 2547768 - DNA, 21 bp, Homo sapiens
acggtcccacactggtgactg

SEQ ID NO: 2547769 - DNA, 16 bp, Homo sapiens
acggtcgccacctggc

SEQ ID NO: 2547770 - DNA, 20 bp, Homo sapiens
acggtctgttcttgaagcag

SEQ ID NO: 2547771 - DNA, 17 bp, Homo sapiens
acggtgcagtctgggtg

SEQ ID NO: 2547772 - DNA, 22 bp, Homo sapiens
acggtgctccaggcaggctaag

SEQ ID NO: 2547773 - DNA, 12 bp, Homo sapiens
acgtacacattt

SEQ ID NO: 2547774 - DNA, 13 bp, Homo sapiens
acgtatgcatgtg

SEQ ID NO: 2547775 - DNA, 20 bp, Homo sapiens
acgtatgtttttgtgtattt

SEQ ID NO: 2547776 - DNA, 16 bp, Homo sapiens
acgtcaaacatgaagt

SEQ ID NO: 2547777 - DNA, 17 bp, Homo sapiens
acgtcaaacatgaagtg

SEQ ID NO: 2547778 - DNA, 23 bp, Homo sapiens
acgtccaccatggggtcctacca

SEQ ID NO: 2547779 - DNA, 19 bp, Homo sapiens
acgtcgtcttctgtatact

SEQ ID NO: 2547780 - DNA, 22 bp, Homo sapiens
acgtctgggagaaattgacaga

SEQ ID NO: 2547781 - DNA, 16 bp, Homo sapiens
acgtctgtaagctgaa

SEQ ID NO: 2547782 - DNA, 21 bp, Homo sapiens
acgtgactgtggcacacgcct

SEQ ID NO: 2547783 - DNA, 16 bp, Homo sapiens
acgtgagatcattcac

SEQ ID NO: 2547784 - DNA, 15 bp, Homo sapiens
acgtgagccaggtaa

SEQ ID NO: 2547785 - DNA, 22 bp, Homo sapiens
acgtgagccaggtaatgaggga

SEQ ID NO: 2547786 - DNA, 20 bp, Homo sapiens
acgtgcacctgtactcagga

SEQ ID NO: 2547787 - DNA, 20 bp, Homo sapiens
acgtgccttttgcacccctc

SEQ ID NO: 2547788 - DNA, 22 bp, Homo sapiens
acgtgccttttgcacccctccc

SEQ ID NO: 2547789 - DNA, 15 bp, Homo sapiens
acgtggagagctggt

SEQ ID NO: 2547790 - DNA, 17 bp, Homo sapiens
acgtggaggagcagtgc

SEQ ID NO: 2547791 - DNA, 15 bp, Homo sapiens
acgtggcatgtggcc

SEQ ID NO: 2547792 - DNA, 14 bp, Homo sapiens
acgtgtagctatat

SEQ ID NO: 2547793 - DNA, 23 bp, Homo sapiens
acgtgtgtgactcagatgtctct

SEQ ID NO: 2547794 - DNA, 16 bp, Homo sapiens
acgtgtttgtgctgtg

SEQ ID NO: 2547795 - DNA, 18 bp, Homo sapiens
acgttagaccacaaatag

SEQ ID NO: 2547796 - DNA, 17 bp, Homo sapiens
acgttatggtgtttctc

SEQ ID NO: 2547797 - DNA, 13 bp, Homo sapiens
acgttgctcccca

SEQ ID NO: 2547798 - DNA, 12 bp, Homo sapiens
acgtttctaaag

SEQ ID NO: 2547799 - DNA, 14 bp, Homo sapiens
acgtttctaaaggc

SEQ ID NO: 2547800 - DNA, 15 bp, Homo sapiens
acgtttctaaaggct

SEQ ID NO: 2547801 - DNA, 22 bp, Homo sapiens
acgtttctaaaggctacctttg

SEQ ID NO: 2547802 - DNA, 14 bp, Homo sapiens
acgttttattgtgt

SEQ ID NO: 2547803 - DNA, 16 bp, Homo sapiens
acgttttattgtgttt

SEQ ID NO: 2547804 - DNA, 21 bp, Homo sapiens
actaaagagagaatgtagata

SEQ ID NO: 2547805 - DNA, 16 bp, Homo sapiens
actaaatctctaatat

SEQ ID NO: 2547806 - DNA, 17 bp, Homo sapiens
actaacatataatgttg

SEQ ID NO: 2547807 - DNA, 23 bp, Homo sapiens
actaaccagggaagctgtccctc

SEQ ID NO: 2547808 - DNA, 20 bp, Homo sapiens
actaactcctaggaaaatac

SEQ ID NO: 2547809 - DNA, 14 bp, Homo sapiens
actaagaaaagata

SEQ ID NO: 2547810 - DNA, 17 bp, Homo sapiens
actaagatgacattgct

SEQ ID NO: 2547811 - DNA, 14 bp, Homo sapiens
actaagcctacctg

SEQ ID NO: 2547812 - DNA, 21 bp, Homo sapiens
actaagctttgccagctgctg

SEQ ID NO: 2547813 - DNA, 15 bp, Homo sapiens
actaagtttttatgg

SEQ ID NO: 2547814 - DNA, 22 bp, Homo sapiens
actaataaaagcataaatgcaa

SEQ ID NO: 2547815 - DNA, 13 bp, Homo sapiens
actcaaccctctc

SEQ ID NO: 2547816 - DNA, 15 bp, Homo sapiens
actcaagaagcaggc

SEQ ID NO: 2547817 - DNA, 16 bp, Homo sapiens
actcaagaagcaggct

SEQ ID NO: 2547818 - DNA, 15 bp, Homo sapiens
actcaagaggctgag

SEQ ID NO: 2547819 - DNA, 18 bp, Homo sapiens
actcaagaggctgaggca

SEQ ID NO: 2547820 - DNA, 19 bp, Homo sapiens
actcaaggttcccagagat

SEQ ID NO: 2547821 - DNA, 22 bp, Homo sapiens
actcaatattttccatgaaaat

SEQ ID NO: 2547822 - DNA, 16 bp, Homo sapiens
actcaatgcactgaca

SEQ ID NO: 2547823 - DNA, 17 bp, Homo sapiens
actcaatttctccccag

SEQ ID NO: 2547824 - DNA, 14 bp, Homo sapiens
actcacaagaagac

SEQ ID NO: 2547825 - DNA, 16 bp, Homo sapiens
actcacaagaagacca

SEQ ID NO: 2547826 - DNA, 22 bp, Homo sapiens
actcacacagccaggtgccttg

SEQ ID NO: 2547827 - DNA, 22 bp, Homo sapiens
actcacacaggacccccttccc

SEQ ID NO: 2547828 - DNA, 20 bp, Homo sapiens
actcacatggctatgtttta

SEQ ID NO: 2547829 - DNA, 23 bp, Homo sapiens
actcaccagtgtcccctccactg

SEQ ID NO: 2547830 - DNA, 13 bp, Homo sapiens
actcaccatctgt

SEQ ID NO: 2547831 - DNA, 15 bp, Homo sapiens
actcaccatctgtgc

SEQ ID NO: 2547832 - DNA, 19 bp, Homo sapiens
actcaccccggcagacgcc

SEQ ID NO: 2547833 - DNA, 20 bp, Homo sapiens
actcacctaatgtttatgag

SEQ ID NO: 2547834 - DNA, 13 bp, Homo sapiens
actcacctgctgg

SEQ ID NO: 2547835 - DNA, 16 bp, Homo sapiens
actcacctgctggccc

SEQ ID NO: 2547836 - DNA, 20 bp, Homo sapiens
actcacctgctggcccctca

SEQ ID NO: 2547837 - DNA, 14 bp, Homo sapiens
actcacctggggct

SEQ ID NO: 2547838 - DNA, 14 bp, Homo sapiens
actcactcctgaga

SEQ ID NO: 2547839 - DNA, 22 bp, Homo sapiens
actcactcctgagacccctggc

SEQ ID NO: 2547840 - DNA, 22 bp, Homo sapiens
actcactgctcaagaagacatg

SEQ ID NO: 2547841 - DNA, 15 bp, Homo sapiens
actcagaaacatcag

SEQ ID NO: 2547842 - DNA, 21 bp, Homo sapiens
actcagaaatttaattcatgt

SEQ ID NO: 2547843 - DNA, 15 bp, Homo sapiens
actcagaagacactg

SEQ ID NO: 2547844 - DNA, 16 bp, Homo sapiens
actcagaagacactga

SEQ ID NO: 2547845 - DNA, 13 bp, Homo sapiens
actcagaagcctg

SEQ ID NO: 2547846 - DNA, 17 bp, Homo sapiens
actcagaagcctgaggc

SEQ ID NO: 2547847 - DNA, 18 bp, Homo sapiens
actcagaagcctgaggct

SEQ ID NO: 2547848 - DNA, 21 bp, Homo sapiens
actcagaattctctagtttga

SEQ ID NO: 2547849 - DNA, 17 bp, Homo sapiens
actcagatcactactgc

SEQ ID NO: 2547850 - DNA, 22 bp, Homo sapiens
actcagatggaaccgcaggaag

SEQ ID NO: 2547851 - DNA, 17 bp, Homo sapiens
actcagccaagcacagt

SEQ ID NO: 2547852 - DNA, 22 bp, Homo sapiens
actcagccaagcacagtggtgg

SEQ ID NO: 2547853 - DNA, 17 bp, Homo sapiens
actcaggaggctgaggc

SEQ ID NO: 2547854 - DNA, 18 bp, Homo sapiens
actcaggaggctgaggca

SEQ ID NO: 2547855 - DNA, 17 bp, Homo sapiens
actcaggatgcccaggg

SEQ ID NO: 2547856 - DNA, 22 bp, Homo sapiens
actcaggttgtagtaaagaaat

SEQ ID NO: 2547857 - DNA, 23 bp, Homo sapiens
actcaggttgtagtaaagaaatt

SEQ ID NO: 2547858 - DNA, 22 bp, Homo sapiens
actcagttttaactagaattta

SEQ ID NO: 2547859 - DNA, 13 bp, Homo sapiens
actcagttttctt

SEQ ID NO: 2547860 - DNA, 14 bp, Homo sapiens
actcataatgtgaa

SEQ ID NO: 2547861 - DNA, 19 bp, Homo sapiens
actcataatgtgaagtgtt

SEQ ID NO: 2547862 - DNA, 14 bp, Homo sapiens
actcatacatctgg

SEQ ID NO: 2547863 - DNA, 15 bp, Homo sapiens
actcatacatctggc

SEQ ID NO: 2547864 - DNA, 20 bp, Homo sapiens
actcatactgtgctggagcc

SEQ ID NO: 2547865 - DNA, 21 bp, Homo sapiens
actcatactgtgctggagcca

SEQ ID NO: 2547866 - DNA, 9 bp, Homo sapiens
actcatcat

SEQ ID NO: 2547867 - DNA, 19 bp, Homo sapiens
actcatccctaatgctgca

SEQ ID NO: 2547868 - DNA, 12 bp, Homo sapiens
actcatcttagg

SEQ ID NO: 2547869 - DNA, 13 bp, Homo sapiens
actcatgctgaaa

SEQ ID NO: 2547870 - DNA, 16 bp, Homo sapiens
actcatgctgaaagcc

SEQ ID NO: 2547871 - DNA, 10 bp, Homo sapiens
actcatgtgt

SEQ ID NO: 2547872 - DNA, 13 bp, Homo sapiens
actcatgtgtatg

SEQ ID NO: 2547873 - DNA, 13 bp, Homo sapiens
actcattcaaaag

SEQ ID NO: 2547874 - DNA, 23 bp, Homo sapiens
actcattcagggatagcactgag

SEQ ID NO: 2547875 - DNA, 15 bp, Homo sapiens
actcattcttctgta

SEQ ID NO: 2547876 - DNA, 22 bp, Homo sapiens
actcattgacctgaggcccttc

SEQ ID NO: 2547877 - DNA, 20 bp, Homo sapiens
actcattttaaaaaatggaa

SEQ ID NO: 2547878 - DNA, 21 bp, Homo sapiens
actccaaacctcctgttagct

SEQ ID NO: 2547879 - DNA, 16 bp, Homo sapiens
actctgtgtcaggtgg

SEQ ID NO: 2547880 - DNA, 14 bp, Homo sapiens
actcttaagccatc

SEQ ID NO: 2547881 - DNA, 22 bp, Homo sapiens
actcttaagccatcttggtaaa

SEQ ID NO: 2547882 - DNA, 18 bp, Homo sapiens
actcttaagtttctcagc

SEQ ID NO: 2547883 - DNA, 14 bp, Homo sapiens
actcttagaaatga

SEQ ID NO: 2547884 - DNA, 15 bp, Homo sapiens
actcttagttactca

SEQ ID NO: 2547885 - DNA, 12 bp, Homo sapiens
actcttatctca

SEQ ID NO: 2547886 - DNA, 23 bp, Homo sapiens
actcttatctcagtcatgcataa

SEQ ID NO: 2547887 - DNA, 16 bp, Homo sapiens
actcttattgcccacg

SEQ ID NO: 2547888 - DNA, 21 bp, Homo sapiens
actcttattgcccacgctgga

SEQ ID NO: 2547889 - DNA, 16 bp, Homo sapiens
actcttggtttcttca

SEQ ID NO: 2547890 - DNA, 13 bp, Homo sapiens
actctttcaaaac

SEQ ID NO: 2547891 - DNA, 17 bp, Homo sapiens
actctttgaatgacaaa

SEQ ID NO: 2547892 - DNA, 13 bp, Homo sapiens
actctttgagaaa

SEQ ID NO: 2547893 - DNA, 22 bp, Homo sapiens
actctttgagatagaagaactg

SEQ ID NO: 2547894 - DNA, 14 bp, Homo sapiens
actctttgtaagag

SEQ ID NO: 2547895 - DNA, 14 bp, Homo sapiens
actgaaaacatctg

SEQ ID NO: 2547896 - DNA, 16 bp, Homo sapiens
actgaaaacatctgga

SEQ ID NO: 2547897 - DNA, 19 bp, Homo sapiens
actgaaaagactcagtgtt

SEQ ID NO: 2547898 - DNA, 15 bp, Homo sapiens
actgaaaatctaata

SEQ ID NO: 2547899 - DNA, 16 bp, Homo sapiens
actgaaaatctaatat

SEQ ID NO: 2547900 - DNA, 15 bp, Homo sapiens
actgaaatatacaca

SEQ ID NO: 2547901 - DNA, 13 bp, Homo sapiens
actgaacattcca

SEQ ID NO: 2547902 - DNA, 19 bp, Homo sapiens
actgaaccggctttaccaa

SEQ ID NO: 2547903 - DNA, 16 bp, Homo sapiens
actgaactttgctgag

SEQ ID NO: 2547904 - DNA, 19 bp, Homo sapiens
actgaagcctgcaggagtt

SEQ ID NO: 2547905 - DNA, 17 bp, Homo sapiens
actgaaggcctggccca

SEQ ID NO: 2547906 - DNA, 13 bp, Homo sapiens
actgaagtctgaa

SEQ ID NO: 2547907 - DNA, 21 bp, Homo sapiens
actgaagttaacagagacaga

SEQ ID NO: 2547908 - DNA, 15 bp, Homo sapiens
actgaagtttcacat

SEQ ID NO: 2547909 - DNA, 21 bp, Homo sapiens
actgaatatttatatttcact

SEQ ID NO: 2547910 - DNA, 19 bp, Homo sapiens
actgaatgaaacccccaca

SEQ ID NO: 2547911 - DNA, 21 bp, Homo sapiens
actgaatgaaacccccacaca

SEQ ID NO: 2547912 - DNA, 21 bp, Homo sapiens
actgaattaatcatctataaa

SEQ ID NO: 2547913 - DNA, 12 bp, Homo sapiens
actgaatttctt

SEQ ID NO: 2547914 - DNA, 23 bp, Homo sapiens
actgacacaaaaagtagattaag

SEQ ID NO: 2547915 - DNA, 21 bp, Homo sapiens
actgacacccatgtttctctg

SEQ ID NO: 2547916 - DNA, 22 bp, Homo sapiens
actgacattgttggccaaagcc

SEQ ID NO: 2547917 - DNA, 23 bp, Homo sapiens
actgacattgttggccaaagcca

SEQ ID NO: 2547918 - DNA, 21 bp, Homo sapiens
actgaccaatattgtacagtt

SEQ ID NO: 2547919 - DNA, 22 bp, Homo sapiens
actgaccaatattgtacagttt

SEQ ID NO: 2547920 - DNA, 15 bp, Homo sapiens
actgaccagcctcca

SEQ ID NO: 2547921 - DNA, 20 bp, Homo sapiens
actgaccagcctccatgctg

SEQ ID NO: 2547922 - DNA, 23 bp, Homo sapiens
actgaccatccactctaccctcc

SEQ ID NO: 2547923 - DNA, 22 bp, Homo sapiens
actgacctgtcatgcccccctc

SEQ ID NO: 2547924 - DNA, 15 bp, Homo sapiens
actgacttctaagta

SEQ ID NO: 2547925 - DNA, 22 bp, Homo sapiens
actgacttctaagtaaaaccac

SEQ ID NO: 2547926 - DNA, 14 bp, Homo sapiens
actgactttatcct

SEQ ID NO: 2547927 - DNA, 21 bp, Homo sapiens
actgagacagcccgggctctg

SEQ ID NO: 2547928 - DNA, 22 bp, Homo sapiens
actgagacagcccgggctctgc

SEQ ID NO: 2547929 - DNA, 15 bp, Homo sapiens
actgagaccaaagaa

SEQ ID NO: 2547930 - DNA, 18 bp, Homo sapiens
actgagataccagcgagg

SEQ ID NO: 2547931 - DNA, 17 bp, Homo sapiens
actgagatgtgaacaca

SEQ ID NO: 2547932 - DNA, 17 bp, Homo sapiens
actggccaccaggctgg

SEQ ID NO: 2547933 - DNA, 22 bp, Homo sapiens
actggccaccaggctggcgcag

SEQ ID NO: 2547934 - DNA, 23 bp, Homo sapiens
actggccaccaggctggcgcagc

SEQ ID NO: 2547935 - DNA, 23 bp, Homo sapiens
actggccagtggctggatctgtg

SEQ ID NO: 2547936 - DNA, 13 bp, Homo sapiens
actggccatctcc

SEQ ID NO: 2547937 - DNA, 17 bp, Homo sapiens
actggcccctgggtcag

SEQ ID NO: 2547938 - DNA, 19 bp, Homo sapiens
actggccggagtcagtgcc

SEQ ID NO: 2547939 - DNA, 19 bp, Homo sapiens
actggcgacacgtagcagc

SEQ ID NO: 2547940 - DNA, 12 bp, Homo sapiens
actggctctcca

SEQ ID NO: 2547941 - DNA, 16 bp, Homo sapiens
actggctctccaagtg

SEQ ID NO: 2547942 - DNA, 22 bp, Homo sapiens
actggctgcaaagggtatcagg

SEQ ID NO: 2547943 - DNA, 19 bp, Homo sapiens
actggcttttattaatgca

SEQ ID NO: 2547944 - DNA, 23 bp, Homo sapiens
actggcttttattaatgcacttt

SEQ ID NO: 2547945 - DNA, 23 bp, Homo sapiens
actgggaagataggctctgcaca

SEQ ID NO: 2547946 - DNA, 16 bp, Homo sapiens
actgggatgagccgct

SEQ ID NO: 2547947 - DNA, 22 bp, Homo sapiens
actgggatgggaggagaggaca

SEQ ID NO: 2547948 - DNA, 13 bp, Homo sapiens
actggggagcccg

SEQ ID NO: 2547949 - DNA, 17 bp, Homo sapiens
actggggagcccgtctc

SEQ ID NO: 2547950 - DNA, 17 bp, Homo sapiens
actggggatgtgggagg

SEQ ID NO: 2547951 - DNA, 14 bp, Homo sapiens
actggggctgaagg

SEQ ID NO: 2547952 - DNA, 18 bp, Homo sapiens
actggggtcctggggcct

SEQ ID NO: 2547953 - DNA, 21 bp, Homo sapiens
actgggtgcccaagctcagaa

SEQ ID NO: 2547954 - DNA, 20 bp, Homo sapiens
actgggtggggtgaggacca

SEQ ID NO: 2547955 - DNA, 19 bp, Homo sapiens
actgggtttggaccccagc

SEQ ID NO: 2547956 - DNA, 20 bp, Homo sapiens
actgggtttggaccccagct

SEQ ID NO: 2547957 - DNA, 23 bp, Homo sapiens
actgggtttggaccccagctggg

SEQ ID NO: 2547958 - DNA, 23 bp, Homo sapiens
actggtgctataggctggagaag

SEQ ID NO: 2547959 - DNA, 22 bp, Homo sapiens
actggtgttatcaccgtgggct

SEQ ID NO: 2547960 - DNA, 18 bp, Homo sapiens
actggttccatggcctct

SEQ ID NO: 2547961 - DNA, 15 bp, Homo sapiens
actgtaaagaaagag

SEQ ID NO: 2547962 - DNA, 21 bp, Homo sapiens
actgtaagactcattccctag

SEQ ID NO: 2547963 - DNA, 19 bp, Homo sapiens
actgtaatttgtgatacaa

SEQ ID NO: 2547964 - DNA, 22 bp, Homo sapiens
actgtacaatgactttattgca

SEQ ID NO: 2547965 - DNA, 16 bp, Homo sapiens
actgtacatgaaaaca

SEQ ID NO: 2547966 - DNA, 20 bp, Homo sapiens
actgtacatgaaaacacatt

SEQ ID NO: 2547967 - DNA, 18 bp, Homo sapiens
actgtacttaataaattc

SEQ ID NO: 2547968 - DNA, 19 bp, Homo sapiens
actgtagaatgatttcatg

SEQ ID NO: 2547969 - DNA, 20 bp, Homo sapiens
actgtagaatgatttcatgc

SEQ ID NO: 2547970 - DNA, 13 bp, Homo sapiens
actgtagtctcag

SEQ ID NO: 2547971 - DNA, 15 bp, Homo sapiens
actgtagtctcagga

SEQ ID NO: 2547972 - DNA, 16 bp, Homo sapiens
actgtagtctcaggac

SEQ ID NO: 2547973 - DNA, 18 bp, Homo sapiens
actgtagtttttcttcaa

SEQ ID NO: 2547974 - DNA, 22 bp, Homo sapiens
acttctgctttccacacctggc

SEQ ID NO: 2547975 - DNA, 19 bp, Homo sapiens
acttctgggcttcatctgg

SEQ ID NO: 2547976 - DNA, 16 bp, Homo sapiens
acttcttaaaagttgt

SEQ ID NO: 2547977 - DNA, 13 bp, Homo sapiens
acttcttcagagc

SEQ ID NO: 2547978 - DNA, 21 bp, Homo sapiens
acttcttcagagctgacacag

SEQ ID NO: 2547979 - DNA, 22 bp, Homo sapiens
acttcttggcttggtgaggaaa

SEQ ID NO: 2547980 - DNA, 21 bp, Homo sapiens
acttctttgctttgcccagca

SEQ ID NO: 2547981 - DNA, 22 bp, Homo sapiens
acttcttttataactagtcctt

SEQ ID NO: 2547982 - DNA, 12 bp, Homo sapiens
acttcttttcac

SEQ ID NO: 2547983 - DNA, 17 bp, Homo sapiens
acttcttttcacattct

SEQ ID NO: 2547984 - DNA, 19 bp, Homo sapiens
acttcttttcacattctta

SEQ ID NO: 2547985 - DNA, 14 bp, Homo sapiens
acttgaaagcatcc

SEQ ID NO: 2547986 - DNA, 18 bp, Homo sapiens
acttgaaagcatccatgt

SEQ ID NO: 2547987 - DNA, 19 bp, Homo sapiens
acttgaaataccagtgaac

SEQ ID NO: 2547988 - DNA, 21 bp, Homo sapiens
acttgaacccgggaggcagag

SEQ ID NO: 2547989 - DNA, 17 bp, Homo sapiens
acttgacagaacactgt

SEQ ID NO: 2547990 - DNA, 17 bp, Homo sapiens
acttgacttttaaggct

SEQ ID NO: 2547991 - DNA, 12 bp, Homo sapiens
acttgagaggat

SEQ ID NO: 2547992 - DNA, 20 bp, Homo sapiens
acttgagcaccgtcatggct

SEQ ID NO: 2547993 - DNA, 17 bp, Homo sapiens
acttgagggcccagagc

SEQ ID NO: 2547994 - DNA, 18 bp, Homo sapiens
acttgagggcccagagca

SEQ ID NO: 2547995 - DNA, 21 bp, Homo sapiens
acttgagggcccagagcagga

SEQ ID NO: 2547996 - DNA, 19 bp, Homo sapiens
acttgatgtgccattttaa

SEQ ID NO: 2547997 - DNA, 17 bp, Homo sapiens
acttgcaaaaagggtca

SEQ ID NO: 2547998 - DNA, 19 bp, Homo sapiens
acttgcacgcccatgtgtg

SEQ ID NO: 2547999 - DNA, 23 bp, Homo sapiens
acttgcagctgatgttggaagag

SEQ ID NO: 2548000 - DNA, 19 bp, Homo sapiens
acttgcatccaactccagg

SEQ ID NO: 2548001 - DNA, 19 bp, Homo sapiens
acttgcattgaatatatta

SEQ ID NO: 2548002 - DNA, 19 bp, Homo sapiens
acttgcatttttgcaggag

SEQ ID NO: 2548003 - DNA, 21 bp, Homo sapiens
acttgctgcagtatgaaaata

SEQ ID NO: 2548004 - DNA, 23 bp, Homo sapiens
acttgctgcctgaagaacagtaa

SEQ ID NO: 2548005 - DNA, 17 bp, Homo sapiens
agaatcagatcatttca

SEQ ID NO: 2548006 - DNA, 19 bp, Homo sapiens
agaatcagtctatccacag

SEQ ID NO: 2548007 - DNA, 21 bp, Homo sapiens
agaatcagtctatccacagag

SEQ ID NO: 2548008 - DNA, 21 bp, Homo sapiens
agaatcatgtgaacccgggac

SEQ ID NO: 2548009 - DNA, 15 bp, Homo sapiens
agaatctaaagccag

SEQ ID NO: 2548010 - DNA, 16 bp, Homo sapiens
agaatctaaagccagt

SEQ ID NO: 2548011 - DNA, 17 bp, Homo sapiens
agaatctcaaataacta

SEQ ID NO: 2548012 - DNA, 13 bp, Homo sapiens
agaatctggagag

SEQ ID NO: 2548013 - DNA, 16 bp, Homo sapiens
agaatgaaaactcatt

SEQ ID NO: 2548014 - DNA, 19 bp, Homo sapiens
agaatgaaatactgtttga

SEQ ID NO: 2548015 - DNA, 16 bp, Homo sapiens
agaatgagggccaaga

SEQ ID NO: 2548016 - DNA, 11 bp, Homo sapiens
agaatgctgaa

SEQ ID NO: 2548017 - DNA, 17 bp, Homo sapiens
agaatgctgaaaccaag

SEQ ID NO: 2548018 - DNA, 17 bp, Homo sapiens
agaatgggaatatttta

SEQ ID NO: 2548019 - DNA, 18 bp, Homo sapiens
agaatggggatcacagag

SEQ ID NO: 2548020 - DNA, 15 bp, Homo sapiens
agaatggggtgcatg

SEQ ID NO: 2548021 - DNA, 15 bp, Homo sapiens
agaatgtattgtacc

SEQ ID NO: 2548022 - DNA, 16 bp, Homo sapiens
agaatgtattgtacct

SEQ ID NO: 2548023 - DNA, 22 bp, Homo sapiens
agaatgtattgtaccttttaac

SEQ ID NO: 2548024 - DNA, 19 bp, Homo sapiens
agaatgtcagtatgtggaa

SEQ ID NO: 2548025 - DNA, 21 bp, Homo sapiens
agaatgtgtttaaacttggtt

SEQ ID NO: 2548026 - DNA, 18 bp, Homo sapiens
agaatgtgttttctgaat

SEQ ID NO: 2548027 - DNA, 18 bp, Homo sapiens
agaatgttgtattcagtg

SEQ ID NO: 2548028 - DNA, 18 bp, Homo sapiens
agaatgttttactgtgaa

SEQ ID NO: 2548029 - DNA, 23 bp, Homo sapiens
agaattaacacatgatcctgcaa

SEQ ID NO: 2548030 - DNA, 13 bp, Homo sapiens
agaattccaagga

SEQ ID NO: 2548031 - DNA, 20 bp, Homo sapiens
agaattccaaggagttccat

SEQ ID NO: 2548032 - DNA, 22 bp, Homo sapiens
agaattccctctctctgactct

SEQ ID NO: 2548033 - DNA, 12 bp, Homo sapiens
agaattccttca

SEQ ID NO: 2548034 - DNA, 17 bp, Homo sapiens
agaattcttacatgttt

SEQ ID NO: 2548035 - DNA, 19 bp, Homo sapiens
agaatttagggagaaatgt

SEQ ID NO: 2548036 - DNA, 21 bp, Homo sapiens
agaatttatcacacttctgtg

SEQ ID NO: 2548037 - DNA, 21 bp, Homo sapiens
agaatttctaccatttcagag

SEQ ID NO: 2548038 - DNA, 13 bp, Homo sapiens
agaatttcttggt

SEQ ID NO: 2548039 - DNA, 22 bp, Homo sapiens
agaatttcttggtaagaagccg

SEQ ID NO: 2548040 - DNA, 12 bp, Homo sapiens
agaattttaaaa

SEQ ID NO: 2548041 - DNA, 14 bp, Homo sapiens
agaattttaaaaat

SEQ ID NO: 2548042 - DNA, 16 bp, Homo sapiens
agaattttaaaaatga

SEQ ID NO: 2548043 - DNA, 21 bp, Homo sapiens
agaattttaaaaatgaatcct

SEQ ID NO: 2548044 - DNA, 13 bp, Homo sapiens
agaattttaaatt

SEQ ID NO: 2548045 - DNA, 15 bp, Homo sapiens
agaattttaaattat

SEQ ID NO: 2548046 - DNA, 18 bp, Homo sapiens
agaattttaaattataac

SEQ ID NO: 2548047 - DNA, 17 bp, Homo sapiens
agacaaaccagaagcaa

SEQ ID NO: 2548048 - DNA, 18 bp, Homo sapiens
agacaaaggttttcctct

SEQ ID NO: 2548049 - DNA, 13 bp, Homo sapiens
agacaaatactca

SEQ ID NO: 2548050 - DNA, 20 bp, Homo sapiens
agacaaatactcatgtgtat

SEQ ID NO: 2548051 - DNA, 15 bp, Homo sapiens
agacaaatatttgga

SEQ ID NO: 2548052 - DNA, 16 bp, Homo sapiens
agacaaatatttggag

SEQ ID NO: 2548053 - DNA, 14 bp, Homo sapiens
agacaaatggagga

SEQ ID NO: 2548054 - DNA, 19 bp, Homo sapiens
agacaaattctgtttcttg

SEQ ID NO: 2548055 - DNA, 21 bp, Homo sapiens
agacaaattctgtttcttgag

SEQ ID NO: 2548056 - DNA, 13 bp, Homo sapiens
agacaacagaagt

SEQ ID NO: 2548057 - DNA, 14 bp, Homo sapiens
agacaaccctgcaa

SEQ ID NO: 2548058 - DNA, 13 bp, Homo sapiens
agacaagctgcaa

SEQ ID NO: 2548059 - DNA, 13 bp, Homo sapiens
agacaatgactta

SEQ ID NO: 2548060 - DNA, 17 bp, Homo sapiens
agacaatgacttactgt

SEQ ID NO: 2548061 - DNA, 18 bp, Homo sapiens
agacaattctttatacaa

SEQ ID NO: 2548062 - DNA, 22 bp, Homo sapiens
agacaattctttatacaacagt

SEQ ID NO: 2548063 - DNA, 14 bp, Homo sapiens
agacaatttattat

SEQ ID NO: 2548064 - DNA, 15 bp, Homo sapiens
agacaatttattatg

SEQ ID NO: 2548065 - DNA, 15 bp, Homo sapiens
agacacaacaactcc

SEQ ID NO: 2548066 - DNA, 11 bp, Homo sapiens
agacacacaca

SEQ ID NO: 2548067 - DNA, 18 bp, Homo sapiens
agacacacgcacacacac

SEQ ID NO: 2548068 - DNA, 12 bp, Homo sapiens
agacacaggccc

SEQ ID NO: 2548069 - DNA, 13 bp, Homo sapiens
agacacaggcccg

SEQ ID NO: 2548070 - DNA, 21 bp, Homo sapiens
agacacaggcccggctccagg

SEQ ID NO: 2548071 - DNA, 16 bp, Homo sapiens
agacacatgtccaaga

SEQ ID NO: 2548072 - DNA, 20 bp, Homo sapiens
agacacatgtccaagaagcc

SEQ ID NO: 2548073 - DNA, 13 bp, Homo sapiens
agacaccagagca

SEQ ID NO: 2548074 - DNA, 21 bp, Homo sapiens
agacaccatcttttgtgagat

SEQ ID NO: 2548075 - DNA, 22 bp, Homo sapiens
agacaccgccacatggcttcct

SEQ ID NO: 2548076 - DNA, 18 bp, Homo sapiens
agacaccttgacagggca

SEQ ID NO: 2548077 - DNA, 15 bp, Homo sapiens
agacactaagttata

SEQ ID NO: 2548078 - DNA, 13 bp, Homo sapiens
agacactctggct

SEQ ID NO: 2548079 - DNA, 16 bp, Homo sapiens
agacactctggctggt

SEQ ID NO: 2548080 - DNA, 21 bp, Homo sapiens
agacactgaaatatacacaca

SEQ ID NO: 2548081 - DNA, 20 bp, Homo sapiens
agacactgccacacagggtc

SEQ ID NO: 2548082 - DNA, 18 bp, Homo sapiens
agacactgtttacaagaa

SEQ ID NO: 2548083 - DNA, 19 bp, Homo sapiens
agacactgtttacaagaaa

SEQ ID NO: 2548084 - DNA, 15 bp, Homo sapiens
agacacttgccttct

SEQ ID NO: 2548085 - DNA, 17 bp, Homo sapiens
agacagaacccctacat

SEQ ID NO: 2548086 - DNA, 18 bp, Homo sapiens
agacagaaccttgttatt

SEQ ID NO: 2548087 - DNA, 15 bp, Homo sapiens
agacagagctcacaa

SEQ ID NO: 2548088 - DNA, 12 bp, Homo sapiens
agacagagctgg

SEQ ID NO: 2548089 - DNA, 15 bp, Homo sapiens
agacagatactcctc

SEQ ID NO: 2548090 - DNA, 21 bp, Homo sapiens
agacagatactcctccaaggt

SEQ ID NO: 2548091 - DNA, 22 bp, Homo sapiens
agacagatactcctccaaggtt

SEQ ID NO: 2548092 - DNA, 15 bp, Homo sapiens
agacagatgccccag

SEQ ID NO: 2548093 - DNA, 19 bp, Homo sapiens
agacagatgccccagagct

SEQ ID NO: 2548094 - DNA, 14 bp, Homo sapiens
agacagcagctcag

SEQ ID NO: 2548095 - DNA, 16 bp, Homo sapiens
agacagcccgggctct

SEQ ID NO: 2548096 - DNA, 17 bp, Homo sapiens
agacagcccgggctctg

SEQ ID NO: 2548097 - DNA, 18 bp, Homo sapiens
agacagcccgggctctgc

SEQ ID NO: 2548098 - DNA, 21 bp, Homo sapiens
agacagcccgggctctgcctc

SEQ ID NO: 2548099 - DNA, 23 bp, Homo sapiens
agacagcccgggctctgcctccc

SEQ ID NO: 2548100 - DNA, 13 bp, Homo sapiens
agacagctgcctg

SEQ ID NO: 2548101 - DNA, 15 bp, Homo sapiens
agacagctgcctggg

SEQ ID NO: 2548102 - DNA, 22 bp, Homo sapiens
agacagcttctcatcctgcagg

SEQ ID NO: 2548103 - DNA, 23 bp, Homo sapiens
agacagcttctcatcctgcaggc

SEQ ID NO: 2548104 - DNA, 21 bp, Homo sapiens
agacaggacagtgcttcagcc

SEQ ID NO: 2548105 - DNA, 16 bp, Homo sapiens
agacaggacctaggat

SEQ ID NO: 2548106 - DNA, 15 bp, Homo sapiens
agacaggcccaagag

SEQ ID NO: 2548107 - DNA, 22 bp, Homo sapiens
agacaggcccaagagatgaaga

SEQ ID NO: 2548108 - DNA, 19 bp, Homo sapiens
agacagggtttcaccatgt

SEQ ID NO: 2548109 - DNA, 21 bp, Homo sapiens
agacagggttttgccatgttg

SEQ ID NO: 2548110 - DNA, 17 bp, Homo sapiens
agacagtcaccccagga

SEQ ID NO: 2548111 - DNA, 17 bp, Homo sapiens
agacagtccagcctgga

SEQ ID NO: 2548112 - DNA, 13 bp, Homo sapiens
agacagtccctgc

SEQ ID NO: 2548113 - DNA, 15 bp, Homo sapiens
agacagtgggaaata

SEQ ID NO: 2548114 - DNA, 14 bp, Homo sapiens
agacagttcaagaa

SEQ ID NO: 2548115 - DNA, 14 bp, Homo sapiens
agacagtttcttag

SEQ ID NO: 2548116 - DNA, 23 bp, Homo sapiens
agacatactaaccagcagaaatg

SEQ ID NO: 2548117 - DNA, 14 bp, Homo sapiens
agacatagaattaa

SEQ ID NO: 2548118 - DNA, 18 bp, Homo sapiens
agacataggccatgaaaa

SEQ ID NO: 2548119 - DNA, 17 bp, Homo sapiens
agacatcaacagataaa

SEQ ID NO: 2548120 - DNA, 17 bp, Homo sapiens
agacatcaagcacagaa

SEQ ID NO: 2548121 - DNA, 16 bp, Homo sapiens
agacatctctgcaccc

SEQ ID NO: 2548122 - DNA, 20 bp, Homo sapiens
agacatgagtgcgtgctcag

SEQ ID NO: 2548123 - DNA, 13 bp, Homo sapiens
agacatggagact

SEQ ID NO: 2548124 - DNA, 19 bp, Homo sapiens
agacatggagactcctgcc

SEQ ID NO: 2548125 - DNA, 22 bp, Homo sapiens
agacatggcttgccacagctct

SEQ ID NO: 2548126 - DNA, 20 bp, Homo sapiens
agacatgtctgttctacata

SEQ ID NO: 2548127 - DNA, 12 bp, Homo sapiens
agacattaaatc

SEQ ID NO: 2548128 - DNA, 22 bp, Homo sapiens
agacattaaatctatgaagtat

SEQ ID NO: 2548129 - DNA, 14 bp, Homo sapiens
agacattctgccag

SEQ ID NO: 2548130 - DNA, 15 bp, Homo sapiens
agacattctgccagg

SEQ ID NO: 2548131 - DNA, 19 bp, Homo sapiens
agacattctgccaggcccc

SEQ ID NO: 2548132 - DNA, 21 bp, Homo sapiens
agacatttgctatgagctggg

SEQ ID NO: 2548133 - DNA, 14 bp, Homo sapiens
agaccaaggcggga

SEQ ID NO: 2548134 - DNA, 16 bp, Homo sapiens
agaccacaaaaattga

SEQ ID NO: 2548135 - DNA, 23 bp, Homo sapiens
agaccacatctttatctgttctt

SEQ ID NO: 2548136 - DNA, 16 bp, Homo sapiens
agaccaccacctcaga

SEQ ID NO: 2548137 - DNA, 14 bp, Homo sapiens
agaccagactgtgg

SEQ ID NO: 2548138 - DNA, 18 bp, Homo sapiens
agaccagactgtggagaa

SEQ ID NO: 2548139 - DNA, 12 bp, Homo sapiens
agaccagcctgg

SEQ ID NO: 2548140 - DNA, 15 bp, Homo sapiens
agaccagcctggcca

SEQ ID NO: 2548141 - DNA, 14 bp, Homo sapiens
agaccagtctggcc

SEQ ID NO: 2548142 - DNA, 22 bp, Homo sapiens
agaccagttgggagcactggag

SEQ ID NO: 2548143 - DNA, 21 bp, Homo sapiens
agaccatccctgaaggccccg

SEQ ID NO: 2548144 - DNA, 17 bp, Homo sapiens
agacccagccctcatcc

SEQ ID NO: 2548145 - DNA, 19 bp, Homo sapiens
agacccagccctcatcccg

SEQ ID NO: 2548146 - DNA, 23 bp, Homo sapiens
agaccccacccaagcttggcagc

SEQ ID NO: 2548147 - DNA, 15 bp, Homo sapiens
agacccccacacctc

SEQ ID NO: 2548148 - DNA, 11 bp, Homo sapiens
agacccccacc

SEQ ID NO: 2548149 - DNA, 14 bp, Homo sapiens
agacccccacccct

SEQ ID NO: 2548150 - DNA, 20 bp, Homo sapiens
agacccccagcaaccctcct

SEQ ID NO: 2548151 - DNA, 12 bp, Homo sapiens
agacccctggcc

SEQ ID NO: 2548152 - DNA, 14 bp, Homo sapiens
agacccctggcctc

SEQ ID NO: 2548153 - DNA, 16 bp, Homo sapiens
agacccctggcctccg

SEQ ID NO: 2548154 - DNA, 14 bp, Homo sapiens
agacccggctgcgt

SEQ ID NO: 2548155 - DNA, 13 bp, Homo sapiens
agaccctgccctg

SEQ ID NO: 2548156 - DNA, 17 bp, Homo sapiens
agacccttattacacgg

SEQ ID NO: 2548157 - DNA, 22 bp, Homo sapiens
agacccttgtggtcccacccca

SEQ ID NO: 2548158 - DNA, 23 bp, Homo sapiens
agacccttgtggtcccaccccac

SEQ ID NO: 2548159 - DNA, 23 bp, Homo sapiens
agacctacctcaggttgctggtt

SEQ ID NO: 2548160 - DNA, 19 bp, Homo sapiens
agacctagggaggacctta

SEQ ID NO: 2548161 - DNA, 19 bp, Homo sapiens
agacctcagcctgtgctgc

SEQ ID NO: 2548162 - DNA, 19 bp, Homo sapiens
agacctcatcaggatgaac

SEQ ID NO: 2548163 - DNA, 22 bp, Homo sapiens
agacctcatcaggatgaaccca

SEQ ID NO: 2548164 - DNA, 15 bp, Homo sapiens
agacctgaattcttt

SEQ ID NO: 2548165 - DNA, 17 bp, Homo sapiens
agacctgacaagcactg

SEQ ID NO: 2548166 - DNA, 20 bp, Homo sapiens
agacctgctgagggaccagc

SEQ ID NO: 2548167 - DNA, 19 bp, Homo sapiens
agacctggagcccctgggt

SEQ ID NO: 2548168 - DNA, 22 bp, Homo sapiens
agacctggcaaggacacagatg

SEQ ID NO: 2548169 - DNA, 16 bp, Homo sapiens
agaccttctccaaatg

SEQ ID NO: 2548170 - DNA, 17 bp, Homo sapiens
agacgaggccctcgggc

SEQ ID NO: 2548171 - DNA, 22 bp, Homo sapiens
agacgaggccctcgggcccagc

SEQ ID NO: 2548172 - DNA, 17 bp, Homo sapiens
agacgatgtcttcatac

SEQ ID NO: 2548173 - DNA, 19 bp, Homo sapiens
agacgatgtcttcatacct

SEQ ID NO: 2548174 - DNA, 13 bp, Homo sapiens
agacgcctgagga

SEQ ID NO: 2548175 - DNA, 17 bp, Homo sapiens
agacgctgtgctgccct

SEQ ID NO: 2548176 - DNA, 22 bp, Homo sapiens
agacgctgtgctgccctgccca

SEQ ID NO: 2548177 - DNA, 18 bp, Homo sapiens
agacggagtcccaccttg

SEQ ID NO: 2548178 - DNA, 19 bp, Homo sapiens
agacggagtcccaccttgg

SEQ ID NO: 2548179 - DNA, 16 bp, Homo sapiens
agacgtatgcttattt

SEQ ID NO: 2548180 - DNA, 18 bp, Homo sapiens
agacgtatgcttatttta

SEQ ID NO: 2548181 - DNA, 19 bp, Homo sapiens
agacgtatgcttattttaa

SEQ ID NO: 2548182 - DNA, 17 bp, Homo sapiens
agacgtgattttgctgt

SEQ ID NO: 2548183 - DNA, 19 bp, Homo sapiens
agacgtgtggcaatagtgg

SEQ ID NO: 2548184 - DNA, 19 bp, Homo sapiens
agactaattcctgccctgc

SEQ ID NO: 2548185 - DNA, 15 bp, Homo sapiens
agactaatttaaaaa

SEQ ID NO: 2548186 - DNA, 18 bp, Homo sapiens
agactatctaaatgttga

SEQ ID NO: 2548187 - DNA, 12 bp, Homo sapiens
agactcagggcc

SEQ ID NO: 2548188 - DNA, 20 bp, Homo sapiens
agactcagggccccagcact

SEQ ID NO: 2548189 - DNA, 21 bp, Homo sapiens
agactcagggccccagcacta

SEQ ID NO: 2548190 - DNA, 12 bp, Homo sapiens
agactcagtttg

SEQ ID NO: 2548191 - DNA, 15 bp, Homo sapiens
agactcagtttgtca

SEQ ID NO: 2548192 - DNA, 16 bp, Homo sapiens
agactcatcttactgt

SEQ ID NO: 2548193 - DNA, 18 bp, Homo sapiens
agactcatcttactgtac

SEQ ID NO: 2548194 - DNA, 18 bp, Homo sapiens
agactcattcttctgtac

SEQ ID NO: 2548195 - DNA, 12 bp, Homo sapiens
agactccaaaga

SEQ ID NO: 2548196 - DNA, 13 bp, Homo sapiens
agactccaaagaa

SEQ ID NO: 2548197 - DNA, 14 bp, Homo sapiens
agactcctaggcag

SEQ ID NO: 2548198 - DNA, 23 bp, Homo sapiens
agactcctcctccaaaggccccc

SEQ ID NO: 2548199 - DNA, 22 bp, Homo sapiens
agactcctgaggacagctgtcc

SEQ ID NO: 2548200 - DNA, 15 bp, Homo sapiens
agactcctgcaggca

SEQ ID NO: 2548201 - DNA, 17 bp, Homo sapiens
agactcctgcaggcagc

SEQ ID NO: 2548202 - DNA, 18 bp, Homo sapiens
agactcctgcaggcagcc

SEQ ID NO: 2548203 - DNA, 14 bp, Homo sapiens
agactcctgccctg

SEQ ID NO: 2548204 - DNA, 23 bp, Homo sapiens
agactcgattcatattgaatata

SEQ ID NO: 2548205 - DNA, 19 bp, Homo sapiens
agactctacccatattaca

SEQ ID NO: 2548206 - DNA, 21 bp, Homo sapiens
agactctaggacataaattag

SEQ ID NO: 2548207 - DNA, 20 bp, Homo sapiens
agactctgaaatctcagaat

SEQ ID NO: 2548208 - DNA, 19 bp, Homo sapiens
agactctggtcttctttgg

SEQ ID NO: 2548209 - DNA, 17 bp, Homo sapiens
agactgaacatgtacac

SEQ ID NO: 2548210 - DNA, 22 bp, Homo sapiens
agactgaccaatattgtacagt

SEQ ID NO: 2548211 - DNA, 16 bp, Homo sapiens
agactgagcacctgct

SEQ ID NO: 2548212 - DNA, 17 bp, Homo sapiens
agactgagcacctgctt

SEQ ID NO: 2548213 - DNA, 13 bp, Homo sapiens
agactgagctcaa

SEQ ID NO: 2548214 - DNA, 22 bp, Homo sapiens
agactgcgggatggtcctgggg

SEQ ID NO: 2548215 - DNA, 14 bp, Homo sapiens
agactgctgggact

SEQ ID NO: 2548216 - DNA, 15 bp, Homo sapiens
agactgctgggactg

SEQ ID NO: 2548217 - DNA, 20 bp, Homo sapiens
agactgctgggactggccag

SEQ ID NO: 2548218 - DNA, 19 bp, Homo sapiens
agactgcttccaattttct

SEQ ID NO: 2548219 - DNA, 21 bp, Homo sapiens
agactgcttcccatcctaccc

SEQ ID NO: 2548220 - DNA, 19 bp, Homo sapiens
agactggaagcacagcttc

SEQ ID NO: 2548221 - DNA, 14 bp, Homo sapiens
agactggagcatct

SEQ ID NO: 2548222 - DNA, 18 bp, Homo sapiens
agactggagcatctgact

SEQ ID NO: 2548223 - DNA, 15 bp, Homo sapiens
agactggatactgcc

SEQ ID NO: 2548224 - DNA, 23 bp, Homo sapiens
agactggcacagttttctgagaa

SEQ ID NO: 2548225 - DNA, 17 bp, Homo sapiens
agactggtcctgtgtgc

SEQ ID NO: 2548226 - DNA, 14 bp, Homo sapiens
agactgtaatgaat

SEQ ID NO: 2548227 - DNA, 11 bp, Homo sapiens
agactgtgtat

SEQ ID NO: 2548228 - DNA, 14 bp, Homo sapiens
agactgttgctcaa

SEQ ID NO: 2548229 - DNA, 23 bp, Homo sapiens
agacttaatagaaacattgaaga

SEQ ID NO: 2548230 - DNA, 15 bp, Homo sapiens
agacttaccaggaag

SEQ ID NO: 2548231 - DNA, 19 bp, Homo sapiens
agacttactttactcattt

SEQ ID NO: 2548232 - DNA, 15 bp, Homo sapiens
agacttccctgaatg

SEQ ID NO: 2548233 - DNA, 13 bp, Homo sapiens
agacttgctctct

SEQ ID NO: 2548234 - DNA, 17 bp, Homo sapiens
agacttggcaacagaag

SEQ ID NO: 2548235 - DNA, 19 bp, Homo sapiens
agacttggcaacagaagca

SEQ ID NO: 2548236 - DNA, 15 bp, Homo sapiens
agacttgggacattg

SEQ ID NO: 2548237 - DNA, 18 bp, Homo sapiens
agacttgtatgaaagatg

SEQ ID NO: 2548238 - DNA, 19 bp, Homo sapiens
agactttacatgacacagc

SEQ ID NO: 2548239 - DNA, 23 bp, Homo sapiens
agactttggaaaatgcattgtat

SEQ ID NO: 2548240 - DNA, 14 bp, Homo sapiens
agactttggaaaga

SEQ ID NO: 2548241 - DNA, 15 bp, Homo sapiens
agactttggaaagac

SEQ ID NO: 2548242 - DNA, 15 bp, Homo sapiens
agagaaaaacaaatt

SEQ ID NO: 2548243 - DNA, 21 bp, Homo sapiens
agagaaaagaaaaaaaaagaa

SEQ ID NO: 2548244 - DNA, 18 bp, Homo sapiens
agagaaaataaaaagtta

SEQ ID NO: 2548245 - DNA, 16 bp, Homo sapiens
agagaaagaaaatgaa

SEQ ID NO: 2548246 - DNA, 15 bp, Homo sapiens
agagaaagaagagac

SEQ ID NO: 2548247 - DNA, 16 bp, Homo sapiens
agagaaagaagagaca

SEQ ID NO: 2548248 - DNA, 19 bp, Homo sapiens
agagaaagtgatttctaga

SEQ ID NO: 2548249 - DNA, 15 bp, Homo sapiens
agagaaccgagcaaa

SEQ ID NO: 2548250 - DNA, 20 bp, Homo sapiens
agagaaccgagcaaagatca

SEQ ID NO: 2548251 - DNA, 23 bp, Homo sapiens
agagaacctcacgcacctcccat

SEQ ID NO: 2548252 - DNA, 15 bp, Homo sapiens
agagaacgcagccct

SEQ ID NO: 2548253 - DNA, 16 bp, Homo sapiens
agagaagcaagtggtg

SEQ ID NO: 2548254 - DNA, 13 bp, Homo sapiens
agagaagcccctt

SEQ ID NO: 2548255 - DNA, 20 bp, Homo sapiens
agagaagccccttccccatg

SEQ ID NO: 2548256 - DNA, 20 bp, Homo sapiens
agagaagctaaaacctgagc

SEQ ID NO: 2548257 - DNA, 13 bp, Homo sapiens
agagaaggagcca

SEQ ID NO: 2548258 - DNA, 15 bp, Homo sapiens
agagaagtgcccctg

SEQ ID NO: 2548259 - DNA, 17 bp, Homo sapiens
agagaagtgcccctgct

SEQ ID NO: 2548260 - DNA, 20 bp, Homo sapiens
agagaatcaacatttctcaa

SEQ ID NO: 2548261 - DNA, 23 bp, Homo sapiens
agagaatccctagtcttcaagca

SEQ ID NO: 2548262 - DNA, 18 bp, Homo sapiens
agagaatgaaagggccca

SEQ ID NO: 2548263 - DNA, 22 bp, Homo sapiens
agagaatgaaattgctgaaaga

SEQ ID NO: 2548264 - DNA, 20 bp, Homo sapiens
agagacaaacacctcccagg

SEQ ID NO: 2548265 - DNA, 20 bp, Homo sapiens
agagacagaagcaggctgga

SEQ ID NO: 2548266 - DNA, 14 bp, Homo sapiens
agagacaggagggc

SEQ ID NO: 2548267 - DNA, 15 bp, Homo sapiens
agagacaggcccaag

SEQ ID NO: 2548268 - DNA, 12 bp, Homo sapiens
agagacagtcac

SEQ ID NO: 2548269 - DNA, 14 bp, Homo sapiens
agagacattcctcc

SEQ ID NO: 2548270 - DNA, 13 bp, Homo sapiens
agagaccatccct

SEQ ID NO: 2548271 - DNA, 19 bp, Homo sapiens
agagaccatccctgaaggc

SEQ ID NO: 2548272 - DNA, 21 bp, Homo sapiens
agagacccccggaacaagcct

SEQ ID NO: 2548273 - DNA, 13 bp, Homo sapiens
agagacctcatca

SEQ ID NO: 2548274 - DNA, 16 bp, Homo sapiens
agagacctcatcagga

SEQ ID NO: 2548275 - DNA, 14 bp, Homo sapiens
agagacgtgtacat

SEQ ID NO: 2548276 - DNA, 12 bp, Homo sapiens
agagactcctgc

SEQ ID NO: 2548277 - DNA, 20 bp, Homo sapiens
agagacttgggacattgcct

SEQ ID NO: 2548278 - DNA, 19 bp, Homo sapiens
agagacttttaatcagaca

SEQ ID NO: 2548279 - DNA, 13 bp, Homo sapiens
agagagaaaaaca

SEQ ID NO: 2548280 - DNA, 11 bp, Homo sapiens
agagagaaaat

SEQ ID NO: 2548281 - DNA, 20 bp, Homo sapiens
agagagaacaactactgtga

SEQ ID NO: 2548282 - DNA, 13 bp, Homo sapiens
agagagagaagtg

SEQ ID NO: 2548283 - DNA, 14 bp, Homo sapiens
agagagatgttttg

SEQ ID NO: 2548284 - DNA, 11 bp, Homo sapiens
agagagcaaga

SEQ ID NO: 2548285 - DNA, 18 bp, Homo sapiens
agagagcacccctctctg

SEQ ID NO: 2548286 - DNA, 15 bp, Homo sapiens
agagagccattttgt

SEQ ID NO: 2548287 - DNA, 12 bp, Homo sapiens
agagagctggta

SEQ ID NO: 2548288 - DNA, 23 bp, Homo sapiens
agagagctggtagttagtagcat

SEQ ID NO: 2548289 - DNA, 17 bp, Homo sapiens
agagagctgttcccaaa

SEQ ID NO: 2548290 - DNA, 23 bp, Homo sapiens
agagaggaaaggtttgagaagca

SEQ ID NO: 2548291 - DNA, 20 bp, Homo sapiens
agagaggagtcagagagaat

SEQ ID NO: 2548292 - DNA, 17 bp, Homo sapiens
agagaggagttcaatga

SEQ ID NO: 2548293 - DNA, 16 bp, Homo sapiens
agagaggccttgtccc

SEQ ID NO: 2548294 - DNA, 16 bp, Homo sapiens
agagagggagaagaag

SEQ ID NO: 2548295 - DNA, 19 bp, Homo sapiens
agagaggggtacatttccc

SEQ ID NO: 2548296 - DNA, 21 bp, Homo sapiens
agagagggtggtgacctctgc

SEQ ID NO: 2548297 - DNA, 13 bp, Homo sapiens
agagatattttaa

SEQ ID NO: 2548298 - DNA, 17 bp, Homo sapiens
agagatattttaaaatg

SEQ ID NO: 2548299 - DNA, 20 bp, Homo sapiens
agagatattttaaaatgaga

SEQ ID NO: 2548300 - DNA, 22 bp, Homo sapiens
agagatcaaccccttcgctcct

SEQ ID NO: 2548301 - DNA, 19 bp, Homo sapiens
agagatgggagctcctctc

SEQ ID NO: 2548302 - DNA, 15 bp, Homo sapiens
agagatgtgcaccca

SEQ ID NO: 2548303 - DNA, 16 bp, Homo sapiens
agagattacctcctga

SEQ ID NO: 2548304 - DNA, 21 bp, Homo sapiens
agagattggaatgggcagctc

SEQ ID NO: 2548305 - DNA, 16 bp, Homo sapiens
agagattgtggtttca

SEQ ID NO: 2548306 - DNA, 16 bp, Homo sapiens
agagatttaattaatc

SEQ ID NO: 2548307 - DNA, 12 bp, Homo sapiens
agagatttcaag

SEQ ID NO: 2548308 - DNA, 12 bp, Homo sapiens
agaaagaagaga

SEQ ID NO: 2548309 - DNA, 15 bp, Homo sapiens
agaaagaagatgaat

SEQ ID NO: 2548310 - DNA, 16 bp, Homo sapiens
agaaagactattcaaa

SEQ ID NO: 2548311 - DNA, 19 bp, Homo sapiens
agaaagactattcaaacag

SEQ ID NO: 2548312 - DNA, 18 bp, Homo sapiens
agaaagagagaaaataaa

SEQ ID NO: 2548313 - DNA, 22 bp, Homo sapiens
agaaagagagaaaataaaaagt

SEQ ID NO: 2548314 - DNA, 17 bp, Homo sapiens
agaaagatcattgaaat

SEQ ID NO: 2548315 - DNA, 15 bp, Homo sapiens
agaaagcaaaattat

SEQ ID NO: 2548316 - DNA, 18 bp, Homo sapiens
agaaagcagaacagtgat

SEQ ID NO: 2548317 - DNA, 20 bp, Homo sapiens
agaaagcagaacagtgatta

SEQ ID NO: 2548318 - DNA, 14 bp, Homo sapiens
agaaagcataaaat

SEQ ID NO: 2548319 - DNA, 21 bp, Homo sapiens
agaaagccaaatcaaaatatg

SEQ ID NO: 2548320 - DNA, 13 bp, Homo sapiens
agaaagctgcctg

SEQ ID NO: 2548321 - DNA, 20 bp, Homo sapiens
agaaagctggtaaactattt

SEQ ID NO: 2548322 - DNA, 15 bp, Homo sapiens
agaaaggactctggg

SEQ ID NO: 2548323 - DNA, 14 bp, Homo sapiens
agaaagggtgtttt

SEQ ID NO: 2548324 - DNA, 19 bp, Homo sapiens
agaaagtggaaaacaagga

SEQ ID NO: 2548325 - DNA, 14 bp, Homo sapiens
agaaagtggtgctc

SEQ ID NO: 2548326 - DNA, 17 bp, Homo sapiens
agaaagtggtgctcagt

SEQ ID NO: 2548327 - DNA, 16 bp, Homo sapiens
agaaagtgtgagcaaa

SEQ ID NO: 2548328 - DNA, 20 bp, Homo sapiens
agaaagttgcacggctgctg

SEQ ID NO: 2548329 - DNA, 23 bp, Homo sapiens
agagggtggtgacctctgcctga

SEQ ID NO: 2548330 - DNA, 16 bp, Homo sapiens
agaggtaacagaacag

SEQ ID NO: 2548331 - DNA, 17 bp, Homo sapiens
agaggtaacagaacagc

SEQ ID NO: 2548332 - DNA, 20 bp, Homo sapiens
agaggtaacagaacagcttc

SEQ ID NO: 2548333 - DNA, 22 bp, Homo sapiens
agaggtaacagaacagcttcag

SEQ ID NO: 2548334 - DNA, 12 bp, Homo sapiens
agaggtgccagc

SEQ ID NO: 2548335 - DNA, 18 bp, Homo sapiens
agaggtggccagagctgg

SEQ ID NO: 2548336 - DNA, 12 bp, Homo sapiens
agaggtgggcag

SEQ ID NO: 2548337 - DNA, 16 bp, Homo sapiens
agaggtggggagcaga

SEQ ID NO: 2548338 - DNA, 20 bp, Homo sapiens
agaggttatctgtcccaggt

SEQ ID NO: 2548339 - DNA, 16 bp, Homo sapiens
agaggttcaaagatat

SEQ ID NO: 2548340 - DNA, 20 bp, Homo sapiens
agaggttcaaagatattttg

SEQ ID NO: 2548341 - DNA, 13 bp, Homo sapiens
agaggtttcagtg

SEQ ID NO: 2548342 - DNA, 19 bp, Homo sapiens
agaggttttaaagtgatta

SEQ ID NO: 2548343 - DNA, 19 bp, Homo sapiens
agagtacagtgagccaaga

SEQ ID NO: 2548344 - DNA, 14 bp, Homo sapiens
agagtagcatttca

SEQ ID NO: 2548345 - DNA, 23 bp, Homo sapiens
agagtattggtctcctctcagcc

SEQ ID NO: 2548346 - DNA, 17 bp, Homo sapiens
agagtcatattttgatt

SEQ ID NO: 2548347 - DNA, 18 bp, Homo sapiens
agagtcatctccatcagc

SEQ ID NO: 2548348 - DNA, 12 bp, Homo sapiens
agatgccccaga

SEQ ID NO: 2548349 - DNA, 22 bp, Homo sapiens
agatgcctccaccccccagaac

SEQ ID NO: 2548350 - DNA, 11 bp, Homo sapiens
agatgctgatg

SEQ ID NO: 2548351 - DNA, 14 bp, Homo sapiens
agatgctgatgttc

SEQ ID NO: 2548352 - DNA, 16 bp, Homo sapiens
agatgctgatgttcag

SEQ ID NO: 2548353 - DNA, 18 bp, Homo sapiens
agatgctgatgttcagtg

SEQ ID NO: 2548354 - DNA, 23 bp, Homo sapiens
agatgctgggttggtgcacagtg

SEQ ID NO: 2548355 - DNA, 15 bp, Homo sapiens
agatgcttctcactg

SEQ ID NO: 2548356 - DNA, 12 bp, Homo sapiens
agatgcttctgg

SEQ ID NO: 2548357 - DNA, 16 bp, Homo sapiens
agatgcttttctgtct

SEQ ID NO: 2548358 - DNA, 22 bp, Homo sapiens
agatggaacccttttggccccc

SEQ ID NO: 2548359 - DNA, 14 bp, Homo sapiens
agatggcactttga

SEQ ID NO: 2548360 - DNA, 19 bp, Homo sapiens
agatggcatcctgtgaagt

SEQ ID NO: 2548361 - DNA, 17 bp, Homo sapiens
agatggctgtgcctctg

SEQ ID NO: 2548362 - DNA, 18 bp, Homo sapiens
agatggctgtgcctctgc

SEQ ID NO: 2548363 - DNA, 22 bp, Homo sapiens
agatggctgtgcctctgcctgt

SEQ ID NO: 2548364 - DNA, 15 bp, Homo sapiens
agatgggaatgaagc

SEQ ID NO: 2548365 - DNA, 23 bp, Homo sapiens
agatgggaatgaagcttgtgtat

SEQ ID NO: 2548366 - DNA, 16 bp, Homo sapiens
agatgggcttgttttc

SEQ ID NO: 2548367 - DNA, 18 bp, Homo sapiens
agatgggcttgttttctt

SEQ ID NO: 2548368 - DNA, 15 bp, Homo sapiens
agatggggcctctgt

SEQ ID NO: 2548369 - DNA, 23 bp, Homo sapiens
agatgggtctggctgagctgaac

SEQ ID NO: 2548370 - DNA, 22 bp, Homo sapiens
agatgggtgcttggaggaagga

SEQ ID NO: 2548371 - DNA, 14 bp, Homo sapiens
agatggtggcagta

SEQ ID NO: 2548372 - DNA, 22 bp, Homo sapiens
agatggttttataatctgattt

SEQ ID NO: 2548373 - DNA, 19 bp, Homo sapiens
agatgtagaggagaaactg

SEQ ID NO: 2548374 - DNA, 19 bp, Homo sapiens
agatgtagataaactcaga

SEQ ID NO: 2548375 - DNA, 18 bp, Homo sapiens
agatgtagatttatttca

SEQ ID NO: 2548376 - DNA, 18 bp, Homo sapiens
agatgtcagactggctgg

SEQ ID NO: 2548377 - DNA, 20 bp, Homo sapiens
agatgtcagccgagccgggc

SEQ ID NO: 2548378 - DNA, 20 bp, Homo sapiens
agcacctgcttcatgctcag

SEQ ID NO: 2548379 - DNA, 20 bp, Homo sapiens
agcaccttagacagtccctg

SEQ ID NO: 2548380 - DNA, 21 bp, Homo sapiens
agcaccttagacagtccctgc

SEQ ID NO: 2548381 - DNA, 16 bp, Homo sapiens
agcaccttcctcactt

SEQ ID NO: 2548382 - DNA, 17 bp, Homo sapiens
agcacgaaatgttattt

SEQ ID NO: 2548383 - DNA, 14 bp, Homo sapiens
agcacgatttctgt

SEQ ID NO: 2548384 - DNA, 16 bp, Homo sapiens
agcacgatttctgttt

SEQ ID NO: 2548385 - DNA, 21 bp, Homo sapiens
agcacgatttctgtttagata

SEQ ID NO: 2548386 - DNA, 17 bp, Homo sapiens
agcactaaagcagtgga

SEQ ID NO: 2548387 - DNA, 17 bp, Homo sapiens
agcactacataaactga

SEQ ID NO: 2548388 - DNA, 14 bp, Homo sapiens
agcactatacagat

SEQ ID NO: 2548389 - DNA, 13 bp, Homo sapiens
agcactgatttca

SEQ ID NO: 2548390 - DNA, 23 bp, Homo sapiens
agcactggagtgcagggaggaga

SEQ ID NO: 2548391 - DNA, 13 bp, Homo sapiens
agcactggcctgc

SEQ ID NO: 2548392 - DNA, 17 bp, Homo sapiens
agcactggctctctcca

SEQ ID NO: 2548393 - DNA, 20 bp, Homo sapiens
agcactggctctctccagga

SEQ ID NO: 2548394 - DNA, 20 bp, Homo sapiens
agcactgtctcagtttcact

SEQ ID NO: 2548395 - DNA, 19 bp, Homo sapiens
agcactgtgctcagggcta

SEQ ID NO: 2548396 - DNA, 18 bp, Homo sapiens
agcacttggactcttgct

SEQ ID NO: 2548397 - DNA, 17 bp, Homo sapiens
agcacttggagccaagg

SEQ ID NO: 2548398 - DNA, 12 bp, Homo sapiens
agcactttggga

SEQ ID NO: 2548399 - DNA, 19 bp, Homo sapiens
agcactttgggaggccaag

SEQ ID NO: 2548400 - DNA, 21 bp, Homo sapiens
agcagaacggagccccaggcc

SEQ ID NO: 2548401 - DNA, 21 bp, Homo sapiens
agcagacagtgttttctggga

SEQ ID NO: 2548402 - DNA, 22 bp, Homo sapiens
agcagagaatgaaagggcccag

SEQ ID NO: 2548403 - DNA, 21 bp, Homo sapiens
agcagagaattctcttatcca

SEQ ID NO: 2548404 - DNA, 15 bp, Homo sapiens
agcagagacactaac

SEQ ID NO: 2548405 - DNA, 15 bp, Homo sapiens
agcagagaccatccc

SEQ ID NO: 2548406 - DNA, 17 bp, Homo sapiens
agcagagaccatccctg

SEQ ID NO: 2548407 - DNA, 15 bp, Homo sapiens
agcagagcaggggca

SEQ ID NO: 2548408 - DNA, 14 bp, Homo sapiens
agcagaggcactgg

SEQ ID NO: 2548409 - DNA, 13 bp, Homo sapiens
agcagaggcagcg

SEQ ID NO: 2548410 - DNA, 18 bp, Homo sapiens
agcagagggactttgtat

SEQ ID NO: 2548411 - DNA, 16 bp, Homo sapiens
agcagatcccagctca

SEQ ID NO: 2548412 - DNA, 14 bp, Homo sapiens
agcagatgcaaaga

SEQ ID NO: 2548413 - DNA, 17 bp, Homo sapiens
agcagatgcaaagaggc

SEQ ID NO: 2548414 - DNA, 19 bp, Homo sapiens
agcagatgcaatgactcag

SEQ ID NO: 2548415 - DNA, 16 bp, Homo sapiens
agcagatgcagagagc

SEQ ID NO: 2548416 - DNA, 20 bp, Homo sapiens
agcagccaagggatgaaaga

SEQ ID NO: 2548417 - DNA, 21 bp, Homo sapiens
agcagcccgctgagtggactg

SEQ ID NO: 2548418 - DNA, 14 bp, Homo sapiens
agcagccctaagga

SEQ ID NO: 2548419 - DNA, 23 bp, Homo sapiens
cagtagtctctgtgctttgactc

SEQ ID NO: 2548420 - DNA, 14 bp, Homo sapiens
cagtataattctgt

SEQ ID NO: 2548421 - DNA, 19 bp, Homo sapiens
cagtataattctgtactga

SEQ ID NO: 2548422 - DNA, 14 bp, Homo sapiens
cagtatcatgaagc

SEQ ID NO: 2548423 - DNA, 20 bp, Homo sapiens
cagtatctatatatgtgtat

SEQ ID NO: 2548424 - DNA, 15 bp, Homo sapiens
cagtatctcagggcc

SEQ ID NO: 2548425 - DNA, 20 bp, Homo sapiens
cagtatgagtcaatgtgcag

SEQ ID NO: 2548426 - DNA, 16 bp, Homo sapiens
cagtatgggttaggga

SEQ ID NO: 2548427 - DNA, 23 bp, Homo sapiens
cagtatgggttagggaaaacatt

SEQ ID NO: 2548428 - DNA, 18 bp, Homo sapiens
cagtattacttctgctac

SEQ ID NO: 2548429 - DNA, 17 bp, Homo sapiens
cagtattgaagcatttt

SEQ ID NO: 2548430 - DNA, 20 bp, Homo sapiens
cagtattgaagcattttata

SEQ ID NO: 2548431 - DNA, 17 bp, Homo sapiens
cagtattttggagaaat

SEQ ID NO: 2548432 - DNA, 15 bp, Homo sapiens
cagtcaaaacagaga

SEQ ID NO: 2548433 - DNA, 14 bp, Homo sapiens
cagtcaccccggcc

SEQ ID NO: 2548434 - DNA, 17 bp, Homo sapiens
cagtcaccccggccacc

SEQ ID NO: 2548435 - DNA, 21 bp, Homo sapiens
cagtcactgtccctcaaatga

SEQ ID NO: 2548436 - DNA, 22 bp, Homo sapiens
cagtcactgtccctcaaatgac

SEQ ID NO: 2548437 - DNA, 22 bp, Homo sapiens
cagtcagcctctctcccagtct

SEQ ID NO: 2548438 - DNA, 12 bp, Homo sapiens
cagtcaggggca

SEQ ID NO: 2548439 - DNA, 21 bp, Homo sapiens
cagtcaggtagttgcaattga

SEQ ID NO: 2548440 - DNA, 22 bp, Homo sapiens
cagtcatcttgaccaagcagga

SEQ ID NO: 2548441 - DNA, 13 bp, Homo sapiens
cagtcatgcataa

SEQ ID NO: 2548442 - DNA, 15 bp, Homo sapiens
cactgttctctgccc

SEQ ID NO: 2548443 - DNA, 17 bp, Homo sapiens
cactgttctctgccctc

SEQ ID NO: 2548444 - DNA, 21 bp, Homo sapiens
cactgttctctgccctccaag

SEQ ID NO: 2548445 - DNA, 16 bp, Homo sapiens
cactgttgaaaattat

SEQ ID NO: 2548446 - DNA, 18 bp, Homo sapiens
cactgttgaaaattattt

SEQ ID NO: 2548447 - DNA, 14 bp, Homo sapiens
cactgttgcccagg

SEQ ID NO: 2548448 - DNA, 17 bp, Homo sapiens
cactgttgcccaggctg

SEQ ID NO: 2548449 - DNA, 16 bp, Homo sapiens
cacttaaaaaatgtcc

SEQ ID NO: 2548450 - DNA, 13 bp, Homo sapiens
cacttaccttcaa

SEQ ID NO: 2548451 - DNA, 15 bp, Homo sapiens
cacttaccttcaata

SEQ ID NO: 2548452 - DNA, 19 bp, Homo sapiens
cacttaccttcaataaagt

SEQ ID NO: 2548453 - DNA, 21 bp, Homo sapiens
cacttaccttcaataaagtat

SEQ ID NO: 2548454 - DNA, 22 bp, Homo sapiens
cacttaccttcaataaagtatc

SEQ ID NO: 2548455 - DNA, 18 bp, Homo sapiens
cacttactgtttctgtca

SEQ ID NO: 2548456 - DNA, 17 bp, Homo sapiens
cacttacttaccctcac

SEQ ID NO: 2548457 - DNA, 15 bp, Homo sapiens
cacttagctatcaga

SEQ ID NO: 2548458 - DNA, 22 bp, Homo sapiens
cacttattggaactctgcttga

SEQ ID NO: 2548459 - DNA, 21 bp, Homo sapiens
cacttcaagtgaccaccagga

SEQ ID NO: 2548460 - DNA, 18 bp, Homo sapiens
cacttcacacacaggcaa

SEQ ID NO: 2548461 - DNA, 13 bp, Homo sapiens
cacttcacagagt

SEQ ID NO: 2548462 - DNA, 15 bp, Homo sapiens
cacttcacagagtgt

SEQ ID NO: 2548463 - DNA, 13 bp, Homo sapiens
cacttcagagagc

SEQ ID NO: 2548464 - DNA, 16 bp, Homo sapiens
cacttcagagagctgg

SEQ ID NO: 2548465 - DNA, 12 bp, Homo sapiens
cacttcagctga

SEQ ID NO: 2548466 - DNA, 21 bp, Homo sapiens
cacttcagctgacttttctgt

SEQ ID NO: 2548467 - DNA, 14 bp, Homo sapiens
cacttcataatcca

SEQ ID NO: 2548468 - DNA, 22 bp, Homo sapiens
cacttcattcttgaaagctgtg

SEQ ID NO: 2548469 - DNA, 22 bp, Homo sapiens
cacttcattgagagttttgtct

SEQ ID NO: 2548470 - DNA, 14 bp, Homo sapiens
cacttccaccagcc

SEQ ID NO: 2548471 - DNA, 20 bp, Homo sapiens
cacttccataatctggactc

SEQ ID NO: 2548472 - DNA, 13 bp, Homo sapiens
cacttcctgtcca

SEQ ID NO: 2548473 - DNA, 14 bp, Homo sapiens
cacttcctgtccag

SEQ ID NO: 2548474 - DNA, 23 bp, Homo sapiens
cacttcgtgggatctgcccctcc

SEQ ID NO: 2548475 - DNA, 13 bp, Homo sapiens
cacttctgaccac

SEQ ID NO: 2548476 - DNA, 20 bp, Homo sapiens
cacttctgtgagacccccac

SEQ ID NO: 2548477 - DNA, 20 bp, Homo sapiens
cacttgaacccgggaggcag

SEQ ID NO: 2548478 - DNA, 13 bp, Homo sapiens
cacttgagaggat

SEQ ID NO: 2548479 - DNA, 22 bp, Homo sapiens
cacttgaggtcaggagttccta

SEQ ID NO: 2548480 - DNA, 13 bp, Homo sapiens
cacttgagtccag

SEQ ID NO: 2548481 - DNA, 12 bp, Homo sapiens
cacttgcatttc

SEQ ID NO: 2548482 - DNA, 17 bp, Homo sapiens
cacttggactcttgctc

SEQ ID NO: 2548483 - DNA, 19 bp, Homo sapiens
cacttggcccaagtggcag

SEQ ID NO: 2548484 - DNA, 20 bp, Homo sapiens
cacttggtgatatgtcctat

SEQ ID NO: 2548485 - DNA, 17 bp, Homo sapiens
cacttgtacaaaataaa

SEQ ID NO: 2548486 - DNA, 22 bp, Homo sapiens
cacttgtgggtttttgttttgt

SEQ ID NO: 2548487 - DNA, 23 bp, Homo sapiens
cacttgtgtgtgggctgtgagtg

SEQ ID NO: 2548488 - DNA, 15 bp, Homo sapiens
cacttgttccagctc

SEQ ID NO: 2548489 - DNA, 20 bp, Homo sapiens
cactttaattaccaacctgt

SEQ ID NO: 2548490 - DNA, 14 bp, Homo sapiens
cactttagatgctg

SEQ ID NO: 2548491 - DNA, 15 bp, Homo sapiens
cactttagatgctga

SEQ ID NO: 2548492 - DNA, 21 bp, Homo sapiens
cactttagatgctgatgattt

SEQ ID NO: 2548493 - DNA, 18 bp, Homo sapiens
cactttcagtgaaagcat

SEQ ID NO: 2548494 - DNA, 14 bp, Homo sapiens
cactttgcacagct

SEQ ID NO: 2548495 - DNA, 19 bp, Homo sapiens
cactttgctctgggtggaa

SEQ ID NO: 2548496 - DNA, 14 bp, Homo sapiens
cactttgggaggcc

SEQ ID NO: 2548497 - DNA, 16 bp, Homo sapiens
cactttgggaggccaa

SEQ ID NO: 2548498 - DNA, 19 bp, Homo sapiens
cactttggtacatggccag

SEQ ID NO: 2548499 - DNA, 20 bp, Homo sapiens
cactttggtacatggccagt

SEQ ID NO: 2548500 - DNA, 22 bp, Homo sapiens
cacttttgttcttggtttgtaa

SEQ ID NO: 2548501 - DNA, 20 bp, Homo sapiens
cactttttcatttgcctatt

SEQ ID NO: 2548502 - DNA, 16 bp, Homo sapiens
cagaaaaactctggga

SEQ ID NO: 2548503 - DNA, 21 bp, Homo sapiens
cagaaaaataacttcaagcaa

SEQ ID NO: 2548504 - DNA, 11 bp, Homo sapiens
cagaaaatata

SEQ ID NO: 2548505 - DNA, 15 bp, Homo sapiens
cagaaaatatactgt

SEQ ID NO: 2548506 - DNA, 16 bp, Homo sapiens
cagaaaatatactgta

SEQ ID NO: 2548507 - DNA, 17 bp, Homo sapiens
cagaaaatatactgtaa

SEQ ID NO: 2548508 - DNA, 20 bp, Homo sapiens
cagaaacaaaaacactaaaa

SEQ ID NO: 2548509 - DNA, 23 bp, Homo sapiens
cagaaacaccctcacactgggac

SEQ ID NO: 2548510 - DNA, 22 bp, Homo sapiens
cagaaacaggtgcatctgggga

SEQ ID NO: 2548511 - DNA, 19 bp, Homo sapiens
cagaaacatcagttactct

SEQ ID NO: 2548512 - DNA, 20 bp, Homo sapiens
cagaaacgaagtagaaaggg

SEQ ID NO: 2548513 - DNA, 19 bp, Homo sapiens
cagaaactgttcccacctg

SEQ ID NO: 2548514 - DNA, 24 bp, Homo sapiens
cagaaagaagtggggacagagcag

SEQ ID NO: 2548515 - DNA, 14 bp, Homo sapiens
cagaaagctgcctg

SEQ ID NO: 2548516 - DNA, 15 bp, Homo sapiens
cagaaagctgcctgg

SEQ ID NO: 2548517 - DNA, 17 bp, Homo sapiens
cagaaagggcaacaata

SEQ ID NO: 2548518 - DNA, 20 bp, Homo sapiens
cagaaaggttttcttctttt

SEQ ID NO: 2548519 - DNA, 23 bp, Homo sapiens
cagaaagtggccatgccaccctg

SEQ ID NO: 2548520 - DNA, 19 bp, Homo sapiens
cagaaagtggtgctcagtt

SEQ ID NO: 2548521 - DNA, 21 bp, Homo sapiens
cagaaagtggtgctcagttgt

SEQ ID NO: 2548522 - DNA, 22 bp, Homo sapiens
cagaaataccaaaattatttca

SEQ ID NO: 2548523 - DNA, 23 bp, Homo sapiens
cagaaatgagatcaggctctgcc

SEQ ID NO: 2548524 - DNA, 21 bp, Homo sapiens
cagaaatgctgcctgcctgtc

SEQ ID NO: 2548525 - DNA, 11 bp, Homo sapiens
cagaaatgtct

SEQ ID NO: 2548526 - DNA, 11 bp, Homo sapiens
cagaaattgga

SEQ ID NO: 2548527 - DNA, 22 bp, Homo sapiens
cagaaatttaattcatgtttct

SEQ ID NO: 2548528 - DNA, 14 bp, Homo sapiens
cagaaatttttatt

SEQ ID NO: 2548529 - DNA, 21 bp, Homo sapiens
cagaacactaacctgaccgtg

SEQ ID NO: 2548530 - DNA, 11 bp, Homo sapiens
cagaacactgt

SEQ ID NO: 2548531 - DNA, 12 bp, Homo sapiens
cagaacagccgc

SEQ ID NO: 2548532 - DNA, 15 bp, Homo sapiens
cagaacagcttcagg

SEQ ID NO: 2548533 - DNA, 11 bp, Homo sapiens
cagaacagtga

SEQ ID NO: 2548534 - DNA, 16 bp, Homo sapiens
cagaacatcattagaa

SEQ ID NO: 2548535 - DNA, 10 bp, Homo sapiens
cagaaccagg

SEQ ID NO: 2548536 - DNA, 16 bp, Homo sapiens
cagaacctcttcccca

SEQ ID NO: 2548537 - DNA, 20 bp, Homo sapiens
cagaacctggagggctagaa

SEQ ID NO: 2548538 - DNA, 14 bp, Homo sapiens
cagaacctgtcctt

SEQ ID NO: 2548539 - DNA, 16 bp, Homo sapiens
cagaaccttgttattt

SEQ ID NO: 2548540 - DNA, 17 bp, Homo sapiens
cagaaccttgttatttc

SEQ ID NO: 2548541 - DNA, 15 bp, Homo sapiens
cagaactagaatttg

SEQ ID NO: 2548542 - DNA, 19 bp, Homo sapiens
cagaactagaatttgatta

SEQ ID NO: 2548543 - DNA, 15 bp, Homo sapiens
cagaactctttcaaa

SEQ ID NO: 2548544 - DNA, 17 bp, Homo sapiens
catgttttaacaaaaac

SEQ ID NO: 2548545 - DNA, 23 bp, Homo sapiens
catgttttgtgactatatagaga

SEQ ID NO: 2548546 - DNA, 15 bp, Homo sapiens
catgttttgtttacg

SEQ ID NO: 2548547 - DNA, 12 bp, Homo sapiens
cattaaaacaat

SEQ ID NO: 2548548 - DNA, 21 bp, Homo sapiens
cattaaaacaatattgtttct

SEQ ID NO: 2548549 - DNA, 22 bp, Homo sapiens
cattaaaacaatattgtttcta

SEQ ID NO: 2548550 - DNA, 17 bp, Homo sapiens
cattaacagttttccat

SEQ ID NO: 2548551 - DNA, 16 bp, Homo sapiens
cattaagccctcttcc

SEQ ID NO: 2548552 - DNA, 17 bp, Homo sapiens
cattaagccctcttcca

SEQ ID NO: 2548553 - DNA, 17 bp, Homo sapiens
cattaatatttgctgac

SEQ ID NO: 2548554 - DNA, 23 bp, Homo sapiens
cattaatcaatcatctgtgtgaa

SEQ ID NO: 2548555 - DNA, 16 bp, Homo sapiens
cattacaaattgctta

SEQ ID NO: 2548556 - DNA, 21 bp, Homo sapiens
cattacagagaggagaaacac

SEQ ID NO: 2548557 - DNA, 22 bp, Homo sapiens
cattacagagaggagaaacaca

SEQ ID NO: 2548558 - DNA, 18 bp, Homo sapiens
cattaccagacggttcac

SEQ ID NO: 2548559 - DNA, 17 bp, Homo sapiens
cattaccttactgtgga

SEQ ID NO: 2548560 - DNA, 23 bp, Homo sapiens
cattactcaattgataaacattt

SEQ ID NO: 2548561 - DNA, 17 bp, Homo sapiens
cattagaaatagacagt

SEQ ID NO: 2548562 - DNA, 16 bp, Homo sapiens
cattagactcctcctc

SEQ ID NO: 2548563 - DNA, 13 bp, Homo sapiens
cattagagcaggc

SEQ ID NO: 2548564 - DNA, 22 bp, Homo sapiens
cattaggacaatcagtcccctc

SEQ ID NO: 2548565 - DNA, 13 bp, Homo sapiens
cattataaacgtg

SEQ ID NO: 2548566 - DNA, 14 bp, Homo sapiens
cattatcatgtgta

SEQ ID NO: 2548567 - DNA, 15 bp, Homo sapiens
cattatcatgtgtaa

SEQ ID NO: 2548568 - DNA, 22 bp, Homo sapiens
cattatcatgtgtaatcaataa

SEQ ID NO: 2548569 - DNA, 23 bp, Homo sapiens
cattatcgggagcagtgtcttcc

SEQ ID NO: 2548570 - DNA, 16 bp, Homo sapiens
cattatctagatactg

SEQ ID NO: 2548571 - DNA, 18 bp, Homo sapiens
cattatctagatactgta

SEQ ID NO: 2548572 - DNA, 16 bp, Homo sapiens
cattatgagaggcaat

SEQ ID NO: 2548573 - DNA, 21 bp, Homo sapiens
cattatgatgtgggtcaagga

SEQ ID NO: 2548574 - DNA, 14 bp, Homo sapiens
cattatgattcttt

SEQ ID NO: 2548575 - DNA, 17 bp, Homo sapiens
cattatgtccactgtgt

SEQ ID NO: 2548576 - DNA, 14 bp, Homo sapiens
cattattggaatta

SEQ ID NO: 2548577 - DNA, 18 bp, Homo sapiens
cattattggaattaacct

SEQ ID NO: 2548578 - DNA, 20 bp, Homo sapiens
cattattggaattaacctgg

SEQ ID NO: 2548579 - DNA, 20 bp, Homo sapiens
cattatttttccactttgtt

SEQ ID NO: 2548580 - DNA, 22 bp, Homo sapiens
cattatttttccactttgttct

SEQ ID NO: 2548581 - DNA, 17 bp, Homo sapiens
cattcaaaagttgaaat

SEQ ID NO: 2548582 - DNA, 17 bp, Homo sapiens
cattcaaccctggagag

SEQ ID NO: 2548583 - DNA, 19 bp, Homo sapiens
cattcaagtgtaaaatatt

SEQ ID NO: 2548584 - DNA, 21 bp, Homo sapiens
cattcaagtgtaaaatatttt

SEQ ID NO: 2548585 - DNA, 23 bp, Homo sapiens
cattcaagtgtaaaatattttga

SEQ ID NO: 2548586 - DNA, 21 bp, Homo sapiens
cattcaataagcatcaaactc

SEQ ID NO: 2548587 - DNA, 22 bp, Homo sapiens
cattcaataagcatcaaactct

SEQ ID NO: 2548588 - DNA, 13 bp, Homo sapiens
cattcaatgttta

SEQ ID NO: 2548589 - DNA, 20 bp, Homo sapiens
cattcacccagacagctccc

SEQ ID NO: 2548590 - DNA, 15 bp, Homo sapiens
cattcacttcataat

SEQ ID NO: 2548591 - DNA, 18 bp, Homo sapiens
cattcacttgcatttctt

SEQ ID NO: 2548592 - DNA, 12 bp, Homo sapiens
cattcagagagc

SEQ ID NO: 2548593 - DNA, 18 bp, Homo sapiens
cattcatcttgtgtttta

SEQ ID NO: 2548594 - DNA, 15 bp, Homo sapiens
cattcattccattct

SEQ ID NO: 2548595 - DNA, 17 bp, Homo sapiens
cattcattccattctgg

SEQ ID NO: 2548596 - DNA, 14 bp, Homo sapiens
cattccaacaaagg

SEQ ID NO: 2548597 - DNA, 18 bp, Homo sapiens
cattccaacaaagggttt

SEQ ID NO: 2548598 - DNA, 16 bp, Homo sapiens
cattccaacagtgagt

SEQ ID NO: 2548599 - DNA, 13 bp, Homo sapiens
cattccaagacag

SEQ ID NO: 2548600 - DNA, 17 bp, Homo sapiens
cattccaccttcccatg

SEQ ID NO: 2548601 - DNA, 14 bp, Homo sapiens
cattccatccttga

SEQ ID NO: 2548602 - DNA, 18 bp, Homo sapiens
cattccccaggaggccag

SEQ ID NO: 2548603 - DNA, 20 bp, Homo sapiens
cattccccaggaggccagcc

SEQ ID NO: 2548604 - DNA, 19 bp, Homo sapiens
cattcctgatgcttcttca

SEQ ID NO: 2548605 - DNA, 23 bp, Homo sapiens
cattcctgatgcttcttcagaga

SEQ ID NO: 2548606 - DNA, 15 bp, Homo sapiens
cattcctgcctgtct

SEQ ID NO: 2548607 - DNA, 15 bp, Homo sapiens
cattcctggtaccca

SEQ ID NO: 2548608 - DNA, 20 bp, Homo sapiens
cattcctggtacccagccat

SEQ ID NO: 2548609 - DNA, 24 bp, Homo sapiens
cattcctggtacccagccatctgc

SEQ ID NO: 2548610 - DNA, 18 bp, Homo sapiens
cattcctgtattcacccg

SEQ ID NO: 2548611 - DNA, 14 bp, Homo sapiens
cattccttctttga

SEQ ID NO: 2548612 - DNA, 15 bp, Homo sapiens
cattccttctttgat

SEQ ID NO: 2548613 - DNA, 19 bp, Homo sapiens
cattccttctttgataatg

SEQ ID NO: 2548614 - DNA, 23 bp, Homo sapiens
cattccttctttgataatgttaa

SEQ ID NO: 2548615 - DNA, 13 bp, Homo sapiens
cattccttgcctg

SEQ ID NO: 2548616 - DNA, 13 bp, Homo sapiens
cattcggctccct

SEQ ID NO: 2548617 - DNA, 15 bp, Homo sapiens
cattcggctccctgg

SEQ ID NO: 2548618 - DNA, 19 bp, Homo sapiens
cattctacacagagcagga

SEQ ID NO: 2548619 - DNA, 22 bp, Homo sapiens
cattctacacagagcaggactg

SEQ ID NO: 2548620 - DNA, 17 bp, Homo sapiens
cattctcaagccctgca

SEQ ID NO: 2548621 - DNA, 13 bp, Homo sapiens
cattctccacctg

SEQ ID NO: 2548622 - DNA, 17 bp, Homo sapiens
cattctccacctgccag

SEQ ID NO: 2548623 - DNA, 18 bp, Homo sapiens
cattctccacctgccagg

SEQ ID NO: 2548624 - DNA, 19 bp, Homo sapiens
cattctccacctgccaggg

SEQ ID NO: 2548625 - DNA, 20 bp, Homo sapiens
cattctccttgtgttactaa

SEQ ID NO: 2548626 - DNA, 12 bp, Homo sapiens
cattctctgaag

SEQ ID NO: 2548627 - DNA, 16 bp, Homo sapiens
cattctgaaggagccc

SEQ ID NO: 2548628 - DNA, 13 bp, Homo sapiens
cattctgcctgcc

SEQ ID NO: 2548629 - DNA, 17 bp, Homo sapiens
cattctgcctgcccagg

SEQ ID NO: 2548630 - DNA, 20 bp, Homo sapiens
cattctgcctgcccaggccc

SEQ ID NO: 2548631 - DNA, 14 bp, Homo sapiens
cattcttataaata

SEQ ID NO: 2548632 - DNA, 15 bp, Homo sapiens
cattcttataaatat

SEQ ID NO: 2548633 - DNA, 17 bp, Homo sapiens
cattcttataaatatga

SEQ ID NO: 2548634 - DNA, 16 bp, Homo sapiens
cattcttggttggctg

SEQ ID NO: 2548635 - DNA, 17 bp, Homo sapiens
cattcttggttggctgg

SEQ ID NO: 2548636 - DNA, 18 bp, Homo sapiens
cattctttatcttgacat

SEQ ID NO: 2548637 - DNA, 16 bp, Homo sapiens
cattgaaagagaacca

SEQ ID NO: 2548638 - DNA, 16 bp, Homo sapiens
cattgaagtcagatgt

SEQ ID NO: 2548639 - DNA, 16 bp, Homo sapiens
cattgacaagaactga

SEQ ID NO: 2548640 - DNA, 14 bp, Homo sapiens
cattgacctgaggc

SEQ ID NO: 2548641 - DNA, 18 bp, Homo sapiens
cattgacctgaggccctt

SEQ ID NO: 2548642 - DNA, 18 bp, Homo sapiens
cattgactatcaaactga

SEQ ID NO: 2548643 - DNA, 22 bp, Homo sapiens
cattgactatcaaactgaagcc

SEQ ID NO: 2548644 - DNA, 19 bp, Homo sapiens
cattgatatgaaaaatatg

SEQ ID NO: 2548645 - DNA, 16 bp, Homo sapiens
cattgattgtcagcta

SEQ ID NO: 2548646 - DNA, 17 bp, Homo sapiens
cattgcactccagcctg

SEQ ID NO: 2548647 - DNA, 18 bp, Homo sapiens
cattgcactctagcctgg

SEQ ID NO: 2548648 - DNA, 20 bp, Homo sapiens
cattgcactctagcctgggc

SEQ ID NO: 2548649 - DNA, 17 bp, Homo sapiens
cattgccattccctgcc

SEQ ID NO: 2548650 - DNA, 19 bp, Homo sapiens
cattgccattccctgcctg

SEQ ID NO: 2548651 - DNA, 14 bp, Homo sapiens
cattgcggacagcc

SEQ ID NO: 2548652 - DNA, 18 bp, Homo sapiens
cattgctgggcttgtctg

SEQ ID NO: 2548653 - DNA, 22 bp, Homo sapiens
cattgctgtgaattagctcact

SEQ ID NO: 2548654 - DNA, 21 bp, Homo sapiens
cattgctgttgtccctctgct

SEQ ID NO: 2548655 - DNA, 22 bp, Homo sapiens
cattgcttgtgccacaccctcc

SEQ ID NO: 2548656 - DNA, 13 bp, Homo sapiens
ccaactttctgta

SEQ ID NO: 2548657 - DNA, 11 bp, Homo sapiens
ccaagacattg

SEQ ID NO: 2548658 - DNA, 12 bp, Homo sapiens
ccaagacattgt

SEQ ID NO: 2548659 - DNA, 16 bp, Homo sapiens
ccaagacattgtcaat

SEQ ID NO: 2548660 - DNA, 15 bp, Homo sapiens
ccaagaccttctcct

SEQ ID NO: 2548661 - DNA, 13 bp, Homo sapiens
ccaagagagaaag

SEQ ID NO: 2548662 - DNA, 19 bp, Homo sapiens
ccaagagggtcctttagta

SEQ ID NO: 2548663 - DNA, 21 bp, Homo sapiens
ccaagattcacacctgactct

SEQ ID NO: 2548664 - DNA, 16 bp, Homo sapiens
ccaagcagccaagctc

SEQ ID NO: 2548665 - DNA, 22 bp, Homo sapiens
ccaagcataccaacacgagcag

SEQ ID NO: 2548666 - DNA, 17 bp, Homo sapiens
ccaagcccgacttgctg

SEQ ID NO: 2548667 - DNA, 23 bp, Homo sapiens
ccaagccctggagccaactgctg

SEQ ID NO: 2548668 - DNA, 19 bp, Homo sapiens
ccaagccttggctctaccc

SEQ ID NO: 2548669 - DNA, 12 bp, Homo sapiens
ccaagctcagaa

SEQ ID NO: 2548670 - DNA, 20 bp, Homo sapiens
ccaagctcaggaccaggcaa

SEQ ID NO: 2548671 - DNA, 14 bp, Homo sapiens
ccaagctccttggg

SEQ ID NO: 2548672 - DNA, 15 bp, Homo sapiens
ccaagctccttggga

SEQ ID NO: 2548673 - DNA, 12 bp, Homo sapiens
ccaagctctgct

SEQ ID NO: 2548674 - DNA, 15 bp, Homo sapiens
ccaagctctgctcct

SEQ ID NO: 2548675 - DNA, 16 bp, Homo sapiens
ccaagctctgctcctc

SEQ ID NO: 2548676 - DNA, 18 bp, Homo sapiens
ccaagctctgctcctctc

SEQ ID NO: 2548677 - DNA, 11 bp, Homo sapiens
ccaagctgggc

SEQ ID NO: 2548678 - DNA, 12 bp, Homo sapiens
ccaagctgggcc

SEQ ID NO: 2548679 - DNA, 13 bp, Homo sapiens
ccaagctgggccc

SEQ ID NO: 2548680 - DNA, 15 bp, Homo sapiens
ccaagctgggcccca

SEQ ID NO: 2548681 - DNA, 21 bp, Homo sapiens
ccaagctgggccccagcccac

SEQ ID NO: 2548682 - DNA, 12 bp, Homo sapiens
ccaagctggtcc

SEQ ID NO: 2548683 - DNA, 14 bp, Homo sapiens
ccaagctgttttct

SEQ ID NO: 2548684 - DNA, 16 bp, Homo sapiens
ccaagcttggcagccg

SEQ ID NO: 2548685 - DNA, 18 bp, Homo sapiens
ccaaggaaaccacagctg

SEQ ID NO: 2548686 - DNA, 21 bp, Homo sapiens
ccaaggaaaccacagctgctg

SEQ ID NO: 2548687 - DNA, 15 bp, Homo sapiens
ccaaggacccctcac

SEQ ID NO: 2548688 - DNA, 22 bp, Homo sapiens
ccaaggacccctcaccttgcaa

SEQ ID NO: 2548689 - DNA, 14 bp, Homo sapiens
ccaaggagaaacag

SEQ ID NO: 2548690 - DNA, 18 bp, Homo sapiens
ccaaggagaaacagagac

SEQ ID NO: 2548691 - DNA, 14 bp, Homo sapiens
ccaaggagatgaag

SEQ ID NO: 2548692 - DNA, 23 bp, Homo sapiens
ccaaggagatgaagcaaacacat

SEQ ID NO: 2548693 - DNA, 22 bp, Homo sapiens
ccaaggcaaggcaggtgcctcc

SEQ ID NO: 2548694 - DNA, 15 bp, Homo sapiens
ccaaggccagagtgg

SEQ ID NO: 2548695 - DNA, 19 bp, Homo sapiens
ccaaggccagagtggcctg

SEQ ID NO: 2548696 - DNA, 14 bp, Homo sapiens
ccaaggccttctcc

SEQ ID NO: 2548697 - DNA, 16 bp, Homo sapiens
ccaaggccttctcctc

SEQ ID NO: 2548698 - DNA, 21 bp, Homo sapiens
ccaaggcggcccctcccgccc

SEQ ID NO: 2548699 - DNA, 23 bp, Homo sapiens
ccaaggcgtccgcgcgccagcac

SEQ ID NO: 2548700 - DNA, 16 bp, Homo sapiens
ccaaggctctgagcaa

SEQ ID NO: 2548701 - DNA, 19 bp, Homo sapiens
ccaaggctgattaaaccaa

SEQ ID NO: 2548702 - DNA, 17 bp, Homo sapiens
ccaagggcttctgcacc

SEQ ID NO: 2548703 - DNA, 20 bp, Homo sapiens
ccaagggcttctgcaccctc

SEQ ID NO: 2548704 - DNA, 22 bp, Homo sapiens
ccaaggggaatgtttgcctctg

SEQ ID NO: 2548705 - DNA, 18 bp, Homo sapiens
ccaaggggtgggccacag

SEQ ID NO: 2548706 - DNA, 20 bp, Homo sapiens
ccaagggttcagagactcag

SEQ ID NO: 2548707 - DNA, 21 bp, Homo sapiens
ccaaggtttaaacttctctga

SEQ ID NO: 2548708 - DNA, 14 bp, Homo sapiens
ccaagtatttatta

SEQ ID NO: 2548709 - DNA, 20 bp, Homo sapiens
ccaagtcaagtgaaaaagga

SEQ ID NO: 2548710 - DNA, 21 bp, Homo sapiens
ccaagtcagctttgccttcca

SEQ ID NO: 2548711 - DNA, 12 bp, Homo sapiens
ccaagtccctgt

SEQ ID NO: 2548712 - DNA, 15 bp, Homo sapiens
ccaagtcctgaagag

SEQ ID NO: 2548713 - DNA, 14 bp, Homo sapiens
ccaagtctacagag

SEQ ID NO: 2548714 - DNA, 14 bp, Homo sapiens
ccaagtgcaggctg

SEQ ID NO: 2548715 - DNA, 14 bp, Homo sapiens
ccaagtgccagagg

SEQ ID NO: 2548716 - DNA, 13 bp, Homo sapiens
ccaagtggcagag

SEQ ID NO: 2548717 - DNA, 14 bp, Homo sapiens
ccaagtggcagagc

SEQ ID NO: 2548718 - DNA, 19 bp, Homo sapiens
ccaagtggcagagcttgga

SEQ ID NO: 2548719 - DNA, 14 bp, Homo sapiens
ccaagtgtgtgtgc

SEQ ID NO: 2548720 - DNA, 17 bp, Homo sapiens
ccaagtgtgtgtgcgtg

SEQ ID NO: 2548721 - DNA, 15 bp, Homo sapiens
ccaagttataaatca

SEQ ID NO: 2548722 - DNA, 20 bp, Homo sapiens
ccaagttataaatcaatgtc

SEQ ID NO: 2548723 - DNA, 22 bp, Homo sapiens
ccaataaaagcaattccaacct

SEQ ID NO: 2548724 - DNA, 13 bp, Homo sapiens
ccaataaaccagg

SEQ ID NO: 2548725 - DNA, 14 bp, Homo sapiens
ccaataaaccaggt

SEQ ID NO: 2548726 - DNA, 14 bp, Homo sapiens
ccaataacacacag

SEQ ID NO: 2548727 - DNA, 16 bp, Homo sapiens
ccaatatgtattgtaa

SEQ ID NO: 2548728 - DNA, 16 bp, Homo sapiens
ccaatattcatagcag

SEQ ID NO: 2548729 - DNA, 20 bp, Homo sapiens
ccaatattcatagcagctta

SEQ ID NO: 2548730 - DNA, 17 bp, Homo sapiens
ccaatatttaccagacc

SEQ ID NO: 2548731 - DNA, 18 bp, Homo sapiens
ccaatcccagctacctca

SEQ ID NO: 2548732 - DNA, 17 bp, Homo sapiens
ccaatcccctccttggg

SEQ ID NO: 2548733 - DNA, 15 bp, Homo sapiens
ccaatcctcactggg

SEQ ID NO: 2548734 - DNA, 17 bp, Homo sapiens
ccaatcctcactgggtg

SEQ ID NO: 2548735 - DNA, 18 bp, Homo sapiens
ccaatctaaccacatcaa

SEQ ID NO: 2548736 - DNA, 23 bp, Homo sapiens
ccaatgaaaaaatgtatatgcac

SEQ ID NO: 2548737 - DNA, 15 bp, Homo sapiens
ccaatgatggtcacc

SEQ ID NO: 2548738 - DNA, 11 bp, Homo sapiens
ccaatgtctgc

SEQ ID NO: 2548739 - DNA, 13 bp, Homo sapiens
ccaattaaggatt

SEQ ID NO: 2548740 - DNA, 23 bp, Homo sapiens
ccaattaggaagtgtaacagctg

SEQ ID NO: 2548741 - DNA, 14 bp, Homo sapiens
ccaattccttgtag

SEQ ID NO: 2548742 - DNA, 19 bp, Homo sapiens
ccaattcttacaaacatgt

SEQ ID NO: 2548743 - DNA, 13 bp, Homo sapiens
ccaattggaggaa

SEQ ID NO: 2548744 - DNA, 20 bp, Homo sapiens
ccaatttgtaaaaacagcat

SEQ ID NO: 2548745 - DNA, 20 bp, Homo sapiens
ccacaaagcacagtttgaac

SEQ ID NO: 2548746 - DNA, 22 bp, Homo sapiens
ccacaactcctgtctaactgct

SEQ ID NO: 2548747 - DNA, 15 bp, Homo sapiens
ccatgtttgtaaaac

SEQ ID NO: 2548748 - DNA, 15 bp, Homo sapiens
ccattaaaactgaag

SEQ ID NO: 2548749 - DNA, 20 bp, Homo sapiens
ccattaaaactgaagtctga

SEQ ID NO: 2548750 - DNA, 15 bp, Homo sapiens
ccattaaagttctca

SEQ ID NO: 2548751 - DNA, 16 bp, Homo sapiens
ccattatcatgtgtaa

SEQ ID NO: 2548752 - DNA, 14 bp, Homo sapiens
ccagccctcatccc

SEQ ID NO: 2548753 - DNA, 13 bp, Homo sapiens
ccagccctgctgg

SEQ ID NO: 2548754 - DNA, 14 bp, Homo sapiens
ccagccctgctggc

SEQ ID NO: 2548755 - DNA, 17 bp, Homo sapiens
ccagccctggctgaagg

SEQ ID NO: 2548756 - DNA, 21 bp, Homo sapiens
ccagccctggctgaaggactg

SEQ ID NO: 2548757 - DNA, 20 bp, Homo sapiens
ccagccctttgggaggctga

SEQ ID NO: 2548758 - DNA, 20 bp, Homo sapiens
ccagccgccattgccaccag

SEQ ID NO: 2548759 - DNA, 13 bp, Homo sapiens
ccagccggcctct

SEQ ID NO: 2548760 - DNA, 18 bp, Homo sapiens
ccagccgtgatgctcagg

SEQ ID NO: 2548761 - DNA, 19 bp, Homo sapiens
ccagccgtgatgctcaggc

SEQ ID NO: 2548762 - DNA, 19 bp, Homo sapiens
ccagcctcatctctttgtt

SEQ ID NO: 2548763 - DNA, 15 bp, Homo sapiens
ccagcctccatgctg

SEQ ID NO: 2548764 - DNA, 16 bp, Homo sapiens
ccagcctccatgctgc

SEQ ID NO: 2548765 - DNA, 16 bp, Homo sapiens
ccagcctcgtcttcat

SEQ ID NO: 2548766 - DNA, 15 bp, Homo sapiens
ccagcctctagggac

SEQ ID NO: 2548767 - DNA, 22 bp, Homo sapiens
ccagcctctcccctgattacac

SEQ ID NO: 2548768 - DNA, 22 bp, Homo sapiens
ccagcctctcttggtttccttc

SEQ ID NO: 2548769 - DNA, 11 bp, Homo sapiens
ccagcctgagc

SEQ ID NO: 2548770 - DNA, 21 bp, Homo sapiens
ccagcctgcctggcaggctgt

SEQ ID NO: 2548771 - DNA, 20 bp, Homo sapiens
ccagcctggagatgaaatct

SEQ ID NO: 2548772 - DNA, 10 bp, Homo sapiens
ccagcctggc

SEQ ID NO: 2548773 - DNA, 12 bp, Homo sapiens
ccagcctggctc

SEQ ID NO: 2548774 - DNA, 22 bp, Homo sapiens
ccaggctctttggggtcagcca

SEQ ID NO: 2548775 - DNA, 13 bp, Homo sapiens
ccaggctgccaag

SEQ ID NO: 2548776 - DNA, 19 bp, Homo sapiens
ccaggctgccaaggccaga

SEQ ID NO: 2548777 - DNA, 13 bp, Homo sapiens
ccaggctgctcag

SEQ ID NO: 2548778 - DNA, 19 bp, Homo sapiens
ccaggctgctcagggctgg

SEQ ID NO: 2548779 - DNA, 14 bp, Homo sapiens
ccaggctgctggac

SEQ ID NO: 2548780 - DNA, 15 bp, Homo sapiens
ccaggctggcgcagc

SEQ ID NO: 2548781 - DNA, 21 bp, Homo sapiens
ccaggctggcgcagccaaggc

SEQ ID NO: 2548782 - DNA, 22 bp, Homo sapiens
ccaggctggcgcagccaaggcc

SEQ ID NO: 2548783 - DNA, 17 bp, Homo sapiens
ccaggctggcgtgcagt

SEQ ID NO: 2548784 - DNA, 18 bp, Homo sapiens
ccaggctggcgtgcagtg

SEQ ID NO: 2548785 - DNA, 19 bp, Homo sapiens
ccaggctggcgtgcagtgg

SEQ ID NO: 2548786 - DNA, 18 bp, Homo sapiens
ccaggctgggcaaggagg

SEQ ID NO: 2548787 - DNA, 20 bp, Homo sapiens
ccaggctgggcaaggaggcc

SEQ ID NO: 2548788 - DNA, 17 bp, Homo sapiens
ccaggcttagtcactga

SEQ ID NO: 2548789 - DNA, 20 bp, Homo sapiens
ccaggcttagtcactgagac

SEQ ID NO: 2548790 - DNA, 17 bp, Homo sapiens
ccaggcttgcctgcagg

SEQ ID NO: 2548791 - DNA, 17 bp, Homo sapiens
ccagggaagagaaagtg

SEQ ID NO: 2548792 - DNA, 18 bp, Homo sapiens
ccagggaagctggccgag

SEQ ID NO: 2548793 - DNA, 21 bp, Homo sapiens
ccagggacagagggggtggcc

SEQ ID NO: 2548794 - DNA, 22 bp, Homo sapiens
ccagggacagagggggtggcct

SEQ ID NO: 2548795 - DNA, 20 bp, Homo sapiens
ccagggagcggaaagcagct

SEQ ID NO: 2548796 - DNA, 22 bp, Homo sapiens
ccagggagcttgaaagttttca

SEQ ID NO: 2548797 - DNA, 17 bp, Homo sapiens
ccagggagtcccctccc

SEQ ID NO: 2548798 - DNA, 19 bp, Homo sapiens
ccagggcacttcacagagt

SEQ ID NO: 2548799 - DNA, 17 bp, Homo sapiens
ccagggccactctgcct

SEQ ID NO: 2548800 - DNA, 17 bp, Homo sapiens
ccagggccagggccctg

SEQ ID NO: 2548801 - DNA, 14 bp, Homo sapiens
ccagggccctgcag

SEQ ID NO: 2548802 - DNA, 20 bp, Homo sapiens
ccagggcctggaagacagag

SEQ ID NO: 2548803 - DNA, 17 bp, Homo sapiens
ccagggctatagctcag

SEQ ID NO: 2548804 - DNA, 20 bp, Homo sapiens
ccagggctatgggagcagct

SEQ ID NO: 2548805 - DNA, 16 bp, Homo sapiens
ccagggctcagcctgg

SEQ ID NO: 2548806 - DNA, 16 bp, Homo sapiens
ccagggctctgaccag

SEQ ID NO: 2548807 - DNA, 13 bp, Homo sapiens
ccaggggaccaca

SEQ ID NO: 2548808 - DNA, 22 bp, Homo sapiens
ccaggggcatgtattggcctgg

SEQ ID NO: 2548809 - DNA, 23 bp, Homo sapiens
ccaggggcatgtattggcctgga

SEQ ID NO: 2548810 - DNA, 19 bp, Homo sapiens
ccaggggcccaaggcggcc

SEQ ID NO: 2548811 - DNA, 22 bp, Homo sapiens
ccaggggcccaaggcggcccct

SEQ ID NO: 2548812 - DNA, 19 bp, Homo sapiens
ccaggggcccctccagctt

SEQ ID NO: 2548813 - DNA, 20 bp, Homo sapiens
ccaggggcccctccagcttg

SEQ ID NO: 2548814 - DNA, 17 bp, Homo sapiens
ccaggggtctccctgga

SEQ ID NO: 2548815 - DNA, 18 bp, Homo sapiens
ccaggggtctccctggag

SEQ ID NO: 2548816 - DNA, 21 bp, Homo sapiens
ccaggggtgatttcagagagg

SEQ ID NO: 2548817 - DNA, 13 bp, Homo sapiens
ccaggggtgcccc

SEQ ID NO: 2548818 - DNA, 17 bp, Homo sapiens
ccaggggtgccccctcc

SEQ ID NO: 2548819 - DNA, 13 bp, Homo sapiens
ccaggggtgggac

SEQ ID NO: 2548820 - DNA, 17 bp, Homo sapiens
ccaggggtgggacaccc

SEQ ID NO: 2548821 - DNA, 20 bp, Homo sapiens
ccaggggtgggacaccctgt

SEQ ID NO: 2548822 - DNA, 22 bp, Homo sapiens
ccaggggtgggacaccctgtga

SEQ ID NO: 2548823 - DNA, 14 bp, Homo sapiens
ccagggtagcccgc

SEQ ID NO: 2548824 - DNA, 23 bp, Homo sapiens
ccagggtcttccctacctcaggc

SEQ ID NO: 2548825 - DNA, 15 bp, Homo sapiens
ccagggtgagagctg

SEQ ID NO: 2548826 - DNA, 20 bp, Homo sapiens
ccagggttcccccagccctg

SEQ ID NO: 2548827 - DNA, 16 bp, Homo sapiens
ccagggttgatcacac

SEQ ID NO: 2548828 - DNA, 16 bp, Homo sapiens
ccaggtaatgagggac

SEQ ID NO: 2548829 - DNA, 18 bp, Homo sapiens
ccaggtaatgagggactg

SEQ ID NO: 2548830 - DNA, 23 bp, Homo sapiens
ccaggtaatgagggactggaacc

SEQ ID NO: 2548831 - DNA, 14 bp, Homo sapiens
ccaggtagaacaca

SEQ ID NO: 2548832 - DNA, 15 bp, Homo sapiens
ccaggtatctccagg

SEQ ID NO: 2548833 - DNA, 16 bp, Homo sapiens
ccaggtctcacgggca

SEQ ID NO: 2548834 - DNA, 19 bp, Homo sapiens
ccaggtcttggagctgagc

SEQ ID NO: 2548835 - DNA, 21 bp, Homo sapiens
ccaggtcttggagctgagcct

SEQ ID NO: 2548836 - DNA, 18 bp, Homo sapiens
ccaggtgcacaagctcca

SEQ ID NO: 2548837 - DNA, 20 bp, Homo sapiens
ccaggtgcacaagctccaag

SEQ ID NO: 2548838 - DNA, 24 bp, Homo sapiens
ccaggtgcacaagctccaagctcc

SEQ ID NO: 2548839 - DNA, 22 bp, Homo sapiens
ccaggtgcagtggctcacgcct

SEQ ID NO: 2548840 - DNA, 13 bp, Homo sapiens
ccaggtgccagtt

SEQ ID NO: 2548841 - DNA, 21 bp, Homo sapiens
ccaggtgctaggaacactcct

SEQ ID NO: 2548842 - DNA, 16 bp, Homo sapiens
ccaggtgtgcacgtgg

SEQ ID NO: 2548843 - DNA, 22 bp, Homo sapiens
ccaggtgtgtccacctgggcat

SEQ ID NO: 2548844 - DNA, 16 bp, Homo sapiens
ccaggttatctgggca

SEQ ID NO: 2548845 - DNA, 15 bp, Homo sapiens
ccaggttctatttgg

SEQ ID NO: 2548846 - DNA, 13 bp, Homo sapiens
ccaggttgaaaga

SEQ ID NO: 2548847 - DNA, 19 bp, Homo sapiens
ccaggttttctgggtgtcc

SEQ ID NO: 2548848 - DNA, 14 bp, Homo sapiens
ccaggtttttcaat

SEQ ID NO: 2548849 - DNA, 17 bp, Homo sapiens
ccaggtttttcaattaa

SEQ ID NO: 2548850 - DNA, 18 bp, Homo sapiens
ccaggtttttcaattaaa

SEQ ID NO: 2548851 - DNA, 12 bp, Homo sapiens
ccagtaaacaga

SEQ ID NO: 2548852 - DNA, 21 bp, Homo sapiens
ccagtaaatgggggtgcattt

SEQ ID NO: 2548853 - DNA, 22 bp, Homo sapiens
ccagtaaatgggggtgcatttg

SEQ ID NO: 2548854 - DNA, 16 bp, Homo sapiens
ccagtacctttgtcac

SEQ ID NO: 2548855 - DNA, 16 bp, Homo sapiens
ccagtacgtgctaaca

SEQ ID NO: 2548856 - DNA, 18 bp, Homo sapiens
ccagtatctatatatgtg

SEQ ID NO: 2548857 - DNA, 15 bp, Homo sapiens
ccagtatgagcccta

SEQ ID NO: 2548858 - DNA, 14 bp, Homo sapiens
ccagtcaacctggg

SEQ ID NO: 2548859 - DNA, 17 bp, Homo sapiens
ccagtcaccccggccac

SEQ ID NO: 2548860 - DNA, 18 bp, Homo sapiens
ccagtcaccccggccacc

SEQ ID NO: 2548861 - DNA, 19 bp, Homo sapiens
ccagtcaccccggccacct

SEQ ID NO: 2548862 - DNA, 20 bp, Homo sapiens
ccagtcaccccggccacctg

SEQ ID NO: 2548863 - DNA, 13 bp, Homo sapiens
ccagtcagcctct

SEQ ID NO: 2548864 - DNA, 17 bp, Homo sapiens
ccagtcagcctctctcc

SEQ ID NO: 2548865 - DNA, 18 bp, Homo sapiens
ccagtcagcctctctccc

SEQ ID NO: 2548866 - DNA, 19 bp, Homo sapiens
ccagtcagcctctctccca

SEQ ID NO: 2548867 - DNA, 20 bp, Homo sapiens
ccagtcagcctctctcccag

SEQ ID NO: 2548868 - DNA, 23 bp, Homo sapiens
ccagtcagcctctctcccagtct

SEQ ID NO: 2548869 - DNA, 19 bp, Homo sapiens
ccagtcaggtagttgcaat

SEQ ID NO: 2548870 - DNA, 21 bp, Homo sapiens
ccagtccaatctcatggagaa

SEQ ID NO: 2548871 - DNA, 22 bp, Homo sapiens
ccagtccaatctcatggagaag

SEQ ID NO: 2548872 - DNA, 14 bp, Homo sapiens
ccagtcccctttgt

SEQ ID NO: 2548873 - DNA, 14 bp, Homo sapiens
ccagtcctgcctgg

SEQ ID NO: 2548874 - DNA, 17 bp, Homo sapiens
ccagtcctgcctggcca

SEQ ID NO: 2548875 - DNA, 21 bp, Homo sapiens
ccagtcctgcctggccaggca

SEQ ID NO: 2548876 - DNA, 12 bp, Homo sapiens
ccagtcctggcc

SEQ ID NO: 2548877 - DNA, 14 bp, Homo sapiens
ccagtctaaaaata

SEQ ID NO: 2548878 - DNA, 12 bp, Homo sapiens
ccagtctcttct

SEQ ID NO: 2548879 - DNA, 22 bp, Homo sapiens
ccagtctgctgccctccatccc

SEQ ID NO: 2548880 - DNA, 18 bp, Homo sapiens
ccagtctggaatgcagtg

SEQ ID NO: 2548881 - DNA, 18 bp, Homo sapiens
ccagtctgggctgccggg

SEQ ID NO: 2548882 - DNA, 16 bp, Homo sapiens
ccagtctgttccccat

SEQ ID NO: 2548883 - DNA, 15 bp, Homo sapiens
ccagtgaaccaaaga

SEQ ID NO: 2548884 - DNA, 16 bp, Homo sapiens
ccagtgaaccaaagag

SEQ ID NO: 2548885 - DNA, 16 bp, Homo sapiens
ccagtgacacttcaga

SEQ ID NO: 2548886 - DNA, 19 bp, Homo sapiens
ccagtgacacttcagagag

SEQ ID NO: 2548887 - DNA, 20 bp, Homo sapiens
ccagtgacacttcagagagc

SEQ ID NO: 2548888 - DNA, 15 bp, Homo sapiens
ccagtgacctgagga

SEQ ID NO: 2548889 - DNA, 17 bp, Homo sapiens
ccagtgacctgaggaag

SEQ ID NO: 2548890 - DNA, 14 bp, Homo sapiens
ccagtgagatgcat

SEQ ID NO: 2548891 - DNA, 18 bp, Homo sapiens
ccagtgagcactcccaag

SEQ ID NO: 2548892 - DNA, 20 bp, Homo sapiens
ccagtgagcactcccaagtc

SEQ ID NO: 2548893 - DNA, 15 bp, Homo sapiens
ccagtgaggctctgc

SEQ ID NO: 2548894 - DNA, 16 bp, Homo sapiens
ccagtgaggctctgcc

SEQ ID NO: 2548895 - DNA, 22 bp, Homo sapiens
ccagtgcccaaagtctgtgtga

SEQ ID NO: 2548896 - DNA, 15 bp, Homo sapiens
ccagtgcggcaggtt

SEQ ID NO: 2548897 - DNA, 17 bp, Homo sapiens
ccagtggccactcagct

SEQ ID NO: 2548898 - DNA, 21 bp, Homo sapiens
ccagtggccactcagcttcct

SEQ ID NO: 2548899 - DNA, 16 bp, Homo sapiens
ccagtggcctcaaccc

SEQ ID NO: 2548900 - DNA, 15 bp, Homo sapiens
ccagtggctgctgcc

SEQ ID NO: 2548901 - DNA, 19 bp, Homo sapiens
ccagtggctgctgcccagg

SEQ ID NO: 2548902 - DNA, 14 bp, Homo sapiens
ccagtgggaggcgc

SEQ ID NO: 2548903 - DNA, 13 bp, Homo sapiens
ccagtgggagggg

SEQ ID NO: 2548904 - DNA, 15 bp, Homo sapiens
ccagtgggaggggca

SEQ ID NO: 2548905 - DNA, 16 bp, Homo sapiens
ccagtgggaggggcag

SEQ ID NO: 2548906 - DNA, 17 bp, Homo sapiens
ccagtgggaggggcagg

SEQ ID NO: 2548907 - DNA, 22 bp, Homo sapiens
ccagtgggaggggcaggctgac

SEQ ID NO: 2548908 - DNA, 23 bp, Homo sapiens
ccagtgggaggggcaggctgaca

SEQ ID NO: 2548909 - DNA, 14 bp, Homo sapiens
ccagtgtagccttg

SEQ ID NO: 2548910 - DNA, 19 bp, Homo sapiens
ccagtgtcaagttgtgctt

SEQ ID NO: 2548911 - DNA, 14 bp, Homo sapiens
ccagtgtcccctcc

SEQ ID NO: 2548912 - DNA, 18 bp, Homo sapiens
ccagtgtctgtcccgggg

SEQ ID NO: 2548913 - DNA, 18 bp, Homo sapiens
cccagtggcctcaaccct

SEQ ID NO: 2548914 - DNA, 15 bp, Homo sapiens
cccagtggctgctgc

SEQ ID NO: 2548915 - DNA, 16 bp, Homo sapiens
cccagtggctgctgcc

SEQ ID NO: 2548916 - DNA, 17 bp, Homo sapiens
cccagtggctgctgccc

SEQ ID NO: 2548917 - DNA, 21 bp, Homo sapiens
cccagtggctgctgcccaggc

SEQ ID NO: 2548918 - DNA, 18 bp, Homo sapiens
cccagtggctgttctgga

SEQ ID NO: 2548919 - DNA, 12 bp, Homo sapiens
cccagtgggagg

SEQ ID NO: 2548920 - DNA, 16 bp, Homo sapiens
cccagtgggaggcgcg

SEQ ID NO: 2548921 - DNA, 16 bp, Homo sapiens
cccagtgggaggggca

SEQ ID NO: 2548922 - DNA, 18 bp, Homo sapiens
cccagtgggaggggcagg

SEQ ID NO: 2548923 - DNA, 21 bp, Homo sapiens
cccagtgtcaagttgtgcttg

SEQ ID NO: 2548924 - DNA, 14 bp, Homo sapiens
cccagttagctctc

SEQ ID NO: 2548925 - DNA, 15 bp, Homo sapiens
cccagttctgctcct

SEQ ID NO: 2548926 - DNA, 19 bp, Homo sapiens
cccataattttcttcatgc

SEQ ID NO: 2548927 - DNA, 22 bp, Homo sapiens
cccataattttttttttccttt

SEQ ID NO: 2548928 - DNA, 16 bp, Homo sapiens
cccatagcttccatga

SEQ ID NO: 2548929 - DNA, 17 bp, Homo sapiens
cccatcatacacttcct

SEQ ID NO: 2548930 - DNA, 21 bp, Homo sapiens
cccatccagttcatgagaatc

SEQ ID NO: 2548931 - DNA, 13 bp, Homo sapiens
cccatcccacacc

SEQ ID NO: 2548932 - DNA, 12 bp, Homo sapiens
cccatccccctg

SEQ ID NO: 2548933 - DNA, 17 bp, Homo sapiens
cccatccccctgccctc

SEQ ID NO: 2548934 - DNA, 15 bp, Homo sapiens
cccatcctccagctt

SEQ ID NO: 2548935 - DNA, 14 bp, Homo sapiens
cccatcctcccctt

SEQ ID NO: 2548936 - DNA, 15 bp, Homo sapiens
cccatcctccccttc

SEQ ID NO: 2548937 - DNA, 22 bp, Homo sapiens
cccatcctccccttccctgcaa

SEQ ID NO: 2548938 - DNA, 13 bp, Homo sapiens
cccatcctctgta

SEQ ID NO: 2548939 - DNA, 14 bp, Homo sapiens
cccatcctctgtac

SEQ ID NO: 2548940 - DNA, 19 bp, Homo sapiens
cccatctctacaaaaagca

SEQ ID NO: 2548941 - DNA, 18 bp, Homo sapiens
cccatctcttcctaccca

SEQ ID NO: 2548942 - DNA, 22 bp, Homo sapiens
cccatgaacttaaaatgaaagt

SEQ ID NO: 2548943 - DNA, 15 bp, Homo sapiens
cccatgacccacccc

SEQ ID NO: 2548944 - DNA, 16 bp, Homo sapiens
cccatgacccacccct

SEQ ID NO: 2548945 - DNA, 21 bp, Homo sapiens
cccatgacccacccctgtgct

SEQ ID NO: 2548946 - DNA, 16 bp, Homo sapiens
cccatgagcctcagca

SEQ ID NO: 2548947 - DNA, 14 bp, Homo sapiens
cccatgcccacctg

SEQ ID NO: 2548948 - DNA, 15 bp, Homo sapiens
cccatgcccacctgc

SEQ ID NO: 2548949 - DNA, 13 bp, Homo sapiens
cccatgcctgtcc

SEQ ID NO: 2548950 - DNA, 16 bp, Homo sapiens
cccatgcctgtccagc

SEQ ID NO: 2548951 - DNA, 20 bp, Homo sapiens
cccatgcctgtccagcctgg

SEQ ID NO: 2548952 - DNA, 16 bp, Homo sapiens
cccatgctgccctgtg

SEQ ID NO: 2548953 - DNA, 16 bp, Homo sapiens
cccatggacactccag

SEQ ID NO: 2548954 - DNA, 21 bp, Homo sapiens
cccatggacactccagtgcca

SEQ ID NO: 2548955 - DNA, 21 bp, Homo sapiens
cccatggagccccagccccct

SEQ ID NO: 2548956 - DNA, 22 bp, Homo sapiens
cccatgggaagacgaggccctc

SEQ ID NO: 2548957 - DNA, 13 bp, Homo sapiens
cccatgtgccaag

SEQ ID NO: 2548958 - DNA, 19 bp, Homo sapiens
cccatgtgtgagtgtgtgc

SEQ ID NO: 2548959 - DNA, 20 bp, Homo sapiens
cccatgtgtgagtgtgtgca

SEQ ID NO: 2548960 - DNA, 16 bp, Homo sapiens
cccattagcaaaaatt

SEQ ID NO: 2548961 - DNA, 18 bp, Homo sapiens
cccattcattccattctg

SEQ ID NO: 2548962 - DNA, 19 bp, Homo sapiens
cccattctgcctgcccagg

SEQ ID NO: 2548963 - DNA, 14 bp, Homo sapiens
cccattgcctcctc

SEQ ID NO: 2548964 - DNA, 19 bp, Homo sapiens
cccattgtggctcctatct

SEQ ID NO: 2548965 - DNA, 18 bp, Homo sapiens
cccattttagtcactttt

SEQ ID NO: 2548966 - DNA, 17 bp, Homo sapiens
cccattttgagtgactc

SEQ ID NO: 2548967 - DNA, 12 bp, Homo sapiens
cccattttgcaa

SEQ ID NO: 2548968 - DNA, 19 bp, Homo sapiens
cccattttgcaaaatttcc

SEQ ID NO: 2548969 - DNA, 15 bp, Homo sapiens
ccccaaaaccacagc

SEQ ID NO: 2548970 - DNA, 22 bp, Homo sapiens
ccccaaaaccacagccctgtca

SEQ ID NO: 2548971 - DNA, 23 bp, Homo sapiens
ccccaaaaccacagccctgtcag

SEQ ID NO: 2548972 - DNA, 20 bp, Homo sapiens
ccccaaaactctcctctgct

SEQ ID NO: 2548973 - DNA, 22 bp, Homo sapiens
ccccaaacaccttccagctcct

SEQ ID NO: 2548974 - DNA, 19 bp, Homo sapiens
ccccaaacctgcaagggct

SEQ ID NO: 2548975 - DNA, 19 bp, Homo sapiens
ccccaaacgggctgccctg

SEQ ID NO: 2548976 - DNA, 15 bp, Homo sapiens
ccccaaagagcctgg

SEQ ID NO: 2548977 - DNA, 19 bp, Homo sapiens
ccccaaatccgaacctcct

SEQ ID NO: 2548978 - DNA, 23 bp, Homo sapiens
ccccaaatccgaacctcctctgt

SEQ ID NO: 2548979 - DNA, 22 bp, Homo sapiens
ccccaaatggaaatgggcagag

SEQ ID NO: 2548980 - DNA, 16 bp, Homo sapiens
ccccaacactgtgccc

SEQ ID NO: 2548981 - DNA, 17 bp, Homo sapiens
ccccaacactgtgccct

SEQ ID NO: 2548982 - DNA, 19 bp, Homo sapiens
ccccaacactgtgccctgg

SEQ ID NO: 2548983 - DNA, 22 bp, Homo sapiens
ccccaacactgtgccctggtgg

SEQ ID NO: 2548984 - DNA, 18 bp, Homo sapiens
ccccaaccctgcccctgc

SEQ ID NO: 2548985 - DNA, 23 bp, Homo sapiens
ccccaaccctgcccctgccccgt

SEQ ID NO: 2548986 - DNA, 17 bp, Homo sapiens
ccccaagctgttttctt

SEQ ID NO: 2548987 - DNA, 14 bp, Homo sapiens
ccccaattccttgt

SEQ ID NO: 2548988 - DNA, 12 bp, Homo sapiens
ccccacacacac

SEQ ID NO: 2548989 - DNA, 14 bp, Homo sapiens
ccccacaccaggcc

SEQ ID NO: 2548990 - DNA, 16 bp, Homo sapiens
ccccacccaagcttgg

SEQ ID NO: 2548991 - DNA, 18 bp, Homo sapiens
ccccacccaagcttggca

SEQ ID NO: 2548992 - DNA, 20 bp, Homo sapiens
ccccacccaagcttggcagc

SEQ ID NO: 2548993 - DNA, 13 bp, Homo sapiens
ccccacccaggag

SEQ ID NO: 2548994 - DNA, 16 bp, Homo sapiens
ccccaccccacacttg

SEQ ID NO: 2548995 - DNA, 13 bp, Homo sapiens
ccccaccccagcc

SEQ ID NO: 2548996 - DNA, 13 bp, Homo sapiens
ccccacccccagc

SEQ ID NO: 2548997 - DNA, 18 bp, Homo sapiens
ccccaccccttccccact

SEQ ID NO: 2548998 - DNA, 15 bp, Homo sapiens
ccccaccctccctgg

SEQ ID NO: 2548999 - DNA, 16 bp, Homo sapiens
ccccaccctccctgga

SEQ ID NO: 2549000 - DNA, 15 bp, Homo sapiens
ccccaccctgggctc

SEQ ID NO: 2549001 - DNA, 19 bp, Homo sapiens
ccccaccgcagacaggacc

SEQ ID NO: 2549002 - DNA, 12 bp, Homo sapiens
ccccacctccac

SEQ ID NO: 2549003 - DNA, 21 bp, Homo sapiens
ccccaccttcaattcctgggc

SEQ ID NO: 2549004 - DNA, 17 bp, Homo sapiens
ccccacgagggtcagga

SEQ ID NO: 2549005 - DNA, 22 bp, Homo sapiens
ccccacggccgctccaggggtg

SEQ ID NO: 2549006 - DNA, 12 bp, Homo sapiens
ccccactctccc

SEQ ID NO: 2549007 - DNA, 15 bp, Homo sapiens
ccccactgcctgccc

SEQ ID NO: 2549008 - DNA, 12 bp, Homo sapiens
ccccactggtga

SEQ ID NO: 2549009 - DNA, 16 bp, Homo sapiens
ccccagaaggcaggga

SEQ ID NO: 2549010 - DNA, 11 bp, Homo sapiens
ccccagagctg

SEQ ID NO: 2549011 - DNA, 23 bp, Homo sapiens
ccccagagctgtttatggcctca

SEQ ID NO: 2549012 - DNA, 18 bp, Homo sapiens
ccccagaggcctctctct

SEQ ID NO: 2549013 - DNA, 23 bp, Homo sapiens
ccccagcagttgaatgacaacag

SEQ ID NO: 2549014 - DNA, 23 bp, Homo sapiens
ccccagccagatggactccagcc

SEQ ID NO: 2549015 - DNA, 22 bp, Homo sapiens
ccccagcccaccctcctgtctt

SEQ ID NO: 2549016 - DNA, 21 bp, Homo sapiens
ccccagcccagggttccccca

SEQ ID NO: 2549017 - DNA, 14 bp, Homo sapiens
ccccagccccaaaa

SEQ ID NO: 2549018 - DNA, 15 bp, Homo sapiens
ccccagccctgtgga

SEQ ID NO: 2549019 - DNA, 22 bp, Homo sapiens
ccccagctgggaggcaagaggg

SEQ ID NO: 2549020 - DNA, 11 bp, Homo sapiens
ccccaggcagg

SEQ ID NO: 2549021 - DNA, 15 bp, Homo sapiens
ccccaggccaggcca

SEQ ID NO: 2549022 - DNA, 11 bp, Homo sapiens
ccccaggcccc

SEQ ID NO: 2549023 - DNA, 12 bp, Homo sapiens
ccccaggcccca

SEQ ID NO: 2549024 - DNA, 13 bp, Homo sapiens
ccccaggccccga

SEQ ID NO: 2549025 - DNA, 11 bp, Homo sapiens
ccccagggcac

SEQ ID NO: 2549026 - DNA, 12 bp, Homo sapiens
ccccagggcact

SEQ ID NO: 2549027 - DNA, 20 bp, Homo sapiens
ccccagggcacttcacagag

SEQ ID NO: 2549028 - DNA, 16 bp, Homo sapiens
ccccaggggaaaatga

SEQ ID NO: 2549029 - DNA, 19 bp, Homo sapiens
ccccaggggaaagatgagc

SEQ ID NO: 2549030 - DNA, 22 bp, Homo sapiens
ccccaggggtcccagccacccc

SEQ ID NO: 2549031 - DNA, 22 bp, Homo sapiens
ccccaggtggttatggagaggg

SEQ ID NO: 2549032 - DNA, 21 bp, Homo sapiens
ccctctcaggcatgcctgtgt

SEQ ID NO: 2549033 - DNA, 22 bp, Homo sapiens
ccctctcaggcatgcctgtgtg

SEQ ID NO: 2549034 - DNA, 13 bp, Homo sapiens
ccctctcccagga

SEQ ID NO: 2549035 - DNA, 19 bp, Homo sapiens
ccctctcccccccccctcc

SEQ ID NO: 2549036 - DNA, 11 bp, Homo sapiens
ccctctccctg

SEQ ID NO: 2549037 - DNA, 15 bp, Homo sapiens
ccctctctctgactc

SEQ ID NO: 2549038 - DNA, 18 bp, Homo sapiens
ccctctctctgactctca

SEQ ID NO: 2549039 - DNA, 18 bp, Homo sapiens
ccctctctcttctgctcc

SEQ ID NO: 2549040 - DNA, 14 bp, Homo sapiens
ccctctctgctctg

SEQ ID NO: 2549041 - DNA, 11 bp, Homo sapiens
ccctctctgga

SEQ ID NO: 2549042 - DNA, 15 bp, Homo sapiens
ccctctgacctgcac

SEQ ID NO: 2549043 - DNA, 20 bp, Homo sapiens
ccctctgagaattccaagga

SEQ ID NO: 2549044 - DNA, 19 bp, Homo sapiens
ccctctgcccactccctgc

SEQ ID NO: 2549045 - DNA, 14 bp, Homo sapiens
ccctctgcccagct

SEQ ID NO: 2549046 - DNA, 16 bp, Homo sapiens
ccctctgcccagcttg

SEQ ID NO: 2549047 - DNA, 23 bp, Homo sapiens
ccctctgcccagcttgggcccag

SEQ ID NO: 2549048 - DNA, 13 bp, Homo sapiens
ccctctgcctgtc

SEQ ID NO: 2549049 - DNA, 23 bp, Homo sapiens
ccctctgcctgtccctctcaggc

SEQ ID NO: 2549050 - DNA, 12 bp, Homo sapiens
ccctctggaggg

SEQ ID NO: 2549051 - DNA, 21 bp, Homo sapiens
ccctctggaggggtgtggctc

SEQ ID NO: 2549052 - DNA, 12 bp, Homo sapiens
ccctctggccag

SEQ ID NO: 2549053 - DNA, 24 bp, Homo sapiens
ccctctgtccaggcactgagatac

SEQ ID NO: 2549054 - DNA, 18 bp, Homo sapiens
ccctctgttgccaggcta

SEQ ID NO: 2549055 - DNA, 16 bp, Homo sapiens
ccctcttctcaagtgc

SEQ ID NO: 2549056 - DNA, 19 bp, Homo sapiens
ccctcttgacccatctccc

SEQ ID NO: 2549057 - DNA, 22 bp, Homo sapiens
ccctcttgacccatctccccct

SEQ ID NO: 2549058 - DNA, 16 bp, Homo sapiens
ccctcttgccccccac

SEQ ID NO: 2549059 - DNA, 16 bp, Homo sapiens
ccctgaaggccccgcc

SEQ ID NO: 2549060 - DNA, 15 bp, Homo sapiens
ccctgaatccccctt

SEQ ID NO: 2549061 - DNA, 20 bp, Homo sapiens
ccctgaatcccccttgccac

SEQ ID NO: 2549062 - DNA, 23 bp, Homo sapiens
ccctgaatcccccttgccacccc

SEQ ID NO: 2549063 - DNA, 20 bp, Homo sapiens
ccctgaatggttccatgcct

SEQ ID NO: 2549064 - DNA, 15 bp, Homo sapiens
ccctgacctcccagc

SEQ ID NO: 2549065 - DNA, 17 bp, Homo sapiens
ccctgacctcccagccc

SEQ ID NO: 2549066 - DNA, 20 bp, Homo sapiens
ccctgacctcccagccctat

SEQ ID NO: 2549067 - DNA, 17 bp, Homo sapiens
ccctgacctccctctaa

SEQ ID NO: 2549068 - DNA, 21 bp, Homo sapiens
ccctgactcattctgaaggag

SEQ ID NO: 2549069 - DNA, 13 bp, Homo sapiens
ccctgactctctg

SEQ ID NO: 2549070 - DNA, 17 bp, Homo sapiens
ccctgagacaaatggag

SEQ ID NO: 2549071 - DNA, 23 bp, Homo sapiens
ccctgagacaaatggaggcctgt

SEQ ID NO: 2549072 - DNA, 12 bp, Homo sapiens
ccctgagcccct

SEQ ID NO: 2549073 - DNA, 15 bp, Homo sapiens
ccctgagccccttcc

SEQ ID NO: 2549074 - DNA, 12 bp, Homo sapiens
ccctgagctcgg

SEQ ID NO: 2549075 - DNA, 14 bp, Homo sapiens
ccctgagctgaggc

SEQ ID NO: 2549076 - DNA, 17 bp, Homo sapiens
ccctgaggcccagaggg

SEQ ID NO: 2549077 - DNA, 18 bp, Homo sapiens
ccctgaggcccagagggc

SEQ ID NO: 2549078 - DNA, 23 bp, Homo sapiens
ccctgaggcccagagggcctgca

SEQ ID NO: 2549079 - DNA, 15 bp, Homo sapiens
ccctgaggtgtgggg

SEQ ID NO: 2549080 - DNA, 22 bp, Homo sapiens
ccctgaggtgtgggggctgcag

SEQ ID NO: 2549081 - DNA, 20 bp, Homo sapiens
ccctgcaaaaggactctcag

SEQ ID NO: 2549082 - DNA, 19 bp, Homo sapiens
ccctgcaaaatgagaccct

SEQ ID NO: 2549083 - DNA, 15 bp, Homo sapiens
ccctgcaaaggactg

SEQ ID NO: 2549084 - DNA, 16 bp, Homo sapiens
ccctgcaaaggactgt

SEQ ID NO: 2549085 - DNA, 13 bp, Homo sapiens
ccctgcactggag

SEQ ID NO: 2549086 - DNA, 21 bp, Homo sapiens
ccattatccctgaatccccct

SEQ ID NO: 2549087 - DNA, 15 bp, Homo sapiens
ccattctgcctgccc

SEQ ID NO: 2549088 - DNA, 21 bp, Homo sapiens
ccattctgcctgcccaggccc

SEQ ID NO: 2549089 - DNA, 15 bp, Homo sapiens
ccattctggaagtga

SEQ ID NO: 2549090 - DNA, 19 bp, Homo sapiens
ccattctggaagtgacttt

SEQ ID NO: 2549091 - DNA, 14 bp, Homo sapiens
ccattcttcctagt

SEQ ID NO: 2549092 - DNA, 16 bp, Homo sapiens
ccattgccaccaggag

SEQ ID NO: 2549093 - DNA, 17 bp, Homo sapiens
ccattgccaccaggaga

SEQ ID NO: 2549094 - DNA, 21 bp, Homo sapiens
ccattgccaccaggagaacca

SEQ ID NO: 2549095 - DNA, 19 bp, Homo sapiens
ccatttaaatttttttcct

SEQ ID NO: 2549096 - DNA, 13 bp, Homo sapiens
ccatttcagagag

SEQ ID NO: 2549097 - DNA, 21 bp, Homo sapiens
ccatttcatctatttctgaga

SEQ ID NO: 2549098 - DNA, 13 bp, Homo sapiens
ccatttctactct

SEQ ID NO: 2549099 - DNA, 13 bp, Homo sapiens
ccatttctcactg

SEQ ID NO: 2549100 - DNA, 20 bp, Homo sapiens
ccatttgcagagtcctgcac

SEQ ID NO: 2549101 - DNA, 16 bp, Homo sapiens
ccatttgctttttcac

SEQ ID NO: 2549102 - DNA, 18 bp, Homo sapiens
ccattttagtcacttttt

SEQ ID NO: 2549103 - DNA, 19 bp, Homo sapiens
ccattttagtcactttttt

SEQ ID NO: 2549104 - DNA, 17 bp, Homo sapiens
ccattttgcaaaatttc

SEQ ID NO: 2549105 - DNA, 16 bp, Homo sapiens
ccattttgcccttcca

SEQ ID NO: 2549106 - DNA, 19 bp, Homo sapiens
ccattttgcccttccatag

SEQ ID NO: 2549107 - DNA, 22 bp, Homo sapiens
ccattttggggtacccactgct

SEQ ID NO: 2549108 - DNA, 13 bp, Homo sapiens
ccattttgtgaat

SEQ ID NO: 2549109 - DNA, 14 bp, Homo sapiens
ccattttgtgaatg

SEQ ID NO: 2549110 - DNA, 11 bp, Homo sapiens
ccatttttcct

SEQ ID NO: 2549111 - DNA, 12 bp, Homo sapiens
ccattttttcct

SEQ ID NO: 2549112 - DNA, 21 bp, Homo sapiens
cccaaaaccacagccctgtca

SEQ ID NO: 2549113 - DNA, 16 bp, Homo sapiens
cccaaaactctcctct

SEQ ID NO: 2549114 - DNA, 18 bp, Homo sapiens
cccaaaactctcctctgc

SEQ ID NO: 2549115 - DNA, 20 bp, Homo sapiens
cccaaaactctcctctgctg

SEQ ID NO: 2549116 - DNA, 20 bp, Homo sapiens
cccaaacaaatatgcaaaag

SEQ ID NO: 2549117 - DNA, 16 bp, Homo sapiens
cccaaacaccttccag

SEQ ID NO: 2549118 - DNA, 19 bp, Homo sapiens
cccaaacaccttccagctc

SEQ ID NO: 2549119 - DNA, 21 bp, Homo sapiens
cccaaagaatgtttatagcaa

SEQ ID NO: 2549120 - DNA, 16 bp, Homo sapiens
cccaaagtctgtgtga

SEQ ID NO: 2549121 - DNA, 15 bp, Homo sapiens
cccaaagtgctggga

SEQ ID NO: 2549122 - DNA, 16 bp, Homo sapiens
cccaaagtgctgggat

SEQ ID NO: 2549123 - DNA, 20 bp, Homo sapiens
cccaaagtggtatagaaatg

SEQ ID NO: 2549124 - DNA, 18 bp, Homo sapiens
cccaaatccgaacctcct

SEQ ID NO: 2549125 - DNA, 23 bp, Homo sapiens
cccaaatccgaacctcctctgtg

SEQ ID NO: 2549126 - DNA, 15 bp, Homo sapiens
cccaacactgtgccc

SEQ ID NO: 2549127 - DNA, 19 bp, Homo sapiens
cccaacactgtgccctggt

SEQ ID NO: 2549128 - DNA, 20 bp, Homo sapiens
cccaacactgtgccctggtg

SEQ ID NO: 2549129 - DNA, 22 bp, Homo sapiens
cccaacactgtgccctggtgga

SEQ ID NO: 2549130 - DNA, 18 bp, Homo sapiens
cccaacaggaggacaatt

SEQ ID NO: 2549131 - DNA, 13 bp, Homo sapiens
cccaacagtgtga

SEQ ID NO: 2549132 - DNA, 15 bp, Homo sapiens
cccaacagtgtgaag

SEQ ID NO: 2549133 - DNA, 12 bp, Homo sapiens
cccaacccccac

SEQ ID NO: 2549134 - DNA, 13 bp, Homo sapiens
cccaaccctgccc

SEQ ID NO: 2549135 - DNA, 22 bp, Homo sapiens
cccaaccggggagcccccgccc

SEQ ID NO: 2549136 - DNA, 12 bp, Homo sapiens
cccaacctcaga

SEQ ID NO: 2549137 - DNA, 14 bp, Homo sapiens
cccaacctgctctc

SEQ ID NO: 2549138 - DNA, 21 bp, Homo sapiens
cccaacctgctctcctcttgc

SEQ ID NO: 2549139 - DNA, 15 bp, Homo sapiens
cccaactcaccccag

SEQ ID NO: 2549140 - DNA, 12 bp, Homo sapiens
cccaactctcct

SEQ ID NO: 2549141 - DNA, 20 bp, Homo sapiens
cccaactttgtggatgtctt

SEQ ID NO: 2549142 - DNA, 18 bp, Homo sapiens
cccaagacagatgcccca

SEQ ID NO: 2549143 - DNA, 19 bp, Homo sapiens
cccaagacagatgccccag

SEQ ID NO: 2549144 - DNA, 15 bp, Homo sapiens
cccaagagatgaaga

SEQ ID NO: 2549145 - DNA, 20 bp, Homo sapiens
cccaagattcacacctgact

SEQ ID NO: 2549146 - DNA, 19 bp, Homo sapiens
cccaagcaaaatcatggaa

SEQ ID NO: 2549147 - DNA, 20 bp, Homo sapiens
cccaagccccctccttgtct

SEQ ID NO: 2549148 - DNA, 18 bp, Homo sapiens
cccaagcccgacttgctg

SEQ ID NO: 2549149 - DNA, 13 bp, Homo sapiens
cccaagctctgct

SEQ ID NO: 2549150 - DNA, 13 bp, Homo sapiens
cccaagctgggcc

SEQ ID NO: 2549151 - DNA, 14 bp, Homo sapiens
cccaagctgggccc

SEQ ID NO: 2549152 - DNA, 19 bp, Homo sapiens
cccaagctgttttcttcta

SEQ ID NO: 2549153 - DNA, 14 bp, Homo sapiens
cccaagcttggcag

SEQ ID NO: 2549154 - DNA, 15 bp, Homo sapiens
cccaaggcggcccct

SEQ ID NO: 2549155 - DNA, 21 bp, Homo sapiens
cccaagggcaaaattcccagg

SEQ ID NO: 2549156 - DNA, 19 bp, Homo sapiens
cccaagggcctggcctgag

SEQ ID NO: 2549157 - DNA, 23 bp, Homo sapiens
cccaaggtttaaacttctctgaa

SEQ ID NO: 2549158 - DNA, 22 bp, Homo sapiens
cccaagtagggggtctaaaatt

SEQ ID NO: 2549159 - DNA, 23 bp, Homo sapiens
cccaagtccctgttttctgagcc

SEQ ID NO: 2549160 - DNA, 13 bp, Homo sapiens
cccaagtcctgaa

SEQ ID NO: 2549161 - DNA, 17 bp, Homo sapiens
cccaagtcctgaagagg

SEQ ID NO: 2549162 - DNA, 23 bp, Homo sapiens
cccaagtcctgaagaggcgggcc

SEQ ID NO: 2549163 - DNA, 15 bp, Homo sapiens
cccaagtgtgaacaa

SEQ ID NO: 2549164 - DNA, 22 bp, Homo sapiens
cccaagttttaggacaaacagc

SEQ ID NO: 2549165 - DNA, 11 bp, Homo sapiens
cccaatattat

SEQ ID NO: 2549166 - DNA, 15 bp, Homo sapiens
cccaatattataatt

SEQ ID NO: 2549167 - DNA, 23 bp, Homo sapiens
cccaatcccagctacctcaacca

SEQ ID NO: 2549168 - DNA, 15 bp, Homo sapiens
cccaattaggaagtg

SEQ ID NO: 2549169 - DNA, 13 bp, Homo sapiens
cccacaagaaatg

SEQ ID NO: 2549170 - DNA, 17 bp, Homo sapiens
cccacacacacacacat

SEQ ID NO: 2549171 - DNA, 15 bp, Homo sapiens
cccacacactcgccc

SEQ ID NO: 2549172 - DNA, 20 bp, Homo sapiens
cccacaccaggccgtcctcc

SEQ ID NO: 2549173 - DNA, 14 bp, Homo sapiens
cccacacccagcta

SEQ ID NO: 2549174 - DNA, 13 bp, Homo sapiens
cccacacctcagt

SEQ ID NO: 2549175 - DNA, 13 bp, Homo sapiens
cccacactcactc

SEQ ID NO: 2549176 - DNA, 14 bp, Homo sapiens
cccacactcctaca

SEQ ID NO: 2549177 - DNA, 19 bp, Homo sapiens
cccacacttgttccagctc

SEQ ID NO: 2549178 - DNA, 21 bp, Homo sapiens
cccacagaaagactgagctca

SEQ ID NO: 2549179 - DNA, 19 bp, Homo sapiens
cccacagcgctggccggga

SEQ ID NO: 2549180 - DNA, 20 bp, Homo sapiens
cccacaggaagcctgcagtc

SEQ ID NO: 2549181 - DNA, 12 bp, Homo sapiens
cccacaggcagc

SEQ ID NO: 2549182 - DNA, 14 bp, Homo sapiens
cccacattggaccc

SEQ ID NO: 2549183 - DNA, 12 bp, Homo sapiens
cccaccacagca

SEQ ID NO: 2549184 - DNA, 20 bp, Homo sapiens
cccaccacggccactggcca

SEQ ID NO: 2549185 - DNA, 15 bp, Homo sapiens
cccacccaagcttgg

SEQ ID NO: 2549186 - DNA, 20 bp, Homo sapiens
cccacccaagggcctggcct

SEQ ID NO: 2549187 - DNA, 13 bp, Homo sapiens
cccaccccacact

SEQ ID NO: 2549188 - DNA, 12 bp, Homo sapiens
cccacccccacc

SEQ ID NO: 2549189 - DNA, 14 bp, Homo sapiens
cccacccccctcat

SEQ ID NO: 2549190 - DNA, 12 bp, Homo sapiens
cccaccccctca

SEQ ID NO: 2549191 - DNA, 13 bp, Homo sapiens
cccaccccctcaa

SEQ ID NO: 2549192 - DNA, 16 bp, Homo sapiens
cccaccccgctctgca

SEQ ID NO: 2549193 - DNA, 13 bp, Homo sapiens
cccacccctgtgc

SEQ ID NO: 2549194 - DNA, 16 bp, Homo sapiens
cccacccctgtgctcc

SEQ ID NO: 2549195 - DNA, 21 bp, Homo sapiens
cccacccctgtgctccgtgcc

SEQ ID NO: 2549196 - DNA, 12 bp, Homo sapiens
cccaccccttcc

SEQ ID NO: 2549197 - DNA, 17 bp, Homo sapiens
cccaccccttccccact

SEQ ID NO: 2549198 - DNA, 14 bp, Homo sapiens
cccaccccttgctc

SEQ ID NO: 2549199 - DNA, 18 bp, Homo sapiens
cccaccctcagcacccct

SEQ ID NO: 2549200 - DNA, 15 bp, Homo sapiens
cccaccctccctgga

SEQ ID NO: 2549201 - DNA, 15 bp, Homo sapiens
cccaccctcctgtct

SEQ ID NO: 2549202 - DNA, 23 bp, Homo sapiens
cccaccgggctgggagctctgca

SEQ ID NO: 2549203 - DNA, 15 bp, Homo sapiens
cccaccgtccgccct

SEQ ID NO: 2549204 - DNA, 17 bp, Homo sapiens
cccaccgtccgccctgc

SEQ ID NO: 2549205 - DNA, 21 bp, Homo sapiens
cccacctcagcctcccaaagt

SEQ ID NO: 2549206 - DNA, 13 bp, Homo sapiens
cccacctgcccat

SEQ ID NO: 2549207 - DNA, 13 bp, Homo sapiens
cccacctggccac

SEQ ID NO: 2549208 - DNA, 15 bp, Homo sapiens
cccacctggccacct

SEQ ID NO: 2549209 - DNA, 15 bp, Homo sapiens
cccacctggcctctg

SEQ ID NO: 2549210 - DNA, 16 bp, Homo sapiens
cccacctggcctctgc

SEQ ID NO: 2549211 - DNA, 19 bp, Homo sapiens
cccacctggcctctgcact

SEQ ID NO: 2549212 - DNA, 23 bp, Homo sapiens
cccacctgtcaaacaaagccaga

SEQ ID NO: 2549213 - DNA, 19 bp, Homo sapiens
cccaccttcaattcctggg

SEQ ID NO: 2549214 - DNA, 20 bp, Homo sapiens
cccaccttcaattcctgggc

SEQ ID NO: 2549215 - DNA, 12 bp, Homo sapiens
cccaccttggct

SEQ ID NO: 2549216 - DNA, 15 bp, Homo sapiens
cccaccttggctgca

SEQ ID NO: 2549217 - DNA, 17 bp, Homo sapiens
cccaccttggctgcagg

SEQ ID NO: 2549218 - DNA, 18 bp, Homo sapiens
cccaccttgttggagcct

SEQ ID NO: 2549219 - DNA, 20 bp, Homo sapiens
cccaccttgttggagcctgc

SEQ ID NO: 2549220 - DNA, 15 bp, Homo sapiens
cccacgcccccactg

SEQ ID NO: 2549221 - DNA, 14 bp, Homo sapiens
cccacggccgctcc

SEQ ID NO: 2549222 - DNA, 23 bp, Homo sapiens
ccctgtctgtagagggccctggt

SEQ ID NO: 2549223 - DNA, 21 bp, Homo sapiens
ccctgtgagtactacagtcct

SEQ ID NO: 2549224 - DNA, 23 bp, Homo sapiens
ccctgtgagtactacagtcctcc

SEQ ID NO: 2549225 - DNA, 22 bp, Homo sapiens
ccctgtgatggggccctgcctc

SEQ ID NO: 2549226 - DNA, 18 bp, Homo sapiens
ccctgtgctccgtgcctc

SEQ ID NO: 2549227 - DNA, 22 bp, Homo sapiens
ccctgtgctccgtgcctccacc

SEQ ID NO: 2549228 - DNA, 12 bp, Homo sapiens
ccctgtgctggt

SEQ ID NO: 2549229 - DNA, 18 bp, Homo sapiens
ccctgtggaagggactag

SEQ ID NO: 2549230 - DNA, 21 bp, Homo sapiens
ccctgtggaagggactaggag

SEQ ID NO: 2549231 - DNA, 15 bp, Homo sapiens
ccctgtgggccccca

SEQ ID NO: 2549232 - DNA, 15 bp, Homo sapiens
ccctgtggggatctc

SEQ ID NO: 2549233 - DNA, 21 bp, Homo sapiens
ccctgtttaatatttaaacag

SEQ ID NO: 2549234 - DNA, 14 bp, Homo sapiens
ccctgtttcctgag

SEQ ID NO: 2549235 - DNA, 22 bp, Homo sapiens
ccctgttttctgagcccgggct

SEQ ID NO: 2549236 - DNA, 14 bp, Homo sapiens
cccttaaaatagaa

SEQ ID NO: 2549237 - DNA, 15 bp, Homo sapiens
cccttacacgtacct

SEQ ID NO: 2549238 - DNA, 16 bp, Homo sapiens
cccttacacgtacctc

SEQ ID NO: 2549239 - DNA, 22 bp, Homo sapiens
cccttaccccttagcctccctg

SEQ ID NO: 2549240 - DNA, 14 bp, Homo sapiens
cccttagcccccac

SEQ ID NO: 2549241 - DNA, 19 bp, Homo sapiens
cccttagcccccacccact

SEQ ID NO: 2549242 - DNA, 17 bp, Homo sapiens
cccttagcctccctgaa

SEQ ID NO: 2549243 - DNA, 12 bp, Homo sapiens
cccttatccagg

SEQ ID NO: 2549244 - DNA, 16 bp, Homo sapiens
cccttatccaggactc

SEQ ID NO: 2549245 - DNA, 16 bp, Homo sapiens
cccttcacagtgtttc

SEQ ID NO: 2549246 - DNA, 17 bp, Homo sapiens
cccttcactgcctttgc

SEQ ID NO: 2549247 - DNA, 17 bp, Homo sapiens
cccttcacttctgacca

SEQ ID NO: 2549248 - DNA, 23 bp, Homo sapiens
cccttcacttctgaccacacttc

SEQ ID NO: 2549249 - DNA, 19 bp, Homo sapiens
cccttcagtaccctctcag

SEQ ID NO: 2549250 - DNA, 15 bp, Homo sapiens
cccttcatctccagg

SEQ ID NO: 2549251 - DNA, 16 bp, Homo sapiens
cccttcatctggaacc

SEQ ID NO: 2549252 - DNA, 17 bp, Homo sapiens
cccttccacacccccac

SEQ ID NO: 2549253 - DNA, 13 bp, Homo sapiens
cccttccactgag

SEQ ID NO: 2549254 - DNA, 18 bp, Homo sapiens
cccttcccatctcttcct

SEQ ID NO: 2549255 - DNA, 12 bp, Homo sapiens
cccttccccact

SEQ ID NO: 2549256 - DNA, 21 bp, Homo sapiens
cccttcccctaccccctcctc

SEQ ID NO: 2549257 - DNA, 12 bp, Homo sapiens
cccttcccctcc

SEQ ID NO: 2549258 - DNA, 13 bp, Homo sapiens
cccttccctgcaa

SEQ ID NO: 2549259 - DNA, 15 bp, Homo sapiens
cccttccctgtccct

SEQ ID NO: 2549260 - DNA, 13 bp, Homo sapiens
cccttcgctcctg

SEQ ID NO: 2549261 - DNA, 18 bp, Homo sapiens
cccttcgctcctgtgtct

SEQ ID NO: 2549262 - DNA, 15 bp, Homo sapiens
cccttctcatcactc

SEQ ID NO: 2549263 - DNA, 19 bp, Homo sapiens
cccttctcatcactcccct

SEQ ID NO: 2549264 - DNA, 17 bp, Homo sapiens
cccttctccatctctct

SEQ ID NO: 2549265 - DNA, 21 bp, Homo sapiens
cccttctccatctctctggcc

SEQ ID NO: 2549266 - DNA, 15 bp, Homo sapiens
cccttctcccacact

SEQ ID NO: 2549267 - DNA, 14 bp, Homo sapiens
cccttctctccagc

SEQ ID NO: 2549268 - DNA, 16 bp, Homo sapiens
cccttctctgctccac

SEQ ID NO: 2549269 - DNA, 22 bp, Homo sapiens
cccttctgacccatgctgccct

SEQ ID NO: 2549270 - DNA, 13 bp, Homo sapiens
cccttctttcctc

SEQ ID NO: 2549271 - DNA, 11 bp, Homo sapiens
cccttcttttt

SEQ ID NO: 2549272 - DNA, 17 bp, Homo sapiens
cccttgaaattttaaac

SEQ ID NO: 2549273 - DNA, 14 bp, Homo sapiens
cccttgagaaacct

SEQ ID NO: 2549274 - DNA, 18 bp, Homo sapiens
cccttgagctccccaaaa

SEQ ID NO: 2549275 - DNA, 23 bp, Homo sapiens
cccttgcagttcagcaccaccct

SEQ ID NO: 2549276 - DNA, 13 bp, Homo sapiens
cccttgccagaca

SEQ ID NO: 2549277 - DNA, 15 bp, Homo sapiens
cccttgccagacatg

SEQ ID NO: 2549278 - DNA, 12 bp, Homo sapiens
cccttgcccagg

SEQ ID NO: 2549279 - DNA, 20 bp, Homo sapiens
cccttgcccagggctcagcc

SEQ ID NO: 2549280 - DNA, 13 bp, Homo sapiens
cccttgccctgac

SEQ ID NO: 2549281 - DNA, 19 bp, Homo sapiens
cccttgccctgacctccca

SEQ ID NO: 2549282 - DNA, 22 bp, Homo sapiens
cccttgccgtctacctgagggg

SEQ ID NO: 2549283 - DNA, 17 bp, Homo sapiens
cccttggaaacctgccc

SEQ ID NO: 2549284 - DNA, 18 bp, Homo sapiens
cccttggaaacctgccct

SEQ ID NO: 2549285 - DNA, 17 bp, Homo sapiens
cccttggaggctgtctt

SEQ ID NO: 2549286 - DNA, 16 bp, Homo sapiens
cccttggcctgtctca

SEQ ID NO: 2549287 - DNA, 14 bp, Homo sapiens
cccttggctgtgag

SEQ ID NO: 2549288 - DNA, 18 bp, Homo sapiens
cccttgggcggctgagag

SEQ ID NO: 2549289 - DNA, 16 bp, Homo sapiens
cccttgggttctgata

SEQ ID NO: 2549290 - DNA, 22 bp, Homo sapiens
cccttggttaggcattgtggga

SEQ ID NO: 2549291 - DNA, 15 bp, Homo sapiens
cccttgtcccactca

SEQ ID NO: 2549292 - DNA, 23 bp, Homo sapiens
cccttgtgcgtgggtgaagccgc

SEQ ID NO: 2549293 - DNA, 20 bp, Homo sapiens
cccttgtggtcccaccccac

SEQ ID NO: 2549294 - DNA, 15 bp, Homo sapiens
ccctttccttccatc

SEQ ID NO: 2549295 - DNA, 12 bp, Homo sapiens
ccctttctgtgt

SEQ ID NO: 2549296 - DNA, 14 bp, Homo sapiens
ccctttcttggcca

SEQ ID NO: 2549297 - DNA, 15 bp, Homo sapiens
ccctttcttggccag

SEQ ID NO: 2549298 - DNA, 16 bp, Homo sapiens
ccctttcttggccagt

SEQ ID NO: 2549299 - DNA, 20 bp, Homo sapiens
ccctttgacgccatcccagc

SEQ ID NO: 2549300 - DNA, 14 bp, Homo sapiens
ccctttgggcccag

SEQ ID NO: 2549301 - DNA, 18 bp, Homo sapiens
ccctttgggcccagggac

SEQ ID NO: 2549302 - DNA, 16 bp, Homo sapiens
cccttttctacagtta

SEQ ID NO: 2549303 - DNA, 23 bp, Homo sapiens
cccttttcttttctaccctagcc

SEQ ID NO: 2549304 - DNA, 22 bp, Homo sapiens
cccttttggcccccgagctggg

SEQ ID NO: 2549305 - DNA, 16 bp, Homo sapiens
ccctttttactcccct

SEQ ID NO: 2549306 - DNA, 16 bp, Homo sapiens
ccctttttctccagct

SEQ ID NO: 2549307 - DNA, 17 bp, Homo sapiens
cccttttttggctgctg

SEQ ID NO: 2549308 - DNA, 18 bp, Homo sapiens
cccttttttggctgctga

SEQ ID NO: 2549309 - DNA, 17 bp, Homo sapiens
ccgaaaaatcctcttcc

SEQ ID NO: 2549310 - DNA, 22 bp, Homo sapiens
ccgaaaaatcctcttcctctga

SEQ ID NO: 2549311 - DNA, 23 bp, Homo sapiens
ccgaacatcaccgacgcgtctcc

SEQ ID NO: 2549312 - DNA, 15 bp, Homo sapiens
ccgaacctcctctgt

SEQ ID NO: 2549313 - DNA, 17 bp, Homo sapiens
ccgaactgttgtataaa

SEQ ID NO: 2549314 - DNA, 16 bp, Homo sapiens
ccgaatagctgggact

SEQ ID NO: 2549315 - DNA, 19 bp, Homo sapiens
ccgaatcccctccctgtca

SEQ ID NO: 2549316 - DNA, 20 bp, Homo sapiens
ccgacaaccgatgctccagc

SEQ ID NO: 2549317 - DNA, 13 bp, Homo sapiens
ccgaccagagccc

SEQ ID NO: 2549318 - DNA, 19 bp, Homo sapiens
ccgaccgaggctggagctg

SEQ ID NO: 2549319 - DNA, 21 bp, Homo sapiens
ccgaccgaggctggagctggc

SEQ ID NO: 2549320 - DNA, 14 bp, Homo sapiens
ccgagaagccagtg

SEQ ID NO: 2549321 - DNA, 23 bp, Homo sapiens
ccgagcaaagatcaaaataaaaa

SEQ ID NO: 2549322 - DNA, 16 bp, Homo sapiens
ccgagccgggcctggg

SEQ ID NO: 2549323 - DNA, 21 bp, Homo sapiens
ccgagcctctgtcactgcagg

SEQ ID NO: 2549324 - DNA, 19 bp, Homo sapiens
ccgagcgctttctggaaaa

SEQ ID NO: 2549325 - DNA, 20 bp, Homo sapiens
ccgagctcgtgtatcctggg

SEQ ID NO: 2549326 - DNA, 17 bp, Homo sapiens
ccgagctggtgcattac

SEQ ID NO: 2549327 - DNA, 18 bp, Homo sapiens
ccgaggacccagacccag

SEQ ID NO: 2549328 - DNA, 14 bp, Homo sapiens
ccgaggcagggtca

SEQ ID NO: 2549329 - DNA, 17 bp, Homo sapiens
ccgagtagctgggacta

SEQ ID NO: 2549330 - DNA, 20 bp, Homo sapiens
ccgagtagctgggactacag

SEQ ID NO: 2549331 - DNA, 14 bp, Homo sapiens
ccgagtctgtctct

SEQ ID NO: 2549332 - DNA, 14 bp, Homo sapiens
ccgatccttcctcc

SEQ ID NO: 2549333 - DNA, 22 bp, Homo sapiens
ccgatgctgctttcccctgtgg

SEQ ID NO: 2549334 - DNA, 23 bp, Homo sapiens
ccgatgctgctttcccctgtggg

SEQ ID NO: 2549335 - DNA, 16 bp, Homo sapiens
ccgcaaaccacactgg

SEQ ID NO: 2549336 - DNA, 16 bp, Homo sapiens
ccgcacccccaccctt

SEQ ID NO: 2549337 - DNA, 13 bp, Homo sapiens
ccgcaccccccaa

SEQ ID NO: 2549338 - DNA, 14 bp, Homo sapiens
ccgcagctcttgcc

SEQ ID NO: 2549339 - DNA, 12 bp, Homo sapiens
ccgcaggaagct

SEQ ID NO: 2549340 - DNA, 14 bp, Homo sapiens
ccgcaggaagctgc

SEQ ID NO: 2549341 - DNA, 16 bp, Homo sapiens
ccgcatgcggcccagg

SEQ ID NO: 2549342 - DNA, 17 bp, Homo sapiens
ccgccacctatctcgtg

SEQ ID NO: 2549343 - DNA, 23 bp, Homo sapiens
ccgccacctatctcgtgggagag

SEQ ID NO: 2549344 - DNA, 16 bp, Homo sapiens
ccgccagatggggcct

SEQ ID NO: 2549345 - DNA, 12 bp, Homo sapiens
ccgccaggcgag

SEQ ID NO: 2549346 - DNA, 12 bp, Homo sapiens
ccgccagggccc

SEQ ID NO: 2549347 - DNA, 21 bp, Homo sapiens
ccgccagggcccacaccccct

SEQ ID NO: 2549348 - DNA, 20 bp, Homo sapiens
ccgccattctcaagccctgc

SEQ ID NO: 2549349 - DNA, 15 bp, Homo sapiens
ccgccattgccacca

SEQ ID NO: 2549350 - DNA, 19 bp, Homo sapiens
ccgccattgccaccaggag

SEQ ID NO: 2549351 - DNA, 20 bp, Homo sapiens
ccgcccaggcttagtcactg

SEQ ID NO: 2549352 - DNA, 11 bp, Homo sapiens
ccgccccctgc

SEQ ID NO: 2549353 - DNA, 16 bp, Homo sapiens
ccgccccctgccctcc

SEQ ID NO: 2549354 - DNA, 14 bp, Homo sapiens
ccgccccgccccac

SEQ ID NO: 2549355 - DNA, 19 bp, Homo sapiens
ccgccctgctcctccctgg

SEQ ID NO: 2549356 - DNA, 15 bp, Homo sapiens
ccgcctcccagcctg

SEQ ID NO: 2549357 - DNA, 22 bp, Homo sapiens
ccgcctgcccgtctctctccca

SEQ ID NO: 2549358 - DNA, 14 bp, Homo sapiens
ccgcctgccctcat

SEQ ID NO: 2549359 - DNA, 21 bp, Homo sapiens
ccgcctggcagaactgagctc

SEQ ID NO: 2549360 - DNA, 16 bp, Homo sapiens
ccgcgcccgcgccctc

SEQ ID NO: 2549361 - DNA, 16 bp, Homo sapiens
ccgcgcctccttcctt

SEQ ID NO: 2549362 - DNA, 23 bp, Homo sapiens
ccgtgagttctcagggctcctgc

SEQ ID NO: 2549363 - DNA, 17 bp, Homo sapiens
ccgtgatgctcaggctt

SEQ ID NO: 2549364 - DNA, 18 bp, Homo sapiens
ccgtgcagcttctgtcct

SEQ ID NO: 2549365 - DNA, 20 bp, Homo sapiens
ccgtgcccaggggcccacag

SEQ ID NO: 2549366 - DNA, 22 bp, Homo sapiens
ccgtgcctccaccaccactggc

SEQ ID NO: 2549367 - DNA, 23 bp, Homo sapiens
ccgtgcttgtttgctcacctggg

SEQ ID NO: 2549368 - DNA, 17 bp, Homo sapiens
ccgtggaccttcctgcc

SEQ ID NO: 2549369 - DNA, 23 bp, Homo sapiens
ccgtggagatgggatgcttgcct

SEQ ID NO: 2549370 - DNA, 15 bp, Homo sapiens
ccgtggcactgcata

SEQ ID NO: 2549371 - DNA, 13 bp, Homo sapiens
ccgtgggcctggg

SEQ ID NO: 2549372 - DNA, 20 bp, Homo sapiens
ccgtggtgttatttaaagaa

SEQ ID NO: 2549373 - DNA, 16 bp, Homo sapiens
ccgtgtgccctcgggc

SEQ ID NO: 2549374 - DNA, 13 bp, Homo sapiens
ccgtgtggcccct

SEQ ID NO: 2549375 - DNA, 15 bp, Homo sapiens
ccgtgtggccccttc

SEQ ID NO: 2549376 - DNA, 21 bp, Homo sapiens
ccgtgtgttctccgtccctgc

SEQ ID NO: 2549377 - DNA, 20 bp, Homo sapiens
ccgttattataattgtatca

SEQ ID NO: 2549378 - DNA, 23 bp, Homo sapiens
ccgttctgctggcctggatctcc

SEQ ID NO: 2549379 - DNA, 19 bp, Homo sapiens
ccgttgatgttggctggga

SEQ ID NO: 2549380 - DNA, 15 bp, Homo sapiens
ccgtttcttccctgt

SEQ ID NO: 2549381 - DNA, 13 bp, Homo sapiens
cctaaaacaaaag

SEQ ID NO: 2549382 - DNA, 18 bp, Homo sapiens
cctaaaacaaaagctcat

SEQ ID NO: 2549383 - DNA, 18 bp, Homo sapiens
cctaaaagcacactcatc

SEQ ID NO: 2549384 - DNA, 14 bp, Homo sapiens
cctaaaagtaaaca

SEQ ID NO: 2549385 - DNA, 21 bp, Homo sapiens
cctaaaccaaaaactgaaagt

SEQ ID NO: 2549386 - DNA, 11 bp, Homo sapiens
cctaaactgta

SEQ ID NO: 2549387 - DNA, 14 bp, Homo sapiens
cctaaagtgtattt

SEQ ID NO: 2549388 - DNA, 15 bp, Homo sapiens
cctaactcatactgt

SEQ ID NO: 2549389 - DNA, 14 bp, Homo sapiens
cctaaggacacact

SEQ ID NO: 2549390 - DNA, 16 bp, Homo sapiens
cctaaggatctctcag

SEQ ID NO: 2549391 - DNA, 23 bp, Homo sapiens
cctaaggatctctcaggagcaca

SEQ ID NO: 2549392 - DNA, 24 bp, Homo sapiens
cctaaggatctctcaggagcacag

SEQ ID NO: 2549393 - DNA, 23 bp, Homo sapiens
cctaagggacatgttttgataaa

SEQ ID NO: 2549394 - DNA, 22 bp, Homo sapiens
cctaataaacatccttcaagaa

SEQ ID NO: 2549395 - DNA, 18 bp, Homo sapiens
cctaatgtttatgagcca

SEQ ID NO: 2549396 - DNA, 19 bp, Homo sapiens
cctaatgtttatgagccag

SEQ ID NO: 2549397 - DNA, 18 bp, Homo sapiens
cctacaagagcagcctgt

SEQ ID NO: 2549398 - DNA, 19 bp, Homo sapiens
cctacaagagcagcctgtg

SEQ ID NO: 2549399 - DNA, 16 bp, Homo sapiens
cctacagtgtacagtc

SEQ ID NO: 2549400 - DNA, 20 bp, Homo sapiens
cctacagtgtacagtcttgt

SEQ ID NO: 2549401 - DNA, 21 bp, Homo sapiens
cctacagttgaaaaacagctg

SEQ ID NO: 2549402 - DNA, 22 bp, Homo sapiens
cctacagttgaaaaacagctga

SEQ ID NO: 2549403 - DNA, 17 bp, Homo sapiens
cctacatgctttgtgaa

SEQ ID NO: 2549404 - DNA, 17 bp, Homo sapiens
cctaccaatagattccc

SEQ ID NO: 2549405 - DNA, 13 bp, Homo sapiens
cctaccacagtgt

SEQ ID NO: 2549406 - DNA, 17 bp, Homo sapiens
cctaccaccccttcctg

SEQ ID NO: 2549407 - DNA, 23 bp, Homo sapiens
cctaccagcgcccgctgggctga

SEQ ID NO: 2549408 - DNA, 15 bp, Homo sapiens
cctacccaaccactc

SEQ ID NO: 2549409 - DNA, 13 bp, Homo sapiens
cctacccacacct

SEQ ID NO: 2549410 - DNA, 19 bp, Homo sapiens
cctacccacacctctgcca

SEQ ID NO: 2549411 - DNA, 19 bp, Homo sapiens
cctaccccaattccttgta

SEQ ID NO: 2549412 - DNA, 18 bp, Homo sapiens
cctaccccacaccaggcc

SEQ ID NO: 2549413 - DNA, 17 bp, Homo sapiens
cctaccccctcctctct

SEQ ID NO: 2549414 - DNA, 14 bp, Homo sapiens
cctaccctcgggcc

SEQ ID NO: 2549415 - DNA, 13 bp, Homo sapiens
cctacctcagcct

SEQ ID NO: 2549416 - DNA, 12 bp, Homo sapiens
cctacctcaggt

SEQ ID NO: 2549417 - DNA, 23 bp, Homo sapiens
cctacctcaggttgctggttgct

SEQ ID NO: 2549418 - DNA, 14 bp, Homo sapiens
cctacctgtgcctg

SEQ ID NO: 2549419 - DNA, 17 bp, Homo sapiens
cctacctgttcagtgtc

SEQ ID NO: 2549420 - DNA, 22 bp, Homo sapiens
cctacctgttcagtgtcccggg

SEQ ID NO: 2549421 - DNA, 19 bp, Homo sapiens
cctaccttcatttcaggag

SEQ ID NO: 2549422 - DNA, 20 bp, Homo sapiens
cctacgtcaaacatgaagtg

SEQ ID NO: 2549423 - DNA, 21 bp, Homo sapiens
cctacgtcaaacatgaagtgt

SEQ ID NO: 2549424 - DNA, 16 bp, Homo sapiens
cctactccaaaatgtt

SEQ ID NO: 2549425 - DNA, 16 bp, Homo sapiens
cctccctttttccttg

SEQ ID NO: 2549426 - DNA, 19 bp, Homo sapiens
cctccctttttccttgtcc

SEQ ID NO: 2549427 - DNA, 19 bp, Homo sapiens
cctccgccttcactccggt

SEQ ID NO: 2549428 - DNA, 20 bp, Homo sapiens
cctccgcgtgatcaaagcca

SEQ ID NO: 2549429 - DNA, 15 bp, Homo sapiens
cctccggcctcccct

SEQ ID NO: 2549430 - DNA, 18 bp, Homo sapiens
cctccgggacctggtgct

SEQ ID NO: 2549431 - DNA, 15 bp, Homo sapiens
cctccgtatttcaga

SEQ ID NO: 2549432 - DNA, 16 bp, Homo sapiens
cctccgtatttcagac

SEQ ID NO: 2549433 - DNA, 19 bp, Homo sapiens
cctcctatcacctcccctc

SEQ ID NO: 2549434 - DNA, 22 bp, Homo sapiens
cctcctattcagttcccagaat

SEQ ID NO: 2549435 - DNA, 13 bp, Homo sapiens
cctcctcacctct

SEQ ID NO: 2549436 - DNA, 21 bp, Homo sapiens
cctcctcacctctggactggc

SEQ ID NO: 2549437 - DNA, 22 bp, Homo sapiens
cctcctcacctctggactggct

SEQ ID NO: 2549438 - DNA, 12 bp, Homo sapiens
cctcctccagcc

SEQ ID NO: 2549439 - DNA, 14 bp, Homo sapiens
cctcctcccttagc

SEQ ID NO: 2549440 - DNA, 15 bp, Homo sapiens
cctcctcccttagct

SEQ ID NO: 2549441 - DNA, 14 bp, Homo sapiens
cctcctctcccatc

SEQ ID NO: 2549442 - DNA, 11 bp, Homo sapiens
cctcctctgtg

SEQ ID NO: 2549443 - DNA, 17 bp, Homo sapiens
cctcctcttctgacgtg

SEQ ID NO: 2549444 - DNA, 18 bp, Homo sapiens
cctcctgacctgaggctc

SEQ ID NO: 2549445 - DNA, 18 bp, Homo sapiens
cctcctgagtagctggga

SEQ ID NO: 2549446 - DNA, 17 bp, Homo sapiens
cctcctgcccacctgtc

SEQ ID NO: 2549447 - DNA, 13 bp, Homo sapiens
cctcctgcctcga

SEQ ID NO: 2549448 - DNA, 18 bp, Homo sapiens
cctcctgcgcgcatgtgc

SEQ ID NO: 2549449 - DNA, 17 bp, Homo sapiens
cctcctgggatctgctc

SEQ ID NO: 2549450 - DNA, 13 bp, Homo sapiens
cctcctgggctaa

SEQ ID NO: 2549451 - DNA, 14 bp, Homo sapiens
cctcctgggctaag

SEQ ID NO: 2549452 - DNA, 22 bp, Homo sapiens
cctcctgtaaatggtgtacata

SEQ ID NO: 2549453 - DNA, 15 bp, Homo sapiens
cctcctgtgtgtgcg

SEQ ID NO: 2549454 - DNA, 22 bp, Homo sapiens
cctcctgtgtgtgcgcctacag

SEQ ID NO: 2549455 - DNA, 16 bp, Homo sapiens
cctcctgttgcaccca

SEQ ID NO: 2549456 - DNA, 19 bp, Homo sapiens
cctcctgttgcacccagcc

SEQ ID NO: 2549457 - DNA, 20 bp, Homo sapiens
cctccttccttgctgtccta

SEQ ID NO: 2549458 - DNA, 23 bp, Homo sapiens
cctccttctctgtctcatgtgtg

SEQ ID NO: 2549459 - DNA, 15 bp, Homo sapiens
cctccttgtccaccc

SEQ ID NO: 2549460 - DNA, 19 bp, Homo sapiens
cctcctttgtgaggaagcc

SEQ ID NO: 2549461 - DNA, 23 bp, Homo sapiens
cctcctttgtgaggaagccgctg

SEQ ID NO: 2549462 - DNA, 16 bp, Homo sapiens
cctcgagggcagggac

SEQ ID NO: 2549463 - DNA, 14 bp, Homo sapiens
cctcgcagagaggc

SEQ ID NO: 2549464 - DNA, 19 bp, Homo sapiens
cctcgctgccagctctgta

SEQ ID NO: 2549465 - DNA, 12 bp, Homo sapiens
cctcgctgcttc

SEQ ID NO: 2549466 - DNA, 17 bp, Homo sapiens
cctcgctggactctcag

SEQ ID NO: 2549467 - DNA, 12 bp, Homo sapiens
cctcgcttggac

SEQ ID NO: 2549468 - DNA, 16 bp, Homo sapiens
cctcgggcccacctgg

SEQ ID NO: 2549469 - DNA, 15 bp, Homo sapiens
cctcgggcccagccc

SEQ ID NO: 2549470 - DNA, 18 bp, Homo sapiens
cctcgggcccagccccca

SEQ ID NO: 2549471 - DNA, 19 bp, Homo sapiens
cctcgggcgagtcactgcc

SEQ ID NO: 2549472 - DNA, 22 bp, Homo sapiens
cctcgggcgagtcactgcctct

SEQ ID NO: 2549473 - DNA, 17 bp, Homo sapiens
cctcgggtctcctcact

SEQ ID NO: 2549474 - DNA, 14 bp, Homo sapiens
cctcggtgtggaga

SEQ ID NO: 2549475 - DNA, 14 bp, Homo sapiens
cctcgtggccagcc

SEQ ID NO: 2549476 - DNA, 15 bp, Homo sapiens
cctcgtggccagccc

SEQ ID NO: 2549477 - DNA, 22 bp, Homo sapiens
cctcgtggccagcccggctggt

SEQ ID NO: 2549478 - DNA, 17 bp, Homo sapiens
cctctaaccccaggccc

SEQ ID NO: 2549479 - DNA, 14 bp, Homo sapiens
cctctaagccactc

SEQ ID NO: 2549480 - DNA, 19 bp, Homo sapiens
cctctagggacccctcctc

SEQ ID NO: 2549481 - DNA, 13 bp, Homo sapiens
cctctagtgccct

SEQ ID NO: 2549482 - DNA, 14 bp, Homo sapiens
cctctattgatgta

SEQ ID NO: 2549483 - DNA, 20 bp, Homo sapiens
cctctattgatgtacagtct

SEQ ID NO: 2549484 - DNA, 15 bp, Homo sapiens
cctctcactgtctga

SEQ ID NO: 2549485 - DNA, 19 bp, Homo sapiens
cctctcactgtctgagagt

SEQ ID NO: 2549486 - DNA, 22 bp, Homo sapiens
cctctcagagctacttgggcca

SEQ ID NO: 2549487 - DNA, 18 bp, Homo sapiens
cctctcagctccaggtgg

SEQ ID NO: 2549488 - DNA, 18 bp, Homo sapiens
cctctcaggtgaccaaaa

SEQ ID NO: 2549489 - DNA, 23 bp, Homo sapiens
cctctcatcagtgtcctcttgct

SEQ ID NO: 2549490 - DNA, 18 bp, Homo sapiens
cctctcattccagaggaa

SEQ ID NO: 2549491 - DNA, 21 bp, Homo sapiens
cctctccaagggcttctgcac

SEQ ID NO: 2549492 - DNA, 14 bp, Homo sapiens
cctctccagctata

SEQ ID NO: 2549493 - DNA, 17 bp, Homo sapiens
cctctccaggcaccctt

SEQ ID NO: 2549494 - DNA, 21 bp, Homo sapiens
cctctcccatccccctgccct

SEQ ID NO: 2549495 - DNA, 16 bp, Homo sapiens
cctctcccctgattac

SEQ ID NO: 2549496 - DNA, 17 bp, Homo sapiens
cctctcccgtcagggcc

SEQ ID NO: 2549497 - DNA, 22 bp, Homo sapiens
cctctcccgtcagggcccaagt

SEQ ID NO: 2549498 - DNA, 17 bp, Homo sapiens
cctctccctcaacaagg

SEQ ID NO: 2549499 - DNA, 15 bp, Homo sapiens
cctctccctggccct

SEQ ID NO: 2549500 - DNA, 22 bp, Homo sapiens
cctctcccttggattgtccccg

SEQ ID NO: 2549501 - DNA, 11 bp, Homo sapiens
cctctcctgga

SEQ ID NO: 2549502 - DNA, 13 bp, Homo sapiens
cctctcctggagg

SEQ ID NO: 2549503 - DNA, 14 bp, Homo sapiens
cctctcctggagga

SEQ ID NO: 2549504 - DNA, 15 bp, Homo sapiens
cctctcctttgtata

SEQ ID NO: 2549505 - DNA, 14 bp, Homo sapiens
cctctctcactcct

SEQ ID NO: 2549506 - DNA, 15 bp, Homo sapiens
cctctctcccagtct

SEQ ID NO: 2549507 - DNA, 14 bp, Homo sapiens
cctctctcctttgc

SEQ ID NO: 2549508 - DNA, 11 bp, Homo sapiens
cctctctctga

SEQ ID NO: 2549509 - DNA, 20 bp, Homo sapiens
cctctctcttctgctccacc

SEQ ID NO: 2549510 - DNA, 15 bp, Homo sapiens
cctctctggcctccc

SEQ ID NO: 2549511 - DNA, 16 bp, Homo sapiens
cctctctggcctccca

SEQ ID NO: 2549512 - DNA, 14 bp, Homo sapiens
cctctcttgcaccc

SEQ ID NO: 2549513 - DNA, 20 bp, Homo sapiens
cctctgaatgaaccttctgg

SEQ ID NO: 2549514 - DNA, 17 bp, Homo sapiens
cctctgacacacagctc

SEQ ID NO: 2549515 - DNA, 20 bp, Homo sapiens
cctctgacacacagctctgt

SEQ ID NO: 2549516 - DNA, 12 bp, Homo sapiens
cctctgacctat

SEQ ID NO: 2549517 - DNA, 20 bp, Homo sapiens
cctctgacctgcaggccaag

SEQ ID NO: 2549518 - DNA, 22 bp, Homo sapiens
cctctgactcagggctcctggg

SEQ ID NO: 2549519 - DNA, 17 bp, Homo sapiens
cctctgagctttgcatg

SEQ ID NO: 2549520 - DNA, 18 bp, Homo sapiens
cctctgatacccagagca

SEQ ID NO: 2549521 - DNA, 16 bp, Homo sapiens
cctctgatctccatgg

SEQ ID NO: 2549522 - DNA, 17 bp, Homo sapiens
cctctgcacaagctgca

SEQ ID NO: 2549523 - DNA, 20 bp, Homo sapiens
cctctgcacaagctgcaccc

SEQ ID NO: 2549524 - DNA, 16 bp, Homo sapiens
cctctgcactcccctg

SEQ ID NO: 2549525 - DNA, 17 bp, Homo sapiens
cctctgcactcccctgc

SEQ ID NO: 2549526 - DNA, 20 bp, Homo sapiens
cctctgcactcccctgctgg

SEQ ID NO: 2549527 - DNA, 20 bp, Homo sapiens
cctctgcccagcttgggccc

SEQ ID NO: 2549528 - DNA, 21 bp, Homo sapiens
cctctgcctctgacacacagc

SEQ ID NO: 2549529 - DNA, 11 bp, Homo sapiens
cctctgcctga

SEQ ID NO: 2549530 - DNA, 21 bp, Homo sapiens
cctctgcctgaaccttccatc

SEQ ID NO: 2549531 - DNA, 15 bp, Homo sapiens
cctctgcctgtctcc

SEQ ID NO: 2549532 - DNA, 11 bp, Homo sapiens
cctctgctacg

SEQ ID NO: 2549533 - DNA, 21 bp, Homo sapiens
cctctgctacgttcctattgt

SEQ ID NO: 2549534 - DNA, 13 bp, Homo sapiens
cctctgctcctgg

SEQ ID NO: 2549535 - DNA, 14 bp, Homo sapiens
cctctgctctgagg

SEQ ID NO: 2549536 - DNA, 20 bp, Homo sapiens
cctctgctctgaggcttcca

SEQ ID NO: 2549537 - DNA, 22 bp, Homo sapiens
cctctgctctgaggcttccaga

SEQ ID NO: 2549538 - DNA, 15 bp, Homo sapiens
cctctgctgctggct

SEQ ID NO: 2549539 - DNA, 16 bp, Homo sapiens
cctctgctgctggctg

SEQ ID NO: 2549540 - DNA, 15 bp, Homo sapiens
cctctggactggcta

SEQ ID NO: 2549541 - DNA, 17 bp, Homo sapiens
cctctggaggggtgtgg

SEQ ID NO: 2549542 - DNA, 16 bp, Homo sapiens
cctctggatggcacca

SEQ ID NO: 2549543 - DNA, 12 bp, Homo sapiens
cctctggccagg

SEQ ID NO: 2549544 - DNA, 22 bp, Homo sapiens
cctctggctagaggccagcccc

SEQ ID NO: 2549545 - DNA, 12 bp, Homo sapiens
cctctgggactg

SEQ ID NO: 2549546 - DNA, 16 bp, Homo sapiens
cctctggtctgggtgc

SEQ ID NO: 2549547 - DNA, 18 bp, Homo sapiens
cctctggtttggggcgag

SEQ ID NO: 2549548 - DNA, 21 bp, Homo sapiens
cctctggtttggggcgaggca

SEQ ID NO: 2549549 - DNA, 15 bp, Homo sapiens
cctctgtacagagcc

SEQ ID NO: 2549550 - DNA, 17 bp, Homo sapiens
cctctgtcactgcaggc

SEQ ID NO: 2549551 - DNA, 15 bp, Homo sapiens
cctctgtccaggcac

SEQ ID NO: 2549552 - DNA, 21 bp, Homo sapiens
cctctgtccaggcactgagat

SEQ ID NO: 2549553 - DNA, 21 bp, Homo sapiens
cctctgtccagggccctgagc

SEQ ID NO: 2549554 - DNA, 13 bp, Homo sapiens
cctctgtctgccc

SEQ ID NO: 2549555 - DNA, 20 bp, Homo sapiens
cctctgtcttggctttcatg

SEQ ID NO: 2549556 - DNA, 22 bp, Homo sapiens
cctctgtcttggctttcatgtt

SEQ ID NO: 2549557 - DNA, 19 bp, Homo sapiens
cctctgtgaccaatgtctt

SEQ ID NO: 2549558 - DNA, 22 bp, Homo sapiens
cctctgttcagtgtaaatagtt

SEQ ID NO: 2549559 - DNA, 15 bp, Homo sapiens
cctctgttgtcctcc

SEQ ID NO: 2549560 - DNA, 18 bp, Homo sapiens
cctcttaaaaaataaaaa

SEQ ID NO: 2549561 - DNA, 17 bp, Homo sapiens
cctcttaaagctgcctg

SEQ ID NO: 2549562 - DNA, 20 bp, Homo sapiens
cctcttaaagctgcctgtag

SEQ ID NO: 2549563 - DNA, 22 bp, Homo sapiens
cctcttaaagctgcctgtagtt

SEQ ID NO: 2549564 - DNA, 14 bp, Homo sapiens
cctcttagaaaaac

SEQ ID NO: 2549565 - DNA, 14 bp, Homo sapiens
cctcttagctgagt

SEQ ID NO: 2549566 - DNA, 17 bp, Homo sapiens
cctcttatgggctgggt

SEQ ID NO: 2549567 - DNA, 18 bp, Homo sapiens
cctcttccatcatgtccc

SEQ ID NO: 2549568 - DNA, 19 bp, Homo sapiens
cctcttccggagatgtagc

SEQ ID NO: 2549569 - DNA, 20 bp, Homo sapiens
cctcttccggagatgtagca

SEQ ID NO: 2549570 - DNA, 16 bp, Homo sapiens
cctcttcctccctcat

SEQ ID NO: 2549571 - DNA, 15 bp, Homo sapiens
cctcttctcaagtgc

SEQ ID NO: 2549572 - DNA, 18 bp, Homo sapiens
cctcttctcaagtgcctt

SEQ ID NO: 2549573 - DNA, 18 bp, Homo sapiens
cctcttctgggagggcag

SEQ ID NO: 2549574 - DNA, 21 bp, Homo sapiens
cctcttctgggagggcagcag

SEQ ID NO: 2549575 - DNA, 22 bp, Homo sapiens
cctcttgccactgcctcttcct

SEQ ID NO: 2549576 - DNA, 21 bp, Homo sapiens
agcatgtttcatgttttgtga

SEQ ID NO: 2549577 - DNA, 14 bp, Homo sapiens
agcatgtttgctga

SEQ ID NO: 2549578 - DNA, 16 bp, Homo sapiens
agcatgtttgctgaac

SEQ ID NO: 2549579 - DNA, 14 bp, Homo sapiens
agcattaactaatc

SEQ ID NO: 2549580 - DNA, 17 bp, Homo sapiens
agcattacgtgagccag

SEQ ID NO: 2549581 - DNA, 14 bp, Homo sapiens
agcattccaacaaa

SEQ ID NO: 2549582 - DNA, 19 bp, Homo sapiens
agcattccaacaaagggtt

SEQ ID NO: 2549583 - DNA, 23 bp, Homo sapiens
agcattgctggttctatttaatg

SEQ ID NO: 2549584 - DNA, 13 bp, Homo sapiens
agcattgctttct

SEQ ID NO: 2549585 - DNA, 14 bp, Homo sapiens
agcattgctttctg

SEQ ID NO: 2549586 - DNA, 15 bp, Homo sapiens
agcattgctttctga

SEQ ID NO: 2549587 - DNA, 16 bp, Homo sapiens
agcattgctttctgaa

SEQ ID NO: 2549588 - DNA, 21 bp, Homo sapiens
agcattgtggctgtcagcagg

SEQ ID NO: 2549589 - DNA, 15 bp, Homo sapiens
agcattgtttgctta

SEQ ID NO: 2549590 - DNA, 23 bp, Homo sapiens
agcattgtttgcttattgttcca

SEQ ID NO: 2549591 - DNA, 21 bp, Homo sapiens
agcatttagtccaatgtcttt

SEQ ID NO: 2549592 - DNA, 14 bp, Homo sapiens
agcatttccaacac

SEQ ID NO: 2549593 - DNA, 23 bp, Homo sapiens
agcattttagcaatttatacaat

SEQ ID NO: 2549594 - DNA, 18 bp, Homo sapiens
agcatttttgatttatgc

SEQ ID NO: 2549595 - DNA, 14 bp, Homo sapiens
agccaaaccctgtc

SEQ ID NO: 2549596 - DNA, 15 bp, Homo sapiens
agccaaaccctgtct

SEQ ID NO: 2549597 - DNA, 13 bp, Homo sapiens
agccaaacccttg

SEQ ID NO: 2549598 - DNA, 14 bp, Homo sapiens
agccaaactctgcc

SEQ ID NO: 2549599 - DNA, 23 bp, Homo sapiens
agccaaagctaggcctggccaga

SEQ ID NO: 2549600 - DNA, 20 bp, Homo sapiens
agccaaatgtaattgaataa

SEQ ID NO: 2549601 - DNA, 13 bp, Homo sapiens
agccaactgctgc

SEQ ID NO: 2549602 - DNA, 21 bp, Homo sapiens
agccaactgctgctttttgag

SEQ ID NO: 2549603 - DNA, 18 bp, Homo sapiens
agccaacttgtaaataca

SEQ ID NO: 2549604 - DNA, 17 bp, Homo sapiens
agccaagcacagtggtg

SEQ ID NO: 2549605 - DNA, 18 bp, Homo sapiens
agccaagcacagtggtgg

SEQ ID NO: 2549606 - DNA, 21 bp, Homo sapiens
agccaagctagaattccctct

SEQ ID NO: 2549607 - DNA, 17 bp, Homo sapiens
agccaagctccttggga

SEQ ID NO: 2549608 - DNA, 23 bp, Homo sapiens
agccaagctccttgggaggcccc

SEQ ID NO: 2549609 - DNA, 18 bp, Homo sapiens
agccaagtccagatttac

SEQ ID NO: 2549610 - DNA, 20 bp, Homo sapiens
agccaatcccctccttgggc

SEQ ID NO: 2549611 - DNA, 21 bp, Homo sapiens
agccaatcccctccttgggca

SEQ ID NO: 2549612 - DNA, 13 bp, Homo sapiens
agccaatgctgtc

SEQ ID NO: 2549613 - DNA, 13 bp, Homo sapiens
agccaatgcttac

SEQ ID NO: 2549614 - DNA, 10 bp, Homo sapiens
agccacacac

SEQ ID NO: 2549615 - DNA, 13 bp, Homo sapiens
agccacacacaca

SEQ ID NO: 2549616 - DNA, 21 bp, Homo sapiens
agccacactctgggctccaga

SEQ ID NO: 2549617 - DNA, 17 bp, Homo sapiens
agccacagaagccagga

SEQ ID NO: 2549618 - DNA, 19 bp, Homo sapiens
agccacagaagccaggagc

SEQ ID NO: 2549619 - DNA, 13 bp, Homo sapiens
agccacagctggt

SEQ ID NO: 2549620 - DNA, 23 bp, Homo sapiens
agccaccaacatactcccatctg

SEQ ID NO: 2549621 - DNA, 13 bp, Homo sapiens
agccaccaactct

SEQ ID NO: 2549622 - DNA, 17 bp, Homo sapiens
agccaccaactcttgca

SEQ ID NO: 2549623 - DNA, 19 bp, Homo sapiens
agccaccccgggctctctg

SEQ ID NO: 2549624 - DNA, 20 bp, Homo sapiens
agccaccccgggctctctgc

SEQ ID NO: 2549625 - DNA, 15 bp, Homo sapiens
agccacctctccctc

SEQ ID NO: 2549626 - DNA, 22 bp, Homo sapiens
agccacctctccctcaacaagg

SEQ ID NO: 2549627 - DNA, 15 bp, Homo sapiens
agccactcaggaggc

SEQ ID NO: 2549628 - DNA, 17 bp, Homo sapiens
agttaggaaataaaacc

SEQ ID NO: 2549629 - DNA, 21 bp, Homo sapiens
agttaggaaataaaacctttc

SEQ ID NO: 2549630 - DNA, 16 bp, Homo sapiens
agttagtagcatgttg

SEQ ID NO: 2549631 - DNA, 17 bp, Homo sapiens
agttagtctactcttaa

SEQ ID NO: 2549632 - DNA, 22 bp, Homo sapiens
agttagtctactcttaagccat

SEQ ID NO: 2549633 - DNA, 23 bp, Homo sapiens
agttagtctactcttaagccatc

SEQ ID NO: 2549634 - DNA, 17 bp, Homo sapiens
agttagtggattactgc

SEQ ID NO: 2549635 - DNA, 16 bp, Homo sapiens
agttagtttctttggg

SEQ ID NO: 2549636 - DNA, 13 bp, Homo sapiens
agttatagtttca

SEQ ID NO: 2549637 - DNA, 16 bp, Homo sapiens
agttatagtttcagat

SEQ ID NO: 2549638 - DNA, 23 bp, Homo sapiens
agttatataggttttgtttgcta

SEQ ID NO: 2549639 - DNA, 21 bp, Homo sapiens
agttatcagacactctggctg

SEQ ID NO: 2549640 - DNA, 19 bp, Homo sapiens
agttatgccgctagataca

SEQ ID NO: 2549641 - DNA, 19 bp, Homo sapiens
agttatggctataggtgct

SEQ ID NO: 2549642 - DNA, 14 bp, Homo sapiens
agttatgtgaatga

SEQ ID NO: 2549643 - DNA, 16 bp, Homo sapiens
agttattgcagtttat

SEQ ID NO: 2549644 - DNA, 18 bp, Homo sapiens
agttattgcagtttatca

SEQ ID NO: 2549645 - DNA, 18 bp, Homo sapiens
agttattgtacagctgtt

SEQ ID NO: 2549646 - DNA, 21 bp, Homo sapiens
agttatttatttattggagat

SEQ ID NO: 2549647 - DNA, 13 bp, Homo sapiens
agttcaaacaaga

SEQ ID NO: 2549648 - DNA, 22 bp, Homo sapiens
agttcaatctcccgctgctgct

SEQ ID NO: 2549649 - DNA, 13 bp, Homo sapiens
agttcaatgatct

SEQ ID NO: 2549650 - DNA, 15 bp, Homo sapiens
agttcaatgatctag

SEQ ID NO: 2549651 - DNA, 22 bp, Homo sapiens
agttcaatgatctaggtttaac

SEQ ID NO: 2549652 - DNA, 16 bp, Homo sapiens
agttcactataaatgg

SEQ ID NO: 2549653 - DNA, 21 bp, Homo sapiens
agttcactataaatggtgttt

SEQ ID NO: 2549654 - DNA, 15 bp, Homo sapiens
agttcacttcatctt

SEQ ID NO: 2549655 - DNA, 17 bp, Homo sapiens
agttcagcaccacccta

SEQ ID NO: 2549656 - DNA, 16 bp, Homo sapiens
agttcaggagtcccaa

SEQ ID NO: 2549657 - DNA, 21 bp, Homo sapiens
agttcaggagtcccaaggaaa

SEQ ID NO: 2549658 - DNA, 18 bp, Homo sapiens
agttcaggtaacaggcag

SEQ ID NO: 2549659 - DNA, 19 bp, Homo sapiens
agttcaggtagctgcccct

SEQ ID NO: 2549660 - DNA, 20 bp, Homo sapiens
agttcaggtagctgcccctg

SEQ ID NO: 2549661 - DNA, 15 bp, Homo sapiens
agttcagtacctgga

SEQ ID NO: 2549662 - DNA, 19 bp, Homo sapiens
agttcagtggcactcaaca

SEQ ID NO: 2549663 - DNA, 22 bp, Homo sapiens
agttcagtggcagggctcagga

SEQ ID NO: 2549664 - DNA, 22 bp, Homo sapiens
agttcatatgtaccatgtacat

SEQ ID NO: 2549665 - DNA, 22 bp, Homo sapiens
agttcatccaatcctcactggg

SEQ ID NO: 2549666 - DNA, 17 bp, Homo sapiens
agttcatccattctatt

SEQ ID NO: 2549667 - DNA, 13 bp, Homo sapiens
agttcatgagaat

SEQ ID NO: 2549668 - DNA, 21 bp, Homo sapiens
agttcatgagaatctatattt

SEQ ID NO: 2549669 - DNA, 17 bp, Homo sapiens
agttcatgtttgcttca

SEQ ID NO: 2549670 - DNA, 13 bp, Homo sapiens
agttcccagaatc

SEQ ID NO: 2549671 - DNA, 16 bp, Homo sapiens
agttcccagaatcaaa

SEQ ID NO: 2549672 - DNA, 16 bp, Homo sapiens
agttccccatgcagac

SEQ ID NO: 2549673 - DNA, 19 bp, Homo sapiens
agttcctgaacctgatgct

SEQ ID NO: 2549674 - DNA, 20 bp, Homo sapiens
agttccttcagcttccattt

SEQ ID NO: 2549675 - DNA, 13 bp, Homo sapiens
ataaaattatgcc

SEQ ID NO: 2549676 - DNA, 13 bp, Homo sapiens
ataaaattatttt

SEQ ID NO: 2549677 - DNA, 22 bp, Homo sapiens
ataaaattctattacagtatgt

SEQ ID NO: 2549678 - DNA, 19 bp, Homo sapiens
ataaaattttttttcatgt

SEQ ID NO: 2549679 - DNA, 22 bp, Homo sapiens
ataaacaagaccacgtttctaa

SEQ ID NO: 2549680 - DNA, 22 bp, Homo sapiens
ataaacagtggaatataaggaa

SEQ ID NO: 2549681 - DNA, 23 bp, Homo sapiens
ataaacattaagattgaggcctg

SEQ ID NO: 2549682 - DNA, 20 bp, Homo sapiens
ataaacgatttaattctctt

SEQ ID NO: 2549683 - DNA, 12 bp, Homo sapiens
ataaactgactt

SEQ ID NO: 2549684 - DNA, 13 bp, Homo sapiens
ataaactgacttt

SEQ ID NO: 2549685 - DNA, 15 bp, Homo sapiens
ataaactgactttat

SEQ ID NO: 2549686 - DNA, 18 bp, Homo sapiens
ataaactgactttatcct

SEQ ID NO: 2549687 - DNA, 20 bp, Homo sapiens
ataaactgactttatcctca

SEQ ID NO: 2549688 - DNA, 14 bp, Homo sapiens
ataaactgtgtgca

SEQ ID NO: 2549689 - DNA, 16 bp, Homo sapiens
ataaactgtgtttact

SEQ ID NO: 2549690 - DNA, 13 bp, Homo sapiens
ataaactttacct

SEQ ID NO: 2549691 - DNA, 23 bp, Homo sapiens
ataaacttttttttgagaatggt

SEQ ID NO: 2549692 - DNA, 11 bp, Homo sapiens
ataaagacagg

SEQ ID NO: 2549693 - DNA, 15 bp, Homo sapiens
ataaagagagaaaaa

SEQ ID NO: 2549694 - DNA, 20 bp, Homo sapiens
ataaagatgatctactcaga

SEQ ID NO: 2549695 - DNA, 14 bp, Homo sapiens
ataaagatgctctt

SEQ ID NO: 2549696 - DNA, 18 bp, Homo sapiens
ataaagatggctgacttt

SEQ ID NO: 2549697 - DNA, 22 bp, Homo sapiens
ataaagcaactgttatgaaata

SEQ ID NO: 2549698 - DNA, 13 bp, Homo sapiens
ataaagcagcgtt

SEQ ID NO: 2549699 - DNA, 18 bp, Homo sapiens
ataaagcagcgtttctat

SEQ ID NO: 2549700 - DNA, 16 bp, Homo sapiens
ataaagccactgaaaa

SEQ ID NO: 2549701 - DNA, 14 bp, Homo sapiens
ataaagcctgcttt

SEQ ID NO: 2549702 - DNA, 20 bp, Homo sapiens
ataaagcctgttttgtcttt

SEQ ID NO: 2549703 - DNA, 20 bp, Homo sapiens
ataaaggaaaaaagagaagt

SEQ ID NO: 2549704 - DNA, 16 bp, Homo sapiens
ataaaggttgacaata

SEQ ID NO: 2549705 - DNA, 16 bp, Homo sapiens
ataaagtagtaaaaat

SEQ ID NO: 2549706 - DNA, 17 bp, Homo sapiens
ataaagtatcatgcatt

SEQ ID NO: 2549707 - DNA, 18 bp, Homo sapiens
ataaagtatcatgcattc

SEQ ID NO: 2549708 - DNA, 21 bp, Homo sapiens
ataaagttctgagtgttttta

SEQ ID NO: 2549709 - DNA, 16 bp, Homo sapiens
ataaataaatgcaata

SEQ ID NO: 2549710 - DNA, 12 bp, Homo sapiens
ataaataaatgt

SEQ ID NO: 2549711 - DNA, 15 bp, Homo sapiens
ataaataatctgtac

SEQ ID NO: 2549712 - DNA, 14 bp, Homo sapiens
ataaatacctctta

SEQ ID NO: 2549713 - DNA, 18 bp, Homo sapiens
ataaatacctcttagctg

SEQ ID NO: 2549714 - DNA, 23 bp, Homo sapiens
ataaatacctcttagctgagtgg

SEQ ID NO: 2549715 - DNA, 14 bp, Homo sapiens
ataaatatgaagct

SEQ ID NO: 2549716 - DNA, 22 bp, Homo sapiens
ataaatatgcctctcctttgta

SEQ ID NO: 2549717 - DNA, 15 bp, Homo sapiens
ataaatcaatgtcac

SEQ ID NO: 2549718 - DNA, 19 bp, Homo sapiens
ataaatcgcttttgataat

SEQ ID NO: 2549719 - DNA, 21 bp, Homo sapiens
ataaatcgcttttgataatca

SEQ ID NO: 2549720 - DNA, 14 bp, Homo sapiens
ataaatctgttgcc

SEQ ID NO: 2549721 - DNA, 11 bp, Homo sapiens
ataaatgaatg

SEQ ID NO: 2549722 - DNA, 17 bp, Homo sapiens
ataaatgaattttagtt

SEQ ID NO: 2549723 - DNA, 20 bp, Homo sapiens
ataaatgcaatatgtattaa

SEQ ID NO: 2549724 - DNA, 22 bp, Homo sapiens
ataaatgcaatatgtattaata

SEQ ID NO: 2549725 - DNA, 22 bp, Homo sapiens
ataaatggtatagcaaatgttt

SEQ ID NO: 2549726 - DNA, 22 bp, Homo sapiens
ataaatggttaaaagaggtttt

SEQ ID NO: 2549727 - DNA, 17 bp, Homo sapiens
ataaatgtatcatagaa

SEQ ID NO: 2549728 - DNA, 18 bp, Homo sapiens
ataaatgtatcttattca

SEQ ID NO: 2549729 - DNA, 21 bp, Homo sapiens
ataaatgtcattaaaataaat

SEQ ID NO: 2549730 - DNA, 15 bp, Homo sapiens
ataaatgtctgttga

SEQ ID NO: 2549731 - DNA, 13 bp, Homo sapiens
ataaattataagt

SEQ ID NO: 2549732 - DNA, 14 bp, Homo sapiens
ataaattatgttta

SEQ ID NO: 2549733 - DNA, 11 bp, Homo sapiens
ataaattattt

SEQ ID NO: 2549734 - DNA, 15 bp, Homo sapiens
ataaattcacctagt

SEQ ID NO: 2549735 - DNA, 12 bp, Homo sapiens
ataaattcagat

SEQ ID NO: 2549736 - DNA, 22 bp, Homo sapiens
ataaattcagatatatttttca

SEQ ID NO: 2549737 - DNA, 19 bp, Homo sapiens
ataaatttatttactgcta

SEQ ID NO: 2549738 - DNA, 19 bp, Homo sapiens
ataaattttttttgtttca

SEQ ID NO: 2549739 - DNA, 14 bp, Homo sapiens
ataacaagatcttt

SEQ ID NO: 2549740 - DNA, 16 bp, Homo sapiens
ataacaagatctttca

SEQ ID NO: 2549741 - DNA, 17 bp, Homo sapiens
ataacaagatctttcag

SEQ ID NO: 2549742 - DNA, 21 bp, Homo sapiens
ataacaaggtccaagatacct

SEQ ID NO: 2549743 - DNA, 22 bp, Homo sapiens
ataacaatgttaaggaaactct

SEQ ID NO: 2549744 - DNA, 13 bp, Homo sapiens
ataacacacagct

SEQ ID NO: 2549745 - DNA, 18 bp, Homo sapiens
ataacaggttattttagt

SEQ ID NO: 2549746 - DNA, 22 bp, Homo sapiens
ataacaggttattttagtttct

SEQ ID NO: 2549747 - DNA, 23 bp, Homo sapiens
ataacaggttattttagtttctg

SEQ ID NO: 2549748 - DNA, 13 bp, Homo sapiens
ataacatgtaatt

SEQ ID NO: 2549749 - DNA, 20 bp, Homo sapiens
ataaccaaagcccaaagtgg

SEQ ID NO: 2549750 - DNA, 20 bp, Homo sapiens
ataaccccagctccctagga

SEQ ID NO: 2549751 - DNA, 23 bp, Homo sapiens
ataaccgtttcctttcatttact

SEQ ID NO: 2549752 - DNA, 16 bp, Homo sapiens
ataactcatcataaaa

SEQ ID NO: 2549753 - DNA, 18 bp, Homo sapiens
ataactcatcataaaata

SEQ ID NO: 2549754 - DNA, 19 bp, Homo sapiens
ataactcatcataaaataa

SEQ ID NO: 2549755 - DNA, 20 bp, Homo sapiens
atagctcctgctccacagcc

SEQ ID NO: 2549756 - DNA, 20 bp, Homo sapiens
atagctctttggcagtctat

SEQ ID NO: 2549757 - DNA, 17 bp, Homo sapiens
atagctgagattcctgg

SEQ ID NO: 2549758 - DNA, 12 bp, Homo sapiens
atagctgggact

SEQ ID NO: 2549759 - DNA, 18 bp, Homo sapiens
atagctgtattgaatcat

SEQ ID NO: 2549760 - DNA, 14 bp, Homo sapiens
atagcttgtatagt

SEQ ID NO: 2549761 - DNA, 10 bp, Homo sapiens
atagctttat

SEQ ID NO: 2549762 - DNA, 15 bp, Homo sapiens
atagcttttattgta

SEQ ID NO: 2549763 - DNA, 18 bp, Homo sapiens
ataggaaaagtacattta

SEQ ID NO: 2549764 - DNA, 15 bp, Homo sapiens
ataggaacatatgaa

SEQ ID NO: 2549765 - DNA, 19 bp, Homo sapiens
ataggaacttaaataatgt

SEQ ID NO: 2549766 - DNA, 18 bp, Homo sapiens
ataggaatgtgaaagcac

SEQ ID NO: 2549767 - DNA, 14 bp, Homo sapiens
ataggagaggatga

SEQ ID NO: 2549768 - DNA, 12 bp, Homo sapiens
ataggagcctgc

SEQ ID NO: 2549769 - DNA, 15 bp, Homo sapiens
ataggagcctgctgg

SEQ ID NO: 2549770 - DNA, 22 bp, Homo sapiens
ataggccaaactggcaaacttc

SEQ ID NO: 2549771 - DNA, 12 bp, Homo sapiens
ataggctctgca

SEQ ID NO: 2549772 - DNA, 14 bp, Homo sapiens
ataggctctgcaca

SEQ ID NO: 2549773 - DNA, 15 bp, Homo sapiens
ataggctctgcacag

SEQ ID NO: 2549774 - DNA, 17 bp, Homo sapiens
atagggctgagctctct

SEQ ID NO: 2549775 - DNA, 16 bp, Homo sapiens
atagggtctcttcagg

SEQ ID NO: 2549776 - DNA, 15 bp, Homo sapiens
ataggtcactcctgg

SEQ ID NO: 2549777 - DNA, 15 bp, Homo sapiens
ataggtcactggctc

SEQ ID NO: 2549778 - DNA, 20 bp, Homo sapiens
ataggtcactggctctccaa

SEQ ID NO: 2549779 - DNA, 13 bp, Homo sapiens
ataggtggcctct

SEQ ID NO: 2549780 - DNA, 18 bp, Homo sapiens
ataggttgtaaatgtgtt

SEQ ID NO: 2549781 - DNA, 16 bp, Homo sapiens
ataggttttgtttgct

SEQ ID NO: 2549782 - DNA, 17 bp, Homo sapiens
ataggttttgtttgcta

SEQ ID NO: 2549783 - DNA, 14 bp, Homo sapiens
atagtaaaaataaa

SEQ ID NO: 2549784 - DNA, 14 bp, Homo sapiens
atagtaattctcag

SEQ ID NO: 2549785 - DNA, 15 bp, Homo sapiens
atagtagcatacatt

SEQ ID NO: 2549786 - DNA, 15 bp, Homo sapiens
atagtatatctggac

SEQ ID NO: 2549787 - DNA, 16 bp, Homo sapiens
atagtatcctccaggt

SEQ ID NO: 2549788 - DNA, 19 bp, Homo sapiens
atagtatcctccaggtttt

SEQ ID NO: 2549789 - DNA, 21 bp, Homo sapiens
atagtattccattgtgtgagt

SEQ ID NO: 2549790 - DNA, 20 bp, Homo sapiens
atagtcaaaccataaacttc

SEQ ID NO: 2549791 - DNA, 22 bp, Homo sapiens
atagtcaaaccataaacttcat

SEQ ID NO: 2549792 - DNA, 22 bp, Homo sapiens
atagtcatgtaagctgaaaata

SEQ ID NO: 2549793 - DNA, 13 bp, Homo sapiens
atagtctgtgtga

SEQ ID NO: 2549794 - DNA, 18 bp, Homo sapiens
atagtgactatgaacttc

SEQ ID NO: 2549795 - DNA, 13 bp, Homo sapiens
atagtgtgttctg

SEQ ID NO: 2549796 - DNA, 17 bp, Homo sapiens
atagtgtgttctgatta

SEQ ID NO: 2549797 - DNA, 21 bp, Homo sapiens
atagtgtgttctgattagaaa

SEQ ID NO: 2549798 - DNA, 21 bp, Homo sapiens
atagtgttaatcaatttaaac

SEQ ID NO: 2549799 - DNA, 13 bp, Homo sapiens
atagttgagcccc

SEQ ID NO: 2549800 - DNA, 13 bp, Homo sapiens
atagtttattgac

SEQ ID NO: 2549801 - DNA, 15 bp, Homo sapiens
atagtttgtacatgc

SEQ ID NO: 2549802 - DNA, 23 bp, Homo sapiens
atataaaaagaaaagataaagat

SEQ ID NO: 2549803 - DNA, 23 bp, Homo sapiens
atataaaaggcaaatgtgtacat

SEQ ID NO: 2549804 - DNA, 14 bp, Homo sapiens
atataaaatatgaa

SEQ ID NO: 2549805 - DNA, 13 bp, Homo sapiens
atataaaatattt

SEQ ID NO: 2549806 - DNA, 18 bp, Homo sapiens
atataaataaaacatttt

SEQ ID NO: 2549807 - DNA, 16 bp, Homo sapiens
atataaatattagaaa

SEQ ID NO: 2549808 - DNA, 23 bp, Homo sapiens
atataaatggctggtttttagaa

SEQ ID NO: 2549809 - DNA, 23 bp, Homo sapiens
atataaccacaaagcacagtttg

SEQ ID NO: 2549810 - DNA, 18 bp, Homo sapiens
atataactattgcccagg

SEQ ID NO: 2549811 - DNA, 23 bp, Homo sapiens
atataaggaaagcaataaatgaa

SEQ ID NO: 2549812 - DNA, 14 bp, Homo sapiens
atataagtttgaag

SEQ ID NO: 2549813 - DNA, 17 bp, Homo sapiens
atataagtttgaaggaa

SEQ ID NO: 2549814 - DNA, 21 bp, Homo sapiens
atataagtttgaaggaaacag

SEQ ID NO: 2549815 - DNA, 18 bp, Homo sapiens
atataataaagctactga

SEQ ID NO: 2549816 - DNA, 18 bp, Homo sapiens
atataatggtttcaaaga

SEQ ID NO: 2549817 - DNA, 14 bp, Homo sapiens
atataattatcgga

SEQ ID NO: 2549818 - DNA, 12 bp, Homo sapiens
atataattctgt

SEQ ID NO: 2549819 - DNA, 20 bp, Homo sapiens
atcagcacgatttctgttta

SEQ ID NO: 2549820 - DNA, 15 bp, Homo sapiens
atcagcctcttaaag

SEQ ID NO: 2549821 - DNA, 19 bp, Homo sapiens
atcagcctgagtctcctgt

SEQ ID NO: 2549822 - DNA, 20 bp, Homo sapiens
atcagcctgctccagctgtt

SEQ ID NO: 2549823 - DNA, 14 bp, Homo sapiens
atcagcctgtctct

SEQ ID NO: 2549824 - DNA, 18 bp, Homo sapiens
atcagcctgtctcttcca

SEQ ID NO: 2549825 - DNA, 19 bp, Homo sapiens
atcagcctgtctcttccat

SEQ ID NO: 2549826 - DNA, 21 bp, Homo sapiens
atcagcctgtctcttccatat

SEQ ID NO: 2549827 - DNA, 23 bp, Homo sapiens
atcagctgctgaaacaacaaata

SEQ ID NO: 2549828 - DNA, 22 bp, Homo sapiens
atcagctggtcaaacaaactct

SEQ ID NO: 2549829 - DNA, 16 bp, Homo sapiens
atcagctgtttgtcat

SEQ ID NO: 2549830 - DNA, 20 bp, Homo sapiens
atcaggacccagaggaaggg

SEQ ID NO: 2549831 - DNA, 13 bp, Homo sapiens
atcaggatgaacc

SEQ ID NO: 2549832 - DNA, 21 bp, Homo sapiens
atcaggccaggccctctgccc

SEQ ID NO: 2549833 - DNA, 16 bp, Homo sapiens
atcaggccattgtccc

SEQ ID NO: 2549834 - DNA, 15 bp, Homo sapiens
atcaggctatgtatg

SEQ ID NO: 2549835 - DNA, 16 bp, Homo sapiens
atcaggctctgcctca

SEQ ID NO: 2549836 - DNA, 20 bp, Homo sapiens
atcaggtcctcagagaattt

SEQ ID NO: 2549837 - DNA, 19 bp, Homo sapiens
atcagtaagaaaaagaaga

SEQ ID NO: 2549838 - DNA, 14 bp, Homo sapiens
atcagtataattct

SEQ ID NO: 2549839 - DNA, 16 bp, Homo sapiens
atcagtataattctgt

SEQ ID NO: 2549840 - DNA, 13 bp, Homo sapiens
atcagtcccctcc

SEQ ID NO: 2549841 - DNA, 17 bp, Homo sapiens
atcagtcccctcccatc

SEQ ID NO: 2549842 - DNA, 19 bp, Homo sapiens
atcagtctatccacagaga

SEQ ID NO: 2549843 - DNA, 22 bp, Homo sapiens
atcagtggcatggctccagtct

SEQ ID NO: 2549844 - DNA, 19 bp, Homo sapiens
atcagtggttatttaggga

SEQ ID NO: 2549845 - DNA, 17 bp, Homo sapiens
atcagtgtcctcttgct

SEQ ID NO: 2549846 - DNA, 14 bp, Homo sapiens
atcagtgtctcaca

SEQ ID NO: 2549847 - DNA, 18 bp, Homo sapiens
atcagttgcaataatact

SEQ ID NO: 2549848 - DNA, 12 bp, Homo sapiens
atcataaaataa

SEQ ID NO: 2549849 - DNA, 17 bp, Homo sapiens
atcataggtatttcaaa

SEQ ID NO: 2549850 - DNA, 18 bp, Homo sapiens
atcataggtatttcaaaa

SEQ ID NO: 2549851 - DNA, 20 bp, Homo sapiens
atcatataataaatgtacat

SEQ ID NO: 2549852 - DNA, 16 bp, Homo sapiens
atcatattatacagac

SEQ ID NO: 2549853 - DNA, 13 bp, Homo sapiens
atcatcaaggcac

SEQ ID NO: 2549854 - DNA, 19 bp, Homo sapiens
atcatcaaggcactgcctg

SEQ ID NO: 2549855 - DNA, 20 bp, Homo sapiens
atcatcagcatacctttatt

SEQ ID NO: 2549856 - DNA, 15 bp, Homo sapiens
atcatcagtattgaa

SEQ ID NO: 2549857 - DNA, 19 bp, Homo sapiens
atcatcagtattgaagcat

SEQ ID NO: 2549858 - DNA, 13 bp, Homo sapiens
atcatcctttcca

SEQ ID NO: 2549859 - DNA, 16 bp, Homo sapiens
atcatcctttccagca

SEQ ID NO: 2549860 - DNA, 18 bp, Homo sapiens
atcatctataaagaagaa

SEQ ID NO: 2549861 - DNA, 21 bp, Homo sapiens
atcatctattgctggcaaaga

SEQ ID NO: 2549862 - DNA, 21 bp, Homo sapiens
atctgaagagctattatataa

SEQ ID NO: 2549863 - DNA, 18 bp, Homo sapiens
atctgactcacaagaaga

SEQ ID NO: 2549864 - DNA, 20 bp, Homo sapiens
atctgagaggccacagtgca

SEQ ID NO: 2549865 - DNA, 14 bp, Homo sapiens
atctgagggaggag

SEQ ID NO: 2549866 - DNA, 19 bp, Homo sapiens
atctgagggaggaggccac

SEQ ID NO: 2549867 - DNA, 23 bp, Homo sapiens
atctgagggaggaggccacctct

SEQ ID NO: 2549868 - DNA, 19 bp, Homo sapiens
atctgatttgttttcctct

SEQ ID NO: 2549869 - DNA, 19 bp, Homo sapiens
atctgcacccccctgggct

SEQ ID NO: 2549870 - DNA, 21 bp, Homo sapiens
atctgcaccctcgatgaagcc

SEQ ID NO: 2549871 - DNA, 20 bp, Homo sapiens
atctgcagggggtgtgtctg

SEQ ID NO: 2549872 - DNA, 19 bp, Homo sapiens
atctgcattttcaccccac

SEQ ID NO: 2549873 - DNA, 16 bp, Homo sapiens
atctgcccaggggtgc

SEQ ID NO: 2549874 - DNA, 16 bp, Homo sapiens
atctgcccctccccca

SEQ ID NO: 2549875 - DNA, 14 bp, Homo sapiens
atctgcccctccct

SEQ ID NO: 2549876 - DNA, 16 bp, Homo sapiens
atctgcccctccctgc

SEQ ID NO: 2549877 - DNA, 20 bp, Homo sapiens
atctgctagggaatatcaat

SEQ ID NO: 2549878 - DNA, 14 bp, Homo sapiens
atctgctcagcagc

SEQ ID NO: 2549879 - DNA, 21 bp, Homo sapiens
atctgctgtccagacagcctg

SEQ ID NO: 2549880 - DNA, 19 bp, Homo sapiens
atctgcttacaattccctg

SEQ ID NO: 2549881 - DNA, 22 bp, Homo sapiens
atctgctttttaaagaatgctc

SEQ ID NO: 2549882 - DNA, 18 bp, Homo sapiens
atctggactcctctgtcc

SEQ ID NO: 2549883 - DNA, 22 bp, Homo sapiens
atggaagcttccagtccaatct

SEQ ID NO: 2549884 - DNA, 17 bp, Homo sapiens
atggaaggtttgtatat

SEQ ID NO: 2549885 - DNA, 22 bp, Homo sapiens
atggaaggtttgtatattgtca

SEQ ID NO: 2549886 - DNA, 15 bp, Homo sapiens
atggaataacatgta

SEQ ID NO: 2549887 - DNA, 16 bp, Homo sapiens
atggaataactctgtg

SEQ ID NO: 2549888 - DNA, 20 bp, Homo sapiens
atggaatgcttgaaaaatgt

SEQ ID NO: 2549889 - DNA, 18 bp, Homo sapiens
atggaatggttataaaag

SEQ ID NO: 2549890 - DNA, 19 bp, Homo sapiens
atggaatggttataaaagt

SEQ ID NO: 2549891 - DNA, 22 bp, Homo sapiens
atggacaccccttatccaggac

SEQ ID NO: 2549892 - DNA, 23 bp, Homo sapiens
atggacaccccttatccaggact

SEQ ID NO: 2549893 - DNA, 17 bp, Homo sapiens
atggacactccagtgcc

SEQ ID NO: 2549894 - DNA, 16 bp, Homo sapiens
atggactctacactgt

SEQ ID NO: 2549895 - DNA, 16 bp, Homo sapiens
atggacttgtatattt

SEQ ID NO: 2549896 - DNA, 23 bp, Homo sapiens
atggacttgtatatttgtacaaa

SEQ ID NO: 2549897 - DNA, 11 bp, Homo sapiens
atggactttgt

SEQ ID NO: 2549898 - DNA, 22 bp, Homo sapiens
atggagaagaaaggccatcaga

SEQ ID NO: 2549899 - DNA, 14 bp, Homo sapiens
atggagactcctgc

SEQ ID NO: 2549900 - DNA, 18 bp, Homo sapiens
atggagactcctgccctg

SEQ ID NO: 2549901 - DNA, 21 bp, Homo sapiens
atggagactggtcctgtgtgc

SEQ ID NO: 2549902 - DNA, 15 bp, Homo sapiens
atggagagaggggaa

SEQ ID NO: 2549903 - DNA, 17 bp, Homo sapiens
atggagagaggggaata

SEQ ID NO: 2549904 - DNA, 20 bp, Homo sapiens
atggagagctagaacccggc

SEQ ID NO: 2549905 - DNA, 21 bp, Homo sapiens
atggagccagctctgcattat

SEQ ID NO: 2549906 - DNA, 12 bp, Homo sapiens
atggagccccag

SEQ ID NO: 2549907 - DNA, 15 bp, Homo sapiens
atggagccccagccc

SEQ ID NO: 2549908 - DNA, 14 bp, Homo sapiens
atggagctcagaga

SEQ ID NO: 2549909 - DNA, 13 bp, Homo sapiens
atggagctggccg

SEQ ID NO: 2549910 - DNA, 18 bp, Homo sapiens
atggaggatggagagagg

SEQ ID NO: 2549911 - DNA, 17 bp, Homo sapiens
atggaggcagaatcctg

SEQ ID NO: 2549912 - DNA, 19 bp, Homo sapiens
atggagtggcaatatagaa

SEQ ID NO: 2549913 - DNA, 17 bp, Homo sapiens
atggagttaacgggtga

SEQ ID NO: 2549914 - DNA, 21 bp, Homo sapiens
atggagttaacgggtgaataa

SEQ ID NO: 2549915 - DNA, 19 bp, Homo sapiens
atggataacctatatgatt

SEQ ID NO: 2549916 - DNA, 21 bp, Homo sapiens
atggataatgccggtgagaat

SEQ ID NO: 2549917 - DNA, 18 bp, Homo sapiens
atggatgattcagaaatt

SEQ ID NO: 2549918 - DNA, 18 bp, Homo sapiens
atggattcattacagctt

SEQ ID NO: 2549919 - DNA, 16 bp, Homo sapiens
atggattctcagatat

SEQ ID NO: 2549920 - DNA, 19 bp, Homo sapiens
atggattctcagatattta

SEQ ID NO: 2549921 - DNA, 14 bp, Homo sapiens
atggatttgaagca

SEQ ID NO: 2549922 - DNA, 19 bp, Homo sapiens
atggatttgatgctgtttg

SEQ ID NO: 2549923 - DNA, 18 bp, Homo sapiens
atggattttctattgtta

SEQ ID NO: 2549924 - DNA, 20 bp, Homo sapiens
atggattttctattgttact

SEQ ID NO: 2549925 - DNA, 14 bp, Homo sapiens
atggcaaaaatggc

SEQ ID NO: 2549926 - DNA, 23 bp, Homo sapiens
atggcaattctttgacctcaacc

SEQ ID NO: 2549927 - DNA, 23 bp, Homo sapiens
atggcacagcccaaagaaggaaa

SEQ ID NO: 2549928 - DNA, 14 bp, Homo sapiens
atggcaccagaggc

SEQ ID NO: 2549929 - DNA, 17 bp, Homo sapiens
atggcaccttcagactt

SEQ ID NO: 2549930 - DNA, 24 bp, Homo sapiens
atggcagaagacaccagagcagat

SEQ ID NO: 2549931 - DNA, 21 bp, Homo sapiens
atggcagaaggcaaacccatc

SEQ ID NO: 2549932 - DNA, 19 bp, Homo sapiens
atggcagaggaatatcaat

SEQ ID NO: 2549933 - DNA, 22 bp, Homo sapiens
atggcaggatggcctggccagg

SEQ ID NO: 2549934 - DNA, 17 bp, Homo sapiens
atggccagtgtctgtcc

SEQ ID NO: 2549935 - DNA, 22 bp, Homo sapiens
atggccatggagtgtacaagta

SEQ ID NO: 2549936 - DNA, 18 bp, Homo sapiens
atggcccctctgacctgc

SEQ ID NO: 2549937 - DNA, 23 bp, Homo sapiens
atggcccctctgacctgcactgg

SEQ ID NO: 2549938 - DNA, 21 bp, Homo sapiens
atggccgggcgcggtggctca

SEQ ID NO: 2549939 - DNA, 21 bp, Homo sapiens
atggcctattatattaaaata

SEQ ID NO: 2549940 - DNA, 21 bp, Homo sapiens
atggcctcaagatcaatgaaa

SEQ ID NO: 2549941 - DNA, 16 bp, Homo sapiens
atggcctcagctgcct

SEQ ID NO: 2549942 - DNA, 18 bp, Homo sapiens
atggcctcagctgcctca

SEQ ID NO: 2549943 - DNA, 17 bp, Homo sapiens
atggcgcagtgcctctg

SEQ ID NO: 2549944 - DNA, 15 bp, Homo sapiens
atggcgggtgggggt

SEQ ID NO: 2549945 - DNA, 17 bp, Homo sapiens
atggctaattcccagag

SEQ ID NO: 2549946 - DNA, 20 bp, Homo sapiens
atggctagtatcaaaagaaa

SEQ ID NO: 2549947 - DNA, 13 bp, Homo sapiens
atggctataaata

SEQ ID NO: 2549948 - DNA, 15 bp, Homo sapiens
atggctataaatata

SEQ ID NO: 2549949 - DNA, 16 bp, Homo sapiens
atggctataaatatat

SEQ ID NO: 2549950 - DNA, 19 bp, Homo sapiens
atggctataggtgctacaa

SEQ ID NO: 2549951 - DNA, 21 bp, Homo sapiens
atggctataggtgctacaaaa

SEQ ID NO: 2549952 - DNA, 18 bp, Homo sapiens
atggctcactatgaatct

SEQ ID NO: 2549953 - DNA, 22 bp, Homo sapiens
atggctcactatggtgccaatg

SEQ ID NO: 2549954 - DNA, 17 bp, Homo sapiens
atggctcccacaggagt

SEQ ID NO: 2549955 - DNA, 18 bp, Homo sapiens
atggctgactttgctctt

SEQ ID NO: 2549956 - DNA, 21 bp, Homo sapiens
atggctgggaactgcagacct

SEQ ID NO: 2549957 - DNA, 23 bp, Homo sapiens
atggctgggaactgcagacctgt

SEQ ID NO: 2549958 - DNA, 20 bp, Homo sapiens
atggctgtctcaaaccaagc

SEQ ID NO: 2549959 - DNA, 16 bp, Homo sapiens
atggctgtgcctctgc

SEQ ID NO: 2549960 - DNA, 20 bp, Homo sapiens
atggctgtgcctctgcctgt

SEQ ID NO: 2549961 - DNA, 21 bp, Homo sapiens
atggcttaatgtttattcctg

SEQ ID NO: 2549962 - DNA, 17 bp, Homo sapiens
atggctttgtgattcaa

SEQ ID NO: 2549963 - DNA, 16 bp, Homo sapiens
atggcttttgtgcatt

SEQ ID NO: 2549964 - DNA, 19 bp, Homo sapiens
atgggaagacgaggccctc

SEQ ID NO: 2549965 - DNA, 14 bp, Homo sapiens
atgggaaggaggga

SEQ ID NO: 2549966 - DNA, 19 bp, Homo sapiens
atgggaaggagggaggtat

SEQ ID NO: 2549967 - DNA, 14 bp, Homo sapiens
atgggaattgtgtg

SEQ ID NO: 2549968 - DNA, 13 bp, Homo sapiens
atgggacttcttt

SEQ ID NO: 2549969 - DNA, 13 bp, Homo sapiens
atgggagccccag

SEQ ID NO: 2549970 - DNA, 19 bp, Homo sapiens
atgggagctcctctcctgg

SEQ ID NO: 2549971 - DNA, 20 bp, Homo sapiens
atgggagctcctctcctgga

SEQ ID NO: 2549972 - DNA, 23 bp, Homo sapiens
atgggagctcctctcctggagga

SEQ ID NO: 2549973 - DNA, 24 bp, Homo sapiens
atgggagctcctctcctggaggat

SEQ ID NO: 2549974 - DNA, 21 bp, Homo sapiens
atgggcaacccccagcctgct

SEQ ID NO: 2549975 - DNA, 14 bp, Homo sapiens
atgggcagagccca

SEQ ID NO: 2549976 - DNA, 19 bp, Homo sapiens
atgggcagttacatgcata

SEQ ID NO: 2549977 - DNA, 19 bp, Homo sapiens
atgggcctgcttcctgtct

SEQ ID NO: 2549978 - DNA, 20 bp, Homo sapiens
atgggcctggccacctctct

SEQ ID NO: 2549979 - DNA, 20 bp, Homo sapiens
atgggctgggttctacccag

SEQ ID NO: 2549980 - DNA, 20 bp, Homo sapiens
atgggcttcactgtataaat

SEQ ID NO: 2549981 - DNA, 16 bp, Homo sapiens
atggggaaggaggctg

SEQ ID NO: 2549982 - DNA, 20 bp, Homo sapiens
atggggccctgcctcctttg

SEQ ID NO: 2549983 - DNA, 14 bp, Homo sapiens
atggggcctctgtt

SEQ ID NO: 2549984 - DNA, 12 bp, Homo sapiens
atggggctgcac

SEQ ID NO: 2549985 - DNA, 18 bp, Homo sapiens
atgggggaaatggtgcct

SEQ ID NO: 2549986 - DNA, 19 bp, Homo sapiens
atgggggagtctgaagcag

SEQ ID NO: 2549987 - DNA, 20 bp, Homo sapiens
atgggggagtctgaagcaga

SEQ ID NO: 2549988 - DNA, 16 bp, Homo sapiens
atggggtgggcctctg

SEQ ID NO: 2549989 - DNA, 18 bp, Homo sapiens
atggggtgggcctctggt

SEQ ID NO: 2549990 - DNA, 19 bp, Homo sapiens
atgggtctggctgagctga

SEQ ID NO: 2549991 - DNA, 22 bp, Homo sapiens
atgggtgaagggagagccagct

SEQ ID NO: 2549992 - DNA, 21 bp, Homo sapiens
atgggtgcttggaggaaggaa

SEQ ID NO: 2549993 - DNA, 23 bp, Homo sapiens
atggtaaaagttacttattctag

SEQ ID NO: 2549994 - DNA, 14 bp, Homo sapiens
atggtaattgttgc

SEQ ID NO: 2549995 - DNA, 19 bp, Homo sapiens
atggtatagcaaatgtttt

SEQ ID NO: 2549996 - DNA, 20 bp, Homo sapiens
atggtatgagctgagggggg

SEQ ID NO: 2549997 - DNA, 18 bp, Homo sapiens
atggtcagccctagggtg

SEQ ID NO: 2549998 - DNA, 18 bp, Homo sapiens
atggtcagcgttgcatgt

SEQ ID NO: 2549999 - DNA, 12 bp, Homo sapiens
atggtcagctcc

SEQ ID NO: 2550000 - DNA, 22 bp, Homo sapiens
atggtcatcttggagggaccaa

SEQ ID NO: 2550001 - DNA, 14 bp, Homo sapiens
atggtcccatccag

SEQ ID NO: 2550002 - DNA, 19 bp, Homo sapiens
atggtcccatccaggcagt

SEQ ID NO: 2550003 - DNA, 15 bp, Homo sapiens
atggtcggaaaacat

SEQ ID NO: 2550004 - DNA, 18 bp, Homo sapiens
atggtctcagaaaccaaa

SEQ ID NO: 2550005 - DNA, 24 bp, Homo sapiens
atggtgaaaccccgtctctactaa

SEQ ID NO: 2550006 - DNA, 21 bp, Homo sapiens
atggtgagagaagcctgtgcc

SEQ ID NO: 2550007 - DNA, 13 bp, Homo sapiens
atggtggagggcc

SEQ ID NO: 2550008 - DNA, 14 bp, Homo sapiens
atggtggagggcca

SEQ ID NO: 2550009 - DNA, 16 bp, Homo sapiens
atggtggcgcgcacct

SEQ ID NO: 2550010 - DNA, 13 bp, Homo sapiens
atggtggctgggt

SEQ ID NO: 2550011 - DNA, 16 bp, Homo sapiens
atggtgtaataagaca

SEQ ID NO: 2550012 - DNA, 13 bp, Homo sapiens
atggtgtacataa

SEQ ID NO: 2550013 - DNA, 16 bp, Homo sapiens
atggtgtttctccctc

SEQ ID NO: 2550014 - DNA, 21 bp, Homo sapiens
atggtgttttcttatgcagga

SEQ ID NO: 2550015 - DNA, 16 bp, Homo sapiens
atggttccatgcctga

SEQ ID NO: 2550016 - DNA, 18 bp, Homo sapiens
atggttgccttaaagaaa

SEQ ID NO: 2550017 - DNA, 13 bp, Homo sapiens
atggtttcaaaga

SEQ ID NO: 2550018 - DNA, 22 bp, Homo sapiens
atggtttgaatataaacactat

SEQ ID NO: 2550019 - DNA, 14 bp, Homo sapiens
atggttttcaaaat

SEQ ID NO: 2550020 - DNA, 15 bp, Homo sapiens
atgtaaaaggccaaa

SEQ ID NO: 2550021 - DNA, 18 bp, Homo sapiens
atgtaaaaggccaaacct

SEQ ID NO: 2550022 - DNA, 14 bp, Homo sapiens
atgtaaactgtgca

SEQ ID NO: 2550023 - DNA, 19 bp, Homo sapiens
atgtaaagaacataaataa

SEQ ID NO: 2550024 - DNA, 14 bp, Homo sapiens
atgtaaagatattt

SEQ ID NO: 2550025 - DNA, 13 bp, Homo sapiens
atgtaaagtatgt

SEQ ID NO: 2550026 - DNA, 21 bp, Homo sapiens
atgtaccatgtacatgaagaa

SEQ ID NO: 2550027 - DNA, 21 bp, Homo sapiens
atgtacgtttgtatgtgtgta

SEQ ID NO: 2550028 - DNA, 13 bp, Homo sapiens
atgtagaagctgc

SEQ ID NO: 2550029 - DNA, 17 bp, Homo sapiens
atgtagcaaaacgcatg

SEQ ID NO: 2550030 - DNA, 21 bp, Homo sapiens
atgtagcaaaatacatgacat

SEQ ID NO: 2550031 - DNA, 16 bp, Homo sapiens
atgtagccatgggacc

SEQ ID NO: 2550032 - DNA, 15 bp, Homo sapiens
atgtagctggtttcc

SEQ ID NO: 2550033 - DNA, 16 bp, Homo sapiens
atgtaggtatgaataa

SEQ ID NO: 2550034 - DNA, 23 bp, Homo sapiens
atgtagtatcaaatattagatgt

SEQ ID NO: 2550035 - DNA, 22 bp, Homo sapiens
atgtataaagcaactgttatga

SEQ ID NO: 2550036 - DNA, 16 bp, Homo sapiens
atgtatatacatttat

SEQ ID NO: 2550037 - DNA, 19 bp, Homo sapiens
atgtatatttaaaagaaag

SEQ ID NO: 2550038 - DNA, 21 bp, Homo sapiens
atgtatcaggaaatatatatg

SEQ ID NO: 2550039 - DNA, 15 bp, Homo sapiens
atgtatctgagcagg

SEQ ID NO: 2550040 - DNA, 12 bp, Homo sapiens
atgtatgtgtaa

SEQ ID NO: 2550041 - DNA, 16 bp, Homo sapiens
atgtatgtgtaagtat

SEQ ID NO: 2550042 - DNA, 15 bp, Homo sapiens
atgtatgtgtgtatg

SEQ ID NO: 2550043 - DNA, 16 bp, Homo sapiens
atgtatgtttacatat

SEQ ID NO: 2550044 - DNA, 11 bp, Homo sapiens
atgtattgtaa

SEQ ID NO: 2550045 - DNA, 20 bp, Homo sapiens
atgtattgtaaacatgtgtt

SEQ ID NO: 2550046 - DNA, 21 bp, Homo sapiens
atgtattgtaaacatgtgttt

SEQ ID NO: 2550047 - DNA, 14 bp, Homo sapiens
atgtatttatattt

SEQ ID NO: 2550048 - DNA, 19 bp, Homo sapiens
atgtatttatttaaaagat

SEQ ID NO: 2550049 - DNA, 22 bp, Homo sapiens
atgtatttatttaaaagattca

SEQ ID NO: 2550050 - DNA, 17 bp, Homo sapiens
atgtcaacttctggctc

SEQ ID NO: 2550051 - DNA, 13 bp, Homo sapiens
atgtcacaggcag

SEQ ID NO: 2550052 - DNA, 16 bp, Homo sapiens
atgtcacaggcaggtc

SEQ ID NO: 2550053 - DNA, 19 bp, Homo sapiens
atgtcacaggcaggtccag

SEQ ID NO: 2550054 - DNA, 14 bp, Homo sapiens
atgtcacagggcca

SEQ ID NO: 2550055 - DNA, 20 bp, Homo sapiens
atgtcaccgtggaccttcct

SEQ ID NO: 2550056 - DNA, 14 bp, Homo sapiens
atgtcactgtggtc

SEQ ID NO: 2550057 - DNA, 23 bp, Homo sapiens
atgtcagacatccatgtttgtaa

SEQ ID NO: 2550058 - DNA, 19 bp, Homo sapiens
atgtcagccgagccgggcc

SEQ ID NO: 2550059 - DNA, 23 bp, Homo sapiens
atgtcagccgagccgggcctggg

SEQ ID NO: 2550060 - DNA, 12 bp, Homo sapiens
atgtcaggcctg

SEQ ID NO: 2550061 - DNA, 16 bp, Homo sapiens
atgtcaggcctgtgtg

SEQ ID NO: 2550062 - DNA, 20 bp, Homo sapiens
atgtcattaaaataaataaa

SEQ ID NO: 2550063 - DNA, 17 bp, Homo sapiens
atgtccaagaagcccag

SEQ ID NO: 2550064 - DNA, 19 bp, Homo sapiens
atgtccaagaagcccagga

SEQ ID NO: 2550065 - DNA, 12 bp, Homo sapiens
atgtccagaaga

SEQ ID NO: 2550066 - DNA, 18 bp, Homo sapiens
atgtccccaaacctgcaa

SEQ ID NO: 2550067 - DNA, 14 bp, Homo sapiens
atgtcccttgctgt

SEQ ID NO: 2550068 - DNA, 16 bp, Homo sapiens
atgtcctaaggacaca

SEQ ID NO: 2550069 - DNA, 18 bp, Homo sapiens
atgtcctaaggacacact

SEQ ID NO: 2550070 - DNA, 20 bp, Homo sapiens
atgtcctaaggacacactaa

SEQ ID NO: 2550071 - DNA, 19 bp, Homo sapiens
atgtcctccagaagcctct

SEQ ID NO: 2550072 - DNA, 22 bp, Homo sapiens
atgtcctccagaagcctctggc

SEQ ID NO: 2550073 - DNA, 21 bp, Homo sapiens
atgtcgtgaccaactagacat

SEQ ID NO: 2550074 - DNA, 15 bp, Homo sapiens
atgtctattcagctt

SEQ ID NO: 2550075 - DNA, 16 bp, Homo sapiens
atgtctattcagcttc

SEQ ID NO: 2550076 - DNA, 19 bp, Homo sapiens
atgtctcgtggtaggactg

SEQ ID NO: 2550077 - DNA, 13 bp, Homo sapiens
atgtctcttctga

SEQ ID NO: 2550078 - DNA, 17 bp, Homo sapiens
atgtctcttctgagcta

SEQ ID NO: 2550079 - DNA, 23 bp, Homo sapiens
atgtctctttaatgtcacaggca

SEQ ID NO: 2550080 - DNA, 16 bp, Homo sapiens
atgtctgccaattttt

SEQ ID NO: 2550081 - DNA, 23 bp, Homo sapiens
atgtctgccaatttttgccttca

SEQ ID NO: 2550082 - DNA, 20 bp, Homo sapiens
atgtctgctgaataataaac

SEQ ID NO: 2550083 - DNA, 23 bp, Homo sapiens
atgtctgttaccatgtcactgtg

SEQ ID NO: 2550084 - DNA, 16 bp, Homo sapiens
atgtctgttctacata

SEQ ID NO: 2550085 - DNA, 17 bp, Homo sapiens
atgtcttcgtacagttc

SEQ ID NO: 2550086 - DNA, 12 bp, Homo sapiens
atgtcttctgcc

SEQ ID NO: 2550087 - DNA, 15 bp, Homo sapiens
atgtcttctgcctgt

SEQ ID NO: 2550088 - DNA, 17 bp, Homo sapiens
atgtcttctgcctgtta

SEQ ID NO: 2550089 - DNA, 19 bp, Homo sapiens
atgtcttctgcctgttata

SEQ ID NO: 2550090 - DNA, 14 bp, Homo sapiens
atgtcttgtacatg

SEQ ID NO: 2550091 - DNA, 22 bp, Homo sapiens
atgtctttaggcagcagctttt

SEQ ID NO: 2550092 - DNA, 20 bp, Homo sapiens
atgtctttgttggaaaagaa

SEQ ID NO: 2550093 - DNA, 23 bp, Homo sapiens
atgtctttgttggaaaagaatac

SEQ ID NO: 2550094 - DNA, 14 bp, Homo sapiens
atgtcttttcttgc

SEQ ID NO: 2550095 - DNA, 23 bp, Homo sapiens
atgtctttttaagcttatttaat

SEQ ID NO: 2550096 - DNA, 18 bp, Homo sapiens
atgtcttttttttaatgt

SEQ ID NO: 2550097 - DNA, 19 bp, Homo sapiens
atgtcttttttttaatgtg

SEQ ID NO: 2550098 - DNA, 21 bp, Homo sapiens
atgtgaaaatggtccaggaga

SEQ ID NO: 2550099 - DNA, 16 bp, Homo sapiens
atgtgaacccgggacg

SEQ ID NO: 2550100 - DNA, 16 bp, Homo sapiens
atgtgaagtgttaata

SEQ ID NO: 2550101 - DNA, 21 bp, Homo sapiens
atgtgaataaaattattttgg

SEQ ID NO: 2550102 - DNA, 16 bp, Homo sapiens
atgtgacaggtaaact

SEQ ID NO: 2550103 - DNA, 21 bp, Homo sapiens
atgtgatccttttatgttatt

SEQ ID NO: 2550104 - DNA, 23 bp, Homo sapiens
atgtgatccttttatgttattta

SEQ ID NO: 2550105 - DNA, 17 bp, Homo sapiens
atgtgatgaatactgta

SEQ ID NO: 2550106 - DNA, 15 bp, Homo sapiens
atgtgattctaatgt

SEQ ID NO: 2550107 - DNA, 16 bp, Homo sapiens
atgtgatttaatagtg

SEQ ID NO: 2550108 - DNA, 18 bp, Homo sapiens
atgtgatttaatagtgtt

SEQ ID NO: 2550109 - DNA, 14 bp, Homo sapiens
atgtgattttaact

SEQ ID NO: 2550110 - DNA, 19 bp, Homo sapiens
atgtgattttaactctgtc

SEQ ID NO: 2550111 - DNA, 14 bp, Homo sapiens
atgtgatttttctg

SEQ ID NO: 2550112 - DNA, 13 bp, Homo sapiens
atgtgcaaaacag

SEQ ID NO: 2550113 - DNA, 14 bp, Homo sapiens
atgtgcaaatgcaa

SEQ ID NO: 2550114 - DNA, 15 bp, Homo sapiens
atgtgcactgtcact

SEQ ID NO: 2550115 - DNA, 18 bp, Homo sapiens
atgtgcactgtcactttg

SEQ ID NO: 2550116 - DNA, 22 bp, Homo sapiens
atgtgccattttaaaaaaaaag

SEQ ID NO: 2550117 - DNA, 15 bp, Homo sapiens
atgtgcctgatccag

SEQ ID NO: 2550118 - DNA, 14 bp, Homo sapiens
atgtgcctgggtgg

SEQ ID NO: 2550119 - DNA, 19 bp, Homo sapiens
atgtgctatactgcatact

SEQ ID NO: 2550120 - DNA, 18 bp, Homo sapiens
atgtgctgcgtgcctgtg

SEQ ID NO: 2550121 - DNA, 15 bp, Homo sapiens
atgtgctgtgtaaag

SEQ ID NO: 2550122 - DNA, 16 bp, Homo sapiens
atgtgctgtgtaaagt

SEQ ID NO: 2550123 - DNA, 20 bp, Homo sapiens
atgtgctgtgtaaagttagt

SEQ ID NO: 2550124 - DNA, 13 bp, Homo sapiens
atgtggaagtgtg

SEQ ID NO: 2550125 - DNA, 22 bp, Homo sapiens
atgtggaagtgtgggtctgtgt

SEQ ID NO: 2550126 - DNA, 23 bp, Homo sapiens
atgtggaagtgtgggtctgtgtg

SEQ ID NO: 2550127 - DNA, 17 bp, Homo sapiens
atgtggaatataaagat

SEQ ID NO: 2550128 - DNA, 23 bp, Homo sapiens
atgtggcaataaattttttttaa

SEQ ID NO: 2550129 - DNA, 18 bp, Homo sapiens
atgtggcccctgaacaag

SEQ ID NO: 2550130 - DNA, 20 bp, Homo sapiens
atgtggcccctgaacaagaa

SEQ ID NO: 2550131 - DNA, 19 bp, Homo sapiens
atgtggcctaaaaatgcaa

SEQ ID NO: 2550132 - DNA, 15 bp, Homo sapiens
atgtggctgcagcag

SEQ ID NO: 2550133 - DNA, 18 bp, Homo sapiens
atgtgggcagtgatgtca

SEQ ID NO: 2550134 - DNA, 13 bp, Homo sapiens
atgtggtgcctga

SEQ ID NO: 2550135 - DNA, 15 bp, Homo sapiens
atgtggtgggacagg

SEQ ID NO: 2550136 - DNA, 15 bp, Homo sapiens
atgtggttcttcaaa

SEQ ID NO: 2550137 - DNA, 19 bp, Homo sapiens
atgtggtttatagagggcc

SEQ ID NO: 2550138 - DNA, 17 bp, Homo sapiens
atgtgtaatcaataaac

SEQ ID NO: 2550139 - DNA, 20 bp, Homo sapiens
atgtgtaatcaataaacgat

SEQ ID NO: 2550140 - DNA, 21 bp, Homo sapiens
atgtgtaatcaataaacgatt

SEQ ID NO: 2550141 - DNA, 14 bp, Homo sapiens
atgtgtacatggca

SEQ ID NO: 2550142 - DNA, 22 bp, Homo sapiens
atgtgtacatggcagagtttgt

SEQ ID NO: 2550143 - DNA, 20 bp, Homo sapiens
atgtgtatttccagtgcaat

SEQ ID NO: 2550144 - DNA, 13 bp, Homo sapiens
atgtgtgagtgtg

SEQ ID NO: 2550145 - DNA, 12 bp, Homo sapiens
atgtgtgcatgt

SEQ ID NO: 2550146 - DNA, 11 bp, Homo sapiens
atgtgtgccat

SEQ ID NO: 2550147 - DNA, 22 bp, Homo sapiens
atgtgtgccatagagtttaaca

SEQ ID NO: 2550148 - DNA, 15 bp, Homo sapiens
atgtgtgcgagtgtg

SEQ ID NO: 2550149 - DNA, 17 bp, Homo sapiens
atgtgtgctcttcttct

SEQ ID NO: 2550150 - DNA, 17 bp, Homo sapiens
atgtgtgtaagtgtgtg

SEQ ID NO: 2550151 - DNA, 12 bp, Homo sapiens
atgtgtgtatat

SEQ ID NO: 2550152 - DNA, 14 bp, Homo sapiens
atgtgtgtatatgt

SEQ ID NO: 2550153 - DNA, 16 bp, Homo sapiens
atgtgtgtatatgtat

SEQ ID NO: 2550154 - DNA, 17 bp, Homo sapiens
atgtgtgtatatgtatg

SEQ ID NO: 2550155 - DNA, 22 bp, Homo sapiens
atgttactgatcatgcattgtt

SEQ ID NO: 2550156 - DNA, 16 bp, Homo sapiens
atgttagaggttttaa

SEQ ID NO: 2550157 - DNA, 15 bp, Homo sapiens
atgttagcaaagagt

SEQ ID NO: 2550158 - DNA, 17 bp, Homo sapiens
atgttatatattttttg

SEQ ID NO: 2550159 - DNA, 18 bp, Homo sapiens
atgttatgcccagcgttt

SEQ ID NO: 2550160 - DNA, 22 bp, Homo sapiens
atgttatttgttattttcagta

SEQ ID NO: 2550161 - DNA, 21 bp, Homo sapiens
atgttattttctgttgaagtt

SEQ ID NO: 2550162 - DNA, 22 bp, Homo sapiens
atgttcaactggagacactatt

SEQ ID NO: 2550163 - DNA, 18 bp, Homo sapiens
atgttcagtgtaatttct

SEQ ID NO: 2550164 - DNA, 18 bp, Homo sapiens
atgttcatcaatgaatga

SEQ ID NO: 2550165 - DNA, 14 bp, Homo sapiens
atgttcattgtaat

SEQ ID NO: 2550166 - DNA, 23 bp, Homo sapiens
atgttcattgtaatgttactgat

SEQ ID NO: 2550167 - DNA, 17 bp, Homo sapiens
atgttctaagaagtgaa

SEQ ID NO: 2550168 - DNA, 22 bp, Homo sapiens
atgttctatttcagtgccaata

SEQ ID NO: 2550169 - DNA, 18 bp, Homo sapiens
atgttctctgaggacact

SEQ ID NO: 2550170 - DNA, 19 bp, Homo sapiens
atgttctgacattaacagt

SEQ ID NO: 2550171 - DNA, 18 bp, Homo sapiens
atgttgaaagatcaaaag

SEQ ID NO: 2550172 - DNA, 17 bp, Homo sapiens
atgttgcccaggcaggt

SEQ ID NO: 2550173 - DNA, 20 bp, Homo sapiens
atgttgctcagtctcccttt

SEQ ID NO: 2550174 - DNA, 20 bp, Homo sapiens
atgttgctgaggagtgagga

SEQ ID NO: 2550175 - DNA, 15 bp, Homo sapiens
atgttgctggactgt

SEQ ID NO: 2550176 - DNA, 17 bp, Homo sapiens
atgttggaagagaaagc

SEQ ID NO: 2550177 - DNA, 13 bp, Homo sapiens
atgttggccaggc

SEQ ID NO: 2550178 - DNA, 17 bp, Homo sapiens
atgttggccaggctggt

SEQ ID NO: 2550179 - DNA, 22 bp, Homo sapiens
atgttgtccaattgttgacagt

SEQ ID NO: 2550180 - DNA, 20 bp, Homo sapiens
atgttgttcattattggagg

SEQ ID NO: 2550181 - DNA, 18 bp, Homo sapiens
atgtttacactctttgta

SEQ ID NO: 2550182 - DNA, 19 bp, Homo sapiens
atgtttacactctttgtaa

SEQ ID NO: 2550183 - DNA, 15 bp, Homo sapiens
atgtttaccttttaa

SEQ ID NO: 2550184 - DNA, 18 bp, Homo sapiens
atgtttaccttttaatta

SEQ ID NO: 2550185 - DNA, 19 bp, Homo sapiens
atgtttatataaatgcttt

SEQ ID NO: 2550186 - DNA, 21 bp, Homo sapiens
atgtttatataaatgctttta

SEQ ID NO: 2550187 - DNA, 14 bp, Homo sapiens
atgtttatgagcca

SEQ ID NO: 2550188 - DNA, 15 bp, Homo sapiens
atgtttatgagccag

SEQ ID NO: 2550189 - DNA, 21 bp, Homo sapiens
atgtttatttattctgcattt

SEQ ID NO: 2550190 - DNA, 21 bp, Homo sapiens
atgtttcacataaaacctcat

SEQ ID NO: 2550191 - DNA, 19 bp, Homo sapiens
atgtttcacgaagtttgtt

SEQ ID NO: 2550192 - DNA, 23 bp, Homo sapiens
atgtttcgtgaagtatactgtat

SEQ ID NO: 2550193 - DNA, 12 bp, Homo sapiens
atgtttctctgg

SEQ ID NO: 2550194 - DNA, 23 bp, Homo sapiens
atgtttctgcagtagtctctgtg

SEQ ID NO: 2550195 - DNA, 17 bp, Homo sapiens
atgtttgcctctgcctc

SEQ ID NO: 2550196 - DNA, 19 bp, Homo sapiens
atgtttgcctctgcctctg

SEQ ID NO: 2550197 - DNA, 22 bp, Homo sapiens
atgtttgcctctgcctctgaca

SEQ ID NO: 2550198 - DNA, 16 bp, Homo sapiens
atgtttgctattgaca

SEQ ID NO: 2550199 - DNA, 14 bp, Homo sapiens
atgtttgtaaaact

SEQ ID NO: 2550200 - DNA, 13 bp, Homo sapiens
atgtttgtggcct

SEQ ID NO: 2550201 - DNA, 14 bp, Homo sapiens
atgtttgtggcctc

SEQ ID NO: 2550202 - DNA, 16 bp, Homo sapiens
atgttttaagaggcag

SEQ ID NO: 2550203 - DNA, 18 bp, Homo sapiens
atgttttaattccatgaa

SEQ ID NO: 2550204 - DNA, 18 bp, Homo sapiens
atgttttccagctcctca

SEQ ID NO: 2550205 - DNA, 23 bp, Homo sapiens
atgttttcctttgtcatcattgt

SEQ ID NO: 2550206 - DNA, 12 bp, Homo sapiens
atgttttgacat

SEQ ID NO: 2550207 - DNA, 16 bp, Homo sapiens
atgttttgacattttt

SEQ ID NO: 2550208 - DNA, 20 bp, Homo sapiens
atgttttgataaagtagtaa

SEQ ID NO: 2550209 - DNA, 21 bp, Homo sapiens
atgttttgataaagtagtaaa

SEQ ID NO: 2550210 - DNA, 17 bp, Homo sapiens
atgttttggtatctgtt

SEQ ID NO: 2550211 - DNA, 20 bp, Homo sapiens
atgttttggtatctgttctt

SEQ ID NO: 2550212 - DNA, 22 bp, Homo sapiens
atgtttttaaaagtttcaatgt

SEQ ID NO: 2550213 - DNA, 23 bp, Homo sapiens
atgtttttaaaagtttcaatgtg

SEQ ID NO: 2550214 - DNA, 21 bp, Homo sapiens
atgtttttctgccagggagct

SEQ ID NO: 2550215 - DNA, 22 bp, Homo sapiens
atgtttttctgccagggagctt

SEQ ID NO: 2550216 - DNA, 15 bp, Homo sapiens
atgtttttgaaggca

SEQ ID NO: 2550217 - DNA, 12 bp, Homo sapiens
attaaaaaattt

SEQ ID NO: 2550218 - DNA, 21 bp, Homo sapiens
attaaaaatatggaacttcta

SEQ ID NO: 2550219 - DNA, 20 bp, Homo sapiens
attaaaaatctcaaatttct

SEQ ID NO: 2550220 - DNA, 14 bp, Homo sapiens
attaaaacaatatt

SEQ ID NO: 2550221 - DNA, 18 bp, Homo sapiens
attaaaacaatattgttt

SEQ ID NO: 2550222 - DNA, 18 bp, Homo sapiens
attaaaactgaagtctga

SEQ ID NO: 2550223 - DNA, 15 bp, Homo sapiens
attaaaactgaattg

SEQ ID NO: 2550224 - DNA, 16 bp, Homo sapiens
attaaaatcctcaatc

SEQ ID NO: 2550225 - DNA, 11 bp, Homo sapiens
attaaaatctt

SEQ ID NO: 2550226 - DNA, 12 bp, Homo sapiens
attaaaatctta

SEQ ID NO: 2550227 - DNA, 15 bp, Homo sapiens
attaaaatcttaaac

SEQ ID NO: 2550228 - DNA, 19 bp, Homo sapiens
attaaaatgattgtaaaat

SEQ ID NO: 2550229 - DNA, 13 bp, Homo sapiens
attaaacggatta

SEQ ID NO: 2550230 - DNA, 16 bp, Homo sapiens
attaaacggattattt

SEQ ID NO: 2550231 - DNA, 19 bp, Homo sapiens
attaaacggattatttttt

SEQ ID NO: 2550232 - DNA, 21 bp, Homo sapiens
attaaacgtatgcatgtgaag

SEQ ID NO: 2550233 - DNA, 17 bp, Homo sapiens
attaaacttaatctaaa

SEQ ID NO: 2550234 - DNA, 19 bp, Homo sapiens
attaaacttaatctaaatg

SEQ ID NO: 2550235 - DNA, 13 bp, Homo sapiens
attaaagacagag

SEQ ID NO: 2550236 - DNA, 12 bp, Homo sapiens
attaaatacaga

SEQ ID NO: 2550237 - DNA, 14 bp, Homo sapiens
attaaatacagaca

SEQ ID NO: 2550238 - DNA, 15 bp, Homo sapiens
attaaatataatatg

SEQ ID NO: 2550239 - DNA, 20 bp, Homo sapiens
attaaatatgttagcaaaga

SEQ ID NO: 2550240 - DNA, 11 bp, Homo sapiens
attaaattatg

SEQ ID NO: 2550241 - DNA, 14 bp, Homo sapiens
attaacagttttcc

SEQ ID NO: 2550242 - DNA, 22 bp, Homo sapiens
attaacagttttccatgaaaac

SEQ ID NO: 2550243 - DNA, 23 bp, Homo sapiens
attaacagttttccatgaaaacg

SEQ ID NO: 2550244 - DNA, 18 bp, Homo sapiens
attaacataggtgaaagt

SEQ ID NO: 2550245 - DNA, 20 bp, Homo sapiens
attaaccacttcagctgact

SEQ ID NO: 2550246 - DNA, 15 bp, Homo sapiens
attaaccatagatgt

SEQ ID NO: 2550247 - DNA, 13 bp, Homo sapiens
attaacctctcac

SEQ ID NO: 2550248 - DNA, 14 bp, Homo sapiens
attaacctggtgct

SEQ ID NO: 2550249 - DNA, 20 bp, Homo sapiens
attaacttttataaacttta

SEQ ID NO: 2550250 - DNA, 13 bp, Homo sapiens
attaagaaagact

SEQ ID NO: 2550251 - DNA, 14 bp, Homo sapiens
attaagaaagacta

SEQ ID NO: 2550252 - DNA, 20 bp, Homo sapiens
attaagattgaggcctgccc

SEQ ID NO: 2550253 - DNA, 13 bp, Homo sapiens
attaagatttcca

SEQ ID NO: 2550254 - DNA, 17 bp, Homo sapiens
attaagtatctgacatc

SEQ ID NO: 2550255 - DNA, 24 bp, Homo sapiens
attaagtctgtgagattcattcat

SEQ ID NO: 2550256 - DNA, 15 bp, Homo sapiens
attaataataaattc

SEQ ID NO: 2550257 - DNA, 19 bp, Homo sapiens
attaatagcttttattgta

SEQ ID NO: 2550258 - DNA, 16 bp, Homo sapiens
attaatattcattgta

SEQ ID NO: 2550259 - DNA, 23 bp, Homo sapiens
attaatcaatcatctgtgtgaaa

SEQ ID NO: 2550260 - DNA, 14 bp, Homo sapiens
attaatcatctata

SEQ ID NO: 2550261 - DNA, 15 bp, Homo sapiens
attaatcatgaatgt

SEQ ID NO: 2550262 - DNA, 14 bp, Homo sapiens
attaatccagaata

SEQ ID NO: 2550263 - DNA, 23 bp, Homo sapiens
attaatctttctttacctgagac

SEQ ID NO: 2550264 - DNA, 12 bp, Homo sapiens
attaatgaaata

SEQ ID NO: 2550265 - DNA, 15 bp, Homo sapiens
attaatgaaatatct

SEQ ID NO: 2550266 - DNA, 16 bp, Homo sapiens
attaatgacagagcca

SEQ ID NO: 2550267 - DNA, 12 bp, Homo sapiens
attaatgcactt

SEQ ID NO: 2550268 - DNA, 18 bp, Homo sapiens
attaatgttaattcagca

SEQ ID NO: 2550269 - DNA, 13 bp, Homo sapiens
attacaaattgct

SEQ ID NO: 2550270 - DNA, 15 bp, Homo sapiens
attacaaattgctta

SEQ ID NO: 2550271 - DNA, 17 bp, Homo sapiens
attacacaaaacaaatg

SEQ ID NO: 2550272 - DNA, 15 bp, Homo sapiens
attacagagaggaga

SEQ ID NO: 2550273 - DNA, 21 bp, Homo sapiens
attacagagaggagaaacaca

SEQ ID NO: 2550274 - DNA, 18 bp, Homo sapiens
attatattgttaatcaat

SEQ ID NO: 2550275 - DNA, 15 bp, Homo sapiens
attatcatgcaaatg

SEQ ID NO: 2550276 - DNA, 17 bp, Homo sapiens
attatcatgcaaatgct

SEQ ID NO: 2550277 - DNA, 14 bp, Homo sapiens
attatcatgtgtaa

SEQ ID NO: 2550278 - DNA, 16 bp, Homo sapiens
attatcatgtgtaatc

SEQ ID NO: 2550279 - DNA, 21 bp, Homo sapiens
attatcatgtgtaatcaataa

SEQ ID NO: 2550280 - DNA, 19 bp, Homo sapiens
attatcggaagcagtgcct

SEQ ID NO: 2550281 - DNA, 21 bp, Homo sapiens
attatcggaagcagtgccttc

SEQ ID NO: 2550282 - DNA, 19 bp, Homo sapiens
attatcgggaacagtgttt

SEQ ID NO: 2550283 - DNA, 20 bp, Homo sapiens
attatcgggaacagtgtttc

SEQ ID NO: 2550284 - DNA, 14 bp, Homo sapiens
attatctagatact

SEQ ID NO: 2550285 - DNA, 23 bp, Homo sapiens
attatctcaaaactgcactgtca

SEQ ID NO: 2550286 - DNA, 17 bp, Homo sapiens
attatctcacttgtgcc

SEQ ID NO: 2550287 - DNA, 14 bp, Homo sapiens
attatgacagttat

SEQ ID NO: 2550288 - DNA, 17 bp, Homo sapiens
attatgacagttatact

SEQ ID NO: 2550289 - DNA, 16 bp, Homo sapiens
attatgagtttgctta

SEQ ID NO: 2550290 - DNA, 17 bp, Homo sapiens
attatgggaatcaagat

SEQ ID NO: 2550291 - DNA, 12 bp, Homo sapiens
attatgtttata

SEQ ID NO: 2550292 - DNA, 20 bp, Homo sapiens
attatgtttatataaatgct

SEQ ID NO: 2550293 - DNA, 15 bp, Homo sapiens
attattatttgtgtt

SEQ ID NO: 2550294 - DNA, 14 bp, Homo sapiens
attattcatttaaa

SEQ ID NO: 2550295 - DNA, 15 bp, Homo sapiens
attattcatttaaaa

SEQ ID NO: 2550296 - DNA, 17 bp, Homo sapiens
attattccctgtacaat

SEQ ID NO: 2550297 - DNA, 16 bp, Homo sapiens
attattctgattccac

SEQ ID NO: 2550298 - DNA, 12 bp, Homo sapiens
attattgcatta

SEQ ID NO: 2550299 - DNA, 18 bp, Homo sapiens
attattggaattaacctg

SEQ ID NO: 2550300 - DNA, 11 bp, Homo sapiens
attatttaaac

SEQ ID NO: 2550301 - DNA, 12 bp, Homo sapiens
attatttaaaca

SEQ ID NO: 2550302 - DNA, 13 bp, Homo sapiens
attatttaataaa

SEQ ID NO: 2550303 - DNA, 13 bp, Homo sapiens
attatttaataac

SEQ ID NO: 2550304 - DNA, 14 bp, Homo sapiens
attatttaataaca

SEQ ID NO: 2550305 - DNA, 22 bp, Homo sapiens
attatttaataacattacctta

SEQ ID NO: 2550306 - DNA, 14 bp, Homo sapiens
attatttatttaat

SEQ ID NO: 2550307 - DNA, 16 bp, Homo sapiens
attatttctaggaaga

SEQ ID NO: 2550308 - DNA, 20 bp, Homo sapiens
attatttctaggaagaattt

SEQ ID NO: 2550309 - DNA, 11 bp, Homo sapiens
attatttgcat

SEQ ID NO: 2550310 - DNA, 15 bp, Homo sapiens
attatttgtgtaata

SEQ ID NO: 2550311 - DNA, 17 bp, Homo sapiens
attatttgtgtaataga

SEQ ID NO: 2550312 - DNA, 18 bp, Homo sapiens
attatttgtgtaatagaa

SEQ ID NO: 2550313 - DNA, 14 bp, Homo sapiens
attattttccaaaa

SEQ ID NO: 2550314 - DNA, 19 bp, Homo sapiens
attattttggtacttttat

SEQ ID NO: 2550315 - DNA, 20 bp, Homo sapiens
attattttggtacttttatg

SEQ ID NO: 2550316 - DNA, 19 bp, Homo sapiens
attcaaaattgacattgct

SEQ ID NO: 2550317 - DNA, 21 bp, Homo sapiens
attcaaaattgacattgcttt

SEQ ID NO: 2550318 - DNA, 14 bp, Homo sapiens
attcaactcagact

SEQ ID NO: 2550319 - DNA, 19 bp, Homo sapiens
attcaagaaaagtaagccc

SEQ ID NO: 2550320 - DNA, 20 bp, Homo sapiens
attcaagtgtaaaatatttt

SEQ ID NO: 2550321 - DNA, 15 bp, Homo sapiens
attcaagttattgta

SEQ ID NO: 2550322 - DNA, 13 bp, Homo sapiens
attcaataaattg

SEQ ID NO: 2550323 - DNA, 15 bp, Homo sapiens
attcaatctgtaaac

SEQ ID NO: 2550324 - DNA, 22 bp, Homo sapiens
attcaatctgtaaactgtgtat

SEQ ID NO: 2550325 - DNA, 22 bp, Homo sapiens
attcaatgtttatgcaaggaag

SEQ ID NO: 2550326 - DNA, 16 bp, Homo sapiens
attcaattcctctggg

SEQ ID NO: 2550327 - DNA, 18 bp, Homo sapiens
attcacaagacccaaaag

SEQ ID NO: 2550328 - DNA, 19 bp, Homo sapiens
attcacaagacccaaaagg

SEQ ID NO: 2550329 - DNA, 21 bp, Homo sapiens
attcactcatacatctggccg

SEQ ID NO: 2550330 - DNA, 20 bp, Homo sapiens
attcactgcccccagctctt

SEQ ID NO: 2550331 - DNA, 11 bp, Homo sapiens
attcagacagc

SEQ ID NO: 2550332 - DNA, 12 bp, Homo sapiens
attcagacagct

SEQ ID NO: 2550333 - DNA, 13 bp, Homo sapiens
attcagacagctg

SEQ ID NO: 2550334 - DNA, 14 bp, Homo sapiens
attcagacagctgc

SEQ ID NO: 2550335 - DNA, 15 bp, Homo sapiens
attcagacagctgcc

SEQ ID NO: 2550336 - DNA, 18 bp, Homo sapiens
attcagacagctgcctgg

SEQ ID NO: 2550337 - DNA, 18 bp, Homo sapiens
attcagatatatttttca

SEQ ID NO: 2550338 - DNA, 17 bp, Homo sapiens
attcagattgttatcta

SEQ ID NO: 2550339 - DNA, 17 bp, Homo sapiens
attcagcactgatttca

SEQ ID NO: 2550340 - DNA, 20 bp, Homo sapiens
attcagcactgatttcacaa

SEQ ID NO: 2550341 - DNA, 22 bp, Homo sapiens
attcagctagaactttgaagga

SEQ ID NO: 2550342 - DNA, 16 bp, Homo sapiens
attcaggaagatgaaa

SEQ ID NO: 2550343 - DNA, 14 bp, Homo sapiens
attcaggaagctca

SEQ ID NO: 2550344 - DNA, 17 bp, Homo sapiens
attcaggaagctcaggg

SEQ ID NO: 2550345 - DNA, 21 bp, Homo sapiens
attcaggaagctcagggcctg

SEQ ID NO: 2550346 - DNA, 23 bp, Homo sapiens
attcaggaagctcagggcctggc

SEQ ID NO: 2550347 - DNA, 11 bp, Homo sapiens
attcaggctgc

SEQ ID NO: 2550348 - DNA, 13 bp, Homo sapiens
attcaggctgctt

SEQ ID NO: 2550349 - DNA, 16 bp, Homo sapiens
attcagttcccagaat

SEQ ID NO: 2550350 - DNA, 19 bp, Homo sapiens
attcagttcccagaatcaa

SEQ ID NO: 2550351 - DNA, 14 bp, Homo sapiens
attcatatttactt

SEQ ID NO: 2550352 - DNA, 13 bp, Homo sapiens
attcatgaacttc

SEQ ID NO: 2550353 - DNA, 13 bp, Homo sapiens
attcatgcctggc

SEQ ID NO: 2550354 - DNA, 14 bp, Homo sapiens
attcatgcctggct

SEQ ID NO: 2550355 - DNA, 12 bp, Homo sapiens
attcatgtttct

SEQ ID NO: 2550356 - DNA, 20 bp, Homo sapiens
attcattatttttccacttt

SEQ ID NO: 2550357 - DNA, 19 bp, Homo sapiens
attcatttgagttatttta

SEQ ID NO: 2550358 - DNA, 13 bp, Homo sapiens
attcatttttaat

SEQ ID NO: 2550359 - DNA, 23 bp, Homo sapiens
attccaacaaagggttttaatgt

SEQ ID NO: 2550360 - DNA, 14 bp, Homo sapiens
attccaacagctca

SEQ ID NO: 2550361 - DNA, 20 bp, Homo sapiens
attccaacagctcaagtctt

SEQ ID NO: 2550362 - DNA, 14 bp, Homo sapiens
attccaacagtgag

SEQ ID NO: 2550363 - DNA, 15 bp, Homo sapiens
attccaacagtgagt

SEQ ID NO: 2550364 - DNA, 16 bp, Homo sapiens
attccaaccccaactc

SEQ ID NO: 2550365 - DNA, 18 bp, Homo sapiens
attccactgcgttgtcca

SEQ ID NO: 2550366 - DNA, 20 bp, Homo sapiens
attccacttataggaattga

SEQ ID NO: 2550367 - DNA, 16 bp, Homo sapiens
attccagaatatctgg

SEQ ID NO: 2550368 - DNA, 20 bp, Homo sapiens
attccagatctgcagtcact

SEQ ID NO: 2550369 - DNA, 17 bp, Homo sapiens
attccatattcatgtaa

SEQ ID NO: 2550370 - DNA, 18 bp, Homo sapiens
attccatattcatgtaaa

SEQ ID NO: 2550371 - DNA, 15 bp, Homo sapiens
attccatgaatcgct

SEQ ID NO: 2550372 - DNA, 18 bp, Homo sapiens
attccatgaatcgcttct

SEQ ID NO: 2550373 - DNA, 18 bp, Homo sapiens
attccatgaatgtatcag

SEQ ID NO: 2550374 - DNA, 15 bp, Homo sapiens
attccattgtgtgag

SEQ ID NO: 2550375 - DNA, 17 bp, Homo sapiens
attccatttatctttct

SEQ ID NO: 2550376 - DNA, 15 bp, Homo sapiens
attcccaagctctgc

SEQ ID NO: 2550377 - DNA, 12 bp, Homo sapiens
attcccagccca

SEQ ID NO: 2550378 - DNA, 15 bp, Homo sapiens
attcccattttgcaa

SEQ ID NO: 2550379 - DNA, 20 bp, Homo sapiens
attccccattgcctcctcct

SEQ ID NO: 2550380 - DNA, 21 bp, Homo sapiens
attcccctatctctagaattt

SEQ ID NO: 2550381 - DNA, 15 bp, Homo sapiens
attcccctctgctgc

SEQ ID NO: 2550382 - DNA, 22 bp, Homo sapiens
attcccctctgctgctgtccct

SEQ ID NO: 2550383 - DNA, 19 bp, Homo sapiens
attctatatgaatttaaat

SEQ ID NO: 2550384 - DNA, 15 bp, Homo sapiens
attctatctattcct

SEQ ID NO: 2550385 - DNA, 14 bp, Homo sapiens
attctcaccaggaa

SEQ ID NO: 2550386 - DNA, 14 bp, Homo sapiens
attctcagaatctc

SEQ ID NO: 2550387 - DNA, 20 bp, Homo sapiens
attctcagaatctcaaataa

SEQ ID NO: 2550388 - DNA, 16 bp, Homo sapiens
attctcatggagaagt

SEQ ID NO: 2550389 - DNA, 21 bp, Homo sapiens
attctccacctgccagggaca

SEQ ID NO: 2550390 - DNA, 14 bp, Homo sapiens
attctcctgcctca

SEQ ID NO: 2550391 - DNA, 14 bp, Homo sapiens
attctcctgtgcta

SEQ ID NO: 2550392 - DNA, 16 bp, Homo sapiens
attctccttgtgttac

SEQ ID NO: 2550393 - DNA, 20 bp, Homo sapiens
attctctagtttgattaaat

SEQ ID NO: 2550394 - DNA, 18 bp, Homo sapiens
attctctgagctgtgcag

SEQ ID NO: 2550395 - DNA, 19 bp, Homo sapiens
attctctgtctcatccatc

SEQ ID NO: 2550396 - DNA, 14 bp, Homo sapiens
attctcttatccaa

SEQ ID NO: 2550397 - DNA, 16 bp, Homo sapiens
attctgaacaattctc

SEQ ID NO: 2550398 - DNA, 15 bp, Homo sapiens
attctgaaggagccc

SEQ ID NO: 2550399 - DNA, 10 bp, Homo sapiens
attctgaatg

SEQ ID NO: 2550400 - DNA, 13 bp, Homo sapiens
attctgcagcatg

SEQ ID NO: 2550401 - DNA, 15 bp, Homo sapiens
attctgcagcatgac

SEQ ID NO: 2550402 - DNA, 18 bp, Homo sapiens
attctgcccaaaaatatg

SEQ ID NO: 2550403 - DNA, 19 bp, Homo sapiens
attctgcccaaaaatatgg

SEQ ID NO: 2550404 - DNA, 18 bp, Homo sapiens
attctgcctgcccaggcc

SEQ ID NO: 2550405 - DNA, 20 bp, Homo sapiens
attctgcctgcccaggcccc

SEQ ID NO: 2550406 - DNA, 20 bp, Homo sapiens
attctgtacatagcctatat

SEQ ID NO: 2550407 - DNA, 18 bp, Homo sapiens
attctgtcgccttagcat

SEQ ID NO: 2550408 - DNA, 19 bp, Homo sapiens
attctgtcgccttagcatg

SEQ ID NO: 2550409 - DNA, 21 bp, Homo sapiens
attctgtgtgttttcataata

SEQ ID NO: 2550410 - DNA, 23 bp, Homo sapiens
attcttaaaatatatttcagata

SEQ ID NO: 2550411 - DNA, 19 bp, Homo sapiens
attcttaaagtacttgtta

SEQ ID NO: 2550412 - DNA, 17 bp, Homo sapiens
attcttacatgttttct

SEQ ID NO: 2550413 - DNA, 12 bp, Homo sapiens
attcttataaat

SEQ ID NO: 2550414 - DNA, 20 bp, Homo sapiens
attcttataaatatgaagct

SEQ ID NO: 2550415 - DNA, 22 bp, Homo sapiens
attcttatgtagcaggaaataa

SEQ ID NO: 2550416 - DNA, 13 bp, Homo sapiens
attcttatttaat

SEQ ID NO: 2550417 - DNA, 18 bp, Homo sapiens
attcttatttaatgaaag

SEQ ID NO: 2550418 - DNA, 15 bp, Homo sapiens
attcttctcttcctt

SEQ ID NO: 2550419 - DNA, 14 bp, Homo sapiens
attcttctgcttca

SEQ ID NO: 2550420 - DNA, 20 bp, Homo sapiens
attcttctgcttcagcctcc

SEQ ID NO: 2550421 - DNA, 13 bp, Homo sapiens
attcttgagttta

SEQ ID NO: 2550422 - DNA, 15 bp, Homo sapiens
attcttgcaaagtat

SEQ ID NO: 2550423 - DNA, 14 bp, Homo sapiens
attcttgtcaaaaa

SEQ ID NO: 2550424 - DNA, 11 bp, Homo sapiens
attctttcctg

SEQ ID NO: 2550425 - DNA, 19 bp, Homo sapiens
attctttgacctgttggga

SEQ ID NO: 2550426 - DNA, 16 bp, Homo sapiens
attctttgatgttaac

SEQ ID NO: 2550427 - DNA, 14 bp, Homo sapiens
attctttttaaagt

SEQ ID NO: 2550428 - DNA, 16 bp, Homo sapiens
attctttttaaagtat

SEQ ID NO: 2550429 - DNA, 13 bp, Homo sapiens
attgaaaaggaca

SEQ ID NO: 2550430 - DNA, 15 bp, Homo sapiens
attgaaagagaacca

SEQ ID NO: 2550431 - DNA, 13 bp, Homo sapiens
attgaaattctga

SEQ ID NO: 2550432 - DNA, 17 bp, Homo sapiens
attgaaattctgagaaa

SEQ ID NO: 2550433 - DNA, 14 bp, Homo sapiens
attgaagtaatgaa

SEQ ID NO: 2550434 - DNA, 15 bp, Homo sapiens
attgaagtaatgaat

SEQ ID NO: 2550435 - DNA, 22 bp, Homo sapiens
attgaataatggtaccagataa

SEQ ID NO: 2550436 - DNA, 10 bp, Homo sapiens
attgaatcta

SEQ ID NO: 2550437 - DNA, 22 bp, Homo sapiens
attgaattcttggttgaggaaa

SEQ ID NO: 2550438 - DNA, 13 bp, Homo sapiens
attgacaaactct

SEQ ID NO: 2550439 - DNA, 15 bp, Homo sapiens
attgacaagaactga

SEQ ID NO: 2550440 - DNA, 15 bp, Homo sapiens
attgacaagtcattt

SEQ ID NO: 2550441 - DNA, 17 bp, Homo sapiens
attgacacttaaaaatg

SEQ ID NO: 2550442 - DNA, 21 bp, Homo sapiens
attgacagatcaagctgtgag

SEQ ID NO: 2550443 - DNA, 18 bp, Homo sapiens
attgacaggattattgga

SEQ ID NO: 2550444 - DNA, 13 bp, Homo sapiens
attgacctgaggc

SEQ ID NO: 2550445 - DNA, 18 bp, Homo sapiens
attgactatcaaactgaa

SEQ ID NO: 2550446 - DNA, 21 bp, Homo sapiens
attgactatcaaactgaagcc

SEQ ID NO: 2550447 - DNA, 14 bp, Homo sapiens
attgacttcaatga

SEQ ID NO: 2550448 - DNA, 14 bp, Homo sapiens
attgagaactgcat

SEQ ID NO: 2550449 - DNA, 18 bp, Homo sapiens
attgagaactgcatatgt

SEQ ID NO: 2550450 - DNA, 22 bp, Homo sapiens
attgagaactgcatatgtttcg

SEQ ID NO: 2550451 - DNA, 20 bp, Homo sapiens
attgagagttttgtcttgaa

SEQ ID NO: 2550452 - DNA, 12 bp, Homo sapiens
attgaggcctgc

SEQ ID NO: 2550453 - DNA, 21 bp, Homo sapiens
attgaggcctgccctcaggga

SEQ ID NO: 2550454 - DNA, 16 bp, Homo sapiens
attgagttttcagtgg

SEQ ID NO: 2550455 - DNA, 21 bp, Homo sapiens
attgatatacacggatgactt

SEQ ID NO: 2550456 - DNA, 17 bp, Homo sapiens
attgatatgcttataca

SEQ ID NO: 2550457 - DNA, 21 bp, Homo sapiens
attgatcattttccccccact

SEQ ID NO: 2550458 - DNA, 19 bp, Homo sapiens
attgatcggagcctcctct

SEQ ID NO: 2550459 - DNA, 21 bp, Homo sapiens
attgatgtacagtctgtcatg

SEQ ID NO: 2550460 - DNA, 22 bp, Homo sapiens
attgatgtacagtctgtcatga

SEQ ID NO: 2550461 - DNA, 22 bp, Homo sapiens
attgattattctgattccactt

SEQ ID NO: 2550462 - DNA, 21 bp, Homo sapiens
attgatttctgccttccttgc

SEQ ID NO: 2550463 - DNA, 23 bp, Homo sapiens
attgcaaaggttccaactgtata

SEQ ID NO: 2550464 - DNA, 13 bp, Homo sapiens
attgcacaatatt

SEQ ID NO: 2550465 - DNA, 22 bp, Homo sapiens
attgcacaatattgaacttttt

SEQ ID NO: 2550466 - DNA, 18 bp, Homo sapiens
attgcactccagcctggg

SEQ ID NO: 2550467 - DNA, 13 bp, Homo sapiens
attgcactctaaa

SEQ ID NO: 2550468 - DNA, 13 bp, Homo sapiens
attgcacttttaa

SEQ ID NO: 2550469 - DNA, 17 bp, Homo sapiens
attgcaggtggaactca

SEQ ID NO: 2550470 - DNA, 17 bp, Homo sapiens
attgcagtttatcattc

SEQ ID NO: 2550471 - DNA, 19 bp, Homo sapiens
attgcagtttatcattcaa

SEQ ID NO: 2550472 - DNA, 16 bp, Homo sapiens
attgcatataacttat

SEQ ID NO: 2550473 - DNA, 22 bp, Homo sapiens
attgcatataacttatattgta

SEQ ID NO: 2550474 - DNA, 22 bp, Homo sapiens
attgcatctgggtagctgtaag

SEQ ID NO: 2550475 - DNA, 14 bp, Homo sapiens
attgcatgtgactc

SEQ ID NO: 2550476 - DNA, 23 bp, Homo sapiens
attgcattaaatataatatgcac

SEQ ID NO: 2550477 - DNA, 22 bp, Homo sapiens
attgccaagctcaggaccaggc

SEQ ID NO: 2550478 - DNA, 15 bp, Homo sapiens
attgcccccagggca

SEQ ID NO: 2550479 - DNA, 16 bp, Homo sapiens
attgcccccagggcac

SEQ ID NO: 2550480 - DNA, 18 bp, Homo sapiens
attttacctcttattgca

SEQ ID NO: 2550481 - DNA, 18 bp, Homo sapiens
attttactactgtggaaa

SEQ ID NO: 2550482 - DNA, 22 bp, Homo sapiens
attttactactgtggaaaaata

SEQ ID NO: 2550483 - DNA, 18 bp, Homo sapiens
attttacttctagagata

SEQ ID NO: 2550484 - DNA, 21 bp, Homo sapiens
attttactttaaaaggagcca

SEQ ID NO: 2550485 - DNA, 19 bp, Homo sapiens
attttagaagactctacca

SEQ ID NO: 2550486 - DNA, 14 bp, Homo sapiens
attttagtcacttt

SEQ ID NO: 2550487 - DNA, 14 bp, Homo sapiens
attttagtttctgt

SEQ ID NO: 2550488 - DNA, 21 bp, Homo sapiens
attttagtttctgttctgtgg

SEQ ID NO: 2550489 - DNA, 16 bp, Homo sapiens
attttataaatcgctt

SEQ ID NO: 2550490 - DNA, 21 bp, Homo sapiens
attttataaatcgcttttgat

SEQ ID NO: 2550491 - DNA, 12 bp, Homo sapiens
attttataattt

SEQ ID NO: 2550492 - DNA, 18 bp, Homo sapiens
attttatatgcttactga

SEQ ID NO: 2550493 - DNA, 19 bp, Homo sapiens
attttatattagaagtgtt

SEQ ID NO: 2550494 - DNA, 15 bp, Homo sapiens
attttatctcttatt

SEQ ID NO: 2550495 - DNA, 13 bp, Homo sapiens
attttatctgtga

SEQ ID NO: 2550496 - DNA, 18 bp, Homo sapiens
attttatgctttaaacat

SEQ ID NO: 2550497 - DNA, 19 bp, Homo sapiens
attttatgctttaaacatt

SEQ ID NO: 2550498 - DNA, 22 bp, Homo sapiens
attttatgttaagggaagaatt

SEQ ID NO: 2550499 - DNA, 14 bp, Homo sapiens
attttatttgacaa

SEQ ID NO: 2550500 - DNA, 22 bp, Homo sapiens
attttcaaagctttttccagag

SEQ ID NO: 2550501 - DNA, 13 bp, Homo sapiens
attttcaagaaac

SEQ ID NO: 2550502 - DNA, 23 bp, Homo sapiens
attttcaagaaactgaggaattt

SEQ ID NO: 2550503 - DNA, 15 bp, Homo sapiens
attttcacataaaat

SEQ ID NO: 2550504 - DNA, 18 bp, Homo sapiens
attttcagcaaactcttt

SEQ ID NO: 2550505 - DNA, 19 bp, Homo sapiens
attttcagcaaactctttt

SEQ ID NO: 2550506 - DNA, 19 bp, Homo sapiens
attttcagtataatttaac

SEQ ID NO: 2550507 - DNA, 22 bp, Homo sapiens
attttcataagtatttcaaatt

SEQ ID NO: 2550508 - DNA, 15 bp, Homo sapiens
attttcattattcct

SEQ ID NO: 2550509 - DNA, 22 bp, Homo sapiens
attttccaaaagtggcctcttt

SEQ ID NO: 2550510 - DNA, 15 bp, Homo sapiens
attttccccccactc

SEQ ID NO: 2550511 - DNA, 12 bp, Homo sapiens
attttcctcccc

SEQ ID NO: 2550512 - DNA, 14 bp, Homo sapiens
attttcctccccag

SEQ ID NO: 2550513 - DNA, 16 bp, Homo sapiens
attttcctccccagca

SEQ ID NO: 2550514 - DNA, 16 bp, Homo sapiens
attttcctgccaggca

SEQ ID NO: 2550515 - DNA, 18 bp, Homo sapiens
attttcctggtgccaatt

SEQ ID NO: 2550516 - DNA, 16 bp, Homo sapiens
attttctagactttct

SEQ ID NO: 2550517 - DNA, 18 bp, Homo sapiens
attttctggtagatagaa

SEQ ID NO: 2550518 - DNA, 16 bp, Homo sapiens
attttctgtgcctgaa

SEQ ID NO: 2550519 - DNA, 18 bp, Homo sapiens
attttctgtgcctgaata

SEQ ID NO: 2550520 - DNA, 23 bp, Homo sapiens
attttctgtgttttgctgtacca

SEQ ID NO: 2550521 - DNA, 11 bp, Homo sapiens
attttctgttg

SEQ ID NO: 2550522 - DNA, 19 bp, Homo sapiens
attttcttatcttctgcaa

SEQ ID NO: 2550523 - DNA, 18 bp, Homo sapiens
attttcttcatgcaatga

SEQ ID NO: 2550524 - DNA, 21 bp, Homo sapiens
attttcttcatgcaatgacat

SEQ ID NO: 2550525 - DNA, 13 bp, Homo sapiens
attttctttaaaa

SEQ ID NO: 2550526 - DNA, 14 bp, Homo sapiens
attttctttcaaaa

SEQ ID NO: 2550527 - DNA, 23 bp, Homo sapiens
attttctttgtgtagctttgctc

SEQ ID NO: 2550528 - DNA, 17 bp, Homo sapiens
attttcttttgtaaatg

SEQ ID NO: 2550529 - DNA, 20 bp, Homo sapiens
attttgaaatcatgaagata

SEQ ID NO: 2550530 - DNA, 15 bp, Homo sapiens
attttgaatcaataa

SEQ ID NO: 2550531 - DNA, 18 bp, Homo sapiens
attttgaatcaataatat

SEQ ID NO: 2550532 - DNA, 17 bp, Homo sapiens
attttgacctactctca

SEQ ID NO: 2550533 - DNA, 18 bp, Homo sapiens
attttgacctactctcat

SEQ ID NO: 2550534 - DNA, 14 bp, Homo sapiens
attttgagtgactc

SEQ ID NO: 2550535 - DNA, 19 bp, Homo sapiens
attttgatccaagctggtc

SEQ ID NO: 2550536 - DNA, 14 bp, Homo sapiens
attttgatgaacaa

SEQ ID NO: 2550537 - DNA, 16 bp, Homo sapiens
attttgattattgtat

SEQ ID NO: 2550538 - DNA, 22 bp, Homo sapiens
attttgattattgtatttattc

SEQ ID NO: 2550539 - DNA, 15 bp, Homo sapiens
attttgcattcaaat

SEQ ID NO: 2550540 - DNA, 18 bp, Homo sapiens
attttgccagtgggaact

SEQ ID NO: 2550541 - DNA, 20 bp, Homo sapiens
attttgctaaatgtgaatga

SEQ ID NO: 2550542 - DNA, 22 bp, Homo sapiens
attttgctattgtaaatatgtt

SEQ ID NO: 2550543 - DNA, 20 bp, Homo sapiens
attttgctgtagaagatggc

SEQ ID NO: 2550544 - DNA, 14 bp, Homo sapiens
caaagaggcaagag

SEQ ID NO: 2550545 - DNA, 14 bp, Homo sapiens
caaagaggttttaa

SEQ ID NO: 2550546 - DNA, 16 bp, Homo sapiens
caaagataatctctca

SEQ ID NO: 2550547 - DNA, 14 bp, Homo sapiens
caaagatattttgc

SEQ ID NO: 2550548 - DNA, 16 bp, Homo sapiens
caaagatattttgctt

SEQ ID NO: 2550549 - DNA, 17 bp, Homo sapiens
caaagatcaaaataaaa

SEQ ID NO: 2550550 - DNA, 15 bp, Homo sapiens
caaagcacagtgtta

SEQ ID NO: 2550551 - DNA, 19 bp, Homo sapiens
caaagcaccaaaataagaa

SEQ ID NO: 2550552 - DNA, 20 bp, Homo sapiens
caaagcacgaaatgttattt

SEQ ID NO: 2550553 - DNA, 22 bp, Homo sapiens
caaagcacgaaatgttattttt

SEQ ID NO: 2550554 - DNA, 22 bp, Homo sapiens
caaagcactgacttctaagtaa

SEQ ID NO: 2550555 - DNA, 15 bp, Homo sapiens
caaagcagggtctgg

SEQ ID NO: 2550556 - DNA, 17 bp, Homo sapiens
caaagcattgagcaaag

SEQ ID NO: 2550557 - DNA, 14 bp, Homo sapiens
caaagccagacagc

SEQ ID NO: 2550558 - DNA, 21 bp, Homo sapiens
caaagccagcgtcctcctctg

SEQ ID NO: 2550559 - DNA, 21 bp, Homo sapiens
caaagccttgtgtctacagag

SEQ ID NO: 2550560 - DNA, 13 bp, Homo sapiens
caaagctaggcct

SEQ ID NO: 2550561 - DNA, 14 bp, Homo sapiens
caaagctaggcctg

SEQ ID NO: 2550562 - DNA, 18 bp, Homo sapiens
caaagctaggcctggcca

SEQ ID NO: 2550563 - DNA, 21 bp, Homo sapiens
caaagctagggtggcccttgc

SEQ ID NO: 2550564 - DNA, 16 bp, Homo sapiens
caaagcttagcaggag

SEQ ID NO: 2550565 - DNA, 22 bp, Homo sapiens
caaagcttagcaggagaggaga

SEQ ID NO: 2550566 - DNA, 18 bp, Homo sapiens
caaagcttctatcccagg

SEQ ID NO: 2550567 - DNA, 20 bp, Homo sapiens
caaagcttctatcccaggag

SEQ ID NO: 2550568 - DNA, 16 bp, Homo sapiens
caaagcttgttaagat

SEQ ID NO: 2550569 - DNA, 19 bp, Homo sapiens
caaaggaatctccagtttt

SEQ ID NO: 2550570 - DNA, 22 bp, Homo sapiens
caaaggaatctccagttttcag

SEQ ID NO: 2550571 - DNA, 15 bp, Homo sapiens
caaaggactccaccc

SEQ ID NO: 2550572 - DNA, 18 bp, Homo sapiens
caaaggacttgacttgca

SEQ ID NO: 2550573 - DNA, 17 bp, Homo sapiens
caaaggaggctggcagg

SEQ ID NO: 2550574 - DNA, 19 bp, Homo sapiens
caaaggccatggagagctg

SEQ ID NO: 2550575 - DNA, 14 bp, Homo sapiens
caaaggctgagaac

SEQ ID NO: 2550576 - DNA, 15 bp, Homo sapiens
caaagggaaatatca

SEQ ID NO: 2550577 - DNA, 17 bp, Homo sapiens
caaagggaaatatcatt

SEQ ID NO: 2550578 - DNA, 14 bp, Homo sapiens
caaagggagagaga

SEQ ID NO: 2550579 - DNA, 18 bp, Homo sapiens
caaagggctgaaagccat

SEQ ID NO: 2550580 - DNA, 22 bp, Homo sapiens
caaagggggaggctaaagccca

SEQ ID NO: 2550581 - DNA, 18 bp, Homo sapiens
caaagggtatcaggtgct

SEQ ID NO: 2550582 - DNA, 23 bp, Homo sapiens
caaagggtatcaggtgctgccat

SEQ ID NO: 2550583 - DNA, 19 bp, Homo sapiens
caaagggtgaagctattta

SEQ ID NO: 2550584 - DNA, 23 bp, Homo sapiens
caaagggtgaagctatttatctg

SEQ ID NO: 2550585 - DNA, 16 bp, Homo sapiens
caaagggttttaatgt

SEQ ID NO: 2550586 - DNA, 15 bp, Homo sapiens
caaaggttgagatgt

SEQ ID NO: 2550587 - DNA, 11 bp, Homo sapiens
caaaggttttc

SEQ ID NO: 2550588 - DNA, 22 bp, Homo sapiens
caaagtagaagtcttagatgta

SEQ ID NO: 2550589 - DNA, 19 bp, Homo sapiens
caaagtatccctactgtaa

SEQ ID NO: 2550590 - DNA, 22 bp, Homo sapiens
caaagtcatgcaaaggctggga

SEQ ID NO: 2550591 - DNA, 18 bp, Homo sapiens
caaagtggtatagaaatg

SEQ ID NO: 2550592 - DNA, 11 bp, Homo sapiens
caaagtgttaa

SEQ ID NO: 2550593 - DNA, 10 bp, Homo sapiens
caaataaaat

SEQ ID NO: 2550594 - DNA, 15 bp, Homo sapiens
caaatactcatgtgt

SEQ ID NO: 2550595 - DNA, 17 bp, Homo sapiens
caaatactcatgtgtat

SEQ ID NO: 2550596 - DNA, 18 bp, Homo sapiens
caaatactcatgtgtatg

SEQ ID NO: 2550597 - DNA, 16 bp, Homo sapiens
caaatactttaaagga

SEQ ID NO: 2550598 - DNA, 12 bp, Homo sapiens
caaatatgcaaa

SEQ ID NO: 2550599 - DNA, 16 bp, Homo sapiens
caaatatgcaaagcac

SEQ ID NO: 2550600 - DNA, 19 bp, Homo sapiens
caaatatgcaaagcactga

SEQ ID NO: 2550601 - DNA, 21 bp, Homo sapiens
caaatatgcaaagcactgact

SEQ ID NO: 2550602 - DNA, 19 bp, Homo sapiens
caaatattagatgtgattt

SEQ ID NO: 2550603 - DNA, 20 bp, Homo sapiens
caaatattagatgtgattta

SEQ ID NO: 2550604 - DNA, 12 bp, Homo sapiens
caaatatttatt

SEQ ID NO: 2550605 - DNA, 13 bp, Homo sapiens
caaatatttggag

SEQ ID NO: 2550606 - DNA, 15 bp, Homo sapiens
caaatcaaagcagat

SEQ ID NO: 2550607 - DNA, 15 bp, Homo sapiens
caaatcaagcttcag

SEQ ID NO: 2550608 - DNA, 13 bp, Homo sapiens
caaatcagctgct

SEQ ID NO: 2550609 - DNA, 17 bp, Homo sapiens
caaatcagctgctacta

SEQ ID NO: 2550610 - DNA, 16 bp, Homo sapiens
caaatccatccagaat

SEQ ID NO: 2550611 - DNA, 13 bp, Homo sapiens
caaatcctatgtg

SEQ ID NO: 2550612 - DNA, 15 bp, Homo sapiens
caaatcctatgtgat

SEQ ID NO: 2550613 - DNA, 22 bp, Homo sapiens
caaatctattcagacaagcaac

SEQ ID NO: 2550614 - DNA, 19 bp, Homo sapiens
caaatgaatgaccttgttg

SEQ ID NO: 2550615 - DNA, 19 bp, Homo sapiens
caaatgcccaagggaaaga

SEQ ID NO: 2550616 - DNA, 23 bp, Homo sapiens
caaatgctgtaactttctgaaat

SEQ ID NO: 2550617 - DNA, 18 bp, Homo sapiens
caaatgcttggcttctca

SEQ ID NO: 2550618 - DNA, 22 bp, Homo sapiens
caaatggaaatgggcagagcag

SEQ ID NO: 2550619 - DNA, 23 bp, Homo sapiens
caaatggaaatgggcagagcaga

SEQ ID NO: 2550620 - DNA, 20 bp, Homo sapiens
caaatgtcagatacaatgta

SEQ ID NO: 2550621 - DNA, 19 bp, Homo sapiens
caaatgtcctccagaagcc

SEQ ID NO: 2550622 - DNA, 14 bp, Homo sapiens
caaatgttcatcaa

SEQ ID NO: 2550623 - DNA, 14 bp, Homo sapiens
caaattcatttttt

SEQ ID NO: 2550624 - DNA, 21 bp, Homo sapiens
caaattctcaacctaccaccc

SEQ ID NO: 2550625 - DNA, 22 bp, Homo sapiens
caaattctcaacctaccacccc

SEQ ID NO: 2550626 - DNA, 15 bp, Homo sapiens
caaattcttctgaac

SEQ ID NO: 2550627 - DNA, 22 bp, Homo sapiens
caaattgctcctaagcttcaaa

SEQ ID NO: 2550628 - DNA, 21 bp, Homo sapiens
caaattggagcttcatggcag

SEQ ID NO: 2550629 - DNA, 22 bp, Homo sapiens
caaattgtatctagtgcagctg

SEQ ID NO: 2550630 - DNA, 15 bp, Homo sapiens
caaatttacagagac

SEQ ID NO: 2550631 - DNA, 16 bp, Homo sapiens
caaatttacagagaca

SEQ ID NO: 2550632 - DNA, 17 bp, Homo sapiens
caaatttacagagacag

SEQ ID NO: 2550633 - DNA, 17 bp, Homo sapiens
caaatttgtcttgcctt

SEQ ID NO: 2550634 - DNA, 17 bp, Homo sapiens
caacaaaaagcttcccc

SEQ ID NO: 2550635 - DNA, 12 bp, Homo sapiens
caacaaagctgt

SEQ ID NO: 2550636 - DNA, 21 bp, Homo sapiens
caacaacatgtataatatttt

SEQ ID NO: 2550637 - DNA, 22 bp, Homo sapiens
caacaatacatgctgctaattc

SEQ ID NO: 2550638 - DNA, 16 bp, Homo sapiens
caacaatttatgaatt

SEQ ID NO: 2550639 - DNA, 18 bp, Homo sapiens
caacaatttatgaattga

SEQ ID NO: 2550640 - DNA, 12 bp, Homo sapiens
caacaccacaga

SEQ ID NO: 2550641 - DNA, 18 bp, Homo sapiens
caataactactgtgttcc

SEQ ID NO: 2550642 - DNA, 19 bp, Homo sapiens
caataactactgtgttcct

SEQ ID NO: 2550643 - DNA, 18 bp, Homo sapiens
caataagcatcaaactct

SEQ ID NO: 2550644 - DNA, 20 bp, Homo sapiens
caataatatattttctgttt

SEQ ID NO: 2550645 - DNA, 18 bp, Homo sapiens
caataatggtcccatcca

SEQ ID NO: 2550646 - DNA, 17 bp, Homo sapiens
caatacagtacaggcag

SEQ ID NO: 2550647 - DNA, 22 bp, Homo sapiens
caatacccaaatcctctccagc

SEQ ID NO: 2550648 - DNA, 18 bp, Homo sapiens
caatactcataatgtgaa

SEQ ID NO: 2550649 - DNA, 18 bp, Homo sapiens
caatagctttaccctcag

SEQ ID NO: 2550650 - DNA, 21 bp, Homo sapiens
caatagctttaccctcaggca

SEQ ID NO: 2550651 - DNA, 23 bp, Homo sapiens
caatagctttaccctcaggcata

SEQ ID NO: 2550652 - DNA, 16 bp, Homo sapiens
caatagtgggccctcc

SEQ ID NO: 2550653 - DNA, 23 bp, Homo sapiens
caatagtgtgttctgattagaaa

SEQ ID NO: 2550654 - DNA, 16 bp, Homo sapiens
caatagtttgcataga

SEQ ID NO: 2550655 - DNA, 12 bp, Homo sapiens
caatatagaaac

SEQ ID NO: 2550656 - DNA, 14 bp, Homo sapiens
caatatagaaacac

SEQ ID NO: 2550657 - DNA, 21 bp, Homo sapiens
caatatatctaaattgaataa

SEQ ID NO: 2550658 - DNA, 14 bp, Homo sapiens
caatatcagacttt

SEQ ID NO: 2550659 - DNA, 21 bp, Homo sapiens
caatatcttttttttaataaa

SEQ ID NO: 2550660 - DNA, 11 bp, Homo sapiens
caatatgctta

SEQ ID NO: 2550661 - DNA, 13 bp, Homo sapiens
cacaaatatttat

SEQ ID NO: 2550662 - DNA, 16 bp, Homo sapiens
cacaacacacacactc

SEQ ID NO: 2550663 - DNA, 23 bp, Homo sapiens
cacaagacccaaaaggcagaagc

SEQ ID NO: 2550664 - DNA, 12 bp, Homo sapiens
cacaagccacag

SEQ ID NO: 2550665 - DNA, 15 bp, Homo sapiens
cacaagccacagaag

SEQ ID NO: 2550666 - DNA, 15 bp, Homo sapiens
cacaagctccaagct

SEQ ID NO: 2550667 - DNA, 19 bp, Homo sapiens
cacaagctccaagctccca

SEQ ID NO: 2550668 - DNA, 20 bp, Homo sapiens
cacaagctccaagctcccag

SEQ ID NO: 2550669 - DNA, 23 bp, Homo sapiens
cacaagctgcaccctcaggcagg

SEQ ID NO: 2550670 - DNA, 13 bp, Homo sapiens
cacaagtaaacat

SEQ ID NO: 2550671 - DNA, 21 bp, Homo sapiens
cacagccgcagcctccctctg

SEQ ID NO: 2550672 - DNA, 15 bp, Homo sapiens
cacagcctcctctgt

SEQ ID NO: 2550673 - DNA, 20 bp, Homo sapiens
cacagcctcctctgtctgcc

SEQ ID NO: 2550674 - DNA, 11 bp, Homo sapiens
cacagcctctg

SEQ ID NO: 2550675 - DNA, 17 bp, Homo sapiens
cacagcgagactccgtc

SEQ ID NO: 2550676 - DNA, 22 bp, Homo sapiens
cacagcgctggccgggaccccg

SEQ ID NO: 2550677 - DNA, 20 bp, Homo sapiens
cacagctaacacacagctcc

SEQ ID NO: 2550678 - DNA, 20 bp, Homo sapiens
cacagctctccggtctctct

SEQ ID NO: 2550679 - DNA, 11 bp, Homo sapiens
cacagctctgt

SEQ ID NO: 2550680 - DNA, 14 bp, Homo sapiens
cacagctctgtcct

SEQ ID NO: 2550681 - DNA, 10 bp, Homo sapiens
cacagctctt

SEQ ID NO: 2550682 - DNA, 14 bp, Homo sapiens
cacagctcttctcc

SEQ ID NO: 2550683 - DNA, 18 bp, Homo sapiens
cacagctcttctccaggc

SEQ ID NO: 2550684 - DNA, 19 bp, Homo sapiens
cacagctcttctccaggct

SEQ ID NO: 2550685 - DNA, 20 bp, Homo sapiens
cacagctcttctccaggctg

SEQ ID NO: 2550686 - DNA, 21 bp, Homo sapiens
cacagctcttctccaggctgt

SEQ ID NO: 2550687 - DNA, 17 bp, Homo sapiens
cacagcttcagccagga

SEQ ID NO: 2550688 - DNA, 22 bp, Homo sapiens
cacagcttcatttcctgtgtct

SEQ ID NO: 2550689 - DNA, 14 bp, Homo sapiens
cacagcttcccctc

SEQ ID NO: 2550690 - DNA, 15 bp, Homo sapiens
cacagcttcccctct

SEQ ID NO: 2550691 - DNA, 23 bp, Homo sapiens
cacagcttcccctctctcctcct

SEQ ID NO: 2550692 - DNA, 20 bp, Homo sapiens
cacagctttatcaccagaga

SEQ ID NO: 2550693 - DNA, 15 bp, Homo sapiens
cacaggacatttctc

SEQ ID NO: 2550694 - DNA, 17 bp, Homo sapiens
cacaggacatttctcta

SEQ ID NO: 2550695 - DNA, 22 bp, Homo sapiens
cacaggaggagaaatctcactt

SEQ ID NO: 2550696 - DNA, 20 bp, Homo sapiens
cacaggatcctattctcacc

SEQ ID NO: 2550697 - DNA, 16 bp, Homo sapiens
cacaggcaaaatcctt

SEQ ID NO: 2550698 - DNA, 17 bp, Homo sapiens
cacaggcaactgaggca

SEQ ID NO: 2550699 - DNA, 12 bp, Homo sapiens
cacaggccccct

SEQ ID NO: 2550700 - DNA, 20 bp, Homo sapiens
cacaggcccggctccaggct

SEQ ID NO: 2550701 - DNA, 16 bp, Homo sapiens
cacagggcagctgggc

SEQ ID NO: 2550702 - DNA, 19 bp, Homo sapiens
cacagggcagctgggccca

SEQ ID NO: 2550703 - DNA, 22 bp, Homo sapiens
cacagggccccagaaggcaggg

SEQ ID NO: 2550704 - DNA, 14 bp, Homo sapiens
cacagggtctgcac

SEQ ID NO: 2550705 - DNA, 14 bp, Homo sapiens
cacagggttgggcc

SEQ ID NO: 2550706 - DNA, 16 bp, Homo sapiens
cacagggttgggccca

SEQ ID NO: 2550707 - DNA, 18 bp, Homo sapiens
cacagggttgggcccaga

SEQ ID NO: 2550708 - DNA, 22 bp, Homo sapiens
cacagggttgggcccagatctg

SEQ ID NO: 2550709 - DNA, 21 bp, Homo sapiens
cacagtattacttctgctaca

SEQ ID NO: 2550710 - DNA, 22 bp, Homo sapiens
cacagtgaaggctgtccttacc

SEQ ID NO: 2550711 - DNA, 19 bp, Homo sapiens
cacagtgagtcgaggacag

SEQ ID NO: 2550712 - DNA, 21 bp, Homo sapiens
cacagtgagtcgaggacaggg

SEQ ID NO: 2550713 - DNA, 11 bp, Homo sapiens
cacagtgattt

SEQ ID NO: 2550714 - DNA, 13 bp, Homo sapiens
cacagtgctgtct

SEQ ID NO: 2550715 - DNA, 14 bp, Homo sapiens
cacagtgggagcca

SEQ ID NO: 2550716 - DNA, 13 bp, Homo sapiens
cacagtgtgtttg

SEQ ID NO: 2550717 - DNA, 17 bp, Homo sapiens
cacagtgtttttgtaaa

SEQ ID NO: 2550718 - DNA, 12 bp, Homo sapiens
cacagttggcct

SEQ ID NO: 2550719 - DNA, 15 bp, Homo sapiens
cacagttggccttca

SEQ ID NO: 2550720 - DNA, 17 bp, Homo sapiens
cacagttggctggatga

SEQ ID NO: 2550721 - DNA, 15 bp, Homo sapiens
cacagttttctgaga

SEQ ID NO: 2550722 - DNA, 20 bp, Homo sapiens
cacagttttctgagaaagac

SEQ ID NO: 2550723 - DNA, 23 bp, Homo sapiens
cacagttttggttgctttaatat

SEQ ID NO: 2550724 - DNA, 20 bp, Homo sapiens
cacatacgcaccacatctct

SEQ ID NO: 2550725 - DNA, 18 bp, Homo sapiens
cacatatgcaccttgtgt

SEQ ID NO: 2550726 - DNA, 21 bp, Homo sapiens
cacatatgcaccttgtgtctg

SEQ ID NO: 2550727 - DNA, 22 bp, Homo sapiens
cacatcagcacgatttctgttt

SEQ ID NO: 2550728 - DNA, 13 bp, Homo sapiens
cacatcagcttgc

SEQ ID NO: 2550729 - DNA, 23 bp, Homo sapiens
cacatcagcttgccctgttaaaa

SEQ ID NO: 2550730 - DNA, 21 bp, Homo sapiens
cacatccatttcatctatttc

SEQ ID NO: 2550731 - DNA, 22 bp, Homo sapiens
cacatcctccacgttctgctca

SEQ ID NO: 2550732 - DNA, 14 bp, Homo sapiens
cacatcctccgtcc

SEQ ID NO: 2550733 - DNA, 17 bp, Homo sapiens
cacatctaacctcatct

SEQ ID NO: 2550734 - DNA, 13 bp, Homo sapiens
cacatctgcattt

SEQ ID NO: 2550735 - DNA, 21 bp, Homo sapiens
cacatctgcattttcacccca

SEQ ID NO: 2550736 - DNA, 22 bp, Homo sapiens
cacatcttccctagagggttcc

SEQ ID NO: 2550737 - DNA, 13 bp, Homo sapiens
cacatcttgctct

SEQ ID NO: 2550738 - DNA, 20 bp, Homo sapiens
cacatcttgctctgctgaca

SEQ ID NO: 2550739 - DNA, 12 bp, Homo sapiens
cacatctttcac

SEQ ID NO: 2550740 - DNA, 17 bp, Homo sapiens
cacatgagcatcaggcc

SEQ ID NO: 2550741 - DNA, 19 bp, Homo sapiens
cacatgagcatcaggccag

SEQ ID NO: 2550742 - DNA, 17 bp, Homo sapiens
cacatgcaaggtcattt

SEQ ID NO: 2550743 - DNA, 14 bp, Homo sapiens
cacatgcagctgca

SEQ ID NO: 2550744 - DNA, 13 bp, Homo sapiens
cacatgcatacac

SEQ ID NO: 2550745 - DNA, 15 bp, Homo sapiens
cacatgcatacacac

SEQ ID NO: 2550746 - DNA, 16 bp, Homo sapiens
cacatgcatacacaca

SEQ ID NO: 2550747 - DNA, 15 bp, Homo sapiens
cacatggcctatgca

SEQ ID NO: 2550748 - DNA, 14 bp, Homo sapiens
cacatggcttcctc

SEQ ID NO: 2550749 - DNA, 19 bp, Homo sapiens
cacatggcttcctcctgcg

SEQ ID NO: 2550750 - DNA, 19 bp, Homo sapiens
cacatgtatgttttggtat

SEQ ID NO: 2550751 - DNA, 16 bp, Homo sapiens
cacatgtccaagaagc

SEQ ID NO: 2550752 - DNA, 17 bp, Homo sapiens
cacatgtccaagaagcc

SEQ ID NO: 2550753 - DNA, 22 bp, Homo sapiens
cacatgtccaagaagcccagga

SEQ ID NO: 2550754 - DNA, 23 bp, Homo sapiens
cacatgtccaagaagcccaggaa

SEQ ID NO: 2550755 - DNA, 15 bp, Homo sapiens
cacatgtgacacata

SEQ ID NO: 2550756 - DNA, 21 bp, Homo sapiens
cacatgtttagagttgcaatc

SEQ ID NO: 2550757 - DNA, 19 bp, Homo sapiens
cacattaatatttgctgac

SEQ ID NO: 2550758 - DNA, 20 bp, Homo sapiens
cacattatcgggagcagtgt

SEQ ID NO: 2550759 - DNA, 22 bp, Homo sapiens
cacattatcgggagcagtgtct

SEQ ID NO: 2550760 - DNA, 14 bp, Homo sapiens
cacattatttgcat

SEQ ID NO: 2550761 - DNA, 15 bp, Homo sapiens
cacattatttgcatg

SEQ ID NO: 2550762 - DNA, 14 bp, Homo sapiens
cacattcaggaaga

SEQ ID NO: 2550763 - DNA, 17 bp, Homo sapiens
cacattcaggaagatga

SEQ ID NO: 2550764 - DNA, 16 bp, Homo sapiens
cacattgttttaaaaa

SEQ ID NO: 2550765 - DNA, 18 bp, Homo sapiens
cacattgttttaaaaaga

SEQ ID NO: 2550766 - DNA, 23 bp, Homo sapiens
cacattgttttaaaaagaaacaa

SEQ ID NO: 2550767 - DNA, 16 bp, Homo sapiens
cacatttaagagacag

SEQ ID NO: 2550768 - DNA, 17 bp, Homo sapiens
cacatttgattctgtgt

SEQ ID NO: 2550769 - DNA, 17 bp, Homo sapiens
cacattttattttatta

SEQ ID NO: 2550770 - DNA, 21 bp, Homo sapiens
cacattttattttattatgca

SEQ ID NO: 2550771 - DNA, 16 bp, Homo sapiens
cacattttgtataatt

SEQ ID NO: 2550772 - DNA, 17 bp, Homo sapiens
cacattttttaaatgca

SEQ ID NO: 2550773 - DNA, 21 bp, Homo sapiens
cacattttttaaatgcacctg

SEQ ID NO: 2550774 - DNA, 19 bp, Homo sapiens
caccaaaataagaaaagat

SEQ ID NO: 2550775 - DNA, 15 bp, Homo sapiens
caccaaagtattttt

SEQ ID NO: 2550776 - DNA, 20 bp, Homo sapiens
caccaacatactcccatctg

SEQ ID NO: 2550777 - DNA, 14 bp, Homo sapiens
caccaacgtctgtg

SEQ ID NO: 2550778 - DNA, 17 bp, Homo sapiens
caccaacgtctgtgcca

SEQ ID NO: 2550779 - DNA, 14 bp, Homo sapiens
caccaactcttgca

SEQ ID NO: 2550780 - DNA, 24 bp, Homo sapiens
caccaattggttaatctttcctga

SEQ ID NO: 2550781 - DNA, 15 bp, Homo sapiens
caccacacccagccc

SEQ ID NO: 2550782 - DNA, 13 bp, Homo sapiens
caccacagacaca

SEQ ID NO: 2550783 - DNA, 14 bp, Homo sapiens
caccacagacacac

SEQ ID NO: 2550784 - DNA, 19 bp, Homo sapiens
caccacagacacacacacg

SEQ ID NO: 2550785 - DNA, 21 bp, Homo sapiens
caccacagacacacacacgca

SEQ ID NO: 2550786 - DNA, 23 bp, Homo sapiens
caccaccactggccaccaggctg

SEQ ID NO: 2550787 - DNA, 22 bp, Homo sapiens
caccaccccccactctgtgcct

SEQ ID NO: 2550788 - DNA, 23 bp, Homo sapiens
caccacccgctttcttgctggtt

SEQ ID NO: 2550789 - DNA, 14 bp, Homo sapiens
caccacctcagagt

SEQ ID NO: 2550790 - DNA, 15 bp, Homo sapiens
caccacggtggtcac

SEQ ID NO: 2550791 - DNA, 16 bp, Homo sapiens
caccactacattctgt

SEQ ID NO: 2550792 - DNA, 17 bp, Homo sapiens
caccactacattctgtt

SEQ ID NO: 2550793 - DNA, 13 bp, Homo sapiens
caccactgcactc

SEQ ID NO: 2550794 - DNA, 21 bp, Homo sapiens
caccagagagggactgacacc

SEQ ID NO: 2550795 - DNA, 18 bp, Homo sapiens
caccagagcccaccttgg

SEQ ID NO: 2550796 - DNA, 23 bp, Homo sapiens
caccagaggctgcagaaggccaa

SEQ ID NO: 2550797 - DNA, 16 bp, Homo sapiens
caccagccaggctctg

SEQ ID NO: 2550798 - DNA, 18 bp, Homo sapiens
caccagccaggctctgtg

SEQ ID NO: 2550799 - DNA, 16 bp, Homo sapiens
caccagccccagtgcc

SEQ ID NO: 2550800 - DNA, 18 bp, Homo sapiens
caccagcccggcctgctc

SEQ ID NO: 2550801 - DNA, 19 bp, Homo sapiens
caccagcccttagcaggga

SEQ ID NO: 2550802 - DNA, 20 bp, Homo sapiens
caccagcctttctcccaggc

SEQ ID NO: 2550803 - DNA, 16 bp, Homo sapiens
caccagcttctccagg

SEQ ID NO: 2550804 - DNA, 11 bp, Homo sapiens
caccaggaagg

SEQ ID NO: 2550805 - DNA, 15 bp, Homo sapiens
caccaggatggccct

SEQ ID NO: 2550806 - DNA, 20 bp, Homo sapiens
caccaggcacctcacagaaa

SEQ ID NO: 2550807 - DNA, 16 bp, Homo sapiens
caccaggctggcgcag

SEQ ID NO: 2550808 - DNA, 22 bp, Homo sapiens
caccaggctggcgcagccaagg

SEQ ID NO: 2550809 - DNA, 19 bp, Homo sapiens
caccagggttgaccccaga

SEQ ID NO: 2550810 - DNA, 15 bp, Homo sapiens
caccatcaagccacc

SEQ ID NO: 2550811 - DNA, 15 bp, Homo sapiens
caccatcatgtctgg

SEQ ID NO: 2550812 - DNA, 18 bp, Homo sapiens
caccatctcaggccacct

SEQ ID NO: 2550813 - DNA, 23 bp, Homo sapiens
caccatcttaagagatgcctcat

SEQ ID NO: 2550814 - DNA, 16 bp, Homo sapiens
caccatggccagccaa

SEQ ID NO: 2550815 - DNA, 15 bp, Homo sapiens
cacccacacactcgc

SEQ ID NO: 2550816 - DNA, 17 bp, Homo sapiens
cacccacacactcgccc

SEQ ID NO: 2550817 - DNA, 19 bp, Homo sapiens
cacccacatgtgacacata

SEQ ID NO: 2550818 - DNA, 13 bp, Homo sapiens
cacccaccctggg

SEQ ID NO: 2550819 - DNA, 14 bp, Homo sapiens
cacccaccctggga

SEQ ID NO: 2550820 - DNA, 23 bp, Homo sapiens
cacccaccgtccgccctgctcct

SEQ ID NO: 2550821 - DNA, 17 bp, Homo sapiens
cacccacctcagcctcc

SEQ ID NO: 2550822 - DNA, 21 bp, Homo sapiens
cacccactctcctctgcctca

SEQ ID NO: 2550823 - DNA, 16 bp, Homo sapiens
cacccagacagctccc

SEQ ID NO: 2550824 - DNA, 14 bp, Homo sapiens
cacccagccctggt

SEQ ID NO: 2550825 - DNA, 16 bp, Homo sapiens
cacccaggagccccga

SEQ ID NO: 2550826 - DNA, 11 bp, Homo sapiens
cacccaggagg

SEQ ID NO: 2550827 - DNA, 20 bp, Homo sapiens
cacccaggctggagtgcaat

SEQ ID NO: 2550828 - DNA, 23 bp, Homo sapiens
cacccagtgagcactcccaagtc

SEQ ID NO: 2550829 - DNA, 14 bp, Homo sapiens
cacccatgaagaca

SEQ ID NO: 2550830 - DNA, 19 bp, Homo sapiens
cacccatgaatcaaagaca

SEQ ID NO: 2550831 - DNA, 19 bp, Homo sapiens
cacccatgggctctgacag

SEQ ID NO: 2550832 - DNA, 20 bp, Homo sapiens
cacccatgggctctgacaga

SEQ ID NO: 2550833 - DNA, 18 bp, Homo sapiens
cacccatgtttctctggc

SEQ ID NO: 2550834 - DNA, 22 bp, Homo sapiens
caccccactgcaatcctgtctt

SEQ ID NO: 2550835 - DNA, 11 bp, Homo sapiens
caccccagcct

SEQ ID NO: 2550836 - DNA, 13 bp, Homo sapiens
caccccaggactc

SEQ ID NO: 2550837 - DNA, 15 bp, Homo sapiens
caccccatcccacac

SEQ ID NO: 2550838 - DNA, 17 bp, Homo sapiens
caccccatgccaaagct

SEQ ID NO: 2550839 - DNA, 12 bp, Homo sapiens
caccccatgctg

SEQ ID NO: 2550840 - DNA, 16 bp, Homo sapiens
caccccatgctgttga

SEQ ID NO: 2550841 - DNA, 17 bp, Homo sapiens
caccccattttctgtgg

SEQ ID NO: 2550842 - DNA, 12 bp, Homo sapiens
cacccccacacc

SEQ ID NO: 2550843 - DNA, 14 bp, Homo sapiens
cacccccacccctt

SEQ ID NO: 2550844 - DNA, 14 bp, Homo sapiens
cacccccagctcaa

SEQ ID NO: 2550845 - DNA, 13 bp, Homo sapiens
cacccccagctgc

SEQ ID NO: 2550846 - DNA, 17 bp, Homo sapiens
cacccccatctctccct

SEQ ID NO: 2550847 - DNA, 15 bp, Homo sapiens
caccccccaagctgt

SEQ ID NO: 2550848 - DNA, 16 bp, Homo sapiens
caccccccactctgtg

SEQ ID NO: 2550849 - DNA, 19 bp, Homo sapiens
caccccccagaacctgtcc

SEQ ID NO: 2550850 - DNA, 21 bp, Homo sapiens
caccccccagaacctgtcctt

SEQ ID NO: 2550851 - DNA, 12 bp, Homo sapiens
cacccccctcat

SEQ ID NO: 2550852 - DNA, 22 bp, Homo sapiens
cacccccttctctgctccacca

SEQ ID NO: 2550853 - DNA, 13 bp, Homo sapiens
caccccgctctgc

SEQ ID NO: 2550854 - DNA, 14 bp, Homo sapiens
caccccgctctgca

SEQ ID NO: 2550855 - DNA, 17 bp, Homo sapiens
caccccggccacctgcg

SEQ ID NO: 2550856 - DNA, 17 bp, Homo sapiens
cacccctcactctggcc

SEQ ID NO: 2550857 - DNA, 12 bp, Homo sapiens
cacccctcccat

SEQ ID NO: 2550858 - DNA, 13 bp, Homo sapiens
cacccctcccatt

SEQ ID NO: 2550859 - DNA, 17 bp, Homo sapiens
cacccctcccattagga

SEQ ID NO: 2550860 - DNA, 15 bp, Homo sapiens
cacccctcccctgcc

SEQ ID NO: 2550861 - DNA, 23 bp, Homo sapiens
cacccctccttccttgaccagca

SEQ ID NO: 2550862 - DNA, 18 bp, Homo sapiens
cacccctgcccccacttc

SEQ ID NO: 2550863 - DNA, 16 bp, Homo sapiens
cacccctgccctggga

SEQ ID NO: 2550864 - DNA, 16 bp, Homo sapiens
cacccctgcctccacc

SEQ ID NO: 2550865 - DNA, 18 bp, Homo sapiens
cacccctgcctccaccct

SEQ ID NO: 2550866 - DNA, 23 bp, Homo sapiens
cacccctgcctccaccctctgag

SEQ ID NO: 2550867 - DNA, 12 bp, Homo sapiens
cacccctgtgct

SEQ ID NO: 2550868 - DNA, 23 bp, Homo sapiens
cacccctgtgctccgtgcctcca

SEQ ID NO: 2550869 - DNA, 17 bp, Homo sapiens
caccccttatccaggac

SEQ ID NO: 2550870 - DNA, 20 bp, Homo sapiens
caccccttatccaggactct

SEQ ID NO: 2550871 - DNA, 16 bp, Homo sapiens
caccccttccatgtgg

SEQ ID NO: 2550872 - DNA, 22 bp, Homo sapiens
caccccttcctgtcccacctct

SEQ ID NO: 2550873 - DNA, 19 bp, Homo sapiens
caccccttgctctcaaccc

SEQ ID NO: 2550874 - DNA, 13 bp, Homo sapiens
cacccgaccacac

SEQ ID NO: 2550875 - DNA, 16 bp, Homo sapiens
cacccgaggctgccca

SEQ ID NO: 2550876 - DNA, 18 bp, Homo sapiens
cacccgatgctgctttcc

SEQ ID NO: 2550877 - DNA, 13 bp, Homo sapiens
cacccgcctctcc

SEQ ID NO: 2550878 - DNA, 17 bp, Homo sapiens
cacccggcccctgctgg

SEQ ID NO: 2550879 - DNA, 18 bp, Homo sapiens
cacccgttctgctggcct

SEQ ID NO: 2550880 - DNA, 20 bp, Homo sapiens
cacccgttctgctggcctgg

SEQ ID NO: 2550881 - DNA, 12 bp, Homo sapiens
caccctcacact

SEQ ID NO: 2550882 - DNA, 19 bp, Homo sapiens
caccctcagcaccccttcc

SEQ ID NO: 2550883 - DNA, 22 bp, Homo sapiens
caccctcagcaccccttccatg

SEQ ID NO: 2550884 - DNA, 13 bp, Homo sapiens
caccctccaccct

SEQ ID NO: 2550885 - DNA, 14 bp, Homo sapiens
caccctccacctct

SEQ ID NO: 2550886 - DNA, 17 bp, Homo sapiens
caccctccacctcttca

SEQ ID NO: 2550887 - DNA, 14 bp, Homo sapiens
caccctcctgtctt

SEQ ID NO: 2550888 - DNA, 15 bp, Homo sapiens
caccctctcccagga

SEQ ID NO: 2550889 - DNA, 13 bp, Homo sapiens
caccctctgagct

SEQ ID NO: 2550890 - DNA, 18 bp, Homo sapiens
caccctgaatggttccat

SEQ ID NO: 2550891 - DNA, 23 bp, Homo sapiens
caccctgaatggttccatgcctg

SEQ ID NO: 2550892 - DNA, 12 bp, Homo sapiens
caccctgagccc

SEQ ID NO: 2550893 - DNA, 12 bp, Homo sapiens
caccctgggctc

SEQ ID NO: 2550894 - DNA, 22 bp, Homo sapiens
caccctggggcctggacctgcc

SEQ ID NO: 2550895 - DNA, 20 bp, Homo sapiens
caccctgtccaaactgccta

SEQ ID NO: 2550896 - DNA, 15 bp, Homo sapiens
caccctgtcccccag

SEQ ID NO: 2550897 - DNA, 18 bp, Homo sapiens
caccctgtcccccagctc

SEQ ID NO: 2550898 - DNA, 20 bp, Homo sapiens
caccctgtcccccagctctg

SEQ ID NO: 2550899 - DNA, 22 bp, Homo sapiens
caccctgtcccccagctctggt

SEQ ID NO: 2550900 - DNA, 23 bp, Homo sapiens
caccctgtcccccagctctggtg

SEQ ID NO: 2550901 - DNA, 15 bp, Homo sapiens
caccctgtgatgggg

SEQ ID NO: 2550902 - DNA, 18 bp, Homo sapiens
caccctgtgatggggccc

SEQ ID NO: 2550903 - DNA, 23 bp, Homo sapiens
caccctgtgatggggccctgcct

SEQ ID NO: 2550904 - DNA, 19 bp, Homo sapiens
cacccttctttcctcttcc

SEQ ID NO: 2550905 - DNA, 21 bp, Homo sapiens
cacccttctttcctcttcccc

SEQ ID NO: 2550906 - DNA, 19 bp, Homo sapiens
cacccttggaggctgtctt

SEQ ID NO: 2550907 - DNA, 20 bp, Homo sapiens
cacccttggaggctgtcttc

SEQ ID NO: 2550908 - DNA, 12 bp, Homo sapiens
cacccttggcct

SEQ ID NO: 2550909 - DNA, 18 bp, Homo sapiens
cacccttggcctgtctca

SEQ ID NO: 2550910 - DNA, 23 bp, Homo sapiens
caccgaagtggactggcccctgg

SEQ ID NO: 2550911 - DNA, 17 bp, Homo sapiens
caccgacgcgtctcctg

SEQ ID NO: 2550912 - DNA, 19 bp, Homo sapiens
caccgacgcgtctcctgtt

SEQ ID NO: 2550913 - DNA, 13 bp, Homo sapiens
caccgagaatgtt

SEQ ID NO: 2550914 - DNA, 13 bp, Homo sapiens
caccgctccccag

SEQ ID NO: 2550915 - DNA, 16 bp, Homo sapiens
caccgctccccagccc

SEQ ID NO: 2550916 - DNA, 17 bp, Homo sapiens
caccgctccccagccca

SEQ ID NO: 2550917 - DNA, 20 bp, Homo sapiens
caccgctccccagcccaggg

SEQ ID NO: 2550918 - DNA, 22 bp, Homo sapiens
caccgcttccggctcctgtgct

SEQ ID NO: 2550919 - DNA, 23 bp, Homo sapiens
caccgcttccggctcctgtgctt

SEQ ID NO: 2550920 - DNA, 15 bp, Homo sapiens
caccggatcctgggt

SEQ ID NO: 2550921 - DNA, 15 bp, Homo sapiens
caccggctggcctgg

SEQ ID NO: 2550922 - DNA, 18 bp, Homo sapiens
caccggctggcctggccc

SEQ ID NO: 2550923 - DNA, 22 bp, Homo sapiens
caccgggcactcagaagacact

SEQ ID NO: 2550924 - DNA, 18 bp, Homo sapiens
caccgtccgccctgctcc

SEQ ID NO: 2550925 - DNA, 15 bp, Homo sapiens
caccgtggaccttcc

SEQ ID NO: 2550926 - DNA, 16 bp, Homo sapiens
caccgtggaccttcct

SEQ ID NO: 2550927 - DNA, 15 bp, Homo sapiens
caccgtggctaagag

SEQ ID NO: 2550928 - DNA, 13 bp, Homo sapiens
caccgtgggctcc

SEQ ID NO: 2550929 - DNA, 18 bp, Homo sapiens
caccgtgggctccctgac

SEQ ID NO: 2550930 - DNA, 21 bp, Homo sapiens
caccgttggggattggggaag

SEQ ID NO: 2550931 - DNA, 17 bp, Homo sapiens
cacctacagtgtacagt

SEQ ID NO: 2550932 - DNA, 23 bp, Homo sapiens
cacctacagtgtacagtcttgta

SEQ ID NO: 2550933 - DNA, 18 bp, Homo sapiens
cacctaccatcagggaca

SEQ ID NO: 2550934 - DNA, 16 bp, Homo sapiens
cacctataaaacaggt

SEQ ID NO: 2550935 - DNA, 21 bp, Homo sapiens
cacctatctcgtgggagagcc

SEQ ID NO: 2550936 - DNA, 17 bp, Homo sapiens
cacctatgtgccaactg

SEQ ID NO: 2550937 - DNA, 13 bp, Homo sapiens
cacctcactcctg

SEQ ID NO: 2550938 - DNA, 21 bp, Homo sapiens
cacctcactgaaaacatctgg

SEQ ID NO: 2550939 - DNA, 21 bp, Homo sapiens
cacctcagttcccttggcctc

SEQ ID NO: 2550940 - DNA, 23 bp, Homo sapiens
cacctcagttcccttggcctcag

SEQ ID NO: 2550941 - DNA, 14 bp, Homo sapiens
cacctccacagttc

SEQ ID NO: 2550942 - DNA, 16 bp, Homo sapiens
cacctccacatcctcc

SEQ ID NO: 2550943 - DNA, 13 bp, Homo sapiens
cacctcccatcct

SEQ ID NO: 2550944 - DNA, 20 bp, Homo sapiens
cacctccccctcccccttct

SEQ ID NO: 2550945 - DNA, 16 bp, Homo sapiens
cacctccccctgcccc

SEQ ID NO: 2550946 - DNA, 16 bp, Homo sapiens
cacctccctcccggca

SEQ ID NO: 2550947 - DNA, 13 bp, Homo sapiens
cacctcctgcctc

SEQ ID NO: 2550948 - DNA, 11 bp, Homo sapiens
cacctctccaa

SEQ ID NO: 2550949 - DNA, 17 bp, Homo sapiens
cactatgaagctacctc

SEQ ID NO: 2550950 - DNA, 14 bp, Homo sapiens
cactatgaatctat

SEQ ID NO: 2550951 - DNA, 17 bp, Homo sapiens
cactatggtatttgagt

SEQ ID NO: 2550952 - DNA, 19 bp, Homo sapiens
cactcaaaagctgggcagg

SEQ ID NO: 2550953 - DNA, 20 bp, Homo sapiens
cactcaaaagctgggcaggt

SEQ ID NO: 2550954 - DNA, 16 bp, Homo sapiens
cactcaaattaatctt

SEQ ID NO: 2550955 - DNA, 12 bp, Homo sapiens
cactcaagccaa

SEQ ID NO: 2550956 - DNA, 15 bp, Homo sapiens
cactcaagccaagca

SEQ ID NO: 2550957 - DNA, 18 bp, Homo sapiens
cactcaagccaagcagcc

SEQ ID NO: 2550958 - DNA, 13 bp, Homo sapiens
cactcaagcttgg

SEQ ID NO: 2550959 - DNA, 15 bp, Homo sapiens
cactcacacagccag

SEQ ID NO: 2550960 - DNA, 23 bp, Homo sapiens
cactcacagacctggagcccctg

SEQ ID NO: 2550961 - DNA, 19 bp, Homo sapiens
cactcacatttattctgct

SEQ ID NO: 2550962 - DNA, 14 bp, Homo sapiens
cactcaccgaagcc

SEQ ID NO: 2550963 - DNA, 17 bp, Homo sapiens
cactcaccgaagccact

SEQ ID NO: 2550964 - DNA, 12 bp, Homo sapiens
cactcactcctg

SEQ ID NO: 2550965 - DNA, 16 bp, Homo sapiens
cactcagaagacactg

SEQ ID NO: 2550966 - DNA, 18 bp, Homo sapiens
cactcagaagacactgat

SEQ ID NO: 2550967 - DNA, 22 bp, Homo sapiens
cactcagaagacactgatgggc

SEQ ID NO: 2550968 - DNA, 21 bp, Homo sapiens
cactcaggaggctgaggcagg

SEQ ID NO: 2550969 - DNA, 16 bp, Homo sapiens
cactcatcccctcact

SEQ ID NO: 2550970 - DNA, 15 bp, Homo sapiens
cactcatgctgaaag

SEQ ID NO: 2550971 - DNA, 15 bp, Homo sapiens
cactcattcctgtag

SEQ ID NO: 2550972 - DNA, 15 bp, Homo sapiens
cactcattgacctga

SEQ ID NO: 2550973 - DNA, 19 bp, Homo sapiens
cactcattgacctgaggcc

SEQ ID NO: 2550974 - DNA, 19 bp, Homo sapiens
cactccaagatatggacac

SEQ ID NO: 2550975 - DNA, 17 bp, Homo sapiens
cactccaattaaggatt

SEQ ID NO: 2550976 - DNA, 13 bp, Homo sapiens
cactccagcctga

SEQ ID NO: 2550977 - DNA, 21 bp, Homo sapiens
gtatatatatgccatgatgga

SEQ ID NO: 2550978 - DNA, 13 bp, Homo sapiens
gtatatatgtgtg

SEQ ID NO: 2550979 - DNA, 14 bp, Homo sapiens
gtatatatgtgtgt

SEQ ID NO: 2550980 - DNA, 20 bp, Homo sapiens
gtatatatgtgtgtttaaat

SEQ ID NO: 2550981 - DNA, 17 bp, Homo sapiens
gtatatgtatgtgtgta

SEQ ID NO: 2550982 - DNA, 22 bp, Homo sapiens
gtatatgtcaagccataattgt

SEQ ID NO: 2550983 - DNA, 15 bp, Homo sapiens
gtatatgtctcaggt

SEQ ID NO: 2550984 - DNA, 16 bp, Homo sapiens
gtatatgttgggtgca

SEQ ID NO: 2550985 - DNA, 22 bp, Homo sapiens
gtatattatttctaggaagaat

SEQ ID NO: 2550986 - DNA, 17 bp, Homo sapiens
gtatatttaaaagaaag

SEQ ID NO: 2550987 - DNA, 22 bp, Homo sapiens
gtatatttatagtcacaagagc

SEQ ID NO: 2550988 - DNA, 13 bp, Homo sapiens
gtatatttgtaca

SEQ ID NO: 2550989 - DNA, 15 bp, Homo sapiens
gtatcaaataaaatt

SEQ ID NO: 2550990 - DNA, 19 bp, Homo sapiens
gtatcaaatattagatgtg

SEQ ID NO: 2550991 - DNA, 20 bp, Homo sapiens
gtatcaaatattagatgtga

SEQ ID NO: 2550992 - DNA, 12 bp, Homo sapiens
gtatcagaggcc

SEQ ID NO: 2550993 - DNA, 17 bp, Homo sapiens
gtatcagaggcctataa

SEQ ID NO: 2550994 - DNA, 14 bp, Homo sapiens
gtatcaggacccag

SEQ ID NO: 2550995 - DNA, 18 bp, Homo sapiens
gtatcaggacccagagga

SEQ ID NO: 2550996 - DNA, 22 bp, Homo sapiens
gtatcaggacccagaggaaggg

SEQ ID NO: 2550997 - DNA, 17 bp, Homo sapiens
gtatcaggacgagaatg

SEQ ID NO: 2550998 - DNA, 15 bp, Homo sapiens
gtatcaggtctccca

SEQ ID NO: 2550999 - DNA, 17 bp, Homo sapiens
gtatcagttgcaataat

SEQ ID NO: 2551000 - DNA, 14 bp, Homo sapiens
gtatcatctggata

SEQ ID NO: 2551001 - DNA, 11 bp, Homo sapiens
gtatcatgcat

SEQ ID NO: 2551002 - DNA, 22 bp, Homo sapiens
gtatcattgttgtttgatttct

SEQ ID NO: 2551003 - DNA, 16 bp, Homo sapiens
gtatccattatcatgt

SEQ ID NO: 2551004 - DNA, 22 bp, Homo sapiens
gtatcctcatttggggtagcta

SEQ ID NO: 2551005 - DNA, 15 bp, Homo sapiens
gtatcctccaggttt

SEQ ID NO: 2551006 - DNA, 16 bp, Homo sapiens
gtatcctccaggtttt

SEQ ID NO: 2551007 - DNA, 17 bp, Homo sapiens
gtatcctggggctccct

SEQ ID NO: 2551008 - DNA, 15 bp, Homo sapiens
gtatcggagacagtg

SEQ ID NO: 2551009 - DNA, 17 bp, Homo sapiens
gtatcggagacagtgat

SEQ ID NO: 2551010 - DNA, 15 bp, Homo sapiens
gtatctcctcgcaag

SEQ ID NO: 2551011 - DNA, 17 bp, Homo sapiens
gtatctctgaagcatgt

SEQ ID NO: 2551012 - DNA, 12 bp, Homo sapiens
gtatctgagcag

SEQ ID NO: 2551013 - DNA, 15 bp, Homo sapiens
gtatgaatgcagtgg

SEQ ID NO: 2551014 - DNA, 14 bp, Homo sapiens
gtatgagctgaggg

SEQ ID NO: 2551015 - DNA, 15 bp, Homo sapiens
gtatgaggcatttgt

SEQ ID NO: 2551016 - DNA, 17 bp, Homo sapiens
gtatgaggcatttgttt

SEQ ID NO: 2551017 - DNA, 16 bp, Homo sapiens
gtatgatgtgttgtga

SEQ ID NO: 2551018 - DNA, 15 bp, Homo sapiens
gtatgcatgtgaaga

SEQ ID NO: 2551019 - DNA, 16 bp, Homo sapiens
gtatgcttattttaaa

SEQ ID NO: 2551020 - DNA, 15 bp, Homo sapiens
gtatggtggctgggt

SEQ ID NO: 2551021 - DNA, 16 bp, Homo sapiens
gtatggtggctgggtt

SEQ ID NO: 2551022 - DNA, 15 bp, Homo sapiens
gtatgtaaatgtata

SEQ ID NO: 2551023 - DNA, 16 bp, Homo sapiens
gtatgtgcactgtcac

SEQ ID NO: 2551024 - DNA, 16 bp, Homo sapiens
gtatgtggaagtgtgg

SEQ ID NO: 2551025 - DNA, 11 bp, Homo sapiens
gtatgttgtcc

SEQ ID NO: 2551026 - DNA, 21 bp, Homo sapiens
gtatgttgtccaattgttgac

SEQ ID NO: 2551027 - DNA, 21 bp, Homo sapiens
gtatgtttgcacacttgtgtg

SEQ ID NO: 2551028 - DNA, 18 bp, Homo sapiens
gtattaagaaaatctatt

SEQ ID NO: 2551029 - DNA, 13 bp, Homo sapiens
gtattacttctgc

SEQ ID NO: 2551030 - DNA, 16 bp, Homo sapiens
gtattattctgcagca

SEQ ID NO: 2551031 - DNA, 22 bp, Homo sapiens
gtattcagtgagggtcttctta

SEQ ID NO: 2551032 - DNA, 14 bp, Homo sapiens
gtattcctgcctcc

SEQ ID NO: 2551033 - DNA, 19 bp, Homo sapiens
gtattctctgagctgtgca

SEQ ID NO: 2551034 - DNA, 15 bp, Homo sapiens
gtattcttcaacctc

SEQ ID NO: 2551035 - DNA, 16 bp, Homo sapiens
gtattcttctcttcct

SEQ ID NO: 2551036 - DNA, 14 bp, Homo sapiens
gtattcttgtcaaa

SEQ ID NO: 2551037 - DNA, 21 bp, Homo sapiens
gtattctttgatgttaacaca

SEQ ID NO: 2551038 - DNA, 10 bp, Homo sapiens
gtattgaagc

SEQ ID NO: 2551039 - DNA, 13 bp, Homo sapiens
gtattgaagcatt

SEQ ID NO: 2551040 - DNA, 18 bp, Homo sapiens
gtattgaagcattttata

SEQ ID NO: 2551041 - DNA, 15 bp, Homo sapiens
gtattggcctggagg

SEQ ID NO: 2551042 - DNA, 15 bp, Homo sapiens
gtatttatatattta

SEQ ID NO: 2551043 - DNA, 16 bp, Homo sapiens
gtatttatatatttat

SEQ ID NO: 2551044 - DNA, 23 bp, Homo sapiens
gtatttattccatattcatgtaa

SEQ ID NO: 2551045 - DNA, 13 bp, Homo sapiens
gtatttatttaaa

SEQ ID NO: 2551046 - DNA, 18 bp, Homo sapiens
gtatttatttaaaagatt

SEQ ID NO: 2551047 - DNA, 20 bp, Homo sapiens
gtatttattttcctccccag

SEQ ID NO: 2551048 - DNA, 11 bp, Homo sapiens
gtatttcagac

SEQ ID NO: 2551049 - DNA, 14 bp, Homo sapiens
gtatttgttaatgg

SEQ ID NO: 2551050 - DNA, 23 bp, Homo sapiens
gtatttgtttgcataggtgatct

SEQ ID NO: 2551051 - DNA, 11 bp, Homo sapiens
gtattttcctg

SEQ ID NO: 2551052 - DNA, 17 bp, Homo sapiens
gtattttggagaaatta

SEQ ID NO: 2551053 - DNA, 16 bp, Homo sapiens
gtcaaaactcaaatgc

SEQ ID NO: 2551054 - DNA, 14 bp, Homo sapiens
gtcaaacgtgaaaa

SEQ ID NO: 2551055 - DNA, 16 bp, Homo sapiens
gtcaaagaaatgctga

SEQ ID NO: 2551056 - DNA, 15 bp, Homo sapiens
gtcaaattatgtatt

SEQ ID NO: 2551057 - DNA, 18 bp, Homo sapiens
gtcaacaaactatttctt

SEQ ID NO: 2551058 - DNA, 19 bp, Homo sapiens
gtcaacacttaagggtttt

SEQ ID NO: 2551059 - DNA, 18 bp, Homo sapiens
gtcaagagggtctgagga

SEQ ID NO: 2551060 - DNA, 17 bp, Homo sapiens
gtcaagtctctgctggc

SEQ ID NO: 2551061 - DNA, 21 bp, Homo sapiens
gtcaagtctctgctggcccag

SEQ ID NO: 2551062 - DNA, 15 bp, Homo sapiens
gtcaagtgaaaaagg

SEQ ID NO: 2551063 - DNA, 16 bp, Homo sapiens
gtcaagtgggatctgt

SEQ ID NO: 2551064 - DNA, 16 bp, Homo sapiens
gtcaagttgtgcttgt

SEQ ID NO: 2551065 - DNA, 15 bp, Homo sapiens
gtcaatattaaatac

SEQ ID NO: 2551066 - DNA, 14 bp, Homo sapiens
gtcaatgtgcagtg

SEQ ID NO: 2551067 - DNA, 15 bp, Homo sapiens
gtcaatgttttcagt

SEQ ID NO: 2551068 - DNA, 21 bp, Homo sapiens
gtcaattttgttatgtatatt

SEQ ID NO: 2551069 - DNA, 17 bp, Homo sapiens
gtcacaagagcccagca

SEQ ID NO: 2551070 - DNA, 20 bp, Homo sapiens
gtcacacagtattacttctg

SEQ ID NO: 2551071 - DNA, 23 bp, Homo sapiens
gtcacagcctcctctgtctgccc

SEQ ID NO: 2551072 - DNA, 15 bp, Homo sapiens
gtcacaggaagtaga

SEQ ID NO: 2551073 - DNA, 13 bp, Homo sapiens
gtcacaggcaggt

SEQ ID NO: 2551074 - DNA, 15 bp, Homo sapiens
gtcacagggccaact

SEQ ID NO: 2551075 - DNA, 23 bp, Homo sapiens
gtcaccatcttaagagatgcctc

SEQ ID NO: 2551076 - DNA, 20 bp, Homo sapiens
gtcacccaggctggagtgca

SEQ ID NO: 2551077 - DNA, 15 bp, Homo sapiens
gtcaccccggccacc

SEQ ID NO: 2551078 - DNA, 20 bp, Homo sapiens
gtcacccctccaggaatgat

SEQ ID NO: 2551079 - DNA, 19 bp, Homo sapiens
gtcaccggatcctgggtgg

SEQ ID NO: 2551080 - DNA, 23 bp, Homo sapiens
gtcaccggatcctgggtggtctg

SEQ ID NO: 2551081 - DNA, 18 bp, Homo sapiens
gtcaccgtggaccttcct

SEQ ID NO: 2551082 - DNA, 22 bp, Homo sapiens
gtcacgtggaggagcagtgcag

SEQ ID NO: 2551083 - DNA, 23 bp, Homo sapiens
gtcactcagatggaaccgcagga

SEQ ID NO: 2551084 - DNA, 12 bp, Homo sapiens
gtcactctggca

SEQ ID NO: 2551085 - DNA, 16 bp, Homo sapiens
gtcactctggcagctc

SEQ ID NO: 2551086 - DNA, 20 bp, Homo sapiens
gtcactcttcctgcaaggac

SEQ ID NO: 2551087 - DNA, 14 bp, Homo sapiens
gtcactgagacagc

SEQ ID NO: 2551088 - DNA, 15 bp, Homo sapiens
gtcactgagacagcc

SEQ ID NO: 2551089 - DNA, 23 bp, Homo sapiens
gtcactgagacagcccgggctct

SEQ ID NO: 2551090 - DNA, 22 bp, Homo sapiens
gtcactgcctctccctggccct

SEQ ID NO: 2551091 - DNA, 23 bp, Homo sapiens
gtcactgcctctccctggccctc

SEQ ID NO: 2551092 - DNA, 21 bp, Homo sapiens
gtcactgcttaacttcacata

SEQ ID NO: 2551093 - DNA, 20 bp, Homo sapiens
gtcactggctctccaagtgc

SEQ ID NO: 2551094 - DNA, 21 bp, Homo sapiens
gtcactggctctccaagtgcc

SEQ ID NO: 2551095 - DNA, 20 bp, Homo sapiens
gtcacttacctagatttaca

SEQ ID NO: 2551096 - DNA, 16 bp, Homo sapiens
gtcacttactgtttct

SEQ ID NO: 2551097 - DNA, 23 bp, Homo sapiens
gtcacttgatgtgccattttaaa

SEQ ID NO: 2551098 - DNA, 16 bp, Homo sapiens
gtcactttgctctggg

SEQ ID NO: 2551099 - DNA, 17 bp, Homo sapiens
gtcactttgctctgggt

SEQ ID NO: 2551100 - DNA, 23 bp, Homo sapiens
gtcactttgctctgggtggaagt

SEQ ID NO: 2551101 - DNA, 20 bp, Homo sapiens
gtcagaataataagaggtgc

SEQ ID NO: 2551102 - DNA, 18 bp, Homo sapiens
gtcagacatccatgtttg

SEQ ID NO: 2551103 - DNA, 16 bp, Homo sapiens
gtcagacgcctgagga

SEQ ID NO: 2551104 - DNA, 15 bp, Homo sapiens
gtcagactttaaaga

SEQ ID NO: 2551105 - DNA, 12 bp, Homo sapiens
gtcagagagaat

SEQ ID NO: 2551106 - DNA, 19 bp, Homo sapiens
gtcagagaggagtcagaga

SEQ ID NO: 2551107 - DNA, 21 bp, Homo sapiens
gtcagagaggagtcagagaga

SEQ ID NO: 2551108 - DNA, 15 bp, Homo sapiens
gtcagagcctgcagt

SEQ ID NO: 2551109 - DNA, 16 bp, Homo sapiens
gtcagagcctgcagtt

SEQ ID NO: 2551110 - DNA, 14 bp, Homo sapiens
gtcagagctgggag

SEQ ID NO: 2551111 - DNA, 14 bp, Homo sapiens
gtcagaggatggcc

SEQ ID NO: 2551112 - DNA, 11 bp, Homo sapiens
gtcagccaggg

SEQ ID NO: 2551113 - DNA, 12 bp, Homo sapiens
gtcagccagggc

SEQ ID NO: 2551114 - DNA, 22 bp, Homo sapiens
gtcagccctagggtggagagcc

SEQ ID NO: 2551115 - DNA, 17 bp, Homo sapiens
gtcagccgggccctgag

SEQ ID NO: 2551116 - DNA, 15 bp, Homo sapiens
gtcagcgttgcatgt

SEQ ID NO: 2551117 - DNA, 16 bp, Homo sapiens
gtcagcgttgcatgtc

SEQ ID NO: 2551118 - DNA, 17 bp, Homo sapiens
gtcagctactaatgatg

SEQ ID NO: 2551119 - DNA, 19 bp, Homo sapiens
gtcagctcccctcggagaa

SEQ ID NO: 2551120 - DNA, 23 bp, Homo sapiens
gtcagctcccctcggagaagagc

SEQ ID NO: 2551121 - DNA, 15 bp, Homo sapiens
gtcagctcccttctc

SEQ ID NO: 2551122 - DNA, 16 bp, Homo sapiens
gtcagctttgccttcc

SEQ ID NO: 2551123 - DNA, 16 bp, Homo sapiens
gtcaggaacagaagga

SEQ ID NO: 2551124 - DNA, 17 bp, Homo sapiens
gtcaggaaggatgagca

SEQ ID NO: 2551125 - DNA, 13 bp, Homo sapiens
gtcaggcctgtgt

SEQ ID NO: 2551126 - DNA, 19 bp, Homo sapiens
gtcaggcgtagatcaccag

SEQ ID NO: 2551127 - DNA, 17 bp, Homo sapiens
gtcaggctccattagga

SEQ ID NO: 2551128 - DNA, 13 bp, Homo sapiens
gtcagggaccaag

SEQ ID NO: 2551129 - DNA, 15 bp, Homo sapiens
ggttagggaggggta

SEQ ID NO: 2551130 - DNA, 17 bp, Homo sapiens
ggttatcgaaataacaa

SEQ ID NO: 2551131 - DNA, 23 bp, Homo sapiens
ggttatcgaaataacaatgttaa

SEQ ID NO: 2551132 - DNA, 14 bp, Homo sapiens
ggttatctctgtgt

SEQ ID NO: 2551133 - DNA, 13 bp, Homo sapiens
ggttatggagagg

SEQ ID NO: 2551134 - DNA, 20 bp, Homo sapiens
ggttatttagggaactgctt

SEQ ID NO: 2551135 - DNA, 17 bp, Homo sapiens
ggttattttagtttctg

SEQ ID NO: 2551136 - DNA, 21 bp, Homo sapiens
ggttcaaagatattttgcttt

SEQ ID NO: 2551137 - DNA, 22 bp, Homo sapiens
ggttcaagcgattcttctgctt

SEQ ID NO: 2551138 - DNA, 23 bp, Homo sapiens
ggttcaagcgattcttctgcttc

SEQ ID NO: 2551139 - DNA, 14 bp, Homo sapiens
ggttcaccagcctc

SEQ ID NO: 2551140 - DNA, 22 bp, Homo sapiens
ggttcacgcctgtaatcccagc

SEQ ID NO: 2551141 - DNA, 16 bp, Homo sapiens
ggttcagaaatgctgc

SEQ ID NO: 2551142 - DNA, 19 bp, Homo sapiens
ggttcagaaatgctgcctg

SEQ ID NO: 2551143 - DNA, 22 bp, Homo sapiens
ggttcagaaatgctgcctgcct

SEQ ID NO: 2551144 - DNA, 12 bp, Homo sapiens
ggttcagcttgt

SEQ ID NO: 2551145 - DNA, 18 bp, Homo sapiens
ggttcagggttggcccct

SEQ ID NO: 2551146 - DNA, 21 bp, Homo sapiens
ggttcagggttggcccctgcc

SEQ ID NO: 2551147 - DNA, 14 bp, Homo sapiens
ggttccatgcctga

SEQ ID NO: 2551148 - DNA, 12 bp, Homo sapiens
ggttccccaccg

SEQ ID NO: 2551149 - DNA, 13 bp, Homo sapiens
ggttcccccagcc

SEQ ID NO: 2551150 - DNA, 15 bp, Homo sapiens
ggttcccccagccct

SEQ ID NO: 2551151 - DNA, 23 bp, Homo sapiens
ggttccctttgacgccatcccag

SEQ ID NO: 2551152 - DNA, 23 bp, Homo sapiens
ggttcgtggaaagggtgctgctt

SEQ ID NO: 2551153 - DNA, 13 bp, Homo sapiens
ggttctatttgga

SEQ ID NO: 2551154 - DNA, 23 bp, Homo sapiens
ggttctcacagtgggagccaggg

SEQ ID NO: 2551155 - DNA, 14 bp, Homo sapiens
ggttcttgtattaa

SEQ ID NO: 2551156 - DNA, 18 bp, Homo sapiens
ggttctttcttcctctgc

SEQ ID NO: 2551157 - DNA, 16 bp, Homo sapiens
ggttgaccccagagga

SEQ ID NO: 2551158 - DNA, 23 bp, Homo sapiens
ggttgaggtccagccctggctga

SEQ ID NO: 2551159 - DNA, 17 bp, Homo sapiens
ggttgataactttgctt

SEQ ID NO: 2551160 - DNA, 19 bp, Homo sapiens
ggttgataactttgcttgc

SEQ ID NO: 2551161 - DNA, 14 bp, Homo sapiens
ggttggcagtaagg

SEQ ID NO: 2551162 - DNA, 21 bp, Homo sapiens
ggttggcccctgcccggctgc

SEQ ID NO: 2551163 - DNA, 14 bp, Homo sapiens
ggttgtattctttg

SEQ ID NO: 2551164 - DNA, 22 bp, Homo sapiens
ggttgtattctttgatgttaac

SEQ ID NO: 2551165 - DNA, 21 bp, Homo sapiens
ggttgtgaggcctggccaggc

SEQ ID NO: 2551166 - DNA, 18 bp, Homo sapiens
ggtttaactcagatcact

SEQ ID NO: 2551167 - DNA, 19 bp, Homo sapiens
ggtttacattcatctcatt

SEQ ID NO: 2551168 - DNA, 12 bp, Homo sapiens
ggtttcagaaat

SEQ ID NO: 2551169 - DNA, 13 bp, Homo sapiens
ggtttcagaaatg

SEQ ID NO: 2551170 - DNA, 14 bp, Homo sapiens
ggtttcagaaatgt

SEQ ID NO: 2551171 - DNA, 12 bp, Homo sapiens
ggtttccaaagg

SEQ ID NO: 2551172 - DNA, 13 bp, Homo sapiens
ggtttctgaaaat

SEQ ID NO: 2551173 - DNA, 15 bp, Homo sapiens
ggtttgaatataaac

SEQ ID NO: 2551174 - DNA, 22 bp, Homo sapiens
ggtttgactccgctggaggtgg

SEQ ID NO: 2551175 - DNA, 16 bp, Homo sapiens
ggtttgcctgagggcg

SEQ ID NO: 2551176 - DNA, 23 bp, Homo sapiens
ggtttggccatctctggatgcct

SEQ ID NO: 2551177 - DNA, 13 bp, Homo sapiens
ggtttgtatattg

SEQ ID NO: 2551178 - DNA, 16 bp, Homo sapiens
ggttttaaagtgatta

SEQ ID NO: 2551179 - DNA, 13 bp, Homo sapiens
ggttttgactgga

SEQ ID NO: 2551180 - DNA, 23 bp, Homo sapiens
ggttttgccatgttggccaggct

SEQ ID NO: 2551181 - DNA, 19 bp, Homo sapiens
ggttttgtaagatgctggg

SEQ ID NO: 2551182 - DNA, 11 bp, Homo sapiens
ggttttgtaca

SEQ ID NO: 2551183 - DNA, 18 bp, Homo sapiens
ggttttgtattctctgag

SEQ ID NO: 2551184 - DNA, 19 bp, Homo sapiens
ggttttgtattctctgagc

SEQ ID NO: 2551185 - DNA, 12 bp, Homo sapiens
ggtttttcaatt

SEQ ID NO: 2551186 - DNA, 16 bp, Homo sapiens
ggtttttcaattaaac

SEQ ID NO: 2551187 - DNA, 17 bp, Homo sapiens
ggtttttcaattaaacg

SEQ ID NO: 2551188 - DNA, 18 bp, Homo sapiens
ggtttttcaattaaacgg

SEQ ID NO: 2551189 - DNA, 19 bp, Homo sapiens
ggtttttcaattaaacgga

SEQ ID NO: 2551190 - DNA, 23 bp, Homo sapiens
gtaaaaaaaaatgcctttgagac

SEQ ID NO: 2551191 - DNA, 18 bp, Homo sapiens
gtaaaaacagcattgctt

SEQ ID NO: 2551192 - DNA, 23 bp, Homo sapiens
gtaaaaacagcattgctttctga

SEQ ID NO: 2551193 - DNA, 13 bp, Homo sapiens
gtaaaaataaaat

SEQ ID NO: 2551194 - DNA, 15 bp, Homo sapiens
gtaaaaccacagcag

SEQ ID NO: 2551195 - DNA, 18 bp, Homo sapiens
gtaaaaccacagcagttg

SEQ ID NO: 2551196 - DNA, 15 bp, Homo sapiens
gtaaaagactttttt

SEQ ID NO: 2551197 - DNA, 15 bp, Homo sapiens
gtaaaagtgtgagca

SEQ ID NO: 2551198 - DNA, 15 bp, Homo sapiens
gtaaaatgttgaata

SEQ ID NO: 2551199 - DNA, 23 bp, Homo sapiens
gtaaacataattcttgtatatta

SEQ ID NO: 2551200 - DNA, 23 bp, Homo sapiens
gtaaactcaaaatatttgtacat

SEQ ID NO: 2551201 - DNA, 12 bp, Homo sapiens
gtaaactcctgt

SEQ ID NO: 2551202 - DNA, 16 bp, Homo sapiens
gtaaactttttgtgct

SEQ ID NO: 2551203 - DNA, 19 bp, Homo sapiens
gtaaagaaagagagaaaat

SEQ ID NO: 2551204 - DNA, 22 bp, Homo sapiens
gtaaagaaagagagaaaataaa

SEQ ID NO: 2551205 - DNA, 16 bp, Homo sapiens
gtaaagactgtagaag

SEQ ID NO: 2551206 - DNA, 21 bp, Homo sapiens
gtaaagagacctacctcaggt

SEQ ID NO: 2551207 - DNA, 20 bp, Homo sapiens
gtaaagctaaaatgatttta

SEQ ID NO: 2551208 - DNA, 16 bp, Homo sapiens
gtaaagctagaaatga

SEQ ID NO: 2551209 - DNA, 17 bp, Homo sapiens
gtaaagtgataatttct

SEQ ID NO: 2551210 - DNA, 12 bp, Homo sapiens
gtaaatacacca

SEQ ID NO: 2551211 - DNA, 15 bp, Homo sapiens
gtaaatattctatat

SEQ ID NO: 2551212 - DNA, 15 bp, Homo sapiens
gtaaatcctttttct

SEQ ID NO: 2551213 - DNA, 17 bp, Homo sapiens
gtaaatgcagcgtgaag

SEQ ID NO: 2551214 - DNA, 18 bp, Homo sapiens
gtaaatgggggtgcattt

SEQ ID NO: 2551215 - DNA, 16 bp, Homo sapiens
gtaaatggtgtacata

SEQ ID NO: 2551216 - DNA, 20 bp, Homo sapiens
gtaaatggtgtacataatgt

SEQ ID NO: 2551217 - DNA, 17 bp, Homo sapiens
gtaaatgtttaggtttt

SEQ ID NO: 2551218 - DNA, 15 bp, Homo sapiens
gtaaattaactttta

SEQ ID NO: 2551219 - DNA, 16 bp, Homo sapiens
gtaaattaacttttat

SEQ ID NO: 2551220 - DNA, 19 bp, Homo sapiens
gtaaatttagcatatcaat

SEQ ID NO: 2551221 - DNA, 16 bp, Homo sapiens
gtaaatttatgtgatg

SEQ ID NO: 2551222 - DNA, 19 bp, Homo sapiens
gtaacacaagccacagaag

SEQ ID NO: 2551223 - DNA, 20 bp, Homo sapiens
gtaacacaagccacagaagc

SEQ ID NO: 2551224 - DNA, 22 bp, Homo sapiens
gtaacacagctgagagactttt

SEQ ID NO: 2551225 - DNA, 22 bp, Homo sapiens
gtaacacagtgccttcaataaa

SEQ ID NO: 2551226 - DNA, 15 bp, Homo sapiens
gtaacagaaagggca

SEQ ID NO: 2551227 - DNA, 22 bp, Homo sapiens
gtaacagaaagggcaacaataa

SEQ ID NO: 2551228 - DNA, 20 bp, Homo sapiens
gtaacaggaaaattttaaaa

SEQ ID NO: 2551229 - DNA, 12 bp, Homo sapiens
gtaacaggcaga

SEQ ID NO: 2551230 - DNA, 21 bp, Homo sapiens
gtaacaggtctcctcttaaaa

SEQ ID NO: 2551231 - DNA, 18 bp, Homo sapiens
gtaacagtctgatcgtga

SEQ ID NO: 2551232 - DNA, 12 bp, Homo sapiens
gtaacctcagct

SEQ ID NO: 2551233 - DNA, 17 bp, Homo sapiens
gtaacgttgctgtggga

SEQ ID NO: 2551234 - DNA, 22 bp, Homo sapiens
gtaactgcattgagaactgcat

SEQ ID NO: 2551235 - DNA, 14 bp, Homo sapiens
gtaactgtgtcatg

SEQ ID NO: 2551236 - DNA, 15 bp, Homo sapiens
gtaactttatgtgta

SEQ ID NO: 2551237 - DNA, 19 bp, Homo sapiens
gtaacttttgtaaatacac

SEQ ID NO: 2551238 - DNA, 14 bp, Homo sapiens
gtaacttttgtaag

SEQ ID NO: 2551239 - DNA, 15 bp, Homo sapiens
gtaacttttgtaaga

SEQ ID NO: 2551240 - DNA, 15 bp, Homo sapiens
gtaagaagacatgaa

SEQ ID NO: 2551241 - DNA, 13 bp, Homo sapiens
gtaagaagagact

SEQ ID NO: 2551242 - DNA, 16 bp, Homo sapiens
gtaagacaatccatgt

SEQ ID NO: 2551243 - DNA, 21 bp, Homo sapiens
gtaagagcaccttcctcactt

SEQ ID NO: 2551244 - DNA, 19 bp, Homo sapiens
gtaagatcgttctctgcct

SEQ ID NO: 2551245 - DNA, 20 bp, Homo sapiens
gtaagatgctgggttggtgc

SEQ ID NO: 2551246 - DNA, 17 bp, Homo sapiens
gtaagctctggctttct

SEQ ID NO: 2551247 - DNA, 12 bp, Homo sapiens
gtaagctgttta

SEQ ID NO: 2551248 - DNA, 20 bp, Homo sapiens
gtaaggctgtgtacactgac

SEQ ID NO: 2551249 - DNA, 15 bp, Homo sapiens
gtaagggaaatagaa

SEQ ID NO: 2551250 - DNA, 13 bp, Homo sapiens
gtaagtaattatc

SEQ ID NO: 2551251 - DNA, 18 bp, Homo sapiens
gtaagtaccactcaggcc

SEQ ID NO: 2551252 - DNA, 12 bp, Homo sapiens
gtaagtgccttc

SEQ ID NO: 2551253 - DNA, 21 bp, Homo sapiens
gtaagtggggttgcaaccact

SEQ ID NO: 2551254 - DNA, 20 bp, Homo sapiens
gtaagtgtgagtaagagctg

SEQ ID NO: 2551255 - DNA, 23 bp, Homo sapiens
gtaagttgaatggcctgccttga

SEQ ID NO: 2551256 - DNA, 14 bp, Homo sapiens
gtaataagacataa

SEQ ID NO: 2551257 - DNA, 23 bp, Homo sapiens
gtaataagacataacgtttttcc

SEQ ID NO: 2551258 - DNA, 19 bp, Homo sapiens
gtaataatgctaaagaaaa

SEQ ID NO: 2551259 - DNA, 16 bp, Homo sapiens
gtaataatgtgaatca

SEQ ID NO: 2551260 - DNA, 13 bp, Homo sapiens
gtccgagctttga

SEQ ID NO: 2551261 - DNA, 12 bp, Homo sapiens
gtccgccctgct

SEQ ID NO: 2551262 - DNA, 18 bp, Homo sapiens
gtccgccctgctcctccc

SEQ ID NO: 2551263 - DNA, 21 bp, Homo sapiens
gtccggtccctgtcccagtgc

SEQ ID NO: 2551264 - DNA, 19 bp, Homo sapiens
gtcctaaggacacactaat

SEQ ID NO: 2551265 - DNA, 15 bp, Homo sapiens
gtcctacccaccctc

SEQ ID NO: 2551266 - DNA, 12 bp, Homo sapiens
gtcctactctgt

SEQ ID NO: 2551267 - DNA, 15 bp, Homo sapiens
gtcctactctgtgtc

SEQ ID NO: 2551268 - DNA, 19 bp, Homo sapiens
gtcctagccactcaggagg

SEQ ID NO: 2551269 - DNA, 19 bp, Homo sapiens
gtcctaggagtatcctcat

SEQ ID NO: 2551270 - DNA, 19 bp, Homo sapiens
gtcctcaaggggccatcct

SEQ ID NO: 2551271 - DNA, 14 bp, Homo sapiens
gtcctcactcccag

SEQ ID NO: 2551272 - DNA, 18 bp, Homo sapiens
gtcctcactcccagtcca

SEQ ID NO: 2551273 - DNA, 14 bp, Homo sapiens
gtcctccaagccag

SEQ ID NO: 2551274 - DNA, 14 bp, Homo sapiens
gtcctccacaataa

SEQ ID NO: 2551275 - DNA, 21 bp, Homo sapiens
gtcctccagaagcctctggct

SEQ ID NO: 2551276 - DNA, 17 bp, Homo sapiens
gtcctcccatcccctgg

SEQ ID NO: 2551277 - DNA, 18 bp, Homo sapiens
gtcctccccttgggcggc

SEQ ID NO: 2551278 - DNA, 19 bp, Homo sapiens
gtcctccccttgggcggct

SEQ ID NO: 2551279 - DNA, 16 bp, Homo sapiens
gtcctcccgggccctc

SEQ ID NO: 2551280 - DNA, 21 bp, Homo sapiens
gtcctcctggtgggtccaggg

SEQ ID NO: 2551281 - DNA, 22 bp, Homo sapiens
gtcctcctggtgggtccagggg

SEQ ID NO: 2551282 - DNA, 13 bp, Homo sapiens
gtcctctgaatga

SEQ ID NO: 2551283 - DNA, 17 bp, Homo sapiens
gtcctctgaatgaacct

SEQ ID NO: 2551284 - DNA, 17 bp, Homo sapiens
gtcctcttgcctcctgg

SEQ ID NO: 2551285 - DNA, 15 bp, Homo sapiens
gtcctgaccaccctc

SEQ ID NO: 2551286 - DNA, 15 bp, Homo sapiens
gtcctgacctgtctc

SEQ ID NO: 2551287 - DNA, 13 bp, Homo sapiens
gtcctgactcaac

SEQ ID NO: 2551288 - DNA, 13 bp, Homo sapiens
gtcctgagacctg

SEQ ID NO: 2551289 - DNA, 21 bp, Homo sapiens
gtcctgagggtccccacctgg

SEQ ID NO: 2551290 - DNA, 15 bp, Homo sapiens
gtcctgatggtcagc

SEQ ID NO: 2551291 - DNA, 17 bp, Homo sapiens
gtcctgatggtcagctc

SEQ ID NO: 2551292 - DNA, 14 bp, Homo sapiens
gtcctgcctggcca

SEQ ID NO: 2551293 - DNA, 23 bp, Homo sapiens
gtcctgcctgtctgaagccaatg

SEQ ID NO: 2551294 - DNA, 21 bp, Homo sapiens
gtcctggaagcgcgagggcct

SEQ ID NO: 2551295 - DNA, 20 bp, Homo sapiens
gtcctggacaccgggccagt

SEQ ID NO: 2551296 - DNA, 17 bp, Homo sapiens
gtcctggcctggcttct

SEQ ID NO: 2551297 - DNA, 17 bp, Homo sapiens
gtcctggctcctgaggg

SEQ ID NO: 2551298 - DNA, 19 bp, Homo sapiens
gtcctggctcctgaggggc

SEQ ID NO: 2551299 - DNA, 20 bp, Homo sapiens
gtcctgggagaacctcaggc

SEQ ID NO: 2551300 - DNA, 16 bp, Homo sapiens
gtcctgggagtgagct

SEQ ID NO: 2551301 - DNA, 16 bp, Homo sapiens
gtcctgggcgccctgg

SEQ ID NO: 2551302 - DNA, 23 bp, Homo sapiens
gtcctgggcgccctggaagccgg

SEQ ID NO: 2551303 - DNA, 15 bp, Homo sapiens
gtcctggggctctgt

SEQ ID NO: 2551304 - DNA, 11 bp, Homo sapiens
gtcctggtgtc

SEQ ID NO: 2551305 - DNA, 18 bp, Homo sapiens
gtcctgtccacacccagc

SEQ ID NO: 2551306 - DNA, 22 bp, Homo sapiens
gtcctgtccacacccagctcag

SEQ ID NO: 2551307 - DNA, 17 bp, Homo sapiens
gtcctgtggcaggcagc

SEQ ID NO: 2551308 - DNA, 14 bp, Homo sapiens
gtccttccaggccc

SEQ ID NO: 2551309 - DNA, 14 bp, Homo sapiens
gtccttgaaaatat

SEQ ID NO: 2551310 - DNA, 12 bp, Homo sapiens
gtccttgcacac

SEQ ID NO: 2551311 - DNA, 18 bp, Homo sapiens
gtctgacaggcaatgctg

SEQ ID NO: 2551312 - DNA, 14 bp, Homo sapiens
gtctgacccactgc

SEQ ID NO: 2551313 - DNA, 23 bp, Homo sapiens
gtctgagactctcttaggagcag

SEQ ID NO: 2551314 - DNA, 14 bp, Homo sapiens
gtctgatattcaaa

SEQ ID NO: 2551315 - DNA, 13 bp, Homo sapiens
gtctgatctgtgc

SEQ ID NO: 2551316 - DNA, 17 bp, Homo sapiens
gtctgatctgtgctttc

SEQ ID NO: 2551317 - DNA, 19 bp, Homo sapiens
gtctgattcccaagctctg

SEQ ID NO: 2551318 - DNA, 20 bp, Homo sapiens
gtctgattcccaagctctgc

SEQ ID NO: 2551319 - DNA, 20 bp, Homo sapiens
gtctgcaactttaagcagct

SEQ ID NO: 2551320 - DNA, 14 bp, Homo sapiens
gtctgcaagtcaga

SEQ ID NO: 2551321 - DNA, 15 bp, Homo sapiens
gtctgcaagtcagag

SEQ ID NO: 2551322 - DNA, 17 bp, Homo sapiens
gtctgcacccaggggtg

SEQ ID NO: 2551323 - DNA, 18 bp, Homo sapiens
gtctgccaatttttgcct

SEQ ID NO: 2551324 - DNA, 17 bp, Homo sapiens
gtctgcccttcacccca

SEQ ID NO: 2551325 - DNA, 15 bp, Homo sapiens
gtctggaatgcagtg

SEQ ID NO: 2551326 - DNA, 16 bp, Homo sapiens
gtctggaatgcagtgg

SEQ ID NO: 2551327 - DNA, 21 bp, Homo sapiens
gtctggagaagctcccaggaa

SEQ ID NO: 2551328 - DNA, 24 bp, Homo sapiens
gtctgggacttccttgctctccct

SEQ ID NO: 2551329 - DNA, 21 bp, Homo sapiens
gtctgggagaaattgacagat

SEQ ID NO: 2551330 - DNA, 13 bp, Homo sapiens
gtctggtttctag

SEQ ID NO: 2551331 - DNA, 14 bp, Homo sapiens
gtctgtacacgtgt

SEQ ID NO: 2551332 - DNA, 19 bp, Homo sapiens
gtctgtacacgtgtcctgt

SEQ ID NO: 2551333 - DNA, 21 bp, Homo sapiens
gtctgtacacgtgtcctgtag

SEQ ID NO: 2551334 - DNA, 20 bp, Homo sapiens
gtctgtatcggagacagtga

SEQ ID NO: 2551335 - DNA, 21 bp, Homo sapiens
gtctgtcccggggtcctgtgg

SEQ ID NO: 2551336 - DNA, 22 bp, Homo sapiens
gtctgtctctccatctgtttgg

SEQ ID NO: 2551337 - DNA, 14 bp, Homo sapiens
gtctgtctctgtca

SEQ ID NO: 2551338 - DNA, 21 bp, Homo sapiens
gtctgtgaattggaccatcct

SEQ ID NO: 2551339 - DNA, 18 bp, Homo sapiens
gtctgtgccattttgtat

SEQ ID NO: 2551340 - DNA, 20 bp, Homo sapiens
gtctgtgtgatgaactttct

SEQ ID NO: 2551341 - DNA, 22 bp, Homo sapiens
gtctgtgttgcgtgtcgtgggt

SEQ ID NO: 2551342 - DNA, 15 bp, Homo sapiens
gtctgttaccatgtc

SEQ ID NO: 2551343 - DNA, 17 bp, Homo sapiens
gtctgttcacttttcct

SEQ ID NO: 2551344 - DNA, 13 bp, Homo sapiens
gtctgttcttgaa

SEQ ID NO: 2551345 - DNA, 15 bp, Homo sapiens
gtctgttcttgaagc

SEQ ID NO: 2551346 - DNA, 14 bp, Homo sapiens
gtctgttctttcca

SEQ ID NO: 2551347 - DNA, 17 bp, Homo sapiens
gtctgttctttccaaag

SEQ ID NO: 2551348 - DNA, 21 bp, Homo sapiens
gtcttaaaaagtggaaaaata

SEQ ID NO: 2551349 - DNA, 15 bp, Homo sapiens
gtcttaaaataactt

SEQ ID NO: 2551350 - DNA, 22 bp, Homo sapiens
gtcttaaaataacttatatcat

SEQ ID NO: 2551351 - DNA, 13 bp, Homo sapiens
gtcttaattatta

SEQ ID NO: 2551352 - DNA, 21 bp, Homo sapiens
gtcttaattattatttgtgtt

SEQ ID NO: 2551353 - DNA, 18 bp, Homo sapiens
gtcttagacttgaaatac

SEQ ID NO: 2551354 - DNA, 15 bp, Homo sapiens
gtcttagttgtacaa

SEQ ID NO: 2551355 - DNA, 19 bp, Homo sapiens
gtcttcaacagctccccat

SEQ ID NO: 2551356 - DNA, 13 bp, Homo sapiens
gtcttcacaacag

SEQ ID NO: 2551357 - DNA, 13 bp, Homo sapiens
gtcttccataatg

SEQ ID NO: 2551358 - DNA, 15 bp, Homo sapiens
gtcttccataatgta

SEQ ID NO: 2551359 - DNA, 17 bp, Homo sapiens
gtcttccataatgtata

SEQ ID NO: 2551360 - DNA, 13 bp, Homo sapiens
gtcttcccagggt

SEQ ID NO: 2551361 - DNA, 19 bp, Homo sapiens
gtcttcctgacactttaat

SEQ ID NO: 2551362 - DNA, 17 bp, Homo sapiens
gtcttcctgcattcacc

SEQ ID NO: 2551363 - DNA, 17 bp, Homo sapiens
gtcttcggaaaccttgg

SEQ ID NO: 2551364 - DNA, 13 bp, Homo sapiens
gtcttcgtacagt

SEQ ID NO: 2551365 - DNA, 14 bp, Homo sapiens
gtcttcgtacagtt

SEQ ID NO: 2551366 - DNA, 18 bp, Homo sapiens
gtcttcgtacagttcttc

SEQ ID NO: 2551367 - DNA, 13 bp, Homo sapiens
gtcttctaatttc

SEQ ID NO: 2551368 - DNA, 20 bp, Homo sapiens
gtcttctcatagcattaact

SEQ ID NO: 2551369 - DNA, 13 bp, Homo sapiens
gtcttctgcctgt

SEQ ID NO: 2551370 - DNA, 14 bp, Homo sapiens
gtcttctgcctgtt

SEQ ID NO: 2551371 - DNA, 14 bp, Homo sapiens
gtcttcttcagggt

SEQ ID NO: 2551372 - DNA, 17 bp, Homo sapiens
gtcttctttgcccacaa

SEQ ID NO: 2551373 - DNA, 12 bp, Homo sapiens
gtcttgaaagat

SEQ ID NO: 2551374 - DNA, 15 bp, Homo sapiens
gtcttgaatgtcttt

SEQ ID NO: 2551375 - DNA, 18 bp, Homo sapiens
gtcttgcaatggcagcct

SEQ ID NO: 2551376 - DNA, 21 bp, Homo sapiens
gtcttgcaatggcagccttgg

SEQ ID NO: 2551377 - DNA, 13 bp, Homo sapiens
gtctttctggaga

SEQ ID NO: 2551378 - DNA, 15 bp, Homo sapiens
gtctttggaccctga

SEQ ID NO: 2551379 - DNA, 12 bp, Homo sapiens
gtctttgtaaga

SEQ ID NO: 2551380 - DNA, 13 bp, Homo sapiens
gtctttgtaagag

SEQ ID NO: 2551381 - DNA, 24 bp, Homo sapiens
gtcttttaggacccttcccttgag

SEQ ID NO: 2551382 - DNA, 24 bp, Homo sapiens
gtcttttcttgcatgaggctagtg

SEQ ID NO: 2551383 - DNA, 14 bp, Homo sapiens
gtcttttgacatgt

SEQ ID NO: 2551384 - DNA, 20 bp, Homo sapiens
gtctttttaagcttatttaa

SEQ ID NO: 2551385 - DNA, 16 bp, Homo sapiens
gtctttttatgcattt

SEQ ID NO: 2551386 - DNA, 16 bp, Homo sapiens
gtctttttctggactg

SEQ ID NO: 2551387 - DNA, 16 bp, Homo sapiens
gtcttttttttaatgt

SEQ ID NO: 2551388 - DNA, 19 bp, Homo sapiens
gtcttttttttaatgtgct

SEQ ID NO: 2551389 - DNA, 18 bp, Homo sapiens
gtgaaaaaaaaaatgctg

SEQ ID NO: 2551390 - DNA, 19 bp, Homo sapiens
gtgaaaacaagtgctggca

SEQ ID NO: 2551391 - DNA, 20 bp, Homo sapiens
gtgaaaagagaggatatgtt

SEQ ID NO: 2551392 - DNA, 18 bp, Homo sapiens
gtgaaacacaccaggctg

SEQ ID NO: 2551393 - DNA, 21 bp, Homo sapiens
gtgaaacacaccaggctgtgg

SEQ ID NO: 2551394 - DNA, 22 bp, Homo sapiens
gtgaaacctttagggcagcttg

SEQ ID NO: 2551395 - DNA, 13 bp, Homo sapiens
gtgaaaccttttt

SEQ ID NO: 2551396 - DNA, 14 bp, Homo sapiens
gtgaaacctttttt

SEQ ID NO: 2551397 - DNA, 19 bp, Homo sapiens
gtgaaaccttttttaagat

SEQ ID NO: 2551398 - DNA, 22 bp, Homo sapiens
gtgaaaccttttttaagatttt

SEQ ID NO: 2551399 - DNA, 12 bp, Homo sapiens
gtgaaactggat

SEQ ID NO: 2551400 - DNA, 17 bp, Homo sapiens
gtgaaatagttcaaagc

SEQ ID NO: 2551401 - DNA, 21 bp, Homo sapiens
gtgaaatagttcaaagccaag

SEQ ID NO: 2551402 - DNA, 21 bp, Homo sapiens
gtgaaatttattagttaatat

SEQ ID NO: 2551403 - DNA, 13 bp, Homo sapiens
gtgaacacatcag

SEQ ID NO: 2551404 - DNA, 15 bp, Homo sapiens
gtgaacacatcagct

SEQ ID NO: 2551405 - DNA, 23 bp, Homo sapiens
gtgaaccaaagagactggagcat

SEQ ID NO: 2551406 - DNA, 19 bp, Homo sapiens
gtgaaccaccacacccagc

SEQ ID NO: 2551407 - DNA, 21 bp, Homo sapiens
gtgaaccaccacacccagccc

SEQ ID NO: 2551408 - DNA, 22 bp, Homo sapiens
gtgaaccaccacacccagccca

SEQ ID NO: 2551409 - DNA, 16 bp, Homo sapiens
gtgaacctaccttcat

SEQ ID NO: 2551410 - DNA, 15 bp, Homo sapiens
gtgaactcagccaag

SEQ ID NO: 2551411 - DNA, 17 bp, Homo sapiens
gtgaactcagccaagca

SEQ ID NO: 2551412 - DNA, 18 bp, Homo sapiens
gtgaactcagccaagcac

SEQ ID NO: 2551413 - DNA, 13 bp, Homo sapiens
gtgaactgacagg

SEQ ID NO: 2551414 - DNA, 23 bp, Homo sapiens
gtgaagaaaagtgaatgctcaag

SEQ ID NO: 2551415 - DNA, 13 bp, Homo sapiens
gtgaagaggggca

SEQ ID NO: 2551416 - DNA, 14 bp, Homo sapiens
gtgaagaggggcag

SEQ ID NO: 2551417 - DNA, 16 bp, Homo sapiens
gtgaagaggggcagcc

SEQ ID NO: 2551418 - DNA, 19 bp, Homo sapiens
gtgaagaggggcagccctt

SEQ ID NO: 2551419 - DNA, 17 bp, Homo sapiens
gtgaagcaccaagctca

SEQ ID NO: 2551420 - DNA, 18 bp, Homo sapiens
gtgaagcaccaagctcaa

SEQ ID NO: 2551421 - DNA, 17 bp, Homo sapiens
gtgaaggcttctctctg

SEQ ID NO: 2551422 - DNA, 17 bp, Homo sapiens
gtgaagtatactgtatt

SEQ ID NO: 2551423 - DNA, 19 bp, Homo sapiens
gtgaagtatactgtatttt

SEQ ID NO: 2551424 - DNA, 14 bp, Homo sapiens
gtgaagtgaagaca

SEQ ID NO: 2551425 - DNA, 14 bp, Homo sapiens
gtgaagttagaatt

SEQ ID NO: 2551426 - DNA, 18 bp, Homo sapiens
gtgaagttagaattcctt

SEQ ID NO: 2551427 - DNA, 19 bp, Homo sapiens
gtgaagtttaattgactta

SEQ ID NO: 2551428 - DNA, 23 bp, Homo sapiens
gtgaataatacagtatctcaggg

SEQ ID NO: 2551429 - DNA, 16 bp, Homo sapiens
gtgaatattgttcata

SEQ ID NO: 2551430 - DNA, 22 bp, Homo sapiens
gtgaatatttccatatggattt

SEQ ID NO: 2551431 - DNA, 20 bp, Homo sapiens
gtgaatggattggattattt

SEQ ID NO: 2551432 - DNA, 20 bp, Homo sapiens
gtgaattgcctgcagagaga

SEQ ID NO: 2551433 - DNA, 19 bp, Homo sapiens
gtgaatttcttcactgttg

SEQ ID NO: 2551434 - DNA, 17 bp, Homo sapiens
gtgaatttttttttcct

SEQ ID NO: 2551435 - DNA, 13 bp, Homo sapiens
gtgacaaggcccc

SEQ ID NO: 2551436 - DNA, 18 bp, Homo sapiens
gtgacaaggccccagaga

SEQ ID NO: 2551437 - DNA, 16 bp, Homo sapiens
gtgacaattttgtaca

SEQ ID NO: 2551438 - DNA, 23 bp, Homo sapiens
gtgacagaccacatctttatctg

SEQ ID NO: 2551439 - DNA, 19 bp, Homo sapiens
gtgacagactcctgaggac

SEQ ID NO: 2551440 - DNA, 22 bp, Homo sapiens
gtgacagactcctgaggacagc

SEQ ID NO: 2551441 - DNA, 16 bp, Homo sapiens
gtgacagaggcagccc

SEQ ID NO: 2551442 - DNA, 22 bp, Homo sapiens
gtgacagagtgagactctgtct

SEQ ID NO: 2551443 - DNA, 19 bp, Homo sapiens
gtgacagtattttggttct

SEQ ID NO: 2551444 - DNA, 18 bp, Homo sapiens
gtgacagtggattgcatt

SEQ ID NO: 2551445 - DNA, 14 bp, Homo sapiens
gtgacatgtctttt

SEQ ID NO: 2551446 - DNA, 19 bp, Homo sapiens
gtgacatgtcttttcttgc

SEQ ID NO: 2551447 - DNA, 14 bp, Homo sapiens
gtgacatgtgaaac

SEQ ID NO: 2551448 - DNA, 17 bp, Homo sapiens
gtgacatgtgaaacctt

SEQ ID NO: 2551449 - DNA, 19 bp, Homo sapiens
gtgacatgtgaaacctttt

SEQ ID NO: 2551450 - DNA, 20 bp, Homo sapiens
gtgacatgtgaaaccttttt

SEQ ID NO: 2551451 - DNA, 22 bp, Homo sapiens
gtgccactcaccgaagccactt

SEQ ID NO: 2551452 - DNA, 17 bp, Homo sapiens
gtgccactgcccgagct

SEQ ID NO: 2551453 - DNA, 22 bp, Homo sapiens
gtgccactgcccgagctggtgc

SEQ ID NO: 2551454 - DNA, 19 bp, Homo sapiens
gtgccagaggtgggcaggt

SEQ ID NO: 2551455 - DNA, 21 bp, Homo sapiens
gtgccagaggtgggcaggtgg

SEQ ID NO: 2551456 - DNA, 22 bp, Homo sapiens
gtgccagaggtgggcaggtggt

SEQ ID NO: 2551457 - DNA, 18 bp, Homo sapiens
gtgccagcaactgaataa

SEQ ID NO: 2551458 - DNA, 17 bp, Homo sapiens
gtgccaggactccccag

SEQ ID NO: 2551459 - DNA, 20 bp, Homo sapiens
gtgccaggtttttggtctga

SEQ ID NO: 2551460 - DNA, 22 bp, Homo sapiens
gtgccaggtttttggtctgacc

SEQ ID NO: 2551461 - DNA, 14 bp, Homo sapiens
gtgccatgtgccag

SEQ ID NO: 2551462 - DNA, 23 bp, Homo sapiens
gtgcccaagttgtggtgctgaca

SEQ ID NO: 2551463 - DNA, 15 bp, Homo sapiens
gtgcccacatcccag

SEQ ID NO: 2551464 - DNA, 20 bp, Homo sapiens
gtgcccacatcccaggcttc

SEQ ID NO: 2551465 - DNA, 16 bp, Homo sapiens
gtgcccagaataagtt

SEQ ID NO: 2551466 - DNA, 14 bp, Homo sapiens
gtgccccctcctct

SEQ ID NO: 2551467 - DNA, 17 bp, Homo sapiens
gtgccccctcctctccc

SEQ ID NO: 2551468 - DNA, 18 bp, Homo sapiens
gtgccccctcctctccca

SEQ ID NO: 2551469 - DNA, 20 bp, Homo sapiens
gtgccctccacagccgcagc

SEQ ID NO: 2551470 - DNA, 15 bp, Homo sapiens
gtgccctcgctgctt

SEQ ID NO: 2551471 - DNA, 15 bp, Homo sapiens
gtgccctggtggaga

SEQ ID NO: 2551472 - DNA, 23 bp, Homo sapiens
gtgccctggtggagaaagcactg

SEQ ID NO: 2551473 - DNA, 23 bp, Homo sapiens
gtgcctccaccaccactggccac

SEQ ID NO: 2551474 - DNA, 13 bp, Homo sapiens
gtgcctccaggtg

SEQ ID NO: 2551475 - DNA, 13 bp, Homo sapiens
gtgcctccttcca

SEQ ID NO: 2551476 - DNA, 21 bp, Homo sapiens
gtgcctccttccacctccctc

SEQ ID NO: 2551477 - DNA, 14 bp, Homo sapiens
gtgcctctgggact

SEQ ID NO: 2551478 - DNA, 11 bp, Homo sapiens
gtgcctgcagc

SEQ ID NO: 2551479 - DNA, 14 bp, Homo sapiens
gtgcctggctcaga

SEQ ID NO: 2551480 - DNA, 18 bp, Homo sapiens
gtgcctggctcagagcca

SEQ ID NO: 2551481 - DNA, 19 bp, Homo sapiens
gtgcctgtatgcaacaggc

SEQ ID NO: 2551482 - DNA, 21 bp, Homo sapiens
gtgcctgtatgcaacaggcac

SEQ ID NO: 2551483 - DNA, 15 bp, Homo sapiens
gtgcctgtcccaccc

SEQ ID NO: 2551484 - DNA, 17 bp, Homo sapiens
gtgccttccataattat

SEQ ID NO: 2551485 - DNA, 22 bp, Homo sapiens
gtgccttccataattatgacag

SEQ ID NO: 2551486 - DNA, 22 bp, Homo sapiens
gtgccttccatgtcggcctcta

SEQ ID NO: 2551487 - DNA, 23 bp, Homo sapiens
gtgccttggagggtcccaagctg

SEQ ID NO: 2551488 - DNA, 19 bp, Homo sapiens
gtgccttggggaatttcct

SEQ ID NO: 2551489 - DNA, 17 bp, Homo sapiens
gtgccttttgcacccct

SEQ ID NO: 2551490 - DNA, 19 bp, Homo sapiens
gtgccttttgcacccctcc

SEQ ID NO: 2551491 - DNA, 14 bp, Homo sapiens
gtgcgagtgtgtgc

SEQ ID NO: 2551492 - DNA, 19 bp, Homo sapiens
gtgcggcagggacacccga

SEQ ID NO: 2551493 - DNA, 14 bp, Homo sapiens
gtgcgtgaaacaca

SEQ ID NO: 2551494 - DNA, 12 bp, Homo sapiens
gtgcgtgggtga

SEQ ID NO: 2551495 - DNA, 17 bp, Homo sapiens
gtgcgtgtgtagagtta

SEQ ID NO: 2551496 - DNA, 13 bp, Homo sapiens
gtgcgtgtgtcca

SEQ ID NO: 2551497 - DNA, 18 bp, Homo sapiens
gtgctaaaaatgggactt

SEQ ID NO: 2551498 - DNA, 22 bp, Homo sapiens
gtgctaaaaatgggacttcttt

SEQ ID NO: 2551499 - DNA, 20 bp, Homo sapiens
gtgctacaaaaacacagcaa

SEQ ID NO: 2551500 - DNA, 21 bp, Homo sapiens
gtgctacacccttttccagct

SEQ ID NO: 2551501 - DNA, 20 bp, Homo sapiens
gtgctacgtacatgtgaggc

SEQ ID NO: 2551502 - DNA, 16 bp, Homo sapiens
gtgctactgattgttt

SEQ ID NO: 2551503 - DNA, 17 bp, Homo sapiens
gtgctaggaacactcct

SEQ ID NO: 2551504 - DNA, 16 bp, Homo sapiens
gtgctataggctggag

SEQ ID NO: 2551505 - DNA, 19 bp, Homo sapiens
gtgctatctcccccagccc

SEQ ID NO: 2551506 - DNA, 21 bp, Homo sapiens
gtgctatctcccccagcccca

SEQ ID NO: 2551507 - DNA, 12 bp, Homo sapiens
gtgctatgttct

SEQ ID NO: 2551508 - DNA, 23 bp, Homo sapiens
gtgctattgtagagccagaggtc

SEQ ID NO: 2551509 - DNA, 21 bp, Homo sapiens
gtgctattttgtttgttttgt

SEQ ID NO: 2551510 - DNA, 13 bp, Homo sapiens
gtgctcagttgta

SEQ ID NO: 2551511 - DNA, 16 bp, Homo sapiens
gtgctccagcctggct

SEQ ID NO: 2551512 - DNA, 15 bp, Homo sapiens
gtgctccctaccacc

SEQ ID NO: 2551513 - DNA, 14 bp, Homo sapiens
gtgctcctccttgg

SEQ ID NO: 2551514 - DNA, 18 bp, Homo sapiens
gtgctctggacaggcatg

SEQ ID NO: 2551515 - DNA, 19 bp, Homo sapiens
gtgctgaatggttttcaaa

SEQ ID NO: 2551516 - DNA, 18 bp, Homo sapiens
gtgctgagtctgaaggct

SEQ ID NO: 2551517 - DNA, 18 bp, Homo sapiens
gtgctgccatccaggttc

SEQ ID NO: 2551518 - DNA, 18 bp, Homo sapiens
gtgctgcccgtcttcagc

SEQ ID NO: 2551519 - DNA, 21 bp, Homo sapiens
gtgctgcccgtcttcagccta

SEQ ID NO: 2551520 - DNA, 11 bp, Homo sapiens
gtgctgccctg

SEQ ID NO: 2551521 - DNA, 12 bp, Homo sapiens
gtgctgccctgc

SEQ ID NO: 2551522 - DNA, 15 bp, Homo sapiens
gtgctgccctgccca

SEQ ID NO: 2551523 - DNA, 18 bp, Homo sapiens
gtgctgccctgcccacct

SEQ ID NO: 2551524 - DNA, 19 bp, Homo sapiens
gtgctgccctgcccacctg

SEQ ID NO: 2551525 - DNA, 12 bp, Homo sapiens
gtgctgcctcta

SEQ ID NO: 2551526 - DNA, 16 bp, Homo sapiens
gtgctgcttccctctg

SEQ ID NO: 2551527 - DNA, 15 bp, Homo sapiens
gtgctggagccacta

SEQ ID NO: 2551528 - DNA, 18 bp, Homo sapiens
gtgctggagccactaact

SEQ ID NO: 2551529 - DNA, 17 bp, Homo sapiens
gtgctgggactgagcca

SEQ ID NO: 2551530 - DNA, 18 bp, Homo sapiens
gtgctgggactgagccag

SEQ ID NO: 2551531 - DNA, 21 bp, Homo sapiens
gtgctgggattacaagcgtga

SEQ ID NO: 2551532 - DNA, 20 bp, Homo sapiens
gtgctgggattacaggtgtg

SEQ ID NO: 2551533 - DNA, 14 bp, Homo sapiens
gtggcagctcacct

SEQ ID NO: 2551534 - DNA, 23 bp, Homo sapiens
gtggcagctgcggtccacccagg

SEQ ID NO: 2551535 - DNA, 18 bp, Homo sapiens
gtggcagggcctagctgc

SEQ ID NO: 2551536 - DNA, 22 bp, Homo sapiens
gtggcagggcctagctgctaca

SEQ ID NO: 2551537 - DNA, 17 bp, Homo sapiens
gtggcagggctcaggat

SEQ ID NO: 2551538 - DNA, 21 bp, Homo sapiens
gtggcaggtgaccttctggga

SEQ ID NO: 2551539 - DNA, 16 bp, Homo sapiens
gtggcagtgggagctg

SEQ ID NO: 2551540 - DNA, 17 bp, Homo sapiens
gtggcagtgggagctgc

SEQ ID NO: 2551541 - DNA, 14 bp, Homo sapiens
gtggcatcacctta

SEQ ID NO: 2551542 - DNA, 20 bp, Homo sapiens
gtggcatcaccttaggcagg

SEQ ID NO: 2551543 - DNA, 21 bp, Homo sapiens
gtggcatctttgccttgggct

SEQ ID NO: 2551544 - DNA, 15 bp, Homo sapiens
gtggcatgtggcctg

SEQ ID NO: 2551545 - DNA, 18 bp, Homo sapiens
gtggcatgtggcctgtgg

SEQ ID NO: 2551546 - DNA, 19 bp, Homo sapiens
gtggcatgtggcctgtggc

SEQ ID NO: 2551547 - DNA, 19 bp, Homo sapiens
gtggccaaattatttgtgt

SEQ ID NO: 2551548 - DNA, 13 bp, Homo sapiens
gtggccagggtga

SEQ ID NO: 2551549 - DNA, 21 bp, Homo sapiens
gtggcctctccttgtggcctg

SEQ ID NO: 2551550 - DNA, 13 bp, Homo sapiens
gtggcctggccag

SEQ ID NO: 2551551 - DNA, 16 bp, Homo sapiens
gtggcctggccaggag

SEQ ID NO: 2551552 - DNA, 12 bp, Homo sapiens
gtggcctgggca

SEQ ID NO: 2551553 - DNA, 12 bp, Homo sapiens
gtggcctgggcc

SEQ ID NO: 2551554 - DNA, 15 bp, Homo sapiens
gtggcctgggcctcc

SEQ ID NO: 2551555 - DNA, 17 bp, Homo sapiens
gtggcctgtgtcccatg

SEQ ID NO: 2551556 - DNA, 19 bp, Homo sapiens
gtggccttccccagcctct

SEQ ID NO: 2551557 - DNA, 22 bp, Homo sapiens
gtggcgcagcatattcaggaag

SEQ ID NO: 2551558 - DNA, 23 bp, Homo sapiens
gtggcgcagcatattcaggaagc

SEQ ID NO: 2551559 - DNA, 12 bp, Homo sapiens
gtggctaggcag

SEQ ID NO: 2551560 - DNA, 22 bp, Homo sapiens
gtggctcccctctatttagcat

SEQ ID NO: 2551561 - DNA, 23 bp, Homo sapiens
gtggctcccctctatttagcatg

SEQ ID NO: 2551562 - DNA, 20 bp, Homo sapiens
gtggctcctatctgtgtttt

SEQ ID NO: 2551563 - DNA, 23 bp, Homo sapiens
gtggctgcagcagcggtggcctc

SEQ ID NO: 2551564 - DNA, 19 bp, Homo sapiens
gtggctgctagcacttgga

SEQ ID NO: 2551565 - DNA, 12 bp, Homo sapiens
gtggctgctgcc

SEQ ID NO: 2551566 - DNA, 16 bp, Homo sapiens
gtggctgctgcccagg

SEQ ID NO: 2551567 - DNA, 22 bp, Homo sapiens
gtggctgggggcaggagggccc

SEQ ID NO: 2551568 - DNA, 14 bp, Homo sapiens
gtggctgtcagcag

SEQ ID NO: 2551569 - DNA, 14 bp, Homo sapiens
gtggcttcttaatc

SEQ ID NO: 2551570 - DNA, 18 bp, Homo sapiens
gtgggaacgagaggggaa

SEQ ID NO: 2551571 - DNA, 13 bp, Homo sapiens
gtgggaaggccag

SEQ ID NO: 2551572 - DNA, 22 bp, Homo sapiens
gtgggacaccctgtgatggggc

SEQ ID NO: 2551573 - DNA, 15 bp, Homo sapiens
gtgggagagcccagc

SEQ ID NO: 2551574 - DNA, 16 bp, Homo sapiens
gtgggagcgtgggagg

SEQ ID NO: 2551575 - DNA, 18 bp, Homo sapiens
gtgggagctgcctgttca

SEQ ID NO: 2551576 - DNA, 23 bp, Homo sapiens
gtgggaggatctcttgagcctgg

SEQ ID NO: 2551577 - DNA, 13 bp, Homo sapiens
gtgggaggggcag

SEQ ID NO: 2551578 - DNA, 14 bp, Homo sapiens
gtgggagtgtgtaa

SEQ ID NO: 2551579 - DNA, 15 bp, Homo sapiens
gtgggatcctccagg

SEQ ID NO: 2551580 - DNA, 19 bp, Homo sapiens
gtgggatctgcccctccct

SEQ ID NO: 2551581 - DNA, 20 bp, Homo sapiens
gtgggcacccaccctgggac

SEQ ID NO: 2551582 - DNA, 18 bp, Homo sapiens
gtgggcaggtggtggcac

SEQ ID NO: 2551583 - DNA, 12 bp, Homo sapiens
gtgggccagccc

SEQ ID NO: 2551584 - DNA, 19 bp, Homo sapiens
gtgggcccaggaccagctg

SEQ ID NO: 2551585 - DNA, 23 bp, Homo sapiens
gtgggcccaggaccagctggggc

SEQ ID NO: 2551586 - DNA, 15 bp, Homo sapiens
gtgggcctcctctgt

SEQ ID NO: 2551587 - DNA, 14 bp, Homo sapiens
gtgggctaattaaa

SEQ ID NO: 2551588 - DNA, 15 bp, Homo sapiens
gtgggctagttgggc

SEQ ID NO: 2551589 - DNA, 14 bp, Homo sapiens
gtgggctccctgac

SEQ ID NO: 2551590 - DNA, 16 bp, Homo sapiens
gtgggctgagccctgg

SEQ ID NO: 2551591 - DNA, 22 bp, Homo sapiens
gtgggcttcccagtggctgctg

SEQ ID NO: 2551592 - DNA, 11 bp, Homo sapiens
gtggggacagg

SEQ ID NO: 2551593 - DNA, 13 bp, Homo sapiens
gtggggagggccg

SEQ ID NO: 2551594 - DNA, 17 bp, Homo sapiens
gtggggatttctcccag

SEQ ID NO: 2551595 - DNA, 17 bp, Homo sapiens
gtggggcagcttgaggg

SEQ ID NO: 2551596 - DNA, 15 bp, Homo sapiens
gtggggcctagatcc

SEQ ID NO: 2551597 - DNA, 12 bp, Homo sapiens
gtgggggctgca

SEQ ID NO: 2551598 - DNA, 22 bp, Homo sapiens
gtggggtgtgttccaactgccc

SEQ ID NO: 2551599 - DNA, 21 bp, Homo sapiens
gtgggtaggttggactggaaa

SEQ ID NO: 2551600 - DNA, 18 bp, Homo sapiens
gtgggtccatgggcagag

SEQ ID NO: 2551601 - DNA, 19 bp, Homo sapiens
gtgggtggaaccaggaacc

SEQ ID NO: 2551602 - DNA, 16 bp, Homo sapiens
gtgggtggtggatctg

SEQ ID NO: 2551603 - DNA, 14 bp, Homo sapiens
gtgggtggtgggga

SEQ ID NO: 2551604 - DNA, 21 bp, Homo sapiens
gtgggttttcatcaagactgg

SEQ ID NO: 2551605 - DNA, 16 bp, Homo sapiens
gtggtaagctctggct

SEQ ID NO: 2551606 - DNA, 14 bp, Homo sapiens
gtggtatagaaatg

SEQ ID NO: 2551607 - DNA, 16 bp, Homo sapiens
gtggtcattaagcatt

SEQ ID NO: 2551608 - DNA, 23 bp, Homo sapiens
gtggtcccaacaggaggacaatt

SEQ ID NO: 2551609 - DNA, 12 bp, Homo sapiens
gtggtcctgact

SEQ ID NO: 2551610 - DNA, 14 bp, Homo sapiens
gtggtctgcaggca

SEQ ID NO: 2551611 - DNA, 15 bp, Homo sapiens
gtggtctgcaggcag

SEQ ID NO: 2551612 - DNA, 17 bp, Homo sapiens
gtggtctttctggagag

SEQ ID NO: 2551613 - DNA, 13 bp, Homo sapiens
gtggtgagatcat

SEQ ID NO: 2551614 - DNA, 15 bp, Homo sapiens
gtggtgctgacaaag

SEQ ID NO: 2551615 - DNA, 18 bp, Homo sapiens
gtggtggaagaggggaca

SEQ ID NO: 2551616 - DNA, 14 bp, Homo sapiens
gtggtggagccagt

SEQ ID NO: 2551617 - DNA, 16 bp, Homo sapiens
gtggtggcacaggccc

SEQ ID NO: 2551618 - DNA, 15 bp, Homo sapiens
gtggtggcagggcct

SEQ ID NO: 2551619 - DNA, 21 bp, Homo sapiens
gtggtggcagggcctagctgc

SEQ ID NO: 2551620 - DNA, 23 bp, Homo sapiens
gtggtggcatacgcctgtagtcc

SEQ ID NO: 2551621 - DNA, 12 bp, Homo sapiens
gtggtggggagg

SEQ ID NO: 2551622 - DNA, 22 bp, Homo sapiens
gtggtgggttctttggaaggag

SEQ ID NO: 2551623 - DNA, 15 bp, Homo sapiens
gtggtgtttcctggc

SEQ ID NO: 2551624 - DNA, 18 bp, Homo sapiens
gtggttatggagagggtg

SEQ ID NO: 2551625 - DNA, 15 bp, Homo sapiens
gtggtttcagaaatg

SEQ ID NO: 2551626 - DNA, 17 bp, Homo sapiens
gtgtaaaatattttgaa

SEQ ID NO: 2551627 - DNA, 12 bp, Homo sapiens
gtgtctgtacac

SEQ ID NO: 2551628 - DNA, 13 bp, Homo sapiens
gtgtctgtacacg

SEQ ID NO: 2551629 - DNA, 22 bp, Homo sapiens
gtgtctgtacacgtgtcctgta

SEQ ID NO: 2551630 - DNA, 19 bp, Homo sapiens
gtgtcttaattattatttg

SEQ ID NO: 2551631 - DNA, 12 bp, Homo sapiens
gtgtcttccata

SEQ ID NO: 2551632 - DNA, 13 bp, Homo sapiens
gtgtcttccataa

SEQ ID NO: 2551633 - DNA, 15 bp, Homo sapiens
gtgtcttccataatg

SEQ ID NO: 2551634 - DNA, 14 bp, Homo sapiens
gtgtcttcctccca

SEQ ID NO: 2551635 - DNA, 18 bp, Homo sapiens
gtgtctttcacagctcct

SEQ ID NO: 2551636 - DNA, 21 bp, Homo sapiens
gtgtcttttctgtagagcata

SEQ ID NO: 2551637 - DNA, 21 bp, Homo sapiens
gtgtgaaaggaagctccactg

SEQ ID NO: 2551638 - DNA, 17 bp, Homo sapiens
gtgtgaagttagaattc

SEQ ID NO: 2551639 - DNA, 19 bp, Homo sapiens
gtgtgatcccaagtgccag

SEQ ID NO: 2551640 - DNA, 22 bp, Homo sapiens
gtgtgatgaactttctcttcat

SEQ ID NO: 2551641 - DNA, 16 bp, Homo sapiens
gtgtgcaccagggttg

SEQ ID NO: 2551642 - DNA, 18 bp, Homo sapiens
gtgtgcatgtgtgtgctc

SEQ ID NO: 2551643 - DNA, 16 bp, Homo sapiens
gtgtgcctgcagcccc

SEQ ID NO: 2551644 - DNA, 18 bp, Homo sapiens
gtgtggactcaagtcctt

SEQ ID NO: 2551645 - DNA, 21 bp, Homo sapiens
gtgtggagaagcggctggcag

SEQ ID NO: 2551646 - DNA, 13 bp, Homo sapiens
gtgtggctgagga

SEQ ID NO: 2551647 - DNA, 17 bp, Homo sapiens
gtgtgggagtgtgtaat

SEQ ID NO: 2551648 - DNA, 16 bp, Homo sapiens
gtgtgggggctgcagc

SEQ ID NO: 2551649 - DNA, 16 bp, Homo sapiens
gtgtggtagagtgtgc

SEQ ID NO: 2551650 - DNA, 23 bp, Homo sapiens
gtgtggtgggttctttggaagga

SEQ ID NO: 2551651 - DNA, 14 bp, Homo sapiens
gtgtgtagccaagg

SEQ ID NO: 2551652 - DNA, 21 bp, Homo sapiens
gtgtgtatgactaaagagaga

SEQ ID NO: 2551653 - DNA, 18 bp, Homo sapiens
gtgtgtatgggtgtgtgt

SEQ ID NO: 2551654 - DNA, 20 bp, Homo sapiens
gtgtgtatgtgcgtgtgtgc

SEQ ID NO: 2551655 - DNA, 12 bp, Homo sapiens
gtgtgtatgtgg

SEQ ID NO: 2551656 - DNA, 15 bp, Homo sapiens
gtgtgtatgtggggg

SEQ ID NO: 2551657 - DNA, 16 bp, Homo sapiens
gtgtgtccccctctgt

SEQ ID NO: 2551658 - DNA, 18 bp, Homo sapiens
gtgtgtccttgtgcatga

SEQ ID NO: 2551659 - DNA, 16 bp, Homo sapiens
gtgtgtctgctcagta

SEQ ID NO: 2551660 - DNA, 22 bp, Homo sapiens
gtgtgtctgttcacttttcctc

SEQ ID NO: 2551661 - DNA, 14 bp, Homo sapiens
gtgtgtgaaaggaa

SEQ ID NO: 2551662 - DNA, 14 bp, Homo sapiens
gtgtgtgtgtgtgt

SEQ ID NO: 2551663 - DNA, 15 bp, Homo sapiens
gtgtgttccaactgc

SEQ ID NO: 2551664 - DNA, 14 bp, Homo sapiens
gtgtgtttcacttt

SEQ ID NO: 2551665 - DNA, 17 bp, Homo sapiens
gtgtgttttcataataa

SEQ ID NO: 2551666 - DNA, 18 bp, Homo sapiens
gtgttaatcaatttaaac

SEQ ID NO: 2551667 - DNA, 20 bp, Homo sapiens
gtgttataatgggtaatata

SEQ ID NO: 2551668 - DNA, 10 bp, Homo sapiens
gtgttcctgg

SEQ ID NO: 2551669 - DNA, 11 bp, Homo sapiens
gtgttctcctt

SEQ ID NO: 2551670 - DNA, 16 bp, Homo sapiens
gtgttctgattagaaa

SEQ ID NO: 2551671 - DNA, 16 bp, Homo sapiens
gtgttgaaaatgttca

SEQ ID NO: 2551672 - DNA, 17 bp, Homo sapiens
gtgttgaaaatgttcag

SEQ ID NO: 2551673 - DNA, 15 bp, Homo sapiens
gtgttgatcccaaga

SEQ ID NO: 2551674 - DNA, 19 bp, Homo sapiens
gtgttgattttctgttgta

SEQ ID NO: 2551675 - DNA, 20 bp, Homo sapiens
gtgttgcccaggctggtctc

SEQ ID NO: 2551676 - DNA, 16 bp, Homo sapiens
gtgttggcccaagctc

SEQ ID NO: 2551677 - DNA, 21 bp, Homo sapiens
gtgttggctaatgaagggaaa

SEQ ID NO: 2551678 - DNA, 22 bp, Homo sapiens
gtgttggttttgactggatatt

SEQ ID NO: 2551679 - DNA, 11 bp, Homo sapiens
gtgtttaaata

SEQ ID NO: 2551680 - DNA, 15 bp, Homo sapiens
gtgtttcccataatt

SEQ ID NO: 2551681 - DNA, 16 bp, Homo sapiens
gtgtttctagcactgg

SEQ ID NO: 2551682 - DNA, 22 bp, Homo sapiens
gtgtttctagcactggcctgca

SEQ ID NO: 2551683 - DNA, 11 bp, Homo sapiens
gtgtttctagg

SEQ ID NO: 2551684 - DNA, 21 bp, Homo sapiens
gtgtttctccctctcactgtc

SEQ ID NO: 2551685 - DNA, 22 bp, Homo sapiens
gtgtttctccctctcactgtct

SEQ ID NO: 2551686 - DNA, 13 bp, Homo sapiens
gtgtttctgactc

SEQ ID NO: 2551687 - DNA, 21 bp, Homo sapiens
gtgtttgggtcacccctccag

SEQ ID NO: 2551688 - DNA, 11 bp, Homo sapiens
gtgtttgtgtt

SEQ ID NO: 2551689 - DNA, 12 bp, Homo sapiens
gtgtttgttcct

SEQ ID NO: 2551690 - DNA, 22 bp, Homo sapiens
gtgttttaattccaatatgatg

SEQ ID NO: 2551691 - DNA, 14 bp, Homo sapiens
gtgttttaatttaa

SEQ ID NO: 2551692 - DNA, 13 bp, Homo sapiens
gtgttttcataat

SEQ ID NO: 2551693 - DNA, 16 bp, Homo sapiens
gtgttttcataataaa

SEQ ID NO: 2551694 - DNA, 13 bp, Homo sapiens
gtgttttctgaat

SEQ ID NO: 2551695 - DNA, 12 bp, Homo sapiens
gtgttttgctgt

SEQ ID NO: 2551696 - DNA, 15 bp, Homo sapiens
gtgtttttaactcaa

SEQ ID NO: 2551697 - DNA, 14 bp, Homo sapiens
gtgtttttctgctt

SEQ ID NO: 2551698 - DNA, 20 bp, Homo sapiens
gttaaaaaaaggcattgttt

SEQ ID NO: 2551699 - DNA, 20 bp, Homo sapiens
gttaaaagaggtttttctta

SEQ ID NO: 2551700 - DNA, 14 bp, Homo sapiens
gttaaaagatgaaa

SEQ ID NO: 2551701 - DNA, 21 bp, Homo sapiens
gttaaaataactagtgttgct

SEQ ID NO: 2551702 - DNA, 17 bp, Homo sapiens
gttaaatgaaattgtaa

SEQ ID NO: 2551703 - DNA, 12 bp, Homo sapiens
gttaacacattt

SEQ ID NO: 2551704 - DNA, 15 bp, Homo sapiens
gttaacacattttgt

SEQ ID NO: 2551705 - DNA, 18 bp, Homo sapiens
gttaacacattttgtata

SEQ ID NO: 2551706 - DNA, 20 bp, Homo sapiens
gttaaccagaataaagttct

SEQ ID NO: 2551707 - DNA, 17 bp, Homo sapiens
gttaacctcagtgtcat

SEQ ID NO: 2551708 - DNA, 17 bp, Homo sapiens
gttaactttaagactga

SEQ ID NO: 2551709 - DNA, 21 bp, Homo sapiens
gttaagaagctgttgtacatt

SEQ ID NO: 2551710 - DNA, 18 bp, Homo sapiens
gttaagacaaactgcata

SEQ ID NO: 2551711 - DNA, 15 bp, Homo sapiens
gttaagatatgatgt

SEQ ID NO: 2551712 - DNA, 20 bp, Homo sapiens
gttaagcattaccactcagg

SEQ ID NO: 2551713 - DNA, 21 bp, Homo sapiens
gttaagcattaccactcaggc

SEQ ID NO: 2551714 - DNA, 16 bp, Homo sapiens
gttaaggaaactctta

SEQ ID NO: 2551715 - DNA, 16 bp, Homo sapiens
gttaaggctgaggaaa

SEQ ID NO: 2551716 - DNA, 17 bp, Homo sapiens
gttaaggctgaggaaag

SEQ ID NO: 2551717 - DNA, 14 bp, Homo sapiens
gttaagggaaggaa

SEQ ID NO: 2551718 - DNA, 22 bp, Homo sapiens
gttaagtctgttttatgacttc

SEQ ID NO: 2551719 - DNA, 15 bp, Homo sapiens
gttaataaattaaaa

SEQ ID NO: 2551720 - DNA, 12 bp, Homo sapiens
gttaatactagt

SEQ ID NO: 2551721 - DNA, 12 bp, Homo sapiens
gttaatcaattt

SEQ ID NO: 2551722 - DNA, 18 bp, Homo sapiens
gttaatcattaggtgtga

SEQ ID NO: 2551723 - DNA, 12 bp, Homo sapiens
gttaatcttagg

SEQ ID NO: 2551724 - DNA, 18 bp, Homo sapiens
gttaatgatagctactgt

SEQ ID NO: 2551725 - DNA, 19 bp, Homo sapiens
gttacaacagatttgtgaa

SEQ ID NO: 2551726 - DNA, 16 bp, Homo sapiens
gttacacatttttcag

SEQ ID NO: 2551727 - DNA, 19 bp, Homo sapiens
gttacatgcatacttcaaa

SEQ ID NO: 2551728 - DNA, 21 bp, Homo sapiens
gttacatgcatacttcaaaag

SEQ ID NO: 2551729 - DNA, 22 bp, Homo sapiens
gttacatgcatacttcaaaagt

SEQ ID NO: 2551730 - DNA, 23 bp, Homo sapiens
gttacatgcatacttcaaaagta

SEQ ID NO: 2551731 - DNA, 21 bp, Homo sapiens
gttacatttttaagtgctgca

SEQ ID NO: 2551732 - DNA, 13 bp, Homo sapiens
gttcaatgatcta

SEQ ID NO: 2551733 - DNA, 17 bp, Homo sapiens
gttcaatgatctaggtt

SEQ ID NO: 2551734 - DNA, 22 bp, Homo sapiens
gttcaatgatctaggtttaact

SEQ ID NO: 2551735 - DNA, 23 bp, Homo sapiens
gttcaattctcatttgtcacaca

SEQ ID NO: 2551736 - DNA, 12 bp, Homo sapiens
gttcacattttt

SEQ ID NO: 2551737 - DNA, 12 bp, Homo sapiens
gttcaccagcct

SEQ ID NO: 2551738 - DNA, 22 bp, Homo sapiens
gttcaccttgaagaacctctca

SEQ ID NO: 2551739 - DNA, 16 bp, Homo sapiens
gttcacttcatcttct

SEQ ID NO: 2551740 - DNA, 16 bp, Homo sapiens
gttcacttttgacaaa

SEQ ID NO: 2551741 - DNA, 20 bp, Homo sapiens
gttcacttttgacaaaggca

SEQ ID NO: 2551742 - DNA, 18 bp, Homo sapiens
gttcagaaatgctgcctg

SEQ ID NO: 2551743 - DNA, 16 bp, Homo sapiens
gttcagagactcaggg

SEQ ID NO: 2551744 - DNA, 16 bp, Homo sapiens
gttcagattgctttga

SEQ ID NO: 2551745 - DNA, 16 bp, Homo sapiens
gttcagcaccacccta

SEQ ID NO: 2551746 - DNA, 15 bp, Homo sapiens
gttcagctccagctc

SEQ ID NO: 2551747 - DNA, 19 bp, Homo sapiens
gttcaggggactcagccct

SEQ ID NO: 2551748 - DNA, 19 bp, Homo sapiens
gttcagggttggcccctgc

SEQ ID NO: 2551749 - DNA, 21 bp, Homo sapiens
gttcagggttggcccctgccc

SEQ ID NO: 2551750 - DNA, 13 bp, Homo sapiens
gttcaggtagctg

SEQ ID NO: 2551751 - DNA, 20 bp, Homo sapiens
gttcagtggcagggctcagg

SEQ ID NO: 2551752 - DNA, 21 bp, Homo sapiens
gttcagtggcagggctcagga

SEQ ID NO: 2551753 - DNA, 16 bp, Homo sapiens
gttcagtgtaatttct

SEQ ID NO: 2551754 - DNA, 11 bp, Homo sapiens
gttcagttaca

SEQ ID NO: 2551755 - DNA, 17 bp, Homo sapiens
gttcagttacagaaagt

SEQ ID NO: 2551756 - DNA, 14 bp, Homo sapiens
gttcatacatttga

SEQ ID NO: 2551757 - DNA, 16 bp, Homo sapiens
gttcatacatttgagg

SEQ ID NO: 2551758 - DNA, 18 bp, Homo sapiens
gttcatagggtctcttca

SEQ ID NO: 2551759 - DNA, 20 bp, Homo sapiens
gttcatagggtctcttcagg

SEQ ID NO: 2551760 - DNA, 16 bp, Homo sapiens
gttcatcaatgaatga

SEQ ID NO: 2551761 - DNA, 16 bp, Homo sapiens
gttcatccattctatt

SEQ ID NO: 2551762 - DNA, 19 bp, Homo sapiens
gttcatgagaatctatatt

SEQ ID NO: 2551763 - DNA, 15 bp, Homo sapiens
gttcatgtttgcttc

SEQ ID NO: 2551764 - DNA, 22 bp, Homo sapiens
gttcattattggaattaacctg

SEQ ID NO: 2551765 - DNA, 20 bp, Homo sapiens
gttcattgtaatgttactga

SEQ ID NO: 2551766 - DNA, 17 bp, Homo sapiens
gttccaaccactgaatc

SEQ ID NO: 2551767 - DNA, 15 bp, Homo sapiens
gttccaagacattgt

SEQ ID NO: 2551768 - DNA, 19 bp, Homo sapiens
gttccaagacattgtcaat

SEQ ID NO: 2551769 - DNA, 17 bp, Homo sapiens
gttccaccatcaagcca

SEQ ID NO: 2551770 - DNA, 12 bp, Homo sapiens
gttccactaacc

SEQ ID NO: 2551771 - DNA, 14 bp, Homo sapiens
gttccatgcctgag

SEQ ID NO: 2551772 - DNA, 20 bp, Homo sapiens
gttccatgcctgagggtgga

SEQ ID NO: 2551773 - DNA, 14 bp, Homo sapiens
gttcccccagccct

SEQ ID NO: 2551774 - DNA, 17 bp, Homo sapiens
gttcccccagccctgtg

SEQ ID NO: 2551775 - DNA, 13 bp, Homo sapiens
gttccccttccac

SEQ ID NO: 2551776 - DNA, 22 bp, Homo sapiens
gttccccttccactgagggcag

SEQ ID NO: 2551777 - DNA, 15 bp, Homo sapiens
gttccctctccctgt

SEQ ID NO: 2551778 - DNA, 21 bp, Homo sapiens
gttccctctgctcctggagcc

SEQ ID NO: 2551779 - DNA, 16 bp, Homo sapiens
gttccctgtcttgtcc

SEQ ID NO: 2551780 - DNA, 12 bp, Homo sapiens
gttcccttggcc

SEQ ID NO: 2551781 - DNA, 18 bp, Homo sapiens
gttcccttggcctcagaa

SEQ ID NO: 2551782 - DNA, 21 bp, Homo sapiens
gttccctttgacgccatccca

SEQ ID NO: 2551783 - DNA, 15 bp, Homo sapiens
gttcctattgtcatt

SEQ ID NO: 2551784 - DNA, 21 bp, Homo sapiens
gttcctgaattctatttgctg

SEQ ID NO: 2551785 - DNA, 19 bp, Homo sapiens
gttcctgcggagtgaagag

SEQ ID NO: 2551786 - DNA, 21 bp, Homo sapiens
gttcctggcaatagtgtgttc

SEQ ID NO: 2551787 - DNA, 16 bp, Homo sapiens
gttcgagaccagcctg

SEQ ID NO: 2551788 - DNA, 14 bp, Homo sapiens
gttctaaagatgga

SEQ ID NO: 2551789 - DNA, 16 bp, Homo sapiens
gttctaagtctttcca

SEQ ID NO: 2551790 - DNA, 19 bp, Homo sapiens
gttctaagtctttccattg

SEQ ID NO: 2551791 - DNA, 18 bp, Homo sapiens
gttctaattttggatgga

SEQ ID NO: 2551792 - DNA, 15 bp, Homo sapiens
gttctagagaagagg

SEQ ID NO: 2551793 - DNA, 23 bp, Homo sapiens
gttctagagaagaggctggtgct

SEQ ID NO: 2551794 - DNA, 13 bp, Homo sapiens
gttctatttggaa

SEQ ID NO: 2551795 - DNA, 18 bp, Homo sapiens
gttctatttggaatttat

SEQ ID NO: 2551796 - DNA, 12 bp, Homo sapiens
gttctcacaccc

SEQ ID NO: 2551797 - DNA, 15 bp, Homo sapiens
gttctcagggctcct

SEQ ID NO: 2551798 - DNA, 23 bp, Homo sapiens
gttctcagggctcctgccttctg

SEQ ID NO: 2551799 - DNA, 18 bp, Homo sapiens
gttctccttttcctctct

SEQ ID NO: 2551800 - DNA, 22 bp, Homo sapiens
gttctccttttcctctctcccg

SEQ ID NO: 2551801 - DNA, 22 bp, Homo sapiens
gttctctaagttccactgagct

SEQ ID NO: 2551802 - DNA, 12 bp, Homo sapiens
gttctctgagga

SEQ ID NO: 2551803 - DNA, 11 bp, Homo sapiens
gttctctgccc

SEQ ID NO: 2551804 - DNA, 17 bp, Homo sapiens
gttctgacattaacagt

SEQ ID NO: 2551805 - DNA, 21 bp, Homo sapiens
gttctgacattaacagttttc

SEQ ID NO: 2551806 - DNA, 17 bp, Homo sapiens
gttctgatgatgtgcct

SEQ ID NO: 2551807 - DNA, 14 bp, Homo sapiens
gttctgattagaaa

SEQ ID NO: 2551808 - DNA, 16 bp, Homo sapiens
gttctgattagaaatg

SEQ ID NO: 2551809 - DNA, 19 bp, Homo sapiens
gttctgctcctctccaggc

SEQ ID NO: 2551810 - DNA, 13 bp, Homo sapiens
gttctgctggcct

SEQ ID NO: 2551811 - DNA, 16 bp, Homo sapiens
gttctgctggcctgga

SEQ ID NO: 2551812 - DNA, 19 bp, Homo sapiens
gttctgctggcctggatct

SEQ ID NO: 2551813 - DNA, 20 bp, Homo sapiens
gttctggctcttccaggctg

SEQ ID NO: 2551814 - DNA, 11 bp, Homo sapiens
gttctgggaca

SEQ ID NO: 2551815 - DNA, 23 bp, Homo sapiens
gttctgggacacagttcaattct

SEQ ID NO: 2551816 - DNA, 14 bp, Homo sapiens
gttctggggcccct

SEQ ID NO: 2551817 - DNA, 15 bp, Homo sapiens
gttctggggcccctt

SEQ ID NO: 2551818 - DNA, 14 bp, Homo sapiens
gttctggtgaggcc

SEQ ID NO: 2551819 - DNA, 16 bp, Homo sapiens
gttctggtgaggcctt

SEQ ID NO: 2551820 - DNA, 14 bp, Homo sapiens
gttctgtggaaagt

SEQ ID NO: 2551821 - DNA, 20 bp, Homo sapiens
gttctgtggaaagtgtaaag

SEQ ID NO: 2551822 - DNA, 21 bp, Homo sapiens
gttctgtggaaagtgtaaagc

SEQ ID NO: 2551823 - DNA, 21 bp, Homo sapiens
gttctgtggttttcccctccc

SEQ ID NO: 2551824 - DNA, 17 bp, Homo sapiens
gttcttaattcttagct

SEQ ID NO: 2551825 - DNA, 13 bp, Homo sapiens
gttcttaattgca

SEQ ID NO: 2551826 - DNA, 21 bp, Homo sapiens
gttcttcgggaagagaggagt

SEQ ID NO: 2551827 - DNA, 22 bp, Homo sapiens
gttcttcgggaagagaggagtt

SEQ ID NO: 2551828 - DNA, 20 bp, Homo sapiens
gttcttcttcctgaagctga

SEQ ID NO: 2551829 - DNA, 17 bp, Homo sapiens
gttcttgtattaagaat

SEQ ID NO: 2551830 - DNA, 21 bp, Homo sapiens
gttcttgtattaagaatgaaa

SEQ ID NO: 2551831 - DNA, 12 bp, Homo sapiens
gttcttgtctga

SEQ ID NO: 2551832 - DNA, 17 bp, Homo sapiens
gttctttaggagatttt

SEQ ID NO: 2551833 - DNA, 13 bp, Homo sapiens
gttctttccaaag

SEQ ID NO: 2551834 - DNA, 20 bp, Homo sapiens
gttctttccaaagtacactg

SEQ ID NO: 2551835 - DNA, 17 bp, Homo sapiens
gttgaaaagactccaaa

SEQ ID NO: 2551836 - DNA, 22 bp, Homo sapiens
gttgaaaagactccaaagaaat

SEQ ID NO: 2551837 - DNA, 23 bp, Homo sapiens
gttgaaaagactccaaagaaatg

SEQ ID NO: 2551838 - DNA, 19 bp, Homo sapiens
gttgaaaattattttaaac

SEQ ID NO: 2551839 - DNA, 20 bp, Homo sapiens
gttgaaattatgtatgttta

SEQ ID NO: 2551840 - DNA, 14 bp, Homo sapiens
gttgaagctctggt

SEQ ID NO: 2551841 - DNA, 15 bp, Homo sapiens
gttgaatgacaacag

SEQ ID NO: 2551842 - DNA, 16 bp, Homo sapiens
gttgaatggcctgcct

SEQ ID NO: 2551843 - DNA, 16 bp, Homo sapiens
gttgacagttctgaag

SEQ ID NO: 2551844 - DNA, 21 bp, Homo sapiens
gttgacttattttctctgtgt

SEQ ID NO: 2551845 - DNA, 12 bp, Homo sapiens
gttgagaaatga

SEQ ID NO: 2551846 - DNA, 15 bp, Homo sapiens
gttgagccaggcctg

SEQ ID NO: 2551847 - DNA, 16 bp, Homo sapiens
gttgctggttgctgtg

SEQ ID NO: 2551848 - DNA, 19 bp, Homo sapiens
gttgctgtcataagaatga

SEQ ID NO: 2551849 - DNA, 16 bp, Homo sapiens
gttgctgtgtggtttg

SEQ ID NO: 2551850 - DNA, 23 bp, Homo sapiens
gttgcttaggatgtgtgcatgtg

SEQ ID NO: 2551851 - DNA, 15 bp, Homo sapiens
gttggaaaagaatac

SEQ ID NO: 2551852 - DNA, 17 bp, Homo sapiens
gttggacccgctctgga

SEQ ID NO: 2551853 - DNA, 18 bp, Homo sapiens
gttggacccgctctggac

SEQ ID NO: 2551854 - DNA, 22 bp, Homo sapiens
gttggagagctagaacctggag

SEQ ID NO: 2551855 - DNA, 16 bp, Homo sapiens
gttggagcctgcaggg

SEQ ID NO: 2551856 - DNA, 21 bp, Homo sapiens
gttggatttataaatgctatt

SEQ ID NO: 2551857 - DNA, 12 bp, Homo sapiens
gttggatttgtt

SEQ ID NO: 2551858 - DNA, 14 bp, Homo sapiens
gttggatttttgtc

SEQ ID NO: 2551859 - DNA, 20 bp, Homo sapiens
gttggatttttgtcttgtgt

SEQ ID NO: 2551860 - DNA, 20 bp, Homo sapiens
gttggcactcacagacctgg

SEQ ID NO: 2551861 - DNA, 23 bp, Homo sapiens
gttggccaaagccaaagctaggc

SEQ ID NO: 2551862 - DNA, 13 bp, Homo sapiens
gttggcctccggc

SEQ ID NO: 2551863 - DNA, 13 bp, Homo sapiens
gttggcctctgca

SEQ ID NO: 2551864 - DNA, 13 bp, Homo sapiens
gttggcctgcact

SEQ ID NO: 2551865 - DNA, 14 bp, Homo sapiens
gttggctggatgaa

SEQ ID NO: 2551866 - DNA, 12 bp, Homo sapiens
gttggctggcct

SEQ ID NO: 2551867 - DNA, 17 bp, Homo sapiens
gttggctgggaactcac

SEQ ID NO: 2551868 - DNA, 13 bp, Homo sapiens
gttggctgggccc

SEQ ID NO: 2551869 - DNA, 14 bp, Homo sapiens
gttggctgggccca

SEQ ID NO: 2551870 - DNA, 14 bp, Homo sapiens
gttgggaagacatg

SEQ ID NO: 2551871 - DNA, 16 bp, Homo sapiens
gttgggattcctgacc

SEQ ID NO: 2551872 - DNA, 19 bp, Homo sapiens
gttgggattcctgacccag

SEQ ID NO: 2551873 - DNA, 13 bp, Homo sapiens
gttggtagtttct

SEQ ID NO: 2551874 - DNA, 19 bp, Homo sapiens
gttggttccaagccctgga

SEQ ID NO: 2551875 - DNA, 20 bp, Homo sapiens
gttgtaaatatttatgtaaa

SEQ ID NO: 2551876 - DNA, 18 bp, Homo sapiens
gttgtaactaggctcaga

SEQ ID NO: 2551877 - DNA, 19 bp, Homo sapiens
gttgtaactaggctcagag

SEQ ID NO: 2551878 - DNA, 18 bp, Homo sapiens
gttgtaccgcaatgtgac

SEQ ID NO: 2551879 - DNA, 17 bp, Homo sapiens
gttgtataaatttattt

SEQ ID NO: 2551880 - DNA, 21 bp, Homo sapiens
gttgtataaatttatttactg

SEQ ID NO: 2551881 - DNA, 14 bp, Homo sapiens
gttgtatgccttta

SEQ ID NO: 2551882 - DNA, 13 bp, Homo sapiens
gttgtattctttg

SEQ ID NO: 2551883 - DNA, 20 bp, Homo sapiens
gttgtattctttgatgttaa

SEQ ID NO: 2551884 - DNA, 23 bp, Homo sapiens
gttgtattttaactcataccttt

SEQ ID NO: 2551885 - DNA, 16 bp, Homo sapiens
gttgtcaatattaaat

SEQ ID NO: 2551886 - DNA, 20 bp, Homo sapiens
gttgtcattgctgttgtccc

SEQ ID NO: 2551887 - DNA, 22 bp, Homo sapiens
gttgtccaattgttgacagttc

SEQ ID NO: 2551888 - DNA, 13 bp, Homo sapiens
gttgtgacctgaa

SEQ ID NO: 2551889 - DNA, 17 bp, Homo sapiens
gttgtgacctgaagttc

SEQ ID NO: 2551890 - DNA, 18 bp, Homo sapiens
gttgtgacctgaagttca

SEQ ID NO: 2551891 - DNA, 21 bp, Homo sapiens
gttgtgatagctaacatttta

SEQ ID NO: 2551892 - DNA, 22 bp, Homo sapiens
gttgtggatttaacagaaatgt

SEQ ID NO: 2551893 - DNA, 14 bp, Homo sapiens
gttgtggttaatct

SEQ ID NO: 2551894 - DNA, 14 bp, Homo sapiens
gttgtgtatagatg

SEQ ID NO: 2551895 - DNA, 13 bp, Homo sapiens
gttgtgtgtggga

SEQ ID NO: 2551896 - DNA, 14 bp, Homo sapiens
gttgtgtgtgggag

SEQ ID NO: 2551897 - DNA, 16 bp, Homo sapiens
gttgttaatgaaaatg

SEQ ID NO: 2551898 - DNA, 14 bp, Homo sapiens
gttgtttctttcta

SEQ ID NO: 2551899 - DNA, 18 bp, Homo sapiens
gttgtttgagaaattaag

SEQ ID NO: 2551900 - DNA, 13 bp, Homo sapiens
gtttaaataaagt

SEQ ID NO: 2551901 - DNA, 19 bp, Homo sapiens
gtttaaatatttcaagaca

SEQ ID NO: 2551902 - DNA, 22 bp, Homo sapiens
gtttaaccaaaaagaccagact

SEQ ID NO: 2551903 - DNA, 16 bp, Homo sapiens
gtttaactcagatcac

SEQ ID NO: 2551904 - DNA, 23 bp, Homo sapiens
gtttaactcagatcactactgca

SEQ ID NO: 2551905 - DNA, 12 bp, Homo sapiens
gtttaagtgttg

SEQ ID NO: 2551906 - DNA, 15 bp, Homo sapiens
gtttaatattgagaa

SEQ ID NO: 2551907 - DNA, 17 bp, Homo sapiens
gtttaatattgagaaag

SEQ ID NO: 2551908 - DNA, 19 bp, Homo sapiens
gtttacaagtgtatatcag

SEQ ID NO: 2551909 - DNA, 11 bp, Homo sapiens
gtttacatgta

SEQ ID NO: 2551910 - DNA, 22 bp, Homo sapiens
gtttacctgaataaatggtagt

SEQ ID NO: 2551911 - DNA, 23 bp, Homo sapiens
gtttaccttttaattaatgaaat

SEQ ID NO: 2551912 - DNA, 22 bp, Homo sapiens
gtttactagggatccctcatct

SEQ ID NO: 2551913 - DNA, 13 bp, Homo sapiens
gtttactatttta

SEQ ID NO: 2551914 - DNA, 14 bp, Homo sapiens
gtttacttaaagat

SEQ ID NO: 2551915 - DNA, 14 bp, Homo sapiens
gtttagataataca

SEQ ID NO: 2551916 - DNA, 12 bp, Homo sapiens
gtttagcaaata

SEQ ID NO: 2551917 - DNA, 16 bp, Homo sapiens
gtttagtaaggctgtg

SEQ ID NO: 2551918 - DNA, 15 bp, Homo sapiens
gtttatacctttgcc

SEQ ID NO: 2551919 - DNA, 20 bp, Homo sapiens
gtttatagagggccaagact

SEQ ID NO: 2551920 - DNA, 16 bp, Homo sapiens
gtttatcattcaagtg

SEQ ID NO: 2551921 - DNA, 18 bp, Homo sapiens
gtttatggcctcagctgc

SEQ ID NO: 2551922 - DNA, 23 bp, Homo sapiens
gtttatggcctcagctgcctcac

SEQ ID NO: 2551923 - DNA, 16 bp, Homo sapiens
gtttatgtgtgtgtgt

SEQ ID NO: 2551924 - DNA, 13 bp, Homo sapiens
gtttattaacaaa

SEQ ID NO: 2551925 - DNA, 23 bp, Homo sapiens
gtttattaacaaattatgttaca

SEQ ID NO: 2551926 - DNA, 17 bp, Homo sapiens
gtttatttattctgcat

SEQ ID NO: 2551927 - DNA, 13 bp, Homo sapiens
gtttattttaaga

SEQ ID NO: 2551928 - DNA, 19 bp, Homo sapiens
gtttattttcaagaataat

SEQ ID NO: 2551929 - DNA, 16 bp, Homo sapiens
gtttatttttcatatt

SEQ ID NO: 2551930 - DNA, 20 bp, Homo sapiens
gtttcaaaaacacagtgttt

SEQ ID NO: 2551931 - DNA, 15 bp, Homo sapiens
gtttcaaaataaaaa

SEQ ID NO: 2551932 - DNA, 19 bp, Homo sapiens
gtttcaaaataaaaaccaa

SEQ ID NO: 2551933 - DNA, 18 bp, Homo sapiens
gtttcaaacacaaatgca

SEQ ID NO: 2551934 - DNA, 14 bp, Homo sapiens
gtttcaaactttac

SEQ ID NO: 2551935 - DNA, 23 bp, Homo sapiens
gtttcaaccaagtcatgtgcatt

SEQ ID NO: 2551936 - DNA, 13 bp, Homo sapiens
gtttcaatgtgat

SEQ ID NO: 2551937 - DNA, 15 bp, Homo sapiens
gtttcaattcagtgc

SEQ ID NO: 2551938 - DNA, 11 bp, Homo sapiens
gtttcagaaat

SEQ ID NO: 2551939 - DNA, 21 bp, Homo sapiens
gtttcagatatatatcatatt

SEQ ID NO: 2551940 - DNA, 10 bp, Homo sapiens
gtttcaggtg

SEQ ID NO: 2551941 - DNA, 14 bp, Homo sapiens
gtttcaggtgacat

SEQ ID NO: 2551942 - DNA, 15 bp, Homo sapiens
gtttcaggtgacatg

SEQ ID NO: 2551943 - DNA, 16 bp, Homo sapiens
gtttcaggtgacatgt

SEQ ID NO: 2551944 - DNA, 16 bp, Homo sapiens
gtttcatccttttcat

SEQ ID NO: 2551945 - DNA, 15 bp, Homo sapiens
gtttcattctcctgc

SEQ ID NO: 2551946 - DNA, 16 bp, Homo sapiens
gtttcattctcctgcc

SEQ ID NO: 2551947 - DNA, 11 bp, Homo sapiens
gtttcattgac

SEQ ID NO: 2551948 - DNA, 22 bp, Homo sapiens
gtttccacgatgaaaaacttcc

SEQ ID NO: 2551949 - DNA, 20 bp, Homo sapiens
gtttcctggcactgcttcca

SEQ ID NO: 2551950 - DNA, 22 bp, Homo sapiens
gtttcctggcactgcttccagt

SEQ ID NO: 2551951 - DNA, 14 bp, Homo sapiens
gtttccttcagtgc

SEQ ID NO: 2551952 - DNA, 17 bp, Homo sapiens
gtttcctttcatttact

SEQ ID NO: 2551953 - DNA, 18 bp, Homo sapiens
gtttcgaagttgatgcaa

SEQ ID NO: 2551954 - DNA, 17 bp, Homo sapiens
gtttcgagaagctgctc

SEQ ID NO: 2551955 - DNA, 23 bp, Homo sapiens
gtttctaaaggctacctttgtat

SEQ ID NO: 2551956 - DNA, 15 bp, Homo sapiens
gtttctcagctccca

SEQ ID NO: 2551957 - DNA, 22 bp, Homo sapiens
gtttctccccctgggctctgcc

SEQ ID NO: 2551958 - DNA, 13 bp, Homo sapiens
gtttctctgctgt

SEQ ID NO: 2551959 - DNA, 15 bp, Homo sapiens
gtttctctgctgttg

SEQ ID NO: 2551960 - DNA, 14 bp, Homo sapiens
gtttctgcagtagt

SEQ ID NO: 2551961 - DNA, 20 bp, Homo sapiens
gtttctgcagtagtctctgt

SEQ ID NO: 2551962 - DNA, 22 bp, Homo sapiens
gtttctgcagtagtctctgtgc

SEQ ID NO: 2551963 - DNA, 21 bp, Homo sapiens
gtttctgcccacattggaccc

SEQ ID NO: 2551964 - DNA, 14 bp, Homo sapiens
gtttctggtctcta

SEQ ID NO: 2551965 - DNA, 14 bp, Homo sapiens
gtttctgttattaa

SEQ ID NO: 2551966 - DNA, 15 bp, Homo sapiens
gtttctgttctgtgg

SEQ ID NO: 2551967 - DNA, 18 bp, Homo sapiens
gtttctgttctgtggaaa

SEQ ID NO: 2551968 - DNA, 20 bp, Homo sapiens
gtttctgttctgtggaaagt

SEQ ID NO: 2551969 - DNA, 17 bp, Homo sapiens
gtttctttaagaaagta

SEQ ID NO: 2551970 - DNA, 17 bp, Homo sapiens
gtttgaaacaaagaagg

SEQ ID NO: 2551971 - DNA, 14 bp, Homo sapiens
gtttgaaatctttt

SEQ ID NO: 2551972 - DNA, 15 bp, Homo sapiens
gtttgaaggaaacag

SEQ ID NO: 2551973 - DNA, 17 bp, Homo sapiens
gtttgaaggaaacagtt

SEQ ID NO: 2551974 - DNA, 15 bp, Homo sapiens
gtttggaccccagct

SEQ ID NO: 2551975 - DNA, 16 bp, Homo sapiens
gtttggaccccagctg

SEQ ID NO: 2551976 - DNA, 21 bp, Homo sapiens
gtttgggcagaagggagaagg

SEQ ID NO: 2551977 - DNA, 18 bp, Homo sapiens
gtttggggcgaggcagag

SEQ ID NO: 2551978 - DNA, 15 bp, Homo sapiens
gtttggtgtgttccc

SEQ ID NO: 2551979 - DNA, 22 bp, Homo sapiens
gtttggttcacttacagatagt

SEQ ID NO: 2551980 - DNA, 20 bp, Homo sapiens
gtttgtaaattaacttttat

SEQ ID NO: 2551981 - DNA, 13 bp, Homo sapiens
gtttgtatattgt

SEQ ID NO: 2551982 - DNA, 16 bp, Homo sapiens
gtttgtatgtataatt

SEQ ID NO: 2551983 - DNA, 15 bp, Homo sapiens
gtttgtctgtcttca

SEQ ID NO: 2551984 - DNA, 18 bp, Homo sapiens
gtttgtctgtcttcatag

SEQ ID NO: 2551985 - DNA, 16 bp, Homo sapiens
gtttgtcttctcccca

SEQ ID NO: 2551986 - DNA, 13 bp, Homo sapiens
gtttgtggcctca

SEQ ID NO: 2551987 - DNA, 13 bp, Homo sapiens
gtttgtggctggg

SEQ ID NO: 2551988 - DNA, 20 bp, Homo sapiens
gtttgtggctgggggcagga

SEQ ID NO: 2551989 - DNA, 22 bp, Homo sapiens
gtttgtggctgggggcaggagg

SEQ ID NO: 2551990 - DNA, 21 bp, Homo sapiens
gtttgtgtgttgtcttgaaag

SEQ ID NO: 2551991 - DNA, 20 bp, Homo sapiens
gtttgtttctgaaagggacg

SEQ ID NO: 2551992 - DNA, 24 bp, Homo sapiens
gttttaaaataaaaattctgaatg

SEQ ID NO: 2551993 - DNA, 14 bp, Homo sapiens
gttttaaaattaaa

SEQ ID NO: 2551994 - DNA, 19 bp, Homo sapiens
gttttaactagaatttatt

SEQ ID NO: 2551995 - DNA, 14 bp, Homo sapiens
gttttaagaggcag

SEQ ID NO: 2551996 - DNA, 14 bp, Homo sapiens
gttttaattccatg

SEQ ID NO: 2551997 - DNA, 18 bp, Homo sapiens
gttttactgcagctttgt

SEQ ID NO: 2551998 - DNA, 13 bp, Homo sapiens
gttttacttttaa

SEQ ID NO: 2551999 - DNA, 18 bp, Homo sapiens
gttttacttttaaactgt

SEQ ID NO: 2552000 - DNA, 16 bp, Homo sapiens
gttttagaaggttctc

SEQ ID NO: 2552001 - DNA, 18 bp, Homo sapiens
gttttagacaaatactca

SEQ ID NO: 2552002 - DNA, 20 bp, Homo sapiens
gttttagccattgttggctt

SEQ ID NO: 2552003 - DNA, 21 bp, Homo sapiens
gttttagctccttgactcctt

SEQ ID NO: 2552004 - DNA, 21 bp, Homo sapiens
gttttaggacaaacagctcag

SEQ ID NO: 2552005 - DNA, 15 bp, Homo sapiens
gttttagttaaattt

SEQ ID NO: 2552006 - DNA, 14 bp, Homo sapiens
gttttagttgcaga

SEQ ID NO: 2552007 - DNA, 19 bp, Homo sapiens
gttttatatttttatagac

SEQ ID NO: 2552008 - DNA, 21 bp, Homo sapiens
gttttatcacatgtatgtttt

SEQ ID NO: 2552009 - DNA, 22 bp, Homo sapiens
gttttatcacatgtatgttttg

SEQ ID NO: 2552010 - DNA, 13 bp, Homo sapiens
gttttatgacttc

SEQ ID NO: 2552011 - DNA, 20 bp, Homo sapiens
gttttattcctgtatgttgt

SEQ ID NO: 2552012 - DNA, 13 bp, Homo sapiens
gttttattgtgtt

SEQ ID NO: 2552013 - DNA, 14 bp, Homo sapiens
gttttcataataaa

SEQ ID NO: 2552014 - DNA, 13 bp, Homo sapiens
gttttccatgaaa

SEQ ID NO: 2552015 - DNA, 15 bp, Homo sapiens
gttttccatgaaaac

SEQ ID NO: 2552016 - DNA, 17 bp, Homo sapiens
gttttccatgaaaacgt

SEQ ID NO: 2552017 - DNA, 22 bp, Homo sapiens
gttttcctataatataataaat

SEQ ID NO: 2552018 - DNA, 19 bp, Homo sapiens
gttttcctttgtcatcatt

SEQ ID NO: 2552019 - DNA, 18 bp, Homo sapiens
gttttcgaagctcagccc

SEQ ID NO: 2552020 - DNA, 19 bp, Homo sapiens
gttttctctcggctcccca

SEQ ID NO: 2552021 - DNA, 19 bp, Homo sapiens
gttttctcttgagagggtg

SEQ ID NO: 2552022 - DNA, 16 bp, Homo sapiens
gttttctgagaaagac

SEQ ID NO: 2552023 - DNA, 15 bp, Homo sapiens
gttttctgttctttc

SEQ ID NO: 2552024 - DNA, 16 bp, Homo sapiens
gttttcttaacttaaa

SEQ ID NO: 2552025 - DNA, 13 bp, Homo sapiens
gttttgaaaagct

SEQ ID NO: 2552026 - DNA, 21 bp, Homo sapiens
gttttgaaaagctattagcca

SEQ ID NO: 2552027 - DNA, 23 bp, Homo sapiens
gttttgaactaataaaagcataa

SEQ ID NO: 2552028 - DNA, 14 bp, Homo sapiens
gttttgacattttt

SEQ ID NO: 2552029 - DNA, 20 bp, Homo sapiens
gttttgataaagtagtaaaa

SEQ ID NO: 2552030 - DNA, 23 bp, Homo sapiens
gttttgatgtttgtggcctcaga

SEQ ID NO: 2552031 - DNA, 19 bp, Homo sapiens
gttttgatttgtactgaaa

SEQ ID NO: 2552032 - DNA, 21 bp, Homo sapiens
gttttgccatgttggccaggc

SEQ ID NO: 2552033 - DNA, 19 bp, Homo sapiens
gttttgctattagactgta

SEQ ID NO: 2552034 - DNA, 16 bp, Homo sapiens
gttttgtaagatgctg

SEQ ID NO: 2552035 - DNA, 12 bp, Homo sapiens
gttttgtattct

SEQ ID NO: 2552036 - DNA, 19 bp, Homo sapiens
gttttgtttcctttcactg

SEQ ID NO: 2552037 - DNA, 13 bp, Homo sapiens
gtttttaaaagtt

SEQ ID NO: 2552038 - DNA, 18 bp, Homo sapiens
gtttttaaatagagtttg

SEQ ID NO: 2552039 - DNA, 19 bp, Homo sapiens
gtttttaactcaatatttt

SEQ ID NO: 2552040 - DNA, 14 bp, Homo sapiens
gtttttaagctgtt

SEQ ID NO: 2552041 - DNA, 18 bp, Homo sapiens
gtttttacccatatcccc

SEQ ID NO: 2552042 - DNA, 20 bp, Homo sapiens
gtttttacccatatcccctc

SEQ ID NO: 2552043 - DNA, 17 bp, Homo sapiens
gtttttacctctgtctt

SEQ ID NO: 2552044 - DNA, 17 bp, Homo sapiens
gtttttactttctgttg

SEQ ID NO: 2552045 - DNA, 22 bp, Homo sapiens
gtttttatggcttttgtgcatt

SEQ ID NO: 2552046 - DNA, 18 bp, Homo sapiens
gtttttcaattaaacgga

SEQ ID NO: 2552047 - DNA, 21 bp, Homo sapiens
gtttttcaattaaacggatta

SEQ ID NO: 2552048 - DNA, 17 bp, Homo sapiens
gtttttctgcttttgaa

SEQ ID NO: 2552049 - DNA, 20 bp, Homo sapiens
gtttttcttaaataataaag

SEQ ID NO: 2552050 - DNA, 21 bp, Homo sapiens
gtttttcttaaataataaaga

SEQ ID NO: 2552051 - DNA, 20 bp, Homo sapiens
gtttttgaaggcagaaagca

SEQ ID NO: 2552052 - DNA, 18 bp, Homo sapiens
gtttttggtttttaaaac

SEQ ID NO: 2552053 - DNA, 15 bp, Homo sapiens
gtttttgttcaaagc

SEQ ID NO: 2552054 - DNA, 16 bp, Homo sapiens
gttttttagatcaaat

SEQ ID NO: 2552055 - DNA, 9 bp, Homo sapiens
gttttttgg

SEQ ID NO: 2552056 - DNA, 10 bp, Homo sapiens
gttttttggt

SEQ ID NO: 2552057 - DNA, 19 bp, Homo sapiens
gtttttttgtatagtaaag

SEQ ID NO: 2552058 - DNA, 18 bp, Homo sapiens
gttttttttaaataaaag

SEQ ID NO: 2552059 - DNA, 20 bp, Homo sapiens
gttttttttaaataaaagca

SEQ ID NO: 2552060 - DNA, 18 bp, Homo sapiens
taaaaaaaaaaaagttat

SEQ ID NO: 2552061 - DNA, 15 bp, Homo sapiens
taaaaaaaaatgcct

SEQ ID NO: 2552062 - DNA, 16 bp, Homo sapiens
taaaaaaaaatgcctt

SEQ ID NO: 2552063 - DNA, 12 bp, Homo sapiens
taaaaaaaagaa

SEQ ID NO: 2552064 - DNA, 18 bp, Homo sapiens
taaaaaaaggcattgttt

SEQ ID NO: 2552065 - DNA, 12 bp, Homo sapiens
taaaaaaattta

SEQ ID NO: 2552066 - DNA, 19 bp, Homo sapiens
taaaaaacaaagaagacaa

SEQ ID NO: 2552067 - DNA, 23 bp, Homo sapiens
taaaaaactgctgactgttttct

SEQ ID NO: 2552068 - DNA, 15 bp, Homo sapiens
taaaaaacttgtaaa

SEQ ID NO: 2552069 - DNA, 10 bp, Homo sapiens
taaaaacaaa

SEQ ID NO: 2552070 - DNA, 18 bp, Homo sapiens
taaaaacagcattgcttt

SEQ ID NO: 2552071 - DNA, 19 bp, Homo sapiens
taaaaacagcattgctttc

SEQ ID NO: 2552072 - DNA, 22 bp, Homo sapiens
taaaaacagcattgctttctga

SEQ ID NO: 2552073 - DNA, 18 bp, Homo sapiens
taaaaagattgaagtatt

SEQ ID NO: 2552074 - DNA, 13 bp, Homo sapiens
taaaaagatttgt

SEQ ID NO: 2552075 - DNA, 16 bp, Homo sapiens
taaaaagtcaatgttt

SEQ ID NO: 2552076 - DNA, 14 bp, Homo sapiens
taaaaagtcttcac

SEQ ID NO: 2552077 - DNA, 18 bp, Homo sapiens
taaaaagtgacacagcag

SEQ ID NO: 2552078 - DNA, 9 bp, Homo sapiens
taaaaagtt

SEQ ID NO: 2552079 - DNA, 11 bp, Homo sapiens
taaaaagttaa

SEQ ID NO: 2552080 - DNA, 13 bp, Homo sapiens
taaaaagttaaaa

SEQ ID NO: 2552081 - DNA, 17 bp, Homo sapiens
taaaaataaatttggtt

SEQ ID NO: 2552082 - DNA, 23 bp, Homo sapiens
taaaaatatggaacttctaatat

SEQ ID NO: 2552083 - DNA, 17 bp, Homo sapiens
taaaaatcataaactgt

SEQ ID NO: 2552084 - DNA, 20 bp, Homo sapiens
taaaaatctaccttctgtag

SEQ ID NO: 2552085 - DNA, 15 bp, Homo sapiens
taaaaatctcaaatt

SEQ ID NO: 2552086 - DNA, 17 bp, Homo sapiens
taaaaatctcaaatttc

SEQ ID NO: 2552087 - DNA, 19 bp, Homo sapiens
taaaaatctcaaatttcta

SEQ ID NO: 2552088 - DNA, 20 bp, Homo sapiens
taaaaatctcaaatttctaa

SEQ ID NO: 2552089 - DNA, 14 bp, Homo sapiens
taaaaatgaatcct

SEQ ID NO: 2552090 - DNA, 11 bp, Homo sapiens
taaaaatgcaa

SEQ ID NO: 2552091 - DNA, 19 bp, Homo sapiens
taaaaatggctcagatgcc

SEQ ID NO: 2552092 - DNA, 17 bp, Homo sapiens
taaaaatgggacttctt

SEQ ID NO: 2552093 - DNA, 18 bp, Homo sapiens
taaaaatgggacttcttt

SEQ ID NO: 2552094 - DNA, 15 bp, Homo sapiens
taaaaatggtttaaa

SEQ ID NO: 2552095 - DNA, 19 bp, Homo sapiens
taaaaatggtttaaatggt

SEQ ID NO: 2552096 - DNA, 22 bp, Homo sapiens
taaaaatgttaaaatgtattct

SEQ ID NO: 2552097 - DNA, 14 bp, Homo sapiens
taaaaattctgaat

SEQ ID NO: 2552098 - DNA, 16 bp, Homo sapiens
taaaacaaaagctcat

SEQ ID NO: 2552099 - DNA, 23 bp, Homo sapiens
taaaacaataaaattttttttca

SEQ ID NO: 2552100 - DNA, 14 bp, Homo sapiens
taaaacaatattgt

SEQ ID NO: 2552101 - DNA, 13 bp, Homo sapiens
taaaacagacact

SEQ ID NO: 2552102 - DNA, 19 bp, Homo sapiens
taaaacagacactggcatg

SEQ ID NO: 2552103 - DNA, 12 bp, Homo sapiens
taaaacatgtaa

SEQ ID NO: 2552104 - DNA, 12 bp, Homo sapiens
taaaacattaat

SEQ ID NO: 2552105 - DNA, 21 bp, Homo sapiens
taaaaccatgtagaaaatttg

SEQ ID NO: 2552106 - DNA, 19 bp, Homo sapiens
taaaaccccatctctacta

SEQ ID NO: 2552107 - DNA, 10 bp, Homo sapiens
taaaaccttt

SEQ ID NO: 2552108 - DNA, 14 bp, Homo sapiens
taaaacctttcaaa

SEQ ID NO: 2552109 - DNA, 13 bp, Homo sapiens
taaaactgaattg

SEQ ID NO: 2552110 - DNA, 20 bp, Homo sapiens
taaaacttgatgtgttatct

SEQ ID NO: 2552111 - DNA, 22 bp, Homo sapiens
taaaacttgatgtgttatctct

SEQ ID NO: 2552112 - DNA, 20 bp, Homo sapiens
taaaagaatgggcagttaca

SEQ ID NO: 2552113 - DNA, 21 bp, Homo sapiens
taaaagaggtttttcttaaat

SEQ ID NO: 2552114 - DNA, 21 bp, Homo sapiens
taaaagatacagttactcaga

SEQ ID NO: 2552115 - DNA, 12 bp, Homo sapiens
taaaagattcat

SEQ ID NO: 2552116 - DNA, 14 bp, Homo sapiens
taaaagattcattt

SEQ ID NO: 2552117 - DNA, 19 bp, Homo sapiens
taaaagattcatttttaat

SEQ ID NO: 2552118 - DNA, 17 bp, Homo sapiens
taaaagcaattccaacc

SEQ ID NO: 2552119 - DNA, 20 bp, Homo sapiens
taaaagcagcatctgctaat

SEQ ID NO: 2552120 - DNA, 14 bp, Homo sapiens
taaaaggaaaagca

SEQ ID NO: 2552121 - DNA, 21 bp, Homo sapiens
taaaagggattacccaagcaa

SEQ ID NO: 2552122 - DNA, 12 bp, Homo sapiens
taaaaggtgacc

SEQ ID NO: 2552123 - DNA, 19 bp, Homo sapiens
taaaaggtgaccaatgatg

SEQ ID NO: 2552124 - DNA, 14 bp, Homo sapiens
taaaagtaaacatt

SEQ ID NO: 2552125 - DNA, 13 bp, Homo sapiens
taaaagtcttgtg

SEQ ID NO: 2552126 - DNA, 14 bp, Homo sapiens
taaaagtgtgagca

SEQ ID NO: 2552127 - DNA, 14 bp, Homo sapiens
taaaagttgtgatt

SEQ ID NO: 2552128 - DNA, 19 bp, Homo sapiens
taaaagtttcaatgtgatt

SEQ ID NO: 2552129 - DNA, 21 bp, Homo sapiens
taaaataactagtgttgcttg

SEQ ID NO: 2552130 - DNA, 24 bp, Homo sapiens
taaaataactagtgttgcttggac

SEQ ID NO: 2552131 - DNA, 21 bp, Homo sapiens
taaaatactatttttactgcc

SEQ ID NO: 2552132 - DNA, 17 bp, Homo sapiens
taaaatagaaataagtg

SEQ ID NO: 2552133 - DNA, 20 bp, Homo sapiens
taaaatagataaataaatat

SEQ ID NO: 2552134 - DNA, 14 bp, Homo sapiens
taaaatagcttgta

SEQ ID NO: 2552135 - DNA, 18 bp, Homo sapiens
taaaatagcttgtatagt

SEQ ID NO: 2552136 - DNA, 19 bp, Homo sapiens
taaaatatgaagacataaa

SEQ ID NO: 2552137 - DNA, 18 bp, Homo sapiens
taaaatatggctataaat

SEQ ID NO: 2552138 - DNA, 13 bp, Homo sapiens
taaaatattcctg

SEQ ID NO: 2552139 - DNA, 13 bp, Homo sapiens
taaaatattttca

SEQ ID NO: 2552140 - DNA, 14 bp, Homo sapiens
taaaatctgtcacg

SEQ ID NO: 2552141 - DNA, 19 bp, Homo sapiens
taaaatcttggcacagaaa

SEQ ID NO: 2552142 - DNA, 20 bp, Homo sapiens
taaaatcttggcacagaaac

SEQ ID NO: 2552143 - DNA, 18 bp, Homo sapiens
taaaatgattgtaaaata

SEQ ID NO: 2552144 - DNA, 20 bp, Homo sapiens
taaaatgattgtaaaatagc

SEQ ID NO: 2552145 - DNA, 18 bp, Homo sapiens
taaaatgcaacatgtgta

SEQ ID NO: 2552146 - DNA, 9 bp, Homo sapiens
taaaatggt

SEQ ID NO: 2552147 - DNA, 14 bp, Homo sapiens
taaaattattttgg

SEQ ID NO: 2552148 - DNA, 13 bp, Homo sapiens
taaaattgaaagg

SEQ ID NO: 2552149 - DNA, 21 bp, Homo sapiens
taaaatttgccctcccatccc

SEQ ID NO: 2552150 - DNA, 15 bp, Homo sapiens
taaaatttgttgcat

SEQ ID NO: 2552151 - DNA, 16 bp, Homo sapiens
taaaattttttttcat

SEQ ID NO: 2552152 - DNA, 17 bp, Homo sapiens
taaaattttttttcatg

SEQ ID NO: 2552153 - DNA, 19 bp, Homo sapiens
taaaattttttttcatgtt

SEQ ID NO: 2552154 - DNA, 19 bp, Homo sapiens
taaacaaattcatattctg

SEQ ID NO: 2552155 - DNA, 23 bp, Homo sapiens
taaacacccatgaatcaaagaca

SEQ ID NO: 2552156 - DNA, 16 bp, Homo sapiens
taaacagatataaatg

SEQ ID NO: 2552157 - DNA, 15 bp, Homo sapiens
taaacagatttttac

SEQ ID NO: 2552158 - DNA, 18 bp, Homo sapiens
taaacagatttttacaaa

SEQ ID NO: 2552159 - DNA, 19 bp, Homo sapiens
taaacagatttttacaaat

SEQ ID NO: 2552160 - DNA, 13 bp, Homo sapiens
taaacagcagtgt

SEQ ID NO: 2552161 - DNA, 17 bp, Homo sapiens
taaacagcagtgttccc

SEQ ID NO: 2552162 - DNA, 20 bp, Homo sapiens
taaacagggcatctccagga

SEQ ID NO: 2552163 - DNA, 16 bp, Homo sapiens
taaacatcacacacac

SEQ ID NO: 2552164 - DNA, 20 bp, Homo sapiens
taaacattagtgttcatagc

SEQ ID NO: 2552165 - DNA, 19 bp, Homo sapiens
taaacattggttcttgtat

SEQ ID NO: 2552166 - DNA, 21 bp, Homo sapiens
taaacattggttcttgtatta

SEQ ID NO: 2552167 - DNA, 21 bp, Homo sapiens
taaaccaggtttagacagtat

SEQ ID NO: 2552168 - DNA, 18 bp, Homo sapiens
taaaccgccaaggctggg

SEQ ID NO: 2552169 - DNA, 18 bp, Homo sapiens
taaacgatttaattctct

SEQ ID NO: 2552170 - DNA, 15 bp, Homo sapiens
taaacgtatgcatgt

SEQ ID NO: 2552171 - DNA, 20 bp, Homo sapiens
taaacgtatgcatgtgaaga

SEQ ID NO: 2552172 - DNA, 14 bp, Homo sapiens
taaactatcttttt

SEQ ID NO: 2552173 - DNA, 15 bp, Homo sapiens
taaactcaaaactta

SEQ ID NO: 2552174 - DNA, 19 bp, Homo sapiens
taaactcaaaacttaacat

SEQ ID NO: 2552175 - DNA, 14 bp, Homo sapiens
taaactcaaaatat

SEQ ID NO: 2552176 - DNA, 16 bp, Homo sapiens
taaactcaaaatattt

SEQ ID NO: 2552177 - DNA, 14 bp, Homo sapiens
taaactctaaacat

SEQ ID NO: 2552178 - DNA, 15 bp, Homo sapiens
taaactgactttatc

SEQ ID NO: 2552179 - DNA, 14 bp, Homo sapiens
taaactgtgcacca

SEQ ID NO: 2552180 - DNA, 17 bp, Homo sapiens
taaactgtgtattccaa

SEQ ID NO: 2552181 - DNA, 13 bp, Homo sapiens
taaactgtgtgca

SEQ ID NO: 2552182 - DNA, 13 bp, Homo sapiens
taaactgtgttta

SEQ ID NO: 2552183 - DNA, 18 bp, Homo sapiens
taaagaaaatctctgtga

SEQ ID NO: 2552184 - DNA, 15 bp, Homo sapiens
taaagaaagagagaa

SEQ ID NO: 2552185 - DNA, 18 bp, Homo sapiens
taaagaaagagagaaaat

SEQ ID NO: 2552186 - DNA, 19 bp, Homo sapiens
taaagaaagagagaaaata

SEQ ID NO: 2552187 - DNA, 23 bp, Homo sapiens
taaagaaagagagaaaataaaaa

SEQ ID NO: 2552188 - DNA, 21 bp, Homo sapiens
taaagaaagtcgaattaatag

SEQ ID NO: 2552189 - DNA, 15 bp, Homo sapiens
taaagaacataaata

SEQ ID NO: 2552190 - DNA, 21 bp, Homo sapiens
taaagaagcaataaagaagag

SEQ ID NO: 2552191 - DNA, 19 bp, Homo sapiens
taaagacaaagacaaattc

SEQ ID NO: 2552192 - DNA, 22 bp, Homo sapiens
taaagacaaagacaaattctgt

SEQ ID NO: 2552193 - DNA, 14 bp, Homo sapiens
taaagactggcttt

SEQ ID NO: 2552194 - DNA, 20 bp, Homo sapiens
taaagactggcttttattaa

SEQ ID NO: 2552195 - DNA, 18 bp, Homo sapiens
taaagatatttttatctt

SEQ ID NO: 2552196 - DNA, 11 bp, Homo sapiens
taaagatgatc

SEQ ID NO: 2552197 - DNA, 21 bp, Homo sapiens
taaagatgatctactcagaaa

SEQ ID NO: 2552198 - DNA, 22 bp, Homo sapiens
taaagatgcaaggaccaggact

SEQ ID NO: 2552199 - DNA, 13 bp, Homo sapiens
taaagatggaaaa

SEQ ID NO: 2552200 - DNA, 23 bp, Homo sapiens
taaagcaataatggtcccatcca

SEQ ID NO: 2552201 - DNA, 15 bp, Homo sapiens
taaagcaatatgcat

SEQ ID NO: 2552202 - DNA, 20 bp, Homo sapiens
taaagcagagggactttgta

SEQ ID NO: 2552203 - DNA, 12 bp, Homo sapiens
taaagcctcctc

SEQ ID NO: 2552204 - DNA, 23 bp, Homo sapiens
taaagctaaaatgattttatctg

SEQ ID NO: 2552205 - DNA, 14 bp, Homo sapiens
taaagctagaaatg

SEQ ID NO: 2552206 - DNA, 17 bp, Homo sapiens
taaagctcgaaaacaat

SEQ ID NO: 2552207 - DNA, 17 bp, Homo sapiens
taaagctgcctgtagtt

SEQ ID NO: 2552208 - DNA, 18 bp, Homo sapiens
taaagctgcctgtagtta

SEQ ID NO: 2552209 - DNA, 16 bp, Homo sapiens
taaaggagttaagagt

SEQ ID NO: 2552210 - DNA, 19 bp, Homo sapiens
taaaggcaccatctaatag

SEQ ID NO: 2552211 - DNA, 20 bp, Homo sapiens
taaaggctatacttgtcttg

SEQ ID NO: 2552212 - DNA, 18 bp, Homo sapiens
taaagggtgtacttatat

SEQ ID NO: 2552213 - DNA, 17 bp, Homo sapiens
taaaggtggtatgtgtg

SEQ ID NO: 2552214 - DNA, 17 bp, Homo sapiens
taaaggtgtcttcctcc

SEQ ID NO: 2552215 - DNA, 19 bp, Homo sapiens
taaaggtgtcttcctccca

SEQ ID NO: 2552216 - DNA, 20 bp, Homo sapiens
taaaggttgacaataaatgt

SEQ ID NO: 2552217 - DNA, 19 bp, Homo sapiens
taaagtagtaaaaattaaa

SEQ ID NO: 2552218 - DNA, 19 bp, Homo sapiens
taaagtatatatagaatct

SEQ ID NO: 2552219 - DNA, 17 bp, Homo sapiens
taaagtatatatttatt

SEQ ID NO: 2552220 - DNA, 20 bp, Homo sapiens
taaagtatcaggatactata

SEQ ID NO: 2552221 - DNA, 14 bp, Homo sapiens
taaagtatcatgca

SEQ ID NO: 2552222 - DNA, 21 bp, Homo sapiens
taaagtatgtaaagtatgtaa

SEQ ID NO: 2552223 - DNA, 13 bp, Homo sapiens
taaagtcaggggt

SEQ ID NO: 2552224 - DNA, 16 bp, Homo sapiens
taaagtgataatttct

SEQ ID NO: 2552225 - DNA, 21 bp, Homo sapiens
taaagtgtatttttttactaa

SEQ ID NO: 2552226 - DNA, 22 bp, Homo sapiens
taaagtgtatttttttactaat

SEQ ID NO: 2552227 - DNA, 23 bp, Homo sapiens
taaagtgtatttttttactaata

SEQ ID NO: 2552228 - DNA, 18 bp, Homo sapiens
taaagtgtggtcccaaca

SEQ ID NO: 2552229 - DNA, 18 bp, Homo sapiens
taaagtgtgttgttgctt

SEQ ID NO: 2552230 - DNA, 17 bp, Homo sapiens
taaagttctgagtgttt

SEQ ID NO: 2552231 - DNA, 22 bp, Homo sapiens
taaataaaacattttcacacaa

SEQ ID NO: 2552232 - DNA, 15 bp, Homo sapiens
taaataaaagcagca

SEQ ID NO: 2552233 - DNA, 14 bp, Homo sapiens
taaataaagtatca

SEQ ID NO: 2552234 - DNA, 21 bp, Homo sapiens
taaataaagtatcatgcattc

SEQ ID NO: 2552235 - DNA, 16 bp, Homo sapiens
taaataaatgtcatta

SEQ ID NO: 2552236 - DNA, 20 bp, Homo sapiens
taaataagtttgcaatttgg

SEQ ID NO: 2552237 - DNA, 19 bp, Homo sapiens
taaataatgtgaaactgga

SEQ ID NO: 2552238 - DNA, 19 bp, Homo sapiens
taaatacacatagcatgta

SEQ ID NO: 2552239 - DNA, 13 bp, Homo sapiens
taaatacagtctt

SEQ ID NO: 2552240 - DNA, 22 bp, Homo sapiens
taaatacctcaacctatggtat

SEQ ID NO: 2552241 - DNA, 23 bp, Homo sapiens
taaatacctcttagctgagtgga

SEQ ID NO: 2552242 - DNA, 14 bp, Homo sapiens
taaatagctatatc

SEQ ID NO: 2552243 - DNA, 20 bp, Homo sapiens
taaatagctatatccatgta

SEQ ID NO: 2552244 - DNA, 22 bp, Homo sapiens
taaatagctatatccatgtact

SEQ ID NO: 2552245 - DNA, 22 bp, Homo sapiens
taaatatatttaagataattat

SEQ ID NO: 2552246 - DNA, 21 bp, Homo sapiens
taaatatgcctctcctttgta

SEQ ID NO: 2552247 - DNA, 13 bp, Homo sapiens
taaatattctata

SEQ ID NO: 2552248 - DNA, 21 bp, Homo sapiens
taaatatttacatatgaaatt

SEQ ID NO: 2552249 - DNA, 16 bp, Homo sapiens
taaatatttatgtaga

SEQ ID NO: 2552250 - DNA, 12 bp, Homo sapiens
taaatatttcaa

SEQ ID NO: 2552251 - DNA, 17 bp, Homo sapiens
taaatcctttttcttta

SEQ ID NO: 2552252 - DNA, 19 bp, Homo sapiens
taaatcgcttttgataatc

SEQ ID NO: 2552253 - DNA, 15 bp, Homo sapiens
taaatctagactcaa

SEQ ID NO: 2552254 - DNA, 21 bp, Homo sapiens
taaatctatgaagtatataat

SEQ ID NO: 2552255 - DNA, 14 bp, Homo sapiens
taaatctccaaaat

SEQ ID NO: 2552256 - DNA, 13 bp, Homo sapiens
taagaagctgttg

SEQ ID NO: 2552257 - DNA, 18 bp, Homo sapiens
taagaagctgttgtacat

SEQ ID NO: 2552258 - DNA, 15 bp, Homo sapiens
taagaatgaaatact

SEQ ID NO: 2552259 - DNA, 15 bp, Homo sapiens
taagaatgctggttt

SEQ ID NO: 2552260 - DNA, 22 bp, Homo sapiens
taagaatgctggttttcctaaa

SEQ ID NO: 2552261 - DNA, 12 bp, Homo sapiens
taagaattattt

SEQ ID NO: 2552262 - DNA, 14 bp, Homo sapiens
taagacactttttg

SEQ ID NO: 2552263 - DNA, 22 bp, Homo sapiens
taagacataacgtttttccttt

SEQ ID NO: 2552264 - DNA, 17 bp, Homo sapiens
taagaccaccacctcag

SEQ ID NO: 2552265 - DNA, 18 bp, Homo sapiens
taagaccaccacctcaga

SEQ ID NO: 2552266 - DNA, 13 bp, Homo sapiens
taagagaaagaaa

SEQ ID NO: 2552267 - DNA, 18 bp, Homo sapiens
taagagaaagaaaatgaa

SEQ ID NO: 2552268 - DNA, 21 bp, Homo sapiens
taagagacagtcaccccagga

SEQ ID NO: 2552269 - DNA, 17 bp, Homo sapiens
taagaggcagaaaattg

SEQ ID NO: 2552270 - DNA, 17 bp, Homo sapiens
taatcaatcatctgtgt

SEQ ID NO: 2552271 - DNA, 20 bp, Homo sapiens
taatcaatttaaacccattt

SEQ ID NO: 2552272 - DNA, 15 bp, Homo sapiens
taatcacgctttcct

SEQ ID NO: 2552273 - DNA, 18 bp, Homo sapiens
taatcacttttttccaca

SEQ ID NO: 2552274 - DNA, 11 bp, Homo sapiens
taatcagcctc

SEQ ID NO: 2552275 - DNA, 15 bp, Homo sapiens
taatcagcctcttaa

SEQ ID NO: 2552276 - DNA, 15 bp, Homo sapiens
taatcaggctgaggt

SEQ ID NO: 2552277 - DNA, 19 bp, Homo sapiens
taatcaggtcctcagagaa

SEQ ID NO: 2552278 - DNA, 17 bp, Homo sapiens
taatcagtgtctcacac

SEQ ID NO: 2552279 - DNA, 15 bp, Homo sapiens
taatcatataataaa

SEQ ID NO: 2552280 - DNA, 22 bp, Homo sapiens
taatcatataataaatgtacat

SEQ ID NO: 2552281 - DNA, 16 bp, Homo sapiens
taatcatctataaaga

SEQ ID NO: 2552282 - DNA, 17 bp, Homo sapiens
taatcatctataaagaa

SEQ ID NO: 2552283 - DNA, 16 bp, Homo sapiens
taatcatgaaattact

SEQ ID NO: 2552284 - DNA, 17 bp, Homo sapiens
taatcatgaatgtgtaa

SEQ ID NO: 2552285 - DNA, 20 bp, Homo sapiens
taatcattcttatttcatga

SEQ ID NO: 2552286 - DNA, 16 bp, Homo sapiens
taatcccagcactttg

SEQ ID NO: 2552287 - DNA, 19 bp, Homo sapiens
taatcccagcactttggga

SEQ ID NO: 2552288 - DNA, 23 bp, Homo sapiens
taatcctctcaaccacctttcag

SEQ ID NO: 2552289 - DNA, 19 bp, Homo sapiens
taatcgttatgtgtgtata

SEQ ID NO: 2552290 - DNA, 22 bp, Homo sapiens
taatctactccttgtaaagact

SEQ ID NO: 2552291 - DNA, 22 bp, Homo sapiens
taatctagaacacaggcaaaat

SEQ ID NO: 2552292 - DNA, 16 bp, Homo sapiens
taatctattgggttca

SEQ ID NO: 2552293 - DNA, 22 bp, Homo sapiens
taatctattgggttcattattg

SEQ ID NO: 2552294 - DNA, 17 bp, Homo sapiens
taatctatttctatgag

SEQ ID NO: 2552295 - DNA, 13 bp, Homo sapiens
taatctccacagt

SEQ ID NO: 2552296 - DNA, 15 bp, Homo sapiens
taatctcgtttcaaa

SEQ ID NO: 2552297 - DNA, 16 bp, Homo sapiens
taatctcgtttcaaaa

SEQ ID NO: 2552298 - DNA, 15 bp, Homo sapiens
taatctggactcctc

SEQ ID NO: 2552299 - DNA, 18 bp, Homo sapiens
taatctggactcctctgt

SEQ ID NO: 2552300 - DNA, 21 bp, Homo sapiens
taatctggactcctctgtcca

SEQ ID NO: 2552301 - DNA, 13 bp, Homo sapiens
taatctgtgtaca

SEQ ID NO: 2552302 - DNA, 14 bp, Homo sapiens
taatctgtgtacaa

SEQ ID NO: 2552303 - DNA, 16 bp, Homo sapiens
taatcttcagttttat

SEQ ID NO: 2552304 - DNA, 20 bp, Homo sapiens
taatcttcagttttatcttt

SEQ ID NO: 2552305 - DNA, 14 bp, Homo sapiens
taatcttctgcctt

SEQ ID NO: 2552306 - DNA, 18 bp, Homo sapiens
taatcttttcacaaataa

SEQ ID NO: 2552307 - DNA, 19 bp, Homo sapiens
taatgaaagactgtacaaa

SEQ ID NO: 2552308 - DNA, 15 bp, Homo sapiens
taatgagggactgga

SEQ ID NO: 2552309 - DNA, 17 bp, Homo sapiens
taatgatgtcgtttgaa

SEQ ID NO: 2552310 - DNA, 12 bp, Homo sapiens
taatgcactttc

SEQ ID NO: 2552311 - DNA, 14 bp, Homo sapiens
taatgcactttcta

SEQ ID NO: 2552312 - DNA, 16 bp, Homo sapiens
taatgcatgttaggaa

SEQ ID NO: 2552313 - DNA, 17 bp, Homo sapiens
taatgcatgttaggaaa

SEQ ID NO: 2552314 - DNA, 15 bp, Homo sapiens
taatgcgtgcatacc

SEQ ID NO: 2552315 - DNA, 20 bp, Homo sapiens
taatgctaaagaaaaagtca

SEQ ID NO: 2552316 - DNA, 17 bp, Homo sapiens
taatgctacgtgtgatt

SEQ ID NO: 2552317 - DNA, 18 bp, Homo sapiens
taatgctacgtgtgattt

SEQ ID NO: 2552318 - DNA, 20 bp, Homo sapiens
taatgcttagagaatgttct

SEQ ID NO: 2552319 - DNA, 15 bp, Homo sapiens
taatgggggtagcag

SEQ ID NO: 2552320 - DNA, 17 bp, Homo sapiens
taatggtaccagataaa

SEQ ID NO: 2552321 - DNA, 14 bp, Homo sapiens
taatggtcccatcc

SEQ ID NO: 2552322 - DNA, 15 bp, Homo sapiens
taatggtcccatcca

SEQ ID NO: 2552323 - DNA, 15 bp, Homo sapiens
taatggtttcaaaga

SEQ ID NO: 2552324 - DNA, 15 bp, Homo sapiens
taatggtttgaatat

SEQ ID NO: 2552325 - DNA, 17 bp, Homo sapiens
taatgtaagctctactg

SEQ ID NO: 2552326 - DNA, 18 bp, Homo sapiens
taatgtcacaggcaggtc

SEQ ID NO: 2552327 - DNA, 17 bp, Homo sapiens
taatgtcttcatttcat

SEQ ID NO: 2552328 - DNA, 19 bp, Homo sapiens
taatgtcttcatttcattg

SEQ ID NO: 2552329 - DNA, 12 bp, Homo sapiens
taatgtgaaact

SEQ ID NO: 2552330 - DNA, 13 bp, Homo sapiens
taatgtgatatta

SEQ ID NO: 2552331 - DNA, 13 bp, Homo sapiens
taatgtgctgtgt

SEQ ID NO: 2552332 - DNA, 16 bp, Homo sapiens
taatgtgctgtgtaaa

SEQ ID NO: 2552333 - DNA, 17 bp, Homo sapiens
taatgtgctgtgtaaag

SEQ ID NO: 2552334 - DNA, 20 bp, Homo sapiens
taatgtgctgtgtaaagtta

SEQ ID NO: 2552335 - DNA, 16 bp, Homo sapiens
taatgttaaatttgta

SEQ ID NO: 2552336 - DNA, 13 bp, Homo sapiens
taatgttactgat

SEQ ID NO: 2552337 - DNA, 14 bp, Homo sapiens
taatgttactgatc

SEQ ID NO: 2552338 - DNA, 20 bp, Homo sapiens
taatgttgtatgtcttgttt

SEQ ID NO: 2552339 - DNA, 22 bp, Homo sapiens
taattaaataaatcattaatac

SEQ ID NO: 2552340 - DNA, 21 bp, Homo sapiens
taattaatcatgaatgtgtaa

SEQ ID NO: 2552341 - DNA, 19 bp, Homo sapiens
taattaatgaaatatctgt

SEQ ID NO: 2552342 - DNA, 20 bp, Homo sapiens
taattaatgaaatatctgta

SEQ ID NO: 2552343 - DNA, 16 bp, Homo sapiens
taattaccaacctgtt

SEQ ID NO: 2552344 - DNA, 17 bp, Homo sapiens
taattaggggttgctaa

SEQ ID NO: 2552345 - DNA, 12 bp, Homo sapiens
taattattattc

SEQ ID NO: 2552346 - DNA, 17 bp, Homo sapiens
taattattatttatata

SEQ ID NO: 2552347 - DNA, 21 bp, Homo sapiens
taattattttggtacttttat

SEQ ID NO: 2552348 - DNA, 19 bp, Homo sapiens
taattcaaagcaccaaaat

SEQ ID NO: 2552349 - DNA, 16 bp, Homo sapiens
taattcaccaaagtat

SEQ ID NO: 2552350 - DNA, 22 bp, Homo sapiens
taattcagcactgatttcacaa

SEQ ID NO: 2552351 - DNA, 14 bp, Homo sapiens
taattcatgtttct

SEQ ID NO: 2552352 - DNA, 16 bp, Homo sapiens
taattccaatatgatg

SEQ ID NO: 2552353 - DNA, 20 bp, Homo sapiens
taattccaatatgatgactc

SEQ ID NO: 2552354 - DNA, 11 bp, Homo sapiens
taattccatga

SEQ ID NO: 2552355 - DNA, 19 bp, Homo sapiens
taattcccattttgcaaaa

SEQ ID NO: 2552356 - DNA, 20 bp, Homo sapiens
taattcccattttgcaaaat

SEQ ID NO: 2552357 - DNA, 20 bp, Homo sapiens
taattccctatcttttagtt

SEQ ID NO: 2552358 - DNA, 11 bp, Homo sapiens
taattctaaat

SEQ ID NO: 2552359 - DNA, 15 bp, Homo sapiens
taattctcaggccat

SEQ ID NO: 2552360 - DNA, 21 bp, Homo sapiens
taattctgtacatagcctata

SEQ ID NO: 2552361 - DNA, 18 bp, Homo sapiens
taattcttagctcattct

SEQ ID NO: 2552362 - DNA, 20 bp, Homo sapiens
taattcttcaccttaggaat

SEQ ID NO: 2552363 - DNA, 16 bp, Homo sapiens
taattcttgtatatta

SEQ ID NO: 2552364 - DNA, 19 bp, Homo sapiens
taattctttgacctgttgg

SEQ ID NO: 2552365 - DNA, 20 bp, Homo sapiens
taattgacaggattattgga

SEQ ID NO: 2552366 - DNA, 22 bp, Homo sapiens
taattgacaggattattggaaa

SEQ ID NO: 2552367 - DNA, 11 bp, Homo sapiens
taattgcactc

SEQ ID NO: 2552368 - DNA, 22 bp, Homo sapiens
taattgcattcatcttgtgttt

SEQ ID NO: 2552369 - DNA, 23 bp, Homo sapiens
taattgcttacatttttacaata

SEQ ID NO: 2552370 - DNA, 16 bp, Homo sapiens
taattgtataacaggt

SEQ ID NO: 2552371 - DNA, 17 bp, Homo sapiens
taattgtataacaggtt

SEQ ID NO: 2552372 - DNA, 15 bp, Homo sapiens
taattgtatcgtata

SEQ ID NO: 2552373 - DNA, 20 bp, Homo sapiens
taattgtatcgtatagctgt

SEQ ID NO: 2552374 - DNA, 16 bp, Homo sapiens
taattgttgtttcttt

SEQ ID NO: 2552375 - DNA, 19 bp, Homo sapiens
taattgttgtttctttcta

SEQ ID NO: 2552376 - DNA, 18 bp, Homo sapiens
taattgttgtttgtatgt

SEQ ID NO: 2552377 - DNA, 23 bp, Homo sapiens
taattgttgtttgtatgtataat

SEQ ID NO: 2552378 - DNA, 20 bp, Homo sapiens
taatttaaacaggcccagca

SEQ ID NO: 2552379 - DNA, 20 bp, Homo sapiens
taatttatgagtttttgata

SEQ ID NO: 2552380 - DNA, 18 bp, Homo sapiens
taatttattattgaaatt

SEQ ID NO: 2552381 - DNA, 18 bp, Homo sapiens
taatttatttattaagat

SEQ ID NO: 2552382 - DNA, 18 bp, Homo sapiens
taatttcaaaaatataac

SEQ ID NO: 2552383 - DNA, 20 bp, Homo sapiens
taatttcaaaaatataactt

SEQ ID NO: 2552384 - DNA, 21 bp, Homo sapiens
taatttcaaaaatataactta

SEQ ID NO: 2552385 - DNA, 17 bp, Homo sapiens
taatttcctggtgtgaa

SEQ ID NO: 2552386 - DNA, 16 bp, Homo sapiens
tacatttctgaaatga

SEQ ID NO: 2552387 - DNA, 14 bp, Homo sapiens
tacattttatatta

SEQ ID NO: 2552388 - DNA, 22 bp, Homo sapiens
tacatttttaagtgctgcattt

SEQ ID NO: 2552389 - DNA, 23 bp, Homo sapiens
tacatttttaagtgctgcattta

SEQ ID NO: 2552390 - DNA, 14 bp, Homo sapiens
tacatttttacaat

SEQ ID NO: 2552391 - DNA, 17 bp, Homo sapiens
tacatttttacaataaa

SEQ ID NO: 2552392 - DNA, 19 bp, Homo sapiens
tacatttttacaataaata

SEQ ID NO: 2552393 - DNA, 21 bp, Homo sapiens
tacatttttacaataaataat

SEQ ID NO: 2552394 - DNA, 23 bp, Homo sapiens
taccaaaattatttcagaaatgt

SEQ ID NO: 2552395 - DNA, 16 bp, Homo sapiens
taccaagtttcaggta

SEQ ID NO: 2552396 - DNA, 15 bp, Homo sapiens
taccaatcattttaa

SEQ ID NO: 2552397 - DNA, 19 bp, Homo sapiens
taccaatcattttaattat

SEQ ID NO: 2552398 - DNA, 17 bp, Homo sapiens
taccaatgaaaaaatgt

SEQ ID NO: 2552399 - DNA, 12 bp, Homo sapiens
taccaatgcatg

SEQ ID NO: 2552400 - DNA, 14 bp, Homo sapiens
taccaccccttcct

SEQ ID NO: 2552401 - DNA, 16 bp, Homo sapiens
taccaccccttcctgt

SEQ ID NO: 2552402 - DNA, 21 bp, Homo sapiens
taccagacggttcaccagcct

SEQ ID NO: 2552403 - DNA, 21 bp, Homo sapiens
taccagcctccgtatttcaga

SEQ ID NO: 2552404 - DNA, 17 bp, Homo sapiens
taccagcgcccgctggg

SEQ ID NO: 2552405 - DNA, 20 bp, Homo sapiens
taccagcgcccgctgggctg

SEQ ID NO: 2552406 - DNA, 14 bp, Homo sapiens
taccaggttgaaag

SEQ ID NO: 2552407 - DNA, 18 bp, Homo sapiens
taccatcagggacaggat

SEQ ID NO: 2552408 - DNA, 16 bp, Homo sapiens
taccatgtgcctgatc

SEQ ID NO: 2552409 - DNA, 18 bp, Homo sapiens
tacccacacctctgccag

SEQ ID NO: 2552410 - DNA, 12 bp, Homo sapiens
tacccaccccca

SEQ ID NO: 2552411 - DNA, 15 bp, Homo sapiens
tacccacccccaccc

SEQ ID NO: 2552412 - DNA, 19 bp, Homo sapiens
tacccacccccacccaagg

SEQ ID NO: 2552413 - DNA, 20 bp, Homo sapiens
tacccacgttctcacaccca

SEQ ID NO: 2552414 - DNA, 11 bp, Homo sapiens
tacccactgct

SEQ ID NO: 2552415 - DNA, 12 bp, Homo sapiens
tacccactgctc

SEQ ID NO: 2552416 - DNA, 14 bp, Homo sapiens
tacccactgctctg

SEQ ID NO: 2552417 - DNA, 18 bp, Homo sapiens
tacccagagaagcccctt

SEQ ID NO: 2552418 - DNA, 15 bp, Homo sapiens
tacccagagaatata

SEQ ID NO: 2552419 - DNA, 18 bp, Homo sapiens
tacccagccatctgccca

SEQ ID NO: 2552420 - DNA, 19 bp, Homo sapiens
tacccagccatctgcccag

SEQ ID NO: 2552421 - DNA, 20 bp, Homo sapiens
tacccagccatctgcccagg

SEQ ID NO: 2552422 - DNA, 17 bp, Homo sapiens
taccccaattccttgta

SEQ ID NO: 2552423 - DNA, 13 bp, Homo sapiens
taccccaccctca

SEQ ID NO: 2552424 - DNA, 23 bp, Homo sapiens
taccccaccctcagcaccccttc

SEQ ID NO: 2552425 - DNA, 16 bp, Homo sapiens
taccccctaagagcca

SEQ ID NO: 2552426 - DNA, 23 bp, Homo sapiens
taccctcaggcataggcctgggt

SEQ ID NO: 2552427 - DNA, 13 bp, Homo sapiens
taccctcccaccc

SEQ ID NO: 2552428 - DNA, 13 bp, Homo sapiens
gccctggccctga

SEQ ID NO: 2552429 - DNA, 18 bp, Homo sapiens
gccctggccctgaggtgt

SEQ ID NO: 2552430 - DNA, 15 bp, Homo sapiens
gccctggctgaagga

SEQ ID NO: 2552431 - DNA, 19 bp, Homo sapiens
gccctggctgaaggactgt

SEQ ID NO: 2552432 - DNA, 19 bp, Homo sapiens
gccctgggctcggaggctg

SEQ ID NO: 2552433 - DNA, 17 bp, Homo sapiens
gccctggtccagggaag

SEQ ID NO: 2552434 - DNA, 18 bp, Homo sapiens
gccctggtccttccaggc

SEQ ID NO: 2552435 - DNA, 16 bp, Homo sapiens
gccctggtctcagcag

SEQ ID NO: 2552436 - DNA, 14 bp, Homo sapiens
gccctggtggagaa

SEQ ID NO: 2552437 - DNA, 19 bp, Homo sapiens
gccctggtggcagtgggag

SEQ ID NO: 2552438 - DNA, 18 bp, Homo sapiens
gccctggtgtttctagca

SEQ ID NO: 2552439 - DNA, 14 bp, Homo sapiens
gccctgtcagtgca

SEQ ID NO: 2552440 - DNA, 23 bp, Homo sapiens
gccctgtggaagggactaggagc

SEQ ID NO: 2552441 - DNA, 16 bp, Homo sapiens
gccctgtgggccccca

SEQ ID NO: 2552442 - DNA, 17 bp, Homo sapiens
gccctgttaaaagatga

SEQ ID NO: 2552443 - DNA, 18 bp, Homo sapiens
gcccttattttcaagaaa

SEQ ID NO: 2552444 - DNA, 16 bp, Homo sapiens
gcccttcccactggag

SEQ ID NO: 2552445 - DNA, 16 bp, Homo sapiens
gcccttccctgtccct

SEQ ID NO: 2552446 - DNA, 22 bp, Homo sapiens
gcccttctctccagcccctgga

SEQ ID NO: 2552447 - DNA, 17 bp, Homo sapiens
gcccttgagctccccaa

SEQ ID NO: 2552448 - DNA, 18 bp, Homo sapiens
gcccttgagctccccaaa

SEQ ID NO: 2552449 - DNA, 14 bp, Homo sapiens
gcccttgccctgac

SEQ ID NO: 2552450 - DNA, 18 bp, Homo sapiens
gcccttgccctgacctcc

SEQ ID NO: 2552451 - DNA, 24 bp, Homo sapiens
gcccttgtcccactcaagccaagc

SEQ ID NO: 2552452 - DNA, 18 bp, Homo sapiens
gccctttgagtgcagtcc

SEQ ID NO: 2552453 - DNA, 17 bp, Homo sapiens
gccctttgggaggctga

SEQ ID NO: 2552454 - DNA, 15 bp, Homo sapiens
gccgaatgccctcag

SEQ ID NO: 2552455 - DNA, 14 bp, Homo sapiens
gccgaatgtgcagg

SEQ ID NO: 2552456 - DNA, 11 bp, Homo sapiens
gccgacctcag

SEQ ID NO: 2552457 - DNA, 20 bp, Homo sapiens
gctaattcccagagtgtgaa

SEQ ID NO: 2552458 - DNA, 22 bp, Homo sapiens
gctaattctttgacctgttggg

SEQ ID NO: 2552459 - DNA, 16 bp, Homo sapiens
gctaatttttcatttt

SEQ ID NO: 2552460 - DNA, 14 bp, Homo sapiens
gctacaaagaagac

SEQ ID NO: 2552461 - DNA, 17 bp, Homo sapiens
gctacaaagaagacatg

SEQ ID NO: 2552462 - DNA, 15 bp, Homo sapiens
gctacaacttcagca

SEQ ID NO: 2552463 - DNA, 20 bp, Homo sapiens
gctacacactgcatgtttgt

SEQ ID NO: 2552464 - DNA, 23 bp, Homo sapiens
gctacaggaagcaccccatgcca

SEQ ID NO: 2552465 - DNA, 16 bp, Homo sapiens
gctacaggttacaaca

SEQ ID NO: 2552466 - DNA, 18 bp, Homo sapiens
gctacaggttacaacaga

SEQ ID NO: 2552467 - DNA, 19 bp, Homo sapiens
gctacaggttacaacagat

SEQ ID NO: 2552468 - DNA, 21 bp, Homo sapiens
gctacccgggaagggggctgg

SEQ ID NO: 2552469 - DNA, 14 bp, Homo sapiens
gctaccctgagctg

SEQ ID NO: 2552470 - DNA, 16 bp, Homo sapiens
gctaccctgagctgag

SEQ ID NO: 2552471 - DNA, 20 bp, Homo sapiens
gctaccctgagctgaggcag

SEQ ID NO: 2552472 - DNA, 16 bp, Homo sapiens
gctaccctttttctcc

SEQ ID NO: 2552473 - DNA, 19 bp, Homo sapiens
gctaccctttttctccagc

SEQ ID NO: 2552474 - DNA, 13 bp, Homo sapiens
gctacctcaaggg

SEQ ID NO: 2552475 - DNA, 20 bp, Homo sapiens
gctaccttgtgacccagcac

SEQ ID NO: 2552476 - DNA, 21 bp, Homo sapiens
gctaccttgtgacccagcact

SEQ ID NO: 2552477 - DNA, 16 bp, Homo sapiens
gctacctttgtattct

SEQ ID NO: 2552478 - DNA, 15 bp, Homo sapiens
gctacgtgtgatttt

SEQ ID NO: 2552479 - DNA, 17 bp, Homo sapiens
gctacgtgtgatttttc

SEQ ID NO: 2552480 - DNA, 19 bp, Homo sapiens
gctacgtgtgatttttctg

SEQ ID NO: 2552481 - DNA, 20 bp, Homo sapiens
gctacgtgtgatttttctgg

SEQ ID NO: 2552482 - DNA, 16 bp, Homo sapiens
gctactcaagaggctg

SEQ ID NO: 2552483 - DNA, 17 bp, Homo sapiens
gctactcaagaggctga

SEQ ID NO: 2552484 - DNA, 16 bp, Homo sapiens
gctactcagaagcctg

SEQ ID NO: 2552485 - DNA, 17 bp, Homo sapiens
gctactcagaagcctga

SEQ ID NO: 2552486 - DNA, 17 bp, Homo sapiens
gctactctgttccttca

SEQ ID NO: 2552487 - DNA, 18 bp, Homo sapiens
gctactgcagctttacat

SEQ ID NO: 2552488 - DNA, 15 bp, Homo sapiens
gctactgtcagctcc

SEQ ID NO: 2552489 - DNA, 16 bp, Homo sapiens
gctactgtctcactga

SEQ ID NO: 2552490 - DNA, 21 bp, Homo sapiens
gctacttaattcctttctcat

SEQ ID NO: 2552491 - DNA, 23 bp, Homo sapiens
gctacttaattcctttctcatcc

SEQ ID NO: 2552492 - DNA, 21 bp, Homo sapiens
gctactttatttatacactgt

SEQ ID NO: 2552493 - DNA, 16 bp, Homo sapiens
gctactttgccttttg

SEQ ID NO: 2552494 - DNA, 18 bp, Homo sapiens
gctagaaccaagaagggc

SEQ ID NO: 2552495 - DNA, 18 bp, Homo sapiens
gctagaacctggaagggc

SEQ ID NO: 2552496 - DNA, 19 bp, Homo sapiens
gctagaacctggaagggct

SEQ ID NO: 2552497 - DNA, 15 bp, Homo sapiens
gctagaacctggagg

SEQ ID NO: 2552498 - DNA, 14 bp, Homo sapiens
gctagaagctggag

SEQ ID NO: 2552499 - DNA, 15 bp, Homo sapiens
gctagaagctggagg

SEQ ID NO: 2552500 - DNA, 19 bp, Homo sapiens
gctagaatctggagagcta

SEQ ID NO: 2552501 - DNA, 15 bp, Homo sapiens
gctagacacccattt

SEQ ID NO: 2552502 - DNA, 19 bp, Homo sapiens
gctagaggccagccccacc

SEQ ID NO: 2552503 - DNA, 20 bp, Homo sapiens
gctagaggccagccccaccc

SEQ ID NO: 2552504 - DNA, 16 bp, Homo sapiens
gctagaggcctgagga

SEQ ID NO: 2552505 - DNA, 18 bp, Homo sapiens
gctagagtcctcactccc

SEQ ID NO: 2552506 - DNA, 23 bp, Homo sapiens
gctagcagaaatctagaagactg

SEQ ID NO: 2552507 - DNA, 18 bp, Homo sapiens
gctagctcccctcctctc

SEQ ID NO: 2552508 - DNA, 22 bp, Homo sapiens
gctagctcccctcctctcccct

SEQ ID NO: 2552509 - DNA, 16 bp, Homo sapiens
gctaggaacactcctt

SEQ ID NO: 2552510 - DNA, 18 bp, Homo sapiens
gctaggaacactccttca

SEQ ID NO: 2552511 - DNA, 22 bp, Homo sapiens
gctaggacccctccatgtgggc

SEQ ID NO: 2552512 - DNA, 16 bp, Homo sapiens
gctaggcgagtgccag

SEQ ID NO: 2552513 - DNA, 19 bp, Homo sapiens
gctaggcgagtgccaggac

SEQ ID NO: 2552514 - DNA, 20 bp, Homo sapiens
gctaggcgagtgccaggact

SEQ ID NO: 2552515 - DNA, 21 bp, Homo sapiens
gctaggcgagtgccaggactc

SEQ ID NO: 2552516 - DNA, 15 bp, Homo sapiens
gctagggtggccctt

SEQ ID NO: 2552517 - DNA, 17 bp, Homo sapiens
gctaggtgggccagccc

SEQ ID NO: 2552518 - DNA, 18 bp, Homo sapiens
gctaggtgggccagcccc

SEQ ID NO: 2552519 - DNA, 21 bp, Homo sapiens
gctaggtgggccagcccctcc

SEQ ID NO: 2552520 - DNA, 16 bp, Homo sapiens
gctagtatcaaaagaa

SEQ ID NO: 2552521 - DNA, 14 bp, Homo sapiens
gctagttgggcttc

SEQ ID NO: 2552522 - DNA, 21 bp, Homo sapiens
gctagttgggcttcctcatag

SEQ ID NO: 2552523 - DNA, 13 bp, Homo sapiens
gctataaatatat

SEQ ID NO: 2552524 - DNA, 20 bp, Homo sapiens
gctataactatgttgataaa

SEQ ID NO: 2552525 - DNA, 21 bp, Homo sapiens
gctatactgcatactttttaa

SEQ ID NO: 2552526 - DNA, 23 bp, Homo sapiens
gctatagacccgaggaaactcag

SEQ ID NO: 2552527 - DNA, 17 bp, Homo sapiens
gctatagctcaggacct

SEQ ID NO: 2552528 - DNA, 21 bp, Homo sapiens
gctataggtgctacaaaaaca

SEQ ID NO: 2552529 - DNA, 17 bp, Homo sapiens
gctatatccatgtactg

SEQ ID NO: 2552530 - DNA, 23 bp, Homo sapiens
gctatatccatgtactgtagttt

SEQ ID NO: 2552531 - DNA, 14 bp, Homo sapiens
gctatctcccccag

SEQ ID NO: 2552532 - DNA, 22 bp, Homo sapiens
gctatctcccccagccccatcc

SEQ ID NO: 2552533 - DNA, 23 bp, Homo sapiens
gctatctcccccagccccatcct

SEQ ID NO: 2552534 - DNA, 17 bp, Homo sapiens
gctatgatcgcgccact

SEQ ID NO: 2552535 - DNA, 18 bp, Homo sapiens
gctatgggagccccaggg

SEQ ID NO: 2552536 - DNA, 21 bp, Homo sapiens
gctatggggatagatgtgtgg

SEQ ID NO: 2552537 - DNA, 15 bp, Homo sapiens
gctatggtgagatgc

SEQ ID NO: 2552538 - DNA, 22 bp, Homo sapiens
gctatgtatggaatacagtgtt

SEQ ID NO: 2552539 - DNA, 17 bp, Homo sapiens
gctattagccaggatca

SEQ ID NO: 2552540 - DNA, 20 bp, Homo sapiens
gctattcagtaataactcta

SEQ ID NO: 2552541 - DNA, 16 bp, Homo sapiens
gctattgtaaatatgt

SEQ ID NO: 2552542 - DNA, 18 bp, Homo sapiens
gctatttccattccagaa

SEQ ID NO: 2552543 - DNA, 15 bp, Homo sapiens
gctatttttatggaa

SEQ ID NO: 2552544 - DNA, 16 bp, Homo sapiens
gctatttttccccctg

SEQ ID NO: 2552545 - DNA, 15 bp, Homo sapiens
gctcaaaaaatgagc

SEQ ID NO: 2552546 - DNA, 23 bp, Homo sapiens
gctcaaatctattcagacaagca

SEQ ID NO: 2552547 - DNA, 15 bp, Homo sapiens
gctcaagcagcgacc

SEQ ID NO: 2552548 - DNA, 21 bp, Homo sapiens
gctcaagcagcgaccgccccc

SEQ ID NO: 2552549 - DNA, 22 bp, Homo sapiens
gctcaagtcctcttttctgaga

SEQ ID NO: 2552550 - DNA, 22 bp, Homo sapiens
gctcaatattcctgaatgaaat

SEQ ID NO: 2552551 - DNA, 20 bp, Homo sapiens
gctcaatccatgttctattt

SEQ ID NO: 2552552 - DNA, 16 bp, Homo sapiens
gctcacatatctgtca

SEQ ID NO: 2552553 - DNA, 18 bp, Homo sapiens
gctcaccagccccagtgc

SEQ ID NO: 2552554 - DNA, 19 bp, Homo sapiens
gctcaccagccccagtgcc

SEQ ID NO: 2552555 - DNA, 23 bp, Homo sapiens
gctcaccagccccagtgcccaca

SEQ ID NO: 2552556 - DNA, 19 bp, Homo sapiens
gctcaccccccacactcac

SEQ ID NO: 2552557 - DNA, 20 bp, Homo sapiens
gctcacccccttctccatcc

SEQ ID NO: 2552558 - DNA, 11 bp, Homo sapiens
gctcacctggg

SEQ ID NO: 2552559 - DNA, 22 bp, Homo sapiens
gctcacctggggtgtgggaggc

SEQ ID NO: 2552560 - DNA, 15 bp, Homo sapiens
gctcacctgttgctt

SEQ ID NO: 2552561 - DNA, 21 bp, Homo sapiens
gctcacgcctgtaatcccagc

SEQ ID NO: 2552562 - DNA, 22 bp, Homo sapiens
gctcacgcctgtaatcccagca

SEQ ID NO: 2552563 - DNA, 14 bp, Homo sapiens
gctcacgtcacact

SEQ ID NO: 2552564 - DNA, 15 bp, Homo sapiens
gctcacgtcacactt

SEQ ID NO: 2552565 - DNA, 16 bp, Homo sapiens
gctcactatgaatcta

SEQ ID NO: 2552566 - DNA, 15 bp, Homo sapiens
gctcactgcagcctc

SEQ ID NO: 2552567 - DNA, 17 bp, Homo sapiens
gctcactgtggtgtctg

SEQ ID NO: 2552568 - DNA, 18 bp, Homo sapiens
gctcactgtggtgtctgt

SEQ ID NO: 2552569 - DNA, 16 bp, Homo sapiens
gctcagaccagctctt

SEQ ID NO: 2552570 - DNA, 13 bp, Homo sapiens
gctcagagagggc

SEQ ID NO: 2552571 - DNA, 18 bp, Homo sapiens
gctcagagagggtgggag

SEQ ID NO: 2552572 - DNA, 22 bp, Homo sapiens
gctcagcaaaagatgcttctca

SEQ ID NO: 2552573 - DNA, 18 bp, Homo sapiens
gctcagcccacccccctc

SEQ ID NO: 2552574 - DNA, 15 bp, Homo sapiens
gctcagcctggtggg

SEQ ID NO: 2552575 - DNA, 19 bp, Homo sapiens
gctcagcggggacagctcc

SEQ ID NO: 2552576 - DNA, 13 bp, Homo sapiens
gctcaggaaaacg

SEQ ID NO: 2552577 - DNA, 14 bp, Homo sapiens
gctcaggaccaggc

SEQ ID NO: 2552578 - DNA, 16 bp, Homo sapiens
gctcaggaggcttgga

SEQ ID NO: 2552579 - DNA, 17 bp, Homo sapiens
gctcaggaggcttggaa

SEQ ID NO: 2552580 - DNA, 13 bp, Homo sapiens
gctcaggagtttg

SEQ ID NO: 2552581 - DNA, 17 bp, Homo sapiens
gctcagggaaaagcagc

SEQ ID NO: 2552582 - DNA, 21 bp, Homo sapiens
gctcaggtggggtcactctgg

SEQ ID NO: 2552583 - DNA, 16 bp, Homo sapiens
gctcaggtgtccctgc

SEQ ID NO: 2552584 - DNA, 21 bp, Homo sapiens
gctcagtaatttgaggacaac

SEQ ID NO: 2552585 - DNA, 12 bp, Homo sapiens
gctcagtcccat

SEQ ID NO: 2552586 - DNA, 17 bp, Homo sapiens
gctcagtctcaggagca

SEQ ID NO: 2552587 - DNA, 14 bp, Homo sapiens
gctcagtctccctt

SEQ ID NO: 2552588 - DNA, 23 bp, Homo sapiens
gctcagttgtagaatgtattgta

SEQ ID NO: 2552589 - DNA, 20 bp, Homo sapiens
gctcatacaggaatgaagcc

SEQ ID NO: 2552590 - DNA, 14 bp, Homo sapiens
gctcatattttgta

SEQ ID NO: 2552591 - DNA, 16 bp, Homo sapiens
gctcatcattctctgt

SEQ ID NO: 2552592 - DNA, 22 bp, Homo sapiens
gctcatctctgtcccacttggc

SEQ ID NO: 2552593 - DNA, 15 bp, Homo sapiens
gctcattttttctta

SEQ ID NO: 2552594 - DNA, 13 bp, Homo sapiens
gctccaaaccctc

SEQ ID NO: 2552595 - DNA, 18 bp, Homo sapiens
gctccaaaccctcgaggc

SEQ ID NO: 2552596 - DNA, 19 bp, Homo sapiens
gctccagcaccatccgcca

SEQ ID NO: 2552597 - DNA, 23 bp, Homo sapiens
gctccagccaacccctgtggagc

SEQ ID NO: 2552598 - DNA, 14 bp, Homo sapiens
gctccagctcacca

SEQ ID NO: 2552599 - DNA, 18 bp, Homo sapiens
gctccagctcaccagccc

SEQ ID NO: 2552600 - DNA, 21 bp, Homo sapiens
gctccagctcaccagccccag

SEQ ID NO: 2552601 - DNA, 20 bp, Homo sapiens
gctccagctgctctgtcttc

SEQ ID NO: 2552602 - DNA, 21 bp, Homo sapiens
gctccagctgctctgtcttct

SEQ ID NO: 2552603 - DNA, 20 bp, Homo sapiens
gctccagctgttcagctggt

SEQ ID NO: 2552604 - DNA, 11 bp, Homo sapiens
gctccaggagc

SEQ ID NO: 2552605 - DNA, 15 bp, Homo sapiens
gctccaggagcagcc

SEQ ID NO: 2552606 - DNA, 16 bp, Homo sapiens
gctccaggagcagcca

SEQ ID NO: 2552607 - DNA, 16 bp, Homo sapiens
gctccaggctccttta

SEQ ID NO: 2552608 - DNA, 24 bp, Homo sapiens
gctccaggctcctttagcgcccag

SEQ ID NO: 2552609 - DNA, 15 bp, Homo sapiens
gctccaggtggctct

SEQ ID NO: 2552610 - DNA, 18 bp, Homo sapiens
gctccagtctgctgccct

SEQ ID NO: 2552611 - DNA, 20 bp, Homo sapiens
gctccatgtgccccctctac

SEQ ID NO: 2552612 - DNA, 17 bp, Homo sapiens
gctcccacaggcagctt

SEQ ID NO: 2552613 - DNA, 11 bp, Homo sapiens
gctcccaggcc

SEQ ID NO: 2552614 - DNA, 16 bp, Homo sapiens
gctccccagcccaggg

SEQ ID NO: 2552615 - DNA, 15 bp, Homo sapiens
gctccccagccctgg

SEQ ID NO: 2552616 - DNA, 19 bp, Homo sapiens
gctccccagccctggctct

SEQ ID NO: 2552617 - DNA, 14 bp, Homo sapiens
gctcccccatcctc

SEQ ID NO: 2552618 - DNA, 16 bp, Homo sapiens
gctcccccatcctccc

SEQ ID NO: 2552619 - DNA, 20 bp, Homo sapiens
gctcccccatcctccccttc

SEQ ID NO: 2552620 - DNA, 18 bp, Homo sapiens
gctcccctcctctcccct

SEQ ID NO: 2552621 - DNA, 16 bp, Homo sapiens
gctccctaccacctcc

SEQ ID NO: 2552622 - DNA, 19 bp, Homo sapiens
gctccctcttggtcttccc

SEQ ID NO: 2552623 - DNA, 21 bp, Homo sapiens
gctcccttcatctccagggag

SEQ ID NO: 2552624 - DNA, 18 bp, Homo sapiens
gctcccttccacctgtca

SEQ ID NO: 2552625 - DNA, 16 bp, Homo sapiens
gctcccttctctgtag

SEQ ID NO: 2552626 - DNA, 18 bp, Homo sapiens
gctccgctttctacccag

SEQ ID NO: 2552627 - DNA, 15 bp, Homo sapiens
gctccgtgcctccac

SEQ ID NO: 2552628 - DNA, 22 bp, Homo sapiens
gctcctaacccttatcaccagc

SEQ ID NO: 2552629 - DNA, 14 bp, Homo sapiens
gctcctagcagaga

SEQ ID NO: 2552630 - DNA, 17 bp, Homo sapiens
gctcctccctggctgcc

SEQ ID NO: 2552631 - DNA, 19 bp, Homo sapiens
gctcctccctggctgccct

SEQ ID NO: 2552632 - DNA, 15 bp, Homo sapiens
gctcctcgagggcag

SEQ ID NO: 2552633 - DNA, 20 bp, Homo sapiens
gctcctcgagggcagggact

SEQ ID NO: 2552634 - DNA, 15 bp, Homo sapiens
gctcctctccaggca

SEQ ID NO: 2552635 - DNA, 17 bp, Homo sapiens
gctcctctccaggcacc

SEQ ID NO: 2552636 - DNA, 21 bp, Homo sapiens
gctcctgaggggcatctgccc

SEQ ID NO: 2552637 - DNA, 22 bp, Homo sapiens
gctcctgaggggcatctgcccc

SEQ ID NO: 2552638 - DNA, 23 bp, Homo sapiens
gctcctgaggggcatctgcccct

SEQ ID NO: 2552639 - DNA, 17 bp, Homo sapiens
gctcctgccttctgtcc

SEQ ID NO: 2552640 - DNA, 18 bp, Homo sapiens
gctcctggagcctttgaa

SEQ ID NO: 2552641 - DNA, 19 bp, Homo sapiens
gctcctggagcctttgaat

SEQ ID NO: 2552642 - DNA, 18 bp, Homo sapiens
gctcctggcccactgcat

SEQ ID NO: 2552643 - DNA, 17 bp, Homo sapiens
gctcctgtctgccagcc

SEQ ID NO: 2552644 - DNA, 21 bp, Homo sapiens
gctcctgtgctactttgcctt

SEQ ID NO: 2552645 - DNA, 22 bp, Homo sapiens
gctcctgtgctttccctgaact

SEQ ID NO: 2552646 - DNA, 13 bp, Homo sapiens
gctcctgtgtctt

SEQ ID NO: 2552647 - DNA, 13 bp, Homo sapiens
gctccttcccatc

SEQ ID NO: 2552648 - DNA, 21 bp, Homo sapiens
gctccttctctcttacattga

SEQ ID NO: 2552649 - DNA, 17 bp, Homo sapiens
gctcctttagcgcccag

SEQ ID NO: 2552650 - DNA, 17 bp, Homo sapiens
gctcctttctccagcca

SEQ ID NO: 2552651 - DNA, 18 bp, Homo sapiens
gctcctttctccagccag

SEQ ID NO: 2552652 - DNA, 19 bp, Homo sapiens
gctcctttctccagccagc

SEQ ID NO: 2552653 - DNA, 20 bp, Homo sapiens
gctcctttctccagccagca

SEQ ID NO: 2552654 - DNA, 19 bp, Homo sapiens
gctcctttttctccctctg

SEQ ID NO: 2552655 - DNA, 14 bp, Homo sapiens
gctcgaaaacaatt

SEQ ID NO: 2552656 - DNA, 20 bp, Homo sapiens
gctcgagcagtcctgcctca

SEQ ID NO: 2552657 - DNA, 21 bp, Homo sapiens
gctcgcctcaggaatgggctg

SEQ ID NO: 2552658 - DNA, 14 bp, Homo sapiens
gctcggaggctgcc

SEQ ID NO: 2552659 - DNA, 15 bp, Homo sapiens
gctcgtgtatcctgg

SEQ ID NO: 2552660 - DNA, 17 bp, Homo sapiens
gctcgtgtatcctgggg

SEQ ID NO: 2552661 - DNA, 20 bp, Homo sapiens
gctctacatcttctgcctta

SEQ ID NO: 2552662 - DNA, 14 bp, Homo sapiens
gctctagtgggaag

SEQ ID NO: 2552663 - DNA, 13 bp, Homo sapiens
gctctcagaagcc

SEQ ID NO: 2552664 - DNA, 12 bp, Homo sapiens
gctctcagaagg

SEQ ID NO: 2552665 - DNA, 10 bp, Homo sapiens
gctctcagcc

SEQ ID NO: 2552666 - DNA, 11 bp, Homo sapiens
gctctcagcca

SEQ ID NO: 2552667 - DNA, 17 bp, Homo sapiens
gctctcagccaacgagt

SEQ ID NO: 2552668 - DNA, 16 bp, Homo sapiens
gctctcagctcagcgc

SEQ ID NO: 2552669 - DNA, 22 bp, Homo sapiens
gctctcagttccgatttcccag

SEQ ID NO: 2552670 - DNA, 18 bp, Homo sapiens
gctctccaagtctcagtg

SEQ ID NO: 2552671 - DNA, 13 bp, Homo sapiens
gctctccaagtgc

SEQ ID NO: 2552672 - DNA, 16 bp, Homo sapiens
gctctccaagtgccag

SEQ ID NO: 2552673 - DNA, 20 bp, Homo sapiens
gctctccaagtgccagaggt

SEQ ID NO: 2552674 - DNA, 19 bp, Homo sapiens
gctctcccctgccctgctg

SEQ ID NO: 2552675 - DNA, 24 bp, Homo sapiens
gctctccctcttctcaagtgcctt

SEQ ID NO: 2552676 - DNA, 18 bp, Homo sapiens
gctctctggccttttcct

SEQ ID NO: 2552677 - DNA, 19 bp, Homo sapiens
gctctctggccttttccta

SEQ ID NO: 2552678 - DNA, 22 bp, Homo sapiens
gctctgaagtcacatcacagga

SEQ ID NO: 2552679 - DNA, 23 bp, Homo sapiens
gctctgaagtcacatcacaggac

SEQ ID NO: 2552680 - DNA, 21 bp, Homo sapiens
gctctgagcaaatgtggctcc

SEQ ID NO: 2552681 - DNA, 18 bp, Homo sapiens
gctctgaggcttccagag

SEQ ID NO: 2552682 - DNA, 20 bp, Homo sapiens
gctctgatcatccactgtgc

SEQ ID NO: 2552683 - DNA, 22 bp, Homo sapiens
gctctgatcatccactgtgcca

SEQ ID NO: 2552684 - DNA, 22 bp, Homo sapiens
gctctgatccctctacagagct

SEQ ID NO: 2552685 - DNA, 18 bp, Homo sapiens
gctctgcaattcccctct

SEQ ID NO: 2552686 - DNA, 11 bp, Homo sapiens
gctctgcacag

SEQ ID NO: 2552687 - DNA, 13 bp, Homo sapiens
gctctgcacagat

SEQ ID NO: 2552688 - DNA, 14 bp, Homo sapiens
gctctgcacagatg

SEQ ID NO: 2552689 - DNA, 11 bp, Homo sapiens
gctctgcatgc

SEQ ID NO: 2552690 - DNA, 15 bp, Homo sapiens
gctctgcatgcggcc

SEQ ID NO: 2552691 - DNA, 17 bp, Homo sapiens
gctctgcatgcggccca

SEQ ID NO: 2552692 - DNA, 18 bp, Homo sapiens
gctctgcatgcggcccag

SEQ ID NO: 2552693 - DNA, 20 bp, Homo sapiens
gctctgcatgcggcccagcc

SEQ ID NO: 2552694 - DNA, 13 bp, Homo sapiens
gctctgccccagc

SEQ ID NO: 2552695 - DNA, 15 bp, Homo sapiens
gctctgccccagctc

SEQ ID NO: 2552696 - DNA, 13 bp, Homo sapiens
gctctgccctgcc

SEQ ID NO: 2552697 - DNA, 11 bp, Homo sapiens
gctctgccctt

SEQ ID NO: 2552698 - DNA, 13 bp, Homo sapiens
gctctgcccttgg

SEQ ID NO: 2552699 - DNA, 22 bp, Homo sapiens
gctctgcctcccatcacccgct

SEQ ID NO: 2552700 - DNA, 17 bp, Homo sapiens
gctctgcgtgtcacctg

SEQ ID NO: 2552701 - DNA, 14 bp, Homo sapiens
gctctgctgacaga

SEQ ID NO: 2552702 - DNA, 18 bp, Homo sapiens
gctctgctgacagacaca

SEQ ID NO: 2552703 - DNA, 20 bp, Homo sapiens
gctctgctgacagacacagg

SEQ ID NO: 2552704 - DNA, 18 bp, Homo sapiens
gctctgctggcctggccg

SEQ ID NO: 2552705 - DNA, 21 bp, Homo sapiens
gctctgctggcctggccggca

SEQ ID NO: 2552706 - DNA, 15 bp, Homo sapiens
gctctggacaggcat

SEQ ID NO: 2552707 - DNA, 11 bp, Homo sapiens
gctctggacca

SEQ ID NO: 2552708 - DNA, 22 bp, Homo sapiens
gctctggaccaaccctgtttcc

SEQ ID NO: 2552709 - DNA, 17 bp, Homo sapiens
gctctggaccagcctgt

SEQ ID NO: 2552710 - DNA, 15 bp, Homo sapiens
gctctggctgaaccc

SEQ ID NO: 2552711 - DNA, 16 bp, Homo sapiens
gctctggctgaaccct

SEQ ID NO: 2552712 - DNA, 20 bp, Homo sapiens
gctctggctgaaccctgtgc

SEQ ID NO: 2552713 - DNA, 19 bp, Homo sapiens
gctctggtgacaccagcct

SEQ ID NO: 2552714 - DNA, 19 bp, Homo sapiens
gctctgtaatctcgtttca

SEQ ID NO: 2552715 - DNA, 23 bp, Homo sapiens
gctctgtaatctcgtttcaaaaa

SEQ ID NO: 2552716 - DNA, 23 bp, Homo sapiens
gctctgtatcaggacccagagga

SEQ ID NO: 2552717 - DNA, 14 bp, Homo sapiens
gctctgtcctggga

SEQ ID NO: 2552718 - DNA, 15 bp, Homo sapiens
gctctgtcctgggag

SEQ ID NO: 2552719 - DNA, 14 bp, Homo sapiens
gctctgtgcaggga

SEQ ID NO: 2552720 - DNA, 22 bp, Homo sapiens
gctctgtgctgaccctcctgtt

SEQ ID NO: 2552721 - DNA, 20 bp, Homo sapiens
gctcttccgaaaaccaggcc

SEQ ID NO: 2552722 - DNA, 16 bp, Homo sapiens
gctcttctccaggctg

SEQ ID NO: 2552723 - DNA, 16 bp, Homo sapiens
gctcttgcccttccct

SEQ ID NO: 2552724 - DNA, 18 bp, Homo sapiens
gctcttgcccttccctgt

SEQ ID NO: 2552725 - DNA, 19 bp, Homo sapiens
gctcttggcaggtactcag

SEQ ID NO: 2552726 - DNA, 21 bp, Homo sapiens
gctggaccttgaactgggtac

SEQ ID NO: 2552727 - DNA, 16 bp, Homo sapiens
gctggacggcattcct

SEQ ID NO: 2552728 - DNA, 14 bp, Homo sapiens
gctggactacccac

SEQ ID NO: 2552729 - DNA, 20 bp, Homo sapiens
gctggagaccatgcagagcg

SEQ ID NO: 2552730 - DNA, 21 bp, Homo sapiens
gctggagaccatgcagagcgc

SEQ ID NO: 2552731 - DNA, 19 bp, Homo sapiens
gctggagccactaactaga

SEQ ID NO: 2552732 - DNA, 22 bp, Homo sapiens
gctggagctggcgtctgtcttc

SEQ ID NO: 2552733 - DNA, 14 bp, Homo sapiens
gctggagtgcagtg

SEQ ID NO: 2552734 - DNA, 15 bp, Homo sapiens
gctggagtgcagtgg

SEQ ID NO: 2552735 - DNA, 21 bp, Homo sapiens
gctggatgctccttccaacag

SEQ ID NO: 2552736 - DNA, 22 bp, Homo sapiens
gctggatgctccttccaacagg

SEQ ID NO: 2552737 - DNA, 17 bp, Homo sapiens
gctggcaccgccttctc

SEQ ID NO: 2552738 - DNA, 18 bp, Homo sapiens
gctggcaccgccttctct

SEQ ID NO: 2552739 - DNA, 13 bp, Homo sapiens
gctggcagcagag

SEQ ID NO: 2552740 - DNA, 14 bp, Homo sapiens
gctggcagctctcc

SEQ ID NO: 2552741 - DNA, 15 bp, Homo sapiens
gctggcagctctcca

SEQ ID NO: 2552742 - DNA, 21 bp, Homo sapiens
gctggccactgcacagagctc

SEQ ID NO: 2552743 - DNA, 14 bp, Homo sapiens
gctggcccagccaa

SEQ ID NO: 2552744 - DNA, 15 bp, Homo sapiens
gctggcccagccctg

SEQ ID NO: 2552745 - DNA, 18 bp, Homo sapiens
gctggcccagccggcctc

SEQ ID NO: 2552746 - DNA, 19 bp, Homo sapiens
gctggcccagccggcctct

SEQ ID NO: 2552747 - DNA, 13 bp, Homo sapiens
gctggccccgccg

SEQ ID NO: 2552748 - DNA, 23 bp, Homo sapiens
gctggccccgccgcctggtactc

SEQ ID NO: 2552749 - DNA, 24 bp, Homo sapiens
gctggccccgccgcctggtactca

SEQ ID NO: 2552750 - DNA, 20 bp, Homo sapiens
gctggcccctcacctgggca

SEQ ID NO: 2552751 - DNA, 17 bp, Homo sapiens
gctggcccgtgacagac

SEQ ID NO: 2552752 - DNA, 13 bp, Homo sapiens
gctggccgggacc

SEQ ID NO: 2552753 - DNA, 18 bp, Homo sapiens
gctggccgtgggcctggg

SEQ ID NO: 2552754 - DNA, 18 bp, Homo sapiens
gctggcctctggctctca

SEQ ID NO: 2552755 - DNA, 12 bp, Homo sapiens
gctggcctggat

SEQ ID NO: 2552756 - DNA, 13 bp, Homo sapiens
gctggcctggccc

SEQ ID NO: 2552757 - DNA, 16 bp, Homo sapiens
gctggcctggcccctc

SEQ ID NO: 2552758 - DNA, 19 bp, Homo sapiens
gctggcctggcccctcagg

SEQ ID NO: 2552759 - DNA, 23 bp, Homo sapiens
gctggccttcctgccctacagag

SEQ ID NO: 2552760 - DNA, 13 bp, Homo sapiens
gctggcgcagcca

SEQ ID NO: 2552761 - DNA, 14 bp, Homo sapiens
gctggcgcctctgc

SEQ ID NO: 2552762 - DNA, 14 bp, Homo sapiens
gctggctcttctgc

SEQ ID NO: 2552763 - DNA, 18 bp, Homo sapiens
gctggctcttctgcccaa

SEQ ID NO: 2552764 - DNA, 19 bp, Homo sapiens
gctggctgcccagacccct

SEQ ID NO: 2552765 - DNA, 18 bp, Homo sapiens
gctggctgttggctgggg

SEQ ID NO: 2552766 - DNA, 15 bp, Homo sapiens
gctgggaactgcaga

SEQ ID NO: 2552767 - DNA, 20 bp, Homo sapiens
gctgggacatgggaaagggg

SEQ ID NO: 2552768 - DNA, 13 bp, Homo sapiens
gctgggactacag

SEQ ID NO: 2552769 - DNA, 18 bp, Homo sapiens
gctgggactacaggcacc

SEQ ID NO: 2552770 - DNA, 19 bp, Homo sapiens
gctgggactacaggtgtga

SEQ ID NO: 2552771 - DNA, 15 bp, Homo sapiens
gctgggactgagcca

SEQ ID NO: 2552772 - DNA, 18 bp, Homo sapiens
gctgggagagccttccag

SEQ ID NO: 2552773 - DNA, 19 bp, Homo sapiens
gctgggagagccttccagg

SEQ ID NO: 2552774 - DNA, 20 bp, Homo sapiens
gctgggaggcatggccctgg

SEQ ID NO: 2552775 - DNA, 18 bp, Homo sapiens
gctgggagtagttgtctt

SEQ ID NO: 2552776 - DNA, 19 bp, Homo sapiens
gctgggatgattggagggg

SEQ ID NO: 2552777 - DNA, 19 bp, Homo sapiens
gctgggattacaggtgtga

SEQ ID NO: 2552778 - DNA, 19 bp, Homo sapiens
gctgggccccagcccaccc

SEQ ID NO: 2552779 - DNA, 24 bp, Homo sapiens
gctgggccccagcccaccctcctg

SEQ ID NO: 2552780 - DNA, 14 bp, Homo sapiens
gctgggctctgcca

SEQ ID NO: 2552781 - DNA, 19 bp, Homo sapiens
gctgggctgagcccctacc

SEQ ID NO: 2552782 - DNA, 20 bp, Homo sapiens
gctgggctgagcccctaccc

SEQ ID NO: 2552783 - DNA, 22 bp, Homo sapiens
gctggggacggggggccccagt

SEQ ID NO: 2552784 - DNA, 19 bp, Homo sapiens
gctggggcgtggggagggc

SEQ ID NO: 2552785 - DNA, 15 bp, Homo sapiens
gctggggctgacctt

SEQ ID NO: 2552786 - DNA, 14 bp, Homo sapiens
gctgggggcctcag

SEQ ID NO: 2552787 - DNA, 15 bp, Homo sapiens
gctgggggcctcagt

SEQ ID NO: 2552788 - DNA, 22 bp, Homo sapiens
gctgggtggcaccagcagcctg

SEQ ID NO: 2552789 - DNA, 14 bp, Homo sapiens
gctgggtggcactg

SEQ ID NO: 2552790 - DNA, 14 bp, Homo sapiens
gctgggttggaggg

SEQ ID NO: 2552791 - DNA, 22 bp, Homo sapiens
gctggtaacagttcatgtttgc

SEQ ID NO: 2552792 - DNA, 13 bp, Homo sapiens
gctggtagctcag

SEQ ID NO: 2552793 - DNA, 19 bp, Homo sapiens
gctggtagctcaggtgggc

SEQ ID NO: 2552794 - DNA, 14 bp, Homo sapiens
gctggtcccactca

SEQ ID NO: 2552795 - DNA, 15 bp, Homo sapiens
gctggtcccactcag

SEQ ID NO: 2552796 - DNA, 20 bp, Homo sapiens
gctggtcccactcagtccat

SEQ ID NO: 2552797 - DNA, 20 bp, Homo sapiens
gctggtgcagagctgaagat

SEQ ID NO: 2552798 - DNA, 20 bp, Homo sapiens
gctggtgcattacagagagg

SEQ ID NO: 2552799 - DNA, 22 bp, Homo sapiens
gctggtgcattacagagaggag

SEQ ID NO: 2552800 - DNA, 22 bp, Homo sapiens
gctggtgccagccttcctctgc

SEQ ID NO: 2552801 - DNA, 19 bp, Homo sapiens
gctggtgctgtggccaggg

SEQ ID NO: 2552802 - DNA, 16 bp, Homo sapiens
gctggtgtcacctgaa

SEQ ID NO: 2552803 - DNA, 15 bp, Homo sapiens
gctggtgtcctgacc

SEQ ID NO: 2552804 - DNA, 18 bp, Homo sapiens
gctggtgtcctgaccacc

SEQ ID NO: 2552805 - DNA, 19 bp, Homo sapiens
gctggtgtcctgaccaccc

SEQ ID NO: 2552806 - DNA, 15 bp, Homo sapiens
gctggttcagggttg

SEQ ID NO: 2552807 - DNA, 13 bp, Homo sapiens
gctggttgctgtg

SEQ ID NO: 2552808 - DNA, 14 bp, Homo sapiens
gctggttgctgtgt

SEQ ID NO: 2552809 - DNA, 21 bp, Homo sapiens
gctggttttgtaagatgctgg

SEQ ID NO: 2552810 - DNA, 14 bp, Homo sapiens
gctggtttttcagt

SEQ ID NO: 2552811 - DNA, 14 bp, Homo sapiens
gctgtaaaatcttg

SEQ ID NO: 2552812 - DNA, 24 bp, Homo sapiens
gctgtaagaagagactgggaagat

SEQ ID NO: 2552813 - DNA, 20 bp, Homo sapiens
gctgtaggactcgcagtcag

SEQ ID NO: 2552814 - DNA, 20 bp, Homo sapiens
gctgtagtagccctttctgt

SEQ ID NO: 2552815 - DNA, 19 bp, Homo sapiens
gctgtattagtcacagaga

SEQ ID NO: 2552816 - DNA, 20 bp, Homo sapiens
gctgtcaaaacaagtttttc

SEQ ID NO: 2552817 - DNA, 16 bp, Homo sapiens
gctgtccagacagcct

SEQ ID NO: 2552818 - DNA, 16 bp, Homo sapiens
gctgtccctccccctt

SEQ ID NO: 2552819 - DNA, 22 bp, Homo sapiens
gctgtccttacccatctgcacc

SEQ ID NO: 2552820 - DNA, 13 bp, Homo sapiens
gctgtctccagac

SEQ ID NO: 2552821 - DNA, 22 bp, Homo sapiens
gctgtctccagacccccacccc

SEQ ID NO: 2552822 - DNA, 17 bp, Homo sapiens
gctgtctgatctgtgct

SEQ ID NO: 2552823 - DNA, 15 bp, Homo sapiens
gctgtgagacagtgg

SEQ ID NO: 2552824 - DNA, 12 bp, Homo sapiens
gctgtgagcccc

SEQ ID NO: 2552825 - DNA, 22 bp, Homo sapiens
gctgtgagtgtaagtgtgagta

SEQ ID NO: 2552826 - DNA, 12 bp, Homo sapiens
gctgtgcctctg

SEQ ID NO: 2552827 - DNA, 16 bp, Homo sapiens
gctgtgcctctgcctg

SEQ ID NO: 2552828 - DNA, 13 bp, Homo sapiens
gctgtgctctgga

SEQ ID NO: 2552829 - DNA, 21 bp, Homo sapiens
gctgtgctctggacaggcatg

SEQ ID NO: 2552830 - DNA, 15 bp, Homo sapiens
gctgtgctgccctgc

SEQ ID NO: 2552831 - DNA, 15 bp, Homo sapiens
gctgtggaagcaaca

SEQ ID NO: 2552832 - DNA, 13 bp, Homo sapiens
gctgtggccaggg

SEQ ID NO: 2552833 - DNA, 14 bp, Homo sapiens
gctgtgggaacgag

SEQ ID NO: 2552834 - DNA, 19 bp, Homo sapiens
gctgtgggcctcaaggact

SEQ ID NO: 2552835 - DNA, 22 bp, Homo sapiens
gctgtggggctggtagctcagg

SEQ ID NO: 2552836 - DNA, 11 bp, Homo sapiens
gctgtgtaaag

SEQ ID NO: 2552837 - DNA, 15 bp, Homo sapiens
gctgtgtaaagttag

SEQ ID NO: 2552838 - DNA, 22 bp, Homo sapiens
gctgtgtacactgacacctttg

SEQ ID NO: 2552839 - DNA, 17 bp, Homo sapiens
gctgtgttctggtgagg

SEQ ID NO: 2552840 - DNA, 18 bp, Homo sapiens
gctgttgagctgttttcc

SEQ ID NO: 2552841 - DNA, 19 bp, Homo sapiens
gctgttgattgctaaatgt

SEQ ID NO: 2552842 - DNA, 21 bp, Homo sapiens
gctgttgcgtaactggctgtg

SEQ ID NO: 2552843 - DNA, 23 bp, Homo sapiens
gctgttgcgtaactggctgtgtt

SEQ ID NO: 2552844 - DNA, 14 bp, Homo sapiens
gctgttggctgggg

SEQ ID NO: 2552845 - DNA, 22 bp, Homo sapiens
gctgttggctgggggcctcagt

SEQ ID NO: 2552846 - DNA, 13 bp, Homo sapiens
gctgttgtacatt

SEQ ID NO: 2552847 - DNA, 15 bp, Homo sapiens
gctgtttatggcctc

SEQ ID NO: 2552848 - DNA, 22 bp, Homo sapiens
gctgtttatggcctcagctgcc

SEQ ID NO: 2552849 - DNA, 23 bp, Homo sapiens
gctgtttatggcctcagctgcct

SEQ ID NO: 2552850 - DNA, 12 bp, Homo sapiens
gctgtttgtcat

SEQ ID NO: 2552851 - DNA, 18 bp, Homo sapiens
gctgttttgttctgtggt

SEQ ID NO: 2552852 - DNA, 15 bp, Homo sapiens
gcttaaaaatcattg

SEQ ID NO: 2552853 - DNA, 17 bp, Homo sapiens
gcttaaaggtgtcttcc

SEQ ID NO: 2552854 - DNA, 16 bp, Homo sapiens
gcttaacttcacatat

SEQ ID NO: 2552855 - DNA, 17 bp, Homo sapiens
gcttaacttcacatatt

SEQ ID NO: 2552856 - DNA, 16 bp, Homo sapiens
gcttaatgcttctttc

SEQ ID NO: 2552857 - DNA, 17 bp, Homo sapiens
gcttaatgtttattcct

SEQ ID NO: 2552858 - DNA, 22 bp, Homo sapiens
gcttacaatttttttaattttg

SEQ ID NO: 2552859 - DNA, 16 bp, Homo sapiens
gcttagacctcagcct

SEQ ID NO: 2552860 - DNA, 23 bp, Homo sapiens
gcttagacctcagcctgtgctgc

SEQ ID NO: 2552861 - DNA, 23 bp, Homo sapiens
gcttagacttcgactcaggatcc

SEQ ID NO: 2552862 - DNA, 18 bp, Homo sapiens
gcttagagaatgttctcc

SEQ ID NO: 2552863 - DNA, 16 bp, Homo sapiens
gcttagagcctccctc

SEQ ID NO: 2552864 - DNA, 23 bp, Homo sapiens
gcttagcaggagaggagagccag

SEQ ID NO: 2552865 - DNA, 22 bp, Homo sapiens
gcttagcctcctgacctgaggc

SEQ ID NO: 2552866 - DNA, 19 bp, Homo sapiens
gcttagctttgctctgcca

SEQ ID NO: 2552867 - DNA, 15 bp, Homo sapiens
gcttagtcactgaga

SEQ ID NO: 2552868 - DNA, 17 bp, Homo sapiens
gcttagtcactgagaca

SEQ ID NO: 2552869 - DNA, 17 bp, Homo sapiens
gcttatcaataaacctg

SEQ ID NO: 2552870 - DNA, 20 bp, Homo sapiens
gcttattgttccaagacatt

SEQ ID NO: 2552871 - DNA, 11 bp, Homo sapiens
gcttatttaat

SEQ ID NO: 2552872 - DNA, 12 bp, Homo sapiens
gcttattttaaa

SEQ ID NO: 2552873 - DNA, 15 bp, Homo sapiens
gcttcaattaataaa

SEQ ID NO: 2552874 - DNA, 19 bp, Homo sapiens
gcttcaccccaatcccagc

SEQ ID NO: 2552875 - DNA, 15 bp, Homo sapiens
gcttcacggaagagc

SEQ ID NO: 2552876 - DNA, 17 bp, Homo sapiens
gcttcacggaagagcct

SEQ ID NO: 2552877 - DNA, 14 bp, Homo sapiens
gcttcactgtataa

SEQ ID NO: 2552878 - DNA, 16 bp, Homo sapiens
gcttcactgtataaat

SEQ ID NO: 2552879 - DNA, 19 bp, Homo sapiens
gcttcagcatatttatagc

SEQ ID NO: 2552880 - DNA, 16 bp, Homo sapiens
gcttcagccacagttt

SEQ ID NO: 2552881 - DNA, 19 bp, Homo sapiens
gcttcagccaggagctggg

SEQ ID NO: 2552882 - DNA, 17 bp, Homo sapiens
gcttcagcctccccacc

SEQ ID NO: 2552883 - DNA, 15 bp, Homo sapiens
gcttcagcctgaggc

SEQ ID NO: 2552884 - DNA, 23 bp, Homo sapiens
gcttcagcctgaggctgagactg

SEQ ID NO: 2552885 - DNA, 19 bp, Homo sapiens
gcttcaggttatcgaaata

SEQ ID NO: 2552886 - DNA, 14 bp, Homo sapiens
gcttcagtggagaa

SEQ ID NO: 2552887 - DNA, 15 bp, Homo sapiens
gcttcagtggcagct

SEQ ID NO: 2552888 - DNA, 13 bp, Homo sapiens
gcttcatctgtca

SEQ ID NO: 2552889 - DNA, 17 bp, Homo sapiens
gcttcattagagcaggc

SEQ ID NO: 2552890 - DNA, 19 bp, Homo sapiens
gcttccagaaaaccccagc

SEQ ID NO: 2552891 - DNA, 13 bp, Homo sapiens
gcttccagagagt

SEQ ID NO: 2552892 - DNA, 21 bp, Homo sapiens
gcttccaggtatctccaggat

SEQ ID NO: 2552893 - DNA, 22 bp, Homo sapiens
gcttccaggtatctccaggatt

SEQ ID NO: 2552894 - DNA, 16 bp, Homo sapiens
gcttccagtgaggctc

SEQ ID NO: 2552895 - DNA, 18 bp, Homo sapiens
gcttcccagtggctgctg

SEQ ID NO: 2552896 - DNA, 13 bp, Homo sapiens
gcttcccatccta

SEQ ID NO: 2552897 - DNA, 22 bp, Homo sapiens
gcttcccatcctaccctcgggc

SEQ ID NO: 2552898 - DNA, 14 bp, Homo sapiens
gcttcccctctctc

SEQ ID NO: 2552899 - DNA, 12 bp, Homo sapiens
gcttccctctgc

SEQ ID NO: 2552900 - DNA, 20 bp, Homo sapiens
gcttccctctgcctgtccct

SEQ ID NO: 2552901 - DNA, 22 bp, Homo sapiens
gcttcctcatagtatggtggct

SEQ ID NO: 2552902 - DNA, 14 bp, Homo sapiens
gcttcctcctccct

SEQ ID NO: 2552903 - DNA, 22 bp, Homo sapiens
gcttccttggcatcacagggca

SEQ ID NO: 2552904 - DNA, 20 bp, Homo sapiens
gcttcgggcccttcccacag

SEQ ID NO: 2552905 - DNA, 17 bp, Homo sapiens
gcttcgtttattttcaa

SEQ ID NO: 2552906 - DNA, 19 bp, Homo sapiens
gcttctaccatgaacagaa

SEQ ID NO: 2552907 - DNA, 17 bp, Homo sapiens
gcttctcactgccatgc

SEQ ID NO: 2552908 - DNA, 22 bp, Homo sapiens
gcttctcactgccatgccagct

SEQ ID NO: 2552909 - DNA, 16 bp, Homo sapiens
gcttctcatacgtcca

SEQ ID NO: 2552910 - DNA, 22 bp, Homo sapiens
gcttctcatcctgcaggcagct

SEQ ID NO: 2552911 - DNA, 22 bp, Homo sapiens
gcttctctgtgaacgatttaga

SEQ ID NO: 2552912 - DNA, 19 bp, Homo sapiens
gcttctgaatgctgctact

SEQ ID NO: 2552913 - DNA, 12 bp, Homo sapiens
gcttctgcaccc

SEQ ID NO: 2552914 - DNA, 14 bp, Homo sapiens
gcttctgcaccctc

SEQ ID NO: 2552915 - DNA, 17 bp, Homo sapiens
gcttctgcaccctccac

SEQ ID NO: 2552916 - DNA, 14 bp, Homo sapiens
gcttctggagccct

SEQ ID NO: 2552917 - DNA, 17 bp, Homo sapiens
gcttctggagcccttgg

SEQ ID NO: 2552918 - DNA, 18 bp, Homo sapiens
gcttctggtactctccta

SEQ ID NO: 2552919 - DNA, 23 bp, Homo sapiens
gcttctgtcttatttgaaggcca

SEQ ID NO: 2552920 - DNA, 16 bp, Homo sapiens
gcttcttcagagactc

SEQ ID NO: 2552921 - DNA, 19 bp, Homo sapiens
gcttcttcagagactcctg

SEQ ID NO: 2552922 - DNA, 23 bp, Homo sapiens
gcttcttcagagactcctgcagg

SEQ ID NO: 2552923 - DNA, 14 bp, Homo sapiens
gcttcttctcaggc

SEQ ID NO: 2552924 - DNA, 13 bp, Homo sapiens
gcttgaaagaaaa

SEQ ID NO: 2552925 - DNA, 13 bp, Homo sapiens
gcttgaacccagg

SEQ ID NO: 2552926 - DNA, 14 bp, Homo sapiens
gcttgaagccaagt

SEQ ID NO: 2552927 - DNA, 22 bp, Homo sapiens
gcttgacttttgtataggtaga

SEQ ID NO: 2552928 - DNA, 14 bp, Homo sapiens
gcttgagcccagga

SEQ ID NO: 2552929 - DNA, 15 bp, Homo sapiens
gcttgagcccaggag

SEQ ID NO: 2552930 - DNA, 14 bp, Homo sapiens
gcttgagctcagga

SEQ ID NO: 2552931 - DNA, 22 bp, Homo sapiens
gcttgagggttgggctggtgtc

SEQ ID NO: 2552932 - DNA, 23 bp, Homo sapiens
gcttgcaagtatgttttagcatg

SEQ ID NO: 2552933 - DNA, 19 bp, Homo sapiens
gcttgcagtgagccgagat

SEQ ID NO: 2552934 - DNA, 15 bp, Homo sapiens
gcttgcataataagc

SEQ ID NO: 2552935 - DNA, 14 bp, Homo sapiens
gcttgccccggccc

SEQ ID NO: 2552936 - DNA, 17 bp, Homo sapiens
gcttgcctagggcctgg

SEQ ID NO: 2552937 - DNA, 19 bp, Homo sapiens
gcttggaaagcatcacctc

SEQ ID NO: 2552938 - DNA, 15 bp, Homo sapiens
gcttggaagagcctg

SEQ ID NO: 2552939 - DNA, 18 bp, Homo sapiens
gcttggaagagcctgcag

SEQ ID NO: 2552940 - DNA, 13 bp, Homo sapiens
gcttggccagaag

SEQ ID NO: 2552941 - DNA, 17 bp, Homo sapiens
gcttgggcccagctggg

SEQ ID NO: 2552942 - DNA, 16 bp, Homo sapiens
gcttggggcttcctaa

SEQ ID NO: 2552943 - DNA, 21 bp, Homo sapiens
gcttgggtgtaacaggtctcc

SEQ ID NO: 2552944 - DNA, 23 bp, Homo sapiens
gcttgggtgtaacaggtctcctc

SEQ ID NO: 2552945 - DNA, 17 bp, Homo sapiens
gcttgtaaatagctcag

SEQ ID NO: 2552946 - DNA, 19 bp, Homo sapiens
gcttgtaaatagctcaggt

SEQ ID NO: 2552947 - DNA, 14 bp, Homo sapiens
gcttgtacataatg

SEQ ID NO: 2552948 - DNA, 16 bp, Homo sapiens
gcttgtcagagctggg

SEQ ID NO: 2552949 - DNA, 19 bp, Homo sapiens
gcttgtcccctcctcactc

SEQ ID NO: 2552950 - DNA, 15 bp, Homo sapiens
gcttgtgcaacaata

SEQ ID NO: 2552951 - DNA, 14 bp, Homo sapiens
gcttgtgtgtttca

SEQ ID NO: 2552952 - DNA, 15 bp, Homo sapiens
gcttgttatttataa

SEQ ID NO: 2552953 - DNA, 18 bp, Homo sapiens
gcttgttccctctccctg

SEQ ID NO: 2552954 - DNA, 24 bp, Homo sapiens
gcttgttgggattcctgacccagg

SEQ ID NO: 2552955 - DNA, 23 bp, Homo sapiens
gcttgtttcctagcacacacttt

SEQ ID NO: 2552956 - DNA, 21 bp, Homo sapiens
gcttgtttgctcacctggggt

SEQ ID NO: 2552957 - DNA, 21 bp, Homo sapiens
gctttaaactcagggacagag

SEQ ID NO: 2552958 - DNA, 19 bp, Homo sapiens
gctttaaccattaaaactg

SEQ ID NO: 2552959 - DNA, 22 bp, Homo sapiens
gctttaatatcatcagtattga

SEQ ID NO: 2552960 - DNA, 23 bp, Homo sapiens
gctttactgtcaaaataatttta

SEQ ID NO: 2552961 - DNA, 16 bp, Homo sapiens
gctttactgtttgtta

SEQ ID NO: 2552962 - DNA, 13 bp, Homo sapiens
gctttatttttta

SEQ ID NO: 2552963 - DNA, 18 bp, Homo sapiens
gctttcatgattagcaag

SEQ ID NO: 2552964 - DNA, 15 bp, Homo sapiens
gctttcatgtaaact

SEQ ID NO: 2552965 - DNA, 14 bp, Homo sapiens
gctttcccctgtgg

SEQ ID NO: 2552966 - DNA, 16 bp, Homo sapiens
gctttcccctgtgggg

SEQ ID NO: 2552967 - DNA, 13 bp, Homo sapiens
gctttctacccag

SEQ ID NO: 2552968 - DNA, 12 bp, Homo sapiens
gctttcttgctg

SEQ ID NO: 2552969 - DNA, 14 bp, Homo sapiens
gctttcttgctggt

SEQ ID NO: 2552970 - DNA, 11 bp, Homo sapiens
gctttgaatgt

SEQ ID NO: 2552971 - DNA, 14 bp, Homo sapiens
gctttgactcacct

SEQ ID NO: 2552972 - DNA, 20 bp, Homo sapiens
gctttgactcacctgttact

SEQ ID NO: 2552973 - DNA, 12 bp, Homo sapiens
gctttgcagtga

SEQ ID NO: 2552974 - DNA, 18 bp, Homo sapiens
gctttgcatgttccacta

SEQ ID NO: 2552975 - DNA, 18 bp, Homo sapiens
gctttgccagctgctgct

SEQ ID NO: 2552976 - DNA, 16 bp, Homo sapiens
gctttgctaccaaagc

SEQ ID NO: 2552977 - DNA, 14 bp, Homo sapiens
gctttgttttgcac

SEQ ID NO: 2552978 - DNA, 23 bp, Homo sapiens
gctttgttttgcacactttgcca

SEQ ID NO: 2552979 - DNA, 17 bp, Homo sapiens
gcttttaaaaaaaaata

SEQ ID NO: 2552980 - DNA, 22 bp, Homo sapiens
gcttttattaatgcactttcta

SEQ ID NO: 2552981 - DNA, 14 bp, Homo sapiens
gcttttccttgggg

SEQ ID NO: 2552982 - DNA, 20 bp, Homo sapiens
gcttttccttggggcaggca

SEQ ID NO: 2552983 - DNA, 21 bp, Homo sapiens
gcttttccttggggcaggcag

SEQ ID NO: 2552984 - DNA, 22 bp, Homo sapiens
gcttttcctttgtttttatgaa

SEQ ID NO: 2552985 - DNA, 18 bp, Homo sapiens
gcttttctgtctctgcct

SEQ ID NO: 2552986 - DNA, 13 bp, Homo sapiens
gcttttgaaatct

SEQ ID NO: 2552987 - DNA, 15 bp, Homo sapiens
gcttttggtctgtgt

SEQ ID NO: 2552988 - DNA, 13 bp, Homo sapiens
gcttttgtgcatt

SEQ ID NO: 2552989 - DNA, 15 bp, Homo sapiens
gctttttaatattga

SEQ ID NO: 2552990 - DNA, 13 bp, Homo sapiens
gctttttaattgt

SEQ ID NO: 2552991 - DNA, 19 bp, Homo sapiens
gctttttattcctcctgct

SEQ ID NO: 2552992 - DNA, 21 bp, Homo sapiens
gctttttgaggtggcactttt

SEQ ID NO: 2552993 - DNA, 11 bp, Homo sapiens
ggaaaaatatt

SEQ ID NO: 2552994 - DNA, 14 bp, Homo sapiens
ggaaaaatatttaa

SEQ ID NO: 2552995 - DNA, 15 bp, Homo sapiens
ggaaaaatatttaag

SEQ ID NO: 2552996 - DNA, 22 bp, Homo sapiens
ggaaaacagaacatcattagaa

SEQ ID NO: 2552997 - DNA, 14 bp, Homo sapiens
ggaaaagaatacag

SEQ ID NO: 2552998 - DNA, 18 bp, Homo sapiens
ggaaaagaatacagaaag

SEQ ID NO: 2552999 - DNA, 18 bp, Homo sapiens
ggaaaagcagctctcccc

SEQ ID NO: 2553000 - DNA, 18 bp, Homo sapiens
ggaaaagctgctgacagt

SEQ ID NO: 2553001 - DNA, 20 bp, Homo sapiens
ggaaaagctgctgacagtgt

SEQ ID NO: 2553002 - DNA, 16 bp, Homo sapiens
ggaaacaacagcttta

SEQ ID NO: 2553003 - DNA, 20 bp, Homo sapiens
ggaaacagctaatgggacac

SEQ ID NO: 2553004 - DNA, 13 bp, Homo sapiens
ggaaacctgccct

SEQ ID NO: 2553005 - DNA, 19 bp, Homo sapiens
ggaaacctgccctgcctga

SEQ ID NO: 2553006 - DNA, 18 bp, Homo sapiens
ggaaactgggttcctgca

SEQ ID NO: 2553007 - DNA, 16 bp, Homo sapiens
ggaaagaaagaaggaa

SEQ ID NO: 2553008 - DNA, 16 bp, Homo sapiens
ggaaagagtaggaaga

SEQ ID NO: 2553009 - DNA, 19 bp, Homo sapiens
ggaaagcatcacctcaggc

SEQ ID NO: 2553010 - DNA, 18 bp, Homo sapiens
ggaaagccacctctccct

SEQ ID NO: 2553011 - DNA, 23 bp, Homo sapiens
ggaaagccacctctccctcaaca

SEQ ID NO: 2553012 - DNA, 18 bp, Homo sapiens
ggaaagctcctagcagag

SEQ ID NO: 2553013 - DNA, 24 bp, Homo sapiens
ggaaaggaagtgggactggcacta

SEQ ID NO: 2553014 - DNA, 20 bp, Homo sapiens
ggaaaggccagctggcagca

SEQ ID NO: 2553015 - DNA, 12 bp, Homo sapiens
ggaaaggctcag

SEQ ID NO: 2553016 - DNA, 17 bp, Homo sapiens
ggaaaggctccaggagc

SEQ ID NO: 2553017 - DNA, 19 bp, Homo sapiens
ggaaaggctccaggagcag

SEQ ID NO: 2553018 - DNA, 22 bp, Homo sapiens
ggaaaggctccaggagcagcca

SEQ ID NO: 2553019 - DNA, 15 bp, Homo sapiens
ggaaaggctctgaaa

SEQ ID NO: 2553020 - DNA, 20 bp, Homo sapiens
ggaaaggctctgaaagccag

SEQ ID NO: 2553021 - DNA, 14 bp, Homo sapiens
ggaaagtgaatttg

SEQ ID NO: 2553022 - DNA, 22 bp, Homo sapiens
ggaaagtgaatttgaatgaaaa

SEQ ID NO: 2553023 - DNA, 15 bp, Homo sapiens
ggaaagtgtaaagca

SEQ ID NO: 2553024 - DNA, 15 bp, Homo sapiens
ggaaatgctgggctg

SEQ ID NO: 2553025 - DNA, 13 bp, Homo sapiens
ggaaatggtgcct

SEQ ID NO: 2553026 - DNA, 14 bp, Homo sapiens
ggaaattaagaaga

SEQ ID NO: 2553027 - DNA, 14 bp, Homo sapiens
ggaacacacttgga

SEQ ID NO: 2553028 - DNA, 19 bp, Homo sapiens
ggaacactccttcacagat

SEQ ID NO: 2553029 - DNA, 11 bp, Homo sapiens
ggaacagaagg

SEQ ID NO: 2553030 - DNA, 12 bp, Homo sapiens
ggaacagaatgt

SEQ ID NO: 2553031 - DNA, 20 bp, Homo sapiens
ggaacagactggaagcacag

SEQ ID NO: 2553032 - DNA, 20 bp, Homo sapiens
ggaacagctatgggagcccc

SEQ ID NO: 2553033 - DNA, 23 bp, Homo sapiens
ggaacagctatgggagccccagg

SEQ ID NO: 2553034 - DNA, 12 bp, Homo sapiens
ggaaccagagcc

SEQ ID NO: 2553035 - DNA, 17 bp, Homo sapiens
ggaacccccctcccacc

SEQ ID NO: 2553036 - DNA, 17 bp, Homo sapiens
ggaaccgcaggaagctg

SEQ ID NO: 2553037 - DNA, 14 bp, Homo sapiens
ggaacgagagggga

SEQ ID NO: 2553038 - DNA, 23 bp, Homo sapiens
ggaactagactcccaagctggac

SEQ ID NO: 2553039 - DNA, 21 bp, Homo sapiens
ggaactagagggatacactga

SEQ ID NO: 2553040 - DNA, 17 bp, Homo sapiens
ggaactcacctggggct

SEQ ID NO: 2553041 - DNA, 11 bp, Homo sapiens
ggaactcccag

SEQ ID NO: 2553042 - DNA, 13 bp, Homo sapiens
ggaactcccagca

SEQ ID NO: 2553043 - DNA, 13 bp, Homo sapiens
ggaactgcagacc

SEQ ID NO: 2553044 - DNA, 15 bp, Homo sapiens
ggaactgctgggctt

SEQ ID NO: 2553045 - DNA, 15 bp, Homo sapiens
ggaacttctaatata

SEQ ID NO: 2553046 - DNA, 14 bp, Homo sapiens
ggaagaaaagagct

SEQ ID NO: 2553047 - DNA, 19 bp, Homo sapiens
ggaagaaattcctgtagca

SEQ ID NO: 2553048 - DNA, 16 bp, Homo sapiens
ggaagaacatagaact

SEQ ID NO: 2553049 - DNA, 15 bp, Homo sapiens
ggaagaagagggaga

SEQ ID NO: 2553050 - DNA, 16 bp, Homo sapiens
ggaagacaatgtgaaa

SEQ ID NO: 2553051 - DNA, 23 bp, Homo sapiens
ggaagacagagacctcctgcctc

SEQ ID NO: 2553052 - DNA, 16 bp, Homo sapiens
ggaagacgcctgagct

SEQ ID NO: 2553053 - DNA, 15 bp, Homo sapiens
ggaagagaaaaaata

SEQ ID NO: 2553054 - DNA, 13 bp, Homo sapiens
ggaagagaaacca

SEQ ID NO: 2553055 - DNA, 21 bp, Homo sapiens
ggaagagcaggcacatggagg

SEQ ID NO: 2553056 - DNA, 13 bp, Homo sapiens
ggaagagccttgc

SEQ ID NO: 2553057 - DNA, 21 bp, Homo sapiens
ggaagataggctctgcacaga

SEQ ID NO: 2553058 - DNA, 23 bp, Homo sapiens
ggaagcacatgtttatttattct

SEQ ID NO: 2553059 - DNA, 22 bp, Homo sapiens
ggaagcagatacatatgagtgt

SEQ ID NO: 2553060 - DNA, 19 bp, Homo sapiens
ggaagcagtgccttccata

SEQ ID NO: 2553061 - DNA, 22 bp, Homo sapiens
ggaagccaaacctctgtgagca

SEQ ID NO: 2553062 - DNA, 18 bp, Homo sapiens
ggaagccgctggggccag

SEQ ID NO: 2553063 - DNA, 20 bp, Homo sapiens
ggaagccggcggcccaagcc

SEQ ID NO: 2553064 - DNA, 16 bp, Homo sapiens
ggaagccgtgccctgc

SEQ ID NO: 2553065 - DNA, 23 bp, Homo sapiens
ggaagcgatgaatttggagactc

SEQ ID NO: 2553066 - DNA, 20 bp, Homo sapiens
ggaagcggaggttgcaggga

SEQ ID NO: 2553067 - DNA, 13 bp, Homo sapiens
ggaagctacaggt

SEQ ID NO: 2553068 - DNA, 15 bp, Homo sapiens
ggaagctacaggtta

SEQ ID NO: 2553069 - DNA, 22 bp, Homo sapiens
ggaagctacaggttacaacaga

SEQ ID NO: 2553070 - DNA, 16 bp, Homo sapiens
ggaagctagctcccct

SEQ ID NO: 2553071 - DNA, 21 bp, Homo sapiens
ggaagctagctcccctcctct

SEQ ID NO: 2553072 - DNA, 15 bp, Homo sapiens
ggaagctcagggcct

SEQ ID NO: 2553073 - DNA, 13 bp, Homo sapiens
ggaagctgctccg

SEQ ID NO: 2553074 - DNA, 19 bp, Homo sapiens
ggaagcttcttaaatgaga

SEQ ID NO: 2553075 - DNA, 16 bp, Homo sapiens
ggaaggaaacccagct

SEQ ID NO: 2553076 - DNA, 19 bp, Homo sapiens
ggaaggaaacccagctctg

SEQ ID NO: 2553077 - DNA, 17 bp, Homo sapiens
ggaaggaactctggctt

SEQ ID NO: 2553078 - DNA, 23 bp, Homo sapiens
ggaaggaactctggcttccaggt

SEQ ID NO: 2553079 - DNA, 13 bp, Homo sapiens
ggaaggagagcct

SEQ ID NO: 2553080 - DNA, 13 bp, Homo sapiens
ggaaggagtgaga

SEQ ID NO: 2553081 - DNA, 16 bp, Homo sapiens
ggaaggattgtaaaaa

SEQ ID NO: 2553082 - DNA, 23 bp, Homo sapiens
ggaaggattgtaaaaaaaaatgc

SEQ ID NO: 2553083 - DNA, 19 bp, Homo sapiens
ggaaggcggggcttcaacc

SEQ ID NO: 2553084 - DNA, 21 bp, Homo sapiens
ggaaggctcttctccccagag

SEQ ID NO: 2553085 - DNA, 14 bp, Homo sapiens
ggaaggctggctgg

SEQ ID NO: 2553086 - DNA, 23 bp, Homo sapiens
ggaagggacaccaagccttggct

SEQ ID NO: 2553087 - DNA, 14 bp, Homo sapiens
ggaagggcaaaacc

SEQ ID NO: 2553088 - DNA, 12 bp, Homo sapiens
ggaagggcagga

SEQ ID NO: 2553089 - DNA, 21 bp, Homo sapiens
ggaagggcaggaaggagagcc

SEQ ID NO: 2553090 - DNA, 11 bp, Homo sapiens
ggaagggccag

SEQ ID NO: 2553091 - DNA, 12 bp, Homo sapiens
ggaagggccagt

SEQ ID NO: 2553092 - DNA, 21 bp, Homo sapiens
ggaagggccagtctgggctgc

SEQ ID NO: 2553093 - DNA, 17 bp, Homo sapiens
ggaaggggacccccgcc

SEQ ID NO: 2553094 - DNA, 22 bp, Homo sapiens
ggaaggggacccccgccccctg

SEQ ID NO: 2553095 - DNA, 19 bp, Homo sapiens
ggaaggtcccttgtttcca

SEQ ID NO: 2553096 - DNA, 23 bp, Homo sapiens
ggaagtaacagtaacgcagggga

SEQ ID NO: 2553097 - DNA, 16 bp, Homo sapiens
ggaagtaggaagtaaa

SEQ ID NO: 2553098 - DNA, 13 bp, Homo sapiens
ggaagtcaaagca

SEQ ID NO: 2553099 - DNA, 18 bp, Homo sapiens
ggaagtccccaggcccca

SEQ ID NO: 2553100 - DNA, 13 bp, Homo sapiens
ggaagtcctctgg

SEQ ID NO: 2553101 - DNA, 18 bp, Homo sapiens
ggaagtgacaaggcccca

SEQ ID NO: 2553102 - DNA, 21 bp, Homo sapiens
ggaagtgacaaggccccagag

SEQ ID NO: 2553103 - DNA, 22 bp, Homo sapiens
ggaagtgacaaggccccagaga

SEQ ID NO: 2553104 - DNA, 21 bp, Homo sapiens
ggaagtgtgggtctgtgtgtg

SEQ ID NO: 2553105 - DNA, 13 bp, Homo sapiens
ggaagtttagaga

SEQ ID NO: 2553106 - DNA, 11 bp, Homo sapiens
ggaagttttca

SEQ ID NO: 2553107 - DNA, 18 bp, Homo sapiens
ggaagttttgcatttatg

SEQ ID NO: 2553108 - DNA, 21 bp, Homo sapiens
ggaagttttgtggaggagctc

SEQ ID NO: 2553109 - DNA, 13 bp, Homo sapiens
ggaataaatatgc

SEQ ID NO: 2553110 - DNA, 13 bp, Homo sapiens
ggaataataccta

SEQ ID NO: 2553111 - DNA, 13 bp, Homo sapiens
ggaataattattt

SEQ ID NO: 2553112 - DNA, 15 bp, Homo sapiens
ggaatacctgtcccc

SEQ ID NO: 2553113 - DNA, 18 bp, Homo sapiens
ggaatactagggagaagg

SEQ ID NO: 2553114 - DNA, 17 bp, Homo sapiens
ggaatagtatcctccag

SEQ ID NO: 2553115 - DNA, 16 bp, Homo sapiens
ggaatagttgagcccc

SEQ ID NO: 2553116 - DNA, 21 bp, Homo sapiens
ggaatcatgtcaggcctgtgt

SEQ ID NO: 2553117 - DNA, 24 bp, Homo sapiens
ggaatcatttctatttctcctcca

SEQ ID NO: 2553118 - DNA, 19 bp, Homo sapiens
ggaatcgaggaaccagagc

SEQ ID NO: 2553119 - DNA, 13 bp, Homo sapiens
ggaatctggagag

SEQ ID NO: 2553120 - DNA, 20 bp, Homo sapiens
ggaatgaggcttgctgagag

SEQ ID NO: 2553121 - DNA, 18 bp, Homo sapiens
ggaatgcctgagtgcctg

SEQ ID NO: 2553122 - DNA, 14 bp, Homo sapiens
ggaatgcggcaaga

SEQ ID NO: 2553123 - DNA, 13 bp, Homo sapiens
ggaatgctccccc

SEQ ID NO: 2553124 - DNA, 16 bp, Homo sapiens
ggaatgcttcctagaa

SEQ ID NO: 2553125 - DNA, 18 bp, Homo sapiens
ggaatgcttgaaaaatgt

SEQ ID NO: 2553126 - DNA, 20 bp, Homo sapiens
ggaatgtaactgctgaaaac

SEQ ID NO: 2553127 - DNA, 21 bp, Homo sapiens
ggaatgtttgggcagaaggga

SEQ ID NO: 2553128 - DNA, 17 bp, Homo sapiens
ggaattaacctggtgct

SEQ ID NO: 2553129 - DNA, 23 bp, Homo sapiens
ggaatttctcccagtcatttaat

SEQ ID NO: 2553130 - DNA, 13 bp, Homo sapiens
ggacaagcagagg

SEQ ID NO: 2553131 - DNA, 23 bp, Homo sapiens
ggacaaggatgatctaggaagac

SEQ ID NO: 2553132 - DNA, 16 bp, Homo sapiens
ggacaatcagtcccct

SEQ ID NO: 2553133 - DNA, 21 bp, Homo sapiens
ggacaatcatgaaatatgcat

SEQ ID NO: 2553134 - DNA, 12 bp, Homo sapiens
ggacacactaat

SEQ ID NO: 2553135 - DNA, 21 bp, Homo sapiens
ggacacagctcttctccaggc

SEQ ID NO: 2553136 - DNA, 18 bp, Homo sapiens
ggacaccagccaggctct

SEQ ID NO: 2553137 - DNA, 20 bp, Homo sapiens
ggacaccagccaggctctgt

SEQ ID NO: 2553138 - DNA, 15 bp, Homo sapiens
ggacactcctagaga

SEQ ID NO: 2553139 - DNA, 19 bp, Homo sapiens
ggacagatcaatggcgcag

SEQ ID NO: 2553140 - DNA, 19 bp, Homo sapiens
ggacagccacggccaggcc

SEQ ID NO: 2553141 - DNA, 20 bp, Homo sapiens
ggacagctccttctgtccta

SEQ ID NO: 2553142 - DNA, 22 bp, Homo sapiens
ggacagggatgagcatggagct

SEQ ID NO: 2553143 - DNA, 19 bp, Homo sapiens
ggacagtcctgggagaacc

SEQ ID NO: 2553144 - DNA, 14 bp, Homo sapiens
ggacagtgcttcag

SEQ ID NO: 2553145 - DNA, 19 bp, Homo sapiens
ggacagtgcttcagcctga

SEQ ID NO: 2553146 - DNA, 18 bp, Homo sapiens
ggatgtcactcagatgga

SEQ ID NO: 2553147 - DNA, 20 bp, Homo sapiens
ggatgtctgccaatttttgc

SEQ ID NO: 2553148 - DNA, 13 bp, Homo sapiens
ggatgtgtgcatg

SEQ ID NO: 2553149 - DNA, 13 bp, Homo sapiens
ggatgttctggga

SEQ ID NO: 2553150 - DNA, 23 bp, Homo sapiens
ggatgtttctgtcacatcagctc

SEQ ID NO: 2553151 - DNA, 18 bp, Homo sapiens
ggatgtttttcatgaaaa

SEQ ID NO: 2553152 - DNA, 19 bp, Homo sapiens
ggattacaagcgtgagcca

SEQ ID NO: 2553153 - DNA, 23 bp, Homo sapiens
ggattacaagcgtgagccactgc

SEQ ID NO: 2553154 - DNA, 15 bp, Homo sapiens
ggattacccaagcaa

SEQ ID NO: 2553155 - DNA, 17 bp, Homo sapiens
ggattattcatttaaaa

SEQ ID NO: 2553156 - DNA, 21 bp, Homo sapiens
ggattattcatttaaaatgat

SEQ ID NO: 2553157 - DNA, 22 bp, Homo sapiens
ggattatttaataacattacct

SEQ ID NO: 2553158 - DNA, 13 bp, Homo sapiens
ggattattttttc

SEQ ID NO: 2553159 - DNA, 19 bp, Homo sapiens
ggattattttttcagaccg

SEQ ID NO: 2553160 - DNA, 13 bp, Homo sapiens
ggattcaggctgc

SEQ ID NO: 2553161 - DNA, 16 bp, Homo sapiens
ggattcattacagctt

SEQ ID NO: 2553162 - DNA, 22 bp, Homo sapiens
ggattcccaccaaggtcttcag

SEQ ID NO: 2553163 - DNA, 23 bp, Homo sapiens
ggattcccaccaaggtcttcagc

SEQ ID NO: 2553164 - DNA, 14 bp, Homo sapiens
ggattcctgaccca

SEQ ID NO: 2553165 - DNA, 16 bp, Homo sapiens
ggattcctgacccagg

SEQ ID NO: 2553166 - DNA, 20 bp, Homo sapiens
ggattctactttaagcacta

SEQ ID NO: 2553167 - DNA, 13 bp, Homo sapiens
ggattgagtctgt

SEQ ID NO: 2553168 - DNA, 15 bp, Homo sapiens
ggattgctgccactt

SEQ ID NO: 2553169 - DNA, 18 bp, Homo sapiens
ggattggattatttaata

SEQ ID NO: 2553170 - DNA, 15 bp, Homo sapiens
ggattgtaaaatggt

SEQ ID NO: 2553171 - DNA, 12 bp, Homo sapiens
ggatttaacaga

SEQ ID NO: 2553172 - DNA, 16 bp, Homo sapiens
ggatttaacagaaatg

SEQ ID NO: 2553173 - DNA, 16 bp, Homo sapiens
ggatttataaatgcta

SEQ ID NO: 2553174 - DNA, 22 bp, Homo sapiens
ggattttaacaaaagcaagact

SEQ ID NO: 2553175 - DNA, 16 bp, Homo sapiens
ggattttcatcagggg

SEQ ID NO: 2553176 - DNA, 22 bp, Homo sapiens
ggattttctattgttactctgg

SEQ ID NO: 2553177 - DNA, 16 bp, Homo sapiens
ggattttgtcaagcag

SEQ ID NO: 2553178 - DNA, 16 bp, Homo sapiens
ggatttttgtcttgtg

SEQ ID NO: 2553179 - DNA, 18 bp, Homo sapiens
ggcaaaactttggcactg

SEQ ID NO: 2553180 - DNA, 23 bp, Homo sapiens
ggcaaacaggcagttggccagag

SEQ ID NO: 2553181 - DNA, 13 bp, Homo sapiens
ggcaaacccatca

SEQ ID NO: 2553182 - DNA, 16 bp, Homo sapiens
ggcaaagacagaagcc

SEQ ID NO: 2553183 - DNA, 20 bp, Homo sapiens
ggcaacacagcgagactccg

SEQ ID NO: 2553184 - DNA, 19 bp, Homo sapiens
ggcaacattgctggctgga

SEQ ID NO: 2553185 - DNA, 21 bp, Homo sapiens
ggcaaccccagttctgctcct

SEQ ID NO: 2553186 - DNA, 22 bp, Homo sapiens
ggcaaccccagttctgctcctc

SEQ ID NO: 2553187 - DNA, 23 bp, Homo sapiens
ggcaaccccagttctgctcctct

SEQ ID NO: 2553188 - DNA, 13 bp, Homo sapiens
ggcaactgaggca

SEQ ID NO: 2553189 - DNA, 20 bp, Homo sapiens
ggcaactgaggcagacagca

SEQ ID NO: 2553190 - DNA, 19 bp, Homo sapiens
ggcaagagcccccttgaca

SEQ ID NO: 2553191 - DNA, 12 bp, Homo sapiens
ggcaagaggggt

SEQ ID NO: 2553192 - DNA, 17 bp, Homo sapiens
ggcaagcacctcctgcc

SEQ ID NO: 2553193 - DNA, 19 bp, Homo sapiens
ggcaagcccctgcccatct

SEQ ID NO: 2553194 - DNA, 13 bp, Homo sapiens
ggcaaggcaggtg

SEQ ID NO: 2553195 - DNA, 13 bp, Homo sapiens
ggcaaggctgtgc

SEQ ID NO: 2553196 - DNA, 19 bp, Homo sapiens
ggcaagggccatgctgaag

SEQ ID NO: 2553197 - DNA, 23 bp, Homo sapiens
ggcaagtccctgactctctgtga

SEQ ID NO: 2553198 - DNA, 15 bp, Homo sapiens
ggcaatgctggctgt

SEQ ID NO: 2553199 - DNA, 18 bp, Homo sapiens
ggcaatgtcaggaacaga

SEQ ID NO: 2553200 - DNA, 22 bp, Homo sapiens
ggcacaatggctaattcccaga

SEQ ID NO: 2553201 - DNA, 18 bp, Homo sapiens
ggcacaccgggcactcag

SEQ ID NO: 2553202 - DNA, 15 bp, Homo sapiens
ggcacacgcctccca

SEQ ID NO: 2553203 - DNA, 14 bp, Homo sapiens
ggcacaggccccct

SEQ ID NO: 2553204 - DNA, 18 bp, Homo sapiens
ggcacatcagcacgattt

SEQ ID NO: 2553205 - DNA, 16 bp, Homo sapiens
ggcaccagcagcctgg

SEQ ID NO: 2553206 - DNA, 20 bp, Homo sapiens
ggcacccaccatcatgtctg

SEQ ID NO: 2553207 - DNA, 14 bp, Homo sapiens
ggcacccaccctgg

SEQ ID NO: 2553208 - DNA, 14 bp, Homo sapiens
ggcaccccctggag

SEQ ID NO: 2553209 - DNA, 19 bp, Homo sapiens
ggcaccccctggagagaag

SEQ ID NO: 2553210 - DNA, 20 bp, Homo sapiens
ggcaccccctggagagaagt

SEQ ID NO: 2553211 - DNA, 18 bp, Homo sapiens
ggcacccggcccctgctg

SEQ ID NO: 2553212 - DNA, 22 bp, Homo sapiens
ggcacccggcccctgctggttc

SEQ ID NO: 2553213 - DNA, 14 bp, Homo sapiens
ggcaccgagaatgt

SEQ ID NO: 2553214 - DNA, 17 bp, Homo sapiens
ggcacctataaaacagg

SEQ ID NO: 2553215 - DNA, 22 bp, Homo sapiens
ggcacctatagtcccagctact

SEQ ID NO: 2553216 - DNA, 17 bp, Homo sapiens
ggcaccttagtggcttt

SEQ ID NO: 2553217 - DNA, 21 bp, Homo sapiens
ggcactcacagacctggagcc

SEQ ID NO: 2553218 - DNA, 22 bp, Homo sapiens
ggcactcacagacctggagccc

SEQ ID NO: 2553219 - DNA, 23 bp, Homo sapiens
ggcactcagaagacactgatggg

SEQ ID NO: 2553220 - DNA, 13 bp, Homo sapiens
ggcactgagcccc

SEQ ID NO: 2553221 - DNA, 19 bp, Homo sapiens
ggcactgagcccccccaac

SEQ ID NO: 2553222 - DNA, 16 bp, Homo sapiens
ggcactgctgtgctgt

SEQ ID NO: 2553223 - DNA, 21 bp, Homo sapiens
ggcactggcattgtccctgtg

SEQ ID NO: 2553224 - DNA, 20 bp, Homo sapiens
ggcactgggatgagccgctg

SEQ ID NO: 2553225 - DNA, 11 bp, Homo sapiens
ggcacttcaca

SEQ ID NO: 2553226 - DNA, 22 bp, Homo sapiens
ggcactttgaaggggcctcacc

SEQ ID NO: 2553227 - DNA, 17 bp, Homo sapiens
ggcagaaaattgcacaa

SEQ ID NO: 2553228 - DNA, 17 bp, Homo sapiens
ggcagaaagcaaaatta

SEQ ID NO: 2553229 - DNA, 16 bp, Homo sapiens
ggcagaaagtggccat

SEQ ID NO: 2553230 - DNA, 15 bp, Homo sapiens
ggcagaacactaacc

SEQ ID NO: 2553231 - DNA, 21 bp, Homo sapiens
ggcagaacactaacctgaccg

SEQ ID NO: 2553232 - DNA, 18 bp, Homo sapiens
ggcagaacagccgctcct

SEQ ID NO: 2553233 - DNA, 13 bp, Homo sapiens
ggcagaactgagc

SEQ ID NO: 2553234 - DNA, 15 bp, Homo sapiens
ggcagaagacaccag

SEQ ID NO: 2553235 - DNA, 19 bp, Homo sapiens
ggcagaagacaccagagca

SEQ ID NO: 2553236 - DNA, 20 bp, Homo sapiens
ggcagaagacaccagagcag

SEQ ID NO: 2553237 - DNA, 21 bp, Homo sapiens
ggcagaagacaccagagcaga

SEQ ID NO: 2553238 - DNA, 22 bp, Homo sapiens
ggcagaagacaccagagcagat

SEQ ID NO: 2553239 - DNA, 19 bp, Homo sapiens
ggcagaataatctttgggt

SEQ ID NO: 2553240 - DNA, 18 bp, Homo sapiens
ggcagaatgctagctctg

SEQ ID NO: 2553241 - DNA, 20 bp, Homo sapiens
ggcagaatgctagctctgag

SEQ ID NO: 2553242 - DNA, 21 bp, Homo sapiens
ggcagaatgctagctctgagc

SEQ ID NO: 2553243 - DNA, 13 bp, Homo sapiens
ggcagacagcagc

SEQ ID NO: 2553244 - DNA, 15 bp, Homo sapiens
ggcagacagcagctc

SEQ ID NO: 2553245 - DNA, 18 bp, Homo sapiens
ggcagacagcagctcagg

SEQ ID NO: 2553246 - DNA, 14 bp, Homo sapiens
ggcagagaatcata

SEQ ID NO: 2553247 - DNA, 12 bp, Homo sapiens
ggcagagcagag

SEQ ID NO: 2553248 - DNA, 12 bp, Homo sapiens
ggcagagcccaa

SEQ ID NO: 2553249 - DNA, 16 bp, Homo sapiens
ggcagagcccaaggga

SEQ ID NO: 2553250 - DNA, 21 bp, Homo sapiens
ggcagaggttgcagtgagccg

SEQ ID NO: 2553251 - DNA, 21 bp, Homo sapiens
ggcagagtttgtgtgttgtct

SEQ ID NO: 2553252 - DNA, 20 bp, Homo sapiens
ggcagatctgtgccccatgc

SEQ ID NO: 2553253 - DNA, 12 bp, Homo sapiens
ggcagcagccat

SEQ ID NO: 2553254 - DNA, 13 bp, Homo sapiens
ggcagcagggcta

SEQ ID NO: 2553255 - DNA, 19 bp, Homo sapiens
ggcagcatagcaagacaca

SEQ ID NO: 2553256 - DNA, 20 bp, Homo sapiens
ggcagccaaacccatgaggc

SEQ ID NO: 2553257 - DNA, 15 bp, Homo sapiens
ggcagccaggccaca

SEQ ID NO: 2553258 - DNA, 20 bp, Homo sapiens
ggcagccccattctgcctgc

SEQ ID NO: 2553259 - DNA, 21 bp, Homo sapiens
ggcagccccattctgcctgcc

SEQ ID NO: 2553260 - DNA, 22 bp, Homo sapiens
ggcagccccattctgcctgccc

SEQ ID NO: 2553261 - DNA, 18 bp, Homo sapiens
ggcagcgccaagcaacct

SEQ ID NO: 2553262 - DNA, 21 bp, Homo sapiens
ggcagcgtactcatcatcaac

SEQ ID NO: 2553263 - DNA, 21 bp, Homo sapiens
ggcagctctccagtcaggagg

SEQ ID NO: 2553264 - DNA, 21 bp, Homo sapiens
ggcagctgaactattggaggg

SEQ ID NO: 2553265 - DNA, 11 bp, Homo sapiens
ggcagctgcca

SEQ ID NO: 2553266 - DNA, 12 bp, Homo sapiens
ggcagctgccac

SEQ ID NO: 2553267 - DNA, 23 bp, Homo sapiens
ggcagctgcggtccacccaggag

SEQ ID NO: 2553268 - DNA, 22 bp, Homo sapiens
ggcagctgggcccaaccctgtc

SEQ ID NO: 2553269 - DNA, 15 bp, Homo sapiens
ggcagcttgccccgg

SEQ ID NO: 2553270 - DNA, 16 bp, Homo sapiens
ggcaggaaggagagcc

SEQ ID NO: 2553271 - DNA, 21 bp, Homo sapiens
ggcaggacctcagagtccagg

SEQ ID NO: 2553272 - DNA, 16 bp, Homo sapiens
ggcaggactcagctcc

SEQ ID NO: 2553273 - DNA, 21 bp, Homo sapiens
ggcaggactcagctccccaga

SEQ ID NO: 2553274 - DNA, 23 bp, Homo sapiens
ggcaggactcagctccccagagt

SEQ ID NO: 2553275 - DNA, 16 bp, Homo sapiens
ggcaggatggcctggc

SEQ ID NO: 2553276 - DNA, 21 bp, Homo sapiens
ggcaggctaaggcgtggagct

SEQ ID NO: 2553277 - DNA, 16 bp, Homo sapiens
ggcaggctgacatctg

SEQ ID NO: 2553278 - DNA, 16 bp, Homo sapiens
ggcaggctggctggcc

SEQ ID NO: 2553279 - DNA, 18 bp, Homo sapiens
ggcagggaaaggctctga

SEQ ID NO: 2553280 - DNA, 17 bp, Homo sapiens
ggcagggtctcactctg

SEQ ID NO: 2553281 - DNA, 20 bp, Homo sapiens
ggcagggtctcactctgtcg

SEQ ID NO: 2553282 - DNA, 17 bp, Homo sapiens
ggcaggtaaactcctgt

SEQ ID NO: 2553283 - DNA, 23 bp, Homo sapiens
ggcaggtcttgaactcctggcct

SEQ ID NO: 2553284 - DNA, 21 bp, Homo sapiens
ggcaggtgccatgtctgggaa

SEQ ID NO: 2553285 - DNA, 17 bp, Homo sapiens
ggccagtctgggctgcc

SEQ ID NO: 2553286 - DNA, 19 bp, Homo sapiens
ggccagtggctggatctgt

SEQ ID NO: 2553287 - DNA, 13 bp, Homo sapiens
ggccagtgtctgt

SEQ ID NO: 2553288 - DNA, 23 bp, Homo sapiens
ggccagtgtctgtcccggggtcc

SEQ ID NO: 2553289 - DNA, 16 bp, Homo sapiens
ggccagtgtgacaagg

SEQ ID NO: 2553290 - DNA, 14 bp, Homo sapiens
ggccagttggtccc

SEQ ID NO: 2553291 - DNA, 23 bp, Homo sapiens
ggccatccggcccccagagcgcc

SEQ ID NO: 2553292 - DNA, 16 bp, Homo sapiens
ggccatgagctccaga

SEQ ID NO: 2553293 - DNA, 17 bp, Homo sapiens
ggccatgctgaagggac

SEQ ID NO: 2553294 - DNA, 16 bp, Homo sapiens
ggccatggagagctgg

SEQ ID NO: 2553295 - DNA, 13 bp, Homo sapiens
ggccatgggcctc

SEQ ID NO: 2553296 - DNA, 14 bp, Homo sapiens
ggcccaaggcggcc

SEQ ID NO: 2553297 - DNA, 21 bp, Homo sapiens
ggcccaaggcggcccctcccg

SEQ ID NO: 2553298 - DNA, 22 bp, Homo sapiens
ggcccaagtccctgttttctga

SEQ ID NO: 2553299 - DNA, 23 bp, Homo sapiens
ggcccacagcaggtgctgagcaa

SEQ ID NO: 2553300 - DNA, 12 bp, Homo sapiens
ggcccacctggc

SEQ ID NO: 2553301 - DNA, 15 bp, Homo sapiens
ggcccacctggccac

SEQ ID NO: 2553302 - DNA, 22 bp, Homo sapiens
ggcccacgcctgtaatcccagc

SEQ ID NO: 2553303 - DNA, 22 bp, Homo sapiens
ggcccacgtagggcggcactca

SEQ ID NO: 2553304 - DNA, 15 bp, Homo sapiens
ggcccagagaagcca

SEQ ID NO: 2553305 - DNA, 14 bp, Homo sapiens
ggcccagagcagga

SEQ ID NO: 2553306 - DNA, 16 bp, Homo sapiens
ggcccagagcaggaag

SEQ ID NO: 2553307 - DNA, 20 bp, Homo sapiens
ggcccagagggcctgcaagg

SEQ ID NO: 2553308 - DNA, 13 bp, Homo sapiens
ggcccagccccca

SEQ ID NO: 2553309 - DNA, 12 bp, Homo sapiens
ggcccagccctg

SEQ ID NO: 2553310 - DNA, 13 bp, Homo sapiens
ggcccagccctgc

SEQ ID NO: 2553311 - DNA, 14 bp, Homo sapiens
ggcccagccctgct

SEQ ID NO: 2553312 - DNA, 17 bp, Homo sapiens
ggcccagcggcccctcc

SEQ ID NO: 2553313 - DNA, 18 bp, Homo sapiens
ggcccagcggcccctccc

SEQ ID NO: 2553314 - DNA, 23 bp, Homo sapiens
ggcccagcggcccctcccacaca

SEQ ID NO: 2553315 - DNA, 18 bp, Homo sapiens
ggcccaggaccagctggg

SEQ ID NO: 2553316 - DNA, 10 bp, Homo sapiens
ggcccaggga

SEQ ID NO: 2553317 - DNA, 23 bp, Homo sapiens
ggcccagggacaccagccaggct

SEQ ID NO: 2553318 - DNA, 20 bp, Homo sapiens
ggcccagggagaggccatga

SEQ ID NO: 2553319 - DNA, 22 bp, Homo sapiens
ggcccagtatgagccctagaag

SEQ ID NO: 2553320 - DNA, 20 bp, Homo sapiens
ggccccaaaaccacagccct

SEQ ID NO: 2553321 - DNA, 12 bp, Homo sapiens
ggccccactggg

SEQ ID NO: 2553322 - DNA, 19 bp, Homo sapiens
ggccccagaaggcagggaa

SEQ ID NO: 2553323 - DNA, 11 bp, Homo sapiens
ggccccagcca

SEQ ID NO: 2553324 - DNA, 13 bp, Homo sapiens
ggccccagccaga

SEQ ID NO: 2553325 - DNA, 16 bp, Homo sapiens
ggccccagcccaccct

SEQ ID NO: 2553326 - DNA, 23 bp, Homo sapiens
ggccccagcccaccctcctgtct

SEQ ID NO: 2553327 - DNA, 16 bp, Homo sapiens
ggcccccagagcgccc

SEQ ID NO: 2553328 - DNA, 16 bp, Homo sapiens
ggcgctggcccagccg

SEQ ID NO: 2553329 - DNA, 20 bp, Homo sapiens
ggcggacacctggcccccga

SEQ ID NO: 2553330 - DNA, 16 bp, Homo sapiens
ggcggacgttccagcc

SEQ ID NO: 2553331 - DNA, 21 bp, Homo sapiens
ggcggagagtacagtgagcca

SEQ ID NO: 2553332 - DNA, 13 bp, Homo sapiens
ggcggagctggcc

SEQ ID NO: 2553333 - DNA, 15 bp, Homo sapiens
ggcggagctggcccc

SEQ ID NO: 2553334 - DNA, 17 bp, Homo sapiens
ggcggagctggccccgc

SEQ ID NO: 2553335 - DNA, 23 bp, Homo sapiens
ggcggagctggccccgccgcctg

SEQ ID NO: 2553336 - DNA, 20 bp, Homo sapiens
ggcggagcttgcagtgagcc

SEQ ID NO: 2553337 - DNA, 18 bp, Homo sapiens
ggcggcccaagcccgact

SEQ ID NO: 2553338 - DNA, 17 bp, Homo sapiens
ggcggcccctcccgccc

SEQ ID NO: 2553339 - DNA, 11 bp, Homo sapiens
ggcggcgccgg

SEQ ID NO: 2553340 - DNA, 18 bp, Homo sapiens
ggcggctgagagccccag

SEQ ID NO: 2553341 - DNA, 16 bp, Homo sapiens
ggcgggacccaggcac

SEQ ID NO: 2553342 - DNA, 19 bp, Homo sapiens
ggcgggacccaggcacctg

SEQ ID NO: 2553343 - DNA, 16 bp, Homo sapiens
ggcgggagcatctctt

SEQ ID NO: 2553344 - DNA, 15 bp, Homo sapiens
ggcgggccagccagg

SEQ ID NO: 2553345 - DNA, 14 bp, Homo sapiens
ggcgggcccctcat

SEQ ID NO: 2553346 - DNA, 12 bp, Homo sapiens
ggcgggtggggg

SEQ ID NO: 2553347 - DNA, 16 bp, Homo sapiens
ggcgggtgggggtgga

SEQ ID NO: 2553348 - DNA, 17 bp, Homo sapiens
ggcgtcagcctccagcc

SEQ ID NO: 2553349 - DNA, 20 bp, Homo sapiens
ggcgtggagagcccggcgcc

SEQ ID NO: 2553350 - DNA, 12 bp, Homo sapiens
ggcgtggagctg

SEQ ID NO: 2553351 - DNA, 20 bp, Homo sapiens
ggctaagtgatcctcccacc

SEQ ID NO: 2553352 - DNA, 19 bp, Homo sapiens
ggctaattcccagagtgtg

SEQ ID NO: 2553353 - DNA, 16 bp, Homo sapiens
ggctagaacctggagg

SEQ ID NO: 2553354 - DNA, 15 bp, Homo sapiens
ggctagaactggaga

SEQ ID NO: 2553355 - DNA, 16 bp, Homo sapiens
ggctagaatctggaga

SEQ ID NO: 2553356 - DNA, 13 bp, Homo sapiens
ggctagagtcctc

SEQ ID NO: 2553357 - DNA, 19 bp, Homo sapiens
ggctagagtcctcactccc

SEQ ID NO: 2553358 - DNA, 20 bp, Homo sapiens
ggctagagtcctcactccca

SEQ ID NO: 2553359 - DNA, 13 bp, Homo sapiens
ggctattcacaac

SEQ ID NO: 2553360 - DNA, 22 bp, Homo sapiens
ggctcacccccttctccatcca

SEQ ID NO: 2553361 - DNA, 20 bp, Homo sapiens
ggctcacgcctatgatccca

SEQ ID NO: 2553362 - DNA, 17 bp, Homo sapiens
ggctcactatggtgcca

SEQ ID NO: 2553363 - DNA, 14 bp, Homo sapiens
ggctcactgcagcc

SEQ ID NO: 2553364 - DNA, 15 bp, Homo sapiens
ggctcactgcagcct

SEQ ID NO: 2553365 - DNA, 13 bp, Homo sapiens
ggctcagagatgt

SEQ ID NO: 2553366 - DNA, 20 bp, Homo sapiens
ggctcagcctggtgggcctc

SEQ ID NO: 2553367 - DNA, 18 bp, Homo sapiens
ggctcagcggggacagct

SEQ ID NO: 2553368 - DNA, 19 bp, Homo sapiens
ggctcagcggggacagctc

SEQ ID NO: 2553369 - DNA, 20 bp, Homo sapiens
ggctcagcggggacagctcc

SEQ ID NO: 2553370 - DNA, 15 bp, Homo sapiens
ggctcagtctcagga

SEQ ID NO: 2553371 - DNA, 9 bp, Homo sapiens
ggctccaga

SEQ ID NO: 2553372 - DNA, 14 bp, Homo sapiens
ggctccaggagcag

SEQ ID NO: 2553373 - DNA, 16 bp, Homo sapiens
ggctccaggagcagcc

SEQ ID NO: 2553374 - DNA, 15 bp, Homo sapiens
ggctccagtctgctg

SEQ ID NO: 2553375 - DNA, 22 bp, Homo sapiens
ggctccagtctgctgccctcca

SEQ ID NO: 2553376 - DNA, 16 bp, Homo sapiens
ggctcccacaggcagc

SEQ ID NO: 2553377 - DNA, 17 bp, Homo sapiens
ggctcccacaggcagct

SEQ ID NO: 2553378 - DNA, 17 bp, Homo sapiens
ggctccccatgtgtcct

SEQ ID NO: 2553379 - DNA, 12 bp, Homo sapiens
ggctcccctcta

SEQ ID NO: 2553380 - DNA, 11 bp, Homo sapiens
ggctccctgga

SEQ ID NO: 2553381 - DNA, 17 bp, Homo sapiens
ggctcccttcccacctc

SEQ ID NO: 2553382 - DNA, 20 bp, Homo sapiens
ggctcctatctgtgttttga

SEQ ID NO: 2553383 - DNA, 12 bp, Homo sapiens
ggctcctgaggg

SEQ ID NO: 2553384 - DNA, 12 bp, Homo sapiens
ggctcctgccag

SEQ ID NO: 2553385 - DNA, 17 bp, Homo sapiens
ggctcctgccttctgtc

SEQ ID NO: 2553386 - DNA, 13 bp, Homo sapiens
ggctcctggaaag

SEQ ID NO: 2553387 - DNA, 23 bp, Homo sapiens
ggctcctgtgctactttgccttt

SEQ ID NO: 2553388 - DNA, 13 bp, Homo sapiens
ggctcctttctcc

SEQ ID NO: 2553389 - DNA, 19 bp, Homo sapiens
ggctcctttctccagccag

SEQ ID NO: 2553390 - DNA, 20 bp, Homo sapiens
ggctcctttttctccctctg

SEQ ID NO: 2553391 - DNA, 21 bp, Homo sapiens
ggctcgagcagtcctgcctca

SEQ ID NO: 2553392 - DNA, 23 bp, Homo sapiens
ggctcgcctcaggaatgggctgt

SEQ ID NO: 2553393 - DNA, 19 bp, Homo sapiens
ggctctccaagtgccagag

SEQ ID NO: 2553394 - DNA, 23 bp, Homo sapiens
ggctctccaagtgccagaggtgg

SEQ ID NO: 2553395 - DNA, 14 bp, Homo sapiens
ggctctgaaagcca

SEQ ID NO: 2553396 - DNA, 19 bp, Homo sapiens
ggctctgaggtgcctgtcc

SEQ ID NO: 2553397 - DNA, 12 bp, Homo sapiens
ggctctgcacag

SEQ ID NO: 2553398 - DNA, 14 bp, Homo sapiens
ggctctgccaccct

SEQ ID NO: 2553399 - DNA, 12 bp, Homo sapiens
ggctctgcccca

SEQ ID NO: 2553400 - DNA, 16 bp, Homo sapiens
ggctctgccccagagg

SEQ ID NO: 2553401 - DNA, 21 bp, Homo sapiens
ggctctgccccagaggcctct

SEQ ID NO: 2553402 - DNA, 14 bp, Homo sapiens
ggctctgccccagc

SEQ ID NO: 2553403 - DNA, 13 bp, Homo sapiens
ggctctgccctgc

SEQ ID NO: 2553404 - DNA, 14 bp, Homo sapiens
ggctctgcccttgg

SEQ ID NO: 2553405 - DNA, 16 bp, Homo sapiens
ggctctgcctcccatc

SEQ ID NO: 2553406 - DNA, 16 bp, Homo sapiens
ggctctgtgctgaccc

SEQ ID NO: 2553407 - DNA, 15 bp, Homo sapiens
ggctcttccaggctg

SEQ ID NO: 2553408 - DNA, 20 bp, Homo sapiens
ggctcttccaggctgggaga

SEQ ID NO: 2553409 - DNA, 15 bp, Homo sapiens
ggctctttccttgct

SEQ ID NO: 2553410 - DNA, 14 bp, Homo sapiens
ggctgaaccctgtg

SEQ ID NO: 2553411 - DNA, 19 bp, Homo sapiens
ggctgaaccctgtgctggt

SEQ ID NO: 2553412 - DNA, 20 bp, Homo sapiens
ggctgaccccaaagagcctg

SEQ ID NO: 2553413 - DNA, 22 bp, Homo sapiens
ggctgactagaagggccagtcc

SEQ ID NO: 2553414 - DNA, 18 bp, Homo sapiens
ggctgagagccccagctg

SEQ ID NO: 2553415 - DNA, 20 bp, Homo sapiens
ggctgagagccccagctgac

SEQ ID NO: 2553416 - DNA, 18 bp, Homo sapiens
ggctgagcccctacccca

SEQ ID NO: 2553417 - DNA, 14 bp, Homo sapiens
ggctgagccctggc

SEQ ID NO: 2553418 - DNA, 15 bp, Homo sapiens
ggctgagccctggca

SEQ ID NO: 2553419 - DNA, 21 bp, Homo sapiens
ggctgatgccaagttgtttga

SEQ ID NO: 2553420 - DNA, 19 bp, Homo sapiens
ggctgcaccggctggcctg

SEQ ID NO: 2553421 - DNA, 21 bp, Homo sapiens
ggctgcagcatgttgctgagg

SEQ ID NO: 2553422 - DNA, 13 bp, Homo sapiens
ggctgcagggagt

SEQ ID NO: 2553423 - DNA, 18 bp, Homo sapiens
ggctgcccactatggtca

SEQ ID NO: 2553424 - DNA, 20 bp, Homo sapiens
ggctgcccccggccccctgg

SEQ ID NO: 2553425 - DNA, 21 bp, Homo sapiens
ggctgcccccggccccctggt

SEQ ID NO: 2553426 - DNA, 12 bp, Homo sapiens
ggctgccctggc

SEQ ID NO: 2553427 - DNA, 17 bp, Homo sapiens
ggctgccctggccctga

SEQ ID NO: 2553428 - DNA, 21 bp, Homo sapiens
ggctgccctggccctgaggtg

SEQ ID NO: 2553429 - DNA, 17 bp, Homo sapiens
ggctgctgtgtgccttc

SEQ ID NO: 2553430 - DNA, 23 bp, Homo sapiens
ggctggaacagattcacactgtc

SEQ ID NO: 2553431 - DNA, 13 bp, Homo sapiens
ggctggaatctgg

SEQ ID NO: 2553432 - DNA, 19 bp, Homo sapiens
ggctggaatctggagagct

SEQ ID NO: 2553433 - DNA, 22 bp, Homo sapiens
ggctggacctatgtcctaagga

SEQ ID NO: 2553434 - DNA, 14 bp, Homo sapiens
ggctggcagctctc

SEQ ID NO: 2553435 - DNA, 13 bp, Homo sapiens
ggctggccactgc

SEQ ID NO: 2553436 - DNA, 14 bp, Homo sapiens
ggctggccactgca

SEQ ID NO: 2553437 - DNA, 17 bp, Homo sapiens
ggctggccactgcacag

SEQ ID NO: 2553438 - DNA, 19 bp, Homo sapiens
ggctggccactgcacagag

SEQ ID NO: 2553439 - DNA, 12 bp, Homo sapiens
ggctggcccagc

SEQ ID NO: 2553440 - DNA, 13 bp, Homo sapiens
ggctggcccagcc

SEQ ID NO: 2553441 - DNA, 19 bp, Homo sapiens
ggctggcccagccctgctg

SEQ ID NO: 2553442 - DNA, 22 bp, Homo sapiens
ggctggcccagccctgctggcc

SEQ ID NO: 2553443 - DNA, 15 bp, Homo sapiens
ggctggcctggcccc

SEQ ID NO: 2553444 - DNA, 16 bp, Homo sapiens
ggctggcgcagccaag

SEQ ID NO: 2553445 - DNA, 19 bp, Homo sapiens
ggctggcgcagccaaggcc

SEQ ID NO: 2553446 - DNA, 15 bp, Homo sapiens
ggctggctgcagtga

SEQ ID NO: 2553447 - DNA, 19 bp, Homo sapiens
ggctgtgcgctgacaacca

SEQ ID NO: 2553448 - DNA, 23 bp, Homo sapiens
ggctgttggcactcacagacctg

SEQ ID NO: 2553449 - DNA, 14 bp, Homo sapiens
ggctgttggctggg

SEQ ID NO: 2553450 - DNA, 15 bp, Homo sapiens
ggcttaaaacaacac

SEQ ID NO: 2553451 - DNA, 16 bp, Homo sapiens
ggcttaatgcttcttt

SEQ ID NO: 2553452 - DNA, 21 bp, Homo sapiens
ggcttagtcactgagacagcc

SEQ ID NO: 2553453 - DNA, 22 bp, Homo sapiens
ggcttcactgtataaataggag

SEQ ID NO: 2553454 - DNA, 20 bp, Homo sapiens
ggcttcagcatatttatagc

SEQ ID NO: 2553455 - DNA, 15 bp, Homo sapiens
ggcttcatgccagct

SEQ ID NO: 2553456 - DNA, 14 bp, Homo sapiens
ggcttcattcaagt

SEQ ID NO: 2553457 - DNA, 17 bp, Homo sapiens
ggcttcattcaagtcta

SEQ ID NO: 2553458 - DNA, 21 bp, Homo sapiens
ggcttccagaaaaccccagca

SEQ ID NO: 2553459 - DNA, 22 bp, Homo sapiens
ggcttcccagtggctgctgccc

SEQ ID NO: 2553460 - DNA, 15 bp, Homo sapiens
ggcttctgcaccctc

SEQ ID NO: 2553461 - DNA, 18 bp, Homo sapiens
ggcttctgcaccctccac

SEQ ID NO: 2553462 - DNA, 13 bp, Homo sapiens
ggcttgcctgcag

SEQ ID NO: 2553463 - DNA, 15 bp, Homo sapiens
ggcttgcctgcaggc

SEQ ID NO: 2553464 - DNA, 11 bp, Homo sapiens
ggcttgctgcc

SEQ ID NO: 2553465 - DNA, 14 bp, Homo sapiens
ggcttgggaccgcc

SEQ ID NO: 2553466 - DNA, 16 bp, Homo sapiens
ggcttgtgtgtttcac

SEQ ID NO: 2553467 - DNA, 22 bp, Homo sapiens
ggctttcattattagtactgct

SEQ ID NO: 2553468 - DNA, 19 bp, Homo sapiens
ggcttttattaatgcactt

SEQ ID NO: 2553469 - DNA, 13 bp, Homo sapiens
gggaaaagcagct

SEQ ID NO: 2553470 - DNA, 13 bp, Homo sapiens
gggaaaatcagcc

SEQ ID NO: 2553471 - DNA, 22 bp, Homo sapiens
gggaaagccagtgactccagga

SEQ ID NO: 2553472 - DNA, 19 bp, Homo sapiens
gggaacaagggtggcatcc

SEQ ID NO: 2553473 - DNA, 19 bp, Homo sapiens
gggaacagacaacagaagt

SEQ ID NO: 2553474 - DNA, 14 bp, Homo sapiens
gggaacagactgga

SEQ ID NO: 2553475 - DNA, 12 bp, Homo sapiens
gggaacagtgtt

SEQ ID NO: 2553476 - DNA, 20 bp, Homo sapiens
gggaacagtgtttcccataa

SEQ ID NO: 2553477 - DNA, 18 bp, Homo sapiens
gggaaccatgaagacagg

SEQ ID NO: 2553478 - DNA, 19 bp, Homo sapiens
gggaagaaaagagctttct

SEQ ID NO: 2553479 - DNA, 17 bp, Homo sapiens
gggaagacgcctgagct

SEQ ID NO: 2553480 - DNA, 21 bp, Homo sapiens
gggaagagaggagttcaatga

SEQ ID NO: 2553481 - DNA, 24 bp, Homo sapiens
gggaagagaggagttcaatgatct

SEQ ID NO: 2553482 - DNA, 22 bp, Homo sapiens
gggaagataggctctgcacaga

SEQ ID NO: 2553483 - DNA, 23 bp, Homo sapiens
gggaagcggaggttgcagggagc

SEQ ID NO: 2553484 - DNA, 16 bp, Homo sapiens
gggaagctacaggtta

SEQ ID NO: 2553485 - DNA, 12 bp, Homo sapiens
gggaagggccag

SEQ ID NO: 2553486 - DNA, 22 bp, Homo sapiens
gggaagggccagtctgggctgc

SEQ ID NO: 2553487 - DNA, 12 bp, Homo sapiens
gggaaggtcacc

SEQ ID NO: 2553488 - DNA, 21 bp, Homo sapiens
gggaagtgacaaggccccaga

SEQ ID NO: 2553489 - DNA, 14 bp, Homo sapiens
gggaataaatatgc

SEQ ID NO: 2553490 - DNA, 19 bp, Homo sapiens
gggaatactagggagaagg

SEQ ID NO: 2553491 - DNA, 14 bp, Homo sapiens
gggaatgaacctgg

SEQ ID NO: 2553492 - DNA, 16 bp, Homo sapiens
gggaatgaacctggag

SEQ ID NO: 2553493 - DNA, 22 bp, Homo sapiens
gggaattgaggtctgctcggcc

SEQ ID NO: 2553494 - DNA, 18 bp, Homo sapiens
gggaattgtgtgatgttt

SEQ ID NO: 2553495 - DNA, 23 bp, Homo sapiens
gggacacattcaaccctggagag

SEQ ID NO: 2553496 - DNA, 20 bp, Homo sapiens
gggacaccaagccttggctc

SEQ ID NO: 2553497 - DNA, 20 bp, Homo sapiens
gggacaccagccaggctctg

SEQ ID NO: 2553498 - DNA, 13 bp, Homo sapiens
gggacagaggggg

SEQ ID NO: 2553499 - DNA, 22 bp, Homo sapiens
gggacagagggggtggcctccc

SEQ ID NO: 2553500 - DNA, 23 bp, Homo sapiens
gggacagagggggtggcctccca

SEQ ID NO: 2553501 - DNA, 21 bp, Homo sapiens
gggacagggctggcccagccc

SEQ ID NO: 2553502 - DNA, 17 bp, Homo sapiens
gggaccaaggacccctc

SEQ ID NO: 2553503 - DNA, 19 bp, Homo sapiens
gggacccccgccccctgcc

SEQ ID NO: 2553504 - DNA, 18 bp, Homo sapiens
gggacctggtaccctcct

SEQ ID NO: 2553505 - DNA, 15 bp, Homo sapiens
gggactatgaatggg

SEQ ID NO: 2553506 - DNA, 16 bp, Homo sapiens
gggactgctaaataaa

SEQ ID NO: 2553507 - DNA, 12 bp, Homo sapiens
gggactgggttt

SEQ ID NO: 2553508 - DNA, 21 bp, Homo sapiens
gggactgggtttggaccccag

SEQ ID NO: 2553509 - DNA, 15 bp, Homo sapiens
gggacttccttgctc

SEQ ID NO: 2553510 - DNA, 20 bp, Homo sapiens
gggacttccttgctctccct

SEQ ID NO: 2553511 - DNA, 15 bp, Homo sapiens
gggagaacctcaggc

SEQ ID NO: 2553512 - DNA, 18 bp, Homo sapiens
gggagagagacgtgtaca

SEQ ID NO: 2553513 - DNA, 13 bp, Homo sapiens
gggagagcaggct

SEQ ID NO: 2553514 - DNA, 12 bp, Homo sapiens
gggagagccagc

SEQ ID NO: 2553515 - DNA, 12 bp, Homo sapiens
gggagagcccag

SEQ ID NO: 2553516 - DNA, 24 bp, Homo sapiens
gggagcaggcggtgggcacccacc

SEQ ID NO: 2553517 - DNA, 22 bp, Homo sapiens
gggagcccccgccccgccccac

SEQ ID NO: 2553518 - DNA, 18 bp, Homo sapiens
gggagctcctctcctgga

SEQ ID NO: 2553519 - DNA, 21 bp, Homo sapiens
gggagctgcctgttcagctcc

SEQ ID NO: 2553520 - DNA, 17 bp, Homo sapiens
gggaggaggccacctct

SEQ ID NO: 2553521 - DNA, 23 bp, Homo sapiens
gggaggatcactggagcccagga

SEQ ID NO: 2553522 - DNA, 23 bp, Homo sapiens
gggaggatctcttgagcctggga

SEQ ID NO: 2553523 - DNA, 11 bp, Homo sapiens
gggaggcagag

SEQ ID NO: 2553524 - DNA, 13 bp, Homo sapiens
gggaggcagccgg

SEQ ID NO: 2553525 - DNA, 16 bp, Homo sapiens
gggaggcatggccctg

SEQ ID NO: 2553526 - DNA, 18 bp, Homo sapiens
gggaggccccactgggga

SEQ ID NO: 2553527 - DNA, 15 bp, Homo sapiens
gggaggctgagacag

SEQ ID NO: 2553528 - DNA, 14 bp, Homo sapiens
gggaggctgaggcg

SEQ ID NO: 2553529 - DNA, 16 bp, Homo sapiens
gggagggagggctcca

SEQ ID NO: 2553530 - DNA, 11 bp, Homo sapiens
gggagggctcc

SEQ ID NO: 2553531 - DNA, 12 bp, Homo sapiens
gggaggggcagg

SEQ ID NO: 2553532 - DNA, 18 bp, Homo sapiens
gggaggtcaaggctgcag

SEQ ID NO: 2553533 - DNA, 14 bp, Homo sapiens
gggaggtcattttg

SEQ ID NO: 2553534 - DNA, 17 bp, Homo sapiens
gggaggtcgaggcagga

SEQ ID NO: 2553535 - DNA, 19 bp, Homo sapiens
gggaggtcgaggcaggagg

SEQ ID NO: 2553536 - DNA, 17 bp, Homo sapiens
gggagtggagtggaaga

SEQ ID NO: 2553537 - DNA, 21 bp, Homo sapiens
gggagtgggacagagtctggg

SEQ ID NO: 2553538 - DNA, 12 bp, Homo sapiens
gggatatgctta

SEQ ID NO: 2553539 - DNA, 13 bp, Homo sapiens
gggatcacagaga

SEQ ID NO: 2553540 - DNA, 14 bp, Homo sapiens
gggatcacagggcc

SEQ ID NO: 2553541 - DNA, 14 bp, Homo sapiens
gggatctcaggggc

SEQ ID NO: 2553542 - DNA, 18 bp, Homo sapiens
gggatcttgcattcccag

SEQ ID NO: 2553543 - DNA, 11 bp, Homo sapiens
gggatgaaaga

SEQ ID NO: 2553544 - DNA, 13 bp, Homo sapiens
gggatgagaaagg

SEQ ID NO: 2553545 - DNA, 20 bp, Homo sapiens
gggatgagctcaagcaggaa

SEQ ID NO: 2553546 - DNA, 13 bp, Homo sapiens
gggatggtgccct

SEQ ID NO: 2553547 - DNA, 15 bp, Homo sapiens
gggattcaggctgct

SEQ ID NO: 2553548 - DNA, 14 bp, Homo sapiens
gggattcctgaccc

SEQ ID NO: 2553549 - DNA, 17 bp, Homo sapiens
gggattcctgacccagg

SEQ ID NO: 2553550 - DNA, 15 bp, Homo sapiens
gggattgctgccact

SEQ ID NO: 2553551 - DNA, 15 bp, Homo sapiens
gggatttccatgatg

SEQ ID NO: 2553552 - DNA, 21 bp, Homo sapiens
gggcaaaaaactcgaggactg

SEQ ID NO: 2553553 - DNA, 18 bp, Homo sapiens
gggcaaaattcccaggga

SEQ ID NO: 2553554 - DNA, 14 bp, Homo sapiens
gggcaaagcctagt

SEQ ID NO: 2553555 - DNA, 22 bp, Homo sapiens
gggcaacagagcaagatcctgt

SEQ ID NO: 2553556 - DNA, 16 bp, Homo sapiens
gggcaacccccagcct

SEQ ID NO: 2553557 - DNA, 20 bp, Homo sapiens
gggcaacccccagcctgcta

SEQ ID NO: 2553558 - DNA, 24 bp, Homo sapiens
gggcaagtccctgactctctgtga

SEQ ID NO: 2553559 - DNA, 12 bp, Homo sapiens
gggcacacactg

SEQ ID NO: 2553560 - DNA, 23 bp, Homo sapiens
gggcacaccgggcactcagaaga

SEQ ID NO: 2553561 - DNA, 19 bp, Homo sapiens
gggcacacgcctcccactg

SEQ ID NO: 2553562 - DNA, 14 bp, Homo sapiens
gggcacttcacaga

SEQ ID NO: 2553563 - DNA, 15 bp, Homo sapiens
gggcacttcacagag

SEQ ID NO: 2553564 - DNA, 16 bp, Homo sapiens
gggcacttcacagagt

SEQ ID NO: 2553565 - DNA, 11 bp, Homo sapiens
gggcagagcag

SEQ ID NO: 2553566 - DNA, 16 bp, Homo sapiens
gggcagagcagagacc

SEQ ID NO: 2553567 - DNA, 23 bp, Homo sapiens
gggcagagcagagaccatccctg

SEQ ID NO: 2553568 - DNA, 14 bp, Homo sapiens
gggcagagcccaag

SEQ ID NO: 2553569 - DNA, 20 bp, Homo sapiens
gggcagcatagcaagacaca

SEQ ID NO: 2553570 - DNA, 17 bp, Homo sapiens
gggcagccaaacccatg

SEQ ID NO: 2553571 - DNA, 12 bp, Homo sapiens
gggcagctgcca

SEQ ID NO: 2553572 - DNA, 16 bp, Homo sapiens
gggcagctgccagaga

SEQ ID NO: 2553573 - DNA, 16 bp, Homo sapiens
gggcaggaaggagagc

SEQ ID NO: 2553574 - DNA, 18 bp, Homo sapiens
gggcaggaaggagagcct

SEQ ID NO: 2553575 - DNA, 18 bp, Homo sapiens
gggcaggagggccctacc

SEQ ID NO: 2553576 - DNA, 21 bp, Homo sapiens
ggggcccgcctggcagaactg

SEQ ID NO: 2553577 - DNA, 12 bp, Homo sapiens
ggggcctccctg

SEQ ID NO: 2553578 - DNA, 21 bp, Homo sapiens
ggggcgatcgcggcggagctg

SEQ ID NO: 2553579 - DNA, 13 bp, Homo sapiens
ggggcgctggccc

SEQ ID NO: 2553580 - DNA, 15 bp, Homo sapiens
ggggcgtggggaggg

SEQ ID NO: 2553581 - DNA, 12 bp, Homo sapiens
ggggctcctgga

SEQ ID NO: 2553582 - DNA, 21 bp, Homo sapiens
ggggctcctttctccagccag

SEQ ID NO: 2553583 - DNA, 15 bp, Homo sapiens
ggggctcgccatgcc

SEQ ID NO: 2553584 - DNA, 20 bp, Homo sapiens
ggggctctcagctcagcgcc

SEQ ID NO: 2553585 - DNA, 12 bp, Homo sapiens
ggggctctggga

SEQ ID NO: 2553586 - DNA, 17 bp, Homo sapiens
ggggctgaggtgggagg

SEQ ID NO: 2553587 - DNA, 19 bp, Homo sapiens
ggggctgaggtgggaggat

SEQ ID NO: 2553588 - DNA, 22 bp, Homo sapiens
ggggctgcaccggctggcctgg

SEQ ID NO: 2553589 - DNA, 23 bp, Homo sapiens
ggggctgcaccggctggcctggc

SEQ ID NO: 2553590 - DNA, 13 bp, Homo sapiens
ggggctgcagcat

SEQ ID NO: 2553591 - DNA, 17 bp, Homo sapiens
ggggctggcactgactg

SEQ ID NO: 2553592 - DNA, 12 bp, Homo sapiens
ggggctggccta

SEQ ID NO: 2553593 - DNA, 19 bp, Homo sapiens
ggggctggccttcctgccc

SEQ ID NO: 2553594 - DNA, 22 bp, Homo sapiens
ggggcttcaaccttgagacagc

SEQ ID NO: 2553595 - DNA, 17 bp, Homo sapiens
gggggagtctgaagcag

SEQ ID NO: 2553596 - DNA, 22 bp, Homo sapiens
gggggagtctgaagcagatgca

SEQ ID NO: 2553597 - DNA, 14 bp, Homo sapiens
gggggccatgagct

SEQ ID NO: 2553598 - DNA, 22 bp, Homo sapiens
gggggctatagctacaggaagc

SEQ ID NO: 2553599 - DNA, 13 bp, Homo sapiens
gggggctggccta

SEQ ID NO: 2553600 - DNA, 11 bp, Homo sapiens
gggggctggga

SEQ ID NO: 2553601 - DNA, 23 bp, Homo sapiens
ggggggcccgcctggcagaactg

SEQ ID NO: 2553602 - DNA, 14 bp, Homo sapiens
gggggtagagctga

SEQ ID NO: 2553603 - DNA, 22 bp, Homo sapiens
ggggtaaaattccttagcttag

SEQ ID NO: 2553604 - DNA, 15 bp, Homo sapiens
ggggtagcagctgga

SEQ ID NO: 2553605 - DNA, 18 bp, Homo sapiens
ggggtagctagaggaacc

SEQ ID NO: 2553606 - DNA, 22 bp, Homo sapiens
ggggtcactctggcagctcaga

SEQ ID NO: 2553607 - DNA, 19 bp, Homo sapiens
ggggtcctgtggcaggcag

SEQ ID NO: 2553608 - DNA, 22 bp, Homo sapiens
ggggtccttcaagttagctcag

SEQ ID NO: 2553609 - DNA, 12 bp, Homo sapiens
ggggtggcctcc

SEQ ID NO: 2553610 - DNA, 19 bp, Homo sapiens
ggggtgtggctccttccca

SEQ ID NO: 2553611 - DNA, 21 bp, Homo sapiens
ggggtgtgttccaactgcccc

SEQ ID NO: 2553612 - DNA, 21 bp, Homo sapiens
ggggttcgagaccagtctggc

SEQ ID NO: 2553613 - DNA, 22 bp, Homo sapiens
ggggttgggattgggggctggt

SEQ ID NO: 2553614 - DNA, 15 bp, Homo sapiens
ggggttgtgttgtca

SEQ ID NO: 2553615 - DNA, 13 bp, Homo sapiens
gggtacccactgc

SEQ ID NO: 2553616 - DNA, 18 bp, Homo sapiens
gggtacccactgctctgg

SEQ ID NO: 2553617 - DNA, 14 bp, Homo sapiens
gggtagagctgatc

SEQ ID NO: 2553618 - DNA, 14 bp, Homo sapiens
gggtagcccgcctg

SEQ ID NO: 2553619 - DNA, 16 bp, Homo sapiens
gggtagctagaggaac

SEQ ID NO: 2553620 - DNA, 14 bp, Homo sapiens
gggtcactctggca

SEQ ID NO: 2553621 - DNA, 22 bp, Homo sapiens
gggtcactctggcagctcagag

SEQ ID NO: 2553622 - DNA, 12 bp, Homo sapiens
gggtcagccagg

SEQ ID NO: 2553623 - DNA, 14 bp, Homo sapiens
gggtcaggagaggg

SEQ ID NO: 2553624 - DNA, 13 bp, Homo sapiens
gggtcccaagctg

SEQ ID NO: 2553625 - DNA, 20 bp, Homo sapiens
gggtcccaagctgggcccca

SEQ ID NO: 2553626 - DNA, 16 bp, Homo sapiens
gggtcccagccacccc

SEQ ID NO: 2553627 - DNA, 18 bp, Homo sapiens
gggtcctggctcctgagg

SEQ ID NO: 2553628 - DNA, 19 bp, Homo sapiens
gggtcctgtggcaggcagc

SEQ ID NO: 2553629 - DNA, 12 bp, Homo sapiens
gggtctcactct

SEQ ID NO: 2553630 - DNA, 18 bp, Homo sapiens
gggtctccaggaggagac

SEQ ID NO: 2553631 - DNA, 15 bp, Homo sapiens
gggtctccctggagt

SEQ ID NO: 2553632 - DNA, 12 bp, Homo sapiens
gggtctgaggaa

SEQ ID NO: 2553633 - DNA, 23 bp, Homo sapiens
gggtcttccctacctcaggcagg

SEQ ID NO: 2553634 - DNA, 21 bp, Homo sapiens
gggtcttttcatctgggaaag

SEQ ID NO: 2553635 - DNA, 23 bp, Homo sapiens
gggtgaataataaaagtatatat

SEQ ID NO: 2553636 - DNA, 21 bp, Homo sapiens
gggtgacaagatagagagcta

SEQ ID NO: 2553637 - DNA, 19 bp, Homo sapiens
gggtgacagagcaagtgag

SEQ ID NO: 2553638 - DNA, 18 bp, Homo sapiens
gggtgaggaccactcctg

SEQ ID NO: 2553639 - DNA, 18 bp, Homo sapiens
gggtgatatggacagcag

SEQ ID NO: 2553640 - DNA, 16 bp, Homo sapiens
gggtgatgccaggttc

SEQ ID NO: 2553641 - DNA, 22 bp, Homo sapiens
gggtgatttcagagagggcaga

SEQ ID NO: 2553642 - DNA, 14 bp, Homo sapiens
gggtgccgcctgcc

SEQ ID NO: 2553643 - DNA, 16 bp, Homo sapiens
gggtgctccctaccac

SEQ ID NO: 2553644 - DNA, 23 bp, Homo sapiens
gggtgctgcttccctctgcctgt

SEQ ID NO: 2553645 - DNA, 15 bp, Homo sapiens
gggtggagaagccat

SEQ ID NO: 2553646 - DNA, 22 bp, Homo sapiens
gggtggagactgcttcccatcc

SEQ ID NO: 2553647 - DNA, 14 bp, Homo sapiens
gggtggcactgcca

SEQ ID NO: 2553648 - DNA, 14 bp, Homo sapiens
gggtggcctcccaa

SEQ ID NO: 2553649 - DNA, 11 bp, Homo sapiens
gggtggcctcg

SEQ ID NO: 2553650 - DNA, 14 bp, Homo sapiens
gggtgggagagccc

SEQ ID NO: 2553651 - DNA, 12 bp, Homo sapiens
gggtggtgctgg

SEQ ID NO: 2553652 - DNA, 12 bp, Homo sapiens
gggtggtgggga

SEQ ID NO: 2553653 - DNA, 13 bp, Homo sapiens
gggtgtgggaggc

SEQ ID NO: 2553654 - DNA, 14 bp, Homo sapiens
gggtgtgtgtttgt

SEQ ID NO: 2553655 - DNA, 22 bp, Homo sapiens
gggtgtgtgtttgtgtgagaga

SEQ ID NO: 2553656 - DNA, 22 bp, Homo sapiens
gggttaagaaaagagatatttt

SEQ ID NO: 2553657 - DNA, 13 bp, Homo sapiens
gggttatctctgt

SEQ ID NO: 2553658 - DNA, 22 bp, Homo sapiens
gggttcaagcgattcttctgct

SEQ ID NO: 2553659 - DNA, 20 bp, Homo sapiens
gggttcacctgggctgaggc

SEQ ID NO: 2553660 - DNA, 19 bp, Homo sapiens
gggttcataggtcactggc

SEQ ID NO: 2553661 - DNA, 22 bp, Homo sapiens
gggttcataggtcactggctct

SEQ ID NO: 2553662 - DNA, 13 bp, Homo sapiens
gggttcattattg

SEQ ID NO: 2553663 - DNA, 18 bp, Homo sapiens
gggttccctttccttcca

SEQ ID NO: 2553664 - DNA, 11 bp, Homo sapiens
gggttcctgca

SEQ ID NO: 2553665 - DNA, 17 bp, Homo sapiens
gggttctacccaggtgc

SEQ ID NO: 2553666 - DNA, 14 bp, Homo sapiens
gggttctttcttcc

SEQ ID NO: 2553667 - DNA, 17 bp, Homo sapiens
gggttctttcttcctct

SEQ ID NO: 2553668 - DNA, 16 bp, Homo sapiens
gggttctttggaagga

SEQ ID NO: 2553669 - DNA, 12 bp, Homo sapiens
gggttgaaaatt

SEQ ID NO: 2553670 - DNA, 16 bp, Homo sapiens
gggttggcccctgccc

SEQ ID NO: 2553671 - DNA, 17 bp, Homo sapiens
gggtttcgagaagctgc

SEQ ID NO: 2553672 - DNA, 20 bp, Homo sapiens
gggtttcgtcatgttggcca

SEQ ID NO: 2553673 - DNA, 18 bp, Homo sapiens
gggtttgaggataggagt

SEQ ID NO: 2553674 - DNA, 18 bp, Homo sapiens
gggtttggaccccagctg

SEQ ID NO: 2553675 - DNA, 18 bp, Homo sapiens
gggttttgtattctctga

SEQ ID NO: 2553676 - DNA, 13 bp, Homo sapiens
ggtaaaatacttc

SEQ ID NO: 2553677 - DNA, 13 bp, Homo sapiens
ggtaaatgatgtg

SEQ ID NO: 2553678 - DNA, 18 bp, Homo sapiens
ggtaaatttccccaacag

SEQ ID NO: 2553679 - DNA, 20 bp, Homo sapiens
ggtaaatttccccaacagtg

SEQ ID NO: 2553680 - DNA, 13 bp, Homo sapiens
ggtaaatttctgt

SEQ ID NO: 2553681 - DNA, 21 bp, Homo sapiens
ggtaacagaacagcttcaggt

SEQ ID NO: 2553682 - DNA, 20 bp, Homo sapiens
ggtaacaggcagatacagga

SEQ ID NO: 2553683 - DNA, 15 bp, Homo sapiens
ggtacatttccctgt

SEQ ID NO: 2553684 - DNA, 18 bp, Homo sapiens
ggtacatttccctgtgct

SEQ ID NO: 2553685 - DNA, 15 bp, Homo sapiens
ggtaccaatgctgca

SEQ ID NO: 2553686 - DNA, 16 bp, Homo sapiens
ggtacccaattcaatt

SEQ ID NO: 2553687 - DNA, 11 bp, Homo sapiens
ggtacccactg

SEQ ID NO: 2553688 - DNA, 13 bp, Homo sapiens
ggtacccactgct

SEQ ID NO: 2553689 - DNA, 20 bp, Homo sapiens
ggtacccagccatctgccca

SEQ ID NO: 2553690 - DNA, 14 bp, Homo sapiens
ggtaccctcctggc

SEQ ID NO: 2553691 - DNA, 14 bp, Homo sapiens
ggtacctattttca

SEQ ID NO: 2553692 - DNA, 19 bp, Homo sapiens
ggtactattctgattacac

SEQ ID NO: 2553693 - DNA, 23 bp, Homo sapiens
ggtagaaatatctgaaaatgtat

SEQ ID NO: 2553694 - DNA, 11 bp, Homo sapiens
ggtagaacaca

SEQ ID NO: 2553695 - DNA, 23 bp, Homo sapiens
ggtagagctgatccagagcacag

SEQ ID NO: 2553696 - DNA, 23 bp, Homo sapiens
ggtagagtttgaaggaggtgagg

SEQ ID NO: 2553697 - DNA, 12 bp, Homo sapiens
ggtagatgttca

SEQ ID NO: 2553698 - DNA, 15 bp, Homo sapiens
ggtagctagaggaac

SEQ ID NO: 2553699 - DNA, 12 bp, Homo sapiens
ggtagctcaggt

SEQ ID NO: 2553700 - DNA, 13 bp, Homo sapiens
ggtagctcaggtg

SEQ ID NO: 2553701 - DNA, 18 bp, Homo sapiens
ggtagctgcccctggctc

SEQ ID NO: 2553702 - DNA, 21 bp, Homo sapiens
ggtagctgtaaggcatgaagg

SEQ ID NO: 2553703 - DNA, 15 bp, Homo sapiens
ggtaggaggatgggc

SEQ ID NO: 2553704 - DNA, 22 bp, Homo sapiens
ggtagtactcctgcaaaatttt

SEQ ID NO: 2553705 - DNA, 16 bp, Homo sapiens
ggtagttagtagcatg

SEQ ID NO: 2553706 - DNA, 16 bp, Homo sapiens
ggtatatccaaaagct

SEQ ID NO: 2553707 - DNA, 14 bp, Homo sapiens
ggtatcaggtgctg

SEQ ID NO: 2553708 - DNA, 19 bp, Homo sapiens
ggtatcaggtgctgccatc

SEQ ID NO: 2553709 - DNA, 21 bp, Homo sapiens
ggtatgaccttctaggaagct

SEQ ID NO: 2553710 - DNA, 15 bp, Homo sapiens
ggtatgagctgaggg

SEQ ID NO: 2553711 - DNA, 21 bp, Homo sapiens
ggtatggaagggtttgtggct

SEQ ID NO: 2553712 - DNA, 23 bp, Homo sapiens
ggtattggctagaggttcaaaga

SEQ ID NO: 2553713 - DNA, 18 bp, Homo sapiens
ggtcaacagctatgctgg

SEQ ID NO: 2553714 - DNA, 13 bp, Homo sapiens
ggtcacagcctcc

SEQ ID NO: 2553715 - DNA, 16 bp, Homo sapiens
ggtcacagcctcctct

SEQ ID NO: 2553716 - DNA, 17 bp, Homo sapiens
ggtcacagcctcctctg

SEQ ID NO: 2553717 - DNA, 13 bp, Homo sapiens
ggtcactggctct

SEQ ID NO: 2553718 - DNA, 16 bp, Homo sapiens
ggtcagagcctgcagt

SEQ ID NO: 2553719 - DNA, 12 bp, Homo sapiens
ggtcagccaggg

SEQ ID NO: 2553720 - DNA, 15 bp, Homo sapiens
ggtccacccaggagc

SEQ ID NO: 2553721 - DNA, 22 bp, Homo sapiens
ggtccaggggcccctccagctt

SEQ ID NO: 2553722 - DNA, 13 bp, Homo sapiens
ggtccatgggcag

SEQ ID NO: 2553723 - DNA, 18 bp, Homo sapiens
ggtccatgggcagagccc

SEQ ID NO: 2553724 - DNA, 15 bp, Homo sapiens
ggtcccaccccacac

SEQ ID NO: 2553725 - DNA, 22 bp, Homo sapiens
ggtcccacgaatttgctgggga

SEQ ID NO: 2553726 - DNA, 14 bp, Homo sapiens
ggtcccactcagtc

SEQ ID NO: 2553727 - DNA, 11 bp, Homo sapiens
ggtcccatcca

SEQ ID NO: 2553728 - DNA, 13 bp, Homo sapiens
ggtcccatccagg

SEQ ID NO: 2553729 - DNA, 14 bp, Homo sapiens
ggtcccatccaggc

SEQ ID NO: 2553730 - DNA, 17 bp, Homo sapiens
ggtcccatccaggcagt

SEQ ID NO: 2553731 - DNA, 20 bp, Homo sapiens
ggtcccatctgcagggcccc

SEQ ID NO: 2553732 - DNA, 16 bp, Homo sapiens
ggtccccacctgggac

SEQ ID NO: 2553733 - DNA, 18 bp, Homo sapiens
ggtccccatcatcccagc

SEQ ID NO: 2553734 - DNA, 21 bp, Homo sapiens
ggtccccatcatcccagctgc

SEQ ID NO: 2553735 - DNA, 23 bp, Homo sapiens
ggtcccccttccatggactttgt

SEQ ID NO: 2553736 - DNA, 18 bp, Homo sapiens
ggtccggacactcctaga

SEQ ID NO: 2553737 - DNA, 21 bp, Homo sapiens
ggtcctctgatacccagagca

SEQ ID NO: 2553738 - DNA, 20 bp, Homo sapiens
ggtcctgcagtctggctgag

SEQ ID NO: 2553739 - DNA, 21 bp, Homo sapiens
ggtcctgctgcagttgccagt

SEQ ID NO: 2553740 - DNA, 21 bp, Homo sapiens
ggtcctggagcagaccacccc

SEQ ID NO: 2553741 - DNA, 12 bp, Homo sapiens
ggtcctggctcc

SEQ ID NO: 2553742 - DNA, 14 bp, Homo sapiens
ggtcctggctcctg

SEQ ID NO: 2553743 - DNA, 12 bp, Homo sapiens
ggtcctgtggca

SEQ ID NO: 2553744 - DNA, 15 bp, Homo sapiens
ggtccttccaggccc

SEQ ID NO: 2553745 - DNA, 16 bp, Homo sapiens
ggtccttgcacccctc

SEQ ID NO: 2553746 - DNA, 13 bp, Homo sapiens
ggtcgaggcagga

SEQ ID NO: 2553747 - DNA, 22 bp, Homo sapiens
ggtcgcttactttgagtgatcc

SEQ ID NO: 2553748 - DNA, 14 bp, Homo sapiens
ggtcggaaaacatg

SEQ ID NO: 2553749 - DNA, 13 bp, Homo sapiens
ggtcggaccagct

SEQ ID NO: 2553750 - DNA, 23 bp, Homo sapiens
ggtctatgtaaatgcatctgtcc

SEQ ID NO: 2553751 - DNA, 15 bp, Homo sapiens
ggtctattgtctgta

SEQ ID NO: 2553752 - DNA, 21 bp, Homo sapiens
ggtctcaaactcctgggctca

SEQ ID NO: 2553753 - DNA, 18 bp, Homo sapiens
ggtctcacagtgttgccc

SEQ ID NO: 2553754 - DNA, 20 bp, Homo sapiens
ggtctcacagtgttgcccag

SEQ ID NO: 2553755 - DNA, 20 bp, Homo sapiens
ggtctcagcagcgaccaccc

SEQ ID NO: 2553756 - DNA, 16 bp, Homo sapiens
ggtctctaggctgggg

SEQ ID NO: 2553757 - DNA, 12 bp, Homo sapiens
ggtctctgctgc

SEQ ID NO: 2553758 - DNA, 10 bp, Homo sapiens
ggtctctggt

SEQ ID NO: 2553759 - DNA, 17 bp, Homo sapiens
ggtctgaatgttctgac

SEQ ID NO: 2553760 - DNA, 21 bp, Homo sapiens
ggtctgaatgttctgacatta

SEQ ID NO: 2553761 - DNA, 15 bp, Homo sapiens
ggtctgacccactgc

SEQ ID NO: 2553762 - DNA, 16 bp, Homo sapiens
ggtctgacccactgct

SEQ ID NO: 2553763 - DNA, 14 bp, Homo sapiens
ggtctgcaagtcag

SEQ ID NO: 2553764 - DNA, 15 bp, Homo sapiens
ggtctgcaagtcaga

SEQ ID NO: 2553765 - DNA, 14 bp, Homo sapiens
ggtctgcaggcagg

SEQ ID NO: 2553766 - DNA, 12 bp, Homo sapiens
ggtctgccacca

SEQ ID NO: 2553767 - DNA, 23 bp, Homo sapiens
ggtctgcctcttctgggagggca

SEQ ID NO: 2553768 - DNA, 16 bp, Homo sapiens
ggtctgggacttcctt

SEQ ID NO: 2553769 - DNA, 18 bp, Homo sapiens
ggtctgtacgttacctct

SEQ ID NO: 2553770 - DNA, 22 bp, Homo sapiens
ggtctgtgccaaagaagaatcc

SEQ ID NO: 2553771 - DNA, 19 bp, Homo sapiens
ggtctgttctttccaaagt

SEQ ID NO: 2553772 - DNA, 17 bp, Homo sapiens
ggtctgttttcctttct

SEQ ID NO: 2553773 - DNA, 14 bp, Homo sapiens
ggtcttcagccatc

SEQ ID NO: 2553774 - DNA, 20 bp, Homo sapiens
ggtcttccctacctcaggca

SEQ ID NO: 2553775 - DNA, 21 bp, Homo sapiens
ggtcttgaactcctggcctca

SEQ ID NO: 2553776 - DNA, 15 bp, Homo sapiens
ggtctttgtaagagt

SEQ ID NO: 2553777 - DNA, 13 bp, Homo sapiens
ggtgacaccagcc

SEQ ID NO: 2553778 - DNA, 23 bp, Homo sapiens
ggtgactgcgatcttcagagcag

SEQ ID NO: 2553779 - DNA, 19 bp, Homo sapiens
ggtgactgggccctgcctc

SEQ ID NO: 2553780 - DNA, 12 bp, Homo sapiens
ggtgagaactct

SEQ ID NO: 2553781 - DNA, 12 bp, Homo sapiens
ggtgagagctgc

SEQ ID NO: 2553782 - DNA, 22 bp, Homo sapiens
ggtgagcccatggccctcccag

SEQ ID NO: 2553783 - DNA, 15 bp, Homo sapiens
ggtgaggcaataaaa

SEQ ID NO: 2553784 - DNA, 17 bp, Homo sapiens
ggtgaggggctggcact

SEQ ID NO: 2553785 - DNA, 23 bp, Homo sapiens
ggtgatccacccacctcagcctc

SEQ ID NO: 2553786 - DNA, 24 bp, Homo sapiens
ggtgatccacccacctcagcctcc

SEQ ID NO: 2553787 - DNA, 16 bp, Homo sapiens
ggtgatgctgggctgg

SEQ ID NO: 2553788 - DNA, 22 bp, Homo sapiens
ggtgattacataatctgtacaa

SEQ ID NO: 2553789 - DNA, 22 bp, Homo sapiens
ggtgcaacccaaggactgaggg

SEQ ID NO: 2553790 - DNA, 16 bp, Homo sapiens
ggtgcacagtgatttt

SEQ ID NO: 2553791 - DNA, 16 bp, Homo sapiens
ggtgcagagctgaaga

SEQ ID NO: 2553792 - DNA, 17 bp, Homo sapiens
ggtgcagagtgcccaga

SEQ ID NO: 2553793 - DNA, 18 bp, Homo sapiens
ggtgcagttgacagcagg

SEQ ID NO: 2553794 - DNA, 21 bp, Homo sapiens
ggtgcatttgaggtctgttct

SEQ ID NO: 2553795 - DNA, 15 bp, Homo sapiens
ggtgccagcaactga

SEQ ID NO: 2553796 - DNA, 15 bp, Homo sapiens
ggtgccagccttcct

SEQ ID NO: 2553797 - DNA, 17 bp, Homo sapiens
ggtgccaggttttctgg

SEQ ID NO: 2553798 - DNA, 14 bp, Homo sapiens
ggtgcctccaggtg

SEQ ID NO: 2553799 - DNA, 16 bp, Homo sapiens
ggtgcctccaggtgtg

SEQ ID NO: 2553800 - DNA, 17 bp, Homo sapiens
ggtgcctgtcccacccc

SEQ ID NO: 2553801 - DNA, 12 bp, Homo sapiens
ggtgcggctgtg

SEQ ID NO: 2553802 - DNA, 23 bp, Homo sapiens
ggtgctaaatggtcgcccaggag

SEQ ID NO: 2553803 - DNA, 17 bp, Homo sapiens
ggtgctatctcccccag

SEQ ID NO: 2553804 - DNA, 21 bp, Homo sapiens
ggtgctatctcccccagcccc

SEQ ID NO: 2553805 - DNA, 23 bp, Homo sapiens
ggtgctatctcccccagccccat

SEQ ID NO: 2553806 - DNA, 19 bp, Homo sapiens
ggtgctcacaccccattgg

SEQ ID NO: 2553807 - DNA, 19 bp, Homo sapiens
ggtgctgtggccagggtga

SEQ ID NO: 2553808 - DNA, 18 bp, Homo sapiens
ggtgcttaagcagaagca

SEQ ID NO: 2553809 - DNA, 20 bp, Homo sapiens
ggtgcttaagcagaagcatt

SEQ ID NO: 2553810 - DNA, 17 bp, Homo sapiens
ggtgcttacacatctca

SEQ ID NO: 2553811 - DNA, 16 bp, Homo sapiens
ggtggaaggcccgagg

SEQ ID NO: 2553812 - DNA, 14 bp, Homo sapiens
ggtggacagtcctg

SEQ ID NO: 2553813 - DNA, 15 bp, Homo sapiens
ggtggacagtcctgg

SEQ ID NO: 2553814 - DNA, 18 bp, Homo sapiens
ggtggacagtcctgggag

SEQ ID NO: 2553815 - DNA, 21 bp, Homo sapiens
ggtggagaaagcactgacctg

SEQ ID NO: 2553816 - DNA, 13 bp, Homo sapiens
ggtggagggccac

SEQ ID NO: 2553817 - DNA, 14 bp, Homo sapiens
ggtggatgcctggt

SEQ ID NO: 2553818 - DNA, 23 bp, Homo sapiens
ggtggcaccagcgaagggagtgc

SEQ ID NO: 2553819 - DNA, 15 bp, Homo sapiens
ggtggcagccctgta

SEQ ID NO: 2553820 - DNA, 18 bp, Homo sapiens
ggtggcagccctgtaggg

SEQ ID NO: 2553821 - DNA, 12 bp, Homo sapiens
ggtggcagctgc

SEQ ID NO: 2553822 - DNA, 13 bp, Homo sapiens
ggtggcagctgcg

SEQ ID NO: 2553823 - DNA, 23 bp, Homo sapiens
ggtggcagctgcggtccacccag

SEQ ID NO: 2553824 - DNA, 14 bp, Homo sapiens
ggtggcaggaccag

SEQ ID NO: 2553825 - DNA, 17 bp, Homo sapiens
ggtggcctcccaactca

SEQ ID NO: 2553826 - DNA, 21 bp, Homo sapiens
ggtggcgggcgcctgtaatcc

SEQ ID NO: 2553827 - DNA, 19 bp, Homo sapiens
ggtggctcacgcctgtaat

SEQ ID NO: 2553828 - DNA, 18 bp, Homo sapiens
ggtggctgggttggaggg

SEQ ID NO: 2553829 - DNA, 20 bp, Homo sapiens
ggtgggaggattgcttgagc

SEQ ID NO: 2553830 - DNA, 14 bp, Homo sapiens
ggtgggatcctcca

SEQ ID NO: 2553831 - DNA, 18 bp, Homo sapiens
ggtgggcacccaccctgg

SEQ ID NO: 2553832 - DNA, 20 bp, Homo sapiens
ggtgggccagcccctcccac

SEQ ID NO: 2553833 - DNA, 20 bp, Homo sapiens
ggtgggcccaggaccagctg

SEQ ID NO: 2553834 - DNA, 21 bp, Homo sapiens
ggtgggcccaggaccagctgg

SEQ ID NO: 2553835 - DNA, 13 bp, Homo sapiens
ggtgggctgagcc

SEQ ID NO: 2553836 - DNA, 20 bp, Homo sapiens
ggtgggcttcccagtggctg

SEQ ID NO: 2553837 - DNA, 13 bp, Homo sapiens
ggtggggaatgtt

SEQ ID NO: 2553838 - DNA, 12 bp, Homo sapiens
ggtggggagggg

SEQ ID NO: 2553839 - DNA, 13 bp, Homo sapiens
ggtggggaggggc

SEQ ID NO: 2553840 - DNA, 14 bp, Homo sapiens
ggtggggaggggcg

SEQ ID NO: 2553841 - DNA, 14 bp, Homo sapiens
ggtgggtccatggg

SEQ ID NO: 2553842 - DNA, 19 bp, Homo sapiens
ggtgggttctttggaagga

SEQ ID NO: 2553843 - DNA, 14 bp, Homo sapiens
ggtggtatgtgtgt

SEQ ID NO: 2553844 - DNA, 18 bp, Homo sapiens
ggtggtcctgagacctga

SEQ ID NO: 2553845 - DNA, 19 bp, Homo sapiens
ggtggtctgaatgttctga

SEQ ID NO: 2553846 - DNA, 18 bp, Homo sapiens
ggtggtctgcaggcaggg

SEQ ID NO: 2553847 - DNA, 14 bp, Homo sapiens
ggtggtgacctctg

SEQ ID NO: 2553848 - DNA, 16 bp, Homo sapiens
ggtggtgacctctgcc

SEQ ID NO: 2553849 - DNA, 13 bp, Homo sapiens
ggtggtggagcca

SEQ ID NO: 2553850 - DNA, 21 bp, Homo sapiens
ggtggttatggagagggtgtc

SEQ ID NO: 2553851 - DNA, 17 bp, Homo sapiens
ggtggtttcagaaatgt

SEQ ID NO: 2553852 - DNA, 18 bp, Homo sapiens
ggtggtttcagaaatgtg

SEQ ID NO: 2553853 - DNA, 15 bp, Homo sapiens
ggtggttttctgttc

SEQ ID NO: 2553854 - DNA, 15 bp, Homo sapiens
ggtgtaataagacat

SEQ ID NO: 2553855 - DNA, 16 bp, Homo sapiens
ggtgtatggttctgtg

SEQ ID NO: 2553856 - DNA, 23 bp, Homo sapiens
ggtgtatttattttcctccccag

SEQ ID NO: 2553857 - DNA, 17 bp, Homo sapiens
ggtgtcaagagggtctg

SEQ ID NO: 2553858 - DNA, 23 bp, Homo sapiens
ggtgtcacttactgtttctgtca

SEQ ID NO: 2553859 - DNA, 13 bp, Homo sapiens
ggtgtcctgacca

SEQ ID NO: 2553860 - DNA, 14 bp, Homo sapiens
ggtgtcctgaccac

SEQ ID NO: 2553861 - DNA, 17 bp, Homo sapiens
ggtgtcctgaccaccct

SEQ ID NO: 2553862 - DNA, 18 bp, Homo sapiens
ggtgtcctgaccaccctc

SEQ ID NO: 2553863 - DNA, 20 bp, Homo sapiens
ggtgtcctgaccaccctccc

SEQ ID NO: 2553864 - DNA, 21 bp, Homo sapiens
ggtgtcgctctgctggcctgg

SEQ ID NO: 2553865 - DNA, 18 bp, Homo sapiens
ggtgtgatcgtctgactg

SEQ ID NO: 2553866 - DNA, 16 bp, Homo sapiens
ggtgtgcaccagggtt

SEQ ID NO: 2553867 - DNA, 24 bp, Homo sapiens
ggtgtgcacgtggcatgtggcctg

SEQ ID NO: 2553868 - DNA, 12 bp, Homo sapiens
ggtgtggagaag

SEQ ID NO: 2553869 - DNA, 18 bp, Homo sapiens
ggtgtgtggagatgcaga

SEQ ID NO: 2553870 - DNA, 14 bp, Homo sapiens
ggtgtgtgtagcca

SEQ ID NO: 2553871 - DNA, 21 bp, Homo sapiens
ggtgttatcaccgtgggctcc

SEQ ID NO: 2553872 - DNA, 13 bp, Homo sapiens
ggtgtttatacag

SEQ ID NO: 2553873 - DNA, 21 bp, Homo sapiens
ggtgtttctagcactggcctg

SEQ ID NO: 2553874 - DNA, 22 bp, Homo sapiens
ggttaaggctgaggaaaggcca

SEQ ID NO: 2553875 - DNA, 13 bp, Homo sapiens
ggttaataagttt

SEQ ID NO: 2553876 - DNA, 17 bp, Homo sapiens
ggttaatctttcctgat

SEQ ID NO: 2553877 - DNA, 19 bp, Homo sapiens
ggttacaacagatttgtga

SEQ ID NO: 2553878 - DNA, 16 bp, Homo sapiens
ggttagggaaaacatt

SEQ ID NO: 2553879 - DNA, 14 bp, Homo sapiens
gattaccagggact

SEQ ID NO: 2553880 - DNA, 14 bp, Homo sapiens
gattacccaagcaa

SEQ ID NO: 2553881 - DNA, 12 bp, Homo sapiens
gattactctttg

SEQ ID NO: 2553882 - DNA, 17 bp, Homo sapiens
gattagaagctgaaaac

SEQ ID NO: 2553883 - DNA, 14 bp, Homo sapiens
gattagaaggcaag

SEQ ID NO: 2553884 - DNA, 15 bp, Homo sapiens
gattagatcttttaa

SEQ ID NO: 2553885 - DNA, 12 bp, Homo sapiens
gattagctctgg

SEQ ID NO: 2553886 - DNA, 14 bp, Homo sapiens
gattagctctggac

SEQ ID NO: 2553887 - DNA, 17 bp, Homo sapiens
gattatggttttgtgat

SEQ ID NO: 2553888 - DNA, 15 bp, Homo sapiens
gattattcagtgtca

SEQ ID NO: 2553889 - DNA, 13 bp, Homo sapiens
gattattcattta

SEQ ID NO: 2553890 - DNA, 17 bp, Homo sapiens
gattattctgattccac

SEQ ID NO: 2553891 - DNA, 13 bp, Homo sapiens
gattatttaataa

SEQ ID NO: 2553892 - DNA, 18 bp, Homo sapiens
gattatttaataacatta

SEQ ID NO: 2553893 - DNA, 21 bp, Homo sapiens
gattatttaataacattacct

SEQ ID NO: 2553894 - DNA, 23 bp, Homo sapiens
gattatttaataacattacctta

SEQ ID NO: 2553895 - DNA, 14 bp, Homo sapiens
gattattttttcag

SEQ ID NO: 2553896 - DNA, 21 bp, Homo sapiens
gattattttttcagaccgaaa

SEQ ID NO: 2553897 - DNA, 21 bp, Homo sapiens
gattcaaaattgacattgctt

SEQ ID NO: 2553898 - DNA, 14 bp, Homo sapiens
gattcaatctgtaa

SEQ ID NO: 2553899 - DNA, 20 bp, Homo sapiens
gattcaatctgtaaactgtg

SEQ ID NO: 2553900 - DNA, 14 bp, Homo sapiens
gattcacatctgca

SEQ ID NO: 2553901 - DNA, 12 bp, Homo sapiens
gattcagaaatt

SEQ ID NO: 2553902 - DNA, 12 bp, Homo sapiens
gattcagacagc

SEQ ID NO: 2553903 - DNA, 18 bp, Homo sapiens
gattcagacagctgcctg

SEQ ID NO: 2553904 - DNA, 15 bp, Homo sapiens
gattcagctctgcaa

SEQ ID NO: 2553905 - DNA, 21 bp, Homo sapiens
gattcatgccaattagcaatt

SEQ ID NO: 2553906 - DNA, 17 bp, Homo sapiens
gattccaaccccaactc

SEQ ID NO: 2553907 - DNA, 22 bp, Homo sapiens
gattcccaccaaggtcttcagc

SEQ ID NO: 2553908 - DNA, 21 bp, Homo sapiens
gattccctcctgctactctgt

SEQ ID NO: 2553909 - DNA, 16 bp, Homo sapiens
gattcctgacccaggc

SEQ ID NO: 2553910 - DNA, 19 bp, Homo sapiens
gattcctgacccaggccgc

SEQ ID NO: 2553911 - DNA, 15 bp, Homo sapiens
gattcctgagccagt

SEQ ID NO: 2553912 - DNA, 14 bp, Homo sapiens
gattctcctgcctc

SEQ ID NO: 2553913 - DNA, 17 bp, Homo sapiens
gattctcctgcctcagc

SEQ ID NO: 2553914 - DNA, 21 bp, Homo sapiens
gattctcctgcctcagcctcc

SEQ ID NO: 2553915 - DNA, 22 bp, Homo sapiens
gattctgggaggaagcaggttg

SEQ ID NO: 2553916 - DNA, 12 bp, Homo sapiens
gattctgtacat

SEQ ID NO: 2553917 - DNA, 13 bp, Homo sapiens
gattcttctgctt

SEQ ID NO: 2553918 - DNA, 20 bp, Homo sapiens
gattctttcccaattcacat

SEQ ID NO: 2553919 - DNA, 22 bp, Homo sapiens
gattctttcctgaggctgggct

SEQ ID NO: 2553920 - DNA, 21 bp, Homo sapiens
gattgaaaacttttctcagat

SEQ ID NO: 2553921 - DNA, 18 bp, Homo sapiens
gattgcaacaggctgggc

SEQ ID NO: 2553922 - DNA, 19 bp, Homo sapiens
gattgcaggtggaactcag

SEQ ID NO: 2553923 - DNA, 13 bp, Homo sapiens
gattgctaaatgt

SEQ ID NO: 2553924 - DNA, 13 bp, Homo sapiens
gattgctgccact

SEQ ID NO: 2553925 - DNA, 16 bp, Homo sapiens
gattgctgccactttt

SEQ ID NO: 2553926 - DNA, 16 bp, Homo sapiens
gattgctgccccatca

SEQ ID NO: 2553927 - DNA, 21 bp, Homo sapiens
gattgctgccccatcagtgct

SEQ ID NO: 2553928 - DNA, 17 bp, Homo sapiens
gattgcttaaaatagca

SEQ ID NO: 2553929 - DNA, 16 bp, Homo sapiens
gattgcttgagcccag

SEQ ID NO: 2553930 - DNA, 18 bp, Homo sapiens
gattgcttgagctcagga

SEQ ID NO: 2553931 - DNA, 21 bp, Homo sapiens
gattggattatttaataacat

SEQ ID NO: 2553932 - DNA, 18 bp, Homo sapiens
gattggctcacccaagca

SEQ ID NO: 2553933 - DNA, 18 bp, Homo sapiens
gattgtaaaaaaaaatgc

SEQ ID NO: 2553934 - DNA, 18 bp, Homo sapiens
gattgtaacgttgctgtg

SEQ ID NO: 2553935 - DNA, 23 bp, Homo sapiens
gattgtaacgttgctgtgggaac

SEQ ID NO: 2553936 - DNA, 15 bp, Homo sapiens
gattgtccccgaccc

SEQ ID NO: 2553937 - DNA, 13 bp, Homo sapiens
gattgtgcccctg

SEQ ID NO: 2553938 - DNA, 13 bp, Homo sapiens
gattgttgtttgc

SEQ ID NO: 2553939 - DNA, 12 bp, Homo sapiens
gattgttttatc

SEQ ID NO: 2553940 - DNA, 15 bp, Homo sapiens
gatttaaaacatgta

SEQ ID NO: 2553941 - DNA, 15 bp, Homo sapiens
gatttaaaagggaag

SEQ ID NO: 2553942 - DNA, 19 bp, Homo sapiens
gatttaacagtcatttaaa

SEQ ID NO: 2553943 - DNA, 13 bp, Homo sapiens
gatttaataaaat

SEQ ID NO: 2553944 - DNA, 15 bp, Homo sapiens
gatttaataaaataa

SEQ ID NO: 2553945 - DNA, 22 bp, Homo sapiens
gatttaataaaataattctaaa

SEQ ID NO: 2553946 - DNA, 17 bp, Homo sapiens
gatttaatagtgttaat

SEQ ID NO: 2553947 - DNA, 22 bp, Homo sapiens
gatttaatagtgttaatcaatt

SEQ ID NO: 2553948 - DNA, 23 bp, Homo sapiens
gatttaatagtgttaatcaattt

SEQ ID NO: 2553949 - DNA, 19 bp, Homo sapiens
gatttacagcctcacttga

SEQ ID NO: 2553950 - DNA, 18 bp, Homo sapiens
gatttataaatgctattt

SEQ ID NO: 2553951 - DNA, 17 bp, Homo sapiens
gatttatagtttgtaca

SEQ ID NO: 2553952 - DNA, 20 bp, Homo sapiens
gatttcatttcaactgtttg

SEQ ID NO: 2553953 - DNA, 21 bp, Homo sapiens
gatttcatttcaactgtttgc

SEQ ID NO: 2553954 - DNA, 18 bp, Homo sapiens
gatttccagccagggctg

SEQ ID NO: 2553955 - DNA, 20 bp, Homo sapiens
gatttctcccagctctagac

SEQ ID NO: 2553956 - DNA, 22 bp, Homo sapiens
gatttctgtttagataatacac

SEQ ID NO: 2553957 - DNA, 16 bp, Homo sapiens
gatttgaactcagatc

SEQ ID NO: 2553958 - DNA, 11 bp, Homo sapiens
gatttgtgaac

SEQ ID NO: 2553959 - DNA, 12 bp, Homo sapiens
gattttaacaat

SEQ ID NO: 2553960 - DNA, 15 bp, Homo sapiens
gattttaattttgaa

SEQ ID NO: 2553961 - DNA, 18 bp, Homo sapiens
gattttacatgtggccca

SEQ ID NO: 2553962 - DNA, 14 bp, Homo sapiens
gattttatgcttta

SEQ ID NO: 2553963 - DNA, 15 bp, Homo sapiens
gattttatttgacaa

SEQ ID NO: 2553964 - DNA, 18 bp, Homo sapiens
gattttcaaagctttttc

SEQ ID NO: 2553965 - DNA, 20 bp, Homo sapiens
gattttctttaaaagaatgg

SEQ ID NO: 2553966 - DNA, 21 bp, Homo sapiens
gattttgaaatcatgaagata

SEQ ID NO: 2553967 - DNA, 21 bp, Homo sapiens
gattttggggttgtgttgtca

SEQ ID NO: 2553968 - DNA, 13 bp, Homo sapiens
gatttttctcaaa

SEQ ID NO: 2553969 - DNA, 23 bp, Homo sapiens
gatttttctggaggttgataact

SEQ ID NO: 2553970 - DNA, 22 bp, Homo sapiens
gcaaaagatgcttctcactgcc

SEQ ID NO: 2553971 - DNA, 20 bp, Homo sapiens
gcaaaaggttcactaaagca

SEQ ID NO: 2553972 - DNA, 21 bp, Homo sapiens
gcaaaaggttcactaaagcag

SEQ ID NO: 2553973 - DNA, 15 bp, Homo sapiens
gcaaaataattttaa

SEQ ID NO: 2553974 - DNA, 20 bp, Homo sapiens
gcaaaataattttaaacaaa

SEQ ID NO: 2553975 - DNA, 13 bp, Homo sapiens
gcaaaatcatgga

SEQ ID NO: 2553976 - DNA, 21 bp, Homo sapiens
gcaaaattgtttttggttgga

SEQ ID NO: 2553977 - DNA, 22 bp, Homo sapiens
gcaaaatttgatgccaggacac

SEQ ID NO: 2553978 - DNA, 22 bp, Homo sapiens
gcaaaccacactggactccggc

SEQ ID NO: 2553979 - DNA, 18 bp, Homo sapiens
gcaaaccccctttgtgct

SEQ ID NO: 2553980 - DNA, 19 bp, Homo sapiens
gcaaactcactgctcaaga

SEQ ID NO: 2553981 - DNA, 16 bp, Homo sapiens
gcaaagatcaaaataa

SEQ ID NO: 2553982 - DNA, 13 bp, Homo sapiens
gcaaagcaccagc

SEQ ID NO: 2553983 - DNA, 21 bp, Homo sapiens
gcaaagcaccagcttctccag

SEQ ID NO: 2553984 - DNA, 23 bp, Homo sapiens
gcaaagcaccagcttctccaggc

SEQ ID NO: 2553985 - DNA, 23 bp, Homo sapiens
gcaaagcactgacttctaagtaa

SEQ ID NO: 2553986 - DNA, 20 bp, Homo sapiens
gcaaaggactgttttttcct

SEQ ID NO: 2553987 - DNA, 13 bp, Homo sapiens
gcaaaggctggga

SEQ ID NO: 2553988 - DNA, 19 bp, Homo sapiens
gcaaagggctgaaagccat

SEQ ID NO: 2553989 - DNA, 19 bp, Homo sapiens
gcaaaggttccaactgtat

SEQ ID NO: 2553990 - DNA, 21 bp, Homo sapiens
gcaaaggttccaactgtatat

SEQ ID NO: 2553991 - DNA, 16 bp, Homo sapiens
gcaaagtatccctact

SEQ ID NO: 2553992 - DNA, 17 bp, Homo sapiens
gcaaatcctatgtgatt

SEQ ID NO: 2553993 - DNA, 14 bp, Homo sapiens
gcaaatgcccaagg

SEQ ID NO: 2553994 - DNA, 11 bp, Homo sapiens
gcaaatgccct

SEQ ID NO: 2553995 - DNA, 15 bp, Homo sapiens
gcaaatgtggctcct

SEQ ID NO: 2553996 - DNA, 12 bp, Homo sapiens
gcaaatgtgtac

SEQ ID NO: 2553997 - DNA, 22 bp, Homo sapiens
gcaacaatacatgctgctaatt

SEQ ID NO: 2553998 - DNA, 17 bp, Homo sapiens
gcaacactctatattta

SEQ ID NO: 2553999 - DNA, 13 bp, Homo sapiens
gcaacagaaaaaa

SEQ ID NO: 2554000 - DNA, 19 bp, Homo sapiens
gcaacagagtgagaccctg

SEQ ID NO: 2554001 - DNA, 13 bp, Homo sapiens
gcaacagcactgg

SEQ ID NO: 2554002 - DNA, 18 bp, Homo sapiens
gcaacagcactggctctc

SEQ ID NO: 2554003 - DNA, 17 bp, Homo sapiens
gcaacagcataacaagg

SEQ ID NO: 2554004 - DNA, 21 bp, Homo sapiens
gcaacaggaatcaagagctgc

SEQ ID NO: 2554005 - DNA, 16 bp, Homo sapiens
gcaaccccagttctgc

SEQ ID NO: 2554006 - DNA, 18 bp, Homo sapiens
gcaaccccagttctgctc

SEQ ID NO: 2554007 - DNA, 20 bp, Homo sapiens
gcaaccccagttctgctcct

SEQ ID NO: 2554008 - DNA, 18 bp, Homo sapiens
gcaacctccgcctcttgg

SEQ ID NO: 2554009 - DNA, 19 bp, Homo sapiens
gcaacctgggtccaaataa

SEQ ID NO: 2554010 - DNA, 14 bp, Homo sapiens
gcaactcatcttag

SEQ ID NO: 2554011 - DNA, 12 bp, Homo sapiens
gcaactgaataa

SEQ ID NO: 2554012 - DNA, 18 bp, Homo sapiens
gcaactgaataaatacct

SEQ ID NO: 2554013 - DNA, 21 bp, Homo sapiens
gcaactgaggcagacagcagc

SEQ ID NO: 2554014 - DNA, 18 bp, Homo sapiens
gcaactgagtctgcggga

SEQ ID NO: 2554015 - DNA, 12 bp, Homo sapiens
gcaactgttatg

SEQ ID NO: 2554016 - DNA, 18 bp, Homo sapiens
gcaactgttatgaaataa

SEQ ID NO: 2554017 - DNA, 17 bp, Homo sapiens
gcaactttaagcagctc

SEQ ID NO: 2554018 - DNA, 15 bp, Homo sapiens
gcaagaatttgatcg

SEQ ID NO: 2554019 - DNA, 14 bp, Homo sapiens
gcaagacgctgtgc

SEQ ID NO: 2554020 - DNA, 20 bp, Homo sapiens
gcaagacgctgtgctgccct

SEQ ID NO: 2554021 - DNA, 22 bp, Homo sapiens
gcaagacgctgtgctgccctgc

SEQ ID NO: 2554022 - DNA, 14 bp, Homo sapiens
gcaagagagatgtt

SEQ ID NO: 2554023 - DNA, 13 bp, Homo sapiens
gcaagatatttat

SEQ ID NO: 2554024 - DNA, 12 bp, Homo sapiens
gcaagatgtggg

SEQ ID NO: 2554025 - DNA, 16 bp, Homo sapiens
gcaagatgtgggcagt

SEQ ID NO: 2554026 - DNA, 18 bp, Homo sapiens
gcaagcaagaaacactgg

SEQ ID NO: 2554027 - DNA, 14 bp, Homo sapiens
gcaagcacatctgc

SEQ ID NO: 2554028 - DNA, 16 bp, Homo sapiens
gcaagcacctcctgcc

SEQ ID NO: 2554029 - DNA, 19 bp, Homo sapiens
gcaaggcaggtgcctccag

SEQ ID NO: 2554030 - DNA, 21 bp, Homo sapiens
gcaaggcaggtgcctccaggt

SEQ ID NO: 2554031 - DNA, 22 bp, Homo sapiens
gcaaggcaggtgcctccaggtg

SEQ ID NO: 2554032 - DNA, 13 bp, Homo sapiens
gcaaggctgtgct

SEQ ID NO: 2554033 - DNA, 14 bp, Homo sapiens
gcaagggctcccca

SEQ ID NO: 2554034 - DNA, 12 bp, Homo sapiens
gcaagtcaggac

SEQ ID NO: 2554035 - DNA, 20 bp, Homo sapiens
gcaagtccctgactctctgt

SEQ ID NO: 2554036 - DNA, 22 bp, Homo sapiens
gcaagtccctgactctctgtga

SEQ ID NO: 2554037 - DNA, 13 bp, Homo sapiens
gcaagtgaagaaa

SEQ ID NO: 2554038 - DNA, 15 bp, Homo sapiens
gcaagtgagagctgg

SEQ ID NO: 2554039 - DNA, 18 bp, Homo sapiens
gcaagtgagagctgggtg

SEQ ID NO: 2554040 - DNA, 19 bp, Homo sapiens
gcaagtgagagctgggtgt

SEQ ID NO: 2554041 - DNA, 20 bp, Homo sapiens
gcaagtgattgggacagagg

SEQ ID NO: 2554042 - DNA, 23 bp, Homo sapiens
gcaagtgtgtatgtgcgtgtgtg

SEQ ID NO: 2554043 - DNA, 11 bp, Homo sapiens
gcaataaagca

SEQ ID NO: 2554044 - DNA, 21 bp, Homo sapiens
gcaataagaatttagggagaa

SEQ ID NO: 2554045 - DNA, 23 bp, Homo sapiens
gcaataccgtgttggttttgact

SEQ ID NO: 2554046 - DNA, 17 bp, Homo sapiens
gcaatagtgggccctcc

SEQ ID NO: 2554047 - DNA, 13 bp, Homo sapiens
gcaatagtgtgtt

SEQ ID NO: 2554048 - DNA, 17 bp, Homo sapiens
gcaatatatctaaattg

SEQ ID NO: 2554049 - DNA, 15 bp, Homo sapiens
gcaatcaaatctgct

SEQ ID NO: 2554050 - DNA, 18 bp, Homo sapiens
gcaatccacaatctgaca

SEQ ID NO: 2554051 - DNA, 21 bp, Homo sapiens
gcaatccatgttagtttttac

SEQ ID NO: 2554052 - DNA, 10 bp, Homo sapiens
gcaatcctaa

SEQ ID NO: 2554053 - DNA, 15 bp, Homo sapiens
gcaatgaaaaattct

SEQ ID NO: 2554054 - DNA, 21 bp, Homo sapiens
gcaatgacatctcaggggcca

SEQ ID NO: 2554055 - DNA, 16 bp, Homo sapiens
gcaatgacatcttcaa

SEQ ID NO: 2554056 - DNA, 17 bp, Homo sapiens
gcaatgatgtccagaag

SEQ ID NO: 2554057 - DNA, 15 bp, Homo sapiens
gcaatgccatcatct

SEQ ID NO: 2554058 - DNA, 19 bp, Homo sapiens
gcaatgccatcatctcctg

SEQ ID NO: 2554059 - DNA, 16 bp, Homo sapiens
gcaatgggcactggga

SEQ ID NO: 2554060 - DNA, 20 bp, Homo sapiens
gcaatgtcaggaacagaagg

SEQ ID NO: 2554061 - DNA, 22 bp, Homo sapiens
gcaatgtcaggaacagaaggat

SEQ ID NO: 2554062 - DNA, 18 bp, Homo sapiens
gcaattcccctctgctgc

SEQ ID NO: 2554063 - DNA, 17 bp, Homo sapiens
gcaattccgcatttaat

SEQ ID NO: 2554064 - DNA, 23 bp, Homo sapiens
gcaatttttccatgaagtttgaa

SEQ ID NO: 2554065 - DNA, 18 bp, Homo sapiens
gcacaaactcaccatctg

SEQ ID NO: 2554066 - DNA, 15 bp, Homo sapiens
gcacaaatatttatt

SEQ ID NO: 2554067 - DNA, 15 bp, Homo sapiens
gcacaagctccaagc

SEQ ID NO: 2554068 - DNA, 22 bp, Homo sapiens
gcacaagctgcaccctcaggca

SEQ ID NO: 2554069 - DNA, 19 bp, Homo sapiens
gcacaaggctgaccaagag

SEQ ID NO: 2554070 - DNA, 15 bp, Homo sapiens
gcacaatagtaacct

SEQ ID NO: 2554071 - DNA, 14 bp, Homo sapiens
gcacaattctgttt

SEQ ID NO: 2554072 - DNA, 12 bp, Homo sapiens
gcacacacacac

SEQ ID NO: 2554073 - DNA, 19 bp, Homo sapiens
gcacacacacacacaggag

SEQ ID NO: 2554074 - DNA, 14 bp, Homo sapiens
gcacacaccagagc

SEQ ID NO: 2554075 - DNA, 18 bp, Homo sapiens
gcacacaccagagcccac

SEQ ID NO: 2554076 - DNA, 19 bp, Homo sapiens
gcacacaccagagcccacc

SEQ ID NO: 2554077 - DNA, 20 bp, Homo sapiens
gcacacaccagagcccacct

SEQ ID NO: 2554078 - DNA, 14 bp, Homo sapiens
gcacacgcctccca

SEQ ID NO: 2554079 - DNA, 17 bp, Homo sapiens
gcacacgcctcccactg

SEQ ID NO: 2554080 - DNA, 15 bp, Homo sapiens
gcacactcccctgca

SEQ ID NO: 2554081 - DNA, 13 bp, Homo sapiens
gcacactttgcca

SEQ ID NO: 2554082 - DNA, 17 bp, Homo sapiens
gcacagaccctgccctg

SEQ ID NO: 2554083 - DNA, 19 bp, Homo sapiens
gcacagaccctgccctgtg

SEQ ID NO: 2554084 - DNA, 17 bp, Homo sapiens
gcacagagctctccagc

SEQ ID NO: 2554085 - DNA, 22 bp, Homo sapiens
gcacagagttgttacattttta

SEQ ID NO: 2554086 - DNA, 22 bp, Homo sapiens
gcacagcatgagaggctctgtg

SEQ ID NO: 2554087 - DNA, 16 bp, Homo sapiens
gcacagggcagctggg

SEQ ID NO: 2554088 - DNA, 12 bp, Homo sapiens
gcacagtgattt

SEQ ID NO: 2554089 - DNA, 16 bp, Homo sapiens
gcacagtggtggcagg

SEQ ID NO: 2554090 - DNA, 15 bp, Homo sapiens
gcacagttcatggtt

SEQ ID NO: 2554091 - DNA, 13 bp, Homo sapiens
gcacagtttgaac

SEQ ID NO: 2554092 - DNA, 20 bp, Homo sapiens
gcacagttttctgagaaaga

SEQ ID NO: 2554093 - DNA, 23 bp, Homo sapiens
gcacagttttctgagaaagacta

SEQ ID NO: 2554094 - DNA, 21 bp, Homo sapiens
gcacatagctatcaagtgtgc

SEQ ID NO: 2554095 - DNA, 13 bp, Homo sapiens
gcacatatggact

SEQ ID NO: 2554096 - DNA, 19 bp, Homo sapiens
gcacatcagcacgatttct

SEQ ID NO: 2554097 - DNA, 17 bp, Homo sapiens
gcacatcctatgcaata

SEQ ID NO: 2554098 - DNA, 18 bp, Homo sapiens
gcacatctgtgtcttgtt

SEQ ID NO: 2554099 - DNA, 19 bp, Homo sapiens
gcacatgcctgtagtccca

SEQ ID NO: 2554100 - DNA, 13 bp, Homo sapiens
gcacatgtcttgt

SEQ ID NO: 2554101 - DNA, 17 bp, Homo sapiens
gcacattcttagagtta

SEQ ID NO: 2554102 - DNA, 23 bp, Homo sapiens
gcacatttaagagacagtcaccc

SEQ ID NO: 2554103 - DNA, 18 bp, Homo sapiens
gcaccaaaataagaaaag

SEQ ID NO: 2554104 - DNA, 20 bp, Homo sapiens
gcaccaccctagtcccttcc

SEQ ID NO: 2554105 - DNA, 20 bp, Homo sapiens
gcaccactgcactccagcct

SEQ ID NO: 2554106 - DNA, 21 bp, Homo sapiens
gcaccactgcactccagcctg

SEQ ID NO: 2554107 - DNA, 22 bp, Homo sapiens
gcaccactgcactccagcctgg

SEQ ID NO: 2554108 - DNA, 13 bp, Homo sapiens
gcaccagcagcct

SEQ ID NO: 2554109 - DNA, 19 bp, Homo sapiens
gcaccagcttctccaggct

SEQ ID NO: 2554110 - DNA, 23 bp, Homo sapiens
gcaccagggttgaccccagagga

SEQ ID NO: 2554111 - DNA, 13 bp, Homo sapiens
gcaccatccgcca

SEQ ID NO: 2554112 - DNA, 20 bp, Homo sapiens
gcaccatctctgattttcaa

SEQ ID NO: 2554113 - DNA, 14 bp, Homo sapiens
gcacccaccctggg

SEQ ID NO: 2554114 - DNA, 11 bp, Homo sapiens
gcacccagccc

SEQ ID NO: 2554115 - DNA, 15 bp, Homo sapiens
gcacccagccctggt

SEQ ID NO: 2554116 - DNA, 17 bp, Homo sapiens
gcacccagtgagcactc

SEQ ID NO: 2554117 - DNA, 13 bp, Homo sapiens
gcaccccaaggct

SEQ ID NO: 2554118 - DNA, 14 bp, Homo sapiens
gcacccccaccctt

SEQ ID NO: 2554119 - DNA, 15 bp, Homo sapiens
gcacccccacccttt

SEQ ID NO: 2554120 - DNA, 14 bp, Homo sapiens
gcaccccccaagct

SEQ ID NO: 2554121 - DNA, 14 bp, Homo sapiens
gcacccccctgggc

SEQ ID NO: 2554122 - DNA, 21 bp, Homo sapiens
gcacccccctgggctgagaga

SEQ ID NO: 2554123 - DNA, 13 bp, Homo sapiens
gcaccccttccat

SEQ ID NO: 2554124 - DNA, 16 bp, Homo sapiens
gcacccgcctctcccg

SEQ ID NO: 2554125 - DNA, 14 bp, Homo sapiens
gcacccggcccctg

SEQ ID NO: 2554126 - DNA, 17 bp, Homo sapiens
gcacccggcccctgctg

SEQ ID NO: 2554127 - DNA, 18 bp, Homo sapiens
gcacccggcccctgctgg

SEQ ID NO: 2554128 - DNA, 14 bp, Homo sapiens
gcaccctccaccct

SEQ ID NO: 2554129 - DNA, 22 bp, Homo sapiens
gcaccctccaccctgtccccca

SEQ ID NO: 2554130 - DNA, 16 bp, Homo sapiens
gcaccctccgccttca

SEQ ID NO: 2554131 - DNA, 15 bp, Homo sapiens
gcaccctggggcctg

SEQ ID NO: 2554132 - DNA, 17 bp, Homo sapiens
gcaccctggggcctgga

SEQ ID NO: 2554133 - DNA, 21 bp, Homo sapiens
gcaccctggggcctggacctg

SEQ ID NO: 2554134 - DNA, 17 bp, Homo sapiens
gcacccttctttcctct

SEQ ID NO: 2554135 - DNA, 19 bp, Homo sapiens
gcacccttctttcctcttc

SEQ ID NO: 2554136 - DNA, 14 bp, Homo sapiens
gcaccgccttctct

SEQ ID NO: 2554137 - DNA, 15 bp, Homo sapiens
gcaccggctggcctg

SEQ ID NO: 2554138 - DNA, 18 bp, Homo sapiens
gcaccggctggcctggcc

SEQ ID NO: 2554139 - DNA, 21 bp, Homo sapiens
gcaccggctggcctggcccct

SEQ ID NO: 2554140 - DNA, 23 bp, Homo sapiens
gcaccgggccacagagaaagtac

SEQ ID NO: 2554141 - DNA, 14 bp, Homo sapiens
gcaccgtactgtgg

SEQ ID NO: 2554142 - DNA, 21 bp, Homo sapiens
gcacctaaaccaccagtgccc

SEQ ID NO: 2554143 - DNA, 23 bp, Homo sapiens
gcacctaaaccaccagtgcccaa

SEQ ID NO: 2554144 - DNA, 21 bp, Homo sapiens
gcacctacagtgtacagtctt

SEQ ID NO: 2554145 - DNA, 11 bp, Homo sapiens
gcacctcccat

SEQ ID NO: 2554146 - DNA, 12 bp, Homo sapiens
gcacctcctgcc

SEQ ID NO: 2554147 - DNA, 13 bp, Homo sapiens
gcacctgccagcc

SEQ ID NO: 2554148 - DNA, 15 bp, Homo sapiens
gcacctgccagcctg

SEQ ID NO: 2554149 - DNA, 22 bp, Homo sapiens
gcacctgccagcctggcttctg

SEQ ID NO: 2554150 - DNA, 15 bp, Homo sapiens
gcacctgccccctgg

SEQ ID NO: 2554151 - DNA, 22 bp, Homo sapiens
gcacctgccccctggtggacag

SEQ ID NO: 2554152 - DNA, 15 bp, Homo sapiens
gcacctgctctcttg

SEQ ID NO: 2554153 - DNA, 21 bp, Homo sapiens
gcacctggaatatataaccag

SEQ ID NO: 2554154 - DNA, 21 bp, Homo sapiens
gcacctgtactcaggaggctg

SEQ ID NO: 2554155 - DNA, 18 bp, Homo sapiens
gcaccttaccaactttct

SEQ ID NO: 2554156 - DNA, 19 bp, Homo sapiens
gcaccttaccaactttctg

SEQ ID NO: 2554157 - DNA, 20 bp, Homo sapiens
gcaccttaccaactttctgt

SEQ ID NO: 2554158 - DNA, 14 bp, Homo sapiens
gcaccttagacagt

SEQ ID NO: 2554159 - DNA, 18 bp, Homo sapiens
gcaccttagacagtccct

SEQ ID NO: 2554160 - DNA, 19 bp, Homo sapiens
gcaccttagacagtccctg

SEQ ID NO: 2554161 - DNA, 20 bp, Homo sapiens
gcaccttagacagtccctgc

SEQ ID NO: 2554162 - DNA, 13 bp, Homo sapiens
gcaccttagtggc

SEQ ID NO: 2554163 - DNA, 16 bp, Homo sapiens
gcaccttagtggcttt

SEQ ID NO: 2554164 - DNA, 14 bp, Homo sapiens
gcacgcacacacac

SEQ ID NO: 2554165 - DNA, 18 bp, Homo sapiens
gcacgcccatgtgtgagt

SEQ ID NO: 2554166 - DNA, 12 bp, Homo sapiens
gcacggctgctg

SEQ ID NO: 2554167 - DNA, 13 bp, Homo sapiens
gcacggctgctga

SEQ ID NO: 2554168 - DNA, 14 bp, Homo sapiens
gcacggtgggcctt

SEQ ID NO: 2554169 - DNA, 17 bp, Homo sapiens
gcacggtgggccttgct

SEQ ID NO: 2554170 - DNA, 23 bp, Homo sapiens
gcacgtggcatgtggcctgtggc

SEQ ID NO: 2554171 - DNA, 14 bp, Homo sapiens
gcacgtgtgtgcac

SEQ ID NO: 2554172 - DNA, 22 bp, Homo sapiens
gcacgttatggtgtttctccct

SEQ ID NO: 2554173 - DNA, 21 bp, Homo sapiens
gcactactccctcaaagcaca

SEQ ID NO: 2554174 - DNA, 17 bp, Homo sapiens
gcactactctgtgccag

SEQ ID NO: 2554175 - DNA, 21 bp, Homo sapiens
gcactaggggatataggagag

SEQ ID NO: 2554176 - DNA, 15 bp, Homo sapiens
gcactataatgtaag

SEQ ID NO: 2554177 - DNA, 22 bp, Homo sapiens
gcactataatgtaagctctact

SEQ ID NO: 2554178 - DNA, 22 bp, Homo sapiens
gcactatgaggaataattattt

SEQ ID NO: 2554179 - DNA, 16 bp, Homo sapiens
gcactcacagacctgg

SEQ ID NO: 2554180 - DNA, 23 bp, Homo sapiens
gcactcacccatgtgccaaggtg

SEQ ID NO: 2554181 - DNA, 12 bp, Homo sapiens
gccaccaggctg

SEQ ID NO: 2554182 - DNA, 17 bp, Homo sapiens
gccaccaggctggcgca

SEQ ID NO: 2554183 - DNA, 20 bp, Homo sapiens
gccaccaggctggcgcagcc

SEQ ID NO: 2554184 - DNA, 23 bp, Homo sapiens
gccaccatattcagtgctgtggc

SEQ ID NO: 2554185 - DNA, 18 bp, Homo sapiens
gccaccccaccctccctg

SEQ ID NO: 2554186 - DNA, 20 bp, Homo sapiens
gccaccccaccctccctgga

SEQ ID NO: 2554187 - DNA, 21 bp, Homo sapiens
gccaccccaccctccctggag

SEQ ID NO: 2554188 - DNA, 19 bp, Homo sapiens
gccaccccgggctctctgc

SEQ ID NO: 2554189 - DNA, 21 bp, Homo sapiens
gccaccccgggctctctgctg

SEQ ID NO: 2554190 - DNA, 18 bp, Homo sapiens
gccacccgttctgctggc

SEQ ID NO: 2554191 - DNA, 22 bp, Homo sapiens
gccacccgttctgctggcctgg

SEQ ID NO: 2554192 - DNA, 16 bp, Homo sapiens
gccaccctcatgctgt

SEQ ID NO: 2554193 - DNA, 13 bp, Homo sapiens
gccaccctgggga

SEQ ID NO: 2554194 - DNA, 20 bp, Homo sapiens
gccaccgcttccggctcctg

SEQ ID NO: 2554195 - DNA, 23 bp, Homo sapiens
gccaccgcttccggctcctgtgc

SEQ ID NO: 2554196 - DNA, 19 bp, Homo sapiens
gccacctatctcgtgggag

SEQ ID NO: 2554197 - DNA, 21 bp, Homo sapiens
gccacctatctcgtgggagag

SEQ ID NO: 2554198 - DNA, 13 bp, Homo sapiens
gccacctccagaa

SEQ ID NO: 2554199 - DNA, 14 bp, Homo sapiens
gccacctctccaag

SEQ ID NO: 2554200 - DNA, 15 bp, Homo sapiens
gccacctctccaagg

SEQ ID NO: 2554201 - DNA, 16 bp, Homo sapiens
gccacctctctccttt

SEQ ID NO: 2554202 - DNA, 22 bp, Homo sapiens
gccacctgaggtgggcccagga

SEQ ID NO: 2554203 - DNA, 16 bp, Homo sapiens
gccacctgcccccttc

SEQ ID NO: 2554204 - DNA, 17 bp, Homo sapiens
gccacctgcccccttct

SEQ ID NO: 2554205 - DNA, 20 bp, Homo sapiens
gccacctgcccccttctccc

SEQ ID NO: 2554206 - DNA, 21 bp, Homo sapiens
gccacctgcccccttctccca

SEQ ID NO: 2554207 - DNA, 23 bp, Homo sapiens
gccacctgcccccttctcccaca

SEQ ID NO: 2554208 - DNA, 20 bp, Homo sapiens
gccacctgcggtgctatctc

SEQ ID NO: 2554209 - DNA, 15 bp, Homo sapiens
gccacggccaggcca

SEQ ID NO: 2554210 - DNA, 16 bp, Homo sapiens
gccacggccaggccag

SEQ ID NO: 2554211 - DNA, 23 bp, Homo sapiens
gccactaactagagcagccctgg

SEQ ID NO: 2554212 - DNA, 19 bp, Homo sapiens
gccactacactccagcctg

SEQ ID NO: 2554213 - DNA, 21 bp, Homo sapiens
gccactacactccagcctgag

SEQ ID NO: 2554214 - DNA, 23 bp, Homo sapiens
gccactacactccagcctgagca

SEQ ID NO: 2554215 - DNA, 16 bp, Homo sapiens
gccactcaccgaagcc

SEQ ID NO: 2554216 - DNA, 15 bp, Homo sapiens
gccactcagcttcct

SEQ ID NO: 2554217 - DNA, 21 bp, Homo sapiens
gccactcaggaggctgaggca

SEQ ID NO: 2554218 - DNA, 14 bp, Homo sapiens
gccactcctctgac

SEQ ID NO: 2554219 - DNA, 17 bp, Homo sapiens
gccactcctctgactca

SEQ ID NO: 2554220 - DNA, 23 bp, Homo sapiens
gccactcctctgactcagggctc

SEQ ID NO: 2554221 - DNA, 15 bp, Homo sapiens
gccactgaagctggg

SEQ ID NO: 2554222 - DNA, 16 bp, Homo sapiens
gccactgcacagagct

SEQ ID NO: 2554223 - DNA, 17 bp, Homo sapiens
gccactgcacagagctc

SEQ ID NO: 2554224 - DNA, 18 bp, Homo sapiens
gccactgcaccgggccac

SEQ ID NO: 2554225 - DNA, 19 bp, Homo sapiens
gccactgcaccgggccaca

SEQ ID NO: 2554226 - DNA, 20 bp, Homo sapiens
gccactgcactccagcctgg

SEQ ID NO: 2554227 - DNA, 18 bp, Homo sapiens
gccactgcccgagctggt

SEQ ID NO: 2554228 - DNA, 19 bp, Homo sapiens
gccactgcccgagctggtg

SEQ ID NO: 2554229 - DNA, 17 bp, Homo sapiens
gccactgcctcttcctc

SEQ ID NO: 2554230 - DNA, 16 bp, Homo sapiens
gccactggccatctcc

SEQ ID NO: 2554231 - DNA, 21 bp, Homo sapiens
gccacttaccttcaataaagt

SEQ ID NO: 2554232 - DNA, 21 bp, Homo sapiens
gccactttggtacatggccag

SEQ ID NO: 2554233 - DNA, 22 bp, Homo sapiens
gccactttggtacatggccagt

SEQ ID NO: 2554234 - DNA, 16 bp, Homo sapiens
gccagaacagtttgta

SEQ ID NO: 2554235 - DNA, 22 bp, Homo sapiens
gccagacatcaacagataaata

SEQ ID NO: 2554236 - DNA, 19 bp, Homo sapiens
gccagactggcacagtttt

SEQ ID NO: 2554237 - DNA, 14 bp, Homo sapiens
gccagagaagtgac

SEQ ID NO: 2554238 - DNA, 20 bp, Homo sapiens
gccagagacggaagcctttt

SEQ ID NO: 2554239 - DNA, 22 bp, Homo sapiens
gccagagctacccgcagagttc

SEQ ID NO: 2554240 - DNA, 15 bp, Homo sapiens
gccagagctgggagg

SEQ ID NO: 2554241 - DNA, 21 bp, Homo sapiens
gccagaggaactgtccagaga

SEQ ID NO: 2554242 - DNA, 23 bp, Homo sapiens
gccagaggaactgtccagagagc

SEQ ID NO: 2554243 - DNA, 22 bp, Homo sapiens
gccagaggctcgttgactggct

SEQ ID NO: 2554244 - DNA, 21 bp, Homo sapiens
gccagagggagtgacagaggc

SEQ ID NO: 2554245 - DNA, 16 bp, Homo sapiens
gccagaggtgggcagg

SEQ ID NO: 2554246 - DNA, 18 bp, Homo sapiens
gccagagtggcctggcca

SEQ ID NO: 2554247 - DNA, 19 bp, Homo sapiens
gccagagtggcctggccag

SEQ ID NO: 2554248 - DNA, 24 bp, Homo sapiens
gccagagtggcctggccaggagct

SEQ ID NO: 2554249 - DNA, 13 bp, Homo sapiens
gccagagttcctg

SEQ ID NO: 2554250 - DNA, 15 bp, Homo sapiens
gccagatcctcttgg

SEQ ID NO: 2554251 - DNA, 16 bp, Homo sapiens
gccagatcctcttggt

SEQ ID NO: 2554252 - DNA, 16 bp, Homo sapiens
gccagatgcaccagcc

SEQ ID NO: 2554253 - DNA, 12 bp, Homo sapiens
gccagatgctga

SEQ ID NO: 2554254 - DNA, 17 bp, Homo sapiens
gccagatgctgatgttc

SEQ ID NO: 2554255 - DNA, 20 bp, Homo sapiens
gccagatgctgatgttcagt

SEQ ID NO: 2554256 - DNA, 24 bp, Homo sapiens
gccagattctttcctgaggctggg

SEQ ID NO: 2554257 - DNA, 14 bp, Homo sapiens
gccagcaactgaat

SEQ ID NO: 2554258 - DNA, 16 bp, Homo sapiens
gccagcaactgaataa

SEQ ID NO: 2554259 - DNA, 18 bp, Homo sapiens
gccagcagccagctctca

SEQ ID NO: 2554260 - DNA, 20 bp, Homo sapiens
gccagcagccagctctcagc

SEQ ID NO: 2554261 - DNA, 23 bp, Homo sapiens
gccagcagccagctctcagccaa

SEQ ID NO: 2554262 - DNA, 11 bp, Homo sapiens
gccagccaggc

SEQ ID NO: 2554263 - DNA, 13 bp, Homo sapiens
gccagccaggcgg

SEQ ID NO: 2554264 - DNA, 15 bp, Homo sapiens
gccagccccacccag

SEQ ID NO: 2554265 - DNA, 17 bp, Homo sapiens
gccagccccacccagga

SEQ ID NO: 2554266 - DNA, 11 bp, Homo sapiens
gccagcccctc

SEQ ID NO: 2554267 - DNA, 16 bp, Homo sapiens
gccagcccctcccacc

SEQ ID NO: 2554268 - DNA, 20 bp, Homo sapiens
gccagcccctcccaccacag

SEQ ID NO: 2554269 - DNA, 21 bp, Homo sapiens
gccagcccctcccaccacagc

SEQ ID NO: 2554270 - DNA, 20 bp, Homo sapiens
gccagccgtgatgctcaggc

SEQ ID NO: 2554271 - DNA, 18 bp, Homo sapiens
gccagcctggcttctgga

SEQ ID NO: 2554272 - DNA, 20 bp, Homo sapiens
gccagcctggcttctggagc

SEQ ID NO: 2554273 - DNA, 21 bp, Homo sapiens
gccagcctggcttctggagcc

SEQ ID NO: 2554274 - DNA, 19 bp, Homo sapiens
gccagccttcctctgcagc

SEQ ID NO: 2554275 - DNA, 21 bp, Homo sapiens
gccagccttcctctgcagctg

SEQ ID NO: 2554276 - DNA, 14 bp, Homo sapiens
gccagccttgacca

SEQ ID NO: 2554277 - DNA, 16 bp, Homo sapiens
gccagcgaacttgaca

SEQ ID NO: 2554278 - DNA, 12 bp, Homo sapiens
gccagcgtcctc

SEQ ID NO: 2554279 - DNA, 23 bp, Homo sapiens
gccagctacttcctcctccccac

SEQ ID NO: 2554280 - DNA, 14 bp, Homo sapiens
gccagctcatttca

SEQ ID NO: 2554281 - DNA, 15 bp, Homo sapiens
gccagctctgtatca

SEQ ID NO: 2554282 - DNA, 13 bp, Homo sapiens
gccagctgctccc

SEQ ID NO: 2554283 - DNA, 15 bp, Homo sapiens
gccagctgctcccca

SEQ ID NO: 2554284 - DNA, 18 bp, Homo sapiens
gccagctggcagcagagt

SEQ ID NO: 2554285 - DNA, 19 bp, Homo sapiens
gccaggactccccaggcca

SEQ ID NO: 2554286 - DNA, 21 bp, Homo sapiens
gccaggactccccaggccagg

SEQ ID NO: 2554287 - DNA, 15 bp, Homo sapiens
gccaggagcaaatgt

SEQ ID NO: 2554288 - DNA, 20 bp, Homo sapiens
gccaggagcaaatgtttctg

SEQ ID NO: 2554289 - DNA, 22 bp, Homo sapiens
gccaggagcaaatgtttctgca

SEQ ID NO: 2554290 - DNA, 22 bp, Homo sapiens
gccaggagctgggcagaaggcc

SEQ ID NO: 2554291 - DNA, 16 bp, Homo sapiens
gccaggaggccaggct

SEQ ID NO: 2554292 - DNA, 19 bp, Homo sapiens
gccaggatcatggtgtaat

SEQ ID NO: 2554293 - DNA, 20 bp, Homo sapiens
gccaggcaccccctggagag

SEQ ID NO: 2554294 - DNA, 14 bp, Homo sapiens
gccaggcagatctg

SEQ ID NO: 2554295 - DNA, 21 bp, Homo sapiens
gccaggccacaagacccttgt

SEQ ID NO: 2554296 - DNA, 15 bp, Homo sapiens
gccaggccaccagga

SEQ ID NO: 2554297 - DNA, 15 bp, Homo sapiens
gccaggccagaggga

SEQ ID NO: 2554298 - DNA, 13 bp, Homo sapiens
gccaggccagctg

SEQ ID NO: 2554299 - DNA, 19 bp, Homo sapiens
gccaggccctctgcccact

SEQ ID NO: 2554300 - DNA, 17 bp, Homo sapiens
gccaggcctcttggcag

SEQ ID NO: 2554301 - DNA, 21 bp, Homo sapiens
gccaggcctcttggcagtcac

SEQ ID NO: 2554302 - DNA, 16 bp, Homo sapiens
gccaggcgggctcaag

SEQ ID NO: 2554303 - DNA, 18 bp, Homo sapiens
gccaggctccttcctgtc

SEQ ID NO: 2554304 - DNA, 20 bp, Homo sapiens
gccaggctctgtgctgaccc

SEQ ID NO: 2554305 - DNA, 18 bp, Homo sapiens
gccagggaagtccccgag

SEQ ID NO: 2554306 - DNA, 13 bp, Homo sapiens
gccagggacagag

SEQ ID NO: 2554307 - DNA, 18 bp, Homo sapiens
gccagggacagagggggt

SEQ ID NO: 2554308 - DNA, 21 bp, Homo sapiens
gccagggcagagtgagaccca

SEQ ID NO: 2554309 - DNA, 14 bp, Homo sapiens
gccagggcagggcc

SEQ ID NO: 2554310 - DNA, 13 bp, Homo sapiens
gccagggccctgc

SEQ ID NO: 2554311 - DNA, 15 bp, Homo sapiens
gccagggccctgcag

SEQ ID NO: 2554312 - DNA, 18 bp, Homo sapiens
gccaggggtctccctgga

SEQ ID NO: 2554313 - DNA, 16 bp, Homo sapiens
gccaggtccttgccct

SEQ ID NO: 2554314 - DNA, 16 bp, Homo sapiens
gccaggtgccttggag

SEQ ID NO: 2554315 - DNA, 20 bp, Homo sapiens
gccaggttctatttggaatt

SEQ ID NO: 2554316 - DNA, 19 bp, Homo sapiens
gccaggttttctgggtgtc

SEQ ID NO: 2554317 - DNA, 12 bp, Homo sapiens
gccagtaaatgg

SEQ ID NO: 2554318 - DNA, 23 bp, Homo sapiens
gccagtaagggaaatagaaaaac

SEQ ID NO: 2554319 - DNA, 17 bp, Homo sapiens
gccagtcaccccggcca

SEQ ID NO: 2554320 - DNA, 20 bp, Homo sapiens
gccagtcaccccggccacct

SEQ ID NO: 2554321 - DNA, 13 bp, Homo sapiens
gccagtcccaggg

SEQ ID NO: 2554322 - DNA, 16 bp, Homo sapiens
gccagtcccaggggca

SEQ ID NO: 2554323 - DNA, 22 bp, Homo sapiens
gccagtcctagctgcacagggc

SEQ ID NO: 2554324 - DNA, 16 bp, Homo sapiens
gccagtcctgcctggc

SEQ ID NO: 2554325 - DNA, 13 bp, Homo sapiens
gccagtctgggct

SEQ ID NO: 2554326 - DNA, 14 bp, Homo sapiens
gccagtctgggctg

SEQ ID NO: 2554327 - DNA, 13 bp, Homo sapiens
gccagtcttgtgt

SEQ ID NO: 2554328 - DNA, 17 bp, Homo sapiens
gccagtgacctgaggaa

SEQ ID NO: 2554329 - DNA, 18 bp, Homo sapiens
gccagtgacctgaggaag

SEQ ID NO: 2554330 - DNA, 13 bp, Homo sapiens
gccagtgactcca

SEQ ID NO: 2554331 - DNA, 20 bp, Homo sapiens
gccagtgatgctaaaggttg

SEQ ID NO: 2554332 - DNA, 15 bp, Homo sapiens
gccagtgtctgtccc

SEQ ID NO: 2554333 - DNA, 17 bp, Homo sapiens
gccagtgtgatcccaag

SEQ ID NO: 2554334 - DNA, 21 bp, Homo sapiens
gccagttcagtacctggagga

SEQ ID NO: 2554335 - DNA, 20 bp, Homo sapiens
gccagttggtcccccttcca

SEQ ID NO: 2554336 - DNA, 18 bp, Homo sapiens
gccatacttatctctctg

SEQ ID NO: 2554337 - DNA, 20 bp, Homo sapiens
gccatacttatctctctgtg

SEQ ID NO: 2554338 - DNA, 16 bp, Homo sapiens
gccatagagtttaaca

SEQ ID NO: 2554339 - DNA, 16 bp, Homo sapiens
gccatataagtttgaa

SEQ ID NO: 2554340 - DNA, 17 bp, Homo sapiens
gccatataagtttgaag

SEQ ID NO: 2554341 - DNA, 19 bp, Homo sapiens
gccatattctgttggccag

SEQ ID NO: 2554342 - DNA, 20 bp, Homo sapiens
gccatattctgttggccagt

SEQ ID NO: 2554343 - DNA, 21 bp, Homo sapiens
gccatcatgtttacagaggac

SEQ ID NO: 2554344 - DNA, 13 bp, Homo sapiens
gccatcccagccc

SEQ ID NO: 2554345 - DNA, 21 bp, Homo sapiens
gccatcctcaaacactgcagg

SEQ ID NO: 2554346 - DNA, 15 bp, Homo sapiens
gccatctgcccaggg

SEQ ID NO: 2554347 - DNA, 20 bp, Homo sapiens
gccatctgcccaggggtgcc

SEQ ID NO: 2554348 - DNA, 22 bp, Homo sapiens
gccatcttggtaaatttcccca

SEQ ID NO: 2554349 - DNA, 16 bp, Homo sapiens
gccatgaggcctcagt

SEQ ID NO: 2554350 - DNA, 13 bp, Homo sapiens
gccatgccagctt

SEQ ID NO: 2554351 - DNA, 24 bp, Homo sapiens
gccatgctcctggcccactgcatc

SEQ ID NO: 2554352 - DNA, 15 bp, Homo sapiens
gccatgctgaaggga

SEQ ID NO: 2554353 - DNA, 18 bp, Homo sapiens
gccatggacagaagaagg

SEQ ID NO: 2554354 - DNA, 23 bp, Homo sapiens
gccatggagagctggagcctggt

SEQ ID NO: 2554355 - DNA, 16 bp, Homo sapiens
gccatggcgtgtccct

SEQ ID NO: 2554356 - DNA, 17 bp, Homo sapiens
gccatggcgtgtccctc

SEQ ID NO: 2554357 - DNA, 20 bp, Homo sapiens
gccatggctgtctcaaacca

SEQ ID NO: 2554358 - DNA, 15 bp, Homo sapiens
gccatgtagaagctg

SEQ ID NO: 2554359 - DNA, 22 bp, Homo sapiens
gccatgtctgggaacagggacg

SEQ ID NO: 2554360 - DNA, 17 bp, Homo sapiens
gccatgtgaagagggag

SEQ ID NO: 2554361 - DNA, 14 bp, Homo sapiens
gccatgttggccag

SEQ ID NO: 2554362 - DNA, 15 bp, Homo sapiens
gccatgttggccagg

SEQ ID NO: 2554363 - DNA, 16 bp, Homo sapiens
gccattaccatggaga

SEQ ID NO: 2554364 - DNA, 18 bp, Homo sapiens
gccattctcaagccctgc

SEQ ID NO: 2554365 - DNA, 17 bp, Homo sapiens
gccattctgactcatat

SEQ ID NO: 2554366 - DNA, 18 bp, Homo sapiens
gccattgcactccagcct

SEQ ID NO: 2554367 - DNA, 23 bp, Homo sapiens
gccattgtcttcggaaaccttgg

SEQ ID NO: 2554368 - DNA, 22 bp, Homo sapiens
gccatttaaagcttattaaaac

SEQ ID NO: 2554369 - DNA, 17 bp, Homo sapiens
gcccaaagccagacagc

SEQ ID NO: 2554370 - DNA, 17 bp, Homo sapiens
gcccaaagtctgtgtga

SEQ ID NO: 2554371 - DNA, 23 bp, Homo sapiens
gcccaaccggggagcccccgccc

SEQ ID NO: 2554372 - DNA, 13 bp, Homo sapiens
gcccaacctcctg

SEQ ID NO: 2554373 - DNA, 23 bp, Homo sapiens
gcccaagacagatgccccagagc

SEQ ID NO: 2554374 - DNA, 18 bp, Homo sapiens
gcccaaggcggcccctcc

SEQ ID NO: 2554375 - DNA, 13 bp, Homo sapiens
gcccaagtccctg

SEQ ID NO: 2554376 - DNA, 21 bp, Homo sapiens
gcccaagttgtggtgctgaca

SEQ ID NO: 2554377 - DNA, 14 bp, Homo sapiens
gcccaatgaaatga

SEQ ID NO: 2554378 - DNA, 22 bp, Homo sapiens
gcccaattcttacaaacatgtg

SEQ ID NO: 2554379 - DNA, 14 bp, Homo sapiens
gcccaattggagga

SEQ ID NO: 2554380 - DNA, 19 bp, Homo sapiens
gcccacagggaaccctgct

SEQ ID NO: 2554381 - DNA, 15 bp, Homo sapiens
gcccacccccctcat

SEQ ID NO: 2554382 - DNA, 13 bp, Homo sapiens
gcccaccccgctc

SEQ ID NO: 2554383 - DNA, 17 bp, Homo sapiens
gcccaccccgctctgca

SEQ ID NO: 2554384 - DNA, 19 bp, Homo sapiens
gcccaccctcctgtcttcc

SEQ ID NO: 2554385 - DNA, 15 bp, Homo sapiens
gcccacctggcctct

SEQ ID NO: 2554386 - DNA, 16 bp, Homo sapiens
gcccacctggcctctg

SEQ ID NO: 2554387 - DNA, 17 bp, Homo sapiens
gcccacctggcctctgc

SEQ ID NO: 2554388 - DNA, 21 bp, Homo sapiens
gcccacctggcctctgcactc

SEQ ID NO: 2554389 - DNA, 22 bp, Homo sapiens
gcccacctgtcaaacaaagcca

SEQ ID NO: 2554390 - DNA, 13 bp, Homo sapiens
gcccaccttggct

SEQ ID NO: 2554391 - DNA, 19 bp, Homo sapiens
gcccacgctggagtgcagt

SEQ ID NO: 2554392 - DNA, 17 bp, Homo sapiens
gcccacgtagggcggca

SEQ ID NO: 2554393 - DNA, 16 bp, Homo sapiens
gcccactgtcctgggc

SEQ ID NO: 2554394 - DNA, 13 bp, Homo sapiens
gcccacttctgcc

SEQ ID NO: 2554395 - DNA, 18 bp, Homo sapiens
gcccagaaaaggacagaa

SEQ ID NO: 2554396 - DNA, 19 bp, Homo sapiens
gcccagaaaaggacagaaa

SEQ ID NO: 2554397 - DNA, 16 bp, Homo sapiens
gcccagaataagttat

SEQ ID NO: 2554398 - DNA, 23 bp, Homo sapiens
gcccagaataagttattgcagtt

SEQ ID NO: 2554399 - DNA, 16 bp, Homo sapiens
gcccagacccctctgg

SEQ ID NO: 2554400 - DNA, 20 bp, Homo sapiens
gcccagacccctctggccag

SEQ ID NO: 2554401 - DNA, 21 bp, Homo sapiens
gcccagacccctctggccagg

SEQ ID NO: 2554402 - DNA, 21 bp, Homo sapiens
gcccagagagggtggtgacct

SEQ ID NO: 2554403 - DNA, 15 bp, Homo sapiens
gcccagagcaggaag

SEQ ID NO: 2554404 - DNA, 18 bp, Homo sapiens
gcccagagcaggaagcat

SEQ ID NO: 2554405 - DNA, 15 bp, Homo sapiens
gcccagagggcccag

SEQ ID NO: 2554406 - DNA, 21 bp, Homo sapiens
gcccagagggcccaggcaggc

SEQ ID NO: 2554407 - DNA, 19 bp, Homo sapiens
gcccagagggcctgcaagg

SEQ ID NO: 2554408 - DNA, 22 bp, Homo sapiens
gcccagagggcctgcaagggag

SEQ ID NO: 2554409 - DNA, 12 bp, Homo sapiens
gcccagaggtaa

SEQ ID NO: 2554410 - DNA, 22 bp, Homo sapiens
gcccagaggtaacagaacagct

SEQ ID NO: 2554411 - DNA, 21 bp, Homo sapiens
gcccagccaaaccctgtctga

SEQ ID NO: 2554412 - DNA, 22 bp, Homo sapiens
gcccagccattaccatggagac

SEQ ID NO: 2554413 - DNA, 21 bp, Homo sapiens
gcccagcccccacagtgctgt

SEQ ID NO: 2554414 - DNA, 14 bp, Homo sapiens
gcccagccccttct

SEQ ID NO: 2554415 - DNA, 13 bp, Homo sapiens
gcccagccctgct

SEQ ID NO: 2554416 - DNA, 15 bp, Homo sapiens
gcccagccctgctgg

SEQ ID NO: 2554417 - DNA, 13 bp, Homo sapiens
gcccagccggcct

SEQ ID NO: 2554418 - DNA, 15 bp, Homo sapiens
gcccagccggcctct

SEQ ID NO: 2554419 - DNA, 16 bp, Homo sapiens
gcccagccggcctctc

SEQ ID NO: 2554420 - DNA, 20 bp, Homo sapiens
gcccagccggcctctctggc

SEQ ID NO: 2554421 - DNA, 21 bp, Homo sapiens
gcccagccggcctctctggcc

SEQ ID NO: 2554422 - DNA, 24 bp, Homo sapiens
gcccagccggcctctctggcctcc

SEQ ID NO: 2554423 - DNA, 19 bp, Homo sapiens
gcccagcggcccctcccac

SEQ ID NO: 2554424 - DNA, 23 bp, Homo sapiens
gcccagcggcccctcccacacac

SEQ ID NO: 2554425 - DNA, 15 bp, Homo sapiens
gcccagctgcacctg

SEQ ID NO: 2554426 - DNA, 14 bp, Homo sapiens
gcccagctgggctc

SEQ ID NO: 2554427 - DNA, 13 bp, Homo sapiens
gcccagcttgggc

SEQ ID NO: 2554428 - DNA, 19 bp, Homo sapiens
gcccagcttgggcccagct

SEQ ID NO: 2554429 - DNA, 21 bp, Homo sapiens
gcccagcttgggcccagctgg

SEQ ID NO: 2554430 - DNA, 23 bp, Homo sapiens
gcccagcttgggcccagctgggc

SEQ ID NO: 2554431 - DNA, 15 bp, Homo sapiens
gcccaggaaaggctc

SEQ ID NO: 2554432 - DNA, 18 bp, Homo sapiens
gcccaggaaaggctccag

SEQ ID NO: 2554433 - DNA, 21 bp, Homo sapiens
gcccaggaaaggctccaggag

SEQ ID NO: 2554434 - DNA, 15 bp, Homo sapiens
gcccaggaccagctg

SEQ ID NO: 2554435 - DNA, 16 bp, Homo sapiens
gcccaggaccagctgg

SEQ ID NO: 2554436 - DNA, 18 bp, Homo sapiens
gcccaggaccagctgggg

SEQ ID NO: 2554437 - DNA, 11 bp, Homo sapiens
gcccaggagac

SEQ ID NO: 2554438 - DNA, 14 bp, Homo sapiens
gcccaggcaggtct

SEQ ID NO: 2554439 - DNA, 12 bp, Homo sapiens
gcccaggcccct

SEQ ID NO: 2554440 - DNA, 17 bp, Homo sapiens
gcccaggcccctgccac

SEQ ID NO: 2554441 - DNA, 20 bp, Homo sapiens
gcccaggctggagtgcagtg

SEQ ID NO: 2554442 - DNA, 20 bp, Homo sapiens
gcccaggctggcgtgcagtg

SEQ ID NO: 2554443 - DNA, 19 bp, Homo sapiens
gcccaggcttagtcactga

SEQ ID NO: 2554444 - DNA, 17 bp, Homo sapiens
gcccagggacaccagcc

SEQ ID NO: 2554445 - DNA, 19 bp, Homo sapiens
gcccagggacaccagccag

SEQ ID NO: 2554446 - DNA, 21 bp, Homo sapiens
gcccagggacaccagccaggc

SEQ ID NO: 2554447 - DNA, 22 bp, Homo sapiens
gcccagggacaccagccaggct

SEQ ID NO: 2554448 - DNA, 19 bp, Homo sapiens
gcccagggagaggccatga

SEQ ID NO: 2554449 - DNA, 17 bp, Homo sapiens
gcccagggagcggaaag

SEQ ID NO: 2554450 - DNA, 23 bp, Homo sapiens
gcccagggagcggaaagcagctc

SEQ ID NO: 2554451 - DNA, 13 bp, Homo sapiens
gcccagggctcag

SEQ ID NO: 2554452 - DNA, 14 bp, Homo sapiens
gcccagggctcagc

SEQ ID NO: 2554453 - DNA, 19 bp, Homo sapiens
gcccaggggcccacaggga

SEQ ID NO: 2554454 - DNA, 19 bp, Homo sapiens
gcccagggttcccccagcc

SEQ ID NO: 2554455 - DNA, 21 bp, Homo sapiens
gcccagggttcccccagccct

SEQ ID NO: 2554456 - DNA, 22 bp, Homo sapiens
gcccagggttcccccagccctg

SEQ ID NO: 2554457 - DNA, 16 bp, Homo sapiens
gcccaggtcctctgat

SEQ ID NO: 2554458 - DNA, 14 bp, Homo sapiens
gcccaggtttctgg

SEQ ID NO: 2554459 - DNA, 18 bp, Homo sapiens
gcccagtcctggcctggc

SEQ ID NO: 2554460 - DNA, 19 bp, Homo sapiens
gcccagtccttccacctcg

SEQ ID NO: 2554461 - DNA, 19 bp, Homo sapiens
gcccagtctggaatgcagt

SEQ ID NO: 2554462 - DNA, 21 bp, Homo sapiens
gcccagttgggtggatgcctg

SEQ ID NO: 2554463 - DNA, 13 bp, Homo sapiens
gcccatcacaggg

SEQ ID NO: 2554464 - DNA, 17 bp, Homo sapiens
gcccatcacagggttgg

SEQ ID NO: 2554465 - DNA, 21 bp, Homo sapiens
gcccatcacagggttgggccc

SEQ ID NO: 2554466 - DNA, 18 bp, Homo sapiens
gcccatctgggaaaatac

SEQ ID NO: 2554467 - DNA, 17 bp, Homo sapiens
gcccatgagtccttgaa

SEQ ID NO: 2554468 - DNA, 15 bp, Homo sapiens
gcccatgcccacctg

SEQ ID NO: 2554469 - DNA, 20 bp, Homo sapiens
gcccatgggagctggttaga

SEQ ID NO: 2554470 - DNA, 21 bp, Homo sapiens
gcccatgtcgcgctcagcatg

SEQ ID NO: 2554471 - DNA, 19 bp, Homo sapiens
gccccaaaaccacagccct

SEQ ID NO: 2554472 - DNA, 19 bp, Homo sapiens
gccccaaaactctcctctg

SEQ ID NO: 2554473 - DNA, 17 bp, Homo sapiens
gccccaaacaaatatgc

SEQ ID NO: 2554474 - DNA, 18 bp, Homo sapiens
gccccaaacaaatatgca

SEQ ID NO: 2554475 - DNA, 13 bp, Homo sapiens
gccccaagtcctg

SEQ ID NO: 2554476 - DNA, 16 bp, Homo sapiens
gccccaagtcctgaag

SEQ ID NO: 2554477 - DNA, 16 bp, Homo sapiens
gccccacactggggtg

SEQ ID NO: 2554478 - DNA, 13 bp, Homo sapiens
gccccacccagat

SEQ ID NO: 2554479 - DNA, 21 bp, Homo sapiens
gccccacctttattaaaatct

SEQ ID NO: 2554480 - DNA, 23 bp, Homo sapiens
gccccacctttattaaaatctta

SEQ ID NO: 2554481 - DNA, 22 bp, Homo sapiens
gccccagagctgtttatggcct

SEQ ID NO: 2554482 - DNA, 23 bp, Homo sapiens
gccccagagctgtttatggcctc

SEQ ID NO: 2554483 - DNA, 15 bp, Homo sapiens
gccccagaggcctct

SEQ ID NO: 2554484 - DNA, 19 bp, Homo sapiens
gccccagaggcctctctct

SEQ ID NO: 2554485 - DNA, 17 bp, Homo sapiens
gccccagcactaaagca

SEQ ID NO: 2554486 - DNA, 19 bp, Homo sapiens
gccccagccagagttcctg

SEQ ID NO: 2554487 - DNA, 12 bp, Homo sapiens
gccccagcccac

SEQ ID NO: 2554488 - DNA, 14 bp, Homo sapiens
gccccagctctggc

SEQ ID NO: 2554489 - DNA, 11 bp, Homo sapiens
gccccagctga

SEQ ID NO: 2554490 - DNA, 14 bp, Homo sapiens
gccccaggaagccg

SEQ ID NO: 2554491 - DNA, 12 bp, Homo sapiens
gccccaggcagg

SEQ ID NO: 2554492 - DNA, 19 bp, Homo sapiens
gccccaggcaggctgtgcg

SEQ ID NO: 2554493 - DNA, 14 bp, Homo sapiens
gccccaggcctctg

SEQ ID NO: 2554494 - DNA, 15 bp, Homo sapiens
gccccagtcagcctc

SEQ ID NO: 2554495 - DNA, 16 bp, Homo sapiens
gccccagtcagcctct

SEQ ID NO: 2554496 - DNA, 22 bp, Homo sapiens
gccccagtcagcctctctccca

SEQ ID NO: 2554497 - DNA, 16 bp, Homo sapiens
gccccagtgcccacag

SEQ ID NO: 2554498 - DNA, 19 bp, Homo sapiens
gccccagtggctgttctgg

SEQ ID NO: 2554499 - DNA, 15 bp, Homo sapiens
gccccatcagctcca

SEQ ID NO: 2554500 - DNA, 17 bp, Homo sapiens
gccccatcagctccagc

SEQ ID NO: 2554501 - DNA, 22 bp, Homo sapiens
gccccatcctctgtacagagcc

SEQ ID NO: 2554502 - DNA, 14 bp, Homo sapiens
gccccattctgcct

SEQ ID NO: 2554503 - DNA, 22 bp, Homo sapiens
gccccattctgcctgcccaggc

SEQ ID NO: 2554504 - DNA, 18 bp, Homo sapiens
gcccccacctccaccctc

SEQ ID NO: 2554505 - DNA, 13 bp, Homo sapiens
gcccccagctggc

SEQ ID NO: 2554506 - DNA, 17 bp, Homo sapiens
gcccccaggctgctgga

SEQ ID NO: 2554507 - DNA, 16 bp, Homo sapiens
gcccccaggtgccagt

SEQ ID NO: 2554508 - DNA, 15 bp, Homo sapiens
gcccccccttccact

SEQ ID NO: 2554509 - DNA, 16 bp, Homo sapiens
gcccccctcaaacctc

SEQ ID NO: 2554510 - DNA, 16 bp, Homo sapiens
gcccccctccttgctc

SEQ ID NO: 2554511 - DNA, 20 bp, Homo sapiens
gcccccctccttgctctgca

SEQ ID NO: 2554512 - DNA, 22 bp, Homo sapiens
gcccccgagctgggggccatga

SEQ ID NO: 2554513 - DNA, 14 bp, Homo sapiens
gcccccggccccct

SEQ ID NO: 2554514 - DNA, 13 bp, Homo sapiens
gcccccggcggcg

SEQ ID NO: 2554515 - DNA, 15 bp, Homo sapiens
gcccccggcggcgcc

SEQ ID NO: 2554516 - DNA, 20 bp, Homo sapiens
gccccctcctctagctgtgg

SEQ ID NO: 2554517 - DNA, 16 bp, Homo sapiens
gccccctcctctccca

SEQ ID NO: 2554518 - DNA, 19 bp, Homo sapiens
gccccctcctctcccatcc

SEQ ID NO: 2554519 - DNA, 21 bp, Homo sapiens
gccccctcctctcccatcccc

SEQ ID NO: 2554520 - DNA, 11 bp, Homo sapiens
gccccctgccc

SEQ ID NO: 2554521 - DNA, 13 bp, Homo sapiens
gccccctgccccc

SEQ ID NO: 2554522 - DNA, 13 bp, Homo sapiens
gccccctgctggc

SEQ ID NO: 2554523 - DNA, 14 bp, Homo sapiens
gccccctggtctct

SEQ ID NO: 2554524 - DNA, 16 bp, Homo sapiens
gccccctggtctctgg

SEQ ID NO: 2554525 - DNA, 17 bp, Homo sapiens
gccccctggtctctggt

SEQ ID NO: 2554526 - DNA, 17 bp, Homo sapiens
gcccccttctcccacac

SEQ ID NO: 2554527 - DNA, 20 bp, Homo sapiens
gcccccttctcccacactgc

SEQ ID NO: 2554528 - DNA, 23 bp, Homo sapiens
gccccgaggccttctctgaagga

SEQ ID NO: 2554529 - DNA, 14 bp, Homo sapiens
gccccgccccacat

SEQ ID NO: 2554530 - DNA, 17 bp, Homo sapiens
gccccgcgcctccttcc

SEQ ID NO: 2554531 - DNA, 17 bp, Homo sapiens
gccccggccccagccag

SEQ ID NO: 2554532 - DNA, 15 bp, Homo sapiens
gccccggccctgggc

SEQ ID NO: 2554533 - DNA, 21 bp, Homo sapiens
gccccggccctgggctcggag

SEQ ID NO: 2554534 - DNA, 18 bp, Homo sapiens
gccccgggacttggaggg

SEQ ID NO: 2554535 - DNA, 17 bp, Homo sapiens
gccccgtcaccatctca

SEQ ID NO: 2554536 - DNA, 21 bp, Homo sapiens
gcccctcccacacacacccac

SEQ ID NO: 2554537 - DNA, 15 bp, Homo sapiens
gcccctcccaccaca

SEQ ID NO: 2554538 - DNA, 16 bp, Homo sapiens
gcccctccccctgcca

SEQ ID NO: 2554539 - DNA, 13 bp, Homo sapiens
gcccctcccgccc

SEQ ID NO: 2554540 - DNA, 16 bp, Homo sapiens
gcccctcccgcccctt

SEQ ID NO: 2554541 - DNA, 13 bp, Homo sapiens
gcccctcttgccc

SEQ ID NO: 2554542 - DNA, 16 bp, Homo sapiens
gcccctcttgcccccc

SEQ ID NO: 2554543 - DNA, 13 bp, Homo sapiens
gcccctgccaccc

SEQ ID NO: 2554544 - DNA, 14 bp, Homo sapiens
gcccctgccaccct

SEQ ID NO: 2554545 - DNA, 15 bp, Homo sapiens
gcccctgccaccctg

SEQ ID NO: 2554546 - DNA, 16 bp, Homo sapiens
gcccctgccaccctgg

SEQ ID NO: 2554547 - DNA, 16 bp, Homo sapiens
gcccctgccccgtcac

SEQ ID NO: 2554548 - DNA, 15 bp, Homo sapiens
gcccctgctgcctcc

SEQ ID NO: 2554549 - DNA, 16 bp, Homo sapiens
gcccctgctgcctccc

SEQ ID NO: 2554550 - DNA, 15 bp, Homo sapiens
gcccctgctggttca

SEQ ID NO: 2554551 - DNA, 16 bp, Homo sapiens
gcccctggcccagcgg

SEQ ID NO: 2554552 - DNA, 17 bp, Homo sapiens
gcccctggcccagcggc

SEQ ID NO: 2554553 - DNA, 23 bp, Homo sapiens
gcccctggcccagcggcccctcc

SEQ ID NO: 2554554 - DNA, 21 bp, Homo sapiens
gcccctgggtgggtggtgggg

SEQ ID NO: 2554555 - DNA, 17 bp, Homo sapiens
gcccctgtatggcactg

SEQ ID NO: 2554556 - DNA, 22 bp, Homo sapiens
gccccttagcccccacccactt

SEQ ID NO: 2554557 - DNA, 20 bp, Homo sapiens
gcccctttacggacaccccc

SEQ ID NO: 2554558 - DNA, 22 bp, Homo sapiens
gcccctttacggacaccccctc

SEQ ID NO: 2554559 - DNA, 21 bp, Homo sapiens
gccccttttcactccctccat

SEQ ID NO: 2554560 - DNA, 20 bp, Homo sapiens
gcccctttttactccccttg

SEQ ID NO: 2554561 - DNA, 21 bp, Homo sapiens
gcccctttttactccccttga

SEQ ID NO: 2554562 - DNA, 23 bp, Homo sapiens
gcccctttttcatatgttgctca

SEQ ID NO: 2554563 - DNA, 13 bp, Homo sapiens
gcccgagctggtg

SEQ ID NO: 2554564 - DNA, 22 bp, Homo sapiens
gcccgagctggtgcattacaga

SEQ ID NO: 2554565 - DNA, 17 bp, Homo sapiens
gcccgcccactgtcctg

SEQ ID NO: 2554566 - DNA, 22 bp, Homo sapiens
gcccgcccactgtcctgggcgc

SEQ ID NO: 2554567 - DNA, 12 bp, Homo sapiens
gcccgcctgcca

SEQ ID NO: 2554568 - DNA, 14 bp, Homo sapiens
gcccgcctgccagt

SEQ ID NO: 2554569 - DNA, 15 bp, Homo sapiens
gcccgcctgccagtc

SEQ ID NO: 2554570 - DNA, 13 bp, Homo sapiens
gcccgcctggcag

SEQ ID NO: 2554571 - DNA, 13 bp, Homo sapiens
gcccgcgcccgcg

SEQ ID NO: 2554572 - DNA, 18 bp, Homo sapiens
gcccgcggggacattggg

SEQ ID NO: 2554573 - DNA, 15 bp, Homo sapiens
gcccgctgggctgag

SEQ ID NO: 2554574 - DNA, 14 bp, Homo sapiens
gcccggatgcttct

SEQ ID NO: 2554575 - DNA, 15 bp, Homo sapiens
gcccggcctgctccc

SEQ ID NO: 2554576 - DNA, 12 bp, Homo sapiens
gcccggctccag

SEQ ID NO: 2554577 - DNA, 14 bp, Homo sapiens
gcccgggagctgct

SEQ ID NO: 2554578 - DNA, 13 bp, Homo sapiens
gcccgggctctgc

SEQ ID NO: 2554579 - DNA, 18 bp, Homo sapiens
gcccgggctctgcctccc

SEQ ID NO: 2554580 - DNA, 21 bp, Homo sapiens
gcccgggctctgcctcccatc

SEQ ID NO: 2554581 - DNA, 23 bp, Homo sapiens
gcccgggctgcctgggctgttgg

SEQ ID NO: 2554582 - DNA, 13 bp, Homo sapiens
gcccgtctcagtg

SEQ ID NO: 2554583 - DNA, 16 bp, Homo sapiens
gcccgtctctctccca

SEQ ID NO: 2554584 - DNA, 17 bp, Homo sapiens
gcccgtctctctcccat

SEQ ID NO: 2554585 - DNA, 19 bp, Homo sapiens
gcccgtctctctcccatgg

SEQ ID NO: 2554586 - DNA, 15 bp, Homo sapiens
gcccgtcttcagcct

SEQ ID NO: 2554587 - DNA, 16 bp, Homo sapiens
gcccgtgtggcccctt

SEQ ID NO: 2554588 - DNA, 17 bp, Homo sapiens
gcccgtgtggccccttc

SEQ ID NO: 2554589 - DNA, 17 bp, Homo sapiens
gcccgttgaggatgagg

SEQ ID NO: 2554590 - DNA, 13 bp, Homo sapiens
gccctagagcaca

SEQ ID NO: 2554591 - DNA, 17 bp, Homo sapiens
gccctagagcacactgt

SEQ ID NO: 2554592 - DNA, 19 bp, Homo sapiens
gccctagagcacactgtag

SEQ ID NO: 2554593 - DNA, 15 bp, Homo sapiens
gccctagagcctgcc

SEQ ID NO: 2554594 - DNA, 14 bp, Homo sapiens
gccctatggatgtg

SEQ ID NO: 2554595 - DNA, 15 bp, Homo sapiens
gccctatttttgcaa

SEQ ID NO: 2554596 - DNA, 15 bp, Homo sapiens
gccctcaatcccagc

SEQ ID NO: 2554597 - DNA, 19 bp, Homo sapiens
gccctcacccctgccctgg

SEQ ID NO: 2554598 - DNA, 22 bp, Homo sapiens
gccctcaggtcagggtgaggat

SEQ ID NO: 2554599 - DNA, 23 bp, Homo sapiens
gccctcaggtcagggtgaggatg

SEQ ID NO: 2554600 - DNA, 14 bp, Homo sapiens
gccctccaaaagca

SEQ ID NO: 2554601 - DNA, 19 bp, Homo sapiens
gccctccaagaccttctcc

SEQ ID NO: 2554602 - DNA, 22 bp, Homo sapiens
gccctccaagaccttctccttc

SEQ ID NO: 2554603 - DNA, 23 bp, Homo sapiens
gccctccacagccgcagcctccc

SEQ ID NO: 2554604 - DNA, 15 bp, Homo sapiens
gccctcccctctctg

SEQ ID NO: 2554605 - DNA, 19 bp, Homo sapiens
gccctcccttggaaacctg

SEQ ID NO: 2554606 - DNA, 23 bp, Homo sapiens
gccctccgccattctcaagccct

SEQ ID NO: 2554607 - DNA, 24 bp, Homo sapiens
gccctcctaccctgcgcccagtcc

SEQ ID NO: 2554608 - DNA, 15 bp, Homo sapiens
gccctccttgtccac

SEQ ID NO: 2554609 - DNA, 18 bp, Homo sapiens
gccctcgggcccagcccc

SEQ ID NO: 2554610 - DNA, 15 bp, Homo sapiens
gccctcgtggccagc

SEQ ID NO: 2554611 - DNA, 18 bp, Homo sapiens
gccctcgtggccagcccg

SEQ ID NO: 2554612 - DNA, 17 bp, Homo sapiens
gccctctagggagggac

SEQ ID NO: 2554613 - DNA, 16 bp, Homo sapiens
gccctctgcccactcc

SEQ ID NO: 2554614 - DNA, 22 bp, Homo sapiens
gccctctgcccactccctgcaa

SEQ ID NO: 2554615 - DNA, 14 bp, Homo sapiens
gccctcttccatca

SEQ ID NO: 2554616 - DNA, 14 bp, Homo sapiens
gccctgagctttct

SEQ ID NO: 2554617 - DNA, 14 bp, Homo sapiens
gccctgaggtgtgg

SEQ ID NO: 2554618 - DNA, 15 bp, Homo sapiens
gccctgaggtgtggg

SEQ ID NO: 2554619 - DNA, 22 bp, Homo sapiens
gccctgaggtgtgggggctgca

SEQ ID NO: 2554620 - DNA, 24 bp, Homo sapiens
gccctgaggtgtgggggctgcagc

SEQ ID NO: 2554621 - DNA, 23 bp, Homo sapiens
gccctgagtggatctccaaggac

SEQ ID NO: 2554622 - DNA, 13 bp, Homo sapiens
gccctgcagaggg

SEQ ID NO: 2554623 - DNA, 21 bp, Homo sapiens
gccctgcccacctggcctctg

SEQ ID NO: 2554624 - DNA, 13 bp, Homo sapiens
gccctgcctgagg

SEQ ID NO: 2554625 - DNA, 14 bp, Homo sapiens
gccctgcctgaggg

SEQ ID NO: 2554626 - DNA, 15 bp, Homo sapiens
gccctgcctgagggc

SEQ ID NO: 2554627 - DNA, 20 bp, Homo sapiens
gccctgcctgagggcccctc

SEQ ID NO: 2554628 - DNA, 21 bp, Homo sapiens
gccctgctgccgcctcccagc

SEQ ID NO: 2554629 - DNA, 21 bp, Homo sapiens
gccctgctggccgcctcaccc

SEQ ID NO: 2554630 - DNA, 19 bp, Homo sapiens
gccctggagtcatgccaag

SEQ ID NO: 2554631 - DNA, 14 bp, Homo sapiens
gcactccagcctgg

SEQ ID NO: 2554632 - DNA, 15 bp, Homo sapiens
gcactccagcctggg

SEQ ID NO: 2554633 - DNA, 21 bp, Homo sapiens
gcactccagcctgggcgacag

SEQ ID NO: 2554634 - DNA, 12 bp, Homo sapiens
gcactcccctgc

SEQ ID NO: 2554635 - DNA, 15 bp, Homo sapiens
gcactcccctgctgg

SEQ ID NO: 2554636 - DNA, 22 bp, Homo sapiens
gcactcccctgctgggtgtggc

SEQ ID NO: 2554637 - DNA, 23 bp, Homo sapiens
gcactcccttggtggcaagagcc

SEQ ID NO: 2554638 - DNA, 17 bp, Homo sapiens
gcactccggcctgatga

SEQ ID NO: 2554639 - DNA, 17 bp, Homo sapiens
gcactctaaaaggttca

SEQ ID NO: 2554640 - DNA, 16 bp, Homo sapiens
gcactcttaagcttcc

SEQ ID NO: 2554641 - DNA, 18 bp, Homo sapiens
gcactgacttctaagtaa

SEQ ID NO: 2554642 - DNA, 21 bp, Homo sapiens
gcactgagataccagcgagga

SEQ ID NO: 2554643 - DNA, 11 bp, Homo sapiens
gcactgagccc

SEQ ID NO: 2554644 - DNA, 17 bp, Homo sapiens
gcactgaggaccagcca

SEQ ID NO: 2554645 - DNA, 12 bp, Homo sapiens
gcactgagggcc

SEQ ID NO: 2554646 - DNA, 13 bp, Homo sapiens
gcactgagggcca

SEQ ID NO: 2554647 - DNA, 14 bp, Homo sapiens
gcactgagggccac

SEQ ID NO: 2554648 - DNA, 14 bp, Homo sapiens
gcactgatatttta

SEQ ID NO: 2554649 - DNA, 12 bp, Homo sapiens
gcactgatttca

SEQ ID NO: 2554650 - DNA, 15 bp, Homo sapiens
gcactgatttcacaa

SEQ ID NO: 2554651 - DNA, 20 bp, Homo sapiens
gcactgatttcacaacagat

SEQ ID NO: 2554652 - DNA, 21 bp, Homo sapiens
gcactgctaggcgagtgccag

SEQ ID NO: 2554653 - DNA, 14 bp, Homo sapiens
gcactgctgcccag

SEQ ID NO: 2554654 - DNA, 11 bp, Homo sapiens
gcactgctgtg

SEQ ID NO: 2554655 - DNA, 20 bp, Homo sapiens
gcactgcttccagtgaggct

SEQ ID NO: 2554656 - DNA, 17 bp, Homo sapiens
gcactgcttgaggaaaa

SEQ ID NO: 2554657 - DNA, 18 bp, Homo sapiens
gcactggagtccagtctc

SEQ ID NO: 2554658 - DNA, 20 bp, Homo sapiens
gcactggcattgtccctgtg

SEQ ID NO: 2554659 - DNA, 15 bp, Homo sapiens
gcactggcctgcacg

SEQ ID NO: 2554660 - DNA, 15 bp, Homo sapiens
gcactggctctctcc

SEQ ID NO: 2554661 - DNA, 23 bp, Homo sapiens
gcactgggatgagccgctgtgag

SEQ ID NO: 2554662 - DNA, 15 bp, Homo sapiens
gcactgtatgctgga

SEQ ID NO: 2554663 - DNA, 15 bp, Homo sapiens
gcactgtcaagatga

SEQ ID NO: 2554664 - DNA, 18 bp, Homo sapiens
gcactgtcactttgctct

SEQ ID NO: 2554665 - DNA, 20 bp, Homo sapiens
gcactgtcactttgctctgg

SEQ ID NO: 2554666 - DNA, 20 bp, Homo sapiens
gcactgtctcagtttcactt

SEQ ID NO: 2554667 - DNA, 11 bp, Homo sapiens
gcactgtgcta

SEQ ID NO: 2554668 - DNA, 14 bp, Homo sapiens
gcactgtgctcagg

SEQ ID NO: 2554669 - DNA, 16 bp, Homo sapiens
gcactgtgctcagggc

SEQ ID NO: 2554670 - DNA, 15 bp, Homo sapiens
gcactgttccccctg

SEQ ID NO: 2554671 - DNA, 18 bp, Homo sapiens
gcactgttccccctgtgc

SEQ ID NO: 2554672 - DNA, 20 bp, Homo sapiens
gcactgttccccctgtgcag

SEQ ID NO: 2554673 - DNA, 13 bp, Homo sapiens
gcacttcacagag

SEQ ID NO: 2554674 - DNA, 15 bp, Homo sapiens
gcacttcacagagtg

SEQ ID NO: 2554675 - DNA, 23 bp, Homo sapiens
gcacttcattgagagttttgtct

SEQ ID NO: 2554676 - DNA, 18 bp, Homo sapiens
gcacttggagacttgtat

SEQ ID NO: 2554677 - DNA, 16 bp, Homo sapiens
gcacttggagccaagg

SEQ ID NO: 2554678 - DNA, 12 bp, Homo sapiens
gcacttgtatat

SEQ ID NO: 2554679 - DNA, 20 bp, Homo sapiens
gcactttgggaggctgaggc

SEQ ID NO: 2554680 - DNA, 16 bp, Homo sapiens
gcactttgttctggct

SEQ ID NO: 2554681 - DNA, 18 bp, Homo sapiens
gcactttgttctggctct

SEQ ID NO: 2554682 - DNA, 16 bp, Homo sapiens
gcagaaaattgcctaa

SEQ ID NO: 2554683 - DNA, 21 bp, Homo sapiens
gcagaaaggttctgcccggga

SEQ ID NO: 2554684 - DNA, 14 bp, Homo sapiens
gcagaaatctagaa

SEQ ID NO: 2554685 - DNA, 13 bp, Homo sapiens
gcagaacactaac

SEQ ID NO: 2554686 - DNA, 21 bp, Homo sapiens
gcagaacagccgctcctgtct

SEQ ID NO: 2554687 - DNA, 13 bp, Homo sapiens
gcagaacagtgat

SEQ ID NO: 2554688 - DNA, 13 bp, Homo sapiens
gcagaacggagcc

SEQ ID NO: 2554689 - DNA, 24 bp, Homo sapiens
gcagaacggagccccaggcctctg

SEQ ID NO: 2554690 - DNA, 21 bp, Homo sapiens
gcagaagacaccagagcagat

SEQ ID NO: 2554691 - DNA, 13 bp, Homo sapiens
gcagaagggagaa

SEQ ID NO: 2554692 - DNA, 18 bp, Homo sapiens
gcagaataatctttgggt

SEQ ID NO: 2554693 - DNA, 17 bp, Homo sapiens
gcagacagcagctcagg

SEQ ID NO: 2554694 - DNA, 14 bp, Homo sapiens
gcagacaggaggaa

SEQ ID NO: 2554695 - DNA, 12 bp, Homo sapiens
gcagacaggcaa

SEQ ID NO: 2554696 - DNA, 13 bp, Homo sapiens
gcagaccaccccg

SEQ ID NO: 2554697 - DNA, 17 bp, Homo sapiens
gcagaccaccccgcctg

SEQ ID NO: 2554698 - DNA, 16 bp, Homo sapiens
gcagacctgtcctcct

SEQ ID NO: 2554699 - DNA, 14 bp, Homo sapiens
gcagacgccgggga

SEQ ID NO: 2554700 - DNA, 18 bp, Homo sapiens
gcagactcagtttgtcag

SEQ ID NO: 2554701 - DNA, 18 bp, Homo sapiens
gcagactctacagaggcc

SEQ ID NO: 2554702 - DNA, 23 bp, Homo sapiens
gcagagaaagaagagacaggagg

SEQ ID NO: 2554703 - DNA, 19 bp, Homo sapiens
gcagagaatgaaagggccc

SEQ ID NO: 2554704 - DNA, 21 bp, Homo sapiens
gcagagaattctcttatccaa

SEQ ID NO: 2554705 - DNA, 15 bp, Homo sapiens
gcagagaccatccct

SEQ ID NO: 2554706 - DNA, 19 bp, Homo sapiens
gcagagaccatccctgaag

SEQ ID NO: 2554707 - DNA, 16 bp, Homo sapiens
gcagagagaagcctgt

SEQ ID NO: 2554708 - DNA, 15 bp, Homo sapiens
gcagagagccatttt

SEQ ID NO: 2554709 - DNA, 19 bp, Homo sapiens
gcagagagccattttgtga

SEQ ID NO: 2554710 - DNA, 23 bp, Homo sapiens
gcagagattggaatgggcagctc

SEQ ID NO: 2554711 - DNA, 15 bp, Homo sapiens
gcagagcagagacca

SEQ ID NO: 2554712 - DNA, 20 bp, Homo sapiens
gcagagcaggggcagggtga

SEQ ID NO: 2554713 - DNA, 16 bp, Homo sapiens
gcagagcccaagggaa

SEQ ID NO: 2554714 - DNA, 13 bp, Homo sapiens
gcagaggtaaaag

SEQ ID NO: 2554715 - DNA, 20 bp, Homo sapiens
gcagaggtaaaagtgtgagc

SEQ ID NO: 2554716 - DNA, 23 bp, Homo sapiens
gcagagtcacacgggggcagctg

SEQ ID NO: 2554717 - DNA, 13 bp, Homo sapiens
gcagagtcagcag

SEQ ID NO: 2554718 - DNA, 14 bp, Homo sapiens
gcagagtcagcaga

SEQ ID NO: 2554719 - DNA, 20 bp, Homo sapiens
gcagagtttgtgtgttgtct

SEQ ID NO: 2554720 - DNA, 16 bp, Homo sapiens
gcagataatcagcctc

SEQ ID NO: 2554721 - DNA, 17 bp, Homo sapiens
gcagataatcagcctct

SEQ ID NO: 2554722 - DNA, 18 bp, Homo sapiens
gcagatacctcaccctgc

SEQ ID NO: 2554723 - DNA, 12 bp, Homo sapiens
gcagatcccagc

SEQ ID NO: 2554724 - DNA, 14 bp, Homo sapiens
gcagatcccagctc

SEQ ID NO: 2554725 - DNA, 20 bp, Homo sapiens
gcagatctgtgccccatgcc

SEQ ID NO: 2554726 - DNA, 19 bp, Homo sapiens
gcagatgcaatgactcagg

SEQ ID NO: 2554727 - DNA, 19 bp, Homo sapiens
gcagattcatttttctttc

SEQ ID NO: 2554728 - DNA, 16 bp, Homo sapiens
gcagatttgggctgga

SEQ ID NO: 2554729 - DNA, 12 bp, Homo sapiens
gcagcagaggca

SEQ ID NO: 2554730 - DNA, 19 bp, Homo sapiens
gcagcagggagggcttctg

SEQ ID NO: 2554731 - DNA, 20 bp, Homo sapiens
gcagcagggagggcttctgc

SEQ ID NO: 2554732 - DNA, 12 bp, Homo sapiens
gcagcagggcta

SEQ ID NO: 2554733 - DNA, 19 bp, Homo sapiens
gcagcagggctaccctgag

SEQ ID NO: 2554734 - DNA, 14 bp, Homo sapiens
gcagcagtgaaaac

SEQ ID NO: 2554735 - DNA, 15 bp, Homo sapiens
gcagcagtgaaaaca

SEQ ID NO: 2554736 - DNA, 21 bp, Homo sapiens
gcagcagtgagtctcttcaga

SEQ ID NO: 2554737 - DNA, 15 bp, Homo sapiens
gcagcagtgtgaggc

SEQ ID NO: 2554738 - DNA, 23 bp, Homo sapiens
gcagcagtgtgaggccagggcag

SEQ ID NO: 2554739 - DNA, 17 bp, Homo sapiens
gcagcatattcaggaag

SEQ ID NO: 2554740 - DNA, 17 bp, Homo sapiens
gcagcatgacctgtgac

SEQ ID NO: 2554741 - DNA, 12 bp, Homo sapiens
gcagccaaggcc

SEQ ID NO: 2554742 - DNA, 22 bp, Homo sapiens
gcagccaaggccgaagctctgg

SEQ ID NO: 2554743 - DNA, 12 bp, Homo sapiens
gcagccaaggga

SEQ ID NO: 2554744 - DNA, 15 bp, Homo sapiens
gcagccacattcctg

SEQ ID NO: 2554745 - DNA, 13 bp, Homo sapiens
gcagccagctctc

SEQ ID NO: 2554746 - DNA, 13 bp, Homo sapiens
gcagccaggccac

SEQ ID NO: 2554747 - DNA, 13 bp, Homo sapiens
gcagccaggctgc

SEQ ID NO: 2554748 - DNA, 18 bp, Homo sapiens
gcagcccatgcccacctg

SEQ ID NO: 2554749 - DNA, 17 bp, Homo sapiens
gcagccccattctgcct

SEQ ID NO: 2554750 - DNA, 15 bp, Homo sapiens
gcagcccgtgtggcc

SEQ ID NO: 2554751 - DNA, 18 bp, Homo sapiens
gcagcccgtgtggcccct

SEQ ID NO: 2554752 - DNA, 22 bp, Homo sapiens
gcagccctaaggatctctcagg

SEQ ID NO: 2554753 - DNA, 13 bp, Homo sapiens
gcagccctagagc

SEQ ID NO: 2554754 - DNA, 17 bp, Homo sapiens
gcagccgctgagcgagg

SEQ ID NO: 2554755 - DNA, 19 bp, Homo sapiens
gcagcctcacagtccttac

SEQ ID NO: 2554756 - DNA, 16 bp, Homo sapiens
gcagcctccctctgac

SEQ ID NO: 2554757 - DNA, 23 bp, Homo sapiens
gcagcctgtcctgggctggtggc

SEQ ID NO: 2554758 - DNA, 14 bp, Homo sapiens
gcagcgaccacccc

SEQ ID NO: 2554759 - DNA, 22 bp, Homo sapiens
gcagcgaccacccctgcctcca

SEQ ID NO: 2554760 - DNA, 14 bp, Homo sapiens
gcagcgaccgcccc

SEQ ID NO: 2554761 - DNA, 18 bp, Homo sapiens
gcagcgaccgccccctcc

SEQ ID NO: 2554762 - DNA, 20 bp, Homo sapiens
gcagcgccaagcaacctggg

SEQ ID NO: 2554763 - DNA, 17 bp, Homo sapiens
gcagcgcggggagcccg

SEQ ID NO: 2554764 - DNA, 23 bp, Homo sapiens
gcagctcaagcagcgaccgcccc

SEQ ID NO: 2554765 - DNA, 21 bp, Homo sapiens
gcagctcacctctcccttgga

SEQ ID NO: 2554766 - DNA, 19 bp, Homo sapiens
gcagctcatctctgtccca

SEQ ID NO: 2554767 - DNA, 12 bp, Homo sapiens
gcagctctcccc

SEQ ID NO: 2554768 - DNA, 17 bp, Homo sapiens
gcagctcttgcccttcc

SEQ ID NO: 2554769 - DNA, 18 bp, Homo sapiens
gcagctcttgcccttccc

SEQ ID NO: 2554770 - DNA, 19 bp, Homo sapiens
gcagctcttgcccttccct

SEQ ID NO: 2554771 - DNA, 20 bp, Homo sapiens
gcagctcttgcccttccctg

SEQ ID NO: 2554772 - DNA, 22 bp, Homo sapiens
gcagctcttgctaatcagtgtc

SEQ ID NO: 2554773 - DNA, 14 bp, Homo sapiens
gcagctgattttaa

SEQ ID NO: 2554774 - DNA, 17 bp, Homo sapiens
gcagctgattttaacaa

SEQ ID NO: 2554775 - DNA, 15 bp, Homo sapiens
gcagctgccagagaa

SEQ ID NO: 2554776 - DNA, 17 bp, Homo sapiens
gcagctgcggtccaccc

SEQ ID NO: 2554777 - DNA, 14 bp, Homo sapiens
gcagctgggcccaa

SEQ ID NO: 2554778 - DNA, 16 bp, Homo sapiens
gcagctgggcccaacc

SEQ ID NO: 2554779 - DNA, 21 bp, Homo sapiens
gcagctgggcccaaccctgtc

SEQ ID NO: 2554780 - DNA, 16 bp, Homo sapiens
gcagctgttgcagtga

SEQ ID NO: 2554781 - DNA, 22 bp, Homo sapiens
gcagctttaaactcagggacag

SEQ ID NO: 2554782 - DNA, 22 bp, Homo sapiens
gcagctttaaccattaaaactg

SEQ ID NO: 2554783 - DNA, 13 bp, Homo sapiens
gcaggaagctgct

SEQ ID NO: 2554784 - DNA, 19 bp, Homo sapiens
gcaggacaacgaggaagcc

SEQ ID NO: 2554785 - DNA, 12 bp, Homo sapiens
gcaggaccagga

SEQ ID NO: 2554786 - DNA, 11 bp, Homo sapiens
gcaggacctca

SEQ ID NO: 2554787 - DNA, 19 bp, Homo sapiens
gcaggactgcacagcgtcc

SEQ ID NO: 2554788 - DNA, 13 bp, Homo sapiens
gcaggagaggaga

SEQ ID NO: 2554789 - DNA, 18 bp, Homo sapiens
gcaggagaggagagccag

SEQ ID NO: 2554790 - DNA, 20 bp, Homo sapiens
gcaggagaggagagccagag

SEQ ID NO: 2554791 - DNA, 13 bp, Homo sapiens
gcaggagcagtat

SEQ ID NO: 2554792 - DNA, 14 bp, Homo sapiens
gcaggagcctgagc

SEQ ID NO: 2554793 - DNA, 14 bp, Homo sapiens
gcaggaggattgct

SEQ ID NO: 2554794 - DNA, 23 bp, Homo sapiens
gcaggaggattgcttgagcccag

SEQ ID NO: 2554795 - DNA, 24 bp, Homo sapiens
gcaggatggcctggccagggcctg

SEQ ID NO: 2554796 - DNA, 16 bp, Homo sapiens
gcaggcagccaggcca

SEQ ID NO: 2554797 - DNA, 18 bp, Homo sapiens
gcaggcagcgccaagcaa

SEQ ID NO: 2554798 - DNA, 20 bp, Homo sapiens
gcaggcatgcatgtgcttgt

SEQ ID NO: 2554799 - DNA, 19 bp, Homo sapiens
gcaggccaaggccttctcc

SEQ ID NO: 2554800 - DNA, 15 bp, Homo sapiens
gcaggccaggccagc

SEQ ID NO: 2554801 - DNA, 14 bp, Homo sapiens
gcaggcggtgggca

SEQ ID NO: 2554802 - DNA, 15 bp, Homo sapiens
gcaggcggtgggcac

SEQ ID NO: 2554803 - DNA, 20 bp, Homo sapiens
gcaggctaaggcgtggagct

SEQ ID NO: 2554804 - DNA, 20 bp, Homo sapiens
gcaggctggaggtaaggcct

SEQ ID NO: 2554805 - DNA, 19 bp, Homo sapiens
gcaggctggcaccgccttc

SEQ ID NO: 2554806 - DNA, 18 bp, Homo sapiens
gcaggctggcagctctcc

SEQ ID NO: 2554807 - DNA, 20 bp, Homo sapiens
gcagggaaggggaggcagcc

SEQ ID NO: 2554808 - DNA, 21 bp, Homo sapiens
gcagggaagtgtaagaaacac

SEQ ID NO: 2554809 - DNA, 13 bp, Homo sapiens
gcagggaggggac

SEQ ID NO: 2554810 - DNA, 14 bp, Homo sapiens
gcagggaggggact

SEQ ID NO: 2554811 - DNA, 15 bp, Homo sapiens
gcagggaggggacta

SEQ ID NO: 2554812 - DNA, 15 bp, Homo sapiens
gcagggattgctgcc

SEQ ID NO: 2554813 - DNA, 22 bp, Homo sapiens
gcagggattgctgccacttttt

SEQ ID NO: 2554814 - DNA, 21 bp, Homo sapiens
gcagggcatctcctgtgcatg

SEQ ID NO: 2554815 - DNA, 21 bp, Homo sapiens
gcagggccccaggcattgcca

SEQ ID NO: 2554816 - DNA, 17 bp, Homo sapiens
gcagggcctagctgcta

SEQ ID NO: 2554817 - DNA, 20 bp, Homo sapiens
gcagggcctagctgctacaa

SEQ ID NO: 2554818 - DNA, 19 bp, Homo sapiens
gcagggctcagcggggaca

SEQ ID NO: 2554819 - DNA, 19 bp, Homo sapiens
gcagggctctgccccagag

SEQ ID NO: 2554820 - DNA, 14 bp, Homo sapiens
gcagggtcaggaga

SEQ ID NO: 2554821 - DNA, 16 bp, Homo sapiens
gcagggtcaggagagg

SEQ ID NO: 2554822 - DNA, 17 bp, Homo sapiens
gcagggtcaggagaggg

SEQ ID NO: 2554823 - DNA, 18 bp, Homo sapiens
gcagggtctcactctgtc

SEQ ID NO: 2554824 - DNA, 17 bp, Homo sapiens
gcagggtctgggcagga

SEQ ID NO: 2554825 - DNA, 20 bp, Homo sapiens
gcagggtctgggcaggactc

SEQ ID NO: 2554826 - DNA, 14 bp, Homo sapiens
gcaggtgcctccag

SEQ ID NO: 2554827 - DNA, 17 bp, Homo sapiens
gcaggtggggagggggt

SEQ ID NO: 2554828 - DNA, 15 bp, Homo sapiens
gcaggtggtcctgag

SEQ ID NO: 2554829 - DNA, 16 bp, Homo sapiens
gcaggtggtcctgaga

SEQ ID NO: 2554830 - DNA, 21 bp, Homo sapiens
gcaggtggtcctgagacctga

SEQ ID NO: 2554831 - DNA, 14 bp, Homo sapiens
gcaggtggtggcac

SEQ ID NO: 2554832 - DNA, 16 bp, Homo sapiens
gcaggttagaacctag

SEQ ID NO: 2554833 - DNA, 22 bp, Homo sapiens
gcaggttcttcttcctgaagct

SEQ ID NO: 2554834 - DNA, 21 bp, Homo sapiens
gcaggttgaggggctcctgga

SEQ ID NO: 2554835 - DNA, 22 bp, Homo sapiens
gcaggttgaggggctcctggaa

SEQ ID NO: 2554836 - DNA, 23 bp, Homo sapiens
gcaggttgggaatgaggcttgct

SEQ ID NO: 2554837 - DNA, 13 bp, Homo sapiens
gcagtaataaaaa

SEQ ID NO: 2554838 - DNA, 19 bp, Homo sapiens
gcagtagaaataatatgca

SEQ ID NO: 2554839 - DNA, 20 bp, Homo sapiens
gcagtagagtcatctccatc

SEQ ID NO: 2554840 - DNA, 15 bp, Homo sapiens
gcagtagattttctt

SEQ ID NO: 2554841 - DNA, 20 bp, Homo sapiens
gcagtagattttctttaaaa

SEQ ID NO: 2554842 - DNA, 17 bp, Homo sapiens
gcagtagtctctgtgct

SEQ ID NO: 2554843 - DNA, 12 bp, Homo sapiens
gcagtatcatga

SEQ ID NO: 2554844 - DNA, 17 bp, Homo sapiens
gcagtcctgcctcagcc

SEQ ID NO: 2554845 - DNA, 18 bp, Homo sapiens
gcagtcctggaagccagc

SEQ ID NO: 2554846 - DNA, 16 bp, Homo sapiens
gcagtcgggggctggc

SEQ ID NO: 2554847 - DNA, 17 bp, Homo sapiens
gcagtcgggggctggcc

SEQ ID NO: 2554848 - DNA, 20 bp, Homo sapiens
gcagtcgggggctggcctag

SEQ ID NO: 2554849 - DNA, 15 bp, Homo sapiens
gcagtcgtcgcacag

SEQ ID NO: 2554850 - DNA, 18 bp, Homo sapiens
gcagtcgtcgcacagtct

SEQ ID NO: 2554851 - DNA, 18 bp, Homo sapiens
gcagtgaaagacaagctg

SEQ ID NO: 2554852 - DNA, 21 bp, Homo sapiens
gcagtgaattgtgaccaagtt

SEQ ID NO: 2554853 - DNA, 20 bp, Homo sapiens
gcagtgagccaagattgcgc

SEQ ID NO: 2554854 - DNA, 21 bp, Homo sapiens
gcagtgatatggcagaagaca

SEQ ID NO: 2554855 - DNA, 21 bp, Homo sapiens
gcagtgatgctggatgctcct

SEQ ID NO: 2554856 - DNA, 20 bp, Homo sapiens
gcagtgcaagagactctggc

SEQ ID NO: 2554857 - DNA, 22 bp, Homo sapiens
gcagtgcaagagactctggcct

SEQ ID NO: 2554858 - DNA, 13 bp, Homo sapiens
gcagtgcctctgg

SEQ ID NO: 2554859 - DNA, 23 bp, Homo sapiens
gcagtgcttccaaggatggacca

SEQ ID NO: 2554860 - DNA, 15 bp, Homo sapiens
gcagtggacaccagg

SEQ ID NO: 2554861 - DNA, 11 bp, Homo sapiens
gcagtgggagc

SEQ ID NO: 2554862 - DNA, 13 bp, Homo sapiens
gcagtgggagctg

SEQ ID NO: 2554863 - DNA, 14 bp, Homo sapiens
gcagtgggagctgc

SEQ ID NO: 2554864 - DNA, 18 bp, Homo sapiens
gcagtggtgcgatctggg

SEQ ID NO: 2554865 - DNA, 21 bp, Homo sapiens
gcagtggtggttttctgttct

SEQ ID NO: 2554866 - DNA, 18 bp, Homo sapiens
gcagtgtcatcagaagat

SEQ ID NO: 2554867 - DNA, 15 bp, Homo sapiens
gcagtgtcttccata

SEQ ID NO: 2554868 - DNA, 21 bp, Homo sapiens
gcagtgtgaggccagggcaga

SEQ ID NO: 2554869 - DNA, 13 bp, Homo sapiens
gcagttcacctgc

SEQ ID NO: 2554870 - DNA, 17 bp, Homo sapiens
gcagttcagcaccaccc

SEQ ID NO: 2554871 - DNA, 19 bp, Homo sapiens
gcagttcagcaccacccta

SEQ ID NO: 2554872 - DNA, 20 bp, Homo sapiens
gcagttcccccaacctcaga

SEQ ID NO: 2554873 - DNA, 19 bp, Homo sapiens
gcagttgaaaagactccaa

SEQ ID NO: 2554874 - DNA, 14 bp, Homo sapiens
gcagttgccagtca

SEQ ID NO: 2554875 - DNA, 22 bp, Homo sapiens
gcagttggccagagagcctggt

SEQ ID NO: 2554876 - DNA, 13 bp, Homo sapiens
gcagttgtgtcag

SEQ ID NO: 2554877 - DNA, 15 bp, Homo sapiens
gcataaatatgcagt

SEQ ID NO: 2554878 - DNA, 18 bp, Homo sapiens
gcataacaaggtccaaga

SEQ ID NO: 2554879 - DNA, 13 bp, Homo sapiens
gcatacaatctga

SEQ ID NO: 2554880 - DNA, 11 bp, Homo sapiens
gcatacacaca

SEQ ID NO: 2554881 - DNA, 13 bp, Homo sapiens
gcatacacacaca

SEQ ID NO: 2554882 - DNA, 22 bp, Homo sapiens
gcatacacacacacacacagcc

SEQ ID NO: 2554883 - DNA, 16 bp, Homo sapiens
gcatacctttattgtg

SEQ ID NO: 2554884 - DNA, 20 bp, Homo sapiens
gcatacctttattgtgatct

SEQ ID NO: 2554885 - DNA, 14 bp, Homo sapiens
gcatacgtacacat

SEQ ID NO: 2554886 - DNA, 17 bp, Homo sapiens
gcatacgtacacatttt

SEQ ID NO: 2554887 - DNA, 19 bp, Homo sapiens
gcatacgtacacattttat

SEQ ID NO: 2554888 - DNA, 17 bp, Homo sapiens
gcatacttcaaaagtat

SEQ ID NO: 2554889 - DNA, 18 bp, Homo sapiens
gcatacttcaaaagtatt

SEQ ID NO: 2554890 - DNA, 22 bp, Homo sapiens
gcatacttcaaaagtattttcc

SEQ ID NO: 2554891 - DNA, 16 bp, Homo sapiens
gcatagatgcaggtga

SEQ ID NO: 2554892 - DNA, 17 bp, Homo sapiens
gcataggcctgggtgct

SEQ ID NO: 2554893 - DNA, 23 bp, Homo sapiens
gcataggcctgggtgctggctgc

SEQ ID NO: 2554894 - DNA, 21 bp, Homo sapiens
gcataggtgatctcatttaat

SEQ ID NO: 2554895 - DNA, 22 bp, Homo sapiens
gcatagtattccattgtgtgag

SEQ ID NO: 2554896 - DNA, 23 bp, Homo sapiens
gcatataacttatattgtaagaa

SEQ ID NO: 2554897 - DNA, 21 bp, Homo sapiens
gcatatgtttcgctgatatat

SEQ ID NO: 2554898 - DNA, 18 bp, Homo sapiens
gcatattcaggaagctca

SEQ ID NO: 2554899 - DNA, 16 bp, Homo sapiens
gcatattcctttctat

SEQ ID NO: 2554900 - DNA, 23 bp, Homo sapiens
gcatatttatagcaatccatgtt

SEQ ID NO: 2554901 - DNA, 14 bp, Homo sapiens
gcatcaaaagacaa

SEQ ID NO: 2554902 - DNA, 14 bp, Homo sapiens
gcatcacagggcag

SEQ ID NO: 2554903 - DNA, 12 bp, Homo sapiens
gcatcacagttt

SEQ ID NO: 2554904 - DNA, 13 bp, Homo sapiens
gcatcacctcagg

SEQ ID NO: 2554905 - DNA, 17 bp, Homo sapiens
gcatcacctcaggccag

SEQ ID NO: 2554906 - DNA, 13 bp, Homo sapiens
gcatcaggccagg

SEQ ID NO: 2554907 - DNA, 15 bp, Homo sapiens
gcatcaggccaggcc

SEQ ID NO: 2554908 - DNA, 15 bp, Homo sapiens
gcatccacctccttc

SEQ ID NO: 2554909 - DNA, 16 bp, Homo sapiens
gcatccacctccttct

SEQ ID NO: 2554910 - DNA, 17 bp, Homo sapiens
gcatccacctccttctc

SEQ ID NO: 2554911 - DNA, 13 bp, Homo sapiens
gcatcccagggga

SEQ ID NO: 2554912 - DNA, 23 bp, Homo sapiens
gcatcccagtggcctcaaccctc

SEQ ID NO: 2554913 - DNA, 19 bp, Homo sapiens
gcatccccttggctgtgag

SEQ ID NO: 2554914 - DNA, 14 bp, Homo sapiens
gcatcctggcaccc

SEQ ID NO: 2554915 - DNA, 17 bp, Homo sapiens
gcatcctggcacccggc

SEQ ID NO: 2554916 - DNA, 20 bp, Homo sapiens
gcatccttttctgcagaggg

SEQ ID NO: 2554917 - DNA, 15 bp, Homo sapiens
gcatctccacctgct

SEQ ID NO: 2554918 - DNA, 13 bp, Homo sapiens
gcatctccaggaa

SEQ ID NO: 2554919 - DNA, 15 bp, Homo sapiens
gcatctcctgtgcat

SEQ ID NO: 2554920 - DNA, 16 bp, Homo sapiens
gcatctcctgtgcatg

SEQ ID NO: 2554921 - DNA, 14 bp, Homo sapiens
gcatctcttgaggc

SEQ ID NO: 2554922 - DNA, 20 bp, Homo sapiens
gcatctcttgaggccaggag

SEQ ID NO: 2554923 - DNA, 12 bp, Homo sapiens
gcatctgcaccc

SEQ ID NO: 2554924 - DNA, 12 bp, Homo sapiens
gcatctgcccct

SEQ ID NO: 2554925 - DNA, 17 bp, Homo sapiens
gcatctgcccctccccc

SEQ ID NO: 2554926 - DNA, 16 bp, Homo sapiens
gcatctgggattccca

SEQ ID NO: 2554927 - DNA, 17 bp, Homo sapiens
gcatcttccagaagtgt

SEQ ID NO: 2554928 - DNA, 16 bp, Homo sapiens
gcatgacaagccccag

SEQ ID NO: 2554929 - DNA, 17 bp, Homo sapiens
gcatgacaagccccagg

SEQ ID NO: 2554930 - DNA, 16 bp, Homo sapiens
gcatgacctgtgacca

SEQ ID NO: 2554931 - DNA, 21 bp, Homo sapiens
gcatgaggaactagccaccaa

SEQ ID NO: 2554932 - DNA, 19 bp, Homo sapiens
gcatgagggatcacagggc

SEQ ID NO: 2554933 - DNA, 20 bp, Homo sapiens
gcatgagggatcacagggcc

SEQ ID NO: 2554934 - DNA, 16 bp, Homo sapiens
gcatgcactgttcccc

SEQ ID NO: 2554935 - DNA, 17 bp, Homo sapiens
gcatgcactgttccccc

SEQ ID NO: 2554936 - DNA, 23 bp, Homo sapiens
gcatgcactgttccccctgtgca

SEQ ID NO: 2554937 - DNA, 13 bp, Homo sapiens
gcatgcctgtgtg

SEQ ID NO: 2554938 - DNA, 16 bp, Homo sapiens
gcatgccttccagcac

SEQ ID NO: 2554939 - DNA, 21 bp, Homo sapiens
gcatgcgcacaaggctgacca

SEQ ID NO: 2554940 - DNA, 16 bp, Homo sapiens
gcatgcggcccagccc

SEQ ID NO: 2554941 - DNA, 15 bp, Homo sapiens
gcatgcggcccagga

SEQ ID NO: 2554942 - DNA, 13 bp, Homo sapiens
gcatgctggggca

SEQ ID NO: 2554943 - DNA, 16 bp, Homo sapiens
gcatgctggggcaagt

SEQ ID NO: 2554944 - DNA, 23 bp, Homo sapiens
gcatggacaccccttatccagga

SEQ ID NO: 2554945 - DNA, 20 bp, Homo sapiens
gcatggagtgtgtattgttc

SEQ ID NO: 2554946 - DNA, 20 bp, Homo sapiens
gcatggcaaggactgcaggg

SEQ ID NO: 2554947 - DNA, 22 bp, Homo sapiens
gcatggccctggggtcccacga

SEQ ID NO: 2554948 - DNA, 19 bp, Homo sapiens
gcatggctccagaaatgtc

SEQ ID NO: 2554949 - DNA, 21 bp, Homo sapiens
gcatggctccagtctgctgcc

SEQ ID NO: 2554950 - DNA, 22 bp, Homo sapiens
gcatggctccagtctgctgccc

SEQ ID NO: 2554951 - DNA, 18 bp, Homo sapiens
gcatgggaaagccacctc

SEQ ID NO: 2554952 - DNA, 19 bp, Homo sapiens
gcatgggaaagccacctct

SEQ ID NO: 2554953 - DNA, 13 bp, Homo sapiens
gcatggtgcagtt

SEQ ID NO: 2554954 - DNA, 15 bp, Homo sapiens
gcatggtggcaccag

SEQ ID NO: 2554955 - DNA, 22 bp, Homo sapiens
gcatgtaccctaaggtcattac

SEQ ID NO: 2554956 - DNA, 16 bp, Homo sapiens
gcatgtattggcctgg

SEQ ID NO: 2554957 - DNA, 17 bp, Homo sapiens
gcatgtattggcctgga

SEQ ID NO: 2554958 - DNA, 19 bp, Homo sapiens
gcatgtcctgtaaaggtta

SEQ ID NO: 2554959 - DNA, 12 bp, Homo sapiens
gcatgtgaagaa

SEQ ID NO: 2554960 - DNA, 17 bp, Homo sapiens
gcatgtggcctgtggcc

SEQ ID NO: 2554961 - DNA, 14 bp, Homo sapiens
gcatgtgtgtgctc

SEQ ID NO: 2554962 - DNA, 19 bp, Homo sapiens
gcatgtgtttggttctggg

SEQ ID NO: 2554963 - DNA, 20 bp, Homo sapiens
gcatgtgtttggttctgggg

SEQ ID NO: 2554964 - DNA, 16 bp, Homo sapiens
gcatgttccactaacc

SEQ ID NO: 2554965 - DNA, 14 bp, Homo sapiens
gcatgttctctgag

SEQ ID NO: 2554966 - DNA, 12 bp, Homo sapiens
gcatgtttgctg

SEQ ID NO: 2554967 - DNA, 15 bp, Homo sapiens
gcattaaaagaaaat

SEQ ID NO: 2554968 - DNA, 14 bp, Homo sapiens
gcattacagagagg

SEQ ID NO: 2554969 - DNA, 19 bp, Homo sapiens
gcattacagagaggagaaa

SEQ ID NO: 2554970 - DNA, 15 bp, Homo sapiens
gcattacgtgagcca

SEQ ID NO: 2554971 - DNA, 18 bp, Homo sapiens
gcattagaattatttaaa

SEQ ID NO: 2554972 - DNA, 17 bp, Homo sapiens
gcattatctagatactg

SEQ ID NO: 2554973 - DNA, 22 bp, Homo sapiens
gcattatctagatactgtatca

SEQ ID NO: 2554974 - DNA, 24 bp, Homo sapiens
gcattatctagatactgtatcatg

SEQ ID NO: 2554975 - DNA, 14 bp, Homo sapiens
gcattattgcatta

SEQ ID NO: 2554976 - DNA, 22 bp, Homo sapiens
gcattcaatttattcaagaaaa

SEQ ID NO: 2554977 - DNA, 17 bp, Homo sapiens
gcattccaacaaagggt

SEQ ID NO: 2554978 - DNA, 13 bp, Homo sapiens
gcattcccagtgg

SEQ ID NO: 2554979 - DNA, 17 bp, Homo sapiens
gcattccccaggaggcc

SEQ ID NO: 2554980 - DNA, 19 bp, Homo sapiens
gcattccccaggaggccag

SEQ ID NO: 2554981 - DNA, 14 bp, Homo sapiens
gcattctctgaaga

SEQ ID NO: 2554982 - DNA, 20 bp, Homo sapiens
gcattctgccgtgtgccctc

SEQ ID NO: 2554983 - DNA, 21 bp, Homo sapiens
gcattcttggttggctggcct

SEQ ID NO: 2554984 - DNA, 22 bp, Homo sapiens
gcattgagaactgcatatgttt

SEQ ID NO: 2554985 - DNA, 17 bp, Homo sapiens
gcattgatggggaagga

SEQ ID NO: 2554986 - DNA, 13 bp, Homo sapiens
gcattgcatggac

SEQ ID NO: 2554987 - DNA, 14 bp, Homo sapiens
gcattgccattccc

SEQ ID NO: 2554988 - DNA, 12 bp, Homo sapiens
gcattgctttcc

SEQ ID NO: 2554989 - DNA, 15 bp, Homo sapiens
gcattgctttccact

SEQ ID NO: 2554990 - DNA, 13 bp, Homo sapiens
gcattgctttctg

SEQ ID NO: 2554991 - DNA, 21 bp, Homo sapiens
gcattggaaaccctatttccc

SEQ ID NO: 2554992 - DNA, 16 bp, Homo sapiens
gcattgtaaatgtgct

SEQ ID NO: 2554993 - DNA, 15 bp, Homo sapiens
gcattgtatcgatgt

SEQ ID NO: 2554994 - DNA, 19 bp, Homo sapiens
gcattgtatcgatgttatg

SEQ ID NO: 2554995 - DNA, 16 bp, Homo sapiens
gcattgtccctgtgcc

SEQ ID NO: 2554996 - DNA, 17 bp, Homo sapiens
gcattgtgaactgacag

SEQ ID NO: 2554997 - DNA, 13 bp, Homo sapiens
gcattgtgggaag

SEQ ID NO: 2554998 - DNA, 16 bp, Homo sapiens
gcattgtgggaagggg

SEQ ID NO: 2554999 - DNA, 18 bp, Homo sapiens
gcatttaaaacagacact

SEQ ID NO: 2555000 - DNA, 15 bp, Homo sapiens
gcatttaaaagatac

SEQ ID NO: 2555001 - DNA, 17 bp, Homo sapiens
gcatttaaaagatacag

SEQ ID NO: 2555002 - DNA, 11 bp, Homo sapiens
gcatttcattc

SEQ ID NO: 2555003 - DNA, 22 bp, Homo sapiens
gcatttcattcttctctagctg

SEQ ID NO: 2555004 - DNA, 21 bp, Homo sapiens
gcatttccaacaccacagaca

SEQ ID NO: 2555005 - DNA, 16 bp, Homo sapiens
gcatttgagaaatgca

SEQ ID NO: 2555006 - DNA, 19 bp, Homo sapiens
gcatttgaggtctgttctt

SEQ ID NO: 2555007 - DNA, 21 bp, Homo sapiens
gcatttgaggtctgttctttc

SEQ ID NO: 2555008 - DNA, 23 bp, Homo sapiens
gcatttgctctttcatctctgct

SEQ ID NO: 2555009 - DNA, 13 bp, Homo sapiens
gcatttgctgaat

SEQ ID NO: 2555010 - DNA, 23 bp, Homo sapiens
gcatttgctgaatacagaggcaa

SEQ ID NO: 2555011 - DNA, 22 bp, Homo sapiens
gcatttggtggtttcagaaatg

SEQ ID NO: 2555012 - DNA, 13 bp, Homo sapiens
gcatttgtcaatg

SEQ ID NO: 2555013 - DNA, 16 bp, Homo sapiens
gcatttgtttgaactg

SEQ ID NO: 2555014 - DNA, 18 bp, Homo sapiens
gcatttgtttgaactgat

SEQ ID NO: 2555015 - DNA, 15 bp, Homo sapiens
gcattttaaaaatga

SEQ ID NO: 2555016 - DNA, 18 bp, Homo sapiens
gcattttcaccccaccct

SEQ ID NO: 2555017 - DNA, 22 bp, Homo sapiens
gcattttgctaaatgtgaatga

SEQ ID NO: 2555018 - DNA, 17 bp, Homo sapiens
gcattttgctattgtaa

SEQ ID NO: 2555019 - DNA, 14 bp, Homo sapiens
gcattttgtatttg

SEQ ID NO: 2555020 - DNA, 17 bp, Homo sapiens
gcatttttgcaggagca

SEQ ID NO: 2555021 - DNA, 21 bp, Homo sapiens
gcatttttgtgaaatgaaaac

SEQ ID NO: 2555022 - DNA, 15 bp, Homo sapiens
gccaaacagccacac

SEQ ID NO: 2555023 - DNA, 18 bp, Homo sapiens
gccaaacccttgtcagtg

SEQ ID NO: 2555024 - DNA, 15 bp, Homo sapiens
gccaaacctctgttc

SEQ ID NO: 2555025 - DNA, 17 bp, Homo sapiens
gccaaactctgccagcc

SEQ ID NO: 2555026 - DNA, 16 bp, Homo sapiens
gccaaagataatctct

SEQ ID NO: 2555027 - DNA, 20 bp, Homo sapiens
gccaaagccaaagctaggcc

SEQ ID NO: 2555028 - DNA, 16 bp, Homo sapiens
gccaaagctaggcctg

SEQ ID NO: 2555029 - DNA, 16 bp, Homo sapiens
gccaaagctagggtgg

SEQ ID NO: 2555030 - DNA, 20 bp, Homo sapiens
gccaaagctagggtggccct

SEQ ID NO: 2555031 - DNA, 19 bp, Homo sapiens
gccaaagggaaatatcatt

SEQ ID NO: 2555032 - DNA, 12 bp, Homo sapiens
gccaaagtgtta

SEQ ID NO: 2555033 - DNA, 18 bp, Homo sapiens
gccaaattatttgtgtaa

SEQ ID NO: 2555034 - DNA, 23 bp, Homo sapiens
gccaaattatttgtgtaatagaa

SEQ ID NO: 2555035 - DNA, 15 bp, Homo sapiens
gccaacaaagctgtt

SEQ ID NO: 2555036 - DNA, 16 bp, Homo sapiens
gccaacactcaagaag

SEQ ID NO: 2555037 - DNA, 19 bp, Homo sapiens
gccaacaggtggcaggacc

SEQ ID NO: 2555038 - DNA, 22 bp, Homo sapiens
gccaacaggtggcaggaccagg

SEQ ID NO: 2555039 - DNA, 23 bp, Homo sapiens
gccaacatcgtgaaaccctgtct

SEQ ID NO: 2555040 - DNA, 14 bp, Homo sapiens
gccaacatggtgaa

SEQ ID NO: 2555041 - DNA, 14 bp, Homo sapiens
gccaacccctgtgg

SEQ ID NO: 2555042 - DNA, 12 bp, Homo sapiens
gccaactgctgc

SEQ ID NO: 2555043 - DNA, 19 bp, Homo sapiens
gccaacttcttcagagctg

SEQ ID NO: 2555044 - DNA, 20 bp, Homo sapiens
gccaacttcttcagagctga

SEQ ID NO: 2555045 - DNA, 23 bp, Homo sapiens
gccaacttgagggcccagagcag

SEQ ID NO: 2555046 - DNA, 13 bp, Homo sapiens
gccaacttgtaaa

SEQ ID NO: 2555047 - DNA, 18 bp, Homo sapiens
gccaacttgtaaatacac

SEQ ID NO: 2555048 - DNA, 20 bp, Homo sapiens
gccaacttgtaaatacacca

SEQ ID NO: 2555049 - DNA, 18 bp, Homo sapiens
gccaagacttggcaacag

SEQ ID NO: 2555050 - DNA, 18 bp, Homo sapiens
gccaagcaacctgggtcc

SEQ ID NO: 2555051 - DNA, 20 bp, Homo sapiens
gccaagcacagtgcctgcat

SEQ ID NO: 2555052 - DNA, 22 bp, Homo sapiens
gccaagcacctagcctcgctct

SEQ ID NO: 2555053 - DNA, 12 bp, Homo sapiens
gccaagcagcca

SEQ ID NO: 2555054 - DNA, 13 bp, Homo sapiens
gccaagctagaat

SEQ ID NO: 2555055 - DNA, 21 bp, Homo sapiens
gccaaggagggtgagtgcaag

SEQ ID NO: 2555056 - DNA, 18 bp, Homo sapiens
gccaaggccttctcctcc

SEQ ID NO: 2555057 - DNA, 21 bp, Homo sapiens
gccaaggctgggggaagaagc

SEQ ID NO: 2555058 - DNA, 16 bp, Homo sapiens
gccaagggctttgttt

SEQ ID NO: 2555059 - DNA, 21 bp, Homo sapiens
gccaaggtgggctgagccctg

SEQ ID NO: 2555060 - DNA, 23 bp, Homo sapiens
gccaaggtgggctgagccctggc

SEQ ID NO: 2555061 - DNA, 15 bp, Homo sapiens
gccaagtgcaggctg

SEQ ID NO: 2555062 - DNA, 15 bp, Homo sapiens
gccaagttcctctag

SEQ ID NO: 2555063 - DNA, 12 bp, Homo sapiens
gccaagttctta

SEQ ID NO: 2555064 - DNA, 20 bp, Homo sapiens
gccaagtttatatacaatta

SEQ ID NO: 2555065 - DNA, 13 bp, Homo sapiens
gccaatcccctcc

SEQ ID NO: 2555066 - DNA, 12 bp, Homo sapiens
gccaatgaggtc

SEQ ID NO: 2555067 - DNA, 22 bp, Homo sapiens
gccaatgaggtctgaaatggag

SEQ ID NO: 2555068 - DNA, 19 bp, Homo sapiens
gccaatggaacctcctttc

SEQ ID NO: 2555069 - DNA, 22 bp, Homo sapiens
gccaatgtattgataagagggc

SEQ ID NO: 2555070 - DNA, 22 bp, Homo sapiens
gccacaagacccttgtggtccc

SEQ ID NO: 2555071 - DNA, 13 bp, Homo sapiens
gccacacacacag

SEQ ID NO: 2555072 - DNA, 15 bp, Homo sapiens
gccacacacacagaa

SEQ ID NO: 2555073 - DNA, 16 bp, Homo sapiens
gccacacacacagaaa

SEQ ID NO: 2555074 - DNA, 21 bp, Homo sapiens
gccacacacacagaaaatata

SEQ ID NO: 2555075 - DNA, 13 bp, Homo sapiens
gccacacagaaac

SEQ ID NO: 2555076 - DNA, 16 bp, Homo sapiens
gccacaccctcccccg

SEQ ID NO: 2555077 - DNA, 19 bp, Homo sapiens
gccacagaagccaggagca

SEQ ID NO: 2555078 - DNA, 21 bp, Homo sapiens
gccacagcctcccctgccagg

SEQ ID NO: 2555079 - DNA, 16 bp, Homo sapiens
gccacatgagtcccag

SEQ ID NO: 2555080 - DNA, 18 bp, Homo sapiens
gccacatgagtcccagtg

SEQ ID NO: 2555081 - DNA, 16 bp, Homo sapiens
gccaccaaaggccagg

SEQ ID NO: 2555082 - DNA, 19 bp, Homo sapiens
gccaccaagagggacgcct

SEQ ID NO: 2555083 - DNA, 16 bp, Homo sapiens
gccaccacgtccagct

SEQ ID NO: 2555084 - DNA, 10 bp, Homo sapiens
gccaccagcg

SEQ ID NO: 2555085 - DNA, 14 bp, Homo sapiens
gaccaccctcccct

SEQ ID NO: 2555086 - DNA, 16 bp, Homo sapiens
gaccaccctcccctct

SEQ ID NO: 2555087 - DNA, 13 bp, Homo sapiens
gaccacctgccca

SEQ ID NO: 2555088 - DNA, 14 bp, Homo sapiens
gaccacctgcccaa

SEQ ID NO: 2555089 - DNA, 14 bp, Homo sapiens
gaccacgctttcta

SEQ ID NO: 2555090 - DNA, 17 bp, Homo sapiens
gaccacgtgctaccccc

SEQ ID NO: 2555091 - DNA, 14 bp, Homo sapiens
gaccacgtttctaa

SEQ ID NO: 2555092 - DNA, 16 bp, Homo sapiens
gaccacgtttctaaag

SEQ ID NO: 2555093 - DNA, 16 bp, Homo sapiens
gaccactgcagaagac

SEQ ID NO: 2555094 - DNA, 21 bp, Homo sapiens
gaccactgcatgagcttttat

SEQ ID NO: 2555095 - DNA, 21 bp, Homo sapiens
gaccagacaccttgacagggc

SEQ ID NO: 2555096 - DNA, 17 bp, Homo sapiens
gaccagcactgtctcag

SEQ ID NO: 2555097 - DNA, 17 bp, Homo sapiens
gaccagcagatcccagc

SEQ ID NO: 2555098 - DNA, 12 bp, Homo sapiens
gaccagcctggg

SEQ ID NO: 2555099 - DNA, 17 bp, Homo sapiens
gaccagcctgggcagca

SEQ ID NO: 2555100 - DNA, 23 bp, Homo sapiens
gaccaggcatcctccacaatagc

SEQ ID NO: 2555101 - DNA, 13 bp, Homo sapiens
gaccaggcctggg

SEQ ID NO: 2555102 - DNA, 18 bp, Homo sapiens
gaccagggatttccatga

SEQ ID NO: 2555103 - DNA, 16 bp, Homo sapiens
gaccagggcagggcca

SEQ ID NO: 2555104 - DNA, 23 bp, Homo sapiens
gaccaggggtgatttcagagagg

SEQ ID NO: 2555105 - DNA, 14 bp, Homo sapiens
gaccagttgggagc

SEQ ID NO: 2555106 - DNA, 17 bp, Homo sapiens
gaccagttgggagcact

SEQ ID NO: 2555107 - DNA, 20 bp, Homo sapiens
gaccagttgggagcactgga

SEQ ID NO: 2555108 - DNA, 19 bp, Homo sapiens
gaccagtttaacctgatgc

SEQ ID NO: 2555109 - DNA, 23 bp, Homo sapiens
gaccatccactctaccctcccac

SEQ ID NO: 2555110 - DNA, 14 bp, Homo sapiens
gaccatccctgaag

SEQ ID NO: 2555111 - DNA, 19 bp, Homo sapiens
gaccatccctgaaggcccc

SEQ ID NO: 2555112 - DNA, 19 bp, Homo sapiens
gaccattctccacctgcca

SEQ ID NO: 2555113 - DNA, 18 bp, Homo sapiens
gacccaaaaggcagaagc

SEQ ID NO: 2555114 - DNA, 11 bp, Homo sapiens
gacccaaagac

SEQ ID NO: 2555115 - DNA, 12 bp, Homo sapiens
gacccaaagacc

SEQ ID NO: 2555116 - DNA, 15 bp, Homo sapiens
gacccacccctgtgc

SEQ ID NO: 2555117 - DNA, 15 bp, Homo sapiens
gacccagatcctcac

SEQ ID NO: 2555118 - DNA, 19 bp, Homo sapiens
gagctcgtgtatcctgggg

SEQ ID NO: 2555119 - DNA, 23 bp, Homo sapiens
gagctcgtgtatcctggggctcc

SEQ ID NO: 2555120 - DNA, 23 bp, Homo sapiens
gagctgacacaaacctgcctggg

SEQ ID NO: 2555121 - DNA, 16 bp, Homo sapiens
gagctgacacaggatg

SEQ ID NO: 2555122 - DNA, 13 bp, Homo sapiens
gagctgagatgga

SEQ ID NO: 2555123 - DNA, 22 bp, Homo sapiens
gagggagtgacagaggcagccc

SEQ ID NO: 2555124 - DNA, 14 bp, Homo sapiens
gagggatcacaggg

SEQ ID NO: 2555125 - DNA, 23 bp, Homo sapiens
gagggatcacagggccccagaag

SEQ ID NO: 2555126 - DNA, 18 bp, Homo sapiens
gagggcaagggccatgct

SEQ ID NO: 2555127 - DNA, 23 bp, Homo sapiens
gagggcacattccttgcctgcac

SEQ ID NO: 2555128 - DNA, 17 bp, Homo sapiens
gagggcagaaaggttct

SEQ ID NO: 2555129 - DNA, 20 bp, Homo sapiens
gagggcagaaaggttctgcc

SEQ ID NO: 2555130 - DNA, 15 bp, Homo sapiens
gagggcagcagggct

SEQ ID NO: 2555131 - DNA, 11 bp, Homo sapiens
gagggcaggga

SEQ ID NO: 2555132 - DNA, 18 bp, Homo sapiens
gagggcatgcgcacaagg

SEQ ID NO: 2555133 - DNA, 14 bp, Homo sapiens
gagggcccagagca

SEQ ID NO: 2555134 - DNA, 16 bp, Homo sapiens
gagggcccagagcagg

SEQ ID NO: 2555135 - DNA, 22 bp, Homo sapiens
gagggcccagagcaggaagcat

SEQ ID NO: 2555136 - DNA, 18 bp, Homo sapiens
gagggcccctctgcccag

SEQ ID NO: 2555137 - DNA, 20 bp, Homo sapiens
gagggcccctctgcccagct

SEQ ID NO: 2555138 - DNA, 22 bp, Homo sapiens
gagggcccctctgcccagcttg

SEQ ID NO: 2555139 - DNA, 18 bp, Homo sapiens
gagtgactcgagggttgg

SEQ ID NO: 2555140 - DNA, 23 bp, Homo sapiens
gagtgagacccagccctcatccc

SEQ ID NO: 2555141 - DNA, 18 bp, Homo sapiens
gagtgaggatgtctgggc

SEQ ID NO: 2555142 - DNA, 22 bp, Homo sapiens
gagtgagggtttctgagctgct

SEQ ID NO: 2555143 - DNA, 19 bp, Homo sapiens
gagtgagtgtggctcccct

SEQ ID NO: 2555144 - DNA, 21 bp, Homo sapiens
gagtgcaagcccctgctccag

SEQ ID NO: 2555145 - DNA, 17 bp, Homo sapiens
gagtgcagtcctgatca

SEQ ID NO: 2555146 - DNA, 22 bp, Homo sapiens
gagtgcagtcctgatcagagcc

SEQ ID NO: 2555147 - DNA, 11 bp, Homo sapiens
gagtgcagtga

SEQ ID NO: 2555148 - DNA, 13 bp, Homo sapiens
gagtgcagtgagc

SEQ ID NO: 2555149 - DNA, 19 bp, Homo sapiens
gagtgccaggactccccag

SEQ ID NO: 2555150 - DNA, 14 bp, Homo sapiens
gagtgcccagaact

SEQ ID NO: 2555151 - DNA, 14 bp, Homo sapiens
gagtgcctggccaa

SEQ ID NO: 2555152 - DNA, 17 bp, Homo sapiens
gagtggaggaggcctgg

SEQ ID NO: 2555153 - DNA, 17 bp, Homo sapiens
gagtggatctccaagga

SEQ ID NO: 2555154 - DNA, 20 bp, Homo sapiens
gagtggcatggccaccacca

SEQ ID NO: 2555155 - DNA, 14 bp, Homo sapiens
gagtggcctggcca

SEQ ID NO: 2555156 - DNA, 19 bp, Homo sapiens
gagtggcctggccaggagc

SEQ ID NO: 2555157 - DNA, 20 bp, Homo sapiens
gagtggcctggccaggagct

SEQ ID NO: 2555158 - DNA, 21 bp, Homo sapiens
gagtggggttatctctgtgtt

SEQ ID NO: 2555159 - DNA, 15 bp, Homo sapiens
gagtgggttgatttc

SEQ ID NO: 2555160 - DNA, 11 bp, Homo sapiens
gagtgtagaag

SEQ ID NO: 2555161 - DNA, 14 bp, Homo sapiens
gagtgtagaagcat

SEQ ID NO: 2555162 - DNA, 15 bp, Homo sapiens
gagtgtagaagcatt

SEQ ID NO: 2555163 - DNA, 18 bp, Homo sapiens
gagtgtgctggaggactg

SEQ ID NO: 2555164 - DNA, 16 bp, Homo sapiens
gagtgtggctgaggag

SEQ ID NO: 2555165 - DNA, 13 bp, Homo sapiens
gagtgtgtaattt

SEQ ID NO: 2555166 - DNA, 16 bp, Homo sapiens
gagtgtgtattgttcc

SEQ ID NO: 2555167 - DNA, 18 bp, Homo sapiens
gagtgtgtattgttccca

SEQ ID NO: 2555168 - DNA, 18 bp, Homo sapiens
gagttacagcgagaggca

SEQ ID NO: 2555169 - DNA, 19 bp, Homo sapiens
gagttacagcgagaggcag

SEQ ID NO: 2555170 - DNA, 17 bp, Homo sapiens
gagttacattaatgtta

SEQ ID NO: 2555171 - DNA, 17 bp, Homo sapiens
gagttaggctattcaca

SEQ ID NO: 2555172 - DNA, 13 bp, Homo sapiens
gagttcaatgatc

SEQ ID NO: 2555173 - DNA, 16 bp, Homo sapiens
gagttcaatgatctag

SEQ ID NO: 2555174 - DNA, 19 bp, Homo sapiens
gagttcaatgatctaggtt

SEQ ID NO: 2555175 - DNA, 15 bp, Homo sapiens
gagttcaatggctgc

SEQ ID NO: 2555176 - DNA, 16 bp, Homo sapiens
gagttcaatggctgct

SEQ ID NO: 2555177 - DNA, 17 bp, Homo sapiens
gagttcgagaccagcct

SEQ ID NO: 2555178 - DNA, 21 bp, Homo sapiens
gagttcgagaccagcctggcc

SEQ ID NO: 2555179 - DNA, 19 bp, Homo sapiens
gagttcgaggctgcagtca

SEQ ID NO: 2555180 - DNA, 14 bp, Homo sapiens
gagttctcagggct

SEQ ID NO: 2555181 - DNA, 23 bp, Homo sapiens
gagttgacttgacagaacactgt

SEQ ID NO: 2555182 - DNA, 16 bp, Homo sapiens
gagttgttacattttt

SEQ ID NO: 2555183 - DNA, 13 bp, Homo sapiens
gagtttaaagcaa

SEQ ID NO: 2555184 - DNA, 21 bp, Homo sapiens
gagtttagtgatctgaacaga

SEQ ID NO: 2555185 - DNA, 16 bp, Homo sapiens
gagtttccaaaaccag

SEQ ID NO: 2555186 - DNA, 15 bp, Homo sapiens
gagtttggtccctgg

SEQ ID NO: 2555187 - DNA, 21 bp, Homo sapiens
gataaaaagatgttcagtcat

SEQ ID NO: 2555188 - DNA, 22 bp, Homo sapiens
gataaaattatagatgggaatg

SEQ ID NO: 2555189 - DNA, 11 bp, Homo sapiens
gataaagatga

SEQ ID NO: 2555190 - DNA, 12 bp, Homo sapiens
gataaagatgat

SEQ ID NO: 2555191 - DNA, 19 bp, Homo sapiens
gataaagccactgaaaatt

SEQ ID NO: 2555192 - DNA, 16 bp, Homo sapiens
gataaagtttctcaga

SEQ ID NO: 2555193 - DNA, 16 bp, Homo sapiens
gataaataactttttt

SEQ ID NO: 2555194 - DNA, 21 bp, Homo sapiens
gataaataacttttttttaag

SEQ ID NO: 2555195 - DNA, 16 bp, Homo sapiens
gataacaacctggaga

SEQ ID NO: 2555196 - DNA, 15 bp, Homo sapiens
gataaccagctgtaa

SEQ ID NO: 2555197 - DNA, 23 bp, Homo sapiens
gataacctatatgatttatagtt

SEQ ID NO: 2555198 - DNA, 21 bp, Homo sapiens
gataacctgtacttcaagtta

SEQ ID NO: 2555199 - DNA, 17 bp, Homo sapiens
gataactgttatttata

SEQ ID NO: 2555200 - DNA, 21 bp, Homo sapiens
gataacttaggtggcaagctg

SEQ ID NO: 2555201 - DNA, 17 bp, Homo sapiens
gataagaatgctggttt

SEQ ID NO: 2555202 - DNA, 22 bp, Homo sapiens
gataagagtagaaactgcaggg

SEQ ID NO: 2555203 - DNA, 16 bp, Homo sapiens
gataataatatatgtt

SEQ ID NO: 2555204 - DNA, 24 bp, Homo sapiens
gataatacaccactacattctgtt

SEQ ID NO: 2555205 - DNA, 17 bp, Homo sapiens
gataatatgagaatcag

SEQ ID NO: 2555206 - DNA, 18 bp, Homo sapiens
gataatattgtggtgcca

SEQ ID NO: 2555207 - DNA, 17 bp, Homo sapiens
gataatcaactgggctg

SEQ ID NO: 2555208 - DNA, 21 bp, Homo sapiens
gataatcaactgggctgaaca

SEQ ID NO: 2555209 - DNA, 13 bp, Homo sapiens
gataatcagcctc

SEQ ID NO: 2555210 - DNA, 16 bp, Homo sapiens
gataatcagcctctta

SEQ ID NO: 2555211 - DNA, 21 bp, Homo sapiens
gataatgtgatattatacata

SEQ ID NO: 2555212 - DNA, 19 bp, Homo sapiens
gataatgttaaatttgtaa

SEQ ID NO: 2555213 - DNA, 21 bp, Homo sapiens
gataatgttaaatttgtaagt

SEQ ID NO: 2555214 - DNA, 16 bp, Homo sapiens
gatacaaaagcatgtg

SEQ ID NO: 2555215 - DNA, 20 bp, Homo sapiens
gatacactgaagttaacaga

SEQ ID NO: 2555216 - DNA, 12 bp, Homo sapiens
gataccagcccc

SEQ ID NO: 2555217 - DNA, 15 bp, Homo sapiens
gataccagcgaggag

SEQ ID NO: 2555218 - DNA, 17 bp, Homo sapiens
gataccaggttgaaaga

SEQ ID NO: 2555219 - DNA, 20 bp, Homo sapiens
gataccaggttgaaagacct

SEQ ID NO: 2555220 - DNA, 15 bp, Homo sapiens
gatactgcccggggc

SEQ ID NO: 2555221 - DNA, 19 bp, Homo sapiens
gatactggaagttttgcat

SEQ ID NO: 2555222 - DNA, 21 bp, Homo sapiens
gatactgtatcatgacaaaga

SEQ ID NO: 2555223 - DNA, 13 bp, Homo sapiens
gatactttacatg

SEQ ID NO: 2555224 - DNA, 14 bp, Homo sapiens
gatagaaataaata

SEQ ID NO: 2555225 - DNA, 14 bp, Homo sapiens
gatagatgtgtgga

SEQ ID NO: 2555226 - DNA, 22 bp, Homo sapiens
gatagatgtgtggacacattgg

SEQ ID NO: 2555227 - DNA, 19 bp, Homo sapiens
gatagcacagaccctgccc

SEQ ID NO: 2555228 - DNA, 20 bp, Homo sapiens
gatagcacagaccctgccct

SEQ ID NO: 2555229 - DNA, 21 bp, Homo sapiens
gatagcacagaccctgccctg

SEQ ID NO: 2555230 - DNA, 17 bp, Homo sapiens
gatagcatttttgattt

SEQ ID NO: 2555231 - DNA, 18 bp, Homo sapiens
gatagctaacattttaaa

SEQ ID NO: 2555232 - DNA, 19 bp, Homo sapiens
gataggaaaaatgagtaat

SEQ ID NO: 2555233 - DNA, 17 bp, Homo sapiens
gataggctctgcacaga

SEQ ID NO: 2555234 - DNA, 20 bp, Homo sapiens
gataggctctgcacagatgg

SEQ ID NO: 2555235 - DNA, 16 bp, Homo sapiens
gatagtattgtgcata

SEQ ID NO: 2555236 - DNA, 16 bp, Homo sapiens
gatatagccagaaaaa

SEQ ID NO: 2555237 - DNA, 23 bp, Homo sapiens
gatataggtcagtgaggcccagg

SEQ ID NO: 2555238 - DNA, 13 bp, Homo sapiens
gatatatatcata

SEQ ID NO: 2555239 - DNA, 20 bp, Homo sapiens
gatatatgtgtttttcacat

SEQ ID NO: 2555240 - DNA, 15 bp, Homo sapiens
gatatctgagggagg

SEQ ID NO: 2555241 - DNA, 14 bp, Homo sapiens
gatatgatttaaaa

SEQ ID NO: 2555242 - DNA, 21 bp, Homo sapiens
gatatggagccctgtaatttt

SEQ ID NO: 2555243 - DNA, 17 bp, Homo sapiens
gatatggcagaagacac

SEQ ID NO: 2555244 - DNA, 16 bp, Homo sapiens
gatattccatgaatgt

SEQ ID NO: 2555245 - DNA, 18 bp, Homo sapiens
gatattccatgaatgtat

SEQ ID NO: 2555246 - DNA, 20 bp, Homo sapiens
gatattccccccacttaaga

SEQ ID NO: 2555247 - DNA, 23 bp, Homo sapiens
gatatttatatttttattttatt

SEQ ID NO: 2555248 - DNA, 22 bp, Homo sapiens
gatatttccctcccctggggac

SEQ ID NO: 2555249 - DNA, 21 bp, Homo sapiens
gatattttacctcttattgca

SEQ ID NO: 2555250 - DNA, 20 bp, Homo sapiens
gatattttcaaattgtatct

SEQ ID NO: 2555251 - DNA, 17 bp, Homo sapiens
gatatttttatctttat

SEQ ID NO: 2555252 - DNA, 15 bp, Homo sapiens
gatatttttttcttt

SEQ ID NO: 2555253 - DNA, 21 bp, Homo sapiens
gatcaaccccttcgctcctgt

SEQ ID NO: 2555254 - DNA, 23 bp, Homo sapiens
gatcaaccccttcgctcctgtgt

SEQ ID NO: 2555255 - DNA, 18 bp, Homo sapiens
gatcaaggagaggaggca

SEQ ID NO: 2555256 - DNA, 18 bp, Homo sapiens
gatcaataaaatgtgatt

SEQ ID NO: 2555257 - DNA, 13 bp, Homo sapiens
gatcaatgaaatg

SEQ ID NO: 2555258 - DNA, 13 bp, Homo sapiens
gatcacaaaaaca

SEQ ID NO: 2555259 - DNA, 16 bp, Homo sapiens
gatcacagcagcttct

SEQ ID NO: 2555260 - DNA, 14 bp, Homo sapiens
gatcaccagcccgg

SEQ ID NO: 2555261 - DNA, 15 bp, Homo sapiens
gatcaccagcccggc

SEQ ID NO: 2555262 - DNA, 20 bp, Homo sapiens
gatcaccagcccggcctgct

SEQ ID NO: 2555263 - DNA, 14 bp, Homo sapiens
gatcacgccactgc

SEQ ID NO: 2555264 - DNA, 16 bp, Homo sapiens
gatcacgccactgcac

SEQ ID NO: 2555265 - DNA, 24 bp, Homo sapiens
gatcacgccactgcactccagcct

SEQ ID NO: 2555266 - DNA, 16 bp, Homo sapiens
gatcacggctcactgc

SEQ ID NO: 2555267 - DNA, 18 bp, Homo sapiens
gatcacggctcactgcag

SEQ ID NO: 2555268 - DNA, 17 bp, Homo sapiens
gatcactggagcccagg

SEQ ID NO: 2555269 - DNA, 18 bp, Homo sapiens
gatcactggagcccagga

SEQ ID NO: 2555270 - DNA, 16 bp, Homo sapiens
gatcagaccataatgt

SEQ ID NO: 2555271 - DNA, 14 bp, Homo sapiens
gatcagagcagcag

SEQ ID NO: 2555272 - DNA, 16 bp, Homo sapiens
gatcagagccgtggtc

SEQ ID NO: 2555273 - DNA, 15 bp, Homo sapiens
gatcagattgcatgt

SEQ ID NO: 2555274 - DNA, 18 bp, Homo sapiens
gatcagctgtttgtcata

SEQ ID NO: 2555275 - DNA, 13 bp, Homo sapiens
gatcaggtgggga

SEQ ID NO: 2555276 - DNA, 20 bp, Homo sapiens
gatcagtataattttttaaa

SEQ ID NO: 2555277 - DNA, 22 bp, Homo sapiens
gatcagtctgattcccaagctc

SEQ ID NO: 2555278 - DNA, 23 bp, Homo sapiens
gatcagtgggcctccaaggaggg

SEQ ID NO: 2555279 - DNA, 16 bp, Homo sapiens
gatcatccactgtgcc

SEQ ID NO: 2555280 - DNA, 21 bp, Homo sapiens
gatcatccactgtgccatgtg

SEQ ID NO: 2555281 - DNA, 18 bp, Homo sapiens
gatcatggtgtaataaga

SEQ ID NO: 2555282 - DNA, 14 bp, Homo sapiens
gatcattatcagcc

SEQ ID NO: 2555283 - DNA, 14 bp, Homo sapiens
gatcattttccccc

SEQ ID NO: 2555284 - DNA, 19 bp, Homo sapiens
gatccaagctggtcccact

SEQ ID NO: 2555285 - DNA, 21 bp, Homo sapiens
gatccaagctggtcccactca

SEQ ID NO: 2555286 - DNA, 16 bp, Homo sapiens
gatccacacacagagg

SEQ ID NO: 2555287 - DNA, 17 bp, Homo sapiens
gatccacacacagagga

SEQ ID NO: 2555288 - DNA, 19 bp, Homo sapiens
gatccacccacctcagcct

SEQ ID NO: 2555289 - DNA, 20 bp, Homo sapiens
gatccacccacctcagcctc

SEQ ID NO: 2555290 - DNA, 21 bp, Homo sapiens
gatccacccacctcagcctcc

SEQ ID NO: 2555291 - DNA, 14 bp, Homo sapiens
gatccagagcacag

SEQ ID NO: 2555292 - DNA, 24 bp, Homo sapiens
gatcccatcttgataagaccacca

SEQ ID NO: 2555293 - DNA, 17 bp, Homo sapiens
gatcccctcaggactgc

SEQ ID NO: 2555294 - DNA, 16 bp, Homo sapiens
gatccctcatcctcat

SEQ ID NO: 2555295 - DNA, 14 bp, Homo sapiens
gatccctctctgga

SEQ ID NO: 2555296 - DNA, 17 bp, Homo sapiens
gatcctcccacctcagc

SEQ ID NO: 2555297 - DNA, 20 bp, Homo sapiens
gatcgcaagagccatgtaga

SEQ ID NO: 2555298 - DNA, 18 bp, Homo sapiens
gatcgcagtttgcctggt

SEQ ID NO: 2555299 - DNA, 15 bp, Homo sapiens
gatcgcatcattgca

SEQ ID NO: 2555300 - DNA, 23 bp, Homo sapiens
gatcgcatcattgcactctagcc

SEQ ID NO: 2555301 - DNA, 20 bp, Homo sapiens
gatcggagcctcctctctca

SEQ ID NO: 2555302 - DNA, 21 bp, Homo sapiens
gatctaaggatgtcacagggc

SEQ ID NO: 2555303 - DNA, 14 bp, Homo sapiens
gatctaggaagact

SEQ ID NO: 2555304 - DNA, 14 bp, Homo sapiens
gatctaggtttaac

SEQ ID NO: 2555305 - DNA, 17 bp, Homo sapiens
gatctaggtttaactca

SEQ ID NO: 2555306 - DNA, 14 bp, Homo sapiens
gatctcaggggctg

SEQ ID NO: 2555307 - DNA, 13 bp, Homo sapiens
gatctcaggttct

SEQ ID NO: 2555308 - DNA, 21 bp, Homo sapiens
gatctcattggacccttccat

SEQ ID NO: 2555309 - DNA, 16 bp, Homo sapiens
gatctccaaggaccag

SEQ ID NO: 2555310 - DNA, 19 bp, Homo sapiens
gatctccaaggaccaggtt

SEQ ID NO: 2555311 - DNA, 12 bp, Homo sapiens
gatctctcagga

SEQ ID NO: 2555312 - DNA, 17 bp, Homo sapiens
gatctctcaggagcaca

SEQ ID NO: 2555313 - DNA, 19 bp, Homo sapiens
gatctctcaggagcacagg

SEQ ID NO: 2555314 - DNA, 16 bp, Homo sapiens
gatctcttgagcctgg

SEQ ID NO: 2555315 - DNA, 17 bp, Homo sapiens
gatctcttgagcctggg

SEQ ID NO: 2555316 - DNA, 18 bp, Homo sapiens
gatctcttgagcctggga

SEQ ID NO: 2555317 - DNA, 17 bp, Homo sapiens
gatctgatgcaagcaag

SEQ ID NO: 2555318 - DNA, 14 bp, Homo sapiens
gatctgcccctccc

SEQ ID NO: 2555319 - DNA, 20 bp, Homo sapiens
gatctgcccctccctgcttc

SEQ ID NO: 2555320 - DNA, 16 bp, Homo sapiens
gatctggttttgctat

SEQ ID NO: 2555321 - DNA, 24 bp, Homo sapiens
gatctggttttgctattagactgt

SEQ ID NO: 2555322 - DNA, 20 bp, Homo sapiens
gatctgtcacaccagccata

SEQ ID NO: 2555323 - DNA, 14 bp, Homo sapiens
gatctgtgccccat

SEQ ID NO: 2555324 - DNA, 18 bp, Homo sapiens
gatctgtgccccatgcct

SEQ ID NO: 2555325 - DNA, 19 bp, Homo sapiens
gatctgtgctttccagctc

SEQ ID NO: 2555326 - DNA, 20 bp, Homo sapiens
gatctgtgctttccagctca

SEQ ID NO: 2555327 - DNA, 14 bp, Homo sapiens
gatcttcaatggct

SEQ ID NO: 2555328 - DNA, 19 bp, Homo sapiens
gatcttctttataattcta

SEQ ID NO: 2555329 - DNA, 13 bp, Homo sapiens
gatctttaaaata

SEQ ID NO: 2555330 - DNA, 11 bp, Homo sapiens
gatctttcagg

SEQ ID NO: 2555331 - DNA, 15 bp, Homo sapiens
gatctttcaggaaag

SEQ ID NO: 2555332 - DNA, 13 bp, Homo sapiens
gatctttggacag

SEQ ID NO: 2555333 - DNA, 14 bp, Homo sapiens
gatgaaaaatagca

SEQ ID NO: 2555334 - DNA, 14 bp, Homo sapiens
gatgaaaatatttg

SEQ ID NO: 2555335 - DNA, 19 bp, Homo sapiens
gatgaaatcttacagctgg

SEQ ID NO: 2555336 - DNA, 13 bp, Homo sapiens
gatgaacccagga

SEQ ID NO: 2555337 - DNA, 23 bp, Homo sapiens
gatgaacccaggacgcttctgaa

SEQ ID NO: 2555338 - DNA, 21 bp, Homo sapiens
gatgaagagtgagagggcatg

SEQ ID NO: 2555339 - DNA, 19 bp, Homo sapiens
gatgaatgaggtcccaggc

SEQ ID NO: 2555340 - DNA, 14 bp, Homo sapiens
gatgaatgtatgtg

SEQ ID NO: 2555341 - DNA, 18 bp, Homo sapiens
gatgacatgtgactccta

SEQ ID NO: 2555342 - DNA, 18 bp, Homo sapiens
gatgacattgctaagatg

SEQ ID NO: 2555343 - DNA, 18 bp, Homo sapiens
gatgaccagaacaaggtt

SEQ ID NO: 2555344 - DNA, 12 bp, Homo sapiens
gatgactaaaat

SEQ ID NO: 2555345 - DNA, 14 bp, Homo sapiens
gatgagaagagggg

SEQ ID NO: 2555346 - DNA, 21 bp, Homo sapiens
gatgagagcccagaggtaaca

SEQ ID NO: 2555347 - DNA, 16 bp, Homo sapiens
gatgagcatcccagga

SEQ ID NO: 2555348 - DNA, 21 bp, Homo sapiens
gatgagcatttagggcaagga

SEQ ID NO: 2555349 - DNA, 13 bp, Homo sapiens
gatgagccgctgt

SEQ ID NO: 2555350 - DNA, 13 bp, Homo sapiens
gatgaggcagagg

SEQ ID NO: 2555351 - DNA, 22 bp, Homo sapiens
gatgaggccgctagaggcctga

SEQ ID NO: 2555352 - DNA, 14 bp, Homo sapiens
gatgaggggaggaa

SEQ ID NO: 2555353 - DNA, 21 bp, Homo sapiens
gatgatctactcagaaatttt

SEQ ID NO: 2555354 - DNA, 21 bp, Homo sapiens
gatgatctaggaagactttgg

SEQ ID NO: 2555355 - DNA, 16 bp, Homo sapiens
gatgatctttaaaata

SEQ ID NO: 2555356 - DNA, 15 bp, Homo sapiens
gatgatgtgcctggg

SEQ ID NO: 2555357 - DNA, 17 bp, Homo sapiens
gatgatttaaaagggaa

SEQ ID NO: 2555358 - DNA, 14 bp, Homo sapiens
gatgatttttgtca

SEQ ID NO: 2555359 - DNA, 17 bp, Homo sapiens
gatgcaagatatttata

SEQ ID NO: 2555360 - DNA, 23 bp, Homo sapiens
gatgcagaggtaaaagtgtgagc

SEQ ID NO: 2555361 - DNA, 12 bp, Homo sapiens
gatgcagcctca

SEQ ID NO: 2555362 - DNA, 22 bp, Homo sapiens
gatgcaggtgagcccatggccc

SEQ ID NO: 2555363 - DNA, 21 bp, Homo sapiens
gatgcatgttttccagctcct

SEQ ID NO: 2555364 - DNA, 15 bp, Homo sapiens
gatgcattaaaagaa

SEQ ID NO: 2555365 - DNA, 16 bp, Homo sapiens
gatgcattaaaagaaa

SEQ ID NO: 2555366 - DNA, 15 bp, Homo sapiens
gatgccaacctctgg

SEQ ID NO: 2555367 - DNA, 22 bp, Homo sapiens
gatgccaacctctggagcaatg

SEQ ID NO: 2555368 - DNA, 21 bp, Homo sapiens
gatgccaagaagtttaaggaa

SEQ ID NO: 2555369 - DNA, 21 bp, Homo sapiens
gatgccagtaggctcaactag

SEQ ID NO: 2555370 - DNA, 18 bp, Homo sapiens
gatgcccagagggcccag

SEQ ID NO: 2555371 - DNA, 23 bp, Homo sapiens
gatgcccagagggcccaggcagg

SEQ ID NO: 2555372 - DNA, 22 bp, Homo sapiens
gatgcccagggccactctgcct

SEQ ID NO: 2555373 - DNA, 23 bp, Homo sapiens
gatgcctcatgatatgtcagggc

SEQ ID NO: 2555374 - DNA, 22 bp, Homo sapiens
gatgcctgattgccaagctcag

SEQ ID NO: 2555375 - DNA, 20 bp, Homo sapiens
gatgcctggtggcagctgcg

SEQ ID NO: 2555376 - DNA, 16 bp, Homo sapiens
gatgcggtggctcacg

SEQ ID NO: 2555377 - DNA, 21 bp, Homo sapiens
gatgcggtggctcacgcctgt

SEQ ID NO: 2555378 - DNA, 14 bp, Homo sapiens
gatgctcaggcttg

SEQ ID NO: 2555379 - DNA, 12 bp, Homo sapiens
gatgctccagcc

SEQ ID NO: 2555380 - DNA, 13 bp, Homo sapiens
gatgctccagcca

SEQ ID NO: 2555381 - DNA, 22 bp, Homo sapiens
gatgctccagccaacccctgtg

SEQ ID NO: 2555382 - DNA, 21 bp, Homo sapiens
gatgctccctcccctgccctg

SEQ ID NO: 2555383 - DNA, 14 bp, Homo sapiens
gatgctccttgggc

SEQ ID NO: 2555384 - DNA, 15 bp, Homo sapiens
gatgctcttctgtgg

SEQ ID NO: 2555385 - DNA, 15 bp, Homo sapiens
gatgctgactagtga

SEQ ID NO: 2555386 - DNA, 13 bp, Homo sapiens
gatgctgatgttc

SEQ ID NO: 2555387 - DNA, 16 bp, Homo sapiens
gatgctgatgttcagt

SEQ ID NO: 2555388 - DNA, 23 bp, Homo sapiens
gatgctgccagggcgccatcgcc

SEQ ID NO: 2555389 - DNA, 12 bp, Homo sapiens
gatgctgcctga

SEQ ID NO: 2555390 - DNA, 14 bp, Homo sapiens
gatgctgcctgagt

SEQ ID NO: 2555391 - DNA, 14 bp, Homo sapiens
gatgctggagaggt

SEQ ID NO: 2555392 - DNA, 16 bp, Homo sapiens
gatgctgggctggctc

SEQ ID NO: 2555393 - DNA, 12 bp, Homo sapiens
gatgctgttgcc

SEQ ID NO: 2555394 - DNA, 15 bp, Homo sapiens
gatgcttctgggaga

SEQ ID NO: 2555395 - DNA, 17 bp, Homo sapiens
gatgcttcttcagagac

SEQ ID NO: 2555396 - DNA, 20 bp, Homo sapiens
gatgcttcttcagagactcc

SEQ ID NO: 2555397 - DNA, 17 bp, Homo sapiens
gatgcttttctgtctct

SEQ ID NO: 2555398 - DNA, 17 bp, Homo sapiens
gatggaaaaggaagact

SEQ ID NO: 2555399 - DNA, 21 bp, Homo sapiens
gatggaacaggctcagatctc

SEQ ID NO: 2555400 - DNA, 17 bp, Homo sapiens
gatggaaccgcaggaag

SEQ ID NO: 2555401 - DNA, 19 bp, Homo sapiens
gatggaaccgcaggaagct

SEQ ID NO: 2555402 - DNA, 14 bp, Homo sapiens
gatggagagagggg

SEQ ID NO: 2555403 - DNA, 22 bp, Homo sapiens
gatggagcgcacctgccccctg

SEQ ID NO: 2555404 - DNA, 21 bp, Homo sapiens
gatggaggggtggtcctgact

SEQ ID NO: 2555405 - DNA, 15 bp, Homo sapiens
gatggatttgaagca

SEQ ID NO: 2555406 - DNA, 14 bp, Homo sapiens
gatggcaccagagg

SEQ ID NO: 2555407 - DNA, 15 bp, Homo sapiens
gatggcaccagaggc

SEQ ID NO: 2555408 - DNA, 21 bp, Homo sapiens
gatggcacttagctatcagaa

SEQ ID NO: 2555409 - DNA, 15 bp, Homo sapiens
gatggcccttcccac

SEQ ID NO: 2555410 - DNA, 14 bp, Homo sapiens
gatggcctggccag

SEQ ID NO: 2555411 - DNA, 18 bp, Homo sapiens
gatgggaatgaagcttgt

SEQ ID NO: 2555412 - DNA, 21 bp, Homo sapiens
gatgggagctcctctcctgga

SEQ ID NO: 2555413 - DNA, 21 bp, Homo sapiens
gatgggcaacccccagcctgc

SEQ ID NO: 2555414 - DNA, 13 bp, Homo sapiens
gatggggaaggag

SEQ ID NO: 2555415 - DNA, 14 bp, Homo sapiens
gatggggaaggagg

SEQ ID NO: 2555416 - DNA, 23 bp, Homo sapiens
gatggggctgcaccggctggcct

SEQ ID NO: 2555417 - DNA, 22 bp, Homo sapiens
gatggggtggggtggagaactc

SEQ ID NO: 2555418 - DNA, 19 bp, Homo sapiens
gatgggtgcttggaggaag

SEQ ID NO: 2555419 - DNA, 21 bp, Homo sapiens
gatgggttctaattttggatg

SEQ ID NO: 2555420 - DNA, 14 bp, Homo sapiens
gatggtcagctccc

SEQ ID NO: 2555421 - DNA, 15 bp, Homo sapiens
gatggtcagctccct

SEQ ID NO: 2555422 - DNA, 16 bp, Homo sapiens
gatgtacagtctgtca

SEQ ID NO: 2555423 - DNA, 19 bp, Homo sapiens
gatgtacagtctgtcatga

SEQ ID NO: 2555424 - DNA, 15 bp, Homo sapiens
gatgtacatttccaa

SEQ ID NO: 2555425 - DNA, 17 bp, Homo sapiens
gatgtagaggagaaact

SEQ ID NO: 2555426 - DNA, 14 bp, Homo sapiens
gatgtagatttatt

SEQ ID NO: 2555427 - DNA, 17 bp, Homo sapiens
gatgtaggcattctgga

SEQ ID NO: 2555428 - DNA, 13 bp, Homo sapiens
gatgtcacagggc

SEQ ID NO: 2555429 - DNA, 20 bp, Homo sapiens
gatgtccacagatgcctcca

SEQ ID NO: 2555430 - DNA, 17 bp, Homo sapiens
gatgtcccaacttgtaa

SEQ ID NO: 2555431 - DNA, 17 bp, Homo sapiens
gatgtcctcaccacatg

SEQ ID NO: 2555432 - DNA, 21 bp, Homo sapiens
gatgtctgccaatttttgcct

SEQ ID NO: 2555433 - DNA, 18 bp, Homo sapiens
gatgtcttcatacctaca

SEQ ID NO: 2555434 - DNA, 22 bp, Homo sapiens
gatgtcttccttggagggggga

SEQ ID NO: 2555435 - DNA, 21 bp, Homo sapiens
gatgtcttcgtacagttcttc

SEQ ID NO: 2555436 - DNA, 15 bp, Homo sapiens
gatgtcttctgcctg

SEQ ID NO: 2555437 - DNA, 20 bp, Homo sapiens
gatgtcttctgcctgttata

SEQ ID NO: 2555438 - DNA, 14 bp, Homo sapiens
gatgtgcacccatg

SEQ ID NO: 2555439 - DNA, 20 bp, Homo sapiens
gatgtgccattttaaaaaaa

SEQ ID NO: 2555440 - DNA, 16 bp, Homo sapiens
gatgtggctgcagcag

SEQ ID NO: 2555441 - DNA, 18 bp, Homo sapiens
gatgtggctgcagcagcg

SEQ ID NO: 2555442 - DNA, 20 bp, Homo sapiens
gatgtggtgcctgaggtctg

SEQ ID NO: 2555443 - DNA, 22 bp, Homo sapiens
gatgtgtacatcccatgtaaca

SEQ ID NO: 2555444 - DNA, 21 bp, Homo sapiens
gatgtgtcctgataagctgag

SEQ ID NO: 2555445 - DNA, 14 bp, Homo sapiens
gatgtgttgtgata

SEQ ID NO: 2555446 - DNA, 20 bp, Homo sapiens
gatgttatgtaaaaggccaa

SEQ ID NO: 2555447 - DNA, 19 bp, Homo sapiens
gatgttcagattgctttga

SEQ ID NO: 2555448 - DNA, 13 bp, Homo sapiens
gatgttcagtgta

SEQ ID NO: 2555449 - DNA, 14 bp, Homo sapiens
gatgttcagtgtaa

SEQ ID NO: 2555450 - DNA, 14 bp, Homo sapiens
gatgttctggccct

SEQ ID NO: 2555451 - DNA, 14 bp, Homo sapiens
gatgttggctggga

SEQ ID NO: 2555452 - DNA, 18 bp, Homo sapiens
gatgtttgtggcctcaga

SEQ ID NO: 2555453 - DNA, 21 bp, Homo sapiens
gatgttttaaggatgcttgta

SEQ ID NO: 2555454 - DNA, 21 bp, Homo sapiens
gatgttttacgtctgggagaa

SEQ ID NO: 2555455 - DNA, 23 bp, Homo sapiens
gatgttttagccattgttggctt

SEQ ID NO: 2555456 - DNA, 15 bp, Homo sapiens
gatgttttccatgag

SEQ ID NO: 2555457 - DNA, 23 bp, Homo sapiens
gatgttttccatgagtcccctgt

SEQ ID NO: 2555458 - DNA, 18 bp, Homo sapiens
gatgtttttaaaagtttc

SEQ ID NO: 2555459 - DNA, 16 bp, Homo sapiens
gattaaacgtgcagac

SEQ ID NO: 2555460 - DNA, 15 bp, Homo sapiens
gattaaacttaatct

SEQ ID NO: 2555461 - DNA, 18 bp, Homo sapiens
gattaaccacttcagctg

SEQ ID NO: 2555462 - DNA, 19 bp, Homo sapiens
gattaaccacttcagctga

SEQ ID NO: 2555463 - DNA, 22 bp, Homo sapiens
gattaagagatgggtttgacaa

SEQ ID NO: 2555464 - DNA, 18 bp, Homo sapiens
gattaatatggggatgca

SEQ ID NO: 2555465 - DNA, 15 bp, Homo sapiens
gattaatccagaata

SEQ ID NO: 2555466 - DNA, 13 bp, Homo sapiens
gattacaagcgtg

SEQ ID NO: 2555467 - DNA, 20 bp, Homo sapiens
ctttcagataactgttattt

SEQ ID NO: 2555468 - DNA, 16 bp, Homo sapiens
ctttcagatgtcttct

SEQ ID NO: 2555469 - DNA, 21 bp, Homo sapiens
ctttcagatgtcttctgcctg

SEQ ID NO: 2555470 - DNA, 22 bp, Homo sapiens
ctttcagatgtcttctgcctgt

SEQ ID NO: 2555471 - DNA, 23 bp, Homo sapiens
ctttcagatgtcttctgcctgtt

SEQ ID NO: 2555472 - DNA, 17 bp, Homo sapiens
ctttcatcctgactctg

SEQ ID NO: 2555473 - DNA, 18 bp, Homo sapiens
ctttcatcctgactctgc

SEQ ID NO: 2555474 - DNA, 18 bp, Homo sapiens
ctttcatttactgtggct

SEQ ID NO: 2555475 - DNA, 13 bp, Homo sapiens
ctttcattttctg

SEQ ID NO: 2555476 - DNA, 14 bp, Homo sapiens
ctttcattttctgt

SEQ ID NO: 2555477 - DNA, 15 bp, Homo sapiens
ctttccaaggcttct

SEQ ID NO: 2555478 - DNA, 22 bp, Homo sapiens
ctttccacggagccactcctct

SEQ ID NO: 2555479 - DNA, 13 bp, Homo sapiens
ctttccagctcac

SEQ ID NO: 2555480 - DNA, 18 bp, Homo sapiens
ctttccattggatctcat

SEQ ID NO: 2555481 - DNA, 18 bp, Homo sapiens
ctttcccggactgcaagc

SEQ ID NO: 2555482 - DNA, 13 bp, Homo sapiens
ctttccctgcctc

SEQ ID NO: 2555483 - DNA, 19 bp, Homo sapiens
ctttccctgcttaatgaaa

SEQ ID NO: 2555484 - DNA, 15 bp, Homo sapiens
ctttcctaaatgttt

SEQ ID NO: 2555485 - DNA, 18 bp, Homo sapiens
ctttcctatcatggagtg

SEQ ID NO: 2555486 - DNA, 14 bp, Homo sapiens
ctttcctcttcccc

SEQ ID NO: 2555487 - DNA, 22 bp, Homo sapiens
ctttcctgaatccaaactaatc

SEQ ID NO: 2555488 - DNA, 13 bp, Homo sapiens
ctttcctgaggct

SEQ ID NO: 2555489 - DNA, 15 bp, Homo sapiens
ctttcctgaggctgg

SEQ ID NO: 2555490 - DNA, 22 bp, Homo sapiens
ctttcctgaggctgggctccct

SEQ ID NO: 2555491 - DNA, 19 bp, Homo sapiens
ctttcctgatggcaggatg

SEQ ID NO: 2555492 - DNA, 20 bp, Homo sapiens
ctttcctggacactcagacc

SEQ ID NO: 2555493 - DNA, 19 bp, Homo sapiens
ctttccttgttccccatca

SEQ ID NO: 2555494 - DNA, 17 bp, Homo sapiens
ctttccttttttaaaaa

SEQ ID NO: 2555495 - DNA, 20 bp, Homo sapiens
ctttcgacttgcatttttgc

SEQ ID NO: 2555496 - DNA, 15 bp, Homo sapiens
ctttcgcacagcagt

SEQ ID NO: 2555497 - DNA, 15 bp, Homo sapiens
ctttcgtacattggc

SEQ ID NO: 2555498 - DNA, 17 bp, Homo sapiens
ctttctaatgtgtgaat

SEQ ID NO: 2555499 - DNA, 14 bp, Homo sapiens
ctttctacaggcca

SEQ ID NO: 2555500 - DNA, 19 bp, Homo sapiens
ctttctacagtattatgta

SEQ ID NO: 2555501 - DNA, 16 bp, Homo sapiens
ctttctacccagcgag

SEQ ID NO: 2555502 - DNA, 16 bp, Homo sapiens
ctttctagtggtcttt

SEQ ID NO: 2555503 - DNA, 20 bp, Homo sapiens
ctttctagtggtctttgtaa

SEQ ID NO: 2555504 - DNA, 16 bp, Homo sapiens
ctttctatcctctgta

SEQ ID NO: 2555505 - DNA, 21 bp, Homo sapiens
ctttctcagccgcttctgact

SEQ ID NO: 2555506 - DNA, 13 bp, Homo sapiens
ctttctcccaggc

SEQ ID NO: 2555507 - DNA, 21 bp, Homo sapiens
ctttctccttagtcttctcat

SEQ ID NO: 2555508 - DNA, 16 bp, Homo sapiens
ctttctctactttgag

SEQ ID NO: 2555509 - DNA, 15 bp, Homo sapiens
ctttctctcctttct

SEQ ID NO: 2555510 - DNA, 15 bp, Homo sapiens
ctttctgcagaaaca

SEQ ID NO: 2555511 - DNA, 17 bp, Homo sapiens
ctttctggctatgcatt

SEQ ID NO: 2555512 - DNA, 14 bp, Homo sapiens
ctttctgggccaag

SEQ ID NO: 2555513 - DNA, 16 bp, Homo sapiens
ctttctgttgccacaa

SEQ ID NO: 2555514 - DNA, 14 bp, Homo sapiens
ctttctgttgtcat

SEQ ID NO: 2555515 - DNA, 22 bp, Homo sapiens
ctttcttacaaggaaggtggtg

SEQ ID NO: 2555516 - DNA, 12 bp, Homo sapiens
ctttcttcctct

SEQ ID NO: 2555517 - DNA, 14 bp, Homo sapiens
ctttcttcctctgc

SEQ ID NO: 2555518 - DNA, 15 bp, Homo sapiens
ctttcttcctctgct

SEQ ID NO: 2555519 - DNA, 21 bp, Homo sapiens
ctttcttgctggttgtcattt

SEQ ID NO: 2555520 - DNA, 15 bp, Homo sapiens
ctttctttacctgag

SEQ ID NO: 2555521 - DNA, 18 bp, Homo sapiens
ctttctttacctgagacc

SEQ ID NO: 2555522 - DNA, 17 bp, Homo sapiens
ctttctttctaactcca

SEQ ID NO: 2555523 - DNA, 18 bp, Homo sapiens
ctttcttttgattcttcc

SEQ ID NO: 2555524 - DNA, 14 bp, Homo sapiens
ctttctttttcttc

SEQ ID NO: 2555525 - DNA, 22 bp, Homo sapiens
ctttgaaacaagataactgaga

SEQ ID NO: 2555526 - DNA, 19 bp, Homo sapiens
ctttgaaatagtctgtgtg

SEQ ID NO: 2555527 - DNA, 15 bp, Homo sapiens
ctttgaatgacaaag

SEQ ID NO: 2555528 - DNA, 23 bp, Homo sapiens
ctttgaatgctttttgaatgtta

SEQ ID NO: 2555529 - DNA, 21 bp, Homo sapiens
ctttgacctcaacctgtgatg

SEQ ID NO: 2555530 - DNA, 15 bp, Homo sapiens
ctttgacctctgcag

SEQ ID NO: 2555531 - DNA, 18 bp, Homo sapiens
ctttgacctctgcagcaa

SEQ ID NO: 2555532 - DNA, 20 bp, Homo sapiens
ctttgacctctgcagcaata

SEQ ID NO: 2555533 - DNA, 23 bp, Homo sapiens
ctttgacctgcctcccttcatgc

SEQ ID NO: 2555534 - DNA, 17 bp, Homo sapiens
ctttgacgccatcccag

SEQ ID NO: 2555535 - DNA, 22 bp, Homo sapiens
ctttgacgccatcccagcccca

SEQ ID NO: 2555536 - DNA, 14 bp, Homo sapiens
ctttgactcacctg

SEQ ID NO: 2555537 - DNA, 16 bp, Homo sapiens
ctttgactcacctgtt

SEQ ID NO: 2555538 - DNA, 21 bp, Homo sapiens
ctttgactcttttgccattaa

SEQ ID NO: 2555539 - DNA, 17 bp, Homo sapiens
ctttgactttttgcatt

SEQ ID NO: 2555540 - DNA, 15 bp, Homo sapiens
ctttgagacagtttc

SEQ ID NO: 2555541 - DNA, 18 bp, Homo sapiens
ctttgagacagtttctta

SEQ ID NO: 2555542 - DNA, 22 bp, Homo sapiens
ctttgataatgttaaatttgta

SEQ ID NO: 2555543 - DNA, 21 bp, Homo sapiens
ctttgatgttaacacattttg

SEQ ID NO: 2555544 - DNA, 23 bp, Homo sapiens
ctttgatgttaacacattttgta

SEQ ID NO: 2555545 - DNA, 17 bp, Homo sapiens
ctttgattaatccagaa

SEQ ID NO: 2555546 - DNA, 13 bp, Homo sapiens
ctttgcactgagg

SEQ ID NO: 2555547 - DNA, 14 bp, Homo sapiens
ctttgcagacaggc

SEQ ID NO: 2555548 - DNA, 16 bp, Homo sapiens
ctttgccaccctcatg

SEQ ID NO: 2555549 - DNA, 17 bp, Homo sapiens
ctttgccagctgctgct

SEQ ID NO: 2555550 - DNA, 18 bp, Homo sapiens
ctttgccagctgctgctg

SEQ ID NO: 2555551 - DNA, 15 bp, Homo sapiens
ctttgcccagaaaga

SEQ ID NO: 2555552 - DNA, 11 bp, Homo sapiens
ctttgcctggt

SEQ ID NO: 2555553 - DNA, 14 bp, Homo sapiens
ctttgcctgttcag

SEQ ID NO: 2555554 - DNA, 13 bp, Homo sapiens
ctttgccttgggc

SEQ ID NO: 2555555 - DNA, 13 bp, Homo sapiens
ctttgctctgggt

SEQ ID NO: 2555556 - DNA, 20 bp, Homo sapiens
ctttgcttcaaatccatcca

SEQ ID NO: 2555557 - DNA, 19 bp, Homo sapiens
ctttgcttgcagtagattt

SEQ ID NO: 2555558 - DNA, 20 bp, Homo sapiens
ctttgcttgcctctctgttt

SEQ ID NO: 2555559 - DNA, 21 bp, Homo sapiens
ctttggaaaatgcattgtatc

SEQ ID NO: 2555560 - DNA, 19 bp, Homo sapiens
ctttggacagaagcagctc

SEQ ID NO: 2555561 - DNA, 18 bp, Homo sapiens
ctttggaccctgaggccc

SEQ ID NO: 2555562 - DNA, 16 bp, Homo sapiens
ctttggacctaatcca

SEQ ID NO: 2555563 - DNA, 23 bp, Homo sapiens
ctttggagatcaaggagaggagg

SEQ ID NO: 2555564 - DNA, 15 bp, Homo sapiens
gaaaggttctgcccg

SEQ ID NO: 2555565 - DNA, 14 bp, Homo sapiens
gaaaggtttacatt

SEQ ID NO: 2555566 - DNA, 17 bp, Homo sapiens
gaaagtcagatgcccag

SEQ ID NO: 2555567 - DNA, 22 bp, Homo sapiens
gaaagtcgaattaatagctttt

SEQ ID NO: 2555568 - DNA, 19 bp, Homo sapiens
gaaagtgaatttgaatgaa

SEQ ID NO: 2555569 - DNA, 12 bp, Homo sapiens
gaaagtgtaaag

SEQ ID NO: 2555570 - DNA, 22 bp, Homo sapiens
gaaagttttcagaacctcttcc

SEQ ID NO: 2555571 - DNA, 14 bp, Homo sapiens
gaaataaatagcta

SEQ ID NO: 2555572 - DNA, 21 bp, Homo sapiens
gaaataaatagctatatccat

SEQ ID NO: 2555573 - DNA, 23 bp, Homo sapiens
gaaataaatagctatatccatgt

SEQ ID NO: 2555574 - DNA, 20 bp, Homo sapiens
gaaataacaatgttaaggaa

SEQ ID NO: 2555575 - DNA, 14 bp, Homo sapiens
gaaataataaatct

SEQ ID NO: 2555576 - DNA, 17 bp, Homo sapiens
gaaataataaatctggt

SEQ ID NO: 2555577 - DNA, 13 bp, Homo sapiens
gaaataatatgca

SEQ ID NO: 2555578 - DNA, 14 bp, Homo sapiens
gaaataatatgcat

SEQ ID NO: 2555579 - DNA, 12 bp, Homo sapiens
gaaatacatatt

SEQ ID NO: 2555580 - DNA, 16 bp, Homo sapiens
gaaatactacttacca

SEQ ID NO: 2555581 - DNA, 21 bp, Homo sapiens
gaaatactacttaccatatgt

SEQ ID NO: 2555582 - DNA, 14 bp, Homo sapiens
gaaatactatttaa

SEQ ID NO: 2555583 - DNA, 23 bp, Homo sapiens
gaaatagaaaaaccctgccccca

SEQ ID NO: 2555584 - DNA, 18 bp, Homo sapiens
gaaatagacagtatattt

SEQ ID NO: 2555585 - DNA, 20 bp, Homo sapiens
gaaatagctccgtggagcag

SEQ ID NO: 2555586 - DNA, 22 bp, Homo sapiens
gaaatagtgtggaaattaagaa

SEQ ID NO: 2555587 - DNA, 13 bp, Homo sapiens
gaaatataattga

SEQ ID NO: 2555588 - DNA, 15 bp, Homo sapiens
gaaatatacacacag

SEQ ID NO: 2555589 - DNA, 14 bp, Homo sapiens
gaaatatatatgtg

SEQ ID NO: 2555590 - DNA, 23 bp, Homo sapiens
gaaatatatatgtgtgtgtatgt

SEQ ID NO: 2555591 - DNA, 21 bp, Homo sapiens
gaaatatctgaaaatgtatgt

SEQ ID NO: 2555592 - DNA, 14 bp, Homo sapiens
gaaatatctgtatt

SEQ ID NO: 2555593 - DNA, 15 bp, Homo sapiens
gaaatattccctaga

SEQ ID NO: 2555594 - DNA, 16 bp, Homo sapiens
gaaatcaaatatgcaa

SEQ ID NO: 2555595 - DNA, 18 bp, Homo sapiens
gaaatcagtaatatttat

SEQ ID NO: 2555596 - DNA, 18 bp, Homo sapiens
gaaatccctgtttaatat

SEQ ID NO: 2555597 - DNA, 19 bp, Homo sapiens
gaaatccctgtttaatatt

SEQ ID NO: 2555598 - DNA, 19 bp, Homo sapiens
gaaatctcacttttctcca

SEQ ID NO: 2555599 - DNA, 14 bp, Homo sapiens
gaaatcttttaaaa

SEQ ID NO: 2555600 - DNA, 19 bp, Homo sapiens
gaaatgaaaacatgtaata

SEQ ID NO: 2555601 - DNA, 13 bp, Homo sapiens
gaaatgaaagaaa

SEQ ID NO: 2555602 - DNA, 17 bp, Homo sapiens
gaaatgaaagcagggac

SEQ ID NO: 2555603 - DNA, 18 bp, Homo sapiens
gaaatgaaagcagggact

SEQ ID NO: 2555604 - DNA, 12 bp, Homo sapiens
gaaatgaatata

SEQ ID NO: 2555605 - DNA, 15 bp, Homo sapiens
gaaatgaattaaagt

SEQ ID NO: 2555606 - DNA, 19 bp, Homo sapiens
gaaatgactaaaaaacaaa

SEQ ID NO: 2555607 - DNA, 18 bp, Homo sapiens
gaaatgagaaggcagcca

SEQ ID NO: 2555608 - DNA, 14 bp, Homo sapiens
gaaatgctgcctgc

SEQ ID NO: 2555609 - DNA, 19 bp, Homo sapiens
gaaatgctgggctgacggt

SEQ ID NO: 2555610 - DNA, 23 bp, Homo sapiens
gaaatgctggtttttcagttttc

SEQ ID NO: 2555611 - DNA, 22 bp, Homo sapiens
gaaatgcttgtggattgagggt

SEQ ID NO: 2555612 - DNA, 17 bp, Homo sapiens
gaaatggaatactgaag

SEQ ID NO: 2555613 - DNA, 18 bp, Homo sapiens
gaaatggcttgaagccaa

SEQ ID NO: 2555614 - DNA, 19 bp, Homo sapiens
gaaatgggcagagcagaga

SEQ ID NO: 2555615 - DNA, 20 bp, Homo sapiens
gaaatgggcagagcagagac

SEQ ID NO: 2555616 - DNA, 16 bp, Homo sapiens
gaaatggtatgagctg

SEQ ID NO: 2555617 - DNA, 17 bp, Homo sapiens
gaaatgtacagcaagga

SEQ ID NO: 2555618 - DNA, 21 bp, Homo sapiens
gaaatgttattttttaattat

SEQ ID NO: 2555619 - DNA, 13 bp, Homo sapiens
gaaattaagaaga

SEQ ID NO: 2555620 - DNA, 16 bp, Homo sapiens
gaaattaagaagaaac

SEQ ID NO: 2555621 - DNA, 18 bp, Homo sapiens
gaaattactacaaaattt

SEQ ID NO: 2555622 - DNA, 13 bp, Homo sapiens
gaaattagccggg

SEQ ID NO: 2555623 - DNA, 13 bp, Homo sapiens
gaaattatttaat

SEQ ID NO: 2555624 - DNA, 19 bp, Homo sapiens
gaaatttattagttaatat

SEQ ID NO: 2555625 - DNA, 21 bp, Homo sapiens
gaaatttattagttaatatat

SEQ ID NO: 2555626 - DNA, 23 bp, Homo sapiens
gaaatttcagattcccagagcaa

SEQ ID NO: 2555627 - DNA, 15 bp, Homo sapiens
gaaatttgatttcta

SEQ ID NO: 2555628 - DNA, 17 bp, Homo sapiens
gaaatttgttataatga

SEQ ID NO: 2555629 - DNA, 22 bp, Homo sapiens
gaaattttaacctatgatattt

SEQ ID NO: 2555630 - DNA, 12 bp, Homo sapiens
gaagcagctctt

SEQ ID NO: 2555631 - DNA, 18 bp, Homo sapiens
gaagcaggctacactgac

SEQ ID NO: 2555632 - DNA, 12 bp, Homo sapiens
gaagcaggctgg

SEQ ID NO: 2555633 - DNA, 13 bp, Homo sapiens
gaagcaggctgga

SEQ ID NO: 2555634 - DNA, 22 bp, Homo sapiens
gaagcaggttgaggggctcctg

SEQ ID NO: 2555635 - DNA, 23 bp, Homo sapiens
gaagcaggttgaggggctcctgg

SEQ ID NO: 2555636 - DNA, 19 bp, Homo sapiens
gaagcagtgccttccataa

SEQ ID NO: 2555637 - DNA, 16 bp, Homo sapiens
gaagcagttgtgtcag

SEQ ID NO: 2555638 - DNA, 22 bp, Homo sapiens
gaagcatcttccagaagtgtga

SEQ ID NO: 2555639 - DNA, 14 bp, Homo sapiens
gaagcatgtttcat

SEQ ID NO: 2555640 - DNA, 17 bp, Homo sapiens
gaagcattaacttctct

SEQ ID NO: 2555641 - DNA, 18 bp, Homo sapiens
gaagcattaacttctctg

SEQ ID NO: 2555642 - DNA, 20 bp, Homo sapiens
gaagcattaacttctctgga

SEQ ID NO: 2555643 - DNA, 15 bp, Homo sapiens
gaagcattcagagag

SEQ ID NO: 2555644 - DNA, 15 bp, Homo sapiens
gaagcattccttctt

SEQ ID NO: 2555645 - DNA, 13 bp, Homo sapiens
gaagcattttata

SEQ ID NO: 2555646 - DNA, 22 bp, Homo sapiens
gaagccagctttccctgcctct

SEQ ID NO: 2555647 - DNA, 22 bp, Homo sapiens
gaagccaggagcaaatgtttct

SEQ ID NO: 2555648 - DNA, 18 bp, Homo sapiens
gaagccagtgcggcaggt

SEQ ID NO: 2555649 - DNA, 12 bp, Homo sapiens
gaagccattgtc

SEQ ID NO: 2555650 - DNA, 13 bp, Homo sapiens
gaagccattgtct

SEQ ID NO: 2555651 - DNA, 14 bp, Homo sapiens
gaagcccaataaac

SEQ ID NO: 2555652 - DNA, 18 bp, Homo sapiens
gaagcccaataaacctct

SEQ ID NO: 2555653 - DNA, 15 bp, Homo sapiens
gaagcccaggaaagg

SEQ ID NO: 2555654 - DNA, 16 bp, Homo sapiens
gaagcccaggaaaggc

SEQ ID NO: 2555655 - DNA, 21 bp, Homo sapiens
gaagcccaggaaaggctccag

SEQ ID NO: 2555656 - DNA, 23 bp, Homo sapiens
gaagcccaggccccttttcactc

SEQ ID NO: 2555657 - DNA, 17 bp, Homo sapiens
gaagccctccaaaagca

SEQ ID NO: 2555658 - DNA, 16 bp, Homo sapiens
gaagccgggaacagac

SEQ ID NO: 2555659 - DNA, 17 bp, Homo sapiens
gaagccgtgccctgccc

SEQ ID NO: 2555660 - DNA, 13 bp, Homo sapiens
gaagcctctggct

SEQ ID NO: 2555661 - DNA, 14 bp, Homo sapiens
gaagcctctggcta

SEQ ID NO: 2555662 - DNA, 13 bp, Homo sapiens
gaagcctctggga

SEQ ID NO: 2555663 - DNA, 12 bp, Homo sapiens
gaagcctgaggc

SEQ ID NO: 2555664 - DNA, 13 bp, Homo sapiens
gaagcctgaggct

SEQ ID NO: 2555665 - DNA, 14 bp, Homo sapiens
gaagccttagccag

SEQ ID NO: 2555666 - DNA, 15 bp, Homo sapiens
gaagcctttcctgta

SEQ ID NO: 2555667 - DNA, 18 bp, Homo sapiens
gaagcctttgggaagggg

SEQ ID NO: 2555668 - DNA, 18 bp, Homo sapiens
gaagcggtcgtgttgtga

SEQ ID NO: 2555669 - DNA, 14 bp, Homo sapiens
gaagctagctcccc

SEQ ID NO: 2555670 - DNA, 22 bp, Homo sapiens
gaagctcacctgttgcttacaa

SEQ ID NO: 2555671 - DNA, 14 bp, Homo sapiens
gaagctcagactgg

SEQ ID NO: 2555672 - DNA, 14 bp, Homo sapiens
gaagctcagcccac

SEQ ID NO: 2555673 - DNA, 22 bp, Homo sapiens
gaagctcagcccacccccctca

SEQ ID NO: 2555674 - DNA, 19 bp, Homo sapiens
gaagctccgctttctaccc

SEQ ID NO: 2555675 - DNA, 22 bp, Homo sapiens
gaagctgaaaacctaagtcctt

SEQ ID NO: 2555676 - DNA, 23 bp, Homo sapiens
gaagctgaagtgcatccaaaggt

SEQ ID NO: 2555677 - DNA, 19 bp, Homo sapiens
gaagctgacgaacttccat

SEQ ID NO: 2555678 - DNA, 18 bp, Homo sapiens
gaagctgaggcgggagaa

SEQ ID NO: 2555679 - DNA, 13 bp, Homo sapiens
gaagctgcctgct

SEQ ID NO: 2555680 - DNA, 13 bp, Homo sapiens
gaagctgctccgt

SEQ ID NO: 2555681 - DNA, 18 bp, Homo sapiens
gaagctgctctggaattt

SEQ ID NO: 2555682 - DNA, 23 bp, Homo sapiens
gaagctgtagtagccctttctgt

SEQ ID NO: 2555683 - DNA, 21 bp, Homo sapiens
gaagctgtcataaaaagacaa

SEQ ID NO: 2555684 - DNA, 16 bp, Homo sapiens
gaagctgttgtacatt

SEQ ID NO: 2555685 - DNA, 19 bp, Homo sapiens
gaagctgttgtacatttat

SEQ ID NO: 2555686 - DNA, 22 bp, Homo sapiens
gaagctgttgtacatttatgat

SEQ ID NO: 2555687 - DNA, 23 bp, Homo sapiens
gaagcttgtgtatccattatcat

SEQ ID NO: 2555688 - DNA, 14 bp, Homo sapiens
gaaggaaacccagc

SEQ ID NO: 2555689 - DNA, 19 bp, Homo sapiens
gaaggacattgcggacagc

SEQ ID NO: 2555690 - DNA, 16 bp, Homo sapiens
gaaggaccacatttta

SEQ ID NO: 2555691 - DNA, 20 bp, Homo sapiens
gaaggaccacattttatatt

SEQ ID NO: 2555692 - DNA, 22 bp, Homo sapiens
gaaggactgtgacaggcagcag

SEQ ID NO: 2555693 - DNA, 18 bp, Homo sapiens
gaaggagacagagctggt

SEQ ID NO: 2555694 - DNA, 13 bp, Homo sapiens
gaaggagagcctg

SEQ ID NO: 2555695 - DNA, 23 bp, Homo sapiens
gacaaggccccagagactcagag

SEQ ID NO: 2555696 - DNA, 20 bp, Homo sapiens
gacaatcagtcccctcccat

SEQ ID NO: 2555697 - DNA, 19 bp, Homo sapiens
gacaatgtgaaaagaaaaa

SEQ ID NO: 2555698 - DNA, 20 bp, Homo sapiens
gacaatgtgaaaagaaaaat

SEQ ID NO: 2555699 - DNA, 15 bp, Homo sapiens
gacaattctttatac

SEQ ID NO: 2555700 - DNA, 22 bp, Homo sapiens
gacaattctttatacaacagtg

SEQ ID NO: 2555701 - DNA, 20 bp, Homo sapiens
gacaatttcaaaaaaataaa

SEQ ID NO: 2555702 - DNA, 12 bp, Homo sapiens
gacacacacaca

SEQ ID NO: 2555703 - DNA, 13 bp, Homo sapiens
gacacacagctct

SEQ ID NO: 2555704 - DNA, 21 bp, Homo sapiens
gacacacagctctgtcctggg

SEQ ID NO: 2555705 - DNA, 15 bp, Homo sapiens
gacacacgcacacac

SEQ ID NO: 2555706 - DNA, 19 bp, Homo sapiens
gacacagcagcttcaccag

SEQ ID NO: 2555707 - DNA, 12 bp, Homo sapiens
gacacagctctt

SEQ ID NO: 2555708 - DNA, 20 bp, Homo sapiens
gacacagctcttctccaggc

SEQ ID NO: 2555709 - DNA, 20 bp, Homo sapiens
gacacaggatgaaggcaatg

SEQ ID NO: 2555710 - DNA, 19 bp, Homo sapiens
gacacaggcccggctccag

SEQ ID NO: 2555711 - DNA, 19 bp, Homo sapiens
gacacatgcaaggtcattt

SEQ ID NO: 2555712 - DNA, 15 bp, Homo sapiens
gacacatgtccaaga

SEQ ID NO: 2555713 - DNA, 23 bp, Homo sapiens
gacacatgtccaagaagcccagg

SEQ ID NO: 2555714 - DNA, 21 bp, Homo sapiens
gacacattcaaccctggagag

SEQ ID NO: 2555715 - DNA, 15 bp, Homo sapiens
gacaccagagcagat

SEQ ID NO: 2555716 - DNA, 22 bp, Homo sapiens
gacaccagagcagatgcagaga

SEQ ID NO: 2555717 - DNA, 17 bp, Homo sapiens
gacaccagccaggctct

SEQ ID NO: 2555718 - DNA, 15 bp, Homo sapiens
gacacccattttcac

SEQ ID NO: 2555719 - DNA, 13 bp, Homo sapiens
gacaccccctcgc

SEQ ID NO: 2555720 - DNA, 17 bp, Homo sapiens
gacaccccttatccagg

SEQ ID NO: 2555721 - DNA, 18 bp, Homo sapiens
gacaccccttatccagga

SEQ ID NO: 2555722 - DNA, 22 bp, Homo sapiens
gacaccctgtgatggggccctg

SEQ ID NO: 2555723 - DNA, 19 bp, Homo sapiens
gacaccgggccagtatcta

SEQ ID NO: 2555724 - DNA, 22 bp, Homo sapiens
gacaccgggccagtatctatat

SEQ ID NO: 2555725 - DNA, 20 bp, Homo sapiens
gacaccggggtggtgggaac

SEQ ID NO: 2555726 - DNA, 15 bp, Homo sapiens
gacacctgccctgcc

SEQ ID NO: 2555727 - DNA, 17 bp, Homo sapiens
gacactaaccacgctgg

SEQ ID NO: 2555728 - DNA, 21 bp, Homo sapiens
gacactaaccacgctggacct

SEQ ID NO: 2555729 - DNA, 13 bp, Homo sapiens
gacactcagacct

SEQ ID NO: 2555730 - DNA, 21 bp, Homo sapiens
gacactcccttgggctccctg

SEQ ID NO: 2555731 - DNA, 14 bp, Homo sapiens
gacactcctagaga

SEQ ID NO: 2555732 - DNA, 15 bp, Homo sapiens
gacactgatgggcaa

SEQ ID NO: 2555733 - DNA, 12 bp, Homo sapiens
gacactggcatg

SEQ ID NO: 2555734 - DNA, 14 bp, Homo sapiens
gacactggcccctc

SEQ ID NO: 2555735 - DNA, 12 bp, Homo sapiens
gacactgtacaa

SEQ ID NO: 2555736 - DNA, 17 bp, Homo sapiens
gacacttcagagagctg

SEQ ID NO: 2555737 - DNA, 23 bp, Homo sapiens
gacacttcagagagctggtagtt

SEQ ID NO: 2555738 - DNA, 17 bp, Homo sapiens
ctggatgcagcctcaca

SEQ ID NO: 2555739 - DNA, 14 bp, Homo sapiens
ctggatgcatttct

SEQ ID NO: 2555740 - DNA, 21 bp, Homo sapiens
ctggatggatttgaagcaaag

SEQ ID NO: 2555741 - DNA, 15 bp, Homo sapiens
ctggatggcaccaga

SEQ ID NO: 2555742 - DNA, 16 bp, Homo sapiens
ctggatggcaccagag

SEQ ID NO: 2555743 - DNA, 16 bp, Homo sapiens
ctggatggggctgcac

SEQ ID NO: 2555744 - DNA, 20 bp, Homo sapiens
ctggatgttttttccctgtt

SEQ ID NO: 2555745 - DNA, 13 bp, Homo sapiens
ctggattaaactt

SEQ ID NO: 2555746 - DNA, 23 bp, Homo sapiens
ctggattaaacttaatctaaatg

SEQ ID NO: 2555747 - DNA, 13 bp, Homo sapiens
ctggattcccagg

SEQ ID NO: 2555748 - DNA, 19 bp, Homo sapiens
ctggcaaacttcagactga

SEQ ID NO: 2555749 - DNA, 18 bp, Homo sapiens
ctggcaaaggtggctctc

SEQ ID NO: 2555750 - DNA, 20 bp, Homo sapiens
ctggcaatagtgtgttctga

SEQ ID NO: 2555751 - DNA, 21 bp, Homo sapiens
ctggcaatgaaaaattctcag

SEQ ID NO: 2555752 - DNA, 22 bp, Homo sapiens
ctggcaatgaaaaattctcagt

SEQ ID NO: 2555753 - DNA, 20 bp, Homo sapiens
ctggcacagttttctgagaa

SEQ ID NO: 2555754 - DNA, 16 bp, Homo sapiens
ctggcacccggcccct

SEQ ID NO: 2555755 - DNA, 18 bp, Homo sapiens
ctggcacccggcccctgc

SEQ ID NO: 2555756 - DNA, 19 bp, Homo sapiens
ctggcactgaattaatcat

SEQ ID NO: 2555757 - DNA, 20 bp, Homo sapiens
ctggcactgactgggcatag

SEQ ID NO: 2555758 - DNA, 13 bp, Homo sapiens
ctggcactgctgt

SEQ ID NO: 2555759 - DNA, 17 bp, Homo sapiens
ctggcactgcttccagt

SEQ ID NO: 2555760 - DNA, 18 bp, Homo sapiens
ctggcactgcttccagtg

SEQ ID NO: 2555761 - DNA, 21 bp, Homo sapiens
ctggcactggatgcagaaaca

SEQ ID NO: 2555762 - DNA, 15 bp, Homo sapiens
ctggcagctcagaga

SEQ ID NO: 2555763 - DNA, 16 bp, Homo sapiens
ctggcagctcagagag

SEQ ID NO: 2555764 - DNA, 15 bp, Homo sapiens
ctggcagctctccag

SEQ ID NO: 2555765 - DNA, 16 bp, Homo sapiens
ctggcattacagctgg

SEQ ID NO: 2555766 - DNA, 21 bp, Homo sapiens
ctggcattatgtccactgtgt

SEQ ID NO: 2555767 - DNA, 20 bp, Homo sapiens
ctggccaccaccccccactc

SEQ ID NO: 2555768 - DNA, 23 bp, Homo sapiens
ctgtccctcaaatgacccaaaga

SEQ ID NO: 2555769 - DNA, 21 bp, Homo sapiens
ctgtcctactctgtgtcaggt

SEQ ID NO: 2555770 - DNA, 12 bp, Homo sapiens
ctgtcctccaag

SEQ ID NO: 2555771 - DNA, 15 bp, Homo sapiens
ctgtcctccaagcca

SEQ ID NO: 2555772 - DNA, 21 bp, Homo sapiens
ctgtcctcccatcccctggac

SEQ ID NO: 2555773 - DNA, 14 bp, Homo sapiens
ctgtcctcctggtg

SEQ ID NO: 2555774 - DNA, 21 bp, Homo sapiens
ctgtcctcctggtgggtccag

SEQ ID NO: 2555775 - DNA, 17 bp, Homo sapiens
ctgtcctgatggtcagc

SEQ ID NO: 2555776 - DNA, 13 bp, Homo sapiens
ctgtcctgctggt

SEQ ID NO: 2555777 - DNA, 13 bp, Homo sapiens
ctgtcctgggagt

SEQ ID NO: 2555778 - DNA, 14 bp, Homo sapiens
ctgtcctgggagtg

SEQ ID NO: 2555779 - DNA, 21 bp, Homo sapiens
ctgtcctgggagtgagctggt

SEQ ID NO: 2555780 - DNA, 11 bp, Homo sapiens
ctgtcctgggc

SEQ ID NO: 2555781 - DNA, 18 bp, Homo sapiens
ctgtcctgggcgccctgg

SEQ ID NO: 2555782 - DNA, 21 bp, Homo sapiens
ctgtcctgggcgccctggaag

SEQ ID NO: 2555783 - DNA, 22 bp, Homo sapiens
ctgtcctgggcgccctggaagc

SEQ ID NO: 2555784 - DNA, 13 bp, Homo sapiens
ctgtcgcccagtc

SEQ ID NO: 2555785 - DNA, 19 bp, Homo sapiens
ctgtcgccttagcatgttt

SEQ ID NO: 2555786 - DNA, 13 bp, Homo sapiens
ctgtctattctag

SEQ ID NO: 2555787 - DNA, 18 bp, Homo sapiens
ctgtctcaaaaaaagaaa

SEQ ID NO: 2555788 - DNA, 22 bp, Homo sapiens
ctgtctcaaaaaaagaaaaaga

SEQ ID NO: 2555789 - DNA, 13 bp, Homo sapiens
ctgtctcagcctc

SEQ ID NO: 2555790 - DNA, 15 bp, Homo sapiens
ctgtctcagcctccc

SEQ ID NO: 2555791 - DNA, 13 bp, Homo sapiens
ctgtctcagggtg

SEQ ID NO: 2555792 - DNA, 17 bp, Homo sapiens
ctgtctcatccatcatc

SEQ ID NO: 2555793 - DNA, 21 bp, Homo sapiens
ctgtctcatccatcatcatgt

SEQ ID NO: 2555794 - DNA, 15 bp, Homo sapiens
ctgtctcatccccag

SEQ ID NO: 2555795 - DNA, 21 bp, Homo sapiens
ctgtctcatccccaggggtcc

SEQ ID NO: 2555796 - DNA, 15 bp, Homo sapiens
ctgtctccagacccc

SEQ ID NO: 2555797 - DNA, 12 bp, Homo sapiens
ctgtctcttcca

SEQ ID NO: 2555798 - DNA, 20 bp, Homo sapiens
ctgtctgacaacctcttggt

SEQ ID NO: 2555799 - DNA, 16 bp, Homo sapiens
ctgtctgatctgtgct

SEQ ID NO: 2555800 - DNA, 21 bp, Homo sapiens
ctgtctgccagccagcagcca

SEQ ID NO: 2555801 - DNA, 17 bp, Homo sapiens
ctgtctggttttaacaa

SEQ ID NO: 2555802 - DNA, 18 bp, Homo sapiens
ctgtctggttttaacaat

SEQ ID NO: 2555803 - DNA, 16 bp, Homo sapiens
ctgtctgtagagggcc

SEQ ID NO: 2555804 - DNA, 22 bp, Homo sapiens
ctgtctgtagagggccctggtg

SEQ ID NO: 2555805 - DNA, 17 bp, Homo sapiens
ctgtcttcacctgattc

SEQ ID NO: 2555806 - DNA, 15 bp, Homo sapiens
ctgtcttcccagggt

SEQ ID NO: 2555807 - DNA, 14 bp, Homo sapiens
ctgtcttcctgcat

SEQ ID NO: 2555808 - DNA, 21 bp, Homo sapiens
ctgtcttcttcagggtcctga

SEQ ID NO: 2555809 - DNA, 16 bp, Homo sapiens
ctgtctttaaggaaaa

SEQ ID NO: 2555810 - DNA, 15 bp, Homo sapiens
ctgtctttcagatac

SEQ ID NO: 2555811 - DNA, 15 bp, Homo sapiens
ctgtgaaactggcac

SEQ ID NO: 2555812 - DNA, 12 bp, Homo sapiens
ctgtgaaatagt

SEQ ID NO: 2555813 - DNA, 16 bp, Homo sapiens
ctgtgaacttggggaa

SEQ ID NO: 2555814 - DNA, 21 bp, Homo sapiens
ctgtgaagcattcgagacaga

SEQ ID NO: 2555815 - DNA, 23 bp, Homo sapiens
ctgtgaagcattcgagacagaac

SEQ ID NO: 2555816 - DNA, 16 bp, Homo sapiens
ctgtgaagtccttcac

SEQ ID NO: 2555817 - DNA, 23 bp, Homo sapiens
ctgtgaccaggaaggaagtcagc

SEQ ID NO: 2555818 - DNA, 22 bp, Homo sapiens
ctgtgacctgccccgcccagct

SEQ ID NO: 2555819 - DNA, 16 bp, Homo sapiens
ctgtgacctgtgggga

SEQ ID NO: 2555820 - DNA, 21 bp, Homo sapiens
ctgtgacttctccaggtctca

SEQ ID NO: 2555821 - DNA, 19 bp, Homo sapiens
ctgtgagacagtgggaaat

SEQ ID NO: 2555822 - DNA, 14 bp, Homo sapiens
ctgtgagaccccca

SEQ ID NO: 2555823 - DNA, 15 bp, Homo sapiens
ctgtgagacccccac

SEQ ID NO: 2555824 - DNA, 18 bp, Homo sapiens
ctgtgagacccccacacc

SEQ ID NO: 2555825 - DNA, 22 bp, Homo sapiens
ctgtgaggtgcagagtgcccag

SEQ ID NO: 2555826 - DNA, 20 bp, Homo sapiens
ctgtgagtactacagtcctc

SEQ ID NO: 2555827 - DNA, 21 bp, Homo sapiens
ctgtgagtactacagtcctcc

SEQ ID NO: 2555828 - DNA, 23 bp, Homo sapiens
ctgtgagtactacagtcctccca

SEQ ID NO: 2555829 - DNA, 17 bp, Homo sapiens
ctgtgagtttaaagcaa

SEQ ID NO: 2555830 - DNA, 17 bp, Homo sapiens
ctgtgatgatcctcata

SEQ ID NO: 2555831 - DNA, 15 bp, Homo sapiens
ctgtgatggggccct

SEQ ID NO: 2555832 - DNA, 20 bp, Homo sapiens
ctgtgatggggccctgcctc

SEQ ID NO: 2555833 - DNA, 21 bp, Homo sapiens
ctgtgcacatctgtgtcttgt

SEQ ID NO: 2555834 - DNA, 21 bp, Homo sapiens
ctgtgcagccgctgagcgagg

SEQ ID NO: 2555835 - DNA, 22 bp, Homo sapiens
ctgtgcagggaggaggtggcag

SEQ ID NO: 2555836 - DNA, 16 bp, Homo sapiens
ctgtgcatgtatgtct

SEQ ID NO: 2555837 - DNA, 15 bp, Homo sapiens
ctgtgccctcttgat

SEQ ID NO: 2555838 - DNA, 13 bp, Homo sapiens
ctgtgccctggtg

SEQ ID NO: 2555839 - DNA, 15 bp, Homo sapiens
ctgtgccctggtgga

SEQ ID NO: 2555840 - DNA, 13 bp, Homo sapiens
ctgtgcctcctca

SEQ ID NO: 2555841 - DNA, 13 bp, Homo sapiens
ctgtgcctctgcc

SEQ ID NO: 2555842 - DNA, 17 bp, Homo sapiens
ctgtgcctctgggactg

SEQ ID NO: 2555843 - DNA, 16 bp, Homo sapiens
ctgtgctactttgcct

SEQ ID NO: 2555844 - DNA, 18 bp, Homo sapiens
ctgtgctactttgccttt

SEQ ID NO: 2555845 - DNA, 13 bp, Homo sapiens
ctgtgctatgaat

SEQ ID NO: 2555846 - DNA, 17 bp, Homo sapiens
ctgtgctccgtgcctcc

SEQ ID NO: 2555847 - DNA, 18 bp, Homo sapiens
ctgtgctccgtgcctcca

SEQ ID NO: 2555848 - DNA, 20 bp, Homo sapiens
ctgtgctccgtgcctccacc

SEQ ID NO: 2555849 - DNA, 21 bp, Homo sapiens
ctgtgctccgtgcctccacca

SEQ ID NO: 2555850 - DNA, 15 bp, Homo sapiens
ctgtgctctggacag

SEQ ID NO: 2555851 - DNA, 19 bp, Homo sapiens
ctgtgctctggacaggcat

SEQ ID NO: 2555852 - DNA, 13 bp, Homo sapiens
ctgtgctgaccct

SEQ ID NO: 2555853 - DNA, 22 bp, Homo sapiens
ctgtgctgcccgtcttcagcct

SEQ ID NO: 2555854 - DNA, 22 bp, Homo sapiens
ctgtgctgccctgcccacctgg

SEQ ID NO: 2555855 - DNA, 16 bp, Homo sapiens
ctgtgctggagccact

SEQ ID NO: 2555856 - DNA, 12 bp, Homo sapiens
ctgtgctggtgt

SEQ ID NO: 2555857 - DNA, 21 bp, Homo sapiens
ctgtgctggtgtcctgaccac

SEQ ID NO: 2555858 - DNA, 18 bp, Homo sapiens
ctgtgctgtgcccaagtt

SEQ ID NO: 2555859 - DNA, 18 bp, Homo sapiens
ctgtgcttcaattaataa

SEQ ID NO: 2555860 - DNA, 16 bp, Homo sapiens
ctgtgctttccagctc

SEQ ID NO: 2555861 - DNA, 20 bp, Homo sapiens
ctgtgctttccagctcaccc

SEQ ID NO: 2555862 - DNA, 19 bp, Homo sapiens
ctgtgctttccctgaactg

SEQ ID NO: 2555863 - DNA, 18 bp, Homo sapiens
ctgtgctttgactcacct

SEQ ID NO: 2555864 - DNA, 18 bp, Homo sapiens
ctgtggaaaaatatttaa

SEQ ID NO: 2555865 - DNA, 14 bp, Homo sapiens
ctgtggaaagtgta

SEQ ID NO: 2555866 - DNA, 14 bp, Homo sapiens
ctgtggaagggact

SEQ ID NO: 2555867 - DNA, 22 bp, Homo sapiens
ctgtggagcccgcacccccacc

SEQ ID NO: 2555868 - DNA, 21 bp, Homo sapiens
ctgtggaggaaggattgtaaa

SEQ ID NO: 2555869 - DNA, 13 bp, Homo sapiens
ctgtggcaggcag

SEQ ID NO: 2555870 - DNA, 14 bp, Homo sapiens
ctgtggcaggcagc

SEQ ID NO: 2555871 - DNA, 13 bp, Homo sapiens
ctgtggccaaagg

SEQ ID NO: 2555872 - DNA, 22 bp, Homo sapiens
ctgtggccagcttgttatttat

SEQ ID NO: 2555873 - DNA, 20 bp, Homo sapiens
ctgtggcctgtgtcccatga

SEQ ID NO: 2555874 - DNA, 15 bp, Homo sapiens
ctgtgggaaggccag

SEQ ID NO: 2555875 - DNA, 20 bp, Homo sapiens
ctgtgggaaggccagctgcc

SEQ ID NO: 2555876 - DNA, 22 bp, Homo sapiens
ctgtgggatccctctgggcact

SEQ ID NO: 2555877 - DNA, 20 bp, Homo sapiens
ctgtgggcctcaaggacttg

SEQ ID NO: 2555878 - DNA, 17 bp, Homo sapiens
ctgtggggatctcaggg

SEQ ID NO: 2555879 - DNA, 21 bp, Homo sapiens
ctgtggggatctcaggggctg

SEQ ID NO: 2555880 - DNA, 21 bp, Homo sapiens
ctgtggggatttctcccagct

SEQ ID NO: 2555881 - DNA, 19 bp, Homo sapiens
ctgtggggccttggttccc

SEQ ID NO: 2555882 - DNA, 21 bp, Homo sapiens
ctgtggggctggtagctcagg

SEQ ID NO: 2555883 - DNA, 22 bp, Homo sapiens
ctgtgggtgaagacagagggaa

SEQ ID NO: 2555884 - DNA, 12 bp, Homo sapiens
ctgtgtaaagtt

SEQ ID NO: 2555885 - DNA, 14 bp, Homo sapiens
ctgtgtaaagttag

SEQ ID NO: 2555886 - DNA, 19 bp, Homo sapiens
ctgtgtaatcatttcttgg

SEQ ID NO: 2555887 - DNA, 17 bp, Homo sapiens
ctgtgtacataactgaa

SEQ ID NO: 2555888 - DNA, 22 bp, Homo sapiens
ctgtgtacataactgaaaatgt

SEQ ID NO: 2555889 - DNA, 16 bp, Homo sapiens
ctgtgtattcattgaa

SEQ ID NO: 2555890 - DNA, 14 bp, Homo sapiens
ctgtgtcactacgt

SEQ ID NO: 2555891 - DNA, 17 bp, Homo sapiens
ctgtgtcagcatagaag

SEQ ID NO: 2555892 - DNA, 20 bp, Homo sapiens
ctgtgtcagcatagaagtaa

SEQ ID NO: 2555893 - DNA, 19 bp, Homo sapiens
ctgtgtcaggtggggcagc

SEQ ID NO: 2555894 - DNA, 17 bp, Homo sapiens
ctgtgtcccatgaccca

SEQ ID NO: 2555895 - DNA, 20 bp, Homo sapiens
ctgtgtcccatgacccaccc

SEQ ID NO: 2555896 - DNA, 23 bp, Homo sapiens
ctgtgtcccatgacccacccctg

SEQ ID NO: 2555897 - DNA, 14 bp, Homo sapiens
ctgtgtcttgcaat

SEQ ID NO: 2555898 - DNA, 19 bp, Homo sapiens
ctgtgtcttgcaatggcag

SEQ ID NO: 2555899 - DNA, 20 bp, Homo sapiens
ctgtgtctttcacagctcct

SEQ ID NO: 2555900 - DNA, 20 bp, Homo sapiens
ctgtgtcttttttcactaca

SEQ ID NO: 2555901 - DNA, 21 bp, Homo sapiens
ctgtgtgcaccttaccaactt

SEQ ID NO: 2555902 - DNA, 23 bp, Homo sapiens
ctgtgtgctcctccttggtgcct

SEQ ID NO: 2555903 - DNA, 21 bp, Homo sapiens
ctgtgtggtttggtgtgttcc

SEQ ID NO: 2555904 - DNA, 18 bp, Homo sapiens
ctgtgtgtgcgcctacag

SEQ ID NO: 2555905 - DNA, 15 bp, Homo sapiens
ctgtgtgtgtgtatg

SEQ ID NO: 2555906 - DNA, 20 bp, Homo sapiens
ctgtgtgtgtgtatgtgggg

SEQ ID NO: 2555907 - DNA, 18 bp, Homo sapiens
ctgtgtgtttatgtgtgt

SEQ ID NO: 2555908 - DNA, 16 bp, Homo sapiens
ctgtgtgttttcataa

SEQ ID NO: 2555909 - DNA, 20 bp, Homo sapiens
ctgtgttctggtgaggcctt

SEQ ID NO: 2555910 - DNA, 21 bp, Homo sapiens
cttacatgttttctttgcttt

SEQ ID NO: 2555911 - DNA, 22 bp, Homo sapiens
cttacatttttacaataaataa

SEQ ID NO: 2555912 - DNA, 21 bp, Homo sapiens
cttaccagataatgctacttt

SEQ ID NO: 2555913 - DNA, 15 bp, Homo sapiens
cttaccatatgtgct

SEQ ID NO: 2555914 - DNA, 20 bp, Homo sapiens
cttaccccttagcctccctg

SEQ ID NO: 2555915 - DNA, 15 bp, Homo sapiens
cttacccttagggag

SEQ ID NO: 2555916 - DNA, 20 bp, Homo sapiens
cttaccgtgagcgacaaaga

SEQ ID NO: 2555917 - DNA, 18 bp, Homo sapiens
cttacctaaacagatata

SEQ ID NO: 2555918 - DNA, 19 bp, Homo sapiens
cttacctaaacagatataa

SEQ ID NO: 2555919 - DNA, 21 bp, Homo sapiens
cttacctcggtgccttcctct

SEQ ID NO: 2555920 - DNA, 19 bp, Homo sapiens
cttacctgggcattcttgt

SEQ ID NO: 2555921 - DNA, 15 bp, Homo sapiens
cttaccttcaataaa

SEQ ID NO: 2555922 - DNA, 13 bp, Homo sapiens
cttacctttttat

SEQ ID NO: 2555923 - DNA, 19 bp, Homo sapiens
cttacctttttatttgcat

SEQ ID NO: 2555924 - DNA, 19 bp, Homo sapiens
cttacgcccaacccttccc

SEQ ID NO: 2555925 - DNA, 19 bp, Homo sapiens
cttactagtttcccttgca

SEQ ID NO: 2555926 - DNA, 19 bp, Homo sapiens
cttactcttcttgaaattt

SEQ ID NO: 2555927 - DNA, 21 bp, Homo sapiens
cttactgatatattttacaat

SEQ ID NO: 2555928 - DNA, 12 bp, Homo sapiens
cttactgcaaat

SEQ ID NO: 2555929 - DNA, 18 bp, Homo sapiens
cttactgtacctgttcct

SEQ ID NO: 2555930 - DNA, 23 bp, Homo sapiens
cttactgtacctgttccttagac

SEQ ID NO: 2555931 - DNA, 13 bp, Homo sapiens
cttactgtttctg

SEQ ID NO: 2555932 - DNA, 14 bp, Homo sapiens
cttactgtttctgt

SEQ ID NO: 2555933 - DNA, 19 bp, Homo sapiens
cttactgtttctgtcagga

SEQ ID NO: 2555934 - DNA, 14 bp, Homo sapiens
cttacttaccctca

SEQ ID NO: 2555935 - DNA, 14 bp, Homo sapiens
cttacttagtgtta

SEQ ID NO: 2555936 - DNA, 15 bp, Homo sapiens
cttagaagtcacaca

SEQ ID NO: 2555937 - DNA, 17 bp, Homo sapiens
cttagaagtcacacagt

SEQ ID NO: 2555938 - DNA, 14 bp, Homo sapiens
cttagacagtccct

SEQ ID NO: 2555939 - DNA, 18 bp, Homo sapiens
cttagacagtccctgcca

SEQ ID NO: 2555940 - DNA, 19 bp, Homo sapiens
cttagacagtccctgccaa

SEQ ID NO: 2555941 - DNA, 13 bp, Homo sapiens
cttagacctcagc

SEQ ID NO: 2555942 - DNA, 15 bp, Homo sapiens
cttagacctcagcct

SEQ ID NO: 2555943 - DNA, 20 bp, Homo sapiens
cttagacctcagcctgtgct

SEQ ID NO: 2555944 - DNA, 18 bp, Homo sapiens
cttagaccttccataatg

SEQ ID NO: 2555945 - DNA, 19 bp, Homo sapiens
cttagacttcgactcagga

SEQ ID NO: 2555946 - DNA, 20 bp, Homo sapiens
cttagacttcgactcaggat

SEQ ID NO: 2555947 - DNA, 14 bp, Homo sapiens
cttagacttctgct

SEQ ID NO: 2555948 - DNA, 17 bp, Homo sapiens
cttagacttgaaatact

SEQ ID NO: 2555949 - DNA, 20 bp, Homo sapiens
cttagagaatgttctcctaa

SEQ ID NO: 2555950 - DNA, 22 bp, Homo sapiens
cttagagcagtttctgtcctgc

SEQ ID NO: 2555951 - DNA, 14 bp, Homo sapiens
cttagatgttctaa

SEQ ID NO: 2555952 - DNA, 16 bp, Homo sapiens
cttagattagctctgg

SEQ ID NO: 2555953 - DNA, 18 bp, Homo sapiens
cttagattagctctggac

SEQ ID NO: 2555954 - DNA, 21 bp, Homo sapiens
cttagattagctctggaccag

SEQ ID NO: 2555955 - DNA, 18 bp, Homo sapiens
cttagcatgtgttgaaaa

SEQ ID NO: 2555956 - DNA, 18 bp, Homo sapiens
cttagcccccacccactt

SEQ ID NO: 2555957 - DNA, 11 bp, Homo sapiens
cttagcctccc

SEQ ID NO: 2555958 - DNA, 17 bp, Homo sapiens
cttagcctcctgacctg

SEQ ID NO: 2555959 - DNA, 22 bp, Homo sapiens
cttagctcattctccttgtgtt

SEQ ID NO: 2555960 - DNA, 11 bp, Homo sapiens
cttagctgagt

SEQ ID NO: 2555961 - DNA, 16 bp, Homo sapiens
cttagcttagacctca

SEQ ID NO: 2555962 - DNA, 18 bp, Homo sapiens
cttagcttagacctcagc

SEQ ID NO: 2555963 - DNA, 20 bp, Homo sapiens
cttagcttagacctcagcct

SEQ ID NO: 2555964 - DNA, 21 bp, Homo sapiens
cttagcttagacctcagcctg

SEQ ID NO: 2555965 - DNA, 23 bp, Homo sapiens
cttagcttctattatagccacat

SEQ ID NO: 2555966 - DNA, 18 bp, Homo sapiens
cttagctttgctctgcca

SEQ ID NO: 2555967 - DNA, 15 bp, Homo sapiens
cttaggaagaatttt

SEQ ID NO: 2555968 - DNA, 20 bp, Homo sapiens
cttaggacagggtccctgct

SEQ ID NO: 2555969 - DNA, 22 bp, Homo sapiens
cttaggatgtgtgcatgtgtgt

SEQ ID NO: 2555970 - DNA, 15 bp, Homo sapiens
cttaggccagcacca

SEQ ID NO: 2555971 - DNA, 21 bp, Homo sapiens
cttaggtggcaagctgtgact

SEQ ID NO: 2555972 - DNA, 21 bp, Homo sapiens
cttaggttggcaaaaaggcag

SEQ ID NO: 2555973 - DNA, 21 bp, Homo sapiens
cttagtaatgctacgtgtgat

SEQ ID NO: 2555974 - DNA, 19 bp, Homo sapiens
cttagtcactgagacagcc

SEQ ID NO: 2555975 - DNA, 21 bp, Homo sapiens
cttagtcactgagacagcccg

SEQ ID NO: 2555976 - DNA, 20 bp, Homo sapiens
cttagtcttctcatagcatt

SEQ ID NO: 2555977 - DNA, 21 bp, Homo sapiens
cttagtcttctcatagcatta

SEQ ID NO: 2555978 - DNA, 22 bp, Homo sapiens
cttagtgcggacaagttttaat

SEQ ID NO: 2555979 - DNA, 19 bp, Homo sapiens
cttagtgtttctgtgcatg

SEQ ID NO: 2555980 - DNA, 16 bp, Homo sapiens
cttagttatcagcttt

SEQ ID NO: 2555981 - DNA, 22 bp, Homo sapiens
cttagtttggattcttatgtag

SEQ ID NO: 2555982 - DNA, 17 bp, Homo sapiens
cttataaatatgaagct

SEQ ID NO: 2555983 - DNA, 15 bp, Homo sapiens
cttatacatttgata

SEQ ID NO: 2555984 - DNA, 13 bp, Homo sapiens
cttatagaatatt

SEQ ID NO: 2555985 - DNA, 16 bp, Homo sapiens
cttatagaatatttat

SEQ ID NO: 2555986 - DNA, 20 bp, Homo sapiens
cttatatagtttactatttt

SEQ ID NO: 2555987 - DNA, 14 bp, Homo sapiens
cttatatatgtgaa

SEQ ID NO: 2555988 - DNA, 17 bp, Homo sapiens
cttatcaccagctgcct

SEQ ID NO: 2555989 - DNA, 20 bp, Homo sapiens
cttatcatgctgtctttaca

SEQ ID NO: 2555990 - DNA, 12 bp, Homo sapiens
cttatccaggac

SEQ ID NO: 2555991 - DNA, 15 bp, Homo sapiens
cttatccaggactct

SEQ ID NO: 2555992 - DNA, 13 bp, Homo sapiens
cttatcctctgat

SEQ ID NO: 2555993 - DNA, 18 bp, Homo sapiens
cttatcctctgatctcca

SEQ ID NO: 2555994 - DNA, 21 bp, Homo sapiens
cttatctcagtcatgcataaa

SEQ ID NO: 2555995 - DNA, 21 bp, Homo sapiens
cttatctctctgtgctgtgga

SEQ ID NO: 2555996 - DNA, 22 bp, Homo sapiens
cttatgacatcacttgtacaaa

SEQ ID NO: 2555997 - DNA, 22 bp, Homo sapiens
cttatgccacgggaagtttaga

SEQ ID NO: 2555998 - DNA, 22 bp, Homo sapiens
cttatgggctgggttctaccca

SEQ ID NO: 2555999 - DNA, 13 bp, Homo sapiens
cttattaaagttc

SEQ ID NO: 2556000 - DNA, 18 bp, Homo sapiens
cttattaaagttctgtaa

SEQ ID NO: 2556001 - DNA, 11 bp, Homo sapiens
cttattagaac

SEQ ID NO: 2556002 - DNA, 17 bp, Homo sapiens
cttattagagtgtcttt

SEQ ID NO: 2556003 - DNA, 20 bp, Homo sapiens
cttattagagtgtctttcca

SEQ ID NO: 2556004 - DNA, 12 bp, Homo sapiens
cttattctgtag

SEQ ID NO: 2556005 - DNA, 12 bp, Homo sapiens
cttattgcaaaa

SEQ ID NO: 2556006 - DNA, 15 bp, Homo sapiens
cttattggaactctg

SEQ ID NO: 2556007 - DNA, 18 bp, Homo sapiens
cttattggaactctgctt

SEQ ID NO: 2556008 - DNA, 18 bp, Homo sapiens
cttattggcagctctact

SEQ ID NO: 2556009 - DNA, 15 bp, Homo sapiens
cttattgttccaaga

SEQ ID NO: 2556010 - DNA, 19 bp, Homo sapiens
cttattgttccaagacatt

SEQ ID NO: 2556011 - DNA, 21 bp, Homo sapiens
cttattgttccaagacattgt

SEQ ID NO: 2556012 - DNA, 22 bp, Homo sapiens
cttattgttccaagacattgtc

SEQ ID NO: 2556013 - DNA, 14 bp, Homo sapiens
cttatttcatttct

SEQ ID NO: 2556014 - DNA, 23 bp, Homo sapiens
cttattttaaaattttatctctt

SEQ ID NO: 2556015 - DNA, 16 bp, Homo sapiens
cttattttcatgtata

SEQ ID NO: 2556016 - DNA, 17 bp, Homo sapiens
cttatttttttctgatt

SEQ ID NO: 2556017 - DNA, 19 bp, Homo sapiens
cttatttttttctgattgt

SEQ ID NO: 2556018 - DNA, 20 bp, Homo sapiens
cttatttttttctgattgta

SEQ ID NO: 2556019 - DNA, 17 bp, Homo sapiens
cttcaaaagtattttcc

SEQ ID NO: 2556020 - DNA, 22 bp, Homo sapiens
cttcaaacagaactgcagtcag

SEQ ID NO: 2556021 - DNA, 16 bp, Homo sapiens
cttcaaagcttgaaga

SEQ ID NO: 2556022 - DNA, 18 bp, Homo sapiens
cttcaaagcttgaagatc

SEQ ID NO: 2556023 - DNA, 24 bp, Homo sapiens
cttcaacagaccccctctagaaat

SEQ ID NO: 2556024 - DNA, 16 bp, Homo sapiens
cttcaacatcaatgtt

SEQ ID NO: 2556025 - DNA, 22 bp, Homo sapiens
cttcaacatcaatgttcattgt

SEQ ID NO: 2556026 - DNA, 15 bp, Homo sapiens
cttcaacatttacat

SEQ ID NO: 2556027 - DNA, 17 bp, Homo sapiens
cttcaactgaccagcct

SEQ ID NO: 2556028 - DNA, 17 bp, Homo sapiens
cttcaagaccttcacca

SEQ ID NO: 2556029 - DNA, 20 bp, Homo sapiens
cttcaagttagctcaggagg

SEQ ID NO: 2556030 - DNA, 14 bp, Homo sapiens
cttcaataaagtat

SEQ ID NO: 2556031 - DNA, 13 bp, Homo sapiens
cttcacagtgttt

SEQ ID NO: 2556032 - DNA, 20 bp, Homo sapiens
cttcacatcctgtgtttcta

SEQ ID NO: 2556033 - DNA, 15 bp, Homo sapiens
cttcaccccccactc

SEQ ID NO: 2556034 - DNA, 21 bp, Homo sapiens
cttcaccctgaatggttccat

SEQ ID NO: 2556035 - DNA, 21 bp, Homo sapiens
cttcacctttgtccccaccgc

SEQ ID NO: 2556036 - DNA, 19 bp, Homo sapiens
cttcacggaagagccttgc

SEQ ID NO: 2556037 - DNA, 16 bp, Homo sapiens
cttcacggcaggacaa

SEQ ID NO: 2556038 - DNA, 20 bp, Homo sapiens
cttcactccagcctgggtga

SEQ ID NO: 2556039 - DNA, 23 bp, Homo sapiens
cttcactccggtgtgcctgcagc

SEQ ID NO: 2556040 - DNA, 24 bp, Homo sapiens
cttcactccggtgtgcctgcagcc

SEQ ID NO: 2556041 - DNA, 17 bp, Homo sapiens
cttcactcgcccccggg

SEQ ID NO: 2556042 - DNA, 14 bp, Homo sapiens
cttcactgcctttg

SEQ ID NO: 2556043 - DNA, 17 bp, Homo sapiens
cttcactgtataaatag

SEQ ID NO: 2556044 - DNA, 18 bp, Homo sapiens
cttcactgtcctccaagc

SEQ ID NO: 2556045 - DNA, 21 bp, Homo sapiens
cttcactgtcctccaagccag

SEQ ID NO: 2556046 - DNA, 16 bp, Homo sapiens
cttcactgttgaaaat

SEQ ID NO: 2556047 - DNA, 18 bp, Homo sapiens
cttcactgttgaaaatta

SEQ ID NO: 2556048 - DNA, 17 bp, Homo sapiens
cttcacttctgaccaca

SEQ ID NO: 2556049 - DNA, 14 bp, Homo sapiens
cttcagactttgct

SEQ ID NO: 2556050 - DNA, 16 bp, Homo sapiens
cttcagagactcctgc

SEQ ID NO: 2556051 - DNA, 18 bp, Homo sapiens
cttcagatggaaactctt

SEQ ID NO: 2556052 - DNA, 21 bp, Homo sapiens
cttcagcagtacctataaagt

SEQ ID NO: 2556053 - DNA, 18 bp, Homo sapiens
cttctactgagccttcag

SEQ ID NO: 2556054 - DNA, 20 bp, Homo sapiens
cttctaggtggcaaggctgt

SEQ ID NO: 2556055 - DNA, 16 bp, Homo sapiens
cttctaggttctaaaa

SEQ ID NO: 2556056 - DNA, 15 bp, Homo sapiens
cttctattttgtaaa

SEQ ID NO: 2556057 - DNA, 16 bp, Homo sapiens
cttctattttgtaaac

SEQ ID NO: 2556058 - DNA, 16 bp, Homo sapiens
cttctcaagtgcctta

SEQ ID NO: 2556059 - DNA, 18 bp, Homo sapiens
cttctcaagtgccttaat

SEQ ID NO: 2556060 - DNA, 22 bp, Homo sapiens
cttctcaggcatgaacatgtac

SEQ ID NO: 2556061 - DNA, 20 bp, Homo sapiens
cttctcaggctctgccctgc

SEQ ID NO: 2556062 - DNA, 16 bp, Homo sapiens
cttctcatacgtccac

SEQ ID NO: 2556063 - DNA, 13 bp, Homo sapiens
cttctcatagcat

SEQ ID NO: 2556064 - DNA, 21 bp, Homo sapiens
cttctcattccaacagtgagt

SEQ ID NO: 2556065 - DNA, 17 bp, Homo sapiens
cttctccagacaaacca

SEQ ID NO: 2556066 - DNA, 14 bp, Homo sapiens
cttctccaggctgt

SEQ ID NO: 2556067 - DNA, 19 bp, Homo sapiens
cttctccagggtccacagg

SEQ ID NO: 2556068 - DNA, 14 bp, Homo sapiens
cttctccatccaca

SEQ ID NO: 2556069 - DNA, 14 bp, Homo sapiens
cttctcccacactg

SEQ ID NO: 2556070 - DNA, 13 bp, Homo sapiens
cttctcccatgag

SEQ ID NO: 2556071 - DNA, 18 bp, Homo sapiens
cttctcctccccacccgc

SEQ ID NO: 2556072 - DNA, 22 bp, Homo sapiens
cttctccttcacctttgtcccc

SEQ ID NO: 2556073 - DNA, 20 bp, Homo sapiens
cttctctaaatgaggggcct

SEQ ID NO: 2556074 - DNA, 15 bp, Homo sapiens
cttctctagctggtg

SEQ ID NO: 2556075 - DNA, 12 bp, Homo sapiens
cttctctccagc

SEQ ID NO: 2556076 - DNA, 12 bp, Homo sapiens
cttctctgctcc

SEQ ID NO: 2556077 - DNA, 13 bp, Homo sapiens
cttctctgctcca

SEQ ID NO: 2556078 - DNA, 21 bp, Homo sapiens
cttctctgctccaccacatcc

SEQ ID NO: 2556079 - DNA, 22 bp, Homo sapiens
cttctctgctccaccacatcct

SEQ ID NO: 2556080 - DNA, 19 bp, Homo sapiens
cttctctggaaagggggga

SEQ ID NO: 2556081 - DNA, 12 bp, Homo sapiens
cttctcttaatt

SEQ ID NO: 2556082 - DNA, 15 bp, Homo sapiens
cttctcttaatttaa

SEQ ID NO: 2556083 - DNA, 22 bp, Homo sapiens
cttctcttccttttatcagtag

SEQ ID NO: 2556084 - DNA, 17 bp, Homo sapiens
cttctgaactcaaactg

SEQ ID NO: 2556085 - DNA, 15 bp, Homo sapiens
cttctgaatgctgct

SEQ ID NO: 2556086 - DNA, 19 bp, Homo sapiens
cttctgaatgctgctactt

SEQ ID NO: 2556087 - DNA, 15 bp, Homo sapiens
cttctgacccatgct

SEQ ID NO: 2556088 - DNA, 19 bp, Homo sapiens
cttctgacgtgccttttgc

SEQ ID NO: 2556089 - DNA, 21 bp, Homo sapiens
cttctgactgctgattctccc

SEQ ID NO: 2556090 - DNA, 16 bp, Homo sapiens
cttctgagctatttca

SEQ ID NO: 2556091 - DNA, 17 bp, Homo sapiens
cttctgagctatttcat

SEQ ID NO: 2556092 - DNA, 20 bp, Homo sapiens
cttctgcaccctccaccctg

SEQ ID NO: 2556093 - DNA, 21 bp, Homo sapiens
cttctgcaccctccaccctgt

SEQ ID NO: 2556094 - DNA, 15 bp, Homo sapiens
cttctgccatattct

SEQ ID NO: 2556095 - DNA, 21 bp, Homo sapiens
cttctgccatattctgttggc

SEQ ID NO: 2556096 - DNA, 23 bp, Homo sapiens
cttctgcccaattggaggaaagc

SEQ ID NO: 2556097 - DNA, 15 bp, Homo sapiens
cttctgcccttgcca

SEQ ID NO: 2556098 - DNA, 18 bp, Homo sapiens
cttctgccttagtctcag

SEQ ID NO: 2556099 - DNA, 19 bp, Homo sapiens
cttctgccttagtctcagt

SEQ ID NO: 2556100 - DNA, 17 bp, Homo sapiens
cttctgctccacccttg

SEQ ID NO: 2556101 - DNA, 19 bp, Homo sapiens
cttctgctggataaaatga

SEQ ID NO: 2556102 - DNA, 17 bp, Homo sapiens
cttctgcttcagcctcc

SEQ ID NO: 2556103 - DNA, 15 bp, Homo sapiens
cttctggcctcccac

SEQ ID NO: 2556104 - DNA, 15 bp, Homo sapiens
cttctgggagggcag

SEQ ID NO: 2556105 - DNA, 19 bp, Homo sapiens
cttctgggagggcagcagg

SEQ ID NO: 2556106 - DNA, 15 bp, Homo sapiens
cttctgtacgtctga

SEQ ID NO: 2556107 - DNA, 11 bp, Homo sapiens
cttctgtagtt

SEQ ID NO: 2556108 - DNA, 14 bp, Homo sapiens
cttctgtagtttta

SEQ ID NO: 2556109 - DNA, 21 bp, Homo sapiens
cttctgtagttttatcacatg

SEQ ID NO: 2556110 - DNA, 17 bp, Homo sapiens
cttctgtcctactctgt

SEQ ID NO: 2556111 - DNA, 20 bp, Homo sapiens
cttctgtgagacccccacac

SEQ ID NO: 2556112 - DNA, 21 bp, Homo sapiens
cttctgtgagacccccacacc

SEQ ID NO: 2556113 - DNA, 14 bp, Homo sapiens
cttcttaaagtatt

SEQ ID NO: 2556114 - DNA, 20 bp, Homo sapiens
cttcttaatcttttcacaaa

SEQ ID NO: 2556115 - DNA, 21 bp, Homo sapiens
cttcttaatcttttcacaaat

SEQ ID NO: 2556116 - DNA, 18 bp, Homo sapiens
cttcttcacccagctaat

SEQ ID NO: 2556117 - DNA, 20 bp, Homo sapiens
cttcttcagagactcctgca

SEQ ID NO: 2556118 - DNA, 21 bp, Homo sapiens
cttcttcagagactcctgcag

SEQ ID NO: 2556119 - DNA, 13 bp, Homo sapiens
cttcttcttcaga

SEQ ID NO: 2556120 - DNA, 19 bp, Homo sapiens
cttcttgaacactcatgct

SEQ ID NO: 2556121 - DNA, 20 bp, Homo sapiens
cttcttgaacactcatgctg

SEQ ID NO: 2556122 - DNA, 22 bp, Homo sapiens
cttcttgaacactcatgctgaa

SEQ ID NO: 2556123 - DNA, 16 bp, Homo sapiens
cttcttggtcttattt

SEQ ID NO: 2556124 - DNA, 23 bp, Homo sapiens
cttcttggtgcttacacatctca

SEQ ID NO: 2556125 - DNA, 14 bp, Homo sapiens
cttctttatactgt

SEQ ID NO: 2556126 - DNA, 11 bp, Homo sapiens
cttctttcctc

SEQ ID NO: 2556127 - DNA, 15 bp, Homo sapiens
cttctttcctcttcc

SEQ ID NO: 2556128 - DNA, 16 bp, Homo sapiens
cttcttttcacattct

SEQ ID NO: 2556129 - DNA, 15 bp, Homo sapiens
cttctttttattttc

SEQ ID NO: 2556130 - DNA, 20 bp, Homo sapiens
cttctttttattttcttttg

SEQ ID NO: 2556131 - DNA, 14 bp, Homo sapiens
cttctttttgctgt

SEQ ID NO: 2556132 - DNA, 15 bp, Homo sapiens
cttctttttgctgtt

SEQ ID NO: 2556133 - DNA, 15 bp, Homo sapiens
cttgaaaagggtgtt

SEQ ID NO: 2556134 - DNA, 20 bp, Homo sapiens
cttgaaagcatccatgtgtg

SEQ ID NO: 2556135 - DNA, 19 bp, Homo sapiens
cttgaaattttaaactata

SEQ ID NO: 2556136 - DNA, 14 bp, Homo sapiens
cttgaaccacttcc

SEQ ID NO: 2556137 - DNA, 15 bp, Homo sapiens
cttgaacccaggaga

SEQ ID NO: 2556138 - DNA, 14 bp, Homo sapiens
cttgaacccgggag

SEQ ID NO: 2556139 - DNA, 19 bp, Homo sapiens
cttgaacccgggaggcaga

SEQ ID NO: 2556140 - DNA, 18 bp, Homo sapiens
cttgaactcctggcctca

SEQ ID NO: 2556141 - DNA, 19 bp, Homo sapiens
cttgaactcctggcctcaa

SEQ ID NO: 2556142 - DNA, 17 bp, Homo sapiens
cttgaactttgacctct

SEQ ID NO: 2556143 - DNA, 13 bp, Homo sapiens
cttgaagccaagt

SEQ ID NO: 2556144 - DNA, 16 bp, Homo sapiens
cttgaagccactgaag

SEQ ID NO: 2556145 - DNA, 19 bp, Homo sapiens
cttgaagccactgaagctg

SEQ ID NO: 2556146 - DNA, 23 bp, Homo sapiens
cttgaaggatctgtttttaaaaa

SEQ ID NO: 2556147 - DNA, 20 bp, Homo sapiens
cttgaattgtaactgttctt

SEQ ID NO: 2556148 - DNA, 19 bp, Homo sapiens
cttgacataatttcactga

SEQ ID NO: 2556149 - DNA, 14 bp, Homo sapiens
cttgacattcaagg

SEQ ID NO: 2556150 - DNA, 15 bp, Homo sapiens
cttgaccaagcagga

SEQ ID NO: 2556151 - DNA, 22 bp, Homo sapiens
cttgaccattctccacctgcca

SEQ ID NO: 2556152 - DNA, 12 bp, Homo sapiens
cttgacctccta

SEQ ID NO: 2556153 - DNA, 20 bp, Homo sapiens
cttgactaaaaaaaaaagaa

SEQ ID NO: 2556154 - DNA, 13 bp, Homo sapiens
cttgactccttgt

SEQ ID NO: 2556155 - DNA, 22 bp, Homo sapiens
cttgacttgcaatttctaccta

SEQ ID NO: 2556156 - DNA, 11 bp, Homo sapiens
cttgagaaacc

SEQ ID NO: 2556157 - DNA, 13 bp, Homo sapiens
cttgagaaacctt

SEQ ID NO: 2556158 - DNA, 13 bp, Homo sapiens
cttgagcccagga

SEQ ID NO: 2556159 - DNA, 14 bp, Homo sapiens
cttgagcccaggag

SEQ ID NO: 2556160 - DNA, 17 bp, Homo sapiens
cttgagccttgaacttt

SEQ ID NO: 2556161 - DNA, 18 bp, Homo sapiens
cttgagccttgaactttg

SEQ ID NO: 2556162 - DNA, 22 bp, Homo sapiens
cttgagccttgaactttgacct

SEQ ID NO: 2556163 - DNA, 14 bp, Homo sapiens
cttgagctccccaa

SEQ ID NO: 2556164 - DNA, 21 bp, Homo sapiens
cttgagcttggcagctgaact

SEQ ID NO: 2556165 - DNA, 14 bp, Homo sapiens
cttgaggagtgtga

SEQ ID NO: 2556166 - DNA, 14 bp, Homo sapiens
cttgaggccaggag

SEQ ID NO: 2556167 - DNA, 17 bp, Homo sapiens
cttgagggttgggctgg

SEQ ID NO: 2556168 - DNA, 17 bp, Homo sapiens
cttgaggtcttttgaca

SEQ ID NO: 2556169 - DNA, 22 bp, Homo sapiens
cttgagtggggttatctctgtg

SEQ ID NO: 2556170 - DNA, 17 bp, Homo sapiens
cttgatacccccctctg

SEQ ID NO: 2556171 - DNA, 15 bp, Homo sapiens
cttgatctgtatata

SEQ ID NO: 2556172 - DNA, 22 bp, Homo sapiens
cttgatctgtatatacaataac

SEQ ID NO: 2556173 - DNA, 22 bp, Homo sapiens
cttgatgtggtgaggcaggctt

SEQ ID NO: 2556174 - DNA, 18 bp, Homo sapiens
cttgatgtgttatctctt

SEQ ID NO: 2556175 - DNA, 15 bp, Homo sapiens
cttgcaacacacaga

SEQ ID NO: 2556176 - DNA, 17 bp, Homo sapiens
cttgcaacacacagaca

SEQ ID NO: 2556177 - DNA, 16 bp, Homo sapiens
cttgcacccgcctctc

SEQ ID NO: 2556178 - DNA, 18 bp, Homo sapiens
cttgcagactctacagag

SEQ ID NO: 2556179 - DNA, 23 bp, Homo sapiens
cttgcagcactcacacaggaccc

SEQ ID NO: 2556180 - DNA, 21 bp, Homo sapiens
cttgcataataagctaaagag

SEQ ID NO: 2556181 - DNA, 23 bp, Homo sapiens
cttgcatcaatttttcttatttc

SEQ ID NO: 2556182 - DNA, 19 bp, Homo sapiens
cttgcatccaactccagga

SEQ ID NO: 2556183 - DNA, 14 bp, Homo sapiens
cttgcatgaggcta

SEQ ID NO: 2556184 - DNA, 21 bp, Homo sapiens
cttgcatggtttagaaagctt

SEQ ID NO: 2556185 - DNA, 16 bp, Homo sapiens
cttgcattcccagtgg

SEQ ID NO: 2556186 - DNA, 21 bp, Homo sapiens
cttgccaccccaccctccctg

SEQ ID NO: 2556187 - DNA, 23 bp, Homo sapiens
cttgccaccccaccctccctgga

SEQ ID NO: 2556188 - DNA, 13 bp, Homo sapiens
cttgcccagggct

SEQ ID NO: 2556189 - DNA, 19 bp, Homo sapiens
cttgcccagggctcagcct

SEQ ID NO: 2556190 - DNA, 13 bp, Homo sapiens
cttgccccccacc

SEQ ID NO: 2556191 - DNA, 15 bp, Homo sapiens
cttgccccccacccc

SEQ ID NO: 2556192 - DNA, 18 bp, Homo sapiens
cttgccccggccccggcc

SEQ ID NO: 2556193 - DNA, 18 bp, Homo sapiens
cttgccctgacctcccag

SEQ ID NO: 2556194 - DNA, 14 bp, Homo sapiens
cttgcccttccctg

SEQ ID NO: 2556195 - DNA, 15 bp, Homo sapiens
cttgcccttccctgt

SEQ ID NO: 2556196 - DNA, 16 bp, Homo sapiens
cttgcccttccctgtc

SEQ ID NO: 2556197 - DNA, 17 bp, Homo sapiens
cttgcccttccctgtcc

SEQ ID NO: 2556198 - DNA, 19 bp, Homo sapiens
ctgcttctccatggccacc

SEQ ID NO: 2556199 - DNA, 14 bp, Homo sapiens
ctgcttgaggaaaa

SEQ ID NO: 2556200 - DNA, 20 bp, Homo sapiens
ctgcttgggtggagaagcca

SEQ ID NO: 2556201 - DNA, 19 bp, Homo sapiens
ctgcttgtgtccctcctgg

SEQ ID NO: 2556202 - DNA, 13 bp, Homo sapiens
ctgcttgtttcct

SEQ ID NO: 2556203 - DNA, 14 bp, Homo sapiens
ctgcttgtttccta

SEQ ID NO: 2556204 - DNA, 17 bp, Homo sapiens
ctgctttcccctgtggg

SEQ ID NO: 2556205 - DNA, 22 bp, Homo sapiens
ctgctttctccattgtaaacca

SEQ ID NO: 2556206 - DNA, 16 bp, Homo sapiens
ctgctttctgttgtca

SEQ ID NO: 2556207 - DNA, 21 bp, Homo sapiens
ctgctttgctcttcaagaaat

SEQ ID NO: 2556208 - DNA, 18 bp, Homo sapiens
ctgcttttcactgctgca

SEQ ID NO: 2556209 - DNA, 22 bp, Homo sapiens
ctgcttttccttggggcaggca

SEQ ID NO: 2556210 - DNA, 19 bp, Homo sapiens
ctgcttttgtctatgggac

SEQ ID NO: 2556211 - DNA, 14 bp, Homo sapiens
ctggaaaagaggag

SEQ ID NO: 2556212 - DNA, 15 bp, Homo sapiens
ctggaaaagaggagt

SEQ ID NO: 2556213 - DNA, 14 bp, Homo sapiens
ctggaaaggctcag

SEQ ID NO: 2556214 - DNA, 20 bp, Homo sapiens
ctggaaaggctcagtctcag

SEQ ID NO: 2556215 - DNA, 19 bp, Homo sapiens
ctggaaaggggggagctgg

SEQ ID NO: 2556216 - DNA, 20 bp, Homo sapiens
ctggaaaggggggagctggg

SEQ ID NO: 2556217 - DNA, 20 bp, Homo sapiens
ctggaacatcatcaaggcac

SEQ ID NO: 2556218 - DNA, 16 bp, Homo sapiens
ctggaaccatcagaaa

SEQ ID NO: 2556219 - DNA, 21 bp, Homo sapiens
ctggaagacagagacctcctg

SEQ ID NO: 2556220 - DNA, 18 bp, Homo sapiens
ctggaagcacagcttcat

SEQ ID NO: 2556221 - DNA, 16 bp, Homo sapiens
ctggaagccagctttc

SEQ ID NO: 2556222 - DNA, 17 bp, Homo sapiens
ctggaaggagtgagagg

SEQ ID NO: 2556223 - DNA, 20 bp, Homo sapiens
ctggaaggtggggacaggga

SEQ ID NO: 2556224 - DNA, 20 bp, Homo sapiens
ctggaagttttgcatttatg

SEQ ID NO: 2556225 - DNA, 18 bp, Homo sapiens
ctggaatacatgaaatat

SEQ ID NO: 2556226 - DNA, 19 bp, Homo sapiens
ctggaatctggagagctag

SEQ ID NO: 2556227 - DNA, 20 bp, Homo sapiens
ctggaatgtaatcaatgttt

SEQ ID NO: 2556228 - DNA, 21 bp, Homo sapiens
ctggaatgtaatcaatgtttc

SEQ ID NO: 2556229 - DNA, 22 bp, Homo sapiens
ctggaatttgcaagtcatggct

SEQ ID NO: 2556230 - DNA, 15 bp, Homo sapiens
ctggacaagccaact

SEQ ID NO: 2556231 - DNA, 22 bp, Homo sapiens
ctggacaccgggccagtatcta

SEQ ID NO: 2556232 - DNA, 15 bp, Homo sapiens
ctggacactcagacc

SEQ ID NO: 2556233 - DNA, 18 bp, Homo sapiens
ctggacactcagacctga

SEQ ID NO: 2556234 - DNA, 23 bp, Homo sapiens
ctggacatagagagggagaagaa

SEQ ID NO: 2556235 - DNA, 18 bp, Homo sapiens
ctggacatcctcttctgc

SEQ ID NO: 2556236 - DNA, 17 bp, Homo sapiens
ctggacattttttcagt

SEQ ID NO: 2556237 - DNA, 21 bp, Homo sapiens
ctggaccaaccctgtttcctg

SEQ ID NO: 2556238 - DNA, 15 bp, Homo sapiens
ctggaccactgggca

SEQ ID NO: 2556239 - DNA, 22 bp, Homo sapiens
ctggaccccatctgtgaataag

SEQ ID NO: 2556240 - DNA, 19 bp, Homo sapiens
ctggacctatgtcctaagg

SEQ ID NO: 2556241 - DNA, 20 bp, Homo sapiens
ctggacctatgtcctaagga

SEQ ID NO: 2556242 - DNA, 15 bp, Homo sapiens
ctggacggggactgg

SEQ ID NO: 2556243 - DNA, 20 bp, Homo sapiens
ctggactcaggatgcccagg

SEQ ID NO: 2556244 - DNA, 13 bp, Homo sapiens
ctggactccggcc

SEQ ID NO: 2556245 - DNA, 19 bp, Homo sapiens
ctggactcctctgtccagg

SEQ ID NO: 2556246 - DNA, 20 bp, Homo sapiens
ctggactcctctgtccaggc

SEQ ID NO: 2556247 - DNA, 14 bp, Homo sapiens
ctggactctcagtc

SEQ ID NO: 2556248 - DNA, 21 bp, Homo sapiens
ctggactggctagagtcctca

SEQ ID NO: 2556249 - DNA, 13 bp, Homo sapiens
ctggactgggagg

SEQ ID NO: 2556250 - DNA, 17 bp, Homo sapiens
ctggactgggaggtaga

SEQ ID NO: 2556251 - DNA, 15 bp, Homo sapiens
ctggacttgagcttg

SEQ ID NO: 2556252 - DNA, 13 bp, Homo sapiens
ctggagaactaga

SEQ ID NO: 2556253 - DNA, 20 bp, Homo sapiens
ctggagaagctcccaggaac

SEQ ID NO: 2556254 - DNA, 15 bp, Homo sapiens
ctggagaagctgatg

SEQ ID NO: 2556255 - DNA, 17 bp, Homo sapiens
ctggagaagctgatgct

SEQ ID NO: 2556256 - DNA, 18 bp, Homo sapiens
ctggagacgggtgggcgg

SEQ ID NO: 2556257 - DNA, 19 bp, Homo sapiens
ctggagactcctaggcagg

SEQ ID NO: 2556258 - DNA, 20 bp, Homo sapiens
ctggagactcctaggcagga

SEQ ID NO: 2556259 - DNA, 17 bp, Homo sapiens
ctggagagaagtttctg

SEQ ID NO: 2556260 - DNA, 22 bp, Homo sapiens
ctggagagctagaacctggaga

SEQ ID NO: 2556261 - DNA, 20 bp, Homo sapiens
ctggagagttcaatggctgc

SEQ ID NO: 2556262 - DNA, 23 bp, Homo sapiens
ctggagagttcaatggctgctga

SEQ ID NO: 2556263 - DNA, 12 bp, Homo sapiens
ctggagcaggcc

SEQ ID NO: 2556264 - DNA, 16 bp, Homo sapiens
ctggagcaggccttgc

SEQ ID NO: 2556265 - DNA, 17 bp, Homo sapiens
ctggagcatctgactca

SEQ ID NO: 2556266 - DNA, 22 bp, Homo sapiens
ctggagcatctgactcacaaga

SEQ ID NO: 2556267 - DNA, 23 bp, Homo sapiens
ctggagcatctgactcacaagaa

SEQ ID NO: 2556268 - DNA, 17 bp, Homo sapiens
ctggagccaactgctgc

SEQ ID NO: 2556269 - DNA, 20 bp, Homo sapiens
ctggagccaactgctgcttt

SEQ ID NO: 2556270 - DNA, 16 bp, Homo sapiens
ctggagccagactctg

SEQ ID NO: 2556271 - DNA, 21 bp, Homo sapiens
ctggagccagactctggtctt

SEQ ID NO: 2556272 - DNA, 13 bp, Homo sapiens
ctggagcccagga

SEQ ID NO: 2556273 - DNA, 15 bp, Homo sapiens
ctggagcccctgggt

SEQ ID NO: 2556274 - DNA, 15 bp, Homo sapiens
ctggagcctggtgcc

SEQ ID NO: 2556275 - DNA, 17 bp, Homo sapiens
ctggagcctggtgccct

SEQ ID NO: 2556276 - DNA, 11 bp, Homo sapiens
ctggagctggc

SEQ ID NO: 2556277 - DNA, 22 bp, Homo sapiens
ctggaggactagaacctggagg

SEQ ID NO: 2556278 - DNA, 14 bp, Homo sapiens
ctggaggagagaag

SEQ ID NO: 2556279 - DNA, 21 bp, Homo sapiens
ctggagggaatgaacctggag

SEQ ID NO: 2556280 - DNA, 23 bp, Homo sapiens
ctggagggaatgaacctggaggg

SEQ ID NO: 2556281 - DNA, 21 bp, Homo sapiens
ctggagggctagaactggaga

SEQ ID NO: 2556282 - DNA, 16 bp, Homo sapiens
ctggaggggtgtggct

SEQ ID NO: 2556283 - DNA, 20 bp, Homo sapiens
ctggaggggtgtggctcctt

SEQ ID NO: 2556284 - DNA, 19 bp, Homo sapiens
ctggaggtcacattcagga

SEQ ID NO: 2556285 - DNA, 21 bp, Homo sapiens
ctggaggtcacattcaggaag

SEQ ID NO: 2556286 - DNA, 15 bp, Homo sapiens
ctggaggtggggttg

SEQ ID NO: 2556287 - DNA, 20 bp, Homo sapiens
ctggaggtggggttgggatt

SEQ ID NO: 2556288 - DNA, 22 bp, Homo sapiens
ctggaggttgataactttgctt

SEQ ID NO: 2556289 - DNA, 15 bp, Homo sapiens
ctggagtccagtctc

SEQ ID NO: 2556290 - DNA, 16 bp, Homo sapiens
ctggagtccagtctct

SEQ ID NO: 2556291 - DNA, 14 bp, Homo sapiens
ctggagtgaggggt

SEQ ID NO: 2556292 - DNA, 12 bp, Homo sapiens
ctggagtgcagg

SEQ ID NO: 2556293 - DNA, 17 bp, Homo sapiens
ctggagtgcagtgagcc

SEQ ID NO: 2556294 - DNA, 20 bp, Homo sapiens
ctggagtgtggctgaggagg

SEQ ID NO: 2556295 - DNA, 16 bp, Homo sapiens
ctggagttacattaat

SEQ ID NO: 2556296 - DNA, 14 bp, Homo sapiens
ctggataacttagg

SEQ ID NO: 2556297 - DNA, 13 bp, Homo sapiens
ctggataggagcc

SEQ ID NO: 2556298 - DNA, 18 bp, Homo sapiens
ctggataggagcctgctg

SEQ ID NO: 2556299 - DNA, 20 bp, Homo sapiens
ctggataggagcctgctggt

SEQ ID NO: 2556300 - DNA, 23 bp, Homo sapiens
ctggatcaaagtaggcaggacca

SEQ ID NO: 2556301 - DNA, 23 bp, Homo sapiens
ctggatcctagccttatcctctg

SEQ ID NO: 2556302 - DNA, 20 bp, Homo sapiens
ctggatctccattctctcag

SEQ ID NO: 2556303 - DNA, 15 bp, Homo sapiens
ctggatctccccact

SEQ ID NO: 2556304 - DNA, 13 bp, Homo sapiens
ctggatgaaattt

SEQ ID NO: 2556305 - DNA, 23 bp, Homo sapiens
ctggatgaagattctcctgtgct

SEQ ID NO: 2556306 - DNA, 13 bp, Homo sapiens
ctggatgagactt

SEQ ID NO: 2556307 - DNA, 17 bp, Homo sapiens
ctgcacagggcagctgg

SEQ ID NO: 2556308 - DNA, 19 bp, Homo sapiens
ctgcacagggcagctgggc

SEQ ID NO: 2556309 - DNA, 18 bp, Homo sapiens
ctgcacagttttctggct

SEQ ID NO: 2556310 - DNA, 21 bp, Homo sapiens
ctgcacagttttctggctgga

SEQ ID NO: 2556311 - DNA, 20 bp, Homo sapiens
ctgcacatgcagctgcaccc

SEQ ID NO: 2556312 - DNA, 21 bp, Homo sapiens
ctgcacatgcagctgcaccct

SEQ ID NO: 2556313 - DNA, 12 bp, Homo sapiens
ctgcacccaggg

SEQ ID NO: 2556314 - DNA, 12 bp, Homo sapiens
ctgcaccctcca

SEQ ID NO: 2556315 - DNA, 14 bp, Homo sapiens
ctgcaccctccacc

SEQ ID NO: 2556316 - DNA, 16 bp, Homo sapiens
ctgcaccctggggcct

SEQ ID NO: 2556317 - DNA, 22 bp, Homo sapiens
ctgcaccctggggcctggacct

SEQ ID NO: 2556318 - DNA, 17 bp, Homo sapiens
ctgcaccggctggcctg

SEQ ID NO: 2556319 - DNA, 18 bp, Homo sapiens
ctgcaccgggccacagag

SEQ ID NO: 2556320 - DNA, 19 bp, Homo sapiens
ctgcacctgccagcctggc

SEQ ID NO: 2556321 - DNA, 18 bp, Homo sapiens
ctgcacggtgggccttgc

SEQ ID NO: 2556322 - DNA, 20 bp, Homo sapiens
ctgcacggtgggccttgctg

SEQ ID NO: 2556323 - DNA, 16 bp, Homo sapiens
ctgcactactcctctg

SEQ ID NO: 2556324 - DNA, 13 bp, Homo sapiens
ctgcactccagcc

SEQ ID NO: 2556325 - DNA, 16 bp, Homo sapiens
ctgcactccagcctga

SEQ ID NO: 2556326 - DNA, 20 bp, Homo sapiens
ctgcactccagcctgggcga

SEQ ID NO: 2556327 - DNA, 13 bp, Homo sapiens
ctgcactcccctg

SEQ ID NO: 2556328 - DNA, 16 bp, Homo sapiens
ctgcactcccctgctg

SEQ ID NO: 2556329 - DNA, 21 bp, Homo sapiens
ctgcactcccctgctgggtgt

SEQ ID NO: 2556330 - DNA, 19 bp, Homo sapiens
ctgcactcttaagcttccg

SEQ ID NO: 2556331 - DNA, 19 bp, Homo sapiens
ctgcacttatacccatgaa

SEQ ID NO: 2556332 - DNA, 20 bp, Homo sapiens
ctgcagagcaggaaacatga

SEQ ID NO: 2556333 - DNA, 23 bp, Homo sapiens
ctgcagaggggctttctggagag

SEQ ID NO: 2556334 - DNA, 17 bp, Homo sapiens
ctgcagatttgggctgg

SEQ ID NO: 2556335 - DNA, 19 bp, Homo sapiens
ctgcagatttgggctggaa

SEQ ID NO: 2556336 - DNA, 19 bp, Homo sapiens
ctgcagcagcggtggcctc

SEQ ID NO: 2556337 - DNA, 23 bp, Homo sapiens
ctgcagcctcaacctcctgggct

SEQ ID NO: 2556338 - DNA, 17 bp, Homo sapiens
ctgcagctcacccagcc

SEQ ID NO: 2556339 - DNA, 13 bp, Homo sapiens
ctgcagctgacct

SEQ ID NO: 2556340 - DNA, 14 bp, Homo sapiens
ctgcagctgacctc

SEQ ID NO: 2556341 - DNA, 12 bp, Homo sapiens
ctgcagctttgt

SEQ ID NO: 2556342 - DNA, 13 bp, Homo sapiens
ctgcaggcagcca

SEQ ID NO: 2556343 - DNA, 19 bp, Homo sapiens
ctgcaggccaagagcagag

SEQ ID NO: 2556344 - DNA, 18 bp, Homo sapiens
ctgcaggccaggccagct

SEQ ID NO: 2556345 - DNA, 23 bp, Homo sapiens
ctgcagggaaaattatttgcata

SEQ ID NO: 2556346 - DNA, 17 bp, Homo sapiens
ctgcagggactgccagt

SEQ ID NO: 2556347 - DNA, 20 bp, Homo sapiens
ctgcagggtggtgctgggac

SEQ ID NO: 2556348 - DNA, 21 bp, Homo sapiens
ctgcagggtggtgctgggact

SEQ ID NO: 2556349 - DNA, 22 bp, Homo sapiens
ctgcagggtggtgctgggactg

SEQ ID NO: 2556350 - DNA, 23 bp, Homo sapiens
ctgcagggtggtgctgggactga

SEQ ID NO: 2556351 - DNA, 17 bp, Homo sapiens
ctgcagtatgaaaataa

SEQ ID NO: 2556352 - DNA, 13 bp, Homo sapiens
ctgcagtcacagc

SEQ ID NO: 2556353 - DNA, 20 bp, Homo sapiens
ctgcagtctggctgagccct

SEQ ID NO: 2556354 - DNA, 22 bp, Homo sapiens
ctgcagttgccagtcaccccgg

SEQ ID NO: 2556355 - DNA, 14 bp, Homo sapiens
ctgcatacttttta

SEQ ID NO: 2556356 - DNA, 15 bp, Homo sapiens
ctgcatccccttggc

SEQ ID NO: 2556357 - DNA, 16 bp, Homo sapiens
ctgcatccccttggct

SEQ ID NO: 2556358 - DNA, 22 bp, Homo sapiens
ctgcatccccttggctgtgagg

SEQ ID NO: 2556359 - DNA, 17 bp, Homo sapiens
ctgcatcctccaagaat

SEQ ID NO: 2556360 - DNA, 16 bp, Homo sapiens
ctgcatcgtttcatct

SEQ ID NO: 2556361 - DNA, 14 bp, Homo sapiens
ctgcatcttgggga

SEQ ID NO: 2556362 - DNA, 22 bp, Homo sapiens
ctgcatgcctggtctttcctct

SEQ ID NO: 2556363 - DNA, 21 bp, Homo sapiens
ctgcatgcggcccagcccggc

SEQ ID NO: 2556364 - DNA, 15 bp, Homo sapiens
ctgcattagaaatta

SEQ ID NO: 2556365 - DNA, 21 bp, Homo sapiens
ctgcattcacccagacagctc

SEQ ID NO: 2556366 - DNA, 15 bp, Homo sapiens
ctgcattctttctgt

SEQ ID NO: 2556367 - DNA, 14 bp, Homo sapiens
ctgcatttaaaaga

SEQ ID NO: 2556368 - DNA, 9 bp, Homo sapiens
ctgcatttt

SEQ ID NO: 2556369 - DNA, 17 bp, Homo sapiens
ctgcattttcaccccac

SEQ ID NO: 2556370 - DNA, 18 bp, Homo sapiens
ctgcattttcaccccacc

SEQ ID NO: 2556371 - DNA, 20 bp, Homo sapiens
ctgccaaattttggccaaag

SEQ ID NO: 2556372 - DNA, 18 bp, Homo sapiens
ctgccaaggccagagtgg

SEQ ID NO: 2556373 - DNA, 22 bp, Homo sapiens
ctgccaaggccagagtggcctg

SEQ ID NO: 2556374 - DNA, 15 bp, Homo sapiens
ctgccacacaaacgt

SEQ ID NO: 2556375 - DNA, 22 bp, Homo sapiens
ctgccacacaaacgtatgtaaa

SEQ ID NO: 2556376 - DNA, 12 bp, Homo sapiens
ctgccacacagg

SEQ ID NO: 2556377 - DNA, 15 bp, Homo sapiens
ctgccacacctgagc

SEQ ID NO: 2556378 - DNA, 14 bp, Homo sapiens
ctgccaccctgggg

SEQ ID NO: 2556379 - DNA, 12 bp, Homo sapiens
ctgccactcaca

SEQ ID NO: 2556380 - DNA, 22 bp, Homo sapiens
ctgccagaagatcccctcagga

SEQ ID NO: 2556381 - DNA, 13 bp, Homo sapiens
ctgccagatgctg

SEQ ID NO: 2556382 - DNA, 18 bp, Homo sapiens
ctgccagatgctgatgtt

SEQ ID NO: 2556383 - DNA, 21 bp, Homo sapiens
ctgccagatgctgatgttcag

SEQ ID NO: 2556384 - DNA, 15 bp, Homo sapiens
ctgccagcaacgcag

SEQ ID NO: 2556385 - DNA, 12 bp, Homo sapiens
ctgccagccaca

SEQ ID NO: 2556386 - DNA, 14 bp, Homo sapiens
ctgccagccagcag

SEQ ID NO: 2556387 - DNA, 16 bp, Homo sapiens
ctgccagccagcagcc

SEQ ID NO: 2556388 - DNA, 23 bp, Homo sapiens
ctgccagccagcagccagctctc

SEQ ID NO: 2556389 - DNA, 20 bp, Homo sapiens
ctgccagcctggcttctgga

SEQ ID NO: 2556390 - DNA, 13 bp, Homo sapiens
ctgccaggcatgg

SEQ ID NO: 2556391 - DNA, 13 bp, Homo sapiens
ctgccaggccccc

SEQ ID NO: 2556392 - DNA, 22 bp, Homo sapiens
ctgccagggacagagggggtgg

SEQ ID NO: 2556393 - DNA, 17 bp, Homo sapiens
ctgccagggagacagag

SEQ ID NO: 2556394 - DNA, 23 bp, Homo sapiens
ctgccagggagacagagctcaca

SEQ ID NO: 2556395 - DNA, 12 bp, Homo sapiens
ctgccagggagc

SEQ ID NO: 2556396 - DNA, 16 bp, Homo sapiens
ctgccagggcagggcc

SEQ ID NO: 2556397 - DNA, 16 bp, Homo sapiens
ctgccagtcctagctg

SEQ ID NO: 2556398 - DNA, 21 bp, Homo sapiens
ctgccagtcctagctgcacag

SEQ ID NO: 2556399 - DNA, 12 bp, Homo sapiens
ctgccagttttg

SEQ ID NO: 2556400 - DNA, 20 bp, Homo sapiens
ctgccatattctgttggcca

SEQ ID NO: 2556401 - DNA, 23 bp, Homo sapiens
ctgccatattctgttggccagtg

SEQ ID NO: 2556402 - DNA, 23 bp, Homo sapiens
ctgccatcatgtttacagaggac

SEQ ID NO: 2556403 - DNA, 18 bp, Homo sapiens
ctgccatccaggttcagc

SEQ ID NO: 2556404 - DNA, 19 bp, Homo sapiens
ctgccatccaggttcagct

SEQ ID NO: 2556405 - DNA, 23 bp, Homo sapiens
ctgccatcttagtttggattctt

SEQ ID NO: 2556406 - DNA, 15 bp, Homo sapiens
ctgccatgcagggcc

SEQ ID NO: 2556407 - DNA, 17 bp, Homo sapiens
ctgccatgccagcttat

SEQ ID NO: 2556408 - DNA, 17 bp, Homo sapiens
ctgcccaaaaatatggt

SEQ ID NO: 2556409 - DNA, 22 bp, Homo sapiens
ctgcccaaagtgcttccaaggc

SEQ ID NO: 2556410 - DNA, 17 bp, Homo sapiens
ctgcccaacctgctctc

SEQ ID NO: 2556411 - DNA, 12 bp, Homo sapiens
ctgcccacccgt

SEQ ID NO: 2556412 - DNA, 15 bp, Homo sapiens
ctgcccacctggcct

SEQ ID NO: 2556413 - DNA, 18 bp, Homo sapiens
ctgcccacctggcctctg

SEQ ID NO: 2556414 - DNA, 18 bp, Homo sapiens
ctgcccagacccctctgg

SEQ ID NO: 2556415 - DNA, 21 bp, Homo sapiens
ctgcccagacccctctggcca

SEQ ID NO: 2556416 - DNA, 22 bp, Homo sapiens
ctgcccagacccctctggccag

SEQ ID NO: 2556417 - DNA, 15 bp, Homo sapiens
ctgcccagcttgggc

SEQ ID NO: 2556418 - DNA, 11 bp, Homo sapiens
ctgatttgcaa

SEQ ID NO: 2556419 - DNA, 22 bp, Homo sapiens
ctgattttaacaataactactg

SEQ ID NO: 2556420 - DNA, 17 bp, Homo sapiens
ctgcaaaaggactctca

SEQ ID NO: 2556421 - DNA, 18 bp, Homo sapiens
ctgcaaaaggactctcag

SEQ ID NO: 2556422 - DNA, 23 bp, Homo sapiens
ctgcaaacatggggttggctggg

SEQ ID NO: 2556423 - DNA, 16 bp, Homo sapiens
ctgcaaactcactgct

SEQ ID NO: 2556424 - DNA, 22 bp, Homo sapiens
ctgcaaagggtatcaggtgctg

SEQ ID NO: 2556425 - DNA, 13 bp, Homo sapiens
ctgcaacctccgc

SEQ ID NO: 2556426 - DNA, 19 bp, Homo sapiens
ctgcaacttgtaaatgtgg

SEQ ID NO: 2556427 - DNA, 21 bp, Homo sapiens
ctgcaactttaagcagctctt

SEQ ID NO: 2556428 - DNA, 20 bp, Homo sapiens
ctgcaagattctgaaacatt

SEQ ID NO: 2556429 - DNA, 16 bp, Homo sapiens
ctgcaaggcctttctg

SEQ ID NO: 2556430 - DNA, 18 bp, Homo sapiens
ctgcaaggcctttctgtg

SEQ ID NO: 2556431 - DNA, 16 bp, Homo sapiens
ctgcaagggctcccca

SEQ ID NO: 2556432 - DNA, 17 bp, Homo sapiens
ctgcaagggctccccac

SEQ ID NO: 2556433 - DNA, 17 bp, Homo sapiens
ctgcaaggtctttggtt

SEQ ID NO: 2556434 - DNA, 15 bp, Homo sapiens
ctgcaagtcagagga

SEQ ID NO: 2556435 - DNA, 19 bp, Homo sapiens
ctgcaagtcagaggatggc

SEQ ID NO: 2556436 - DNA, 19 bp, Homo sapiens
ctgcaagtgacatctcttt

SEQ ID NO: 2556437 - DNA, 17 bp, Homo sapiens
ctgcaattcccctctgc

SEQ ID NO: 2556438 - DNA, 20 bp, Homo sapiens
ctgcacaaagcccttccatg

SEQ ID NO: 2556439 - DNA, 15 bp, Homo sapiens
ctgcacaagctgcac

SEQ ID NO: 2556440 - DNA, 15 bp, Homo sapiens
ctgcacacacctcag

SEQ ID NO: 2556441 - DNA, 19 bp, Homo sapiens
ctgcacacacctcagaggc

SEQ ID NO: 2556442 - DNA, 20 bp, Homo sapiens
ctgcacacacctcagaggct

SEQ ID NO: 2556443 - DNA, 11 bp, Homo sapiens
ctgcacagagc

SEQ ID NO: 2556444 - DNA, 18 bp, Homo sapiens
ctgcacagagctctccag

SEQ ID NO: 2556445 - DNA, 12 bp, Homo sapiens
ctgcacagatgg

SEQ ID NO: 2556446 - DNA, 23 bp, Homo sapiens
ctgcacagatggatttgcctgtg

SEQ ID NO: 2556447 - DNA, 12 bp, Homo sapiens
cctcttgccccc

SEQ ID NO: 2556448 - DNA, 21 bp, Homo sapiens
cctcttgccccccaccccagc

SEQ ID NO: 2556449 - DNA, 23 bp, Homo sapiens
cctcttgccccccaccccagcct

SEQ ID NO: 2556450 - DNA, 12 bp, Homo sapiens
cctcttgctcaa

SEQ ID NO: 2556451 - DNA, 21 bp, Homo sapiens
cctcttggacctctgctctga

SEQ ID NO: 2556452 - DNA, 15 bp, Homo sapiens
cctcttggctgcctt

SEQ ID NO: 2556453 - DNA, 12 bp, Homo sapiens
cctctttaagag

SEQ ID NO: 2556454 - DNA, 23 bp, Homo sapiens
cctctttgtctaaaacaataaaa

SEQ ID NO: 2556455 - DNA, 18 bp, Homo sapiens
cctgaaaacactgtgcac

SEQ ID NO: 2556456 - DNA, 18 bp, Homo sapiens
cctgaaacttacacacaa

SEQ ID NO: 2556457 - DNA, 16 bp, Homo sapiens
cctgaaacttattttt

SEQ ID NO: 2556458 - DNA, 22 bp, Homo sapiens
cctgaaacttatttttttctga

SEQ ID NO: 2556459 - DNA, 23 bp, Homo sapiens
cctgaaagaggaatgaagtactc

SEQ ID NO: 2556460 - DNA, 15 bp, Homo sapiens
cctgaacaagaattg

SEQ ID NO: 2556461 - DNA, 21 bp, Homo sapiens
cctgaacaagaattggaagct

SEQ ID NO: 2556462 - DNA, 21 bp, Homo sapiens
cctgaagactcattcttctgt

SEQ ID NO: 2556463 - DNA, 18 bp, Homo sapiens
cctgaagaggcgggccag

SEQ ID NO: 2556464 - DNA, 21 bp, Homo sapiens
cctgaagaggcgggccagcca

SEQ ID NO: 2556465 - DNA, 22 bp, Homo sapiens
cctgaagaggcgggccagccag

SEQ ID NO: 2556466 - DNA, 21 bp, Homo sapiens
cctgaagccaggccatggcta

SEQ ID NO: 2556467 - DNA, 13 bp, Homo sapiens
cctgaaggccccg

SEQ ID NO: 2556468 - DNA, 14 bp, Homo sapiens
cctgaaggccccgc

SEQ ID NO: 2556469 - DNA, 18 bp, Homo sapiens
cctgaaggccccgcccag

SEQ ID NO: 2556470 - DNA, 19 bp, Homo sapiens
cctgaaggccccgcccagg

SEQ ID NO: 2556471 - DNA, 17 bp, Homo sapiens
cctgaagtcacacagtg

SEQ ID NO: 2556472 - DNA, 19 bp, Homo sapiens
cctgaatttattattgttc

SEQ ID NO: 2556473 - DNA, 16 bp, Homo sapiens
cctgacattggagcct

SEQ ID NO: 2556474 - DNA, 20 bp, Homo sapiens
cctgaccaccctcccctctc

SEQ ID NO: 2556475 - DNA, 16 bp, Homo sapiens
cctgacccaggccgca

SEQ ID NO: 2556476 - DNA, 19 bp, Homo sapiens
cctgacccaggccgcagct

SEQ ID NO: 2556477 - DNA, 14 bp, Homo sapiens
cctgacccctgctc

SEQ ID NO: 2556478 - DNA, 15 bp, Homo sapiens
cctgacccctgctca

SEQ ID NO: 2556479 - DNA, 17 bp, Homo sapiens
cctgacctcccagccct

SEQ ID NO: 2556480 - DNA, 13 bp, Homo sapiens
cctgacctgaggc

SEQ ID NO: 2556481 - DNA, 13 bp, Homo sapiens
cctgactcctcta

SEQ ID NO: 2556482 - DNA, 16 bp, Homo sapiens
cctgactctctgtgac

SEQ ID NO: 2556483 - DNA, 17 bp, Homo sapiens
cctgactctctgtgacc

SEQ ID NO: 2556484 - DNA, 22 bp, Homo sapiens
cctgactctgccccctgctggc

SEQ ID NO: 2556485 - DNA, 21 bp, Homo sapiens
cctgactggtgctataggctg

SEQ ID NO: 2556486 - DNA, 22 bp, Homo sapiens
cctgagaataagaaagtttcac

SEQ ID NO: 2556487 - DNA, 19 bp, Homo sapiens
cctgagacaaatggaggcc

SEQ ID NO: 2556488 - DNA, 12 bp, Homo sapiens
cctgagaccaca

SEQ ID NO: 2556489 - DNA, 22 bp, Homo sapiens
cctgagaccagttgggagcact

SEQ ID NO: 2556490 - DNA, 14 bp, Homo sapiens
cctgagatttacac

SEQ ID NO: 2556491 - DNA, 23 bp, Homo sapiens
cctgagccaagctagaattccct

SEQ ID NO: 2556492 - DNA, 23 bp, Homo sapiens
cctgagccccttccttgctctgc

SEQ ID NO: 2556493 - DNA, 11 bp, Homo sapiens
cctgagctaga

SEQ ID NO: 2556494 - DNA, 19 bp, Homo sapiens
cctgagctcggtggaccca

SEQ ID NO: 2556495 - DNA, 21 bp, Homo sapiens
cctgagctcggtggacccagg

SEQ ID NO: 2556496 - DNA, 16 bp, Homo sapiens
cctgagctgaggcagc

SEQ ID NO: 2556497 - DNA, 18 bp, Homo sapiens
cctgagctgaggcagcag

SEQ ID NO: 2556498 - DNA, 12 bp, Homo sapiens
cctgagctggga

SEQ ID NO: 2556499 - DNA, 13 bp, Homo sapiens
cctgaggatgagc

SEQ ID NO: 2556500 - DNA, 15 bp, Homo sapiens
cctgaggatgagctg

SEQ ID NO: 2556501 - DNA, 13 bp, Homo sapiens
cctgaggcccaga

SEQ ID NO: 2556502 - DNA, 11 bp, Homo sapiens
cctgaggccct

SEQ ID NO: 2556503 - DNA, 12 bp, Homo sapiens
cctgaggccctt

SEQ ID NO: 2556504 - DNA, 14 bp, Homo sapiens
cctgaggcccttct

SEQ ID NO: 2556505 - DNA, 22 bp, Homo sapiens
cctgaggcccttctctccagcc

SEQ ID NO: 2556506 - DNA, 12 bp, Homo sapiens
cctgaggctcct

SEQ ID NO: 2556507 - DNA, 18 bp, Homo sapiens
cctgaggctcctgtgcta

SEQ ID NO: 2556508 - DNA, 21 bp, Homo sapiens
cctgaggctgagactgcggga

SEQ ID NO: 2556509 - DNA, 15 bp, Homo sapiens
cctgaggctgggctc

SEQ ID NO: 2556510 - DNA, 23 bp, Homo sapiens
cctgagggcagaaaggttctgcc

SEQ ID NO: 2556511 - DNA, 13 bp, Homo sapiens
cctgagggcccct

SEQ ID NO: 2556512 - DNA, 20 bp, Homo sapiens
cctgagggcccctctgccca

SEQ ID NO: 2556513 - DNA, 18 bp, Homo sapiens
cctgaggggcatctgccc

SEQ ID NO: 2556514 - DNA, 12 bp, Homo sapiens
cctgaggggcct

SEQ ID NO: 2556515 - DNA, 16 bp, Homo sapiens
cctgaggggcctctta

SEQ ID NO: 2556516 - DNA, 13 bp, Homo sapiens
cctgagggtggag

SEQ ID NO: 2556517 - DNA, 16 bp, Homo sapiens
cctgagggtggagact

SEQ ID NO: 2556518 - DNA, 15 bp, Homo sapiens
cctgaggtgtggggg

SEQ ID NO: 2556519 - DNA, 17 bp, Homo sapiens
cctgaggtgtgggggct

SEQ ID NO: 2556520 - DNA, 20 bp, Homo sapiens
cctgagtaatcgcttaaaga

SEQ ID NO: 2556521 - DNA, 15 bp, Homo sapiens
cctgagtagctggat

SEQ ID NO: 2556522 - DNA, 23 bp, Homo sapiens
cctgagtccaagagggtccttta

SEQ ID NO: 2556523 - DNA, 21 bp, Homo sapiens
cctgagtcgtacagaaagctg

SEQ ID NO: 2556524 - DNA, 18 bp, Homo sapiens
cctgagtctcctgtgccc

SEQ ID NO: 2556525 - DNA, 17 bp, Homo sapiens
cctgataacaacctgga

SEQ ID NO: 2556526 - DNA, 18 bp, Homo sapiens
cctgataacaacctggag

SEQ ID NO: 2556527 - DNA, 14 bp, Homo sapiens
cctgatatgattta

SEQ ID NO: 2556528 - DNA, 21 bp, Homo sapiens
cctgatatttccctcccctgg

SEQ ID NO: 2556529 - DNA, 20 bp, Homo sapiens
cctgatcaagtcaccggagc

SEQ ID NO: 2556530 - DNA, 15 bp, Homo sapiens
cctgatcaatgacag

SEQ ID NO: 2556531 - DNA, 15 bp, Homo sapiens
cctgatccagcctct

SEQ ID NO: 2556532 - DNA, 15 bp, Homo sapiens
cctgatcctgtgaag

SEQ ID NO: 2556533 - DNA, 19 bp, Homo sapiens
cctgatctgacatccccac

SEQ ID NO: 2556534 - DNA, 16 bp, Homo sapiens
cctgatgctcatatca

SEQ ID NO: 2556535 - DNA, 13 bp, Homo sapiens
cctgatgctccct

SEQ ID NO: 2556536 - DNA, 18 bp, Homo sapiens
cctgatgcttcttcagag

SEQ ID NO: 2556537 - DNA, 22 bp, Homo sapiens
cctgatggtcagctcccttctc

SEQ ID NO: 2556538 - DNA, 16 bp, Homo sapiens
cctgatgttaaaattc

SEQ ID NO: 2556539 - DNA, 19 bp, Homo sapiens
cctgattgtgtctcttggt

SEQ ID NO: 2556540 - DNA, 14 bp, Homo sapiens
cctgcaaaatttta

SEQ ID NO: 2556541 - DNA, 22 bp, Homo sapiens
cctgcacaaagcccttccatgt

SEQ ID NO: 2556542 - DNA, 19 bp, Homo sapiens
cctgcacaataaaaatgtt

SEQ ID NO: 2556543 - DNA, 15 bp, Homo sapiens
cctgcacctgtgcag

SEQ ID NO: 2556544 - DNA, 17 bp, Homo sapiens
cctgcacggtgggcctt

SEQ ID NO: 2556545 - DNA, 17 bp, Homo sapiens
cctgcactggagtccag

SEQ ID NO: 2556546 - DNA, 16 bp, Homo sapiens
cctgcacttgcagact

SEQ ID NO: 2556547 - DNA, 17 bp, Homo sapiens
cctgcacttgcagactc

SEQ ID NO: 2556548 - DNA, 11 bp, Homo sapiens
cctgcagagag

SEQ ID NO: 2556549 - DNA, 16 bp, Homo sapiens
cctgcagagagaagcc

SEQ ID NO: 2556550 - DNA, 19 bp, Homo sapiens
cctgcagaggggaaaccag

SEQ ID NO: 2556551 - DNA, 18 bp, Homo sapiens
cctgcaggcagccaggcc

SEQ ID NO: 2556552 - DNA, 21 bp, Homo sapiens
cctgcaggcagccaggccaca

SEQ ID NO: 2556553 - DNA, 23 bp, Homo sapiens
cctgcaggcagccaggccacaag

SEQ ID NO: 2556554 - DNA, 16 bp, Homo sapiens
cctgcaggccaggcca

SEQ ID NO: 2556555 - DNA, 21 bp, Homo sapiens
cctgcagggtggtgctgggac

SEQ ID NO: 2556556 - DNA, 22 bp, Homo sapiens
cctgcagggtggtgctgggact

SEQ ID NO: 2556557 - DNA, 22 bp, Homo sapiens
cctgcagtctggctgagccctg

SEQ ID NO: 2556558 - DNA, 24 bp, Homo sapiens
cctgcatccccttggctgtgaggc

SEQ ID NO: 2556559 - DNA, 16 bp, Homo sapiens
cctgcattcacccaga

SEQ ID NO: 2556560 - DNA, 22 bp, Homo sapiens
cctgcattctgccgtgtgccct

SEQ ID NO: 2556561 - DNA, 16 bp, Homo sapiens
cctgcatttctgagtt

SEQ ID NO: 2556562 - DNA, 14 bp, Homo sapiens
cctgccaccagtca

SEQ ID NO: 2556563 - DNA, 14 bp, Homo sapiens
cctgccaccctggg

SEQ ID NO: 2556564 - DNA, 13 bp, Homo sapiens
cctgccactcaca

SEQ ID NO: 2556565 - DNA, 22 bp, Homo sapiens
cctgccactcacacagccaggt

SEQ ID NO: 2556566 - DNA, 14 bp, Homo sapiens
cctgccagcctggc

SEQ ID NO: 2556567 - DNA, 17 bp, Homo sapiens
cctgccagcctggcttc

SEQ ID NO: 2556568 - DNA, 21 bp, Homo sapiens
cctgccagcctggcttctgga

SEQ ID NO: 2556569 - DNA, 12 bp, Homo sapiens
cctgccaggcat

SEQ ID NO: 2556570 - DNA, 15 bp, Homo sapiens
cctgccaggcatggt

SEQ ID NO: 2556571 - DNA, 12 bp, Homo sapiens
cctgccagggac

SEQ ID NO: 2556572 - DNA, 16 bp, Homo sapiens
cctgccagggagacag

SEQ ID NO: 2556573 - DNA, 13 bp, Homo sapiens
cctgccagggcag

SEQ ID NO: 2556574 - DNA, 20 bp, Homo sapiens
cctgccatcatgtttacaga

SEQ ID NO: 2556575 - DNA, 17 bp, Homo sapiens
cctgccatttgcaccct

SEQ ID NO: 2556576 - DNA, 23 bp, Homo sapiens
cctgccatttgcaccctccgcct

SEQ ID NO: 2556577 - DNA, 13 bp, Homo sapiens
cctgcccacccgt

SEQ ID NO: 2556578 - DNA, 12 bp, Homo sapiens
cctgcccacctg

SEQ ID NO: 2556579 - DNA, 15 bp, Homo sapiens
cctgcccacctggcc

SEQ ID NO: 2556580 - DNA, 17 bp, Homo sapiens
cctgcccacctggcctc

SEQ ID NO: 2556581 - DNA, 14 bp, Homo sapiens
cctgcccacctgtc

SEQ ID NO: 2556582 - DNA, 14 bp, Homo sapiens
cctgcccaggcccc

SEQ ID NO: 2556583 - DNA, 16 bp, Homo sapiens
cctgcccaggcccctg

SEQ ID NO: 2556584 - DNA, 21 bp, Homo sapiens
cctgcccaggcccctgccacc

SEQ ID NO: 2556585 - DNA, 22 bp, Homo sapiens
cctgcccatgtcgcgctcagca

SEQ ID NO: 2556586 - DNA, 16 bp, Homo sapiens
cctgcccattggagag

SEQ ID NO: 2556587 - DNA, 15 bp, Homo sapiens
cctgcccccaatcca

SEQ ID NO: 2556588 - DNA, 16 bp, Homo sapiens
cctgcccccaatccat

SEQ ID NO: 2556589 - DNA, 23 bp, Homo sapiens
cctgcccccaccacggccactgg

SEQ ID NO: 2556590 - DNA, 15 bp, Homo sapiens
cctgccccccagcct

SEQ ID NO: 2556591 - DNA, 22 bp, Homo sapiens
cctgccccccagcctctggcat

SEQ ID NO: 2556592 - DNA, 18 bp, Homo sapiens
cctgccccctgaaactta

SEQ ID NO: 2556593 - DNA, 16 bp, Homo sapiens
cctgcccccttctccc

SEQ ID NO: 2556594 - DNA, 18 bp, Homo sapiens
cctgcccccttctcccac

SEQ ID NO: 2556595 - DNA, 23 bp, Homo sapiens
cctgcccccttctcccacactgc

SEQ ID NO: 2556596 - DNA, 22 bp, Homo sapiens
cctgccccgtcaccatctcagg

SEQ ID NO: 2556597 - DNA, 15 bp, Homo sapiens
cctgcccctcccaga

SEQ ID NO: 2556598 - DNA, 17 bp, Homo sapiens
gtaatgttactgatcat

SEQ ID NO: 2556599 - DNA, 20 bp, Homo sapiens
gtaatgttactgatcatgca

SEQ ID NO: 2556600 - DNA, 22 bp, Homo sapiens
gtaatgttactgatcatgcatt

SEQ ID NO: 2556601 - DNA, 20 bp, Homo sapiens
gtaattaagtactatgtatc

SEQ ID NO: 2556602 - DNA, 15 bp, Homo sapiens
gtaattagtaacatg

SEQ ID NO: 2556603 - DNA, 21 bp, Homo sapiens
gtaattatcgggaacagtgtt

SEQ ID NO: 2556604 - DNA, 14 bp, Homo sapiens
gtaattctaaatga

SEQ ID NO: 2556605 - DNA, 15 bp, Homo sapiens
gtaattctaaatgaa

SEQ ID NO: 2556606 - DNA, 16 bp, Homo sapiens
gtaattgaataaagtt

SEQ ID NO: 2556607 - DNA, 16 bp, Homo sapiens
gtaattgcttacattt

SEQ ID NO: 2556608 - DNA, 22 bp, Homo sapiens
gtaattgcttacatttttacaa

SEQ ID NO: 2556609 - DNA, 21 bp, Homo sapiens
gtaattgttgctaatcttctt

SEQ ID NO: 2556610 - DNA, 19 bp, Homo sapiens
gtaatttaaaattgtgatg

SEQ ID NO: 2556611 - DNA, 23 bp, Homo sapiens
gtaatttaaaattgtgatgtgtc

SEQ ID NO: 2556612 - DNA, 17 bp, Homo sapiens
gtaatttgtgatacaat

SEQ ID NO: 2556613 - DNA, 22 bp, Homo sapiens
gtaatttgtgatacaatgctgt

SEQ ID NO: 2556614 - DNA, 16 bp, Homo sapiens
gtaatttttttcttat

SEQ ID NO: 2556615 - DNA, 14 bp, Homo sapiens
gtacaaaataaaca

SEQ ID NO: 2556616 - DNA, 20 bp, Homo sapiens
gtacaatgactttattgcat

SEQ ID NO: 2556617 - DNA, 21 bp, Homo sapiens
gtacaatgactttattgcatc

SEQ ID NO: 2556618 - DNA, 17 bp, Homo sapiens
gtacacgtgtcctgtag

SEQ ID NO: 2556619 - DNA, 14 bp, Homo sapiens
gtacactgaatatt

SEQ ID NO: 2556620 - DNA, 15 bp, Homo sapiens
gtacactgaatattt

SEQ ID NO: 2556621 - DNA, 21 bp, Homo sapiens
gtacactgtttcaaactttac

SEQ ID NO: 2556622 - DNA, 12 bp, Homo sapiens
gtacactttttt

SEQ ID NO: 2556623 - DNA, 17 bp, Homo sapiens
gtacagacgtatgctta

SEQ ID NO: 2556624 - DNA, 19 bp, Homo sapiens
gtacagatgaatgataaac

SEQ ID NO: 2556625 - DNA, 14 bp, Homo sapiens
gtacagtctgtcat

SEQ ID NO: 2556626 - DNA, 13 bp, Homo sapiens
gtacagtcttgta

SEQ ID NO: 2556627 - DNA, 22 bp, Homo sapiens
gtacagttcttcgggaagagag

SEQ ID NO: 2556628 - DNA, 23 bp, Homo sapiens
gtacagttcttcgggaagagagg

SEQ ID NO: 2556629 - DNA, 15 bp, Homo sapiens
gtacagtttgctgta

SEQ ID NO: 2556630 - DNA, 13 bp, Homo sapiens
gtacagtttttat

SEQ ID NO: 2556631 - DNA, 22 bp, Homo sapiens
gtacataaaggtggtatgtgtg

SEQ ID NO: 2556632 - DNA, 12 bp, Homo sapiens
gtacatagccta

SEQ ID NO: 2556633 - DNA, 14 bp, Homo sapiens
gtacatgaaaacac

SEQ ID NO: 2556634 - DNA, 15 bp, Homo sapiens
gtacatgaaaacaca

SEQ ID NO: 2556635 - DNA, 18 bp, Homo sapiens
gtacatttatgatttaat

SEQ ID NO: 2556636 - DNA, 21 bp, Homo sapiens
gtacatttatgatttaataaa

SEQ ID NO: 2556637 - DNA, 14 bp, Homo sapiens
gtacatttccctgt

SEQ ID NO: 2556638 - DNA, 16 bp, Homo sapiens
gtacatttccctgtgc

SEQ ID NO: 2556639 - DNA, 17 bp, Homo sapiens
gtacatttctgaaatga

SEQ ID NO: 2556640 - DNA, 21 bp, Homo sapiens
gtaccaatcattttaattatt

SEQ ID NO: 2556641 - DNA, 16 bp, Homo sapiens
gtaccagataaaatta

SEQ ID NO: 2556642 - DNA, 16 bp, Homo sapiens
gtaccagcaatatgta

SEQ ID NO: 2556643 - DNA, 20 bp, Homo sapiens
gtacccagccatctgcccag

SEQ ID NO: 2556644 - DNA, 21 bp, Homo sapiens
gtacccagccatctgcccagg

SEQ ID NO: 2556645 - DNA, 22 bp, Homo sapiens
gtaccccaccctcagcacccct

SEQ ID NO: 2556646 - DNA, 18 bp, Homo sapiens
gtaccctctcagctccag

SEQ ID NO: 2556647 - DNA, 15 bp, Homo sapiens
gtaccctctggaggg

SEQ ID NO: 2556648 - DNA, 19 bp, Homo sapiens
gtacctataaagtaaagct

SEQ ID NO: 2556649 - DNA, 20 bp, Homo sapiens
gtacctataaagtaaagcta

SEQ ID NO: 2556650 - DNA, 21 bp, Homo sapiens
gtacctcttgagccttgaact

SEQ ID NO: 2556651 - DNA, 22 bp, Homo sapiens
gtacctcttgagccttgaactt

SEQ ID NO: 2556652 - DNA, 12 bp, Homo sapiens
gtacctgaaaag

SEQ ID NO: 2556653 - DNA, 15 bp, Homo sapiens
gtacctggaggagga

SEQ ID NO: 2556654 - DNA, 14 bp, Homo sapiens
gtaccttgaacact

SEQ ID NO: 2556655 - DNA, 15 bp, Homo sapiens
gtacgtctgacaggc

SEQ ID NO: 2556656 - DNA, 17 bp, Homo sapiens
gtacgtctgacaggcaa

SEQ ID NO: 2556657 - DNA, 15 bp, Homo sapiens
gtacgttgtgcattt

SEQ ID NO: 2556658 - DNA, 23 bp, Homo sapiens
gtactaaggaatctttctgcttt

SEQ ID NO: 2556659 - DNA, 21 bp, Homo sapiens
gtactactagatgtctttagg

SEQ ID NO: 2556660 - DNA, 13 bp, Homo sapiens
gtactatgtatca

SEQ ID NO: 2556661 - DNA, 13 bp, Homo sapiens
gtactattctgat

SEQ ID NO: 2556662 - DNA, 17 bp, Homo sapiens
gtactcaggaggctgag

SEQ ID NO: 2556663 - DNA, 14 bp, Homo sapiens
gtactctcctagag

SEQ ID NO: 2556664 - DNA, 14 bp, Homo sapiens
gtactcttccgaaa

SEQ ID NO: 2556665 - DNA, 22 bp, Homo sapiens
gtactcttccgaaaaatcctct

SEQ ID NO: 2556666 - DNA, 12 bp, Homo sapiens
gtactgagattt

SEQ ID NO: 2556667 - DNA, 16 bp, Homo sapiens
gtactgatttttgtaa

SEQ ID NO: 2556668 - DNA, 16 bp, Homo sapiens
gtactgtaaagagacc

SEQ ID NO: 2556669 - DNA, 18 bp, Homo sapiens
gtactgttctgtgtcttt

SEQ ID NO: 2556670 - DNA, 17 bp, Homo sapiens
gtacttaaatgaaagca

SEQ ID NO: 2556671 - DNA, 19 bp, Homo sapiens
gtacttaaatgaaagcatg

SEQ ID NO: 2556672 - DNA, 15 bp, Homo sapiens
gtacttctccaccct

SEQ ID NO: 2556673 - DNA, 16 bp, Homo sapiens
gtacttctccaccctg

SEQ ID NO: 2556674 - DNA, 21 bp, Homo sapiens
gtacttctccaccctgctctc

SEQ ID NO: 2556675 - DNA, 11 bp, Homo sapiens
gtacttgtcaa

SEQ ID NO: 2556676 - DNA, 16 bp, Homo sapiens
gtacttgtggacacag

SEQ ID NO: 2556677 - DNA, 22 bp, Homo sapiens
gtacttttatgatgtatattta

SEQ ID NO: 2556678 - DNA, 19 bp, Homo sapiens
gtagaaactgcagggaaaa

SEQ ID NO: 2556679 - DNA, 18 bp, Homo sapiens
gtagaaagacagagctgg

SEQ ID NO: 2556680 - DNA, 22 bp, Homo sapiens
gtagaaaggggcccagtcctgg

SEQ ID NO: 2556681 - DNA, 23 bp, Homo sapiens
gtagaaatatctgaaaatgtatg

SEQ ID NO: 2556682 - DNA, 22 bp, Homo sapiens
gtagaacacaaggtcatttgct

SEQ ID NO: 2556683 - DNA, 18 bp, Homo sapiens
gtagaacgtaaccacgga

SEQ ID NO: 2556684 - DNA, 17 bp, Homo sapiens
gtagaatgtattgtacc

SEQ ID NO: 2556685 - DNA, 20 bp, Homo sapiens
gtagaatgtattgtaccttt

SEQ ID NO: 2556686 - DNA, 23 bp, Homo sapiens
gtagaatgtattgtaccttttaa

SEQ ID NO: 2556687 - DNA, 14 bp, Homo sapiens
gtagaccaaaataa

SEQ ID NO: 2556688 - DNA, 11 bp, Homo sapiens
gtagagacagg

SEQ ID NO: 2556689 - DNA, 12 bp, Homo sapiens
gtagagacaggg

SEQ ID NO: 2556690 - DNA, 18 bp, Homo sapiens
gtagagaccgagcctctg

SEQ ID NO: 2556691 - DNA, 15 bp, Homo sapiens
gtagagtcatctcca

SEQ ID NO: 2556692 - DNA, 23 bp, Homo sapiens
gtagagtcatctccatcagctgt

SEQ ID NO: 2556693 - DNA, 16 bp, Homo sapiens
gtagagttaagaagct

SEQ ID NO: 2556694 - DNA, 17 bp, Homo sapiens
gtagagttaagaagctg

SEQ ID NO: 2556695 - DNA, 18 bp, Homo sapiens
gtagagttaagaagctgt

SEQ ID NO: 2556696 - DNA, 12 bp, Homo sapiens
gtagatagaaat

SEQ ID NO: 2556697 - DNA, 13 bp, Homo sapiens
gtagatagaaata

SEQ ID NO: 2556698 - DNA, 19 bp, Homo sapiens
gtagatattttttctgaat

SEQ ID NO: 2556699 - DNA, 19 bp, Homo sapiens
gtagatcaccagaataaac

SEQ ID NO: 2556700 - DNA, 23 bp, Homo sapiens
gtagatgttcagattgctttgat

SEQ ID NO: 2556701 - DNA, 13 bp, Homo sapiens
gtagattctgtgg

SEQ ID NO: 2556702 - DNA, 19 bp, Homo sapiens
gtagatttatttcatcata

SEQ ID NO: 2556703 - DNA, 16 bp, Homo sapiens
gtagattttctttaaa

SEQ ID NO: 2556704 - DNA, 12 bp, Homo sapiens
gtagcagctgga

SEQ ID NO: 2556705 - DNA, 15 bp, Homo sapiens
gtagcagtagatgca

SEQ ID NO: 2556706 - DNA, 15 bp, Homo sapiens
gtagcattacagtgg

SEQ ID NO: 2556707 - DNA, 14 bp, Homo sapiens
gtagccatgggacc

SEQ ID NO: 2556708 - DNA, 15 bp, Homo sapiens
gtagccatgggacca

SEQ ID NO: 2556709 - DNA, 21 bp, Homo sapiens
gtagcccacacttgagaggat

SEQ ID NO: 2556710 - DNA, 16 bp, Homo sapiens
gtagcccgcctgccag

SEQ ID NO: 2556711 - DNA, 21 bp, Homo sapiens
gtagcctcgccgtctgtgaat

SEQ ID NO: 2556712 - DNA, 15 bp, Homo sapiens
gtagctgcccctggc

SEQ ID NO: 2556713 - DNA, 16 bp, Homo sapiens
gtagctgcccctggct

SEQ ID NO: 2556714 - DNA, 17 bp, Homo sapiens
gtagctggattacaggc

SEQ ID NO: 2556715 - DNA, 21 bp, Homo sapiens
gtagctgggactacaggcacc

SEQ ID NO: 2556716 - DNA, 17 bp, Homo sapiens
gtaggaagagtagcatt

SEQ ID NO: 2556717 - DNA, 19 bp, Homo sapiens
gtaggactttcctaaatgt

SEQ ID NO: 2556718 - DNA, 12 bp, Homo sapiens
tttatgatttaa

SEQ ID NO: 2556719 - DNA, 18 bp, Homo sapiens
tttatgatttaataaaat

SEQ ID NO: 2556720 - DNA, 19 bp, Homo sapiens
tttatgccttcttattgct

SEQ ID NO: 2556721 - DNA, 16 bp, Homo sapiens
tttatgctcaatccat

SEQ ID NO: 2556722 - DNA, 12 bp, Homo sapiens
tttatgctttaa

SEQ ID NO: 2556723 - DNA, 23 bp, Homo sapiens
tttatggaggatggagagagggg

SEQ ID NO: 2556724 - DNA, 12 bp, Homo sapiens
tttatggcctca

SEQ ID NO: 2556725 - DNA, 16 bp, Homo sapiens
tttatggcttttgtgc

SEQ ID NO: 2556726 - DNA, 22 bp, Homo sapiens
tttatgtaaactgcattagaaa

SEQ ID NO: 2556727 - DNA, 15 bp, Homo sapiens
tttattaaaatctta

SEQ ID NO: 2556728 - DNA, 16 bp, Homo sapiens
tttattaaaatcttaa

SEQ ID NO: 2556729 - DNA, 14 bp, Homo sapiens
tttattaaaatgat

SEQ ID NO: 2556730 - DNA, 21 bp, Homo sapiens
tttattaaaatgattgtaaaa

SEQ ID NO: 2556731 - DNA, 17 bp, Homo sapiens
tttattaaacagatttt

SEQ ID NO: 2556732 - DNA, 19 bp, Homo sapiens
tttattaaatgcccagccc

SEQ ID NO: 2556733 - DNA, 18 bp, Homo sapiens
tttattaacaaattatgt

SEQ ID NO: 2556734 - DNA, 22 bp, Homo sapiens
ttttccctctttggctcccctg

SEQ ID NO: 2556735 - DNA, 20 bp, Homo sapiens
ttttcctaagtgattgtatg

SEQ ID NO: 2556736 - DNA, 20 bp, Homo sapiens
ttttcctaataaagttctgt

SEQ ID NO: 2556737 - DNA, 18 bp, Homo sapiens
ttttcctattttcagccc

SEQ ID NO: 2556738 - DNA, 22 bp, Homo sapiens
ttttcctcccttgggttctgat

SEQ ID NO: 2556739 - DNA, 12 bp, Homo sapiens
ttttcctttaaa

SEQ ID NO: 2556740 - DNA, 16 bp, Homo sapiens
ttttcctttgtcatca

SEQ ID NO: 2556741 - DNA, 15 bp, Homo sapiens
ttttctaatgtggtt

SEQ ID NO: 2556742 - DNA, 13 bp, Homo sapiens
ttttctagacttt

SEQ ID NO: 2556743 - DNA, 14 bp, Homo sapiens
ttttctagactttc

SEQ ID NO: 2556744 - DNA, 18 bp, Homo sapiens
ttttctagcccgaataca

SEQ ID NO: 2556745 - DNA, 15 bp, Homo sapiens
ttttctcaaagtttt

SEQ ID NO: 2556746 - DNA, 13 bp, Homo sapiens
ttttctcctccca

SEQ ID NO: 2556747 - DNA, 19 bp, Homo sapiens
ttttctcctcccaggaact

SEQ ID NO: 2556748 - DNA, 17 bp, Homo sapiens
ttttctctttctctcct

SEQ ID NO: 2556749 - DNA, 17 bp, Homo sapiens
ttttctgaataacattt

SEQ ID NO: 2556750 - DNA, 18 bp, Homo sapiens
ttttctgagaaagactat

SEQ ID NO: 2556751 - DNA, 22 bp, Homo sapiens
ttttctgagcccgggctgcctg

SEQ ID NO: 2556752 - DNA, 23 bp, Homo sapiens
ttttctgattgtaacgttgctgt

SEQ ID NO: 2556753 - DNA, 16 bp, Homo sapiens
ttttctggtagataga

SEQ ID NO: 2556754 - DNA, 19 bp, Homo sapiens
ttttctggtagatagaaat

SEQ ID NO: 2556755 - DNA, 13 bp, Homo sapiens
ttttctgttcttt

SEQ ID NO: 2556756 - DNA, 23 bp, Homo sapiens
ttttcttaaataataaagatcat

SEQ ID NO: 2556757 - DNA, 14 bp, Homo sapiens
ttttcttcttccct

SEQ ID NO: 2556758 - DNA, 15 bp, Homo sapiens
ttttcttcttccctc

SEQ ID NO: 2556759 - DNA, 17 bp, Homo sapiens
ttttcttgcatgaggct

SEQ ID NO: 2556760 - DNA, 21 bp, Homo sapiens
ttttcttgccaatgaggtctg

SEQ ID NO: 2556761 - DNA, 15 bp, Homo sapiens
ttttctttaaaagaa

SEQ ID NO: 2556762 - DNA, 14 bp, Homo sapiens
ttttctttgaaatt

SEQ ID NO: 2556763 - DNA, 22 bp, Homo sapiens
ttttgaaaaattcctattgtga

SEQ ID NO: 2556764 - DNA, 20 bp, Homo sapiens
ttttgaaatctgtatctgta

SEQ ID NO: 2556765 - DNA, 21 bp, Homo sapiens
ttttgaactaataaaagcata

SEQ ID NO: 2556766 - DNA, 16 bp, Homo sapiens
ttttgaatccatgctt

SEQ ID NO: 2556767 - DNA, 14 bp, Homo sapiens
ttttgaatgttatt

SEQ ID NO: 2556768 - DNA, 22 bp, Homo sapiens
ttttgactagggattcaggctg

SEQ ID NO: 2556769 - DNA, 11 bp, Homo sapiens
ttttgagaaag

SEQ ID NO: 2556770 - DNA, 17 bp, Homo sapiens
ttttgagacagaatctc

SEQ ID NO: 2556771 - DNA, 17 bp, Homo sapiens
ttttgagcaactttctt

SEQ ID NO: 2556772 - DNA, 18 bp, Homo sapiens
ttttgagtggatgatgtt

SEQ ID NO: 2556773 - DNA, 22 bp, Homo sapiens
ttttgataaagtagtaaaaatt

SEQ ID NO: 2556774 - DNA, 19 bp, Homo sapiens
ttttgataaagtttctcag

SEQ ID NO: 2556775 - DNA, 20 bp, Homo sapiens
ttttgataaagtttctcaga

SEQ ID NO: 2556776 - DNA, 21 bp, Homo sapiens
ttttgataaagtttctcagat

SEQ ID NO: 2556777 - DNA, 12 bp, Homo sapiens
ttttgattgaag

SEQ ID NO: 2556778 - DNA, 17 bp, Homo sapiens
ttttgcaatggctatat

SEQ ID NO: 2556779 - DNA, 18 bp, Homo sapiens
ttttgcaccccatgctgt

SEQ ID NO: 2556780 - DNA, 13 bp, Homo sapiens
ttttgcacccctc

SEQ ID NO: 2556781 - DNA, 19 bp, Homo sapiens
ttttgcatggcacttgcat

SEQ ID NO: 2556782 - DNA, 15 bp, Homo sapiens
ttttgcattcaaatt

SEQ ID NO: 2556783 - DNA, 13 bp, Homo sapiens
ttttgccctttga

SEQ ID NO: 2556784 - DNA, 13 bp, Homo sapiens
ttttgccttcatt

SEQ ID NO: 2556785 - DNA, 10 bp, Homo sapiens
ttttgctgtt

SEQ ID NO: 2556786 - DNA, 21 bp, Homo sapiens
ttttgctttcgaactgctagt

SEQ ID NO: 2556787 - DNA, 15 bp, Homo sapiens
ttttggaggtgctta

SEQ ID NO: 2556788 - DNA, 19 bp, Homo sapiens
ttttggcccccgagctggg

SEQ ID NO: 2556789 - DNA, 21 bp, Homo sapiens
ttttggggatatgcttagtaa

SEQ ID NO: 2556790 - DNA, 15 bp, Homo sapiens
ttttggtctgtgtga

SEQ ID NO: 2556791 - DNA, 15 bp, Homo sapiens
ttttggttgctttaa

SEQ ID NO: 2556792 - DNA, 22 bp, Homo sapiens
ttttgtaggggtcaaagaaatg

SEQ ID NO: 2556793 - DNA, 17 bp, Homo sapiens
ttttgtatagtaaagtg

SEQ ID NO: 2556794 - DNA, 23 bp, Homo sapiens
ttttgtatagttgtggacattta

SEQ ID NO: 2556795 - DNA, 13 bp, Homo sapiens
ttttgtatatatc

SEQ ID NO: 2556796 - DNA, 19 bp, Homo sapiens
ttttgtatctacatctttt

SEQ ID NO: 2556797 - DNA, 17 bp, Homo sapiens
ttttgtattctctgagc

SEQ ID NO: 2556798 - DNA, 19 bp, Homo sapiens
ttttgtattttccaagtgt

SEQ ID NO: 2556799 - DNA, 15 bp, Homo sapiens
ttttgtatttttaat

SEQ ID NO: 2556800 - DNA, 16 bp, Homo sapiens
ttttgtcatataagat

SEQ ID NO: 2556801 - DNA, 18 bp, Homo sapiens
ttttgtcattttctccat

SEQ ID NO: 2556802 - DNA, 14 bp, Homo sapiens
ttttgtgaactttt

SEQ ID NO: 2556803 - DNA, 21 bp, Homo sapiens
ttttgtgaagtttaattgact

SEQ ID NO: 2556804 - DNA, 23 bp, Homo sapiens
ttttgtgactatatagagatgtt

SEQ ID NO: 2556805 - DNA, 13 bp, Homo sapiens
ttttgtgagatgt

SEQ ID NO: 2556806 - DNA, 21 bp, Homo sapiens
ttttgtgatgtcccaacttgt

SEQ ID NO: 2556807 - DNA, 19 bp, Homo sapiens
ttttgtgatttagaactgt

SEQ ID NO: 2556808 - DNA, 17 bp, Homo sapiens
ttttgtgcattatctag

SEQ ID NO: 2556809 - DNA, 21 bp, Homo sapiens
ttttgtggtcattaagcattg

SEQ ID NO: 2556810 - DNA, 19 bp, Homo sapiens
ttttgttcttaattgcact

SEQ ID NO: 2556811 - DNA, 19 bp, Homo sapiens
ttttgtttcatattgatgt

SEQ ID NO: 2556812 - DNA, 15 bp, Homo sapiens
ttttgtttcttccaa

SEQ ID NO: 2556813 - DNA, 15 bp, Homo sapiens
ttttgttttcattat

SEQ ID NO: 2556814 - DNA, 17 bp, Homo sapiens
ttttgtttttcattcag

SEQ ID NO: 2556815 - DNA, 20 bp, Homo sapiens
tttttaaaaatgcaaatcct

SEQ ID NO: 2556816 - DNA, 20 bp, Homo sapiens
tttttaaagtgtttctgtta

SEQ ID NO: 2556817 - DNA, 11 bp, Homo sapiens
tttttaaatgc

SEQ ID NO: 2556818 - DNA, 20 bp, Homo sapiens
tttttaaatgtaaagatatt

SEQ ID NO: 2556819 - DNA, 23 bp, Homo sapiens
tttttaagaaaaaggatgcacag

SEQ ID NO: 2556820 - DNA, 18 bp, Homo sapiens
tttttaagccttaaagga

SEQ ID NO: 2556821 - DNA, 19 bp, Homo sapiens
tttttaagtgctgcattta

SEQ ID NO: 2556822 - DNA, 17 bp, Homo sapiens
tttttaataaagacagg

SEQ ID NO: 2556823 - DNA, 20 bp, Homo sapiens
tttttaataaagacagggtt

SEQ ID NO: 2556824 - DNA, 12 bp, Homo sapiens
tttttaatgtgc

SEQ ID NO: 2556825 - DNA, 19 bp, Homo sapiens
tttttaatgtgctgtgtaa

SEQ ID NO: 2556826 - DNA, 20 bp, Homo sapiens
tttttaatgtgctgtgtaaa

SEQ ID NO: 2556827 - DNA, 21 bp, Homo sapiens
tttttaatgtgctgtgtaaag

SEQ ID NO: 2556828 - DNA, 16 bp, Homo sapiens
tttttactacagttgt

SEQ ID NO: 2556829 - DNA, 14 bp, Homo sapiens
tttttactgaacaa

SEQ ID NO: 2556830 - DNA, 22 bp, Homo sapiens
tttttagacagagtctcactgt

SEQ ID NO: 2556831 - DNA, 23 bp, Homo sapiens
tttttatctccccttcacatgca

SEQ ID NO: 2556832 - DNA, 17 bp, Homo sapiens
tttttatcttgggactg

SEQ ID NO: 2556833 - DNA, 12 bp, Homo sapiens
tttttatggctt

SEQ ID NO: 2556834 - DNA, 23 bp, Homo sapiens
tttttattgaatctatttaagta

SEQ ID NO: 2556835 - DNA, 19 bp, Homo sapiens
tttttatttgtttgtgcat

SEQ ID NO: 2556836 - DNA, 13 bp, Homo sapiens
tttttcaattaaa

SEQ ID NO: 2556837 - DNA, 18 bp, Homo sapiens
tttttcaattaaacggat

SEQ ID NO: 2556838 - DNA, 13 bp, Homo sapiens
tttttcacatttt

SEQ ID NO: 2556839 - DNA, 10 bp, Homo sapiens
tttttcagac

SEQ ID NO: 2556840 - DNA, 11 bp, Homo sapiens
tttttcagacc

SEQ ID NO: 2556841 - DNA, 12 bp, Homo sapiens
tttttcagaccg

SEQ ID NO: 2556842 - DNA, 14 bp, Homo sapiens
tttttcagaccgaa

SEQ ID NO: 2556843 - DNA, 11 bp, Homo sapiens
tttttcatgat

SEQ ID NO: 2556844 - DNA, 11 bp, Homo sapiens
tttttcatgtt

SEQ ID NO: 2556845 - DNA, 20 bp, Homo sapiens
tttttcatgttttaacaaaa

SEQ ID NO: 2556846 - DNA, 21 bp, Homo sapiens
tttttcattgatatgaaaaat

SEQ ID NO: 2556847 - DNA, 16 bp, Homo sapiens
tttttccaaaaaaata

SEQ ID NO: 2556848 - DNA, 14 bp, Homo sapiens
tttttccaactgtg

SEQ ID NO: 2556849 - DNA, 20 bp, Homo sapiens
tttttccactttgttcttta

SEQ ID NO: 2556850 - DNA, 16 bp, Homo sapiens
tttttccccaaagtct

SEQ ID NO: 2556851 - DNA, 22 bp, Homo sapiens
tttttccttgtccccacactcc

SEQ ID NO: 2556852 - DNA, 18 bp, Homo sapiens
tttttctcaaagttttga

SEQ ID NO: 2556853 - DNA, 19 bp, Homo sapiens
tttttctcatgaatctgca

SEQ ID NO: 2556854 - DNA, 11 bp, Homo sapiens
tttttctctaa

SEQ ID NO: 2556855 - DNA, 17 bp, Homo sapiens
tttttctgcttttgaaa

SEQ ID NO: 2556856 - DNA, 13 bp, Homo sapiens
tttttcttgtaat

SEQ ID NO: 2556857 - DNA, 17 bp, Homo sapiens
tttttctttataaactt

SEQ ID NO: 2556858 - DNA, 22 bp, Homo sapiens
tttttgaaggcagaaagcaaaa

SEQ ID NO: 2556859 - DNA, 20 bp, Homo sapiens
tttttgcaccccatgctgtt

SEQ ID NO: 2556860 - DNA, 23 bp, Homo sapiens
tttttgcaccccatgctgttgat

SEQ ID NO: 2556861 - DNA, 18 bp, Homo sapiens
tttttgcaggagcagtat

SEQ ID NO: 2556862 - DNA, 21 bp, Homo sapiens
tttttgcatggcacttgcatc

SEQ ID NO: 2556863 - DNA, 21 bp, Homo sapiens
taatagaagaacatccaagga

SEQ ID NO: 2556864 - DNA, 21 bp, Homo sapiens
taatagcttttattgtataaa

SEQ ID NO: 2556865 - DNA, 21 bp, Homo sapiens
taatagtgcttaaaaatcatt

SEQ ID NO: 2556866 - DNA, 20 bp, Homo sapiens
taatagtgttaatcaattta

SEQ ID NO: 2556867 - DNA, 21 bp, Homo sapiens
taatagttcaggtaacaggca

SEQ ID NO: 2556868 - DNA, 17 bp, Homo sapiens
taatatatatctgctgt

SEQ ID NO: 2556869 - DNA, 13 bp, Homo sapiens
taatatatgttta

SEQ ID NO: 2556870 - DNA, 14 bp, Homo sapiens
taatatatgtttac

SEQ ID NO: 2556871 - DNA, 19 bp, Homo sapiens
taatatatttgtgtattta

SEQ ID NO: 2556872 - DNA, 20 bp, Homo sapiens
taatatatttgtgtatttaa

SEQ ID NO: 2556873 - DNA, 15 bp, Homo sapiens
taatatgcacacatt

SEQ ID NO: 2556874 - DNA, 18 bp, Homo sapiens
taatatgcacacattttt

SEQ ID NO: 2556875 - DNA, 15 bp, Homo sapiens
taatatggcaaaaat

SEQ ID NO: 2556876 - DNA, 18 bp, Homo sapiens
taatatgggcattgtagt

SEQ ID NO: 2556877 - DNA, 19 bp, Homo sapiens
taatatgggcattgtagtt

SEQ ID NO: 2556878 - DNA, 20 bp, Homo sapiens
taatatgggcattgtagtta

SEQ ID NO: 2556879 - DNA, 16 bp, Homo sapiens
taatatggggatgcag

SEQ ID NO: 2556880 - DNA, 22 bp, Homo sapiens
taatattaaaaatatggaactt

SEQ ID NO: 2556881 - DNA, 20 bp, Homo sapiens
taatattaaggaagacaatg

SEQ ID NO: 2556882 - DNA, 14 bp, Homo sapiens
taatattgagaaag

SEQ ID NO: 2556883 - DNA, 19 bp, Homo sapiens
taatattgagaaagaaact

SEQ ID NO: 2556884 - DNA, 21 bp, Homo sapiens
taatattgatatgcttataca

SEQ ID NO: 2556885 - DNA, 14 bp, Homo sapiens
taatcaagcctctg

SEQ ID NO: 2556886 - DNA, 22 bp, Homo sapiens
taatcaataaacgatttaattc

SEQ ID NO: 2556887 - DNA, 15 bp, Homo sapiens
taccctcctggctct

SEQ ID NO: 2556888 - DNA, 22 bp, Homo sapiens
taccctcgggcccacctggcca

SEQ ID NO: 2556889 - DNA, 13 bp, Homo sapiens
taccctctcagct

SEQ ID NO: 2556890 - DNA, 15 bp, Homo sapiens
taccctctcagctcc

SEQ ID NO: 2556891 - DNA, 21 bp, Homo sapiens
taccctctcagctccaggtgg

SEQ ID NO: 2556892 - DNA, 22 bp, Homo sapiens
taccctctggaggggtgtggct

SEQ ID NO: 2556893 - DNA, 17 bp, Homo sapiens
taccctgagctgaggca

SEQ ID NO: 2556894 - DNA, 21 bp, Homo sapiens
taccctgcgcccagtccttcc

SEQ ID NO: 2556895 - DNA, 19 bp, Homo sapiens
taccctttttctccagctg

SEQ ID NO: 2556896 - DNA, 19 bp, Homo sapiens
taccgtgagcgacaaagat

SEQ ID NO: 2556897 - DNA, 19 bp, Homo sapiens
tacctaaaaggaaatctca

SEQ ID NO: 2556898 - DNA, 14 bp, Homo sapiens
tacctaaacagata

SEQ ID NO: 2556899 - DNA, 15 bp, Homo sapiens
tacctaacattattt

SEQ ID NO: 2556900 - DNA, 23 bp, Homo sapiens
tacctacatgtatttgtttgcat

SEQ ID NO: 2556901 - DNA, 13 bp, Homo sapiens
tacctatgtaaca

SEQ ID NO: 2556902 - DNA, 13 bp, Homo sapiens
tacctattttcat

SEQ ID NO: 2556903 - DNA, 14 bp, Homo sapiens
tacctcagcctaga

SEQ ID NO: 2556904 - DNA, 16 bp, Homo sapiens
tacctcagcctagacc

SEQ ID NO: 2556905 - DNA, 14 bp, Homo sapiens
tacctcaggcagct

SEQ ID NO: 2556906 - DNA, 17 bp, Homo sapiens
tacctcaggcagctcaa

SEQ ID NO: 2556907 - DNA, 18 bp, Homo sapiens
tacctcaggcagctcaag

SEQ ID NO: 2556908 - DNA, 14 bp, Homo sapiens
tacctcctgtctct

SEQ ID NO: 2556909 - DNA, 15 bp, Homo sapiens
tacctcctgtctctg

SEQ ID NO: 2556910 - DNA, 12 bp, Homo sapiens
tacctctgtgtg

SEQ ID NO: 2556911 - DNA, 14 bp, Homo sapiens
tacctctgtgtgct

SEQ ID NO: 2556912 - DNA, 17 bp, Homo sapiens
tacctcttattgcaaaa

SEQ ID NO: 2556913 - DNA, 22 bp, Homo sapiens
tacctcttgagccttgaacttt

SEQ ID NO: 2556914 - DNA, 23 bp, Homo sapiens
tacctcttgagccttgaactttg

SEQ ID NO: 2556915 - DNA, 20 bp, Homo sapiens
tacctgaaaacactgtgcac

SEQ ID NO: 2556916 - DNA, 21 bp, Homo sapiens
tacctgaaaacactgtgcaca

SEQ ID NO: 2556917 - DNA, 16 bp, Homo sapiens
tacctgaggggcctct

SEQ ID NO: 2556918 - DNA, 14 bp, Homo sapiens
tacctgggaagggg

SEQ ID NO: 2556919 - DNA, 17 bp, Homo sapiens
tacctgtccccctgaca

SEQ ID NO: 2556920 - DNA, 12 bp, Homo sapiens
tacctgtgcctg

SEQ ID NO: 2556921 - DNA, 20 bp, Homo sapiens
tacctgtgcgttactaattg

SEQ ID NO: 2556922 - DNA, 16 bp, Homo sapiens
tacctgttcagtgtcc

SEQ ID NO: 2556923 - DNA, 20 bp, Homo sapiens
tacctgttcagtgtcccggg

SEQ ID NO: 2556924 - DNA, 14 bp, Homo sapiens
taccttcaataaag

SEQ ID NO: 2556925 - DNA, 14 bp, Homo sapiens
taccttcatttcag

SEQ ID NO: 2556926 - DNA, 14 bp, Homo sapiens
taccttctgtagtt

SEQ ID NO: 2556927 - DNA, 18 bp, Homo sapiens
taccttgaacactggggg

SEQ ID NO: 2556928 - DNA, 15 bp, Homo sapiens
taccttgaggtcttt

SEQ ID NO: 2556929 - DNA, 14 bp, Homo sapiens
tacctttatggttt

SEQ ID NO: 2556930 - DNA, 16 bp, Homo sapiens
taccttttaattaatg

SEQ ID NO: 2556931 - DNA, 20 bp, Homo sapiens
tacctttttatttgcatgtg

SEQ ID NO: 2556932 - DNA, 13 bp, Homo sapiens
taccttttttaga

SEQ ID NO: 2556933 - DNA, 19 bp, Homo sapiens
taccttttttagagttgat

SEQ ID NO: 2556934 - DNA, 17 bp, Homo sapiens
taccttttttatacata

SEQ ID NO: 2556935 - DNA, 22 bp, Homo sapiens
taccttttttatacataaacaa

SEQ ID NO: 2556936 - DNA, 14 bp, Homo sapiens
tacgaatacttttg

SEQ ID NO: 2556937 - DNA, 14 bp, Homo sapiens
tacgactttatttt

SEQ ID NO: 2556938 - DNA, 15 bp, Homo sapiens
tacgactttattttc

SEQ ID NO: 2556939 - DNA, 19 bp, Homo sapiens
tacgcccaacccttcccca

SEQ ID NO: 2556940 - DNA, 13 bp, Homo sapiens
tacgctagttatc

SEQ ID NO: 2556941 - DNA, 15 bp, Homo sapiens
tacgtacacatttta

SEQ ID NO: 2556942 - DNA, 13 bp, Homo sapiens
tacgtatgagacg

SEQ ID NO: 2556943 - DNA, 14 bp, Homo sapiens
tacgtctgggagaa

SEQ ID NO: 2556944 - DNA, 14 bp, Homo sapiens
tacgtgagccaggt

SEQ ID NO: 2556945 - DNA, 14 bp, Homo sapiens
tacgttaccaggca

SEQ ID NO: 2556946 - DNA, 16 bp, Homo sapiens
tacgttgtgcatttgg

SEQ ID NO: 2556947 - DNA, 18 bp, Homo sapiens
tactaaccagcagaaatg

SEQ ID NO: 2556948 - DNA, 15 bp, Homo sapiens
tactaagaaaagata

SEQ ID NO: 2556949 - DNA, 15 bp, Homo sapiens
tactaagatgacatt

SEQ ID NO: 2556950 - DNA, 19 bp, Homo sapiens
tactaagatgacattgcta

SEQ ID NO: 2556951 - DNA, 20 bp, Homo sapiens
tactaagcatagcaaacaga

SEQ ID NO: 2556952 - DNA, 22 bp, Homo sapiens
tactaaggagtaatctgtgtac

SEQ ID NO: 2556953 - DNA, 22 bp, Homo sapiens
tactaataaaatttaaaagtct

SEQ ID NO: 2556954 - DNA, 13 bp, Homo sapiens
tactaatgatgtt

SEQ ID NO: 2556955 - DNA, 15 bp, Homo sapiens
tactaatgatgtttt

SEQ ID NO: 2556956 - DNA, 16 bp, Homo sapiens
tactacaaaaaagttg

SEQ ID NO: 2556957 - DNA, 18 bp, Homo sapiens
tactacaaaatttgaaat

SEQ ID NO: 2556958 - DNA, 20 bp, Homo sapiens
tactacagtcctcccatctc

SEQ ID NO: 2556959 - DNA, 23 bp, Homo sapiens
tactacagttgttttttgaaaac

SEQ ID NO: 2556960 - DNA, 13 bp, Homo sapiens
tactacagtttgt

SEQ ID NO: 2556961 - DNA, 13 bp, Homo sapiens
tactactcctgta

SEQ ID NO: 2556962 - DNA, 16 bp, Homo sapiens
tactactgaatctcta

SEQ ID NO: 2556963 - DNA, 17 bp, Homo sapiens
tactagaagatgaatac

SEQ ID NO: 2556964 - DNA, 17 bp, Homo sapiens
tactagcatatgagttt

SEQ ID NO: 2556965 - DNA, 18 bp, Homo sapiens
tactagggagaaggtttc

SEQ ID NO: 2556966 - DNA, 19 bp, Homo sapiens
tactatatatgtgatgatc

SEQ ID NO: 2556967 - DNA, 19 bp, Homo sapiens
tactatttaaagcctcctc

SEQ ID NO: 2556968 - DNA, 22 bp, Homo sapiens
tactatttaaagcctcctcatc

SEQ ID NO: 2556969 - DNA, 13 bp, Homo sapiens
tactatttagata

SEQ ID NO: 2556970 - DNA, 18 bp, Homo sapiens
tactattttacttctaga

SEQ ID NO: 2556971 - DNA, 14 bp, Homo sapiens
tactcaaccctctc

SEQ ID NO: 2556972 - DNA, 15 bp, Homo sapiens
tactcaagaggctga

SEQ ID NO: 2556973 - DNA, 22 bp, Homo sapiens
tactcaattgataaacatttaa

SEQ ID NO: 2556974 - DNA, 16 bp, Homo sapiens
tactcagaagcctgag

SEQ ID NO: 2556975 - DNA, 17 bp, Homo sapiens
tactcagaagcctgagg

SEQ ID NO: 2556976 - DNA, 14 bp, Homo sapiens
tactcagaattaag

SEQ ID NO: 2556977 - DNA, 14 bp, Homo sapiens
tactcataatgtga

SEQ ID NO: 2556978 - DNA, 15 bp, Homo sapiens
tactcataatgtgaa

SEQ ID NO: 2556979 - DNA, 23 bp, Homo sapiens
tactcatatatatctatcttata

SEQ ID NO: 2556980 - DNA, 17 bp, Homo sapiens
tactcatgatcttgtga

SEQ ID NO: 2556981 - DNA, 14 bp, Homo sapiens
tactcatgtgtatg

SEQ ID NO: 2556982 - DNA, 20 bp, Homo sapiens
tactcatgtgtatgggcaaa

SEQ ID NO: 2556983 - DNA, 14 bp, Homo sapiens
tactccagtggtga

SEQ ID NO: 2556984 - DNA, 19 bp, Homo sapiens
tactccagtggtgaagaaa

SEQ ID NO: 2556985 - DNA, 12 bp, Homo sapiens
tactcccatctg

SEQ ID NO: 2556986 - DNA, 14 bp, Homo sapiens
tactcccatctgtg

SEQ ID NO: 2556987 - DNA, 20 bp, Homo sapiens
tactgtttgtcttctcccca

SEQ ID NO: 2556988 - DNA, 12 bp, Homo sapiens
tacttaaagatt

SEQ ID NO: 2556989 - DNA, 13 bp, Homo sapiens
tacttaataaatt

SEQ ID NO: 2556990 - DNA, 16 bp, Homo sapiens
tacttacctaaacaga

SEQ ID NO: 2556991 - DNA, 22 bp, Homo sapiens
tacttacctaaacagatataaa

SEQ ID NO: 2556992 - DNA, 18 bp, Homo sapiens
tacttagcaaagttttac

SEQ ID NO: 2556993 - DNA, 15 bp, Homo sapiens
tacttagcagctatc

SEQ ID NO: 2556994 - DNA, 19 bp, Homo sapiens
tacttcaaaagtattttcc

SEQ ID NO: 2556995 - DNA, 19 bp, Homo sapiens
tacttcaggggcacttcat

SEQ ID NO: 2556996 - DNA, 23 bp, Homo sapiens
tacttcccattttggaagttttc

SEQ ID NO: 2556997 - DNA, 19 bp, Homo sapiens
tacttcctatcaagccagt

SEQ ID NO: 2556998 - DNA, 14 bp, Homo sapiens
tacttcctcctccc

SEQ ID NO: 2556999 - DNA, 18 bp, Homo sapiens
tacttctccaccctgctc

SEQ ID NO: 2557000 - DNA, 16 bp, Homo sapiens
tacttcttatacattt

SEQ ID NO: 2557001 - DNA, 17 bp, Homo sapiens
tacttgggaagctgagg

SEQ ID NO: 2557002 - DNA, 19 bp, Homo sapiens
tacttgggaagctgaggcg

SEQ ID NO: 2557003 - DNA, 19 bp, Homo sapiens
tacttgggccatagctcct

SEQ ID NO: 2557004 - DNA, 19 bp, Homo sapiens
tacttgtggacacagctct

SEQ ID NO: 2557005 - DNA, 14 bp, Homo sapiens
tactttaaaggaaa

SEQ ID NO: 2557006 - DNA, 15 bp, Homo sapiens
tactttaaaggaaaa

SEQ ID NO: 2557007 - DNA, 22 bp, Homo sapiens
tactttaagcactacataaact

SEQ ID NO: 2557008 - DNA, 19 bp, Homo sapiens
tactttaccacccccacac

SEQ ID NO: 2557009 - DNA, 14 bp, Homo sapiens
tactttgacttttt

SEQ ID NO: 2557010 - DNA, 14 bp, Homo sapiens
tacttttaaactgt

SEQ ID NO: 2557011 - DNA, 21 bp, Homo sapiens
tacttttaaactgtgtacata

SEQ ID NO: 2557012 - DNA, 14 bp, Homo sapiens
tactttttaaatgt

SEQ ID NO: 2557013 - DNA, 18 bp, Homo sapiens
tacttttttcttatttaa

SEQ ID NO: 2557014 - DNA, 20 bp, Homo sapiens
tagaaaactgaaaatctaat

SEQ ID NO: 2557015 - DNA, 21 bp, Homo sapiens
tagaaaaggctaggtacacag

SEQ ID NO: 2557016 - DNA, 14 bp, Homo sapiens
tagaaaccttaata

SEQ ID NO: 2557017 - DNA, 19 bp, Homo sapiens
tagaaactcaccatgtaaa

SEQ ID NO: 2557018 - DNA, 15 bp, Homo sapiens
tagaaacttccaaat

SEQ ID NO: 2557019 - DNA, 17 bp, Homo sapiens
tagaaagacagagctgg

SEQ ID NO: 2557020 - DNA, 23 bp, Homo sapiens
tagaaataagtggttatttctca

SEQ ID NO: 2557021 - DNA, 16 bp, Homo sapiens
tagaaataatatgcat

SEQ ID NO: 2557022 - DNA, 20 bp, Homo sapiens
tagaaatatctgaaaatgta

SEQ ID NO: 2557023 - DNA, 21 bp, Homo sapiens
tagaaatatctgaaaatgtat

SEQ ID NO: 2557024 - DNA, 23 bp, Homo sapiens
tagaaatatctgaaaatgtatgt

SEQ ID NO: 2557025 - DNA, 19 bp, Homo sapiens
tagaaatgtaacttttgta

SEQ ID NO: 2557026 - DNA, 16 bp, Homo sapiens
tagaaatttccagaga

SEQ ID NO: 2557027 - DNA, 22 bp, Homo sapiens
tagaaatttttcagatgcttct

SEQ ID NO: 2557028 - DNA, 16 bp, Homo sapiens
tagaaccaagaagggc

SEQ ID NO: 2557029 - DNA, 17 bp, Homo sapiens
tagaaccaagaagggct

SEQ ID NO: 2557030 - DNA, 14 bp, Homo sapiens
tagaacctagaagg

SEQ ID NO: 2557031 - DNA, 23 bp, Homo sapiens
tagaacctagaagggctagaacc

SEQ ID NO: 2557032 - DNA, 16 bp, Homo sapiens
tagaacctggaagggc

SEQ ID NO: 2557033 - DNA, 23 bp, Homo sapiens
tagaacctggaagggctagaacc

SEQ ID NO: 2557034 - DNA, 13 bp, Homo sapiens
tagaacctggagg

SEQ ID NO: 2557035 - DNA, 22 bp, Homo sapiens
tagaacctggagggctagaacc

SEQ ID NO: 2557036 - DNA, 19 bp, Homo sapiens
tagaactgtatgtcagaca

SEQ ID NO: 2557037 - DNA, 22 bp, Homo sapiens
tagaacttggatgtacctgccc

SEQ ID NO: 2557038 - DNA, 12 bp, Homo sapiens
tagaagaactgc

SEQ ID NO: 2557039 - DNA, 20 bp, Homo sapiens
tagaagactctaccagactg

SEQ ID NO: 2557040 - DNA, 14 bp, Homo sapiens
tagaagcattcctt

SEQ ID NO: 2557041 - DNA, 20 bp, Homo sapiens
tagaagcattccttctttga

SEQ ID NO: 2557042 - DNA, 21 bp, Homo sapiens
tagaagcattccttctttgat

SEQ ID NO: 2557043 - DNA, 16 bp, Homo sapiens
tagaagctgtagtagc

SEQ ID NO: 2557044 - DNA, 15 bp, Homo sapiens
tagaaggagacagag

SEQ ID NO: 2557045 - DNA, 23 bp, Homo sapiens
tagaaggagacagagctggttgg

SEQ ID NO: 2557046 - DNA, 21 bp, Homo sapiens
tagaaggatgtacatttccaa

SEQ ID NO: 2557047 - DNA, 19 bp, Homo sapiens
tagaagggccagtcctgcc

SEQ ID NO: 2557048 - DNA, 22 bp, Homo sapiens
tagaagggctagaacctggaga

SEQ ID NO: 2557049 - DNA, 16 bp, Homo sapiens
tagaaggtcggaggct

SEQ ID NO: 2557050 - DNA, 19 bp, Homo sapiens
tagaaggttctctcctccc

SEQ ID NO: 2557051 - DNA, 16 bp, Homo sapiens
tagaagtcacacagta

SEQ ID NO: 2557052 - DNA, 19 bp, Homo sapiens
tagaagtcttagatgtata

SEQ ID NO: 2557053 - DNA, 15 bp, Homo sapiens
tagaagttactgaat

SEQ ID NO: 2557054 - DNA, 16 bp, Homo sapiens
tagaagtttttgtact

SEQ ID NO: 2557055 - DNA, 18 bp, Homo sapiens
tagaagtttttgtactgt

SEQ ID NO: 2557056 - DNA, 20 bp, Homo sapiens
tagaatgaaaattgtatgtt

SEQ ID NO: 2557057 - DNA, 13 bp, Homo sapiens
tagaatgtattgt

SEQ ID NO: 2557058 - DNA, 17 bp, Homo sapiens
tagaatgtattgtacct

SEQ ID NO: 2557059 - DNA, 23 bp, Homo sapiens
tagaattagtggcacttgctttt

SEQ ID NO: 2557060 - DNA, 15 bp, Homo sapiens
tagaattatttaaac

SEQ ID NO: 2557061 - DNA, 19 bp, Homo sapiens
tagaattccctctctctga

SEQ ID NO: 2557062 - DNA, 21 bp, Homo sapiens
tagaattccctctctctgact

SEQ ID NO: 2557063 - DNA, 17 bp, Homo sapiens
tagacaaatactcatgt

SEQ ID NO: 2557064 - DNA, 18 bp, Homo sapiens
tagacaaatactcatgtg

SEQ ID NO: 2557065 - DNA, 21 bp, Homo sapiens
tagacaaatactcatgtgtat

SEQ ID NO: 2557066 - DNA, 19 bp, Homo sapiens
tagacaaatatttggaggg

SEQ ID NO: 2557067 - DNA, 16 bp, Homo sapiens
tagacaatttattatg

SEQ ID NO: 2557068 - DNA, 18 bp, Homo sapiens
tagacacccattttcaca

SEQ ID NO: 2557069 - DNA, 12 bp, Homo sapiens
tagacagtccct

SEQ ID NO: 2557070 - DNA, 14 bp, Homo sapiens
tagacagtccctgc

SEQ ID NO: 2557071 - DNA, 16 bp, Homo sapiens
tagacattctgtcgcc

SEQ ID NO: 2557072 - DNA, 21 bp, Homo sapiens
tagacatttgctatgagctgg

SEQ ID NO: 2557073 - DNA, 18 bp, Homo sapiens
tctggatgcatttctctg

SEQ ID NO: 2557074 - DNA, 22 bp, Homo sapiens
tctggatgcctgattgccaagc

SEQ ID NO: 2557075 - DNA, 21 bp, Homo sapiens
tctggccctctacccctgatc

SEQ ID NO: 2557076 - DNA, 20 bp, Homo sapiens
tctggcctagtcccttccac

SEQ ID NO: 2557077 - DNA, 13 bp, Homo sapiens
tctggcctcccac

SEQ ID NO: 2557078 - DNA, 14 bp, Homo sapiens
tctggccttttcct

SEQ ID NO: 2557079 - DNA, 18 bp, Homo sapiens
tctggcgacagttttcct

SEQ ID NO: 2557080 - DNA, 22 bp, Homo sapiens
tctggcgacagttttccttctc

SEQ ID NO: 2557081 - DNA, 22 bp, Homo sapiens
tctggctagaggccagccccac

SEQ ID NO: 2557082 - DNA, 19 bp, Homo sapiens
tctggctcctcaaacagta

SEQ ID NO: 2557083 - DNA, 13 bp, Homo sapiens
tctggctctgtct

SEQ ID NO: 2557084 - DNA, 16 bp, Homo sapiens
tctggctcttccaggc

SEQ ID NO: 2557085 - DNA, 16 bp, Homo sapiens
tctggctgaaccctgt

SEQ ID NO: 2557086 - DNA, 17 bp, Homo sapiens
tctggctgaaccctgtg

SEQ ID NO: 2557087 - DNA, 20 bp, Homo sapiens
tctggctgaaccctgtgctg

SEQ ID NO: 2557088 - DNA, 21 bp, Homo sapiens
tctggctgaaccctgtgctgg

SEQ ID NO: 2557089 - DNA, 15 bp, Homo sapiens
tctggctgagccctg

SEQ ID NO: 2557090 - DNA, 14 bp, Homo sapiens
tctggctgagctga

SEQ ID NO: 2557091 - DNA, 15 bp, Homo sapiens
tctggctgagctgaa

SEQ ID NO: 2557092 - DNA, 15 bp, Homo sapiens
tctggcttccaggta

SEQ ID NO: 2557093 - DNA, 12 bp, Homo sapiens
tctgggacacag

SEQ ID NO: 2557094 - DNA, 21 bp, Homo sapiens
tctgggacttccttgctctcc

SEQ ID NO: 2557095 - DNA, 13 bp, Homo sapiens
tctgggagaggat

SEQ ID NO: 2557096 - DNA, 16 bp, Homo sapiens
tctgggagaggatttt

SEQ ID NO: 2557097 - DNA, 12 bp, Homo sapiens
tctgggccaagt

SEQ ID NO: 2557098 - DNA, 18 bp, Homo sapiens
tctgggccaagtcaaaga

SEQ ID NO: 2557099 - DNA, 16 bp, Homo sapiens
tctgggccaagttcct

SEQ ID NO: 2557100 - DNA, 15 bp, Homo sapiens
tctggggctctggga

SEQ ID NO: 2557101 - DNA, 17 bp, Homo sapiens
tctggtcaacctcctgg

SEQ ID NO: 2557102 - DNA, 21 bp, Homo sapiens
tctggtcaacctcctggacat

SEQ ID NO: 2557103 - DNA, 18 bp, Homo sapiens
tctggtccatagagagca

SEQ ID NO: 2557104 - DNA, 18 bp, Homo sapiens
tctggtccggacactcct

SEQ ID NO: 2557105 - DNA, 16 bp, Homo sapiens
tctggtctctaggctg

SEQ ID NO: 2557106 - DNA, 17 bp, Homo sapiens
tctggtctctaggctgg

SEQ ID NO: 2557107 - DNA, 18 bp, Homo sapiens
tctggtctctaggctggg

SEQ ID NO: 2557108 - DNA, 18 bp, Homo sapiens
tctggtgacaccagcctt

SEQ ID NO: 2557109 - DNA, 17 bp, Homo sapiens
tctggtgaggccttgct

SEQ ID NO: 2557110 - DNA, 21 bp, Homo sapiens
tctggtggccgatcggggcac

SEQ ID NO: 2557111 - DNA, 23 bp, Homo sapiens
tctggtggggtgtgttccaactg

SEQ ID NO: 2557112 - DNA, 15 bp, Homo sapiens
tctggtttcaccgag

SEQ ID NO: 2557113 - DNA, 18 bp, Homo sapiens
tctggtttgactccgctg

SEQ ID NO: 2557114 - DNA, 13 bp, Homo sapiens
tctggtttggggc

SEQ ID NO: 2557115 - DNA, 14 bp, Homo sapiens
tctggttttgctat

SEQ ID NO: 2557116 - DNA, 15 bp, Homo sapiens
tctggttttgctatt

SEQ ID NO: 2557117 - DNA, 14 bp, Homo sapiens
tctgtacagagccc

SEQ ID NO: 2557118 - DNA, 15 bp, Homo sapiens
tctgtacagagccca

SEQ ID NO: 2557119 - DNA, 18 bp, Homo sapiens
tctgtacgtctgacaggc

SEQ ID NO: 2557120 - DNA, 20 bp, Homo sapiens
tctgtagagggccctggtgt

SEQ ID NO: 2557121 - DNA, 16 bp, Homo sapiens
tctgtagattctgtgg

SEQ ID NO: 2557122 - DNA, 19 bp, Homo sapiens
tctgtagggaactctgggg

SEQ ID NO: 2557123 - DNA, 15 bp, Homo sapiens
tctgtagggctggac

SEQ ID NO: 2557124 - DNA, 15 bp, Homo sapiens
tctgtatataaaata

SEQ ID NO: 2557125 - DNA, 20 bp, Homo sapiens
tctgtatcaggacccagagg

SEQ ID NO: 2557126 - DNA, 23 bp, Homo sapiens
tctgtatttccccaacatgtaat

SEQ ID NO: 2557127 - DNA, 13 bp, Homo sapiens
tctgtcaagaaga

SEQ ID NO: 2557128 - DNA, 15 bp, Homo sapiens
tctgtcacaccagcc

SEQ ID NO: 2557129 - DNA, 19 bp, Homo sapiens
tctgtcaccaattggttaa

SEQ ID NO: 2557130 - DNA, 17 bp, Homo sapiens
tctgtcaggagagcagc

SEQ ID NO: 2557131 - DNA, 23 bp, Homo sapiens
tctgtcatttgagcagggctcag

SEQ ID NO: 2557132 - DNA, 17 bp, Homo sapiens
tctgtccaaaggaggct

SEQ ID NO: 2557133 - DNA, 22 bp, Homo sapiens
tctgtccaaaggaggctggcag

SEQ ID NO: 2557134 - DNA, 23 bp, Homo sapiens
tctgtccaaaggaggctggcagg

SEQ ID NO: 2557135 - DNA, 12 bp, Homo sapiens
tctgtccaagga

SEQ ID NO: 2557136 - DNA, 24 bp, Homo sapiens
tctgtccaggcactgctgcccagc

SEQ ID NO: 2557137 - DNA, 13 bp, Homo sapiens
tctgtccagggcc

SEQ ID NO: 2557138 - DNA, 17 bp, Homo sapiens
tctgtccagggccctga

SEQ ID NO: 2557139 - DNA, 19 bp, Homo sapiens
tctgtccgagctttgaaaa

SEQ ID NO: 2557140 - DNA, 20 bp, Homo sapiens
tctgtcctactctgtgtcag

SEQ ID NO: 2557141 - DNA, 12 bp, Homo sapiens
tctgtcctggga

SEQ ID NO: 2557142 - DNA, 14 bp, Homo sapiens
tctgtccttcagat

SEQ ID NO: 2557143 - DNA, 20 bp, Homo sapiens
tctgtccttcagatggaaac

SEQ ID NO: 2557144 - DNA, 17 bp, Homo sapiens
tctgtcgcccagtctgg

SEQ ID NO: 2557145 - DNA, 16 bp, Homo sapiens
tctgtcgccttagcat

SEQ ID NO: 2557146 - DNA, 17 bp, Homo sapiens
tctgtcgccttagcatg

SEQ ID NO: 2557147 - DNA, 21 bp, Homo sapiens
tctgtctcatccatcatcatg

SEQ ID NO: 2557148 - DNA, 11 bp, Homo sapiens
tctgtgaataa

SEQ ID NO: 2557149 - DNA, 16 bp, Homo sapiens
tctgtgaataagccat

SEQ ID NO: 2557150 - DNA, 17 bp, Homo sapiens
tctgtgcatggtggcac

SEQ ID NO: 2557151 - DNA, 14 bp, Homo sapiens
tctgtgccccatgc

SEQ ID NO: 2557152 - DNA, 15 bp, Homo sapiens
tctgtgccccatgcc

SEQ ID NO: 2557153 - DNA, 17 bp, Homo sapiens
tctgtgcctgaatattt

SEQ ID NO: 2557154 - DNA, 16 bp, Homo sapiens
tctgtgcgtgaaacac

SEQ ID NO: 2557155 - DNA, 19 bp, Homo sapiens
tctgtgctgaccctcctgt

SEQ ID NO: 2557156 - DNA, 21 bp, Homo sapiens
tctgtgctggagatgttttag

SEQ ID NO: 2557157 - DNA, 20 bp, Homo sapiens
tctgtgctttgactcacctg

SEQ ID NO: 2557158 - DNA, 20 bp, Homo sapiens
tctgtggaaagtgtaaagca

SEQ ID NO: 2557159 - DNA, 22 bp, Homo sapiens
tctgtggaccactgcatgagct

SEQ ID NO: 2557160 - DNA, 21 bp, Homo sapiens
tctgtgggtgacccaggtcct

SEQ ID NO: 2557161 - DNA, 20 bp, Homo sapiens
tctgtggttttcccctccct

SEQ ID NO: 2557162 - DNA, 23 bp, Homo sapiens
tctgtggttttcccctccctggg

SEQ ID NO: 2557163 - DNA, 14 bp, Homo sapiens
tctgtgtacaaaga

SEQ ID NO: 2557164 - DNA, 15 bp, Homo sapiens
tctgtgtacaaagaa

SEQ ID NO: 2557165 - DNA, 22 bp, Homo sapiens
tctgtgtcaggtggggcagctt

SEQ ID NO: 2557166 - DNA, 11 bp, Homo sapiens
tctgtgtcttt

SEQ ID NO: 2557167 - DNA, 13 bp, Homo sapiens
tctgtgtgaaaat

SEQ ID NO: 2557168 - DNA, 20 bp, Homo sapiens
tctgtgtgatgaactttctc

SEQ ID NO: 2557169 - DNA, 22 bp, Homo sapiens
tctgtgtgcaagtgtgtgcaca

SEQ ID NO: 2557170 - DNA, 14 bp, Homo sapiens
tctgtgtgcacaaa

SEQ ID NO: 2557171 - DNA, 18 bp, Homo sapiens
tctgtgtgcaccttacca

SEQ ID NO: 2557172 - DNA, 19 bp, Homo sapiens
tctgtgtgcaccttaccaa

SEQ ID NO: 2557173 - DNA, 22 bp, Homo sapiens
tctgtgtgcaccttaccaactt

SEQ ID NO: 2557174 - DNA, 13 bp, Homo sapiens
tctgtgtgtgtgt

SEQ ID NO: 2557175 - DNA, 15 bp, Homo sapiens
tctgtgtgtgtgtat

SEQ ID NO: 2557176 - DNA, 18 bp, Homo sapiens
tctgtgtgtgtgtatgtg

SEQ ID NO: 2557177 - DNA, 21 bp, Homo sapiens
tctgtgtgtgtgtatgtgggg

SEQ ID NO: 2557178 - DNA, 19 bp, Homo sapiens
tctgtgtgtttatgtgtgt

SEQ ID NO: 2557179 - DNA, 20 bp, Homo sapiens
tctgtgtgtttatgtgtgtg

SEQ ID NO: 2557180 - DNA, 17 bp, Homo sapiens
tctgttatgctgtgaca

SEQ ID NO: 2557181 - DNA, 15 bp, Homo sapiens
tctgttattaacaaa

SEQ ID NO: 2557182 - DNA, 15 bp, Homo sapiens
tctgttccttcacat

SEQ ID NO: 2557183 - DNA, 18 bp, Homo sapiens
tctgttggccagtgtgac

SEQ ID NO: 2557184 - DNA, 23 bp, Homo sapiens
tctgtttagataatacaccacta

SEQ ID NO: 2557185 - DNA, 18 bp, Homo sapiens
tctgttttaggttaaaaa

SEQ ID NO: 2557186 - DNA, 16 bp, Homo sapiens
tctgttttatgacttc

SEQ ID NO: 2557187 - DNA, 16 bp, Homo sapiens
tctgttttcctttctc

SEQ ID NO: 2557188 - DNA, 12 bp, Homo sapiens
tctgttttctgt

SEQ ID NO: 2557189 - DNA, 23 bp, Homo sapiens
tctgttttctttctaatgagata

SEQ ID NO: 2557190 - DNA, 13 bp, Homo sapiens
tcttaaaaagtgg

SEQ ID NO: 2557191 - DNA, 14 bp, Homo sapiens
tcttaaaataactt

SEQ ID NO: 2557192 - DNA, 15 bp, Homo sapiens
tcttaaaataactta

SEQ ID NO: 2557193 - DNA, 21 bp, Homo sapiens
tcttaaaataacttatatcat

SEQ ID NO: 2557194 - DNA, 16 bp, Homo sapiens
tcttaaaccttcagtt

SEQ ID NO: 2557195 - DNA, 19 bp, Homo sapiens
tcttaaagaaaacccaccc

SEQ ID NO: 2557196 - DNA, 18 bp, Homo sapiens
tcttaaagtattcttctc

SEQ ID NO: 2557197 - DNA, 22 bp, Homo sapiens
tcttaaagtattcttctcttcc

SEQ ID NO: 2557198 - DNA, 14 bp, Homo sapiens
tcttaaattttgtg

SEQ ID NO: 2557199 - DNA, 23 bp, Homo sapiens
tcttaacacatgtccttgtgtgt

SEQ ID NO: 2557200 - DNA, 22 bp, Homo sapiens
tcttaacgttagaccacaaata

SEQ ID NO: 2557201 - DNA, 19 bp, Homo sapiens
tcttaagccatcttggtaa

SEQ ID NO: 2557202 - DNA, 12 bp, Homo sapiens
tcttaagcttcc

SEQ ID NO: 2557203 - DNA, 15 bp, Homo sapiens
tcttaagtttctcag

SEQ ID NO: 2557204 - DNA, 17 bp, Homo sapiens
tcttaagtttctcagct

SEQ ID NO: 2557205 - DNA, 21 bp, Homo sapiens
tcttaatcttttcacaaataa

SEQ ID NO: 2557206 - DNA, 14 bp, Homo sapiens
tcttaattaaaaga

SEQ ID NO: 2557207 - DNA, 19 bp, Homo sapiens
tcttacaggcacaaaatga

SEQ ID NO: 2557208 - DNA, 15 bp, Homo sapiens
tcttacatgttttct

SEQ ID NO: 2557209 - DNA, 23 bp, Homo sapiens
tcttacctgtatgtctccagtat

SEQ ID NO: 2557210 - DNA, 23 bp, Homo sapiens
tcttactgaaggtaaaattgaaa

SEQ ID NO: 2557211 - DNA, 18 bp, Homo sapiens
tcttagacttgaaatact

SEQ ID NO: 2557212 - DNA, 23 bp, Homo sapiens
tcttagctgtctgctcagacaga

SEQ ID NO: 2557213 - DNA, 14 bp, Homo sapiens
tcttagctttttaa

SEQ ID NO: 2557214 - DNA, 16 bp, Homo sapiens
tcttagctttttaatt

SEQ ID NO: 2557215 - DNA, 19 bp, Homo sapiens
tcttaggaagagaaaccag

SEQ ID NO: 2557216 - DNA, 19 bp, Homo sapiens
tcttaggagcagagctctg

SEQ ID NO: 2557217 - DNA, 17 bp, Homo sapiens
tcttaggggagagcttt

SEQ ID NO: 2557218 - DNA, 19 bp, Homo sapiens
tcttaggggagagctttct

SEQ ID NO: 2557219 - DNA, 16 bp, Homo sapiens
tcttagttctcactgt

SEQ ID NO: 2557220 - DNA, 11 bp, Homo sapiens
tcttataaata

SEQ ID NO: 2557221 - DNA, 13 bp, Homo sapiens
tcttataaatatg

SEQ ID NO: 2557222 - DNA, 21 bp, Homo sapiens
tcttataaatatgaagctcac

SEQ ID NO: 2557223 - DNA, 15 bp, Homo sapiens
tcttatacatttgat

SEQ ID NO: 2557224 - DNA, 22 bp, Homo sapiens
tcttatagtcaatgtttctttt

SEQ ID NO: 2557225 - DNA, 20 bp, Homo sapiens
tcttatatatatttctttgt

SEQ ID NO: 2557226 - DNA, 15 bp, Homo sapiens
tcttatatatgtgaa

SEQ ID NO: 2557227 - DNA, 18 bp, Homo sapiens
tcttatatatgtgaacat

SEQ ID NO: 2557228 - DNA, 16 bp, Homo sapiens
tcttatcaagcagcca

SEQ ID NO: 2557229 - DNA, 22 bp, Homo sapiens
tcttatccaacatcaacatctt

SEQ ID NO: 2557230 - DNA, 13 bp, Homo sapiens
tcttatgggctgg

SEQ ID NO: 2557231 - DNA, 14 bp, Homo sapiens
tcttatttaactta

SEQ ID NO: 2557232 - DNA, 14 bp, Homo sapiens
tcttatttcatgaa

SEQ ID NO: 2557233 - DNA, 16 bp, Homo sapiens
tcttatttcatgaaaa

SEQ ID NO: 2557234 - DNA, 18 bp, Homo sapiens
tcttatttcatgaaaatt

SEQ ID NO: 2557235 - DNA, 15 bp, Homo sapiens
tcttatttcatttct

SEQ ID NO: 2557236 - DNA, 16 bp, Homo sapiens
tcttatttcatttctt

SEQ ID NO: 2557237 - DNA, 11 bp, Homo sapiens
tcttcaacaga

SEQ ID NO: 2557238 - DNA, 16 bp, Homo sapiens
tcttcaactgaccagc

SEQ ID NO: 2557239 - DNA, 19 bp, Homo sapiens
tcttcaactgaccagcctc

SEQ ID NO: 2557240 - DNA, 20 bp, Homo sapiens
tcttcacccagctaatctgt

SEQ ID NO: 2557241 - DNA, 14 bp, Homo sapiens
tcttcactcgcccc

SEQ ID NO: 2557242 - DNA, 13 bp, Homo sapiens
tcttcagaagaca

SEQ ID NO: 2557243 - DNA, 14 bp, Homo sapiens
tcttcagaggccct

SEQ ID NO: 2557244 - DNA, 15 bp, Homo sapiens
tcttcagaggccctc

SEQ ID NO: 2557245 - DNA, 14 bp, Homo sapiens
tcttcagatctcta

SEQ ID NO: 2557246 - DNA, 18 bp, Homo sapiens
tcttcagatctctaactt

SEQ ID NO: 2557247 - DNA, 19 bp, Homo sapiens
tcttcagccacctctcttt

SEQ ID NO: 2557248 - DNA, 22 bp, Homo sapiens
tcttcagcctagccgacctcag

SEQ ID NO: 2557249 - DNA, 20 bp, Homo sapiens
tcttcagcttgtgcacaatt

SEQ ID NO: 2557250 - DNA, 13 bp, Homo sapiens
tcttcaggcctcc

SEQ ID NO: 2557251 - DNA, 15 bp, Homo sapiens
tcttcaggcctccct

SEQ ID NO: 2557252 - DNA, 15 bp, Homo sapiens
tcttcagtaagccgt

SEQ ID NO: 2557253 - DNA, 12 bp, Homo sapiens
tcttcagtttta

SEQ ID NO: 2557254 - DNA, 20 bp, Homo sapiens
tcttcataacaattttagga

SEQ ID NO: 2557255 - DNA, 19 bp, Homo sapiens
tcttcatccggcagcctgg

SEQ ID NO: 2557256 - DNA, 20 bp, Homo sapiens
tcttcatccggcagcctgga

SEQ ID NO: 2557257 - DNA, 14 bp, Homo sapiens
tcttcatgcaatga

SEQ ID NO: 2557258 - DNA, 22 bp, Homo sapiens
tcttcattaagccctcttccat

SEQ ID NO: 2557259 - DNA, 15 bp, Homo sapiens
tcttccaaaggcata

SEQ ID NO: 2557260 - DNA, 14 bp, Homo sapiens
tcttccaggctggg

SEQ ID NO: 2557261 - DNA, 15 bp, Homo sapiens
tcttccaggctggga

SEQ ID NO: 2557262 - DNA, 21 bp, Homo sapiens
tcttccaggctgggagagcct

SEQ ID NO: 2557263 - DNA, 22 bp, Homo sapiens
tcttccaggctgggagagcctt

SEQ ID NO: 2557264 - DNA, 19 bp, Homo sapiens
tcttccatatgacctcatg

SEQ ID NO: 2557265 - DNA, 18 bp, Homo sapiens
tcttccatcatggattca

SEQ ID NO: 2557266 - DNA, 14 bp, Homo sapiens
tcttccccactccc

SEQ ID NO: 2557267 - DNA, 20 bp, Homo sapiens
tcttccccagaaaggagact

SEQ ID NO: 2557268 - DNA, 13 bp, Homo sapiens
tcttccccttgcc

SEQ ID NO: 2557269 - DNA, 22 bp, Homo sapiens
tcttccccttgcccttgccctg

SEQ ID NO: 2557270 - DNA, 17 bp, Homo sapiens
tcttcccgaaccccaag

SEQ ID NO: 2557271 - DNA, 19 bp, Homo sapiens
tcttcccgaaccccaagga

SEQ ID NO: 2557272 - DNA, 10 bp, Homo sapiens
tcttccctcc

SEQ ID NO: 2557273 - DNA, 16 bp, Homo sapiens
tcttccggagatgtag

SEQ ID NO: 2557274 - DNA, 18 bp, Homo sapiens
tcttccggagatgtagca

SEQ ID NO: 2557275 - DNA, 19 bp, Homo sapiens
tcttccggagatgtagcaa

SEQ ID NO: 2557276 - DNA, 13 bp, Homo sapiens
tcttcctcccaag

SEQ ID NO: 2557277 - DNA, 22 bp, Homo sapiens
tcttcctcccaagtggtgccta

SEQ ID NO: 2557278 - DNA, 18 bp, Homo sapiens
tcttcctccgaggccagt

SEQ ID NO: 2557279 - DNA, 13 bp, Homo sapiens
tcttcctctgagg

SEQ ID NO: 2557280 - DNA, 11 bp, Homo sapiens
tcttcctctgc

SEQ ID NO: 2557281 - DNA, 14 bp, Homo sapiens
tcttcctctgctga

SEQ ID NO: 2557282 - DNA, 13 bp, Homo sapiens
tcttcgggaagag

SEQ ID NO: 2557283 - DNA, 22 bp, Homo sapiens
tcttcgggaagagaggagttca

SEQ ID NO: 2557284 - DNA, 15 bp, Homo sapiens
tcttctaatttcaaa

SEQ ID NO: 2557285 - DNA, 13 bp, Homo sapiens
tcttctattttgt

SEQ ID NO: 2557286 - DNA, 16 bp, Homo sapiens
tcttctcaagtgcctt

SEQ ID NO: 2557287 - DNA, 23 bp, Homo sapiens
tcttctcagaaggcaaatgactt

SEQ ID NO: 2557288 - DNA, 16 bp, Homo sapiens
tcttctcatagcatta

SEQ ID NO: 2557289 - DNA, 17 bp, Homo sapiens
tcttctcatagcattaa

SEQ ID NO: 2557290 - DNA, 19 bp, Homo sapiens
tcttctcatagcattaact

SEQ ID NO: 2557291 - DNA, 20 bp, Homo sapiens
tcttctcatagcattaacta

SEQ ID NO: 2557292 - DNA, 12 bp, Homo sapiens
tcttctccaggc

SEQ ID NO: 2557293 - DNA, 14 bp, Homo sapiens
tcttctccaggctg

SEQ ID NO: 2557294 - DNA, 14 bp, Homo sapiens
tcttctcttcctgt

SEQ ID NO: 2557295 - DNA, 19 bp, Homo sapiens
tcttctcttccttttatca

SEQ ID NO: 2557296 - DNA, 21 bp, Homo sapiens
tcttctcttccttttatcagt

SEQ ID NO: 2557297 - DNA, 12 bp, Homo sapiens
tcttctgcctgt

SEQ ID NO: 2557298 - DNA, 15 bp, Homo sapiens
tcttctgcctgttat

SEQ ID NO: 2557299 - DNA, 15 bp, Homo sapiens
tcttctgctccaccc

SEQ ID NO: 2557300 - DNA, 23 bp, Homo sapiens
tcttctgctccacccttggcctg

SEQ ID NO: 2557301 - DNA, 20 bp, Homo sapiens
tcttctgggagggcagcagg

SEQ ID NO: 2557302 - DNA, 17 bp, Homo sapiens
tcttctgttttctgttt

SEQ ID NO: 2557303 - DNA, 15 bp, Homo sapiens
tcttcttacatgcat

SEQ ID NO: 2557304 - DNA, 13 bp, Homo sapiens
tcttcttccctcc

SEQ ID NO: 2557305 - DNA, 19 bp, Homo sapiens
tcttcttcctgaagctgag

SEQ ID NO: 2557306 - DNA, 20 bp, Homo sapiens
tcttgaaatataggaactta

SEQ ID NO: 2557307 - DNA, 23 bp, Homo sapiens
tcttgaaatgaaagtataactga

SEQ ID NO: 2557308 - DNA, 20 bp, Homo sapiens
tcttgaacactcatgctgaa

SEQ ID NO: 2557309 - DNA, 13 bp, Homo sapiens
tcttgaatcccat

SEQ ID NO: 2557310 - DNA, 16 bp, Homo sapiens
tcttgaatgtcttttg

SEQ ID NO: 2557311 - DNA, 16 bp, Homo sapiens
tcttgagccttgaact

SEQ ID NO: 2557312 - DNA, 17 bp, Homo sapiens
tcttgagccttgaactt

SEQ ID NO: 2557313 - DNA, 14 bp, Homo sapiens
tcttgagggagctt

SEQ ID NO: 2557314 - DNA, 17 bp, Homo sapiens
tcttgatacccccctct

SEQ ID NO: 2557315 - DNA, 20 bp, Homo sapiens
tcttgatacccccctctgtc

SEQ ID NO: 2557316 - DNA, 18 bp, Homo sapiens
tcttgatgtggtgaggca

SEQ ID NO: 2557317 - DNA, 13 bp, Homo sapiens
tcttgcaatggca

SEQ ID NO: 2557318 - DNA, 16 bp, Homo sapiens
tcttgcaatggcagcc

SEQ ID NO: 2557319 - DNA, 23 bp, Homo sapiens
tcttgcaatggcagccttggcaa

SEQ ID NO: 2557320 - DNA, 13 bp, Homo sapiens
tcttgcaggtctc

SEQ ID NO: 2557321 - DNA, 14 bp, Homo sapiens
tcttgcaggtctca

SEQ ID NO: 2557322 - DNA, 20 bp, Homo sapiens
tcttgcaggtctcaaccctt

SEQ ID NO: 2557323 - DNA, 12 bp, Homo sapiens
tcttgcccccca

SEQ ID NO: 2557324 - DNA, 18 bp, Homo sapiens
tcttgcccttccctgtcc

SEQ ID NO: 2557325 - DNA, 15 bp, Homo sapiens
tcttgctaatcagtg

SEQ ID NO: 2557326 - DNA, 16 bp, Homo sapiens
tcttgctaatcagtgt

SEQ ID NO: 2557327 - DNA, 22 bp, Homo sapiens
tcttgctaatcagtgtctcaca

SEQ ID NO: 2557328 - DNA, 23 bp, Homo sapiens
tcttgctctgctgacagacacag

SEQ ID NO: 2557329 - DNA, 17 bp, Homo sapiens
tcttgctctgtaatctc

SEQ ID NO: 2557330 - DNA, 14 bp, Homo sapiens
tcttgctctttcta

SEQ ID NO: 2557331 - DNA, 19 bp, Homo sapiens
tcttgctctttctactctg

SEQ ID NO: 2557332 - DNA, 21 bp, Homo sapiens
tcttgctctttctactctgaa

SEQ ID NO: 2557333 - DNA, 13 bp, Homo sapiens
tcttgcttgggaa

SEQ ID NO: 2557334 - DNA, 17 bp, Homo sapiens
tcttggacactgtacaa

SEQ ID NO: 2557335 - DNA, 16 bp, Homo sapiens
tcttggacctctgctc

SEQ ID NO: 2557336 - DNA, 21 bp, Homo sapiens
tcttggacctctgctctgagg

SEQ ID NO: 2557337 - DNA, 13 bp, Homo sapiens
tcttggctcactg

SEQ ID NO: 2557338 - DNA, 12 bp, Homo sapiens
tcttgggaaata

SEQ ID NO: 2557339 - DNA, 19 bp, Homo sapiens
tcttgggaaatatgaatgc

SEQ ID NO: 2557340 - DNA, 21 bp, Homo sapiens
tcttgggggacagggctggcc

SEQ ID NO: 2557341 - DNA, 16 bp, Homo sapiens
tcttgggtaggcggga

SEQ ID NO: 2557342 - DNA, 14 bp, Homo sapiens
tcttggtagagatt

SEQ ID NO: 2557343 - DNA, 17 bp, Homo sapiens
tcttggtcttcccaggc

SEQ ID NO: 2557344 - DNA, 19 bp, Homo sapiens
tcttggttgaaaataaaaa

SEQ ID NO: 2557345 - DNA, 23 bp, Homo sapiens
tcttggttgaaaataaaaagatc

SEQ ID NO: 2557346 - DNA, 14 bp, Homo sapiens
tcttggtttccaaa

SEQ ID NO: 2557347 - DNA, 16 bp, Homo sapiens
tcttggtttgtaaatt

SEQ ID NO: 2557348 - DNA, 19 bp, Homo sapiens
tcttgtaatccgaatctct

SEQ ID NO: 2557349 - DNA, 23 bp, Homo sapiens
tcttgtaatttaaacaggcccag

SEQ ID NO: 2557350 - DNA, 14 bp, Homo sapiens
tcttgtacatgtgt

SEQ ID NO: 2557351 - DNA, 19 bp, Homo sapiens
tcttgtacatgtgtagcct

SEQ ID NO: 2557352 - DNA, 15 bp, Homo sapiens
tcttgtattaagaat

SEQ ID NO: 2557353 - DNA, 16 bp, Homo sapiens
tcttgtattaagttgt

SEQ ID NO: 2557354 - DNA, 18 bp, Homo sapiens
tcttgtattaagttgtta

SEQ ID NO: 2557355 - DNA, 22 bp, Homo sapiens
tcttgtattaagttgttaataa

SEQ ID NO: 2557356 - DNA, 13 bp, Homo sapiens
tcttgtcctagct

SEQ ID NO: 2557357 - DNA, 12 bp, Homo sapiens
tcttgtctctgg

SEQ ID NO: 2557358 - DNA, 13 bp, Homo sapiens
tcttgtctctggg

SEQ ID NO: 2557359 - DNA, 23 bp, Homo sapiens
tcttgtggatgttttaattccat

SEQ ID NO: 2557360 - DNA, 16 bp, Homo sapiens
tcttgttaagtgcagt

SEQ ID NO: 2557361 - DNA, 14 bp, Homo sapiens
tcttgttttcagtt

SEQ ID NO: 2557362 - DNA, 22 bp, Homo sapiens
tcttgtttttccactactgcta

SEQ ID NO: 2557363 - DNA, 18 bp, Homo sapiens
tctttaaagtcaggtcca

SEQ ID NO: 2557364 - DNA, 23 bp, Homo sapiens
tctttaatcattttgcctctttt

SEQ ID NO: 2557365 - DNA, 15 bp, Homo sapiens
tctttaatcttcagt

SEQ ID NO: 2557366 - DNA, 16 bp, Homo sapiens
tctttacctgagacca

SEQ ID NO: 2557367 - DNA, 15 bp, Homo sapiens
tctttagtttttgtg

SEQ ID NO: 2557368 - DNA, 20 bp, Homo sapiens
tctttatacaacagtgctaa

SEQ ID NO: 2557369 - DNA, 11 bp, Homo sapiens
tctttcaaaac

SEQ ID NO: 2557370 - DNA, 20 bp, Homo sapiens
tctttcaaaaccttttgaaa

SEQ ID NO: 2557371 - DNA, 18 bp, Homo sapiens
tctttcaaattgagagaa

SEQ ID NO: 2557372 - DNA, 16 bp, Homo sapiens
tctttcaagtgaatct

SEQ ID NO: 2557373 - DNA, 23 bp, Homo sapiens
tctttcacacttccaccagcctg

SEQ ID NO: 2557374 - DNA, 14 bp, Homo sapiens
tctttcacagctcc

SEQ ID NO: 2557375 - DNA, 18 bp, Homo sapiens
tctttcacagctcctccc

SEQ ID NO: 2557376 - DNA, 13 bp, Homo sapiens
tctttccaaagta

SEQ ID NO: 2557377 - DNA, 11 bp, Homo sapiens
tctttcctctt

SEQ ID NO: 2557378 - DNA, 22 bp, Homo sapiens
tctttcctcttccccttgccct

SEQ ID NO: 2557379 - DNA, 12 bp, Homo sapiens
tctttcctgagg

SEQ ID NO: 2557380 - DNA, 14 bp, Homo sapiens
tctttcctgaggct

SEQ ID NO: 2557381 - DNA, 14 bp, Homo sapiens
tctttcctgccttc

SEQ ID NO: 2557382 - DNA, 16 bp, Homo sapiens
tctttcctgccttctt

SEQ ID NO: 2557383 - DNA, 18 bp, Homo sapiens
tctttcctgttgttgtta

SEQ ID NO: 2557384 - DNA, 13 bp, Homo sapiens
tctttccttgctc

SEQ ID NO: 2557385 - DNA, 21 bp, Homo sapiens
tctttctaactccagtgaagt

SEQ ID NO: 2557386 - DNA, 19 bp, Homo sapiens
tctttctaatgtgtgaatc

SEQ ID NO: 2557387 - DNA, 14 bp, Homo sapiens
tctttctacagtat

SEQ ID NO: 2557388 - DNA, 15 bp, Homo sapiens
tctttctagtggtct

SEQ ID NO: 2557389 - DNA, 17 bp, Homo sapiens
tctttctagtggtcttt

SEQ ID NO: 2557390 - DNA, 16 bp, Homo sapiens
tctttctctactttga

SEQ ID NO: 2557391 - DNA, 21 bp, Homo sapiens
tctttctgagcacactttagt

SEQ ID NO: 2557392 - DNA, 21 bp, Homo sapiens
tctttctgcagaaacagaaag

SEQ ID NO: 2557393 - DNA, 19 bp, Homo sapiens
tctttctggctatgcattt

SEQ ID NO: 2557394 - DNA, 21 bp, Homo sapiens
tctttctggctatgcatttga

SEQ ID NO: 2557395 - DNA, 14 bp, Homo sapiens
tctttctgtattga

SEQ ID NO: 2557396 - DNA, 17 bp, Homo sapiens
tctttctttacctgaga

SEQ ID NO: 2557397 - DNA, 21 bp, Homo sapiens
tctttctttacctgagaccag

SEQ ID NO: 2557398 - DNA, 22 bp, Homo sapiens
tctttcttttgattcttcctaa

SEQ ID NO: 2557399 - DNA, 15 bp, Homo sapiens
tctttgaatgacaaa

SEQ ID NO: 2557400 - DNA, 17 bp, Homo sapiens
tctttgaattttctgtg

SEQ ID NO: 2557401 - DNA, 13 bp, Homo sapiens
tctttgataatgt

SEQ ID NO: 2557402 - DNA, 19 bp, Homo sapiens
tctttgatgttaacacatt

SEQ ID NO: 2557403 - DNA, 17 bp, Homo sapiens
tctttgcagacaggcaa

SEQ ID NO: 2557404 - DNA, 16 bp, Homo sapiens
tctttgccaccctcat

SEQ ID NO: 2557405 - DNA, 17 bp, Homo sapiens
tctttgcctgttcagtt

SEQ ID NO: 2557406 - DNA, 13 bp, Homo sapiens
tctttgcttgcct

SEQ ID NO: 2557407 - DNA, 15 bp, Homo sapiens
tctttgcttgcctct

SEQ ID NO: 2557408 - DNA, 16 bp, Homo sapiens
tctttggaccctgagg

SEQ ID NO: 2557409 - DNA, 21 bp, Homo sapiens
tctttggggtcagccagggcc

SEQ ID NO: 2557410 - DNA, 14 bp, Homo sapiens
tctttggtctacac

SEQ ID NO: 2557411 - DNA, 17 bp, Homo sapiens
tctttggtggctttgca

SEQ ID NO: 2557412 - DNA, 14 bp, Homo sapiens
tctttgtaagagtg

SEQ ID NO: 2557413 - DNA, 21 bp, Homo sapiens
tctttgtaagagtgtagaagc

SEQ ID NO: 2557414 - DNA, 23 bp, Homo sapiens
tctttgtaagagtgtagaagcat

SEQ ID NO: 2557415 - DNA, 19 bp, Homo sapiens
tctttgtctaaaacaataa

SEQ ID NO: 2557416 - DNA, 13 bp, Homo sapiens
tctttgtgtagct

SEQ ID NO: 2557417 - DNA, 18 bp, Homo sapiens
tctttgttggaaaagaat

SEQ ID NO: 2557418 - DNA, 18 bp, Homo sapiens
tcttttaaaaattcaaat

SEQ ID NO: 2557419 - DNA, 17 bp, Homo sapiens
tcttttagctgatgaac

SEQ ID NO: 2557420 - DNA, 22 bp, Homo sapiens
tcttttcacatagctgtctaga

SEQ ID NO: 2557421 - DNA, 14 bp, Homo sapiens
tcttttcacattct

SEQ ID NO: 2557422 - DNA, 19 bp, Homo sapiens
tcttttcacattcttataa

SEQ ID NO: 2557423 - DNA, 14 bp, Homo sapiens
tcttttctattttc

SEQ ID NO: 2557424 - DNA, 18 bp, Homo sapiens
tcttttctattttccctc

SEQ ID NO: 2557425 - DNA, 17 bp, Homo sapiens
tcttttctctgtgcttc

SEQ ID NO: 2557426 - DNA, 16 bp, Homo sapiens
tcttttctttagagca

SEQ ID NO: 2557427 - DNA, 15 bp, Homo sapiens
tcttttgaaacaata

SEQ ID NO: 2557428 - DNA, 15 bp, Homo sapiens
tcttttgacatgtgg

SEQ ID NO: 2557429 - DNA, 16 bp, Homo sapiens
tcttttggggaagtga

SEQ ID NO: 2557430 - DNA, 23 bp, Homo sapiens
tctttttaaagtgtttctgttat

SEQ ID NO: 2557431 - DNA, 21 bp, Homo sapiens
tctttttaagcttatttaatt

SEQ ID NO: 2557432 - DNA, 16 bp, Homo sapiens
tctttttatactatta

SEQ ID NO: 2557433 - DNA, 14 bp, Homo sapiens
tctttttattgaat

SEQ ID NO: 2557434 - DNA, 12 bp, Homo sapiens
tctttttcttct

SEQ ID NO: 2557435 - DNA, 19 bp, Homo sapiens
tcttttttttaatgtgctg

SEQ ID NO: 2557436 - DNA, 18 bp, Homo sapiens
tgaaaaaaaaaatgctga

SEQ ID NO: 2557437 - DNA, 21 bp, Homo sapiens
tgaaaaaaaaaatgctgaaca

SEQ ID NO: 2557438 - DNA, 14 bp, Homo sapiens
tgaaaaaaaagttt

SEQ ID NO: 2557439 - DNA, 16 bp, Homo sapiens
tgaaaaaaaagtttca

SEQ ID NO: 2557440 - DNA, 21 bp, Homo sapiens
tgaaaaaaggacaatttcaaa

SEQ ID NO: 2557441 - DNA, 18 bp, Homo sapiens
tgaaaaaatgtatatgca

SEQ ID NO: 2557442 - DNA, 21 bp, Homo sapiens
tgaaaaagcagctaccaggtg

SEQ ID NO: 2557443 - DNA, 16 bp, Homo sapiens
tgaaaaaggaggaaga

SEQ ID NO: 2557444 - DNA, 20 bp, Homo sapiens
tgaaaaaggaggaagagaaa

SEQ ID NO: 2557445 - DNA, 22 bp, Homo sapiens
tgaaaaagttctgcagataaac

SEQ ID NO: 2557446 - DNA, 13 bp, Homo sapiens
tgaaaaattccta

SEQ ID NO: 2557447 - DNA, 13 bp, Homo sapiens
tgaaaaattctca

SEQ ID NO: 2557448 - DNA, 12 bp, Homo sapiens
tgaaaacaagtg

SEQ ID NO: 2557449 - DNA, 15 bp, Homo sapiens
tgaaaacaagtgctg

SEQ ID NO: 2557450 - DNA, 18 bp, Homo sapiens
tgaaaacaagtgctggca

SEQ ID NO: 2557451 - DNA, 17 bp, Homo sapiens
tgaaaacacatttttct

SEQ ID NO: 2557452 - DNA, 16 bp, Homo sapiens
tgaaaacactgtgcac

SEQ ID NO: 2557453 - DNA, 18 bp, Homo sapiens
tgaaaacactgtgcacat

SEQ ID NO: 2557454 - DNA, 23 bp, Homo sapiens
tgaaaacactgttctctgccctc

SEQ ID NO: 2557455 - DNA, 13 bp, Homo sapiens
tgaaaacatctgg

SEQ ID NO: 2557456 - DNA, 16 bp, Homo sapiens
tgaaaacgttttattg

SEQ ID NO: 2557457 - DNA, 18 bp, Homo sapiens
tgaaaacgttttattgtg

SEQ ID NO: 2557458 - DNA, 19 bp, Homo sapiens
tgaaaactcattacttttc

SEQ ID NO: 2557459 - DNA, 15 bp, Homo sapiens
tgaaaagaaaaatga

SEQ ID NO: 2557460 - DNA, 20 bp, Homo sapiens
tgaaaagaaaaatgagcctg

SEQ ID NO: 2557461 - DNA, 16 bp, Homo sapiens
tgaaaagataaattat

SEQ ID NO: 2557462 - DNA, 17 bp, Homo sapiens
tgaaaagctattagcca

SEQ ID NO: 2557463 - DNA, 20 bp, Homo sapiens
tgaaaagctattagccagga

SEQ ID NO: 2557464 - DNA, 20 bp, Homo sapiens
tgaaaagttactacctgtca

SEQ ID NO: 2557465 - DNA, 13 bp, Homo sapiens
tgaaaataattgt

SEQ ID NO: 2557466 - DNA, 12 bp, Homo sapiens
tgaaaatacaac

SEQ ID NO: 2557467 - DNA, 18 bp, Homo sapiens
tgaaaatacttaggaagg

SEQ ID NO: 2557468 - DNA, 18 bp, Homo sapiens
tgaaaataggtatacagt

SEQ ID NO: 2557469 - DNA, 16 bp, Homo sapiens
tgaaaatataaccagc

SEQ ID NO: 2557470 - DNA, 17 bp, Homo sapiens
tgaaaatatttgtatca

SEQ ID NO: 2557471 - DNA, 12 bp, Homo sapiens
tgaaaatcaaat

SEQ ID NO: 2557472 - DNA, 14 bp, Homo sapiens
tgaaaatctaatat

SEQ ID NO: 2557473 - DNA, 20 bp, Homo sapiens
tgaaaatgcaacaacatgta

SEQ ID NO: 2557474 - DNA, 21 bp, Homo sapiens
tgaaaatgcaacaacatgtat

SEQ ID NO: 2557475 - DNA, 23 bp, Homo sapiens
tgaaaatgcaacaacatgtataa

SEQ ID NO: 2557476 - DNA, 13 bp, Homo sapiens
tgaaaatgtactg

SEQ ID NO: 2557477 - DNA, 14 bp, Homo sapiens
tgaaaatgtcagaa

SEQ ID NO: 2557478 - DNA, 14 bp, Homo sapiens
tgaaaatgtcttgt

SEQ ID NO: 2557479 - DNA, 16 bp, Homo sapiens
tgaaaatgtcttgtgt

SEQ ID NO: 2557480 - DNA, 13 bp, Homo sapiens
tgaaaatgttttt

SEQ ID NO: 2557481 - DNA, 20 bp, Homo sapiens
tgaaaattaggatttcatga

SEQ ID NO: 2557482 - DNA, 15 bp, Homo sapiens
tgaaaattattttaa

SEQ ID NO: 2557483 - DNA, 19 bp, Homo sapiens
tgaaaattattttaaacaa

SEQ ID NO: 2557484 - DNA, 22 bp, Homo sapiens
tgaaacaacaaataggaattgt

SEQ ID NO: 2557485 - DNA, 23 bp, Homo sapiens
tgaaacaatactcataatgtgaa

SEQ ID NO: 2557486 - DNA, 13 bp, Homo sapiens
tgaaacacaaaca

SEQ ID NO: 2557487 - DNA, 20 bp, Homo sapiens
tgaaacacaaacaatagtaa

SEQ ID NO: 2557488 - DNA, 22 bp, Homo sapiens
tgaaacacaccaggctgtgggc

SEQ ID NO: 2557489 - DNA, 17 bp, Homo sapiens
tgaaacccccacacaca

SEQ ID NO: 2557490 - DNA, 18 bp, Homo sapiens
tgaaaccctgtctctact

SEQ ID NO: 2557491 - DNA, 20 bp, Homo sapiens
tgaaacctttagggcagctt

SEQ ID NO: 2557492 - DNA, 21 bp, Homo sapiens
tgaaacctttagggcagcttg

SEQ ID NO: 2557493 - DNA, 16 bp, Homo sapiens
tgaaaccttttttaag

SEQ ID NO: 2557494 - DNA, 18 bp, Homo sapiens
tgaaaccttttttaagat

SEQ ID NO: 2557495 - DNA, 23 bp, Homo sapiens
tgaaaccttttttaagatttttc

SEQ ID NO: 2557496 - DNA, 20 bp, Homo sapiens
tgaaactgcttgtttcctag

SEQ ID NO: 2557497 - DNA, 22 bp, Homo sapiens
tgaaagaaaataccaaggaaca

SEQ ID NO: 2557498 - DNA, 20 bp, Homo sapiens
tgaaagaaaatatgcatcta

SEQ ID NO: 2557499 - DNA, 20 bp, Homo sapiens
tgaaagaacatggacttgta

SEQ ID NO: 2557500 - DNA, 19 bp, Homo sapiens
tgaaagaccttctccaaat

SEQ ID NO: 2557501 - DNA, 15 bp, Homo sapiens
tgaaagactgtacaa

SEQ ID NO: 2557502 - DNA, 22 bp, Homo sapiens
tgaaagactgtacaaagtagaa

SEQ ID NO: 2557503 - DNA, 17 bp, Homo sapiens
tgaaagaggaatgaagt

SEQ ID NO: 2557504 - DNA, 20 bp, Homo sapiens
tgaaagagtaaaggaaatga

SEQ ID NO: 2557505 - DNA, 19 bp, Homo sapiens
tgaaagatggctgtgcctc

SEQ ID NO: 2557506 - DNA, 22 bp, Homo sapiens
tgaaagatggctgtgcctctgc

SEQ ID NO: 2557507 - DNA, 23 bp, Homo sapiens
tgaaagcagggacttgaacccat

SEQ ID NO: 2557508 - DNA, 15 bp, Homo sapiens
tgaaagcatccatgt

SEQ ID NO: 2557509 - DNA, 19 bp, Homo sapiens
tgaaaggcattctctgaag

SEQ ID NO: 2557510 - DNA, 20 bp, Homo sapiens
tgaaagggagctatcaggaa

SEQ ID NO: 2557511 - DNA, 23 bp, Homo sapiens
tgaaagggagtattacaaaaaca

SEQ ID NO: 2557512 - DNA, 15 bp, Homo sapiens
tgaaagggcccagag

SEQ ID NO: 2557513 - DNA, 16 bp, Homo sapiens
tgaaaggtaatttgag

SEQ ID NO: 2557514 - DNA, 15 bp, Homo sapiens
tgaaagtcagatgcc

SEQ ID NO: 2557515 - DNA, 11 bp, Homo sapiens
tgaaagtgact

SEQ ID NO: 2557516 - DNA, 20 bp, Homo sapiens
tgaaataaagaaattgcaat

SEQ ID NO: 2557517 - DNA, 17 bp, Homo sapiens
tgaaataacatggcctt

SEQ ID NO: 2557518 - DNA, 14 bp, Homo sapiens
tgaaataactcctt

SEQ ID NO: 2557519 - DNA, 14 bp, Homo sapiens
tgaaataagccaga

SEQ ID NO: 2557520 - DNA, 22 bp, Homo sapiens
tgaaataccagtgaaccaaaga

SEQ ID NO: 2557521 - DNA, 16 bp, Homo sapiens
tgaaataccagtgtgg

SEQ ID NO: 2557522 - DNA, 13 bp, Homo sapiens
tgaaatactactt

SEQ ID NO: 2557523 - DNA, 16 bp, Homo sapiens
tgaaatactgtttgag

SEQ ID NO: 2557524 - DNA, 17 bp, Homo sapiens
tgaaatagtctgtgtga

SEQ ID NO: 2557525 - DNA, 19 bp, Homo sapiens
tgaaatagttcaaagccaa

SEQ ID NO: 2557526 - DNA, 16 bp, Homo sapiens
tgaaatctcagaattc

SEQ ID NO: 2557527 - DNA, 19 bp, Homo sapiens
tgaaatctcagaattcctt

SEQ ID NO: 2557528 - DNA, 19 bp, Homo sapiens
tgaaatgacctcaagatgt

SEQ ID NO: 2557529 - DNA, 19 bp, Homo sapiens
tgaaatgaggtcagagcct

SEQ ID NO: 2557530 - DNA, 23 bp, Homo sapiens
tgaaatgaggtcagagcctgcag

SEQ ID NO: 2557531 - DNA, 18 bp, Homo sapiens
tgaaatgcatcattcttg

SEQ ID NO: 2557532 - DNA, 17 bp, Homo sapiens
tgaaatgctctcctttc

SEQ ID NO: 2557533 - DNA, 18 bp, Homo sapiens
tgaaattaaccatagatg

SEQ ID NO: 2557534 - DNA, 17 bp, Homo sapiens
tgaaattatgtatgttt

SEQ ID NO: 2557535 - DNA, 18 bp, Homo sapiens
tgaaattatgtatgttta

SEQ ID NO: 2557536 - DNA, 17 bp, Homo sapiens
tgaaattgtacatattt

SEQ ID NO: 2557537 - DNA, 22 bp, Homo sapiens
tgaaatttaatatagctatttt

SEQ ID NO: 2557538 - DNA, 22 bp, Homo sapiens
tgaaatttattagttaatatat

SEQ ID NO: 2557539 - DNA, 22 bp, Homo sapiens
tgaaatttcagattcccagagc

SEQ ID NO: 2557540 - DNA, 20 bp, Homo sapiens
tgaaattttctagactttct

SEQ ID NO: 2557541 - DNA, 21 bp, Homo sapiens
tgaaattttctagactttctg

SEQ ID NO: 2557542 - DNA, 15 bp, Homo sapiens
tgaaatttttattaa

SEQ ID NO: 2557543 - DNA, 20 bp, Homo sapiens
tgaaatttttattaaattat

SEQ ID NO: 2557544 - DNA, 19 bp, Homo sapiens
tgaacaaatttacagagac

SEQ ID NO: 2557545 - DNA, 12 bp, Homo sapiens
tgaacaagaatt

SEQ ID NO: 2557546 - DNA, 20 bp, Homo sapiens
tgaacaagttgtttcattga

SEQ ID NO: 2557547 - DNA, 16 bp, Homo sapiens
tgaacactcatgctga

SEQ ID NO: 2557548 - DNA, 19 bp, Homo sapiens
tgaacactccaattaagga

SEQ ID NO: 2557549 - DNA, 23 bp, Homo sapiens
tgaacactccaattaaggatttt

SEQ ID NO: 2557550 - DNA, 14 bp, Homo sapiens
tgaacactggggga

SEQ ID NO: 2557551 - DNA, 17 bp, Homo sapiens
tgaacatattgttgaaa

SEQ ID NO: 2557552 - DNA, 19 bp, Homo sapiens
tgaaccacatcttgctctg

SEQ ID NO: 2557553 - DNA, 20 bp, Homo sapiens
tgaaccacatcttgctctgc

SEQ ID NO: 2557554 - DNA, 17 bp, Homo sapiens
tgaaccaccacacccag

SEQ ID NO: 2557555 - DNA, 23 bp, Homo sapiens
tgaaccacttccctcatctctcc

SEQ ID NO: 2557556 - DNA, 21 bp, Homo sapiens
tgaacccaggacgcttctgaa

SEQ ID NO: 2557557 - DNA, 14 bp, Homo sapiens
tgaacccccatgat

SEQ ID NO: 2557558 - DNA, 22 bp, Homo sapiens
tgaacccgggacgcaggggttg

SEQ ID NO: 2557559 - DNA, 13 bp, Homo sapiens
tgaaccctgtgct

SEQ ID NO: 2557560 - DNA, 13 bp, Homo sapiens
tgaacccttgctt

SEQ ID NO: 2557561 - DNA, 22 bp, Homo sapiens
tgaaccgaggggctcaggaaaa

SEQ ID NO: 2557562 - DNA, 14 bp, Homo sapiens
tgaacctaccttca

SEQ ID NO: 2557563 - DNA, 15 bp, Homo sapiens
tgaacctgatgctga

SEQ ID NO: 2557564 - DNA, 12 bp, Homo sapiens
tgaacctggagg

SEQ ID NO: 2557565 - DNA, 20 bp, Homo sapiens
tgaactaccttggttccccc

SEQ ID NO: 2557566 - DNA, 23 bp, Homo sapiens
tgaactagggtggtgcatttttg

SEQ ID NO: 2557567 - DNA, 17 bp, Homo sapiens
tgaactcaactttgaca

SEQ ID NO: 2557568 - DNA, 14 bp, Homo sapiens
tgaactcagccaag

SEQ ID NO: 2557569 - DNA, 15 bp, Homo sapiens
tgaactcttaatcaa

SEQ ID NO: 2557570 - DNA, 19 bp, Homo sapiens
tgaactcttagaaatgaag

SEQ ID NO: 2557571 - DNA, 18 bp, Homo sapiens
tgaactcttcaatctctt

SEQ ID NO: 2557572 - DNA, 17 bp, Homo sapiens
tgaactctttgaatgac

SEQ ID NO: 2557573 - DNA, 19 bp, Homo sapiens
tgaactctttgaatgacaa

SEQ ID NO: 2557574 - DNA, 13 bp, Homo sapiens
tgaactgaagttt

SEQ ID NO: 2557575 - DNA, 13 bp, Homo sapiens
tgaactgacaggc

SEQ ID NO: 2557576 - DNA, 13 bp, Homo sapiens
tgaactgataaag

SEQ ID NO: 2557577 - DNA, 14 bp, Homo sapiens
tgaactgggacctt

SEQ ID NO: 2557578 - DNA, 19 bp, Homo sapiens
tgaactgggtacttgtgga

SEQ ID NO: 2557579 - DNA, 22 bp, Homo sapiens
tgaacttaaataaatgtcatta

SEQ ID NO: 2557580 - DNA, 14 bp, Homo sapiens
tgaacttcgcatca

SEQ ID NO: 2557581 - DNA, 11 bp, Homo sapiens
tgaactttctc

SEQ ID NO: 2557582 - DNA, 21 bp, Homo sapiens
tgaactttctcttcatacttt

SEQ ID NO: 2557583 - DNA, 17 bp, Homo sapiens
tgaactttgacctctgc

SEQ ID NO: 2557584 - DNA, 11 bp, Homo sapiens
tgaactttgct

SEQ ID NO: 2557585 - DNA, 17 bp, Homo sapiens
tgaagaaaaaatacatt

SEQ ID NO: 2557586 - DNA, 18 bp, Homo sapiens
tgaagaaaagtgggccag

SEQ ID NO: 2557587 - DNA, 22 bp, Homo sapiens
tgaagaagctaaatcctttact

SEQ ID NO: 2557588 - DNA, 13 bp, Homo sapiens
tgaagacaatgac

SEQ ID NO: 2557589 - DNA, 17 bp, Homo sapiens
tgaagacaatgacttac

SEQ ID NO: 2557590 - DNA, 22 bp, Homo sapiens
tgaagacaatgacttactgtac

SEQ ID NO: 2557591 - DNA, 14 bp, Homo sapiens
tgaagacagaggga

SEQ ID NO: 2557592 - DNA, 13 bp, Homo sapiens
tgaagaggaaggg

SEQ ID NO: 2557593 - DNA, 15 bp, Homo sapiens
tgaagaggcgggcca

SEQ ID NO: 2557594 - DNA, 19 bp, Homo sapiens
tgaagaggcgggccagcca

SEQ ID NO: 2557595 - DNA, 21 bp, Homo sapiens
tgaagaggcgggccagccagg

SEQ ID NO: 2557596 - DNA, 18 bp, Homo sapiens
tgaagagggagaagcatg

SEQ ID NO: 2557597 - DNA, 23 bp, Homo sapiens
tgaagagtaagtcaacctgcctg

SEQ ID NO: 2557598 - DNA, 17 bp, Homo sapiens
tgaagagtcctctgaat

SEQ ID NO: 2557599 - DNA, 23 bp, Homo sapiens
tgaagatataactattgcccagg

SEQ ID NO: 2557600 - DNA, 16 bp, Homo sapiens
tgaagatatcttgaaa

SEQ ID NO: 2557601 - DNA, 21 bp, Homo sapiens
tgaagatatcttgaaatgaaa

SEQ ID NO: 2557602 - DNA, 22 bp, Homo sapiens
tgaagatatcttgaaatgaaag

SEQ ID NO: 2557603 - DNA, 13 bp, Homo sapiens
tgaagatgatcat

SEQ ID NO: 2557604 - DNA, 15 bp, Homo sapiens
tgaagatgcagctca

SEQ ID NO: 2557605 - DNA, 18 bp, Homo sapiens
tgaagatggcatcctgtg

SEQ ID NO: 2557606 - DNA, 19 bp, Homo sapiens
tgaagatggcatcctgtga

SEQ ID NO: 2557607 - DNA, 21 bp, Homo sapiens
tgaagatggcatcctgtgaag

SEQ ID NO: 2557608 - DNA, 15 bp, Homo sapiens
tgaagattctcctgt

SEQ ID NO: 2557609 - DNA, 19 bp, Homo sapiens
tgaagattctcctgtgcta

SEQ ID NO: 2557610 - DNA, 14 bp, Homo sapiens
tgaagcaaacacat

SEQ ID NO: 2557611 - DNA, 15 bp, Homo sapiens
tgaagcaaatcagaa

SEQ ID NO: 2557612 - DNA, 17 bp, Homo sapiens
tgaagcaccaagctcaa

SEQ ID NO: 2557613 - DNA, 23 bp, Homo sapiens
tgaagcagatgcaaagaggcaag

SEQ ID NO: 2557614 - DNA, 17 bp, Homo sapiens
tgaagcagttgtgtcag

SEQ ID NO: 2557615 - DNA, 14 bp, Homo sapiens
tgaagcatgtttca

SEQ ID NO: 2557616 - DNA, 20 bp, Homo sapiens
tgaagcatgtttcatgtttt

SEQ ID NO: 2557617 - DNA, 22 bp, Homo sapiens
tgaagcattttataaatcgctt

SEQ ID NO: 2557618 - DNA, 16 bp, Homo sapiens
tgaagccactgaagct

SEQ ID NO: 2557619 - DNA, 19 bp, Homo sapiens
tgaagccactgaagctggg

SEQ ID NO: 2557620 - DNA, 15 bp, Homo sapiens
tgaagcccaataaac

SEQ ID NO: 2557621 - DNA, 19 bp, Homo sapiens
tgaagcccaataaacctct

SEQ ID NO: 2557622 - DNA, 14 bp, Homo sapiens
tgaagcctctggga

SEQ ID NO: 2557623 - DNA, 15 bp, Homo sapiens
tgaagctaagattta

SEQ ID NO: 2557624 - DNA, 18 bp, Homo sapiens
tgaagctcacctgttgct

SEQ ID NO: 2557625 - DNA, 19 bp, Homo sapiens
tgaagctcacctgttgctt

SEQ ID NO: 2557626 - DNA, 13 bp, Homo sapiens
tgaagcttgtgta

SEQ ID NO: 2557627 - DNA, 15 bp, Homo sapiens
tgaagcttgtgtatc

SEQ ID NO: 2557628 - DNA, 20 bp, Homo sapiens
tgaaggaataaattgctcct

SEQ ID NO: 2557629 - DNA, 22 bp, Homo sapiens
tgaaggacattgcggacagcca

SEQ ID NO: 2557630 - DNA, 10 bp, Homo sapiens
tgaaggactg

SEQ ID NO: 2557631 - DNA, 12 bp, Homo sapiens
tgaaggactgtg

SEQ ID NO: 2557632 - DNA, 23 bp, Homo sapiens
tgaaggactgtgacaggcagcag

SEQ ID NO: 2557633 - DNA, 16 bp, Homo sapiens
tgaaggagagcccttc

SEQ ID NO: 2557634 - DNA, 13 bp, Homo sapiens
tgaaggaggtgag

SEQ ID NO: 2557635 - DNA, 15 bp, Homo sapiens
tgaaggcagaaagca

SEQ ID NO: 2557636 - DNA, 18 bp, Homo sapiens
tgaaggcagaaagcaaaa

SEQ ID NO: 2557637 - DNA, 18 bp, Homo sapiens
tgaaggccccgcccaggc

SEQ ID NO: 2557638 - DNA, 18 bp, Homo sapiens
tgaaggcctggcccacag

SEQ ID NO: 2557639 - DNA, 21 bp, Homo sapiens
tgaaggctgggttctgatcct

SEQ ID NO: 2557640 - DNA, 19 bp, Homo sapiens
tgaaggcttctctctgtgg

SEQ ID NO: 2557641 - DNA, 18 bp, Homo sapiens
tgaagggaaaggatattt

SEQ ID NO: 2557642 - DNA, 20 bp, Homo sapiens
tgaagggaccttgaagggta

SEQ ID NO: 2557643 - DNA, 19 bp, Homo sapiens
tgaagggggatatgaatgg

SEQ ID NO: 2557644 - DNA, 16 bp, Homo sapiens
tgaaggttaggattta

SEQ ID NO: 2557645 - DNA, 13 bp, Homo sapiens
tgaaggtttctga

SEQ ID NO: 2557646 - DNA, 16 bp, Homo sapiens
tgaaggtttctgaaaa

SEQ ID NO: 2557647 - DNA, 15 bp, Homo sapiens
tgaagtaatatgcac

SEQ ID NO: 2557648 - DNA, 21 bp, Homo sapiens
tgaagtaatatgcacacattt

SEQ ID NO: 2557649 - DNA, 20 bp, Homo sapiens
tgaagtattttgctggaata

SEQ ID NO: 2557650 - DNA, 14 bp, Homo sapiens
tgaagtcacacagt

SEQ ID NO: 2557651 - DNA, 18 bp, Homo sapiens
tgaagtcacatcacagga

SEQ ID NO: 2557652 - DNA, 14 bp, Homo sapiens
tgaagtcagatgtg

SEQ ID NO: 2557653 - DNA, 16 bp, Homo sapiens
tgaagtcagatgtggt

SEQ ID NO: 2557654 - DNA, 11 bp, Homo sapiens
tgaagtctgaa

SEQ ID NO: 2557655 - DNA, 13 bp, Homo sapiens
tgaagtgaaactg

SEQ ID NO: 2557656 - DNA, 18 bp, Homo sapiens
tgaagtgagcacagccta

SEQ ID NO: 2557657 - DNA, 18 bp, Homo sapiens
tgaagtgtgtttccttca

SEQ ID NO: 2557658 - DNA, 13 bp, Homo sapiens
tgaagtttcacat

SEQ ID NO: 2557659 - DNA, 13 bp, Homo sapiens
tgaataaatacct

SEQ ID NO: 2557660 - DNA, 23 bp, Homo sapiens
tgaataaatacctcttagctgag

SEQ ID NO: 2557661 - DNA, 21 bp, Homo sapiens
tgaataaattctataggaaca

SEQ ID NO: 2557662 - DNA, 15 bp, Homo sapiens
tgaataaccacttaa

SEQ ID NO: 2557663 - DNA, 17 bp, Homo sapiens
tgaataagccattctga

SEQ ID NO: 2557664 - DNA, 18 bp, Homo sapiens
tgaataatggtaccagat

SEQ ID NO: 2557665 - DNA, 15 bp, Homo sapiens
tgaataatttcccaa

SEQ ID NO: 2557666 - DNA, 14 bp, Homo sapiens
tgaatataaacact

SEQ ID NO: 2557667 - DNA, 22 bp, Homo sapiens
tgaatataatatatttgtgtat

SEQ ID NO: 2557668 - DNA, 13 bp, Homo sapiens
tgaatatcccctc

SEQ ID NO: 2557669 - DNA, 14 bp, Homo sapiens
tgaatatcccctcc

SEQ ID NO: 2557670 - DNA, 16 bp, Homo sapiens
tgaatatcccctccca

SEQ ID NO: 2557671 - DNA, 21 bp, Homo sapiens
tgaatatggactcagttttct

SEQ ID NO: 2557672 - DNA, 13 bp, Homo sapiens
tgaatcaataata

SEQ ID NO: 2557673 - DNA, 20 bp, Homo sapiens
tgaatcaataatatattttc

SEQ ID NO: 2557674 - DNA, 17 bp, Homo sapiens
tgaatccatgcttgggt

SEQ ID NO: 2557675 - DNA, 21 bp, Homo sapiens
tgaatcccccttgccacccca

SEQ ID NO: 2557676 - DNA, 15 bp, Homo sapiens
tgaatcctaagggct

SEQ ID NO: 2557677 - DNA, 22 bp, Homo sapiens
tgaatcctaagggctggtctct

SEQ ID NO: 2557678 - DNA, 17 bp, Homo sapiens
tgaatcctcttctttat

SEQ ID NO: 2557679 - DNA, 20 bp, Homo sapiens
tgaatctaagcagcatttct

SEQ ID NO: 2557680 - DNA, 21 bp, Homo sapiens
tgaatctattatactgtatta

SEQ ID NO: 2557681 - DNA, 22 bp, Homo sapiens
tgaatctattatactgtattaa

SEQ ID NO: 2557682 - DNA, 21 bp, Homo sapiens
tgaatgaaaaatttaagcatt

SEQ ID NO: 2557683 - DNA, 22 bp, Homo sapiens
tgaatgaaaaatttaagcattg

SEQ ID NO: 2557684 - DNA, 19 bp, Homo sapiens
tgaatgaaacccccacaca

SEQ ID NO: 2557685 - DNA, 21 bp, Homo sapiens
tgaatgaaacccccacacaca

SEQ ID NO: 2557686 - DNA, 14 bp, Homo sapiens
tgaatgaaatatca

SEQ ID NO: 2557687 - DNA, 15 bp, Homo sapiens
tgaatgaatggctaa

SEQ ID NO: 2557688 - DNA, 17 bp, Homo sapiens
tgaatgacaacagaagc

SEQ ID NO: 2557689 - DNA, 17 bp, Homo sapiens
tgaatgaggtcccaggc

SEQ ID NO: 2557690 - DNA, 18 bp, Homo sapiens
tgaatgaggtcccaggca

SEQ ID NO: 2557691 - DNA, 19 bp, Homo sapiens
tgaatgcacactagcctct

SEQ ID NO: 2557692 - DNA, 14 bp, Homo sapiens
tgaatgcataaaat

SEQ ID NO: 2557693 - DNA, 16 bp, Homo sapiens
tgaatgcataaaatgt

SEQ ID NO: 2557694 - DNA, 17 bp, Homo sapiens
tgaatgcccccagctgg

SEQ ID NO: 2557695 - DNA, 18 bp, Homo sapiens
tgaatgcccccagctggc

SEQ ID NO: 2557696 - DNA, 19 bp, Homo sapiens
tgaatgcccccagctggcc

SEQ ID NO: 2557697 - DNA, 20 bp, Homo sapiens
tgaatggattggattattta

SEQ ID NO: 2557698 - DNA, 21 bp, Homo sapiens
tgaatggattggattatttaa

SEQ ID NO: 2557699 - DNA, 21 bp, Homo sapiens
tgaatggcctgccttgaagcc

SEQ ID NO: 2557700 - DNA, 17 bp, Homo sapiens
tgaatgggcaaaactga

SEQ ID NO: 2557701 - DNA, 18 bp, Homo sapiens
tgaatggtgttgtatgcc

SEQ ID NO: 2557702 - DNA, 20 bp, Homo sapiens
tgaatggtgttgtatgcctt

SEQ ID NO: 2557703 - DNA, 21 bp, Homo sapiens
tgaatggtgttgtatgccttt

SEQ ID NO: 2557704 - DNA, 21 bp, Homo sapiens
tgaatggttccatgcctgagg

SEQ ID NO: 2557705 - DNA, 15 bp, Homo sapiens
tgaatgtatgtgcac

SEQ ID NO: 2557706 - DNA, 23 bp, Homo sapiens
tgaatgtatgtgcactgtcactt

SEQ ID NO: 2557707 - DNA, 12 bp, Homo sapiens
tgaatgttctga

SEQ ID NO: 2557708 - DNA, 15 bp, Homo sapiens
tgaatgttctgacat

SEQ ID NO: 2557709 - DNA, 19 bp, Homo sapiens
tgaatgtttattccttgat

SEQ ID NO: 2557710 - DNA, 21 bp, Homo sapiens
tgaatgtttccaacctggagt

SEQ ID NO: 2557711 - DNA, 17 bp, Homo sapiens
tgaattaaataaaccct

SEQ ID NO: 2557712 - DNA, 16 bp, Homo sapiens
tgaattaaattaggaa

SEQ ID NO: 2557713 - DNA, 15 bp, Homo sapiens
tgaattaaatttaat

SEQ ID NO: 2557714 - DNA, 23 bp, Homo sapiens
tgaattaatcatctataaagaag

SEQ ID NO: 2557715 - DNA, 12 bp, Homo sapiens
tgaattcagatt

SEQ ID NO: 2557716 - DNA, 17 bp, Homo sapiens
tgaattcttatgcttat

SEQ ID NO: 2557717 - DNA, 20 bp, Homo sapiens
tgaattcttggttgaggaaa

SEQ ID NO: 2557718 - DNA, 21 bp, Homo sapiens
tgaattcttggttgaggaaac

SEQ ID NO: 2557719 - DNA, 22 bp, Homo sapiens
tgaattgcctgcagagagaagc

SEQ ID NO: 2557720 - DNA, 19 bp, Homo sapiens
tgaattgtaactgttcttg

SEQ ID NO: 2557721 - DNA, 15 bp, Homo sapiens
tgaatttaaatataa

SEQ ID NO: 2557722 - DNA, 20 bp, Homo sapiens
tgaatttaaatataattctg

SEQ ID NO: 2557723 - DNA, 15 bp, Homo sapiens
tgaatttcttttgcc

SEQ ID NO: 2557724 - DNA, 18 bp, Homo sapiens
tgaatttgaatgaaaaat

SEQ ID NO: 2557725 - DNA, 13 bp, Homo sapiens
tgaattttctgtg

SEQ ID NO: 2557726 - DNA, 13 bp, Homo sapiens
tgaatttttctct

SEQ ID NO: 2557727 - DNA, 17 bp, Homo sapiens
tgacaaaggcaagcact

SEQ ID NO: 2557728 - DNA, 23 bp, Homo sapiens
tgacaaatgtgtatcggatgctt

SEQ ID NO: 2557729 - DNA, 14 bp, Homo sapiens
tgacaacagaagct

SEQ ID NO: 2557730 - DNA, 22 bp, Homo sapiens
tgacaacagaagcttcagaagt

SEQ ID NO: 2557731 - DNA, 21 bp, Homo sapiens
tgacaaccaccgctccccagc

SEQ ID NO: 2557732 - DNA, 23 bp, Homo sapiens
tgacaaccaccgctccccagccc

SEQ ID NO: 2557733 - DNA, 13 bp, Homo sapiens
tgacaaggcccca

SEQ ID NO: 2557734 - DNA, 17 bp, Homo sapiens
tgacaaggccccagaga

SEQ ID NO: 2557735 - DNA, 12 bp, Homo sapiens
tgacaataaaac

SEQ ID NO: 2557736 - DNA, 16 bp, Homo sapiens
tgacaataaaacatta

SEQ ID NO: 2557737 - DNA, 14 bp, Homo sapiens
tgacaataaatgtg

SEQ ID NO: 2557738 - DNA, 17 bp, Homo sapiens
tgacaataatttcaggt

SEQ ID NO: 2557739 - DNA, 16 bp, Homo sapiens
tgacacacagctctgt

SEQ ID NO: 2557740 - DNA, 21 bp, Homo sapiens
tgacacacagctctgtcctgg

SEQ ID NO: 2557741 - DNA, 16 bp, Homo sapiens
tgacacagcagcttca

SEQ ID NO: 2557742 - DNA, 22 bp, Homo sapiens
tgacacagcagcttcaccagag

SEQ ID NO: 2557743 - DNA, 12 bp, Homo sapiens
tgacacatgcaa

SEQ ID NO: 2557744 - DNA, 20 bp, Homo sapiens
tgacacatgcaaggtcattt

SEQ ID NO: 2557745 - DNA, 15 bp, Homo sapiens
tgacaccagcctttc

SEQ ID NO: 2557746 - DNA, 23 bp, Homo sapiens
tgacaccagcctttctcccaggc

SEQ ID NO: 2557747 - DNA, 18 bp, Homo sapiens
tgacacctttgcaggcat

SEQ ID NO: 2557748 - DNA, 19 bp, Homo sapiens
tgacacctttgcaggcatg

SEQ ID NO: 2557749 - DNA, 19 bp, Homo sapiens
tgacactagcccaatgaaa

SEQ ID NO: 2557750 - DNA, 22 bp, Homo sapiens
tgacactcccttgggctccctg

SEQ ID NO: 2557751 - DNA, 17 bp, Homo sapiens
tgacacttaaaaatggt

SEQ ID NO: 2557752 - DNA, 19 bp, Homo sapiens
tgacacttcagagagctgg

SEQ ID NO: 2557753 - DNA, 13 bp, Homo sapiens
tgacagaacactg

SEQ ID NO: 2557754 - DNA, 16 bp, Homo sapiens
tgacagaacactgtct

SEQ ID NO: 2557755 - DNA, 14 bp, Homo sapiens
tgacagactctcgt

SEQ ID NO: 2557756 - DNA, 15 bp, Homo sapiens
tgacagaggcagccc

SEQ ID NO: 2557757 - DNA, 22 bp, Homo sapiens
tgacagagtgagactctgtctc

SEQ ID NO: 2557758 - DNA, 11 bp, Homo sapiens
tgacagcctcc

SEQ ID NO: 2557759 - DNA, 15 bp, Homo sapiens
tgacaggcagcagag

SEQ ID NO: 2557760 - DNA, 16 bp, Homo sapiens
tgacaggcagcagaga

SEQ ID NO: 2557761 - DNA, 20 bp, Homo sapiens
tgacaggcagcctggacata

SEQ ID NO: 2557762 - DNA, 14 bp, Homo sapiens
tgacagggaagcta

SEQ ID NO: 2557763 - DNA, 17 bp, Homo sapiens
tgacagggaagctacag

SEQ ID NO: 2557764 - DNA, 21 bp, Homo sapiens
tgacagggcacaccgggcact

SEQ ID NO: 2557765 - DNA, 15 bp, Homo sapiens
tgacaggtaaactat

SEQ ID NO: 2557766 - DNA, 14 bp, Homo sapiens
tgacagtgcctggg

SEQ ID NO: 2557767 - DNA, 20 bp, Homo sapiens
tgacagtgcctgggaatgta

SEQ ID NO: 2557768 - DNA, 21 bp, Homo sapiens
tgacataacactataaaggtt

SEQ ID NO: 2557769 - DNA, 17 bp, Homo sapiens
tgacatacatccaacat

SEQ ID NO: 2557770 - DNA, 19 bp, Homo sapiens
tgacatcacttgtacaaaa

SEQ ID NO: 2557771 - DNA, 22 bp, Homo sapiens
tgacatcacttgtacaaaataa

SEQ ID NO: 2557772 - DNA, 23 bp, Homo sapiens
tgacatcacttgtacaaaataaa

SEQ ID NO: 2557773 - DNA, 14 bp, Homo sapiens
tgacatctcagggg

SEQ ID NO: 2557774 - DNA, 21 bp, Homo sapiens
tgacatctcaggggccagagg

SEQ ID NO: 2557775 - DNA, 13 bp, Homo sapiens
tgacatgtaacag

SEQ ID NO: 2557776 - DNA, 19 bp, Homo sapiens
tgacatgtgaaaccttttt

SEQ ID NO: 2557777 - DNA, 16 bp, Homo sapiens
tgacatgtgactccta

SEQ ID NO: 2557778 - DNA, 20 bp, Homo sapiens
tgacattcctaaactatctt

SEQ ID NO: 2557779 - DNA, 19 bp, Homo sapiens
tgacattgctaagatgctc

SEQ ID NO: 2557780 - DNA, 21 bp, Homo sapiens
tgacattgttggccaaagcca

SEQ ID NO: 2557781 - DNA, 21 bp, Homo sapiens
tgacatttatttttctcatga

SEQ ID NO: 2557782 - DNA, 18 bp, Homo sapiens
tgaccaactagacattct

SEQ ID NO: 2557783 - DNA, 15 bp, Homo sapiens
tgaccaagagagaaa

SEQ ID NO: 2557784 - DNA, 14 bp, Homo sapiens
tgaccaagcaggaa

SEQ ID NO: 2557785 - DNA, 15 bp, Homo sapiens
tgaccaagcaggaag

SEQ ID NO: 2557786 - DNA, 19 bp, Homo sapiens
tgaccaagcaggaagctca

SEQ ID NO: 2557787 - DNA, 13 bp, Homo sapiens
tgaccaatgtctt

SEQ ID NO: 2557788 - DNA, 14 bp, Homo sapiens
tgaccaatgtcttg

SEQ ID NO: 2557789 - DNA, 15 bp, Homo sapiens
tgaccacacttcctg

SEQ ID NO: 2557790 - DNA, 18 bp, Homo sapiens
tgaccacacttcctgtcc

SEQ ID NO: 2557791 - DNA, 22 bp, Homo sapiens
tgaccacagcatcattttgcat

SEQ ID NO: 2557792 - DNA, 18 bp, Homo sapiens
tgaccacatagcatgagg

SEQ ID NO: 2557793 - DNA, 18 bp, Homo sapiens
tgaccaccctcccctctc

SEQ ID NO: 2557794 - DNA, 19 bp, Homo sapiens
tgaccaccctcccctctct

SEQ ID NO: 2557795 - DNA, 17 bp, Homo sapiens
tgaccactgcagaagac

SEQ ID NO: 2557796 - DNA, 18 bp, Homo sapiens
tgaccagcagatcccagc

SEQ ID NO: 2557797 - DNA, 21 bp, Homo sapiens
tgaccagcagatcccagctca

SEQ ID NO: 2557798 - DNA, 22 bp, Homo sapiens
tgaccagcagatcccagctcac

SEQ ID NO: 2557799 - DNA, 21 bp, Homo sapiens
tgaccagcctccatgctgcct

SEQ ID NO: 2557800 - DNA, 23 bp, Homo sapiens
tgaccagcctccatgctgcctcc

SEQ ID NO: 2557801 - DNA, 13 bp, Homo sapiens
tgaccaggcctgg

SEQ ID NO: 2557802 - DNA, 15 bp, Homo sapiens
tgaccaggcctgggc

SEQ ID NO: 2557803 - DNA, 20 bp, Homo sapiens
tgaccaggcctgggccagag

SEQ ID NO: 2557804 - DNA, 23 bp, Homo sapiens
tgaccagtttaacctgatgcagt

SEQ ID NO: 2557805 - DNA, 23 bp, Homo sapiens
tgaccattctccacctgccaggg

SEQ ID NO: 2557806 - DNA, 15 bp, Homo sapiens
tgacccacccctgtg

SEQ ID NO: 2557807 - DNA, 13 bp, Homo sapiens
tgacccactgctt

SEQ ID NO: 2557808 - DNA, 12 bp, Homo sapiens
tgacccaggctg

SEQ ID NO: 2557809 - DNA, 13 bp, Homo sapiens
tgacccaggctgg

SEQ ID NO: 2557810 - DNA, 15 bp, Homo sapiens
tgacccaggctgggc

SEQ ID NO: 2557811 - DNA, 19 bp, Homo sapiens
tgacccaggctgggcaagg

SEQ ID NO: 2557812 - DNA, 15 bp, Homo sapiens
tgacccatgctgccc

SEQ ID NO: 2557813 - DNA, 17 bp, Homo sapiens
tgacccatgctgccctg

SEQ ID NO: 2557814 - DNA, 21 bp, Homo sapiens
tgaccctgcgaaggggccctg

SEQ ID NO: 2557815 - DNA, 19 bp, Homo sapiens
tgaccgaaacagcgctggg

SEQ ID NO: 2557816 - DNA, 17 bp, Homo sapiens
tgacctagttttccatg

SEQ ID NO: 2557817 - DNA, 16 bp, Homo sapiens
tgacctatcacttcca

SEQ ID NO: 2557818 - DNA, 19 bp, Homo sapiens
tgacctcatgcatctccac

SEQ ID NO: 2557819 - DNA, 15 bp, Homo sapiens
tgacctccacagctt

SEQ ID NO: 2557820 - DNA, 17 bp, Homo sapiens
tgacctccacagcttcc

SEQ ID NO: 2557821 - DNA, 11 bp, Homo sapiens
tgacctcccag

SEQ ID NO: 2557822 - DNA, 12 bp, Homo sapiens
tgacctcccagc

SEQ ID NO: 2557823 - DNA, 13 bp, Homo sapiens
tgacctccctcta

SEQ ID NO: 2557824 - DNA, 13 bp, Homo sapiens
tgacctctgcagc

SEQ ID NO: 2557825 - DNA, 16 bp, Homo sapiens
tgacctctgcagcaat

SEQ ID NO: 2557826 - DNA, 18 bp, Homo sapiens
tgacctctgcagcaataa

SEQ ID NO: 2557827 - DNA, 14 bp, Homo sapiens
tgacctctgcctga

SEQ ID NO: 2557828 - DNA, 19 bp, Homo sapiens
tgacctctgttgtcctccc

SEQ ID NO: 2557829 - DNA, 18 bp, Homo sapiens
tgacctgaagttcaccat

SEQ ID NO: 2557830 - DNA, 14 bp, Homo sapiens
tgacctgaggaagc

SEQ ID NO: 2557831 - DNA, 14 bp, Homo sapiens
tgacctgaggccct

SEQ ID NO: 2557832 - DNA, 15 bp, Homo sapiens
tgacctgaggccctt

SEQ ID NO: 2557833 - DNA, 18 bp, Homo sapiens
tgacctgaggcccttctc

SEQ ID NO: 2557834 - DNA, 18 bp, Homo sapiens
tgacctgaggctcctgtg

SEQ ID NO: 2557835 - DNA, 17 bp, Homo sapiens
tgacctgcctcccttca

SEQ ID NO: 2557836 - DNA, 21 bp, Homo sapiens
tgacctgcctcccttcatgca

SEQ ID NO: 2557837 - DNA, 15 bp, Homo sapiens
tgacctgtcatgccc

SEQ ID NO: 2557838 - DNA, 16 bp, Homo sapiens
tgacctgtcatgcccc

SEQ ID NO: 2557839 - DNA, 21 bp, Homo sapiens
tgacctgtcatgcccccctca

SEQ ID NO: 2557840 - DNA, 21 bp, Homo sapiens
tgacctgtggggatttctccc

SEQ ID NO: 2557841 - DNA, 15 bp, Homo sapiens
tgaccttagtgtttc

SEQ ID NO: 2557842 - DNA, 14 bp, Homo sapiens
tgaccttctgggaa

SEQ ID NO: 2557843 - DNA, 22 bp, Homo sapiens
tgaccttgaggagtcttgtgtg

SEQ ID NO: 2557844 - DNA, 20 bp, Homo sapiens
tgaccttttgacttaaagca

SEQ ID NO: 2557845 - DNA, 14 bp, Homo sapiens
tgacgaagtctctt

SEQ ID NO: 2557846 - DNA, 19 bp, Homo sapiens
tgacgcaacccacgtgtaa

SEQ ID NO: 2557847 - DNA, 19 bp, Homo sapiens
tgacgccatcccagcccca

SEQ ID NO: 2557848 - DNA, 21 bp, Homo sapiens
tgacggtcccacactggtgac

SEQ ID NO: 2557849 - DNA, 23 bp, Homo sapiens
tgacggtcccacactggtgactg

SEQ ID NO: 2557850 - DNA, 17 bp, Homo sapiens
tgacggtgcagtctggg

SEQ ID NO: 2557851 - DNA, 19 bp, Homo sapiens
tgacgtcaagtctccttcc

SEQ ID NO: 2557852 - DNA, 22 bp, Homo sapiens
tgactaaaaaacaaagaagaca

SEQ ID NO: 2557853 - DNA, 14 bp, Homo sapiens
tgactaattgtata

SEQ ID NO: 2557854 - DNA, 18 bp, Homo sapiens
tgactaattgtataacag

SEQ ID NO: 2557855 - DNA, 20 bp, Homo sapiens
tgactagggattcaggctgc

SEQ ID NO: 2557856 - DNA, 21 bp, Homo sapiens
tgactagggattcaggctgct

SEQ ID NO: 2557857 - DNA, 16 bp, Homo sapiens
tgactatatagagatg

SEQ ID NO: 2557858 - DNA, 21 bp, Homo sapiens
tgactatatagagatgttttt

SEQ ID NO: 2557859 - DNA, 23 bp, Homo sapiens
tgactcaacatgttactgaccag

SEQ ID NO: 2557860 - DNA, 14 bp, Homo sapiens
tgactcagggctcc

SEQ ID NO: 2557861 - DNA, 17 bp, Homo sapiens
tgactcagggctcctgg

SEQ ID NO: 2557862 - DNA, 11 bp, Homo sapiens
tgactccagga

SEQ ID NO: 2557863 - DNA, 18 bp, Homo sapiens
tgactccaggagaggagc

SEQ ID NO: 2557864 - DNA, 21 bp, Homo sapiens
tgactccgctggaggtggggc

SEQ ID NO: 2557865 - DNA, 22 bp, Homo sapiens
tgactccttagagacatcaaaa

SEQ ID NO: 2557866 - DNA, 21 bp, Homo sapiens
tgactcgagggttgggttcat

SEQ ID NO: 2557867 - DNA, 20 bp, Homo sapiens
tgactcgtctgactgtgtgt

SEQ ID NO: 2557868 - DNA, 14 bp, Homo sapiens
tgactctcaaatct

SEQ ID NO: 2557869 - DNA, 11 bp, Homo sapiens
tgactctgaaa

SEQ ID NO: 2557870 - DNA, 14 bp, Homo sapiens
tgactctgaaatct

SEQ ID NO: 2557871 - DNA, 15 bp, Homo sapiens
tgactctgccccctg

SEQ ID NO: 2557872 - DNA, 19 bp, Homo sapiens
tgactctgccccctgctgg

SEQ ID NO: 2557873 - DNA, 19 bp, Homo sapiens
tgactcttggcacagcatg

SEQ ID NO: 2557874 - DNA, 20 bp, Homo sapiens
tgactcttgttttcagtttc

SEQ ID NO: 2557875 - DNA, 19 bp, Homo sapiens
tgactgaagatgcagctca

SEQ ID NO: 2557876 - DNA, 15 bp, Homo sapiens
tgactgaatttcttt

SEQ ID NO: 2557877 - DNA, 16 bp, Homo sapiens
tgactgcgatcttcag

SEQ ID NO: 2557878 - DNA, 17 bp, Homo sapiens
tgactgcgatcttcaga

SEQ ID NO: 2557879 - DNA, 11 bp, Homo sapiens
tgactggatat

SEQ ID NO: 2557880 - DNA, 13 bp, Homo sapiens
tgactgtcactgt

SEQ ID NO: 2557881 - DNA, 17 bp, Homo sapiens
tgactgtttttacccat

SEQ ID NO: 2557882 - DNA, 20 bp, Homo sapiens
tgacttatttatataaattt

SEQ ID NO: 2557883 - DNA, 17 bp, Homo sapiens
tgacttcaatgatagta

SEQ ID NO: 2557884 - DNA, 14 bp, Homo sapiens
tgacttccacacct

SEQ ID NO: 2557885 - DNA, 15 bp, Homo sapiens
tgacttctccaggtc

SEQ ID NO: 2557886 - DNA, 16 bp, Homo sapiens
tgacttctccaggtct

SEQ ID NO: 2557887 - DNA, 17 bp, Homo sapiens
tgacttgacagaacact

SEQ ID NO: 2557888 - DNA, 18 bp, Homo sapiens
tgactttatatggatgat

SEQ ID NO: 2557889 - DNA, 13 bp, Homo sapiens
tgactttcaggta

SEQ ID NO: 2557890 - DNA, 13 bp, Homo sapiens
tgactttctcagc

SEQ ID NO: 2557891 - DNA, 14 bp, Homo sapiens
tgactttttgcatt

SEQ ID NO: 2557892 - DNA, 16 bp, Homo sapiens
tgagaaaaagctcctg

SEQ ID NO: 2557893 - DNA, 18 bp, Homo sapiens
tgagaaaaagctcctgtc

SEQ ID NO: 2557894 - DNA, 16 bp, Homo sapiens
tgagaaaacttctttt

SEQ ID NO: 2557895 - DNA, 15 bp, Homo sapiens
tgagaaagactattc

SEQ ID NO: 2557896 - DNA, 18 bp, Homo sapiens
tgagaaagactattcaaa

SEQ ID NO: 2557897 - DNA, 20 bp, Homo sapiens
tgagaaagactattcaaaca

SEQ ID NO: 2557898 - DNA, 22 bp, Homo sapiens
tgagaaatgaataatttcccaa

SEQ ID NO: 2557899 - DNA, 13 bp, Homo sapiens
tgagaaattaagt

SEQ ID NO: 2557900 - DNA, 12 bp, Homo sapiens
tgagaacactgt

SEQ ID NO: 2557901 - DNA, 16 bp, Homo sapiens
tgagaaccctgcgtgg

SEQ ID NO: 2557902 - DNA, 21 bp, Homo sapiens
tgagaaccctgcgtggggaca

SEQ ID NO: 2557903 - DNA, 20 bp, Homo sapiens
tgagaagctttgccctccta

SEQ ID NO: 2557904 - DNA, 18 bp, Homo sapiens
tgagaagtccccttccat

SEQ ID NO: 2557905 - DNA, 20 bp, Homo sapiens
tgagaatcagatcatttcaa

SEQ ID NO: 2557906 - DNA, 23 bp, Homo sapiens
tgagaattttaaattataactta

SEQ ID NO: 2557907 - DNA, 13 bp, Homo sapiens
tgagacagaatct

SEQ ID NO: 2557908 - DNA, 14 bp, Homo sapiens
tgagacagaatctc

SEQ ID NO: 2557909 - DNA, 19 bp, Homo sapiens
tgagacagcccgggctctg

SEQ ID NO: 2557910 - DNA, 20 bp, Homo sapiens
tgagacagcccgggctctgc

SEQ ID NO: 2557911 - DNA, 18 bp, Homo sapiens
tgagacagtgggaaatat

SEQ ID NO: 2557912 - DNA, 14 bp, Homo sapiens
tgagacagtttctt

SEQ ID NO: 2557913 - DNA, 15 bp, Homo sapiens
tgagacagtttctta

SEQ ID NO: 2557914 - DNA, 20 bp, Homo sapiens
tgagacagtttcttagcttt

SEQ ID NO: 2557915 - DNA, 23 bp, Homo sapiens
tgagacagtttcttagcttttta

SEQ ID NO: 2557916 - DNA, 21 bp, Homo sapiens
tgagaccacagagagagggga

SEQ ID NO: 2557917 - DNA, 12 bp, Homo sapiens
tgagaccagttg

SEQ ID NO: 2557918 - DNA, 14 bp, Homo sapiens
tgagacccccacac

SEQ ID NO: 2557919 - DNA, 16 bp, Homo sapiens
tgagacccccacacct

SEQ ID NO: 2557920 - DNA, 17 bp, Homo sapiens
tgagacccccacacctc

SEQ ID NO: 2557921 - DNA, 22 bp, Homo sapiens
tgagacccccacacctcagttc

SEQ ID NO: 2557922 - DNA, 12 bp, Homo sapiens
tgagaccctgtc

SEQ ID NO: 2557923 - DNA, 14 bp, Homo sapiens
tgagaccctgtctc

SEQ ID NO: 2557924 - DNA, 23 bp, Homo sapiens
tgagacggagtctcgctctgtca

SEQ ID NO: 2557925 - DNA, 12 bp, Homo sapiens
tgagactctgtc

SEQ ID NO: 2557926 - DNA, 20 bp, Homo sapiens
tgagactctgtctcagtcca

SEQ ID NO: 2557927 - DNA, 12 bp, Homo sapiens
tgagacttccaa

SEQ ID NO: 2557928 - DNA, 20 bp, Homo sapiens
tgagacttgctctctggcct

SEQ ID NO: 2557929 - DNA, 19 bp, Homo sapiens
tgagagaatggaaaacaga

SEQ ID NO: 2557930 - DNA, 23 bp, Homo sapiens
tgagagagatgggagctcctctc

SEQ ID NO: 2557931 - DNA, 16 bp, Homo sapiens
tgagagccccagctga

SEQ ID NO: 2557932 - DNA, 19 bp, Homo sapiens
tgagagctgctctggaaaa

SEQ ID NO: 2557933 - DNA, 23 bp, Homo sapiens
tgagaggacttttctttgtggct

SEQ ID NO: 2557934 - DNA, 17 bp, Homo sapiens
tgagagggcatgcgcac

SEQ ID NO: 2557935 - DNA, 18 bp, Homo sapiens
tgagaggggctgtccagt

SEQ ID NO: 2557936 - DNA, 17 bp, Homo sapiens
tgagagtatcaggtctc

SEQ ID NO: 2557937 - DNA, 19 bp, Homo sapiens
tgagagtatcaggtctccc

SEQ ID NO: 2557938 - DNA, 22 bp, Homo sapiens
tgagagtgtcttcacggcagga

SEQ ID NO: 2557939 - DNA, 24 bp, Homo sapiens
tgagagtgtcttcacggcaggaca

SEQ ID NO: 2557940 - DNA, 20 bp, Homo sapiens
tgagataccagcgaggaggc

SEQ ID NO: 2557941 - DNA, 13 bp, Homo sapiens
tgagatcaggctc

SEQ ID NO: 2557942 - DNA, 16 bp, Homo sapiens
tgagatctaagccttt

SEQ ID NO: 2557943 - DNA, 20 bp, Homo sapiens
tgagatctaagcctttccat

SEQ ID NO: 2557944 - DNA, 21 bp, Homo sapiens
tgagatctaagcctttccata

SEQ ID NO: 2557945 - DNA, 19 bp, Homo sapiens
tgagatgattcagaagggg

SEQ ID NO: 2557946 - DNA, 16 bp, Homo sapiens
tgagatggacacactg

SEQ ID NO: 2557947 - DNA, 13 bp, Homo sapiens
tgagatgtgaaca

SEQ ID NO: 2557948 - DNA, 19 bp, Homo sapiens
tgagatgtgaacacatcag

SEQ ID NO: 2557949 - DNA, 15 bp, Homo sapiens
tgagattattttaat

SEQ ID NO: 2557950 - DNA, 18 bp, Homo sapiens
tgagattgcaccactgca

SEQ ID NO: 2557951 - DNA, 15 bp, Homo sapiens
tgagcaaatgtggct

SEQ ID NO: 2557952 - DNA, 18 bp, Homo sapiens
tgagcaaatgtggctcct

SEQ ID NO: 2557953 - DNA, 17 bp, Homo sapiens
tgagcaactttcttaca

SEQ ID NO: 2557954 - DNA, 20 bp, Homo sapiens
tgagcacactttagtggccg

SEQ ID NO: 2557955 - DNA, 17 bp, Homo sapiens
tgagcacagcctagggc

SEQ ID NO: 2557956 - DNA, 12 bp, Homo sapiens
tgagcacctgct

SEQ ID NO: 2557957 - DNA, 21 bp, Homo sapiens
tgagcacctgcttcatgctca

SEQ ID NO: 2557958 - DNA, 22 bp, Homo sapiens
tgagcagggagatcctggttgg

SEQ ID NO: 2557959 - DNA, 13 bp, Homo sapiens
tgagcagggctca

SEQ ID NO: 2557960 - DNA, 19 bp, Homo sapiens
tgagcagggctcagcgggg

SEQ ID NO: 2557961 - DNA, 23 bp, Homo sapiens
tgagcagggctcagcggggacag

SEQ ID NO: 2557962 - DNA, 13 bp, Homo sapiens
tgagcatcaggcc

SEQ ID NO: 2557963 - DNA, 16 bp, Homo sapiens
tgagcatcaggccagg

SEQ ID NO: 2557964 - DNA, 18 bp, Homo sapiens
tgagcatcaggccaggcc

SEQ ID NO: 2557965 - DNA, 19 bp, Homo sapiens
tgagcatcaggccaggccc

SEQ ID NO: 2557966 - DNA, 14 bp, Homo sapiens
tgagcatggagctg

SEQ ID NO: 2557967 - DNA, 12 bp, Homo sapiens
tgagccaccacg

SEQ ID NO: 2557968 - DNA, 14 bp, Homo sapiens
tgagccactgcacc

SEQ ID NO: 2557969 - DNA, 18 bp, Homo sapiens
tgagccaggcctgggtct

SEQ ID NO: 2557970 - DNA, 21 bp, Homo sapiens
tgagccaggtaatgagggact

SEQ ID NO: 2557971 - DNA, 17 bp, Homo sapiens
tgagcccacaaagcctt

SEQ ID NO: 2557972 - DNA, 21 bp, Homo sapiens
tgagcccactgcccaccccct

SEQ ID NO: 2557973 - DNA, 22 bp, Homo sapiens
tgagcccactgcccaccccctc

SEQ ID NO: 2557974 - DNA, 23 bp, Homo sapiens
tgagcccccccaacactgtgccc

SEQ ID NO: 2557975 - DNA, 16 bp, Homo sapiens
tgagcccgggctgcct

SEQ ID NO: 2557976 - DNA, 13 bp, Homo sapiens
tgagcctcagcat

SEQ ID NO: 2557977 - DNA, 21 bp, Homo sapiens
tgagcctcagcatcctggcac

SEQ ID NO: 2557978 - DNA, 22 bp, Homo sapiens
tgagcctcagcatcctggcacc

SEQ ID NO: 2557979 - DNA, 19 bp, Homo sapiens
tgagcctctcacctgtact

SEQ ID NO: 2557980 - DNA, 10 bp, Homo sapiens
tgagcctggc

SEQ ID NO: 2557981 - DNA, 16 bp, Homo sapiens
tgagcctggcaagaat

SEQ ID NO: 2557982 - DNA, 17 bp, Homo sapiens
tgagccttgaactttga

SEQ ID NO: 2557983 - DNA, 14 bp, Homo sapiens
tgagctatgtatta

SEQ ID NO: 2557984 - DNA, 15 bp, Homo sapiens
tgagctatgtattaa

SEQ ID NO: 2557985 - DNA, 15 bp, Homo sapiens
tgagctatttcatct

SEQ ID NO: 2557986 - DNA, 12 bp, Homo sapiens
tgagctccagac

SEQ ID NO: 2557987 - DNA, 15 bp, Homo sapiens
tgagctccagacccc

SEQ ID NO: 2557988 - DNA, 17 bp, Homo sapiens
tgagctccagaccccca

SEQ ID NO: 2557989 - DNA, 21 bp, Homo sapiens
tgagctccagacccccagcaa

SEQ ID NO: 2557990 - DNA, 13 bp, Homo sapiens
tgagctcctctgg

SEQ ID NO: 2557991 - DNA, 15 bp, Homo sapiens
tgagctcctctgggc

SEQ ID NO: 2557992 - DNA, 14 bp, Homo sapiens
tgagctcggtggac

SEQ ID NO: 2557993 - DNA, 18 bp, Homo sapiens
tgagctctgcagcccagg

SEQ ID NO: 2557994 - DNA, 14 bp, Homo sapiens
tgagctgagcaggg

SEQ ID NO: 2557995 - DNA, 16 bp, Homo sapiens
tgagctgagcagggag

SEQ ID NO: 2557996 - DNA, 16 bp, Homo sapiens
tgagctgcctctgaga

SEQ ID NO: 2557997 - DNA, 13 bp, Homo sapiens
tgagctgggatga

SEQ ID NO: 2557998 - DNA, 15 bp, Homo sapiens
tgagctgttgcctca

SEQ ID NO: 2557999 - DNA, 15 bp, Homo sapiens
tgagcttatcatgct

SEQ ID NO: 2558000 - DNA, 19 bp, Homo sapiens
tgagcttggcagctgaact

SEQ ID NO: 2558001 - DNA, 13 bp, Homo sapiens
tgagcttggccag

SEQ ID NO: 2558002 - DNA, 19 bp, Homo sapiens
tgagcttggccagaagggg

SEQ ID NO: 2558003 - DNA, 21 bp, Homo sapiens
tgagcttggccagaagggggc

SEQ ID NO: 2558004 - DNA, 12 bp, Homo sapiens
tgagcttttcta

SEQ ID NO: 2558005 - DNA, 13 bp, Homo sapiens
tgagcttttctag

SEQ ID NO: 2558006 - DNA, 15 bp, Homo sapiens
tgaggaaaggccagc

SEQ ID NO: 2558007 - DNA, 16 bp, Homo sapiens
tgaggaaaggccagct

SEQ ID NO: 2558008 - DNA, 19 bp, Homo sapiens
tgaggaaaggccagctggc

SEQ ID NO: 2558009 - DNA, 19 bp, Homo sapiens
tgaggaatagttgagcccc

SEQ ID NO: 2558010 - DNA, 20 bp, Homo sapiens
tgaggaatagttgagcccca

SEQ ID NO: 2558011 - DNA, 21 bp, Homo sapiens
tgaggaatttcacctgtaaac

SEQ ID NO: 2558012 - DNA, 18 bp, Homo sapiens
tgaggaattttctttgtg

SEQ ID NO: 2558013 - DNA, 19 bp, Homo sapiens
tgaggacaaccattccaga

SEQ ID NO: 2558014 - DNA, 13 bp, Homo sapiens
tgaggacagctgt

SEQ ID NO: 2558015 - DNA, 11 bp, Homo sapiens
tgaggagctgc

SEQ ID NO: 2558016 - DNA, 14 bp, Homo sapiens
tgaggaggcctcca

SEQ ID NO: 2558017 - DNA, 16 bp, Homo sapiens
tgaggaggcctccatc

SEQ ID NO: 2558018 - DNA, 16 bp, Homo sapiens
tgaggagtcttgtgtg

SEQ ID NO: 2558019 - DNA, 16 bp, Homo sapiens
tgaggagtgtgagaat

SEQ ID NO: 2558020 - DNA, 15 bp, Homo sapiens
tgaggatgagctgga

SEQ ID NO: 2558021 - DNA, 16 bp, Homo sapiens
tgaggatgagctggaa

SEQ ID NO: 2558022 - DNA, 20 bp, Homo sapiens
tgaggatgggaaggagggag

SEQ ID NO: 2558023 - DNA, 17 bp, Homo sapiens
tgaggatgtcactcaga

SEQ ID NO: 2558024 - DNA, 20 bp, Homo sapiens
tgaggcaaccacaggcagca

SEQ ID NO: 2558025 - DNA, 16 bp, Homo sapiens
tgaggcaatgtcagga

SEQ ID NO: 2558026 - DNA, 20 bp, Homo sapiens
tgaggcaatgtcaggaacag

SEQ ID NO: 2558027 - DNA, 21 bp, Homo sapiens
tgaggcaatgtcaggaacaga

SEQ ID NO: 2558028 - DNA, 12 bp, Homo sapiens
tgaggcagacag

SEQ ID NO: 2558029 - DNA, 14 bp, Homo sapiens
tgaggcagacagca

SEQ ID NO: 2558030 - DNA, 20 bp, Homo sapiens
tgaggcagacagcagctcag

SEQ ID NO: 2558031 - DNA, 23 bp, Homo sapiens
tgaggcagacagcagctcaggca

SEQ ID NO: 2558032 - DNA, 24 bp, Homo sapiens
tgaggcagacagcagctcaggcac

SEQ ID NO: 2558033 - DNA, 21 bp, Homo sapiens
tgaggcagcagtgtgaggcca

SEQ ID NO: 2558034 - DNA, 15 bp, Homo sapiens
tgaggcaggctttgt

SEQ ID NO: 2558035 - DNA, 18 bp, Homo sapiens
tgaggcattgcacaggga

SEQ ID NO: 2558036 - DNA, 12 bp, Homo sapiens
tgaggccaggag

SEQ ID NO: 2558037 - DNA, 14 bp, Homo sapiens
tgaggccagggcag

SEQ ID NO: 2558038 - DNA, 15 bp, Homo sapiens
tgaggccagggcaga

SEQ ID NO: 2558039 - DNA, 16 bp, Homo sapiens
tgaggccagggcagag

SEQ ID NO: 2558040 - DNA, 17 bp, Homo sapiens
tgaggcccagagggcct

SEQ ID NO: 2558041 - DNA, 18 bp, Homo sapiens
tgaggcccagagggcctg

SEQ ID NO: 2558042 - DNA, 24 bp, Homo sapiens
tgaggcccttctctccagcccctg

SEQ ID NO: 2558043 - DNA, 16 bp, Homo sapiens
tgaggccgctagaggc

SEQ ID NO: 2558044 - DNA, 17 bp, Homo sapiens
tgaggccgctagaggcc

SEQ ID NO: 2558045 - DNA, 20 bp, Homo sapiens
tgaggccgctagaggcctga

SEQ ID NO: 2558046 - DNA, 19 bp, Homo sapiens
tgaggcctaaaagtaaaca

SEQ ID NO: 2558047 - DNA, 15 bp, Homo sapiens
tgaggcctcagtgga

SEQ ID NO: 2558048 - DNA, 23 bp, Homo sapiens
tgaggcctcttggacctctgctc

SEQ ID NO: 2558049 - DNA, 17 bp, Homo sapiens
tgaggcctgccctcagg

SEQ ID NO: 2558050 - DNA, 21 bp, Homo sapiens
tgaggcctgccctcagggatc

SEQ ID NO: 2558051 - DNA, 16 bp, Homo sapiens
tgaggcctggccaggc

SEQ ID NO: 2558052 - DNA, 12 bp, Homo sapiens
tgaggccttgct

SEQ ID NO: 2558053 - DNA, 13 bp, Homo sapiens
tgaggctctgccc

SEQ ID NO: 2558054 - DNA, 15 bp, Homo sapiens
tgaggctctgccctt

SEQ ID NO: 2558055 - DNA, 17 bp, Homo sapiens
tgaggctctttctgggc

SEQ ID NO: 2558056 - DNA, 16 bp, Homo sapiens
tgaggctgggctccct

SEQ ID NO: 2558057 - DNA, 15 bp, Homo sapiens
tgaggcttccagaga

SEQ ID NO: 2558058 - DNA, 13 bp, Homo sapiens
tgaggcttgctga

SEQ ID NO: 2558059 - DNA, 14 bp, Homo sapiens
tgaggcttgctgag

SEQ ID NO: 2558060 - DNA, 15 bp, Homo sapiens
tgaggcttgctgaga

SEQ ID NO: 2558061 - DNA, 20 bp, Homo sapiens
tgaggcttgctgagaggggc

SEQ ID NO: 2558062 - DNA, 14 bp, Homo sapiens
tgagggagcttagc

SEQ ID NO: 2558063 - DNA, 13 bp, Homo sapiens
tgagggcccagag

SEQ ID NO: 2558064 - DNA, 15 bp, Homo sapiens
tgagggcccagagca

SEQ ID NO: 2558065 - DNA, 17 bp, Homo sapiens
tgagggcccagagcagg

SEQ ID NO: 2558066 - DNA, 17 bp, Homo sapiens
tgagggcgaggggaggg

SEQ ID NO: 2558067 - DNA, 21 bp, Homo sapiens
tgaggggaggaaactcacctg

SEQ ID NO: 2558068 - DNA, 12 bp, Homo sapiens
tgaggggcctct

SEQ ID NO: 2558069 - DNA, 15 bp, Homo sapiens
tgaggggctcctgga

SEQ ID NO: 2558070 - DNA, 15 bp, Homo sapiens
tgagggtccccacct

SEQ ID NO: 2558071 - DNA, 19 bp, Homo sapiens
tgagggtcttcttacatgc

SEQ ID NO: 2558072 - DNA, 22 bp, Homo sapiens
tgagggtgactatggagctgag

SEQ ID NO: 2558073 - DNA, 21 bp, Homo sapiens
tgagggtgcttgttccctctc

SEQ ID NO: 2558074 - DNA, 20 bp, Homo sapiens
tgagggttgggctggtgtca

SEQ ID NO: 2558075 - DNA, 19 bp, Homo sapiens
tgagggtttctgagctgct

SEQ ID NO: 2558076 - DNA, 17 bp, Homo sapiens
tgaggtactgagagtga

SEQ ID NO: 2558077 - DNA, 22 bp, Homo sapiens
tgaggtactgagagtgaacaaa

SEQ ID NO: 2558078 - DNA, 13 bp, Homo sapiens
tgaggtcagagcc

SEQ ID NO: 2558079 - DNA, 14 bp, Homo sapiens
tgaggtcagagcct

SEQ ID NO: 2558080 - DNA, 17 bp, Homo sapiens
tgaggtcagagcctgca

SEQ ID NO: 2558081 - DNA, 19 bp, Homo sapiens
tgaggtcagagcctgcagt

SEQ ID NO: 2558082 - DNA, 16 bp, Homo sapiens
tgaggtccagccctgg

SEQ ID NO: 2558083 - DNA, 21 bp, Homo sapiens
tgaggtccagccctggctgaa

SEQ ID NO: 2558084 - DNA, 17 bp, Homo sapiens
tgaggtcccaggcagag

SEQ ID NO: 2558085 - DNA, 16 bp, Homo sapiens
tgaggtctgctcggcc

SEQ ID NO: 2558086 - DNA, 15 bp, Homo sapiens
tgaggtctgttcttt

SEQ ID NO: 2558087 - DNA, 17 bp, Homo sapiens
tgaggtcttttgacatg

SEQ ID NO: 2558088 - DNA, 16 bp, Homo sapiens
tgaggtgctatgttct

SEQ ID NO: 2558089 - DNA, 23 bp, Homo sapiens
tgaggtggcactttttcatttgc

SEQ ID NO: 2558090 - DNA, 13 bp, Homo sapiens
tgaggtgggagga

SEQ ID NO: 2558091 - DNA, 13 bp, Homo sapiens
tgaggtgggccca

SEQ ID NO: 2558092 - DNA, 15 bp, Homo sapiens
tgaggtgggcccagg

SEQ ID NO: 2558093 - DNA, 13 bp, Homo sapiens
tgaggtggtctga

SEQ ID NO: 2558094 - DNA, 14 bp, Homo sapiens
tgaggtggtctgaa

SEQ ID NO: 2558095 - DNA, 18 bp, Homo sapiens
tgaggtgtgggggctgca

SEQ ID NO: 2558096 - DNA, 21 bp, Homo sapiens
tgaggtgtgggggctgcagca

SEQ ID NO: 2558097 - DNA, 21 bp, Homo sapiens
tgaggtttccttcagacagat

SEQ ID NO: 2558098 - DNA, 17 bp, Homo sapiens
tgagtaagagctggtgt

SEQ ID NO: 2558099 - DNA, 18 bp, Homo sapiens
tgagtaagagctggtgtc

SEQ ID NO: 2558100 - DNA, 21 bp, Homo sapiens
tgagtatctcctcgcaagctg

SEQ ID NO: 2558101 - DNA, 17 bp, Homo sapiens
tgagtcaccaagcccag

SEQ ID NO: 2558102 - DNA, 16 bp, Homo sapiens
tgagtcacccatgaag

SEQ ID NO: 2558103 - DNA, 13 bp, Homo sapiens
tgagtccagaagt

SEQ ID NO: 2558104 - DNA, 19 bp, Homo sapiens
tgagtcccagtgggaggcg

SEQ ID NO: 2558105 - DNA, 20 bp, Homo sapiens
tgagtcccctgtttgtttct

SEQ ID NO: 2558106 - DNA, 18 bp, Homo sapiens
tgagtccttaaacagggc

SEQ ID NO: 2558107 - DNA, 16 bp, Homo sapiens
tgagtccttgaaaata

SEQ ID NO: 2558108 - DNA, 14 bp, Homo sapiens
tgagtctcttcaga

SEQ ID NO: 2558109 - DNA, 13 bp, Homo sapiens
tgagtctgaaggc

SEQ ID NO: 2558110 - DNA, 15 bp, Homo sapiens
tgagtcttggcggca

SEQ ID NO: 2558111 - DNA, 14 bp, Homo sapiens
tgagtgatagagct

SEQ ID NO: 2558112 - DNA, 20 bp, Homo sapiens
tgagtgatgcggcagattga

SEQ ID NO: 2558113 - DNA, 13 bp, Homo sapiens
tgagtgctctgat

SEQ ID NO: 2558114 - DNA, 15 bp, Homo sapiens
tgagtggcatggcca

SEQ ID NO: 2558115 - DNA, 23 bp, Homo sapiens
tgagtgggggatcacagcctctg

SEQ ID NO: 2558116 - DNA, 15 bp, Homo sapiens
tgagtgtggaagccg

SEQ ID NO: 2558117 - DNA, 14 bp, Homo sapiens
tgagtgtggctccc

SEQ ID NO: 2558118 - DNA, 16 bp, Homo sapiens
tgagtgtggctcccct

SEQ ID NO: 2558119 - DNA, 15 bp, Homo sapiens
tgagttacttcctat

SEQ ID NO: 2558120 - DNA, 17 bp, Homo sapiens
tgagttattttaattat

SEQ ID NO: 2558121 - DNA, 23 bp, Homo sapiens
tgagttgatagcacagaccctgc

SEQ ID NO: 2558122 - DNA, 20 bp, Homo sapiens
tgagttggtgttgacatgtg

SEQ ID NO: 2558123 - DNA, 21 bp, Homo sapiens
tgagtttagtgatctgaacag

SEQ ID NO: 2558124 - DNA, 15 bp, Homo sapiens
tgagtttcatagcta

SEQ ID NO: 2558125 - DNA, 19 bp, Homo sapiens
tgagtttcattctcctgcc

SEQ ID NO: 2558126 - DNA, 18 bp, Homo sapiens
tgagttttattgagaatt

SEQ ID NO: 2558127 - DNA, 17 bp, Homo sapiens
tgagttttttctcttgg

SEQ ID NO: 2558128 - DNA, 19 bp, Homo sapiens
tgataaagtagtaaaaatt

SEQ ID NO: 2558129 - DNA, 18 bp, Homo sapiens
tgataaagtttctcagat

SEQ ID NO: 2558130 - DNA, 22 bp, Homo sapiens
tgataaagtttctcagatcctt

SEQ ID NO: 2558131 - DNA, 15 bp, Homo sapiens
tgataactttgcttg

SEQ ID NO: 2558132 - DNA, 17 bp, Homo sapiens
tgataagagaatcaaca

SEQ ID NO: 2558133 - DNA, 20 bp, Homo sapiens
tgataaggatcagaacagca

SEQ ID NO: 2558134 - DNA, 18 bp, Homo sapiens
tgataatcaactgggctg

SEQ ID NO: 2558135 - DNA, 15 bp, Homo sapiens
tgataatgttaaatt

SEQ ID NO: 2558136 - DNA, 17 bp, Homo sapiens
tgataatgttaaatttg

SEQ ID NO: 2558137 - DNA, 21 bp, Homo sapiens
tgataatgttaaatttgtaag

SEQ ID NO: 2558138 - DNA, 22 bp, Homo sapiens
tgataatgttaaatttgtaagt

SEQ ID NO: 2558139 - DNA, 17 bp, Homo sapiens
tgataattccagtggtc

SEQ ID NO: 2558140 - DNA, 20 bp, Homo sapiens
tgatacaaattgcagactgt

SEQ ID NO: 2558141 - DNA, 17 bp, Homo sapiens
tgatacaagattagaag

SEQ ID NO: 2558142 - DNA, 15 bp, Homo sapiens
tgatacaatgctgtg

SEQ ID NO: 2558143 - DNA, 21 bp, Homo sapiens
tgatacaatgctgtgccctaa

SEQ ID NO: 2558144 - DNA, 14 bp, Homo sapiens
tgataccagctgga

SEQ ID NO: 2558145 - DNA, 15 bp, Homo sapiens
tgatacccccctctg

SEQ ID NO: 2558146 - DNA, 19 bp, Homo sapiens
tgataccgaattgtgactc

SEQ ID NO: 2558147 - DNA, 21 bp, Homo sapiens
tgatacttttgacaacaaatt

SEQ ID NO: 2558148 - DNA, 13 bp, Homo sapiens
tgatagcacagac

SEQ ID NO: 2558149 - DNA, 15 bp, Homo sapiens
tgatagcacagaccc

SEQ ID NO: 2558150 - DNA, 20 bp, Homo sapiens
tgatagcacagaccctgccc

SEQ ID NO: 2558151 - DNA, 22 bp, Homo sapiens
tgatagcacagaccctgccctg

SEQ ID NO: 2558152 - DNA, 11 bp, Homo sapiens
tgatagcttta

SEQ ID NO: 2558153 - DNA, 14 bp, Homo sapiens
tgatagctttattt

SEQ ID NO: 2558154 - DNA, 21 bp, Homo sapiens
tgataggaatgtgaaagcacg

SEQ ID NO: 2558155 - DNA, 12 bp, Homo sapiens
tgatagttactg

SEQ ID NO: 2558156 - DNA, 20 bp, Homo sapiens
tgatagttactgttgtgacc

SEQ ID NO: 2558157 - DNA, 24 bp, Homo sapiens
tgatagttgtaccgcaatgtgact

SEQ ID NO: 2558158 - DNA, 16 bp, Homo sapiens
tgatatatggataatg

SEQ ID NO: 2558159 - DNA, 21 bp, Homo sapiens
tgatatatgtgtttttcacat

SEQ ID NO: 2558160 - DNA, 13 bp, Homo sapiens
tgatatattttac

SEQ ID NO: 2558161 - DNA, 15 bp, Homo sapiens
tgatatattttacaa

SEQ ID NO: 2558162 - DNA, 12 bp, Homo sapiens
tgatatgaaaaa

SEQ ID NO: 2558163 - DNA, 19 bp, Homo sapiens
tgatatgatttaaaacatg

SEQ ID NO: 2558164 - DNA, 19 bp, Homo sapiens
tgatatgcagttttcctta

SEQ ID NO: 2558165 - DNA, 15 bp, Homo sapiens
tgatatggcagaaga

SEQ ID NO: 2558166 - DNA, 18 bp, Homo sapiens
tgatatggcagaagacac

SEQ ID NO: 2558167 - DNA, 20 bp, Homo sapiens
tgatatggcagaagacacca

SEQ ID NO: 2558168 - DNA, 19 bp, Homo sapiens
tgatatgttggtagattct

SEQ ID NO: 2558169 - DNA, 20 bp, Homo sapiens
tgatattcaaatggacaaac

SEQ ID NO: 2558170 - DNA, 20 bp, Homo sapiens
tgatattccatgaatgtatc

SEQ ID NO: 2558171 - DNA, 19 bp, Homo sapiens
tgatatttccccatggttt

SEQ ID NO: 2558172 - DNA, 23 bp, Homo sapiens
tgatatttccctcccctggggac

SEQ ID NO: 2558173 - DNA, 20 bp, Homo sapiens
tgatattttctgtgcctgaa

SEQ ID NO: 2558174 - DNA, 13 bp, Homo sapiens
tgatcaataaaat

SEQ ID NO: 2558175 - DNA, 15 bp, Homo sapiens
tgatcaataaaatgt

SEQ ID NO: 2558176 - DNA, 19 bp, Homo sapiens
tgatcaataaaatgtgatt

SEQ ID NO: 2558177 - DNA, 18 bp, Homo sapiens
tgatcaatgacagagcct

SEQ ID NO: 2558178 - DNA, 18 bp, Homo sapiens
tgatcactggcaatgaaa

SEQ ID NO: 2558179 - DNA, 17 bp, Homo sapiens
tgatcattttcccccca

SEQ ID NO: 2558180 - DNA, 22 bp, Homo sapiens
tgatcattttccccccactctc

SEQ ID NO: 2558181 - DNA, 14 bp, Homo sapiens
tgatccaagctggt

SEQ ID NO: 2558182 - DNA, 21 bp, Homo sapiens
tgatccaagctggtcccactc

SEQ ID NO: 2558183 - DNA, 16 bp, Homo sapiens
tgatccacccacctca

SEQ ID NO: 2558184 - DNA, 17 bp, Homo sapiens
tgatccacccacctcag

SEQ ID NO: 2558185 - DNA, 18 bp, Homo sapiens
tgatccacccacctcagc

SEQ ID NO: 2558186 - DNA, 19 bp, Homo sapiens
tgatcccaagtgccagtct

SEQ ID NO: 2558187 - DNA, 12 bp, Homo sapiens
tgatcccagcac

SEQ ID NO: 2558188 - DNA, 18 bp, Homo sapiens
tgatccccaagtgtgaac

SEQ ID NO: 2558189 - DNA, 21 bp, Homo sapiens
tgatccctgttacccagagaa

SEQ ID NO: 2558190 - DNA, 22 bp, Homo sapiens
tgatccgttccattgcaagctt

SEQ ID NO: 2558191 - DNA, 18 bp, Homo sapiens
tgatcctcccacctcagc

SEQ ID NO: 2558192 - DNA, 19 bp, Homo sapiens
tgatcctcccacctcagcc

SEQ ID NO: 2558193 - DNA, 17 bp, Homo sapiens
tgatcgcctttcccagg

SEQ ID NO: 2558194 - DNA, 23 bp, Homo sapiens
tgatcgtgacgctgaataaatgt

SEQ ID NO: 2558195 - DNA, 14 bp, Homo sapiens
tgatctaggaagac

SEQ ID NO: 2558196 - DNA, 13 bp, Homo sapiens
tgatctaggttta

SEQ ID NO: 2558197 - DNA, 14 bp, Homo sapiens
tgatctaggtttaa

SEQ ID NO: 2558198 - DNA, 16 bp, Homo sapiens
tgatctaggtttaact

SEQ ID NO: 2558199 - DNA, 18 bp, Homo sapiens
tgatctaggtttaactca

SEQ ID NO: 2558200 - DNA, 14 bp, Homo sapiens
tgatctcaggttct

SEQ ID NO: 2558201 - DNA, 21 bp, Homo sapiens
tgatctgatgcaagcaagaaa

SEQ ID NO: 2558202 - DNA, 22 bp, Homo sapiens
tgatctgtatatacaataacat

SEQ ID NO: 2558203 - DNA, 19 bp, Homo sapiens
tgatctgtgctttccagct

SEQ ID NO: 2558204 - DNA, 22 bp, Homo sapiens
tgatctgtgctttccagctcac

SEQ ID NO: 2558205 - DNA, 21 bp, Homo sapiens
tgatcttggcttactgcagcc

SEQ ID NO: 2558206 - DNA, 14 bp, Homo sapiens
tgatcttgtgacat

SEQ ID NO: 2558207 - DNA, 14 bp, Homo sapiens
tgatctttaaaata

SEQ ID NO: 2558208 - DNA, 19 bp, Homo sapiens
tgatctttctttcctttct

SEQ ID NO: 2558209 - DNA, 16 bp, Homo sapiens
tgatctttgcagacag

SEQ ID NO: 2558210 - DNA, 14 bp, Homo sapiens
tgatgaactttctc

SEQ ID NO: 2558211 - DNA, 23 bp, Homo sapiens
tgatgaactttctcttcatactt

SEQ ID NO: 2558212 - DNA, 16 bp, Homo sapiens
tgatgagctcctcttc

SEQ ID NO: 2558213 - DNA, 17 bp, Homo sapiens
tgatgaggcctcttgga

SEQ ID NO: 2558214 - DNA, 19 bp, Homo sapiens
tgatgatctttgcagacag

SEQ ID NO: 2558215 - DNA, 23 bp, Homo sapiens
tgatgatctttgcagacaggcaa

SEQ ID NO: 2558216 - DNA, 21 bp, Homo sapiens
tgatgatgggaattgtgtgat

SEQ ID NO: 2558217 - DNA, 17 bp, Homo sapiens
tgatgcattaaaagaaa

SEQ ID NO: 2558218 - DNA, 19 bp, Homo sapiens
tgatgcattaaaagaaaat

SEQ ID NO: 2558219 - DNA, 21 bp, Homo sapiens
tgatgcattaaaagaaaataa

SEQ ID NO: 2558220 - DNA, 14 bp, Homo sapiens
tgatgccaggacac

SEQ ID NO: 2558221 - DNA, 16 bp, Homo sapiens
tgatgctaaataggag

SEQ ID NO: 2558222 - DNA, 14 bp, Homo sapiens
tgatgctcaggctt

SEQ ID NO: 2558223 - DNA, 14 bp, Homo sapiens
tgatgctggagagg

SEQ ID NO: 2558224 - DNA, 15 bp, Homo sapiens
tgatgctggagaggt

SEQ ID NO: 2558225 - DNA, 17 bp, Homo sapiens
tgatgctggagaggtta

SEQ ID NO: 2558226 - DNA, 12 bp, Homo sapiens
tgatgctgggat

SEQ ID NO: 2558227 - DNA, 18 bp, Homo sapiens
tgatgcttcttcagagac

SEQ ID NO: 2558228 - DNA, 21 bp, Homo sapiens
tgatgcttcttcagagactcc

SEQ ID NO: 2558229 - DNA, 20 bp, Homo sapiens
tgatggacccaatgcacaca

SEQ ID NO: 2558230 - DNA, 20 bp, Homo sapiens
tgatggcaggatggcctggc

SEQ ID NO: 2558231 - DNA, 13 bp, Homo sapiens
tgatggcttctcc

SEQ ID NO: 2558232 - DNA, 22 bp, Homo sapiens
tgatgggcaacccccagcctgc

SEQ ID NO: 2558233 - DNA, 17 bp, Homo sapiens
tgatggggaaggaggct

SEQ ID NO: 2558234 - DNA, 15 bp, Homo sapiens
tgatggggccctgcc

SEQ ID NO: 2558235 - DNA, 15 bp, Homo sapiens
tgatggtgatgaaat

SEQ ID NO: 2558236 - DNA, 15 bp, Homo sapiens
tgatggtgctgacct

SEQ ID NO: 2558237 - DNA, 19 bp, Homo sapiens
tgatgtaagtttacctatg

SEQ ID NO: 2558238 - DNA, 22 bp, Homo sapiens
tgatgtaatcttgaattgtaac

SEQ ID NO: 2558239 - DNA, 18 bp, Homo sapiens
tgatgtaccatgaaacaa

SEQ ID NO: 2558240 - DNA, 17 bp, Homo sapiens
tgatgtcatctgtcact

SEQ ID NO: 2558241 - DNA, 12 bp, Homo sapiens
tgatgtccagaa

SEQ ID NO: 2558242 - DNA, 19 bp, Homo sapiens
tgatgtcccaacttgtaaa

SEQ ID NO: 2558243 - DNA, 15 bp, Homo sapiens
tgatgtccctatgga

SEQ ID NO: 2558244 - DNA, 16 bp, Homo sapiens
tgatgtccctatggaa

SEQ ID NO: 2558245 - DNA, 15 bp, Homo sapiens
tgatgtggtgcctga

SEQ ID NO: 2558246 - DNA, 16 bp, Homo sapiens
tgatgtggtgcctgag

SEQ ID NO: 2558247 - DNA, 23 bp, Homo sapiens
tgatgtgttgtgatagctaacat

SEQ ID NO: 2558248 - DNA, 14 bp, Homo sapiens
tgatgttaaaattc

SEQ ID NO: 2558249 - DNA, 16 bp, Homo sapiens
tgatgttaaaattcca

SEQ ID NO: 2558250 - DNA, 10 bp, Homo sapiens
tgatgttaac

SEQ ID NO: 2558251 - DNA, 15 bp, Homo sapiens
tgatgttaacacatt

SEQ ID NO: 2558252 - DNA, 20 bp, Homo sapiens
tgatgttaacacattttgta

SEQ ID NO: 2558253 - DNA, 16 bp, Homo sapiens
tgatgttcagtgtaat

SEQ ID NO: 2558254 - DNA, 18 bp, Homo sapiens
tgatgttcagtgtaattt

SEQ ID NO: 2558255 - DNA, 13 bp, Homo sapiens
tgatgttggaaga

SEQ ID NO: 2558256 - DNA, 13 bp, Homo sapiens
tgatgtttgtcct

SEQ ID NO: 2558257 - DNA, 19 bp, Homo sapiens
tgatgttttccatgagtcc

SEQ ID NO: 2558258 - DNA, 23 bp, Homo sapiens
tgatgttttccatgagtcccctg

SEQ ID NO: 2558259 - DNA, 18 bp, Homo sapiens
tgatgttttcctataata

SEQ ID NO: 2558260 - DNA, 13 bp, Homo sapiens
tgattaaattctt

SEQ ID NO: 2558261 - DNA, 16 bp, Homo sapiens
tgattaaattcttgca

SEQ ID NO: 2558262 - DNA, 17 bp, Homo sapiens
tgattaaattcttgcaa

SEQ ID NO: 2558263 - DNA, 19 bp, Homo sapiens
tgattaaccacttcagctg

SEQ ID NO: 2558264 - DNA, 20 bp, Homo sapiens
tgattaaccacttcagctga

SEQ ID NO: 2558265 - DNA, 15 bp, Homo sapiens
tgattacacaaaaca

SEQ ID NO: 2558266 - DNA, 14 bp, Homo sapiens
tgattacacagttg

SEQ ID NO: 2558267 - DNA, 14 bp, Homo sapiens
tgattactctttga

SEQ ID NO: 2558268 - DNA, 11 bp, Homo sapiens
tgattagatga

SEQ ID NO: 2558269 - DNA, 16 bp, Homo sapiens
tgattagtaaagaaat

SEQ ID NO: 2558270 - DNA, 18 bp, Homo sapiens
tgattattctgattccac

SEQ ID NO: 2558271 - DNA, 16 bp, Homo sapiens
tgattatttcacttta

SEQ ID NO: 2558272 - DNA, 23 bp, Homo sapiens
tgattcaactaaaaaaaaaaaag

SEQ ID NO: 2558273 - DNA, 23 bp, Homo sapiens
tgattcaatctgtaaactgtgta

SEQ ID NO: 2558274 - DNA, 21 bp, Homo sapiens
tgattcaattcaacactccct

SEQ ID NO: 2558275 - DNA, 12 bp, Homo sapiens
tgattcacagtg

SEQ ID NO: 2558276 - DNA, 12 bp, Homo sapiens
tgattcactgca

SEQ ID NO: 2558277 - DNA, 14 bp, Homo sapiens
tgattcagacagct

SEQ ID NO: 2558278 - DNA, 15 bp, Homo sapiens
tgattcagacagctg

SEQ ID NO: 2558279 - DNA, 16 bp, Homo sapiens
tgattcagacagctgc

SEQ ID NO: 2558280 - DNA, 19 bp, Homo sapiens
tgattcatgccaattagca

SEQ ID NO: 2558281 - DNA, 15 bp, Homo sapiens
tgattccacttttat

SEQ ID NO: 2558282 - DNA, 19 bp, Homo sapiens
tgattctcagggtctctgc

SEQ ID NO: 2558283 - DNA, 19 bp, Homo sapiens
tgattctcctgcctcagcc

SEQ ID NO: 2558284 - DNA, 13 bp, Homo sapiens
tgattctgccttt

SEQ ID NO: 2558285 - DNA, 13 bp, Homo sapiens
tgattctgtgtgt

SEQ ID NO: 2558286 - DNA, 14 bp, Homo sapiens
tgattgctaaatgt

SEQ ID NO: 2558287 - DNA, 14 bp, Homo sapiens
tgattggattattc

SEQ ID NO: 2558288 - DNA, 16 bp, Homo sapiens
tgattggattattcat

SEQ ID NO: 2558289 - DNA, 17 bp, Homo sapiens
tgattgggaataaatat

SEQ ID NO: 2558290 - DNA, 21 bp, Homo sapiens
tgattggtgcaacccttaccc

SEQ ID NO: 2558291 - DNA, 19 bp, Homo sapiens
tgattgtaacgttgctgtg

SEQ ID NO: 2558292 - DNA, 22 bp, Homo sapiens
tgattgtaacgttgctgtggga

SEQ ID NO: 2558293 - DNA, 16 bp, Homo sapiens
tgattgtgtctcttgg

SEQ ID NO: 2558294 - DNA, 14 bp, Homo sapiens
tgattgttggcaca

SEQ ID NO: 2558295 - DNA, 14 bp, Homo sapiens
tgatttaaaacatg

SEQ ID NO: 2558296 - DNA, 15 bp, Homo sapiens
tgatttaaaacatgt

SEQ ID NO: 2558297 - DNA, 17 bp, Homo sapiens
tgatttaataaaataat

SEQ ID NO: 2558298 - DNA, 22 bp, Homo sapiens
tgatttagtgtttttacctctg

SEQ ID NO: 2558299 - DNA, 11 bp, Homo sapiens
tgatttcagga

SEQ ID NO: 2558300 - DNA, 18 bp, Homo sapiens
tgatttcaggatactctg

SEQ ID NO: 2558301 - DNA, 19 bp, Homo sapiens
tgatttcaggatactctgt

SEQ ID NO: 2558302 - DNA, 23 bp, Homo sapiens
tgatttcaggatactctgtcaga

SEQ ID NO: 2558303 - DNA, 14 bp, Homo sapiens
tgatttctattcaa

SEQ ID NO: 2558304 - DNA, 17 bp, Homo sapiens
tgatttggggatatttt

SEQ ID NO: 2558305 - DNA, 14 bp, Homo sapiens
tgattttaacaata

SEQ ID NO: 2558306 - DNA, 19 bp, Homo sapiens
tgattttaacaataactac

SEQ ID NO: 2558307 - DNA, 16 bp, Homo sapiens
tgattttaataatata

SEQ ID NO: 2558308 - DNA, 15 bp, Homo sapiens
tgattttatctgtga

SEQ ID NO: 2558309 - DNA, 13 bp, Homo sapiens
tgattttctgttg

SEQ ID NO: 2558310 - DNA, 17 bp, Homo sapiens
tgattttgctgtagaag

SEQ ID NO: 2558311 - DNA, 21 bp, Homo sapiens
tgatttttgcctcttccagtc

SEQ ID NO: 2558312 - DNA, 22 bp, Homo sapiens
tgatttttgcctcttccagtct

SEQ ID NO: 2558313 - DNA, 22 bp, Homo sapiens
tgatttttttttcatacactta

SEQ ID NO: 2558314 - DNA, 22 bp, Homo sapiens
tgcaaaaggttcactaaagcag

SEQ ID NO: 2558315 - DNA, 14 bp, Homo sapiens
tgcaaaatttccag

SEQ ID NO: 2558316 - DNA, 16 bp, Homo sapiens
tgcaaaatttccagta

SEQ ID NO: 2558317 - DNA, 23 bp, Homo sapiens
tgcaaacacacaaaggtataatt

SEQ ID NO: 2558318 - DNA, 23 bp, Homo sapiens
tgcaaacctgacccctgctcagt

SEQ ID NO: 2558319 - DNA, 16 bp, Homo sapiens
tgcaaactcactgctc

SEQ ID NO: 2558320 - DNA, 17 bp, Homo sapiens
tgcaaactttattttca

SEQ ID NO: 2558321 - DNA, 16 bp, Homo sapiens
tgcaaagaaaatcaga

SEQ ID NO: 2558322 - DNA, 13 bp, Homo sapiens
tgcaaagaggcaa

SEQ ID NO: 2558323 - DNA, 15 bp, Homo sapiens
tgcaaagaggcaaga

SEQ ID NO: 2558324 - DNA, 19 bp, Homo sapiens
tgcaaagaggcaagaggct

SEQ ID NO: 2558325 - DNA, 12 bp, Homo sapiens
tgcaaagatttg

SEQ ID NO: 2558326 - DNA, 16 bp, Homo sapiens
tgcaaaggaaatacca

SEQ ID NO: 2558327 - DNA, 12 bp, Homo sapiens
tgcaaaggactg

SEQ ID NO: 2558328 - DNA, 20 bp, Homo sapiens
tgcaaagtcatgcaaaggct

SEQ ID NO: 2558329 - DNA, 22 bp, Homo sapiens
tgcaaagtcatgcaaaggctgg

SEQ ID NO: 2558330 - DNA, 23 bp, Homo sapiens
tgcaaagttccctacttcctgtg

SEQ ID NO: 2558331 - DNA, 10 bp, Homo sapiens
tgcaaatcct

SEQ ID NO: 2558332 - DNA, 12 bp, Homo sapiens
tgcaaatcctat

SEQ ID NO: 2558333 - DNA, 13 bp, Homo sapiens
tgcaacaaaattc

SEQ ID NO: 2558334 - DNA, 13 bp, Homo sapiens
tgcaacagcactg

SEQ ID NO: 2558335 - DNA, 14 bp, Homo sapiens
tgcaacagcactgg

SEQ ID NO: 2558336 - DNA, 15 bp, Homo sapiens
tgcaacaggcactca

SEQ ID NO: 2558337 - DNA, 13 bp, Homo sapiens
tgcaacaggctgg

SEQ ID NO: 2558338 - DNA, 14 bp, Homo sapiens
tgcaacaggctggg

SEQ ID NO: 2558339 - DNA, 15 bp, Homo sapiens
tgcaacaggctgggc

SEQ ID NO: 2558340 - DNA, 16 bp, Homo sapiens
tgcaacaggctgggct

SEQ ID NO: 2558341 - DNA, 13 bp, Homo sapiens
tgcaacagtagca

SEQ ID NO: 2558342 - DNA, 11 bp, Homo sapiens
tgcaaccactg

SEQ ID NO: 2558343 - DNA, 20 bp, Homo sapiens
tgcaacccaaggactgaggg

SEQ ID NO: 2558344 - DNA, 17 bp, Homo sapiens
tgcaacccttacccctt

SEQ ID NO: 2558345 - DNA, 20 bp, Homo sapiens
tgcaacctccgcctcttggg

SEQ ID NO: 2558346 - DNA, 20 bp, Homo sapiens
tgcaacctgattgtgtctct

SEQ ID NO: 2558347 - DNA, 22 bp, Homo sapiens
tgcaacctgattgtgtctcttg

SEQ ID NO: 2558348 - DNA, 16 bp, Homo sapiens
tgcaacggcttagact

SEQ ID NO: 2558349 - DNA, 14 bp, Homo sapiens
tgcaacttctgcct

SEQ ID NO: 2558350 - DNA, 23 bp, Homo sapiens
tgcaactttaagcagctcttgct

SEQ ID NO: 2558351 - DNA, 16 bp, Homo sapiens
tgcaaggaaggaaaga

SEQ ID NO: 2558352 - DNA, 11 bp, Homo sapiens
tgcaagggaaa

SEQ ID NO: 2558353 - DNA, 15 bp, Homo sapiens
tgcaagggctcccca

SEQ ID NO: 2558354 - DNA, 20 bp, Homo sapiens
tgcaagggctccccactgcc

SEQ ID NO: 2558355 - DNA, 18 bp, Homo sapiens
tgcaaggggaaaatctca

SEQ ID NO: 2558356 - DNA, 16 bp, Homo sapiens
tgcaagtcagaggatg

SEQ ID NO: 2558357 - DNA, 21 bp, Homo sapiens
tgcaagtcagaggatggccag

SEQ ID NO: 2558358 - DNA, 16 bp, Homo sapiens
tgcaagtcatggctgt

SEQ ID NO: 2558359 - DNA, 21 bp, Homo sapiens
tgcaagtgtatgcacgtgtgc

SEQ ID NO: 2558360 - DNA, 23 bp, Homo sapiens
tgcaagtgtgtgcacatgtgtgc

SEQ ID NO: 2558361 - DNA, 18 bp, Homo sapiens
tgcaagtgtgtgcatgtg

SEQ ID NO: 2558362 - DNA, 14 bp, Homo sapiens
tgcaatatgtatta

SEQ ID NO: 2558363 - DNA, 15 bp, Homo sapiens
tgcaatgaagtctct

SEQ ID NO: 2558364 - DNA, 22 bp, Homo sapiens
tgcaatgaagtctctgaagtga

SEQ ID NO: 2558365 - DNA, 13 bp, Homo sapiens
tgcaatggcagcc

SEQ ID NO: 2558366 - DNA, 15 bp, Homo sapiens
tgcaatgggcactgg

SEQ ID NO: 2558367 - DNA, 18 bp, Homo sapiens
tgcaattcccctctgctg

SEQ ID NO: 2558368 - DNA, 15 bp, Homo sapiens
tgcaattgcttagga

SEQ ID NO: 2558369 - DNA, 21 bp, Homo sapiens
tgcaattgtaggggtgtgtgt

SEQ ID NO: 2558370 - DNA, 17 bp, Homo sapiens
tgcacaaagcccttcca

SEQ ID NO: 2558371 - DNA, 21 bp, Homo sapiens
tgcacaaccatctgtccctgc

SEQ ID NO: 2558372 - DNA, 23 bp, Homo sapiens
tgcacaagctccaagctcccagg

SEQ ID NO: 2558373 - DNA, 19 bp, Homo sapiens
tgcacaatattgaactttt

SEQ ID NO: 2558374 - DNA, 15 bp, Homo sapiens
tgcacacaccagagc

SEQ ID NO: 2558375 - DNA, 21 bp, Homo sapiens
tgcacacaccagagcccacct

SEQ ID NO: 2558376 - DNA, 12 bp, Homo sapiens
tgcacacatttt

SEQ ID NO: 2558377 - DNA, 21 bp, Homo sapiens
tgcacactagcctctccagga

SEQ ID NO: 2558378 - DNA, 16 bp, Homo sapiens
tgcacagagctctcca

SEQ ID NO: 2558379 - DNA, 18 bp, Homo sapiens
tgcacagagttgttacat

SEQ ID NO: 2558380 - DNA, 20 bp, Homo sapiens
tgcacagagttgttacattt

SEQ ID NO: 2558381 - DNA, 19 bp, Homo sapiens
tgcacagatggatttgcct

SEQ ID NO: 2558382 - DNA, 23 bp, Homo sapiens
tgcacagatggatttgcctgtgc

SEQ ID NO: 2558383 - DNA, 18 bp, Homo sapiens
tgcacagcggcccctgca

SEQ ID NO: 2558384 - DNA, 19 bp, Homo sapiens
tgcacagtgatttttttct

SEQ ID NO: 2558385 - DNA, 22 bp, Homo sapiens
tgcacagttagcaaactttgta

SEQ ID NO: 2558386 - DNA, 23 bp, Homo sapiens
tgcacagttttctggctggagcc

SEQ ID NO: 2558387 - DNA, 15 bp, Homo sapiens
tgcacatacttgaga

SEQ ID NO: 2558388 - DNA, 14 bp, Homo sapiens
tgcacatatggact

SEQ ID NO: 2558389 - DNA, 16 bp, Homo sapiens
tgcacatctgtgtctt

SEQ ID NO: 2558390 - DNA, 19 bp, Homo sapiens
tgcacatctgtgtcttgtt

SEQ ID NO: 2558391 - DNA, 23 bp, Homo sapiens
tgcacatgaatcccacccacatg

SEQ ID NO: 2558392 - DNA, 23 bp, Homo sapiens
tgcacatgtcttgtacatgtgta

SEQ ID NO: 2558393 - DNA, 14 bp, Homo sapiens
tgcaccaagcagga

SEQ ID NO: 2558394 - DNA, 22 bp, Homo sapiens
tgcaccaagcaggaaatgaaaa

SEQ ID NO: 2558395 - DNA, 14 bp, Homo sapiens
tgcaccactgcact

SEQ ID NO: 2558396 - DNA, 18 bp, Homo sapiens
tgcacccacccaggagtg

SEQ ID NO: 2558397 - DNA, 17 bp, Homo sapiens
tgcacccagccctggtc

SEQ ID NO: 2558398 - DNA, 18 bp, Homo sapiens
tgcacccatgggctctga

SEQ ID NO: 2558399 - DNA, 20 bp, Homo sapiens
tgcacccatgggctctgaca

SEQ ID NO: 2558400 - DNA, 22 bp, Homo sapiens
tgcacccatgggctctgacaga

SEQ ID NO: 2558401 - DNA, 14 bp, Homo sapiens
tgcaccccatgctg

SEQ ID NO: 2558402 - DNA, 14 bp, Homo sapiens
tgcacccccctggg

SEQ ID NO: 2558403 - DNA, 12 bp, Homo sapiens
tgcacccctccc

SEQ ID NO: 2558404 - DNA, 13 bp, Homo sapiens
tgcacccctccca

SEQ ID NO: 2558405 - DNA, 14 bp, Homo sapiens
tgcacccgcctctc

SEQ ID NO: 2558406 - DNA, 16 bp, Homo sapiens
tgcacccgcctctccc

SEQ ID NO: 2558407 - DNA, 16 bp, Homo sapiens
tgcaccctcaggcagg

SEQ ID NO: 2558408 - DNA, 20 bp, Homo sapiens
tgcaccggctggcctggccc

SEQ ID NO: 2558409 - DNA, 15 bp, Homo sapiens
tgcaccgggccacag

SEQ ID NO: 2558410 - DNA, 22 bp, Homo sapiens
tgcaccgggccacagagaaagt

SEQ ID NO: 2558411 - DNA, 17 bp, Homo sapiens
tgcacctggaatatata

SEQ ID NO: 2558412 - DNA, 20 bp, Homo sapiens
tgcacctggaatatataacc

SEQ ID NO: 2558413 - DNA, 16 bp, Homo sapiens
tgcacctgtactcagg

SEQ ID NO: 2558414 - DNA, 13 bp, Homo sapiens
tgcaccttaccaa

SEQ ID NO: 2558415 - DNA, 14 bp, Homo sapiens
tgcaccttgtgtct

SEQ ID NO: 2558416 - DNA, 13 bp, Homo sapiens
tgcacggctgctg

SEQ ID NO: 2558417 - DNA, 18 bp, Homo sapiens
tgcacggtgggccttgct

SEQ ID NO: 2558418 - DNA, 23 bp, Homo sapiens
tgcacggtgggccttgctgggga

SEQ ID NO: 2558419 - DNA, 19 bp, Homo sapiens
tgcacgtacacacacatac

SEQ ID NO: 2558420 - DNA, 17 bp, Homo sapiens
tgcacgtggagagctgg

SEQ ID NO: 2558421 - DNA, 18 bp, Homo sapiens
tgcacgtggagagctggt

SEQ ID NO: 2558422 - DNA, 15 bp, Homo sapiens
tgcactactcctctg

SEQ ID NO: 2558423 - DNA, 18 bp, Homo sapiens
tgcactactcctctgcag

SEQ ID NO: 2558424 - DNA, 15 bp, Homo sapiens
tgcactccagcctga

SEQ ID NO: 2558425 - DNA, 17 bp, Homo sapiens
tgcactccagcctgggc

SEQ ID NO: 2558426 - DNA, 20 bp, Homo sapiens
tgcactccagcctgggcaac

SEQ ID NO: 2558427 - DNA, 15 bp, Homo sapiens
tgcactcccctgctg

SEQ ID NO: 2558428 - DNA, 16 bp, Homo sapiens
tgcactcccctgctgg

SEQ ID NO: 2558429 - DNA, 21 bp, Homo sapiens
tgcactctaaaaggttcaggg

SEQ ID NO: 2558430 - DNA, 18 bp, Homo sapiens
tgcactgacattgttggc

SEQ ID NO: 2558431 - DNA, 14 bp, Homo sapiens
tgcactgagggcca

SEQ ID NO: 2558432 - DNA, 15 bp, Homo sapiens
tgcactgagggccac

SEQ ID NO: 2558433 - DNA, 15 bp, Homo sapiens
tgcactggagtccag

SEQ ID NO: 2558434 - DNA, 15 bp, Homo sapiens
tgcactgtatgctgg

SEQ ID NO: 2558435 - DNA, 21 bp, Homo sapiens
tgcactgttccccctgtgcag

SEQ ID NO: 2558436 - DNA, 23 bp, Homo sapiens
tgcactgttccccctgtgcagcc

SEQ ID NO: 2558437 - DNA, 18 bp, Homo sapiens
tgcacttaacaagctccc

SEQ ID NO: 2558438 - DNA, 20 bp, Homo sapiens
tgcactttctatcctctgta

SEQ ID NO: 2558439 - DNA, 20 bp, Homo sapiens
tgcactttgttctggctctt

SEQ ID NO: 2558440 - DNA, 22 bp, Homo sapiens
tgcagaagacagtatggcagct

SEQ ID NO: 2558441 - DNA, 14 bp, Homo sapiens
tgcagacctgtcct

SEQ ID NO: 2558442 - DNA, 16 bp, Homo sapiens
tgcagactcaataaaa

SEQ ID NO: 2558443 - DNA, 14 bp, Homo sapiens
tgcagactcagttt

SEQ ID NO: 2558444 - DNA, 20 bp, Homo sapiens
tgcagactcagtttgtcaga

SEQ ID NO: 2558445 - DNA, 17 bp, Homo sapiens
tgcagactctacagagg

SEQ ID NO: 2558446 - DNA, 20 bp, Homo sapiens
tgcagactctacagaggcca

SEQ ID NO: 2558447 - DNA, 23 bp, Homo sapiens
tgcagagagccattttgtgaatg

SEQ ID NO: 2558448 - DNA, 15 bp, Homo sapiens
tgcagagtcagcaga

SEQ ID NO: 2558449 - DNA, 15 bp, Homo sapiens
tgcagagtgcccaga

SEQ ID NO: 2558450 - DNA, 15 bp, Homo sapiens
tgcagatgacaaaaa

SEQ ID NO: 2558451 - DNA, 17 bp, Homo sapiens
tgcagatttgggctgga

SEQ ID NO: 2558452 - DNA, 16 bp, Homo sapiens
tgcagcaataaagcag

SEQ ID NO: 2558453 - DNA, 20 bp, Homo sapiens
tgcagcactcacacaggacc

SEQ ID NO: 2558454 - DNA, 22 bp, Homo sapiens
tgcagcagtgagtctcttcaga

SEQ ID NO: 2558455 - DNA, 13 bp, Homo sapiens
tgcagcatgacct

SEQ ID NO: 2558456 - DNA, 19 bp, Homo sapiens
tgcagcatgacctgtgacc

SEQ ID NO: 2558457 - DNA, 17 bp, Homo sapiens
tgcagcatgttgctgag

SEQ ID NO: 2558458 - DNA, 18 bp, Homo sapiens
tgcagcatgttgctgagg

SEQ ID NO: 2558459 - DNA, 20 bp, Homo sapiens
tgcagccccgcctccaggcc

SEQ ID NO: 2558460 - DNA, 21 bp, Homo sapiens
tgcagccccgcctccaggcca

SEQ ID NO: 2558461 - DNA, 23 bp, Homo sapiens
tgcagcccgtgtggccccttcac

SEQ ID NO: 2558462 - DNA, 18 bp, Homo sapiens
tgcagcctcaacctcctg

SEQ ID NO: 2558463 - DNA, 20 bp, Homo sapiens
tgcagcctcaacctcctggg

SEQ ID NO: 2558464 - DNA, 15 bp, Homo sapiens
tgcagcctcacagtc

SEQ ID NO: 2558465 - DNA, 18 bp, Homo sapiens
tgcagcctcacagtcctt

SEQ ID NO: 2558466 - DNA, 21 bp, Homo sapiens
tgcagcctcacagtccttacc

SEQ ID NO: 2558467 - DNA, 23 bp, Homo sapiens
tgcagcctttgcctccccggctc

SEQ ID NO: 2558468 - DNA, 19 bp, Homo sapiens
tgcagcgaaccaatatttg

SEQ ID NO: 2558469 - DNA, 13 bp, Homo sapiens
tgcagctatctgg

SEQ ID NO: 2558470 - DNA, 15 bp, Homo sapiens
tgcagctgattttaa

SEQ ID NO: 2558471 - DNA, 16 bp, Homo sapiens
tgcagctgattttaac

SEQ ID NO: 2558472 - DNA, 18 bp, Homo sapiens
tgcagctgattttaacaa

SEQ ID NO: 2558473 - DNA, 17 bp, Homo sapiens
tgcaggaataaggcctt

SEQ ID NO: 2558474 - DNA, 14 bp, Homo sapiens
tgcaggcagccagg

SEQ ID NO: 2558475 - DNA, 16 bp, Homo sapiens
tgcaggcagccaggcc

SEQ ID NO: 2558476 - DNA, 17 bp, Homo sapiens
tgcaggcagccaggcca

SEQ ID NO: 2558477 - DNA, 19 bp, Homo sapiens
tgcaggcagccaggccaca

SEQ ID NO: 2558478 - DNA, 15 bp, Homo sapiens
tgcaggccaggccag

SEQ ID NO: 2558479 - DNA, 21 bp, Homo sapiens
tgcaggctggcaccgccttct

SEQ ID NO: 2558480 - DNA, 22 bp, Homo sapiens
tgcaggctggcaccgccttctc

SEQ ID NO: 2558481 - DNA, 21 bp, Homo sapiens
tgcagggccagacctgcctgc

SEQ ID NO: 2558482 - DNA, 19 bp, Homo sapiens
tgcagggggtgtgtctgct

SEQ ID NO: 2558483 - DNA, 20 bp, Homo sapiens
tgcagggtggtgctgggact

SEQ ID NO: 2558484 - DNA, 15 bp, Homo sapiens
tgcaggtctcaaccc

SEQ ID NO: 2558485 - DNA, 23 bp, Homo sapiens
tgcaggtgagcccatggccctcc

SEQ ID NO: 2558486 - DNA, 16 bp, Homo sapiens
tgcaggtgctgctgcg

SEQ ID NO: 2558487 - DNA, 18 bp, Homo sapiens
tgcagtactttacctcct

SEQ ID NO: 2558488 - DNA, 16 bp, Homo sapiens
tgcagtagagtcatct

SEQ ID NO: 2558489 - DNA, 15 bp, Homo sapiens
tgcagtagtctctgt

SEQ ID NO: 2558490 - DNA, 18 bp, Homo sapiens
tgcagtagtctctgtgct

SEQ ID NO: 2558491 - DNA, 21 bp, Homo sapiens
tgcagtagtctctgtgctttg

SEQ ID NO: 2558492 - DNA, 19 bp, Homo sapiens
tgcagtcacgtggaggagc

SEQ ID NO: 2558493 - DNA, 13 bp, Homo sapiens
tgcagtcctggga

SEQ ID NO: 2558494 - DNA, 18 bp, Homo sapiens
tgcagtgacgtgcacctg

SEQ ID NO: 2558495 - DNA, 19 bp, Homo sapiens
tgcagtgagccgagattgt

SEQ ID NO: 2558496 - DNA, 12 bp, Homo sapiens
tgcagtgccttg

SEQ ID NO: 2558497 - DNA, 16 bp, Homo sapiens
tgcagtgcttccaagg

SEQ ID NO: 2558498 - DNA, 17 bp, Homo sapiens
tgcagtggctcacgcct

SEQ ID NO: 2558499 - DNA, 22 bp, Homo sapiens
tgcagtggtatgatcacggctc

SEQ ID NO: 2558500 - DNA, 20 bp, Homo sapiens
tgcagtggtgcgatctgggt

SEQ ID NO: 2558501 - DNA, 21 bp, Homo sapiens
tgcagtggtgcgatctgggtt

SEQ ID NO: 2558502 - DNA, 18 bp, Homo sapiens
tgcagttcagcaccaccc

SEQ ID NO: 2558503 - DNA, 19 bp, Homo sapiens
tgcagttctagtttgcatt

SEQ ID NO: 2558504 - DNA, 20 bp, Homo sapiens
tgcagttctagtttgcattc

SEQ ID NO: 2558505 - DNA, 13 bp, Homo sapiens
tgcagttgccagt

SEQ ID NO: 2558506 - DNA, 16 bp, Homo sapiens
tgcagttgccagtcac

SEQ ID NO: 2558507 - DNA, 10 bp, Homo sapiens
tgcagtttat

SEQ ID NO: 2558508 - DNA, 16 bp, Homo sapiens
tgcagtttatcattca

SEQ ID NO: 2558509 - DNA, 17 bp, Homo sapiens
tgcagtttatcattcaa

SEQ ID NO: 2558510 - DNA, 16 bp, Homo sapiens
tgcagtttttcagagt

SEQ ID NO: 2558511 - DNA, 13 bp, Homo sapiens
tgcataaatatgc

SEQ ID NO: 2558512 - DNA, 18 bp, Homo sapiens
tgcataacaattcctcta

SEQ ID NO: 2558513 - DNA, 17 bp, Homo sapiens
tgcataagttaacttcc

SEQ ID NO: 2558514 - DNA, 23 bp, Homo sapiens
tgcataataagctaaagaggctg

SEQ ID NO: 2558515 - DNA, 11 bp, Homo sapiens
tgcatacacac

SEQ ID NO: 2558516 - DNA, 16 bp, Homo sapiens
tgcatacacacacaca

SEQ ID NO: 2558517 - DNA, 21 bp, Homo sapiens
tgcatacacacacacacacag

SEQ ID NO: 2558518 - DNA, 12 bp, Homo sapiens
tgcataccactt

SEQ ID NO: 2558519 - DNA, 20 bp, Homo sapiens
tgcataccacttttgttctt

SEQ ID NO: 2558520 - DNA, 22 bp, Homo sapiens
tgcataccacttttgttcttgg

SEQ ID NO: 2558521 - DNA, 18 bp, Homo sapiens
tgcatactttttaaatgt

SEQ ID NO: 2558522 - DNA, 23 bp, Homo sapiens
tgcatactttttaaatgtaaaga

SEQ ID NO: 2558523 - DNA, 17 bp, Homo sapiens
tgcatagagccacgtat

SEQ ID NO: 2558524 - DNA, 19 bp, Homo sapiens
tgcatagaggtaccagcaa

SEQ ID NO: 2558525 - DNA, 20 bp, Homo sapiens
tgcatagtaccaatcatttt

SEQ ID NO: 2558526 - DNA, 14 bp, Homo sapiens
tgcatataacttat

SEQ ID NO: 2558527 - DNA, 15 bp, Homo sapiens
tgcatataacttata

SEQ ID NO: 2558528 - DNA, 18 bp, Homo sapiens
tgcatatcctgagccatc

SEQ ID NO: 2558529 - DNA, 15 bp, Homo sapiens
tgcatatgtatgact

SEQ ID NO: 2558530 - DNA, 13 bp, Homo sapiens
tgcatatgtttcg

SEQ ID NO: 2558531 - DNA, 13 bp, Homo sapiens
tgcatattccttt

SEQ ID NO: 2558532 - DNA, 16 bp, Homo sapiens
tgcatattcctttcta

SEQ ID NO: 2558533 - DNA, 14 bp, Homo sapiens
tgcatattgtacac

SEQ ID NO: 2558534 - DNA, 17 bp, Homo sapiens
tgcatattgtacacttt

SEQ ID NO: 2558535 - DNA, 19 bp, Homo sapiens
tgcatattgtacacttttt

SEQ ID NO: 2558536 - DNA, 20 bp, Homo sapiens
tgcatattgtattactagaa

SEQ ID NO: 2558537 - DNA, 19 bp, Homo sapiens
tgcatcagctgctgaaaca

SEQ ID NO: 2558538 - DNA, 22 bp, Homo sapiens
tgcatcagctgctgaaacaaca

SEQ ID NO: 2558539 - DNA, 13 bp, Homo sapiens
tgcatccaactcc

SEQ ID NO: 2558540 - DNA, 16 bp, Homo sapiens
tgcatccaactccagg

SEQ ID NO: 2558541 - DNA, 19 bp, Homo sapiens
tgcatccgggggcagctct

SEQ ID NO: 2558542 - DNA, 15 bp, Homo sapiens
tgcatcctccaagaa

SEQ ID NO: 2558543 - DNA, 22 bp, Homo sapiens
tgcatcctccaagaatctatct

SEQ ID NO: 2558544 - DNA, 14 bp, Homo sapiens
tgcatcgtggagac

SEQ ID NO: 2558545 - DNA, 15 bp, Homo sapiens
tgcatcgtggagaca

SEQ ID NO: 2558546 - DNA, 15 bp, Homo sapiens
tgcatcgtttcatct

SEQ ID NO: 2558547 - DNA, 14 bp, Homo sapiens
tgcatctccacctg

SEQ ID NO: 2558548 - DNA, 18 bp, Homo sapiens
tgcatctcccagataatg

SEQ ID NO: 2558549 - DNA, 23 bp, Homo sapiens
tgcatctgggattcccaccaagg

SEQ ID NO: 2558550 - DNA, 19 bp, Homo sapiens
tgcatctgggtagctgtaa

SEQ ID NO: 2558551 - DNA, 21 bp, Homo sapiens
tgcatctgggtagctgtaagg

SEQ ID NO: 2558552 - DNA, 18 bp, Homo sapiens
tgcatcttactgaaggta

SEQ ID NO: 2558553 - DNA, 22 bp, Homo sapiens
tgcatcttactgaaggtaaaat

SEQ ID NO: 2558554 - DNA, 18 bp, Homo sapiens
tgcatgaaggtttctgaa

SEQ ID NO: 2558555 - DNA, 19 bp, Homo sapiens
tgcatgaaggtttctgaaa

SEQ ID NO: 2558556 - DNA, 18 bp, Homo sapiens
tgcatgcagccactgtgc

SEQ ID NO: 2558557 - DNA, 13 bp, Homo sapiens
tgcatgcggccca

SEQ ID NO: 2558558 - DNA, 15 bp, Homo sapiens
tgcatggaaacctga

SEQ ID NO: 2558559 - DNA, 23 bp, Homo sapiens
tgcatggaaattcccttcatctg

SEQ ID NO: 2558560 - DNA, 23 bp, Homo sapiens
tgcatggtgcagttgacagcagg

SEQ ID NO: 2558561 - DNA, 13 bp, Homo sapiens
tgcatgtatgtct

SEQ ID NO: 2558562 - DNA, 14 bp, Homo sapiens
tgcatgtatgtctt

SEQ ID NO: 2558563 - DNA, 16 bp, Homo sapiens
tgcatgtatgtcttgg

SEQ ID NO: 2558564 - DNA, 12 bp, Homo sapiens
tgcatgtgaaga

SEQ ID NO: 2558565 - DNA, 17 bp, Homo sapiens
tgcatgtgactctgaag

SEQ ID NO: 2558566 - DNA, 20 bp, Homo sapiens
tgcatgtgactctgaagctg

SEQ ID NO: 2558567 - DNA, 14 bp, Homo sapiens
tgcatgtgtgtgct

SEQ ID NO: 2558568 - DNA, 18 bp, Homo sapiens
tgcatgttccactaaccc

SEQ ID NO: 2558569 - DNA, 14 bp, Homo sapiens
tgcattaaaagaaa

SEQ ID NO: 2558570 - DNA, 15 bp, Homo sapiens
tgcattaaaagaaaa

SEQ ID NO: 2558571 - DNA, 16 bp, Homo sapiens
tgcattaaaagaaaat

SEQ ID NO: 2558572 - DNA, 22 bp, Homo sapiens
tgcattacagagaggagaaaca

SEQ ID NO: 2558573 - DNA, 23 bp, Homo sapiens
tgcattacagagaggagaaacac

SEQ ID NO: 2558574 - DNA, 22 bp, Homo sapiens
tgcattagaaatagacagtata

SEQ ID NO: 2558575 - DNA, 21 bp, Homo sapiens
tgcattatatttgtaaattta

SEQ ID NO: 2558576 - DNA, 18 bp, Homo sapiens
tgcattatctagatactg

SEQ ID NO: 2558577 - DNA, 14 bp, Homo sapiens
tgcattcccagtgg

SEQ ID NO: 2558578 - DNA, 21 bp, Homo sapiens
tgcattctgccgtgtgccctc

SEQ ID NO: 2558579 - DNA, 17 bp, Homo sapiens
tgcattgagaactgcat

SEQ ID NO: 2558580 - DNA, 19 bp, Homo sapiens
tgcattggaagaccccacc

SEQ ID NO: 2558581 - DNA, 20 bp, Homo sapiens
tgcatttaaaacagacactg

SEQ ID NO: 2558582 - DNA, 22 bp, Homo sapiens
tgcatttaaaacagacactggc

SEQ ID NO: 2558583 - DNA, 20 bp, Homo sapiens
tgcatttaaaagatacagtt

SEQ ID NO: 2558584 - DNA, 13 bp, Homo sapiens
tgcatttgaggtc

SEQ ID NO: 2558585 - DNA, 17 bp, Homo sapiens
tgcattttcaccccacc

SEQ ID NO: 2558586 - DNA, 13 bp, Homo sapiens
tgcattttgctat

SEQ ID NO: 2558587 - DNA, 15 bp, Homo sapiens
tgcattttgctattg

SEQ ID NO: 2558588 - DNA, 18 bp, Homo sapiens
tgcattttgctattgtaa

SEQ ID NO: 2558589 - DNA, 16 bp, Homo sapiens
tgcatttttgtgaaat

SEQ ID NO: 2558590 - DNA, 19 bp, Homo sapiens
tgccaaaatcattttaatg

SEQ ID NO: 2558591 - DNA, 16 bp, Homo sapiens
tgccaaataataaaaa

SEQ ID NO: 2558592 - DNA, 22 bp, Homo sapiens
tgccaagcatttaatgtagcca

SEQ ID NO: 2558593 - DNA, 14 bp, Homo sapiens
tgccaagctcagga

SEQ ID NO: 2558594 - DNA, 18 bp, Homo sapiens
tgccaagctcaggaccag

SEQ ID NO: 2558595 - DNA, 22 bp, Homo sapiens
tgccaagctcaggaccaggcaa

SEQ ID NO: 2558596 - DNA, 21 bp, Homo sapiens
tgccaaggccagagtggcctg

SEQ ID NO: 2558597 - DNA, 19 bp, Homo sapiens
tgccaagttgtttgagaaa

SEQ ID NO: 2558598 - DNA, 20 bp, Homo sapiens
tgccaagttgtttgagaaat

SEQ ID NO: 2558599 - DNA, 15 bp, Homo sapiens
tgccaatatgtattg

SEQ ID NO: 2558600 - DNA, 16 bp, Homo sapiens
tgccaatatgtattgt

SEQ ID NO: 2558601 - DNA, 19 bp, Homo sapiens
tgccaatatgtattgtaaa

SEQ ID NO: 2558602 - DNA, 20 bp, Homo sapiens
tgccaatgaggtctgaaatg

SEQ ID NO: 2558603 - DNA, 19 bp, Homo sapiens
tgccaatggaacctccttt

SEQ ID NO: 2558604 - DNA, 15 bp, Homo sapiens
tgccaattagcaatt

SEQ ID NO: 2558605 - DNA, 13 bp, Homo sapiens
tgccaatttcaag

SEQ ID NO: 2558606 - DNA, 18 bp, Homo sapiens
tgccaatttttgccttca

SEQ ID NO: 2558607 - DNA, 13 bp, Homo sapiens
tgccacacagagt

SEQ ID NO: 2558608 - DNA, 23 bp, Homo sapiens
tgccacacagagtggtctttctg

SEQ ID NO: 2558609 - DNA, 14 bp, Homo sapiens
tgccacaccctccc

SEQ ID NO: 2558610 - DNA, 14 bp, Homo sapiens
tgccaccaggagaa

SEQ ID NO: 2558611 - DNA, 17 bp, Homo sapiens
tgccaccccaccctccc

SEQ ID NO: 2558612 - DNA, 14 bp, Homo sapiens
tgccaccctacctg

SEQ ID NO: 2558613 - DNA, 20 bp, Homo sapiens
tgccactcacacagccaggt

SEQ ID NO: 2558614 - DNA, 21 bp, Homo sapiens
tgccactcacacagccaggtg

SEQ ID NO: 2558615 - DNA, 23 bp, Homo sapiens
tgccactttggtacatggccagt

SEQ ID NO: 2558616 - DNA, 21 bp, Homo sapiens
tgccagaagatcccctcagga

SEQ ID NO: 2558617 - DNA, 22 bp, Homo sapiens
tgccagagacggaagccttttt

SEQ ID NO: 2558618 - DNA, 16 bp, Homo sapiens
tgccagaggtgggcag

SEQ ID NO: 2558619 - DNA, 18 bp, Homo sapiens
tgccagaggtgggcaggt

SEQ ID NO: 2558620 - DNA, 11 bp, Homo sapiens
tgccagatgct

SEQ ID NO: 2558621 - DNA, 12 bp, Homo sapiens
tgccagcaactg

SEQ ID NO: 2558622 - DNA, 15 bp, Homo sapiens
tgccagcaactgaat

SEQ ID NO: 2558623 - DNA, 16 bp, Homo sapiens
tgccagcaactgaata

SEQ ID NO: 2558624 - DNA, 22 bp, Homo sapiens
tgccagcaatgacatctcaggg

SEQ ID NO: 2558625 - DNA, 12 bp, Homo sapiens
tgccagccagca

SEQ ID NO: 2558626 - DNA, 15 bp, Homo sapiens
tgccagccagcagcc

SEQ ID NO: 2558627 - DNA, 21 bp, Homo sapiens
tgccagccgtgatgctcaggc

SEQ ID NO: 2558628 - DNA, 12 bp, Homo sapiens
tgccagcctggc

SEQ ID NO: 2558629 - DNA, 16 bp, Homo sapiens
tgccagcctggcttct

SEQ ID NO: 2558630 - DNA, 20 bp, Homo sapiens
tgccagcctggcttctggag

SEQ ID NO: 2558631 - DNA, 22 bp, Homo sapiens
tgccagcctggcttctggagcc

SEQ ID NO: 2558632 - DNA, 12 bp, Homo sapiens
tgccagccttcc

SEQ ID NO: 2558633 - DNA, 23 bp, Homo sapiens
tgccagctctgtatcaggaccca

SEQ ID NO: 2558634 - DNA, 16 bp, Homo sapiens
tgccaggactccccag

SEQ ID NO: 2558635 - DNA, 20 bp, Homo sapiens
tgccaggctagagtgcagtg

SEQ ID NO: 2558636 - DNA, 16 bp, Homo sapiens
tgccagggcagggccc

SEQ ID NO: 2558637 - DNA, 20 bp, Homo sapiens
tgccaggtccttgccctttg

SEQ ID NO: 2558638 - DNA, 16 bp, Homo sapiens
tgccagtcaccccggc

SEQ ID NO: 2558639 - DNA, 17 bp, Homo sapiens
tgccagtccccctgccc

SEQ ID NO: 2558640 - DNA, 16 bp, Homo sapiens
tgccagtgacacttcc

SEQ ID NO: 2558641 - DNA, 17 bp, Homo sapiens
tgccatactttgtctga

SEQ ID NO: 2558642 - DNA, 20 bp, Homo sapiens
tgccatagagtttaacacaa

SEQ ID NO: 2558643 - DNA, 21 bp, Homo sapiens
tgccatagagtttaacacaag

SEQ ID NO: 2558644 - DNA, 17 bp, Homo sapiens
tgccatagtcacatggc

SEQ ID NO: 2558645 - DNA, 19 bp, Homo sapiens
tgccatagtcacatggcct

SEQ ID NO: 2558646 - DNA, 20 bp, Homo sapiens
tgccatattctgttggccag

SEQ ID NO: 2558647 - DNA, 17 bp, Homo sapiens
tgccatattttcaccat

SEQ ID NO: 2558648 - DNA, 12 bp, Homo sapiens
tgccatccaggt

SEQ ID NO: 2558649 - DNA, 21 bp, Homo sapiens
tgccatccaggttcagcttgt

SEQ ID NO: 2558650 - DNA, 23 bp, Homo sapiens
tgccatcctcaaacactgcaggc

SEQ ID NO: 2558651 - DNA, 17 bp, Homo sapiens
tgccatggcgtgtccct

SEQ ID NO: 2558652 - DNA, 20 bp, Homo sapiens
tgccatgtagggttccctta

SEQ ID NO: 2558653 - DNA, 16 bp, Homo sapiens
tgccatgttggccagg

SEQ ID NO: 2558654 - DNA, 22 bp, Homo sapiens
tgccatttaaagcttattaaaa

SEQ ID NO: 2558655 - DNA, 22 bp, Homo sapiens
tgccatttgcaccctccgcctt

SEQ ID NO: 2558656 - DNA, 23 bp, Homo sapiens
tgcccaacctgctctcctcttgc

SEQ ID NO: 2558657 - DNA, 24 bp, Homo sapiens
tgcccaacctgctctcctcttgcc

SEQ ID NO: 2558658 - DNA, 22 bp, Homo sapiens
tgcccaagttgtggtgctgaca

SEQ ID NO: 2558659 - DNA, 16 bp, Homo sapiens
tgcccaattggaggaa

SEQ ID NO: 2558660 - DNA, 21 bp, Homo sapiens
tgcccaattggaggaaagcaa

SEQ ID NO: 2558661 - DNA, 16 bp, Homo sapiens
tgcccacaggatcagt

SEQ ID NO: 2558662 - DNA, 20 bp, Homo sapiens
tgcccacaggatcagtctga

SEQ ID NO: 2558663 - DNA, 15 bp, Homo sapiens
tgcccacctgcccat

SEQ ID NO: 2558664 - DNA, 17 bp, Homo sapiens
tgcccacctgcccatca

SEQ ID NO: 2558665 - DNA, 13 bp, Homo sapiens
tgcccacctggcc

SEQ ID NO: 2558666 - DNA, 15 bp, Homo sapiens
tgcccacctggcctc

SEQ ID NO: 2558667 - DNA, 17 bp, Homo sapiens
tgcccacctggcctctg

SEQ ID NO: 2558668 - DNA, 18 bp, Homo sapiens
tgcccacctggcctctgc

SEQ ID NO: 2558669 - DNA, 11 bp, Homo sapiens
tgcccacctgt

SEQ ID NO: 2558670 - DNA, 18 bp, Homo sapiens
tgcccacgctggagtgca

SEQ ID NO: 2558671 - DNA, 14 bp, Homo sapiens
tgcccactccctgc

SEQ ID NO: 2558672 - DNA, 16 bp, Homo sapiens
tgcccactccctgcaa

SEQ ID NO: 2558673 - DNA, 17 bp, Homo sapiens
tgcccactgtctctcct

SEQ ID NO: 2558674 - DNA, 19 bp, Homo sapiens
tgcccagacccctctggcc

SEQ ID NO: 2558675 - DNA, 22 bp, Homo sapiens
tgcccagacccctctggccagg

SEQ ID NO: 2558676 - DNA, 23 bp, Homo sapiens
tgcccagagggcccaggcaggcc

SEQ ID NO: 2558677 - DNA, 10 bp, Homo sapiens
tgcccagccc

SEQ ID NO: 2558678 - DNA, 12 bp, Homo sapiens
tgcccagcccct

SEQ ID NO: 2558679 - DNA, 13 bp, Homo sapiens
tgcccagcccctt

SEQ ID NO: 2558680 - DNA, 16 bp, Homo sapiens
tgcccagccccttctg

SEQ ID NO: 2558681 - DNA, 17 bp, Homo sapiens
tgcccagccccttctga

SEQ ID NO: 2558682 - DNA, 14 bp, Homo sapiens
tgcccagcttgggc

SEQ ID NO: 2558683 - DNA, 16 bp, Homo sapiens
tgcccagcttgggccc

SEQ ID NO: 2558684 - DNA, 12 bp, Homo sapiens
tgcccaggcagg

SEQ ID NO: 2558685 - DNA, 11 bp, Homo sapiens
tgcccaggccc

SEQ ID NO: 2558686 - DNA, 14 bp, Homo sapiens
tgcccaggcccctg

SEQ ID NO: 2558687 - DNA, 17 bp, Homo sapiens
tgcccaggcccctgcca

SEQ ID NO: 2558688 - DNA, 22 bp, Homo sapiens
tgcccaggcccctgccaccctg

SEQ ID NO: 2558689 - DNA, 13 bp, Homo sapiens
tgcccaggctgga

SEQ ID NO: 2558690 - DNA, 18 bp, Homo sapiens
tgcccaggctggcgtgca

SEQ ID NO: 2558691 - DNA, 19 bp, Homo sapiens
tgcccagggctcagcctgg

SEQ ID NO: 2558692 - DNA, 23 bp, Homo sapiens
tgcccagggctcagcctggtggg

SEQ ID NO: 2558693 - DNA, 11 bp, Homo sapiens
tgcccaggggt

SEQ ID NO: 2558694 - DNA, 21 bp, Homo sapiens
tgcccaggggtgccccctcct

SEQ ID NO: 2558695 - DNA, 18 bp, Homo sapiens
tgcccagtttctgcctct

SEQ ID NO: 2558696 - DNA, 19 bp, Homo sapiens
tgcccatctgggaaaatac

SEQ ID NO: 2558697 - DNA, 21 bp, Homo sapiens
tgcccatgtcgcgctcagcat

SEQ ID NO: 2558698 - DNA, 19 bp, Homo sapiens
tgccccacctttattaaaa

SEQ ID NO: 2558699 - DNA, 19 bp, Homo sapiens
tgccccagctctggcttcc

SEQ ID NO: 2558700 - DNA, 12 bp, Homo sapiens
tgccccatgcct

SEQ ID NO: 2558701 - DNA, 13 bp, Homo sapiens
tgcccccagctgg

SEQ ID NO: 2558702 - DNA, 14 bp, Homo sapiens
tgcccccagctggc

SEQ ID NO: 2558703 - DNA, 12 bp, Homo sapiens
tgccccccaccc

SEQ ID NO: 2558704 - DNA, 17 bp, Homo sapiens
tgccccccaccccagcc

SEQ ID NO: 2558705 - DNA, 20 bp, Homo sapiens
tgccccccaccccagcctaa

SEQ ID NO: 2558706 - DNA, 14 bp, Homo sapiens
tgcccccggccccc

SEQ ID NO: 2558707 - DNA, 17 bp, Homo sapiens
tgcccccggccccctgg

SEQ ID NO: 2558708 - DNA, 21 bp, Homo sapiens
tgcccccggccccctggtctc

SEQ ID NO: 2558709 - DNA, 13 bp, Homo sapiens
tgccccctgctgg

SEQ ID NO: 2558710 - DNA, 12 bp, Homo sapiens
tgccccctggtg

SEQ ID NO: 2558711 - DNA, 12 bp, Homo sapiens
tgcccccttctc

SEQ ID NO: 2558712 - DNA, 15 bp, Homo sapiens
tgcccccttctccca

SEQ ID NO: 2558713 - DNA, 16 bp, Homo sapiens
tgcccccttctcccac

SEQ ID NO: 2558714 - DNA, 22 bp, Homo sapiens
tgccccctttcagatgtcttct

SEQ ID NO: 2558715 - DNA, 21 bp, Homo sapiens
tgccccgtcaccatctcaggc

SEQ ID NO: 2558716 - DNA, 21 bp, Homo sapiens
tgcccctcccccaacccccac

SEQ ID NO: 2558717 - DNA, 15 bp, Homo sapiens
tgcccctccctgctt

SEQ ID NO: 2558718 - DNA, 23 bp, Homo sapiens
tgcccctgctgcctccccaaccc

SEQ ID NO: 2558719 - DNA, 14 bp, Homo sapiens
tgcccctggctctg

SEQ ID NO: 2558720 - DNA, 14 bp, Homo sapiens
tgcccgagctggtg

SEQ ID NO: 2558721 - DNA, 20 bp, Homo sapiens
tgcccgagctggtgcattac

SEQ ID NO: 2558722 - DNA, 23 bp, Homo sapiens
tgcccggagattggacggcctga

SEQ ID NO: 2558723 - DNA, 17 bp, Homo sapiens
tgcccggattctgggag

SEQ ID NO: 2558724 - DNA, 19 bp, Homo sapiens
tgcccgggcgcggccagcc

SEQ ID NO: 2558725 - DNA, 22 bp, Homo sapiens
tgcccgggcgcggccagccccg

SEQ ID NO: 2558726 - DNA, 17 bp, Homo sapiens
tgcccgtctctctccca

SEQ ID NO: 2558727 - DNA, 17 bp, Homo sapiens
tgcccgtcttcagccta

SEQ ID NO: 2558728 - DNA, 22 bp, Homo sapiens
tgccctaacctctgagtcacca

SEQ ID NO: 2558729 - DNA, 12 bp, Homo sapiens
tgccctcaggga

SEQ ID NO: 2558730 - DNA, 18 bp, Homo sapiens
tgccctccacagccgcag

SEQ ID NO: 2558731 - DNA, 17 bp, Homo sapiens
tgccctccatcccgaca

SEQ ID NO: 2558732 - DNA, 12 bp, Homo sapiens
tgccctcccatc

SEQ ID NO: 2558733 - DNA, 17 bp, Homo sapiens
tgccctcccctctctgc

SEQ ID NO: 2558734 - DNA, 22 bp, Homo sapiens
tgccctccttgtccacccacct

SEQ ID NO: 2558735 - DNA, 17 bp, Homo sapiens
tgccctcgctgcttctg

SEQ ID NO: 2558736 - DNA, 22 bp, Homo sapiens
tgccctcgggcgagtcactgcc

SEQ ID NO: 2558737 - DNA, 16 bp, Homo sapiens
tgccctcgtggccagc

SEQ ID NO: 2558738 - DNA, 18 bp, Homo sapiens
tgccctcgtggccagccc

SEQ ID NO: 2558739 - DNA, 13 bp, Homo sapiens
tgccctgacctcc

SEQ ID NO: 2558740 - DNA, 16 bp, Homo sapiens
tgccctgacctcccag

SEQ ID NO: 2558741 - DNA, 22 bp, Homo sapiens
tgccctgagtggatctccaagg

SEQ ID NO: 2558742 - DNA, 22 bp, Homo sapiens
tgccctgcccacctggcctctg

SEQ ID NO: 2558743 - DNA, 23 bp, Homo sapiens
tgccctgcccacctggcctctgc

SEQ ID NO: 2558744 - DNA, 16 bp, Homo sapiens
tgccctgcccccacga

SEQ ID NO: 2558745 - DNA, 12 bp, Homo sapiens
tgccctgcctga

SEQ ID NO: 2558746 - DNA, 14 bp, Homo sapiens
tgccctgcctgagg

SEQ ID NO: 2558747 - DNA, 19 bp, Homo sapiens
tgccctgcggccccgtctg

SEQ ID NO: 2558748 - DNA, 18 bp, Homo sapiens
tgccctggatccatcagg

SEQ ID NO: 2558749 - DNA, 18 bp, Homo sapiens
tgccctggccctgaggtg

SEQ ID NO: 2558750 - DNA, 22 bp, Homo sapiens
tgccctggccctgaggtgtggg

SEQ ID NO: 2558751 - DNA, 16 bp, Homo sapiens
tgccctgggatgtcca

SEQ ID NO: 2558752 - DNA, 21 bp, Homo sapiens
tgccctggtccagggaagctg

SEQ ID NO: 2558753 - DNA, 22 bp, Homo sapiens
tgccctggtggagaaagcactg

SEQ ID NO: 2558754 - DNA, 23 bp, Homo sapiens
tgccctgtgagtactacagtcct

SEQ ID NO: 2558755 - DNA, 20 bp, Homo sapiens
tgccctgttaaaagatgaaa

SEQ ID NO: 2558756 - DNA, 19 bp, Homo sapiens
tgccctgttctctaccaag

SEQ ID NO: 2558757 - DNA, 20 bp, Homo sapiens
tgccctgttgtgtatagatg

SEQ ID NO: 2558758 - DNA, 18 bp, Homo sapiens
tgcccttacacttactgt

SEQ ID NO: 2558759 - DNA, 14 bp, Homo sapiens
tgcccttcacccca

SEQ ID NO: 2558760 - DNA, 17 bp, Homo sapiens
tgcccttccctgtccct

SEQ ID NO: 2558761 - DNA, 13 bp, Homo sapiens
tgcccttgccctg

SEQ ID NO: 2558762 - DNA, 14 bp, Homo sapiens
tgcccttgccctga

SEQ ID NO: 2558763 - DNA, 17 bp, Homo sapiens
tgcccttgtcccactca

SEQ ID NO: 2558764 - DNA, 15 bp, Homo sapiens
tgccgaccagagccc

SEQ ID NO: 2558765 - DNA, 23 bp, Homo sapiens
tgccgaccgaggctggagctggc

SEQ ID NO: 2558766 - DNA, 14 bp, Homo sapiens
tgccgactcctggg

SEQ ID NO: 2558767 - DNA, 17 bp, Homo sapiens
tgccgcaatacaggaac

SEQ ID NO: 2558768 - DNA, 15 bp, Homo sapiens
tgccgccccacccag

SEQ ID NO: 2558769 - DNA, 16 bp, Homo sapiens
tgccgccccacccaga

SEQ ID NO: 2558770 - DNA, 17 bp, Homo sapiens
tgccgcctcccagcctg

SEQ ID NO: 2558771 - DNA, 16 bp, Homo sapiens
tgccgcgtcgccctcc

SEQ ID NO: 2558772 - DNA, 14 bp, Homo sapiens
tgccggccctgggg

SEQ ID NO: 2558773 - DNA, 16 bp, Homo sapiens
tgccggtgagaataag

SEQ ID NO: 2558774 - DNA, 19 bp, Homo sapiens
tgccgtctacctgaggggc

SEQ ID NO: 2558775 - DNA, 13 bp, Homo sapiens
tgcctaagccctc

SEQ ID NO: 2558776 - DNA, 17 bp, Homo sapiens
tgcctaggaattcccag

SEQ ID NO: 2558777 - DNA, 17 bp, Homo sapiens
tgcctagggcctggtcc

SEQ ID NO: 2558778 - DNA, 12 bp, Homo sapiens
tgcctcagcctc

SEQ ID NO: 2558779 - DNA, 16 bp, Homo sapiens
tgcctcaggttcctat

SEQ ID NO: 2558780 - DNA, 22 bp, Homo sapiens
tgcctccaccaccactggccac

SEQ ID NO: 2558781 - DNA, 23 bp, Homo sapiens
tgcctccaccaccactggccacc

SEQ ID NO: 2558782 - DNA, 13 bp, Homo sapiens
tgcctcccatcac

SEQ ID NO: 2558783 - DNA, 19 bp, Homo sapiens
tgcctcccatcacccgcta

SEQ ID NO: 2558784 - DNA, 20 bp, Homo sapiens
tgcctccccaaccctgcccc

SEQ ID NO: 2558785 - DNA, 21 bp, Homo sapiens
tgcctccccaaccctgcccct

SEQ ID NO: 2558786 - DNA, 24 bp, Homo sapiens
tgcctcctcacccccagctttgct

SEQ ID NO: 2558787 - DNA, 16 bp, Homo sapiens
tgcctcctcttcaact

SEQ ID NO: 2558788 - DNA, 18 bp, Homo sapiens
tgcctcctgcctgcccct

SEQ ID NO: 2558789 - DNA, 19 bp, Homo sapiens
tgcctccttccacctccct

SEQ ID NO: 2558790 - DNA, 20 bp, Homo sapiens
tgcctcctttgtgaggaagc

SEQ ID NO: 2558791 - DNA, 18 bp, Homo sapiens
tgcctcgaactggctgca

SEQ ID NO: 2558792 - DNA, 23 bp, Homo sapiens
tgcctctacctgacactcccttg

SEQ ID NO: 2558793 - DNA, 18 bp, Homo sapiens
tgcctctcatcaactgaa

SEQ ID NO: 2558794 - DNA, 18 bp, Homo sapiens
tgcctctccctggccctc

SEQ ID NO: 2558795 - DNA, 16 bp, Homo sapiens
tgcctctcctttgtat

SEQ ID NO: 2558796 - DNA, 14 bp, Homo sapiens
tgcctctgacacac

SEQ ID NO: 2558797 - DNA, 13 bp, Homo sapiens
tgcctctgcctct

SEQ ID NO: 2558798 - DNA, 15 bp, Homo sapiens
tgcctctgcctctga

SEQ ID NO: 2558799 - DNA, 20 bp, Homo sapiens
tgcctctgcctctgacacac

SEQ ID NO: 2558800 - DNA, 12 bp, Homo sapiens
tgcctctgcctg

SEQ ID NO: 2558801 - DNA, 14 bp, Homo sapiens
tgcctctgcctgtc

SEQ ID NO: 2558802 - DNA, 23 bp, Homo sapiens
tgcctctgtttgacaaacctcta

SEQ ID NO: 2558803 - DNA, 16 bp, Homo sapiens
tgcctcttctgggagg

SEQ ID NO: 2558804 - DNA, 16 bp, Homo sapiens
tgcctcttctgtgggt

SEQ ID NO: 2558805 - DNA, 18 bp, Homo sapiens
tgcctctttcctgttgtt

SEQ ID NO: 2558806 - DNA, 18 bp, Homo sapiens
tgcctgaagtcacacagt

SEQ ID NO: 2558807 - DNA, 19 bp, Homo sapiens
tgcctgaagttggagtgag

SEQ ID NO: 2558808 - DNA, 16 bp, Homo sapiens
tgcctgagggcccctc

SEQ ID NO: 2558809 - DNA, 20 bp, Homo sapiens
tgcctgagggcccctctgcc

SEQ ID NO: 2558810 - DNA, 18 bp, Homo sapiens
tgcctgagggtggagact

SEQ ID NO: 2558811 - DNA, 17 bp, Homo sapiens
tgcctgcacaaactcac

SEQ ID NO: 2558812 - DNA, 19 bp, Homo sapiens
tgcctgcacaaactcacca

SEQ ID NO: 2558813 - DNA, 18 bp, Homo sapiens
tgcctgcagagagaagcc

SEQ ID NO: 2558814 - DNA, 15 bp, Homo sapiens
tgcctgcagccccgc

SEQ ID NO: 2558815 - DNA, 15 bp, Homo sapiens
tgcctgcatgtattt

SEQ ID NO: 2558816 - DNA, 13 bp, Homo sapiens
tgcctgcccaccc

SEQ ID NO: 2558817 - DNA, 19 bp, Homo sapiens
tgcctgcccaggcccctgc

SEQ ID NO: 2558818 - DNA, 20 bp, Homo sapiens
tgcctgcccaggcccctgcc

SEQ ID NO: 2558819 - DNA, 24 bp, Homo sapiens
tgcctgcccaggcccctgccaccc

SEQ ID NO: 2558820 - DNA, 20 bp, Homo sapiens
tgcctgccccaaacaaatat

SEQ ID NO: 2558821 - DNA, 20 bp, Homo sapiens
tgcctgcctgtctgtctctc

SEQ ID NO: 2558822 - DNA, 14 bp, Homo sapiens
tgcctgcgcccacc

SEQ ID NO: 2558823 - DNA, 20 bp, Homo sapiens
tgcctgcgcccaccccgctc

SEQ ID NO: 2558824 - DNA, 21 bp, Homo sapiens
tgcctgcgcccaccccgctct

SEQ ID NO: 2558825 - DNA, 19 bp, Homo sapiens
tgcctgcttttcactgctg

SEQ ID NO: 2558826 - DNA, 23 bp, Homo sapiens
tgcctgcttttcactgctgcaag

SEQ ID NO: 2558827 - DNA, 21 bp, Homo sapiens
tgcctggacatttgccttgct

SEQ ID NO: 2558828 - DNA, 15 bp, Homo sapiens
tgcctggatggggct

SEQ ID NO: 2558829 - DNA, 14 bp, Homo sapiens
tgcctggccaggca

SEQ ID NO: 2558830 - DNA, 16 bp, Homo sapiens
tgcctggccaggcaga

SEQ ID NO: 2558831 - DNA, 22 bp, Homo sapiens
tgcctggcctggcacacatcag

SEQ ID NO: 2558832 - DNA, 15 bp, Homo sapiens
tgcctgggaatgtat

SEQ ID NO: 2558833 - DNA, 17 bp, Homo sapiens
tgcctgggctgttggca

SEQ ID NO: 2558834 - DNA, 22 bp, Homo sapiens
tgcctgggtttaaggggagagg

SEQ ID NO: 2558835 - DNA, 19 bp, Homo sapiens
tgcctggtgcactgtgtct

SEQ ID NO: 2558836 - DNA, 16 bp, Homo sapiens
tgcctggtggcagctg

SEQ ID NO: 2558837 - DNA, 19 bp, Homo sapiens
tgcctggtggcagctgcgg

SEQ ID NO: 2558838 - DNA, 23 bp, Homo sapiens
tgcctgtagttaggaaataaaac

SEQ ID NO: 2558839 - DNA, 19 bp, Homo sapiens
tgcctgtccagcctgggca

SEQ ID NO: 2558840 - DNA, 16 bp, Homo sapiens
tgcctgtcccaccccc

SEQ ID NO: 2558841 - DNA, 11 bp, Homo sapiens
tgcctgtccct

SEQ ID NO: 2558842 - DNA, 22 bp, Homo sapiens
tgcctgtctcctttgcaggctc

SEQ ID NO: 2558843 - DNA, 21 bp, Homo sapiens
tgcctgtctgtctctccatct

SEQ ID NO: 2558844 - DNA, 20 bp, Homo sapiens
tgcctgtgccacccaccagg

SEQ ID NO: 2558845 - DNA, 21 bp, Homo sapiens
tgcctgtggaatctggagtga

SEQ ID NO: 2558846 - DNA, 20 bp, Homo sapiens
tgcctgttataactctgcac

SEQ ID NO: 2558847 - DNA, 15 bp, Homo sapiens
tgcctgttcagctcc

SEQ ID NO: 2558848 - DNA, 21 bp, Homo sapiens
tgcctgttcagctccagctca

SEQ ID NO: 2558849 - DNA, 18 bp, Homo sapiens
tgcctgttcagttacaga

SEQ ID NO: 2558850 - DNA, 19 bp, Homo sapiens
tgcctgttcagttacagaa

SEQ ID NO: 2558851 - DNA, 22 bp, Homo sapiens
tgcctgttcagttacagaaagt

SEQ ID NO: 2558852 - DNA, 15 bp, Homo sapiens
tgccttaaagaaagt

SEQ ID NO: 2558853 - DNA, 23 bp, Homo sapiens
tgccttaataagaatggttgcct

SEQ ID NO: 2558854 - DNA, 21 bp, Homo sapiens
tgccttaccctcatgttctta

SEQ ID NO: 2558855 - DNA, 15 bp, Homo sapiens
tgccttactcttctt

SEQ ID NO: 2558856 - DNA, 14 bp, Homo sapiens
tgccttcaataaat

SEQ ID NO: 2558857 - DNA, 17 bp, Homo sapiens
tgccttcattacctttt

SEQ ID NO: 2558858 - DNA, 19 bp, Homo sapiens
tgccttcattacctttttt

SEQ ID NO: 2558859 - DNA, 14 bp, Homo sapiens
tgccttccacgctg

SEQ ID NO: 2558860 - DNA, 17 bp, Homo sapiens
tgccttccacgctgtct

SEQ ID NO: 2558861 - DNA, 20 bp, Homo sapiens
tgccttccacgctgtctcca

SEQ ID NO: 2558862 - DNA, 21 bp, Homo sapiens
tgccttccacgctgtctccag

SEQ ID NO: 2558863 - DNA, 22 bp, Homo sapiens
tgccttccacgctgtctccaga

SEQ ID NO: 2558864 - DNA, 18 bp, Homo sapiens
tgccttccagcaccctgc

SEQ ID NO: 2558865 - DNA, 21 bp, Homo sapiens
tgccttccataattatgacag

SEQ ID NO: 2558866 - DNA, 20 bp, Homo sapiens
tgccttcctcctgggccctc

SEQ ID NO: 2558867 - DNA, 15 bp, Homo sapiens
tgccttcctgttttt

SEQ ID NO: 2558868 - DNA, 12 bp, Homo sapiens
tgccttctgtcc

SEQ ID NO: 2558869 - DNA, 17 bp, Homo sapiens
tgccttctgtcctggtg

SEQ ID NO: 2558870 - DNA, 18 bp, Homo sapiens
tgccttctgtcctggtgt

SEQ ID NO: 2558871 - DNA, 13 bp, Homo sapiens
tgccttcttcacc

SEQ ID NO: 2558872 - DNA, 14 bp, Homo sapiens
tgccttcttcaccc

SEQ ID NO: 2558873 - DNA, 17 bp, Homo sapiens
tgccttcttcacccagc

SEQ ID NO: 2558874 - DNA, 12 bp, Homo sapiens
tgccttcttctt

SEQ ID NO: 2558875 - DNA, 19 bp, Homo sapiens
tgccttcttctttttgctg

SEQ ID NO: 2558876 - DNA, 21 bp, Homo sapiens
tgccttgaaccacttccctca

SEQ ID NO: 2558877 - DNA, 19 bp, Homo sapiens
tgccttggagggtcccaag

SEQ ID NO: 2558878 - DNA, 13 bp, Homo sapiens
tgccttggcttca

SEQ ID NO: 2558879 - DNA, 11 bp, Homo sapiens
tgccttgggct

SEQ ID NO: 2558880 - DNA, 15 bp, Homo sapiens
tgccttgggctgctc

SEQ ID NO: 2558881 - DNA, 19 bp, Homo sapiens
tgccttgtgtacagttatt

SEQ ID NO: 2558882 - DNA, 11 bp, Homo sapiens
tgcctttctcg

SEQ ID NO: 2558883 - DNA, 23 bp, Homo sapiens
tgcctttgacctgcctcccttca

SEQ ID NO: 2558884 - DNA, 12 bp, Homo sapiens
tgcctttgagac

SEQ ID NO: 2558885 - DNA, 18 bp, Homo sapiens
tgcctttgagacagtttc

SEQ ID NO: 2558886 - DNA, 23 bp, Homo sapiens
tgcctttgagacagtttcttagc

SEQ ID NO: 2558887 - DNA, 22 bp, Homo sapiens
tgccttttatagctattactgt

SEQ ID NO: 2558888 - DNA, 18 bp, Homo sapiens
tgccttttgcacccctcc

SEQ ID NO: 2558889 - DNA, 19 bp, Homo sapiens
tgccttttgcacccctccc

SEQ ID NO: 2558890 - DNA, 20 bp, Homo sapiens
tgccttttgcacccctccca

SEQ ID NO: 2558891 - DNA, 21 bp, Homo sapiens
tgccttttgcacccctcccat

SEQ ID NO: 2558892 - DNA, 13 bp, Homo sapiens
tgcgaaaggatga

SEQ ID NO: 2558893 - DNA, 14 bp, Homo sapiens
tgcgatctgggttc

SEQ ID NO: 2558894 - DNA, 15 bp, Homo sapiens
tgcgattctggataa

SEQ ID NO: 2558895 - DNA, 22 bp, Homo sapiens
tgcgcacaaggctgaccaagag

SEQ ID NO: 2558896 - DNA, 13 bp, Homo sapiens
tgcgcattctcat

SEQ ID NO: 2558897 - DNA, 17 bp, Homo sapiens
tgcgccattgcactcca

SEQ ID NO: 2558898 - DNA, 17 bp, Homo sapiens
tgcgcccaccccgctct

SEQ ID NO: 2558899 - DNA, 20 bp, Homo sapiens
tgcgcccaccccgctctgca

SEQ ID NO: 2558900 - DNA, 18 bp, Homo sapiens
tgcgcccagtccttccac

SEQ ID NO: 2558901 - DNA, 16 bp, Homo sapiens
tgcgcccttaccttcc

SEQ ID NO: 2558902 - DNA, 13 bp, Homo sapiens
tgcgcctacagga

SEQ ID NO: 2558903 - DNA, 16 bp, Homo sapiens
tgcgcctacaggagtg

SEQ ID NO: 2558904 - DNA, 23 bp, Homo sapiens
tgcgctgacaaccaccgctcccc

SEQ ID NO: 2558905 - DNA, 22 bp, Homo sapiens
tgcggacagccacggccaggcc

SEQ ID NO: 2558906 - DNA, 23 bp, Homo sapiens
tgcggacagccacggccaggcca

SEQ ID NO: 2558907 - DNA, 15 bp, Homo sapiens
tgcggagaacaaatg

SEQ ID NO: 2558908 - DNA, 19 bp, Homo sapiens
tgcggagaaccttgtgcct

SEQ ID NO: 2558909 - DNA, 16 bp, Homo sapiens
tgcggagtgaagaggg

SEQ ID NO: 2558910 - DNA, 14 bp, Homo sapiens
tgcggatctctgga

SEQ ID NO: 2558911 - DNA, 13 bp, Homo sapiens
tgcggcccagccc

SEQ ID NO: 2558912 - DNA, 13 bp, Homo sapiens
tgcggctgtgcag

SEQ ID NO: 2558913 - DNA, 21 bp, Homo sapiens
tgcggctgtgcagcctgtcct

SEQ ID NO: 2558914 - DNA, 19 bp, Homo sapiens
tgcgggatggtcctggggc

SEQ ID NO: 2558915 - DNA, 17 bp, Homo sapiens
tgcggtatccgccccca

SEQ ID NO: 2558916 - DNA, 21 bp, Homo sapiens
tgcggtttgttggatcttcaa

SEQ ID NO: 2558917 - DNA, 17 bp, Homo sapiens
tgcgtaactggctgtgt

SEQ ID NO: 2558918 - DNA, 15 bp, Homo sapiens
tgcgtacgtttcctg

SEQ ID NO: 2558919 - DNA, 19 bp, Homo sapiens
tgcgtccacgagctgttta

SEQ ID NO: 2558920 - DNA, 14 bp, Homo sapiens
tgcgtgacaataaa

SEQ ID NO: 2558921 - DNA, 15 bp, Homo sapiens
tgcgtgacaataaaa

SEQ ID NO: 2558922 - DNA, 17 bp, Homo sapiens
tgcgtgacaataaaaca

SEQ ID NO: 2558923 - DNA, 22 bp, Homo sapiens
tgcgtgacaataaaacattaat

SEQ ID NO: 2558924 - DNA, 12 bp, Homo sapiens
tgcgtgtgtaga

SEQ ID NO: 2558925 - DNA, 24 bp, Homo sapiens
tgcgtgtgtagagttaagaagctg

SEQ ID NO: 2558926 - DNA, 19 bp, Homo sapiens
tgctaaaccttagtactga

SEQ ID NO: 2558927 - DNA, 17 bp, Homo sapiens
tgctaaataaaatttgt

SEQ ID NO: 2558928 - DNA, 22 bp, Homo sapiens
tgctaaataaaatttgttgcat

SEQ ID NO: 2558929 - DNA, 11 bp, Homo sapiens
tgctaaatgta

SEQ ID NO: 2558930 - DNA, 21 bp, Homo sapiens
tgctaaattttcagtagggct

SEQ ID NO: 2558931 - DNA, 20 bp, Homo sapiens
tgctaactagcttggaaact

SEQ ID NO: 2558932 - DNA, 22 bp, Homo sapiens
tgctaactagcttggaaactgg

SEQ ID NO: 2558933 - DNA, 19 bp, Homo sapiens
tgctaacttggagccccag

SEQ ID NO: 2558934 - DNA, 22 bp, Homo sapiens
tgctaagaagcgagcactgacc

SEQ ID NO: 2558935 - DNA, 13 bp, Homo sapiens
tgctaagatgctc

SEQ ID NO: 2558936 - DNA, 13 bp, Homo sapiens
tgctaatcttctt

SEQ ID NO: 2558937 - DNA, 22 bp, Homo sapiens
tgctaatcttcttatgcaattt

SEQ ID NO: 2558938 - DNA, 19 bp, Homo sapiens
tgctacaaaaacacagcaa

SEQ ID NO: 2558939 - DNA, 20 bp, Homo sapiens
tgctacaaaaacacagcaag

SEQ ID NO: 2558940 - DNA, 11 bp, Homo sapiens
tgctacacact

SEQ ID NO: 2558941 - DNA, 23 bp, Homo sapiens
tgctacccatgactttatatgga

SEQ ID NO: 2558942 - DNA, 19 bp, Homo sapiens
tgctacgtacatgtgaggc

SEQ ID NO: 2558943 - DNA, 14 bp, Homo sapiens
tgctactacaaaaa

SEQ ID NO: 2558944 - DNA, 15 bp, Homo sapiens
tgctactctgttcct

SEQ ID NO: 2558945 - DNA, 14 bp, Homo sapiens
tgctactgattgtt

SEQ ID NO: 2558946 - DNA, 22 bp, Homo sapiens
tgctactgtcctacccaccctc

SEQ ID NO: 2558947 - DNA, 22 bp, Homo sapiens
tgctactgtctcactgaaacat

SEQ ID NO: 2558948 - DNA, 13 bp, Homo sapiens
tgctactttgcct

SEQ ID NO: 2558949 - DNA, 17 bp, Homo sapiens
tgctactttgccttttg

SEQ ID NO: 2558950 - DNA, 17 bp, Homo sapiens
tgctagacacattttta

SEQ ID NO: 2558951 - DNA, 17 bp, Homo sapiens
tgctaggaacactcctt

SEQ ID NO: 2558952 - DNA, 18 bp, Homo sapiens
tgctaggcgagtgccagg

SEQ ID NO: 2558953 - DNA, 22 bp, Homo sapiens
tgctaggcgagtgccaggactc

SEQ ID NO: 2558954 - DNA, 21 bp, Homo sapiens
tgctaggggttttaggtctct

SEQ ID NO: 2558955 - DNA, 14 bp, Homo sapiens
tgctaggtctcgga

SEQ ID NO: 2558956 - DNA, 14 bp, Homo sapiens
tgctatcacacagt

SEQ ID NO: 2558957 - DNA, 22 bp, Homo sapiens
tgctatccatttctcatgtttt

SEQ ID NO: 2558958 - DNA, 20 bp, Homo sapiens
tgctatcctgccaaaatcat

SEQ ID NO: 2558959 - DNA, 22 bp, Homo sapiens
tgctatcgcaccactgtgtatt

SEQ ID NO: 2558960 - DNA, 18 bp, Homo sapiens
tgctatctcccccagccc

SEQ ID NO: 2558961 - DNA, 16 bp, Homo sapiens
tgctatctctgtgtgc

SEQ ID NO: 2558962 - DNA, 12 bp, Homo sapiens
tgctatggggag

SEQ ID NO: 2558963 - DNA, 18 bp, Homo sapiens
tgctatggggagaaaaga

SEQ ID NO: 2558964 - DNA, 14 bp, Homo sapiens
tgctattagactgt

SEQ ID NO: 2558965 - DNA, 16 bp, Homo sapiens
tgctattgacaagtca

SEQ ID NO: 2558966 - DNA, 15 bp, Homo sapiens
tgctcaaaaaatgag

SEQ ID NO: 2558967 - DNA, 14 bp, Homo sapiens
tgctcaagaagaca

SEQ ID NO: 2558968 - DNA, 18 bp, Homo sapiens
tgctcaatgactctctgg

SEQ ID NO: 2558969 - DNA, 17 bp, Homo sapiens
tgctcacatatctgtca

SEQ ID NO: 2558970 - DNA, 23 bp, Homo sapiens
tgctcacctggggtgtgggaggc

SEQ ID NO: 2558971 - DNA, 13 bp, Homo sapiens
tgctcagacagaa

SEQ ID NO: 2558972 - DNA, 21 bp, Homo sapiens
tgctcagggaaaagcagctct

SEQ ID NO: 2558973 - DNA, 14 bp, Homo sapiens
tgctcagtctccct

SEQ ID NO: 2558974 - DNA, 18 bp, Homo sapiens
tgctcagttgtagaatgt

SEQ ID NO: 2558975 - DNA, 21 bp, Homo sapiens
tgctcagttgtagaatgtatt

SEQ ID NO: 2558976 - DNA, 23 bp, Homo sapiens
tgctcatattgtgattctgcctt

SEQ ID NO: 2558977 - DNA, 22 bp, Homo sapiens
tgctcatcattccttgagaaaa

SEQ ID NO: 2558978 - DNA, 15 bp, Homo sapiens
tgctcatcattctct

SEQ ID NO: 2558979 - DNA, 20 bp, Homo sapiens
tgctcatcattctctgtctc

SEQ ID NO: 2558980 - DNA, 15 bp, Homo sapiens
tgctccagccaaccc

SEQ ID NO: 2558981 - DNA, 14 bp, Homo sapiens
tgctccagcctggc

SEQ ID NO: 2558982 - DNA, 20 bp, Homo sapiens
tgctccagctgttcagctgg

SEQ ID NO: 2558983 - DNA, 21 bp, Homo sapiens
tgctccagctgttcagctggt

SEQ ID NO: 2558984 - DNA, 14 bp, Homo sapiens
tgctcccagcagcc

SEQ ID NO: 2558985 - DNA, 15 bp, Homo sapiens
tgctcccagcagccc

SEQ ID NO: 2558986 - DNA, 21 bp, Homo sapiens
tgctcccagcagccctaagga

SEQ ID NO: 2558987 - DNA, 16 bp, Homo sapiens
tgctccccagccctgg

SEQ ID NO: 2558988 - DNA, 17 bp, Homo sapiens
tgctccccagccctggc

SEQ ID NO: 2558989 - DNA, 22 bp, Homo sapiens
tgctccccagccctggctctgc

SEQ ID NO: 2558990 - DNA, 19 bp, Homo sapiens
tgctcccccatcctcccct

SEQ ID NO: 2558991 - DNA, 16 bp, Homo sapiens
tgctccctaccacctc

SEQ ID NO: 2558992 - DNA, 19 bp, Homo sapiens
tgctccgtgcctccaccac

SEQ ID NO: 2558993 - DNA, 13 bp, Homo sapiens
tgctccgtgcttg

SEQ ID NO: 2558994 - DNA, 15 bp, Homo sapiens
tgctcctccctggct

SEQ ID NO: 2558995 - DNA, 17 bp, Homo sapiens
tgctcctccctggctgc

SEQ ID NO: 2558996 - DNA, 20 bp, Homo sapiens
tgctcctccctggctgccct

SEQ ID NO: 2558997 - DNA, 23 bp, Homo sapiens
tgctcctccctggctgccctggc

SEQ ID NO: 2558998 - DNA, 15 bp, Homo sapiens
tgctcctctccaggc

SEQ ID NO: 2558999 - DNA, 14 bp, Homo sapiens
tgctcctggagcct

SEQ ID NO: 2559000 - DNA, 20 bp, Homo sapiens
tgctcctggagcctttgaat

SEQ ID NO: 2559001 - DNA, 12 bp, Homo sapiens
tgctccttgggc

SEQ ID NO: 2559002 - DNA, 18 bp, Homo sapiens
tgctccttgggccctttg

SEQ ID NO: 2559003 - DNA, 20 bp, Homo sapiens
tgctctatgtgcttgtaaaa

SEQ ID NO: 2559004 - DNA, 13 bp, Homo sapiens
tgctctcccctgc

SEQ ID NO: 2559005 - DNA, 14 bp, Homo sapiens
tgctctcccctgcc

SEQ ID NO: 2559006 - DNA, 16 bp, Homo sapiens
tgctctcccctgccct

SEQ ID NO: 2559007 - DNA, 21 bp, Homo sapiens
tgctctccctcttctcaagtg

SEQ ID NO: 2559008 - DNA, 23 bp, Homo sapiens
tgctctccgaccagacaccttga

SEQ ID NO: 2559009 - DNA, 14 bp, Homo sapiens
tgctctcctcttgc

SEQ ID NO: 2559010 - DNA, 22 bp, Homo sapiens
tgctctcgcacctttccaaagt

SEQ ID NO: 2559011 - DNA, 14 bp, Homo sapiens
tgctctgatccctc

SEQ ID NO: 2559012 - DNA, 16 bp, Homo sapiens
tgctctgatccctcta

SEQ ID NO: 2559013 - DNA, 15 bp, Homo sapiens
tgctctgcaggcacc

SEQ ID NO: 2559014 - DNA, 23 bp, Homo sapiens
tgctctgcgtgtcacctgtgctt

SEQ ID NO: 2559015 - DNA, 23 bp, Homo sapiens
tgctctggaaaatgtgacccaga

SEQ ID NO: 2559016 - DNA, 16 bp, Homo sapiens
tgctctggaagagagg

SEQ ID NO: 2559017 - DNA, 14 bp, Homo sapiens
tgctctggacaggc

SEQ ID NO: 2559018 - DNA, 15 bp, Homo sapiens
tgctctggacaggca

SEQ ID NO: 2559019 - DNA, 17 bp, Homo sapiens
tgctctggacaggcatg

SEQ ID NO: 2559020 - DNA, 18 bp, Homo sapiens
tgctcttagctgtctgct

SEQ ID NO: 2559021 - DNA, 14 bp, Homo sapiens
tgctcttcaagaaa

SEQ ID NO: 2559022 - DNA, 14 bp, Homo sapiens
tgctgaaaatggta

SEQ ID NO: 2559023 - DNA, 17 bp, Homo sapiens
tgctgaaattttatatg

SEQ ID NO: 2559024 - DNA, 14 bp, Homo sapiens
tgctgaagctgcct

SEQ ID NO: 2559025 - DNA, 12 bp, Homo sapiens
tgctgaaggctc

SEQ ID NO: 2559026 - DNA, 13 bp, Homo sapiens
tgctgaaggctcg

SEQ ID NO: 2559027 - DNA, 22 bp, Homo sapiens
tgctgaatggttttcaaaataa

SEQ ID NO: 2559028 - DNA, 19 bp, Homo sapiens
tgctgacagacacaggccc

SEQ ID NO: 2559029 - DNA, 22 bp, Homo sapiens
tgctgacagacacaggcccggc

SEQ ID NO: 2559030 - DNA, 15 bp, Homo sapiens
tgctgacagctgacc

SEQ ID NO: 2559031 - DNA, 24 bp, Homo sapiens
tgctgactgttttctcttgagagg

SEQ ID NO: 2559032 - DNA, 17 bp, Homo sapiens
tgctgaggcctccagct

SEQ ID NO: 2559033 - DNA, 21 bp, Homo sapiens
tgctgatgaactcttaatcaa

SEQ ID NO: 2559034 - DNA, 21 bp, Homo sapiens
tgctgatgttcagtgtaattt

SEQ ID NO: 2559035 - DNA, 20 bp, Homo sapiens
tgctgcaaacctgacccctg

SEQ ID NO: 2559036 - DNA, 23 bp, Homo sapiens
tgctgcagttgccagtcaccccg

SEQ ID NO: 2559037 - DNA, 15 bp, Homo sapiens
tgctgcatgcctggt

SEQ ID NO: 2559038 - DNA, 14 bp, Homo sapiens
tgctgcatttaaaa

SEQ ID NO: 2559039 - DNA, 23 bp, Homo sapiens
tgctgcatttaaaagatacagtt

SEQ ID NO: 2559040 - DNA, 14 bp, Homo sapiens
tgctgccacttttt

SEQ ID NO: 2559041 - DNA, 12 bp, Homo sapiens
tgctgccatcca

SEQ ID NO: 2559042 - DNA, 16 bp, Homo sapiens
tgctgcccatgccacc

SEQ ID NO: 2559043 - DNA, 17 bp, Homo sapiens
tgctgccctgcccacct

SEQ ID NO: 2559044 - DNA, 18 bp, Homo sapiens
tgctgccctgcccacctg

SEQ ID NO: 2559045 - DNA, 19 bp, Homo sapiens
tgctgccctgcccacctgg

SEQ ID NO: 2559046 - DNA, 21 bp, Homo sapiens
tgctgccgccccacccagatg

SEQ ID NO: 2559047 - DNA, 23 bp, Homo sapiens
tgctgccgccccacccagatggg

SEQ ID NO: 2559048 - DNA, 17 bp, Homo sapiens
tgctgccgcctcccagc

SEQ ID NO: 2559049 - DNA, 19 bp, Homo sapiens
tgctgccgcctcccagcct

SEQ ID NO: 2559050 - DNA, 12 bp, Homo sapiens
tgctgcctcccc

SEQ ID NO: 2559051 - DNA, 13 bp, Homo sapiens
tgctgcctcccca

SEQ ID NO: 2559052 - DNA, 19 bp, Homo sapiens
tgctgcctccccaaccctg

SEQ ID NO: 2559053 - DNA, 14 bp, Homo sapiens
tgctgcgtgcctgt

SEQ ID NO: 2559054 - DNA, 17 bp, Homo sapiens
tgctgctgctgcgccct

SEQ ID NO: 2559055 - DNA, 13 bp, Homo sapiens
tgctgctggctgg

SEQ ID NO: 2559056 - DNA, 14 bp, Homo sapiens
tgctgctgtgtttt

SEQ ID NO: 2559057 - DNA, 20 bp, Homo sapiens
tgctgcttagacataacaaa

SEQ ID NO: 2559058 - DNA, 22 bp, Homo sapiens
tgctgctttttgaggtggcact

SEQ ID NO: 2559059 - DNA, 17 bp, Homo sapiens
tgctggaataagttcaa

SEQ ID NO: 2559060 - DNA, 19 bp, Homo sapiens
tgctggacggcattcctgc

SEQ ID NO: 2559061 - DNA, 14 bp, Homo sapiens
tgctggactgtcat

SEQ ID NO: 2559062 - DNA, 19 bp, Homo sapiens
tgctggactgtcatagaaa

SEQ ID NO: 2559063 - DNA, 13 bp, Homo sapiens
tgctggagactcc

SEQ ID NO: 2559064 - DNA, 21 bp, Homo sapiens
tgctggaggtgacatctctta

SEQ ID NO: 2559065 - DNA, 17 bp, Homo sapiens
tgctggatattttcaaa

SEQ ID NO: 2559066 - DNA, 18 bp, Homo sapiens
tgctggatgtctgccaat

SEQ ID NO: 2559067 - DNA, 13 bp, Homo sapiens
tgctggcccctca

SEQ ID NO: 2559068 - DNA, 16 bp, Homo sapiens
tgctggcctggatctc

SEQ ID NO: 2559069 - DNA, 21 bp, Homo sapiens
tgctggctggaagggaggagc

SEQ ID NO: 2559070 - DNA, 19 bp, Homo sapiens
tgctggctgttggctgggg

SEQ ID NO: 2559071 - DNA, 21 bp, Homo sapiens
tgctggctgttggctgggggc

SEQ ID NO: 2559072 - DNA, 17 bp, Homo sapiens
tgctgggactgagccag

SEQ ID NO: 2559073 - DNA, 15 bp, Homo sapiens
tgctgggactggcca

SEQ ID NO: 2559074 - DNA, 19 bp, Homo sapiens
tgctgggattacaagcgtg

SEQ ID NO: 2559075 - DNA, 21 bp, Homo sapiens
tgctgggattacaagcgtgag

SEQ ID NO: 2559076 - DNA, 20 bp, Homo sapiens
tgctggggacggggggcccc

SEQ ID NO: 2559077 - DNA, 20 bp, Homo sapiens
tgctgggggggattgtaaaa

SEQ ID NO: 2559078 - DNA, 13 bp, Homo sapiens
tgctgggtgtggc

SEQ ID NO: 2559079 - DNA, 16 bp, Homo sapiens
tgctgggttggtgcac

SEQ ID NO: 2559080 - DNA, 18 bp, Homo sapiens
tgctgggttggtgcacag

SEQ ID NO: 2559081 - DNA, 23 bp, Homo sapiens
tgctggttgtcatttttgcagta

SEQ ID NO: 2559082 - DNA, 14 bp, Homo sapiens
tgctggttttccta

SEQ ID NO: 2559083 - DNA, 12 bp, Homo sapiens
tgctggtttttc

SEQ ID NO: 2559084 - DNA, 18 bp, Homo sapiens
tgctgtaactttctgaaa

SEQ ID NO: 2559085 - DNA, 19 bp, Homo sapiens
tgctgtactagagatctgg

SEQ ID NO: 2559086 - DNA, 23 bp, Homo sapiens
tgctgtatccatccatggggctg

SEQ ID NO: 2559087 - DNA, 20 bp, Homo sapiens
tgctgtcaagttcctttggg

SEQ ID NO: 2559088 - DNA, 16 bp, Homo sapiens
tgctgtccctccccct

SEQ ID NO: 2559089 - DNA, 17 bp, Homo sapiens
tgctgtccctccccctt

SEQ ID NO: 2559090 - DNA, 14 bp, Homo sapiens
tgctgtctatgtgg

SEQ ID NO: 2559091 - DNA, 14 bp, Homo sapiens
tgctgtgaaaaaaa

SEQ ID NO: 2559092 - DNA, 21 bp, Homo sapiens
tgctgtgaatttgtgtaagga

SEQ ID NO: 2559093 - DNA, 12 bp, Homo sapiens
tgctgtggccag

SEQ ID NO: 2559094 - DNA, 12 bp, Homo sapiens
tgctgtggcctg

SEQ ID NO: 2559095 - DNA, 16 bp, Homo sapiens
tgctgtggcctgggca

SEQ ID NO: 2559096 - DNA, 18 bp, Homo sapiens
tgctgtggggctggtagc

SEQ ID NO: 2559097 - DNA, 15 bp, Homo sapiens
tgctgtggtgtgtcc

SEQ ID NO: 2559098 - DNA, 17 bp, Homo sapiens
tgctgtggtgtgtcccc

SEQ ID NO: 2559099 - DNA, 13 bp, Homo sapiens
tgctgtgtaaagt

SEQ ID NO: 2559100 - DNA, 14 bp, Homo sapiens
tgctgtgtaaagtt

SEQ ID NO: 2559101 - DNA, 21 bp, Homo sapiens
tgctgtgtatctgatagctct

SEQ ID NO: 2559102 - DNA, 14 bp, Homo sapiens
tgctgtgtggtttg

SEQ ID NO: 2559103 - DNA, 15 bp, Homo sapiens
tgctgtgtttgagct

SEQ ID NO: 2559104 - DNA, 16 bp, Homo sapiens
tgctgttgattgctaa

SEQ ID NO: 2559105 - DNA, 12 bp, Homo sapiens
tgctgtttcctt

SEQ ID NO: 2559106 - DNA, 13 bp, Homo sapiens
tgctgtttgacaa

SEQ ID NO: 2559107 - DNA, 15 bp, Homo sapiens
tgctgttttgttctg

SEQ ID NO: 2559108 - DNA, 16 bp, Homo sapiens
tgctgttttgttctgt

SEQ ID NO: 2559109 - DNA, 13 bp, Homo sapiens
tgcttaacttcac

SEQ ID NO: 2559110 - DNA, 18 bp, Homo sapiens
tgcttaacttcacatatt

SEQ ID NO: 2559111 - DNA, 16 bp, Homo sapiens
tgcttaagcagaagca

SEQ ID NO: 2559112 - DNA, 12 bp, Homo sapiens
tgcttaatgaaa

SEQ ID NO: 2559113 - DNA, 20 bp, Homo sapiens
tgcttacaattccctgctgt

SEQ ID NO: 2559114 - DNA, 22 bp, Homo sapiens
tgcttacaatttttttaatttt

SEQ ID NO: 2559115 - DNA, 20 bp, Homo sapiens
tgcttacatttttacaataa

SEQ ID NO: 2559116 - DNA, 18 bp, Homo sapiens
tgcttactttggaataca

SEQ ID NO: 2559117 - DNA, 22 bp, Homo sapiens
tgcttactttggaatacatttc

SEQ ID NO: 2559118 - DNA, 19 bp, Homo sapiens
tgcttagcctcctgacctg

SEQ ID NO: 2559119 - DNA, 18 bp, Homo sapiens
tgcttagctcatcttaga

SEQ ID NO: 2559120 - DNA, 14 bp, Homo sapiens
tgcttaggatgtgt

SEQ ID NO: 2559121 - DNA, 16 bp, Homo sapiens
tgcttaggatgtgtgc

SEQ ID NO: 2559122 - DNA, 13 bp, Homo sapiens
tgcttagtaatgc

SEQ ID NO: 2559123 - DNA, 18 bp, Homo sapiens
tgcttataggtggcctct

SEQ ID NO: 2559124 - DNA, 17 bp, Homo sapiens
tgcttattgttccaaga

SEQ ID NO: 2559125 - DNA, 23 bp, Homo sapiens
tgcttattgttccaagacattgt

SEQ ID NO: 2559126 - DNA, 23 bp, Homo sapiens
tgcttcaattaataaaaaatgga

SEQ ID NO: 2559127 - DNA, 13 bp, Homo sapiens
tgcttcagcctcc

SEQ ID NO: 2559128 - DNA, 14 bp, Homo sapiens
tgcttcagcctgag

SEQ ID NO: 2559129 - DNA, 18 bp, Homo sapiens
tgcttcagtggagaatta

SEQ ID NO: 2559130 - DNA, 16 bp, Homo sapiens
tgcttccagtgaggct

SEQ ID NO: 2559131 - DNA, 20 bp, Homo sapiens
tgcttccagtgaggctctgc

SEQ ID NO: 2559132 - DNA, 14 bp, Homo sapiens
tgcttcccatccta

SEQ ID NO: 2559133 - DNA, 20 bp, Homo sapiens
tgcttcctagaagttactga

SEQ ID NO: 2559134 - DNA, 14 bp, Homo sapiens
tgcttgaaagaaaa

SEQ ID NO: 2559135 - DNA, 21 bp, Homo sapiens
tgcttgaaagaaaatatgcat

SEQ ID NO: 2559136 - DNA, 13 bp, Homo sapiens
tgcttgagcccag

SEQ ID NO: 2559137 - DNA, 14 bp, Homo sapiens
tgcttgagcccagg

SEQ ID NO: 2559138 - DNA, 16 bp, Homo sapiens
tgcttgagcccaggag

SEQ ID NO: 2559139 - DNA, 15 bp, Homo sapiens
tgcttgagctcagga

SEQ ID NO: 2559140 - DNA, 13 bp, Homo sapiens
tgcttgaggaaaa

SEQ ID NO: 2559141 - DNA, 21 bp, Homo sapiens
tgcttgaggcaactcatctta

SEQ ID NO: 2559142 - DNA, 15 bp, Homo sapiens
tgcttgcagtagatt

SEQ ID NO: 2559143 - DNA, 11 bp, Homo sapiens
tgcttgcctct

SEQ ID NO: 2559144 - DNA, 14 bp, Homo sapiens
tgcttggaggaagg

SEQ ID NO: 2559145 - DNA, 21 bp, Homo sapiens
tgcttggaggaaggaaaccca

SEQ ID NO: 2559146 - DNA, 15 bp, Homo sapiens
tgcttgggtggagaa

SEQ ID NO: 2559147 - DNA, 16 bp, Homo sapiens
tgcttgggtggagaag

SEQ ID NO: 2559148 - DNA, 22 bp, Homo sapiens
tgcttgggtggagaagccattg

SEQ ID NO: 2559149 - DNA, 13 bp, Homo sapiens
tgcttgtacataa

SEQ ID NO: 2559150 - DNA, 16 bp, Homo sapiens
tgcttgtacataatgc

SEQ ID NO: 2559151 - DNA, 16 bp, Homo sapiens
tgcttgttccctctcc

SEQ ID NO: 2559152 - DNA, 19 bp, Homo sapiens
tgcttgttgggattcctga

SEQ ID NO: 2559153 - DNA, 20 bp, Homo sapiens
tgctttaatatcatcagtat

SEQ ID NO: 2559154 - DNA, 17 bp, Homo sapiens
tgctttaggctcacggc

SEQ ID NO: 2559155 - DNA, 12 bp, Homo sapiens
tgctttccagct

SEQ ID NO: 2559156 - DNA, 13 bp, Homo sapiens
tgctttcccctgt

SEQ ID NO: 2559157 - DNA, 20 bp, Homo sapiens
tgctttcccctgtggggatc

SEQ ID NO: 2559158 - DNA, 12 bp, Homo sapiens
tgctttctgaaa

SEQ ID NO: 2559159 - DNA, 23 bp, Homo sapiens
tgctttctgttgtcattgctgtt

SEQ ID NO: 2559160 - DNA, 14 bp, Homo sapiens
tgctttgcccagca

SEQ ID NO: 2559161 - DNA, 15 bp, Homo sapiens
tgctttgcccctgag

SEQ ID NO: 2559162 - DNA, 13 bp, Homo sapiens
tgctttggaaatc

SEQ ID NO: 2559163 - DNA, 12 bp, Homo sapiens
tgctttgtgatt

SEQ ID NO: 2559164 - DNA, 17 bp, Homo sapiens
tgcttttaaaaaaaaat

SEQ ID NO: 2559165 - DNA, 17 bp, Homo sapiens
tgcttttcactgctgca

SEQ ID NO: 2559166 - DNA, 18 bp, Homo sapiens
tgcttttcactgctgcaa

SEQ ID NO: 2559167 - DNA, 18 bp, Homo sapiens
tgcttttggtctgtgtga

SEQ ID NO: 2559168 - DNA, 17 bp, Homo sapiens
tgctttttaagtgttaa

SEQ ID NO: 2559169 - DNA, 13 bp, Homo sapiens
tgctttttctaat

SEQ ID NO: 2559170 - DNA, 17 bp, Homo sapiens
tgctttttgaggtggca

SEQ ID NO: 2559171 - DNA, 19 bp, Homo sapiens
tggaaaaatccagaaagaa

SEQ ID NO: 2559172 - DNA, 17 bp, Homo sapiens
tggaaaacaaggaagtc

SEQ ID NO: 2559173 - DNA, 14 bp, Homo sapiens
tggaaaagaataca

SEQ ID NO: 2559174 - DNA, 16 bp, Homo sapiens
tggaaaaggaagacta

SEQ ID NO: 2559175 - DNA, 18 bp, Homo sapiens
tggaaaaggaagactaga

SEQ ID NO: 2559176 - DNA, 22 bp, Homo sapiens
tggaaaaggaagactagaggct

SEQ ID NO: 2559177 - DNA, 15 bp, Homo sapiens
tggaaaataaatcaa

SEQ ID NO: 2559178 - DNA, 14 bp, Homo sapiens
tggaaacaggacca

SEQ ID NO: 2559179 - DNA, 15 bp, Homo sapiens
tggaaacctgccctg

SEQ ID NO: 2559180 - DNA, 16 bp, Homo sapiens
tggaaacctgccctgc

SEQ ID NO: 2559181 - DNA, 19 bp, Homo sapiens
tggaaacctgccctgcctg

SEQ ID NO: 2559182 - DNA, 14 bp, Homo sapiens
tggaaactgaatgc

SEQ ID NO: 2559183 - DNA, 20 bp, Homo sapiens
tggaaagagtaggaagactt

SEQ ID NO: 2559184 - DNA, 16 bp, Homo sapiens
tggaaagcatcacctc

SEQ ID NO: 2559185 - DNA, 19 bp, Homo sapiens
tggaaagcatcacctcagg

SEQ ID NO: 2559186 - DNA, 15 bp, Homo sapiens
tggaaagcctctgct

SEQ ID NO: 2559187 - DNA, 15 bp, Homo sapiens
tggaaagtgaatttg

SEQ ID NO: 2559188 - DNA, 21 bp, Homo sapiens
tggaaagtgaatttgaatgaa

SEQ ID NO: 2559189 - DNA, 13 bp, Homo sapiens
tggaaagtgtaaa

SEQ ID NO: 2559190 - DNA, 15 bp, Homo sapiens
tggaaatgctgggct

SEQ ID NO: 2559191 - DNA, 23 bp, Homo sapiens
tggaaatgggcagagcagagacc

SEQ ID NO: 2559192 - DNA, 18 bp, Homo sapiens
tggaaattaagaagaaac

SEQ ID NO: 2559193 - DNA, 21 bp, Homo sapiens
tggaacataaaatacaatgtt

SEQ ID NO: 2559194 - DNA, 21 bp, Homo sapiens
tggaacatcatcaaggcactg

SEQ ID NO: 2559195 - DNA, 23 bp, Homo sapiens
tggaacatcatcaaggcactgcc

SEQ ID NO: 2559196 - DNA, 16 bp, Homo sapiens
tggaaccgcaggaagc

SEQ ID NO: 2559197 - DNA, 19 bp, Homo sapiens
tggaaccgcaggaagctgc

SEQ ID NO: 2559198 - DNA, 21 bp, Homo sapiens
tggaacctcctttctcttctc

SEQ ID NO: 2559199 - DNA, 19 bp, Homo sapiens
tggaactcattcctgcctg

SEQ ID NO: 2559200 - DNA, 13 bp, Homo sapiens
tggaactctgctt

SEQ ID NO: 2559201 - DNA, 15 bp, Homo sapiens
tggaacttctaatat

SEQ ID NO: 2559202 - DNA, 16 bp, Homo sapiens
tggaacttctaatata

SEQ ID NO: 2559203 - DNA, 18 bp, Homo sapiens
tggaacttctaatatatt

SEQ ID NO: 2559204 - DNA, 21 bp, Homo sapiens
tggaacttctaatatattttt

SEQ ID NO: 2559205 - DNA, 20 bp, Homo sapiens
tggaagaaattcctgtagca

SEQ ID NO: 2559206 - DNA, 15 bp, Homo sapiens
tggaagaagagggag

SEQ ID NO: 2559207 - DNA, 17 bp, Homo sapiens
tggaagaccccacccaa

SEQ ID NO: 2559208 - DNA, 15 bp, Homo sapiens
tggaagagcctgcag

SEQ ID NO: 2559209 - DNA, 14 bp, Homo sapiens
tggaagattttaaa

SEQ ID NO: 2559210 - DNA, 16 bp, Homo sapiens
tggaagccagctttcc

SEQ ID NO: 2559211 - DNA, 18 bp, Homo sapiens
tggaagccagctttccct

SEQ ID NO: 2559212 - DNA, 17 bp, Homo sapiens
tggaagccggcggccca

SEQ ID NO: 2559213 - DNA, 12 bp, Homo sapiens
tggaagctagct

SEQ ID NO: 2559214 - DNA, 18 bp, Homo sapiens
tggaagctagctcccctc

SEQ ID NO: 2559215 - DNA, 22 bp, Homo sapiens
tggaagctagctcccctcctct

SEQ ID NO: 2559216 - DNA, 13 bp, Homo sapiens
tggaagctccgct

SEQ ID NO: 2559217 - DNA, 14 bp, Homo sapiens
tggaagcttccagt

SEQ ID NO: 2559218 - DNA, 15 bp, Homo sapiens
tggaagggactagga

SEQ ID NO: 2559219 - DNA, 15 bp, Homo sapiens
tggaaggtgctgtta

SEQ ID NO: 2559220 - DNA, 21 bp, Homo sapiens
tggaaggtgctgttatccatg

SEQ ID NO: 2559221 - DNA, 13 bp, Homo sapiens
tggaaggtgggga

SEQ ID NO: 2559222 - DNA, 15 bp, Homo sapiens
tggaagtgactttgg

SEQ ID NO: 2559223 - DNA, 16 bp, Homo sapiens
tggaagtgaggcattg

SEQ ID NO: 2559224 - DNA, 21 bp, Homo sapiens
tggaagtgtgtgatctgtggg

SEQ ID NO: 2559225 - DNA, 11 bp, Homo sapiens
tggaagttgca

SEQ ID NO: 2559226 - DNA, 19 bp, Homo sapiens
tggaataaaatactatttt

SEQ ID NO: 2559227 - DNA, 15 bp, Homo sapiens
tggaatacagtgtta

SEQ ID NO: 2559228 - DNA, 14 bp, Homo sapiens
tggaatacatgaaa

SEQ ID NO: 2559229 - DNA, 14 bp, Homo sapiens
tggaatacatttct

SEQ ID NO: 2559230 - DNA, 18 bp, Homo sapiens
tggaatagtatcctccag

SEQ ID NO: 2559231 - DNA, 23 bp, Homo sapiens
tggaatagtatcctccaggtttt

SEQ ID NO: 2559232 - DNA, 14 bp, Homo sapiens
tggaatataaggaa

SEQ ID NO: 2559233 - DNA, 21 bp, Homo sapiens
tggaatataaggaaagcaata

SEQ ID NO: 2559234 - DNA, 12 bp, Homo sapiens
tggaatctggag

SEQ ID NO: 2559235 - DNA, 15 bp, Homo sapiens
tggaatctggagagc

SEQ ID NO: 2559236 - DNA, 20 bp, Homo sapiens
tggaatgatgggtcagttgt

SEQ ID NO: 2559237 - DNA, 16 bp, Homo sapiens
tggaatgcttcctaga

SEQ ID NO: 2559238 - DNA, 17 bp, Homo sapiens
tggaatgggcagctcat

SEQ ID NO: 2559239 - DNA, 23 bp, Homo sapiens
tggaatgtggcccctgaacaaga

SEQ ID NO: 2559240 - DNA, 19 bp, Homo sapiens
tggaattaacctggtgctg

SEQ ID NO: 2559241 - DNA, 17 bp, Homo sapiens
tggaatttatatacaac

SEQ ID NO: 2559242 - DNA, 22 bp, Homo sapiens
tggaatttctcccagtcattta

SEQ ID NO: 2559243 - DNA, 22 bp, Homo sapiens
tggaatttgcaagtcatggctg

SEQ ID NO: 2559244 - DNA, 16 bp, Homo sapiens
tggaatttgtaacctc

SEQ ID NO: 2559245 - DNA, 19 bp, Homo sapiens
tggaatttgtaacctcagc

SEQ ID NO: 2559246 - DNA, 23 bp, Homo sapiens
tggaatttttcattgatatgaaa

SEQ ID NO: 2559247 - DNA, 22 bp, Homo sapiens
tggacaagcagaggtggccaga

SEQ ID NO: 2559248 - DNA, 13 bp, Homo sapiens
tggacaaggaggt

SEQ ID NO: 2559249 - DNA, 17 bp, Homo sapiens
tggacacacaaggtgca

SEQ ID NO: 2559250 - DNA, 13 bp, Homo sapiens
tggacacagctct

SEQ ID NO: 2559251 - DNA, 21 bp, Homo sapiens
tggacaccaggagtccctggt

SEQ ID NO: 2559252 - DNA, 16 bp, Homo sapiens
tggacactcagacctg

SEQ ID NO: 2559253 - DNA, 17 bp, Homo sapiens
tggacactccagtgcca

SEQ ID NO: 2559254 - DNA, 15 bp, Homo sapiens
tggacagaagcagct

SEQ ID NO: 2559255 - DNA, 12 bp, Homo sapiens
tggacaggcatg

SEQ ID NO: 2559256 - DNA, 18 bp, Homo sapiens
tggacaggcatgttctct

SEQ ID NO: 2559257 - DNA, 22 bp, Homo sapiens
tggacaggcatgttctctgagg

SEQ ID NO: 2559258 - DNA, 12 bp, Homo sapiens
tggacagtcctg

SEQ ID NO: 2559259 - DNA, 14 bp, Homo sapiens
tggacagtcctggg

SEQ ID NO: 2559260 - DNA, 16 bp, Homo sapiens
tggacagtcctgggag

SEQ ID NO: 2559261 - DNA, 23 bp, Homo sapiens
tggacatagagagggagaagaag

SEQ ID NO: 2559262 - DNA, 21 bp, Homo sapiens
tggacatgaagattctttccc

SEQ ID NO: 2559263 - DNA, 22 bp, Homo sapiens
tggacatgaagattctttccca

SEQ ID NO: 2559264 - DNA, 16 bp, Homo sapiens
tggacatgagataatg

SEQ ID NO: 2559265 - DNA, 17 bp, Homo sapiens
tggacatggcccctgtg

SEQ ID NO: 2559266 - DNA, 18 bp, Homo sapiens
tggacatttgccttgctg

SEQ ID NO: 2559267 - DNA, 22 bp, Homo sapiens
tggacatttgccttgctggacg

SEQ ID NO: 2559268 - DNA, 21 bp, Homo sapiens
tggaccaatagggctgagctc

SEQ ID NO: 2559269 - DNA, 16 bp, Homo sapiens
tggaccccatctgtga

SEQ ID NO: 2559270 - DNA, 21 bp, Homo sapiens
tggaccccatctgtgaataag

SEQ ID NO: 2559271 - DNA, 14 bp, Homo sapiens
tggacccgctctgg

SEQ ID NO: 2559272 - DNA, 15 bp, Homo sapiens
tggacccgctctgga

SEQ ID NO: 2559273 - DNA, 15 bp, Homo sapiens
tggaccctgaggccc

SEQ ID NO: 2559274 - DNA, 21 bp, Homo sapiens
tggaccctgaggcccagaggg

SEQ ID NO: 2559275 - DNA, 14 bp, Homo sapiens
tggacctaatccaa

SEQ ID NO: 2559276 - DNA, 22 bp, Homo sapiens
tggacctaatccaagcatccct

SEQ ID NO: 2559277 - DNA, 17 bp, Homo sapiens
tggacctctgctctgag

SEQ ID NO: 2559278 - DNA, 16 bp, Homo sapiens
tggacctgcctcctgc

SEQ ID NO: 2559279 - DNA, 13 bp, Homo sapiens
tggaccttcctgc

SEQ ID NO: 2559280 - DNA, 16 bp, Homo sapiens
tggacggggactgggg

SEQ ID NO: 2559281 - DNA, 19 bp, Homo sapiens
tggacggtgctccaggcag

SEQ ID NO: 2559282 - DNA, 20 bp, Homo sapiens
tggactaacttgtctttgga

SEQ ID NO: 2559283 - DNA, 19 bp, Homo sapiens
tggactccagactctctgt

SEQ ID NO: 2559284 - DNA, 14 bp, Homo sapiens
tggactccagcctg

SEQ ID NO: 2559285 - DNA, 22 bp, Homo sapiens
tggactccagcctgcctggcag

SEQ ID NO: 2559286 - DNA, 23 bp, Homo sapiens
tggactccagcctgcctggcagg

SEQ ID NO: 2559287 - DNA, 13 bp, Homo sapiens
tggactcctctgt

SEQ ID NO: 2559288 - DNA, 14 bp, Homo sapiens
tggactcctctgtc

SEQ ID NO: 2559289 - DNA, 15 bp, Homo sapiens
tggactcctctgtcc

SEQ ID NO: 2559290 - DNA, 16 bp, Homo sapiens
tggactcgcctgtaat

SEQ ID NO: 2559291 - DNA, 20 bp, Homo sapiens
tggactctcagtctctgagc

SEQ ID NO: 2559292 - DNA, 22 bp, Homo sapiens
tggactctcagtctctgagcag

SEQ ID NO: 2559293 - DNA, 16 bp, Homo sapiens
tggactctgcacatga

SEQ ID NO: 2559294 - DNA, 17 bp, Homo sapiens
tggactctgcacatgtc

SEQ ID NO: 2559295 - DNA, 18 bp, Homo sapiens
tggactctgcacatgtct

SEQ ID NO: 2559296 - DNA, 12 bp, Homo sapiens
tggactcttgct

SEQ ID NO: 2559297 - DNA, 19 bp, Homo sapiens
tggactctttggtggcttt

SEQ ID NO: 2559298 - DNA, 16 bp, Homo sapiens
tggactggcccctggg

SEQ ID NO: 2559299 - DNA, 13 bp, Homo sapiens
tggactggctaga

SEQ ID NO: 2559300 - DNA, 20 bp, Homo sapiens
tggactggctagagtcctca

SEQ ID NO: 2559301 - DNA, 20 bp, Homo sapiens
tggactgtgatgccacacag

SEQ ID NO: 2559302 - DNA, 21 bp, Homo sapiens
tggactgtgatgccacacaga

SEQ ID NO: 2559303 - DNA, 22 bp, Homo sapiens
tggactgttttctctcggctcc

SEQ ID NO: 2559304 - DNA, 18 bp, Homo sapiens
tggacttggtcaccagct

SEQ ID NO: 2559305 - DNA, 20 bp, Homo sapiens
tggacttgtatatttgtaca

SEQ ID NO: 2559306 - DNA, 20 bp, Homo sapiens
tggactttccaccccctccc

SEQ ID NO: 2559307 - DNA, 24 bp, Homo sapiens
tggactttgttagtttctccaagc

SEQ ID NO: 2559308 - DNA, 14 bp, Homo sapiens
tggactttgttcac

SEQ ID NO: 2559309 - DNA, 17 bp, Homo sapiens
tggagaaactgtagtct

SEQ ID NO: 2559310 - DNA, 14 bp, Homo sapiens
tggagaaagcactg

SEQ ID NO: 2559311 - DNA, 17 bp, Homo sapiens
tggagaaagcactgacc

SEQ ID NO: 2559312 - DNA, 18 bp, Homo sapiens
tggagaaagcactgacct

SEQ ID NO: 2559313 - DNA, 19 bp, Homo sapiens
tggagaaagcactgacctg

SEQ ID NO: 2559314 - DNA, 19 bp, Homo sapiens
tggagaaattatttaataa

SEQ ID NO: 2559315 - DNA, 21 bp, Homo sapiens
tggagaaattatttaataaaa

SEQ ID NO: 2559316 - DNA, 19 bp, Homo sapiens
tggagaactagaacctgga

SEQ ID NO: 2559317 - DNA, 21 bp, Homo sapiens
tggagaactagaacctggagg

SEQ ID NO: 2559318 - DNA, 20 bp, Homo sapiens
tggagaagagagaggaaagg

SEQ ID NO: 2559319 - DNA, 11 bp, Homo sapiens
tggagaagcca

SEQ ID NO: 2559320 - DNA, 12 bp, Homo sapiens
tggagaagccat

SEQ ID NO: 2559321 - DNA, 14 bp, Homo sapiens
tggagaagccattg

SEQ ID NO: 2559322 - DNA, 18 bp, Homo sapiens
tggagaagccattgtctt

SEQ ID NO: 2559323 - DNA, 19 bp, Homo sapiens
tggagaagccattgtcttc

SEQ ID NO: 2559324 - DNA, 16 bp, Homo sapiens
tggagaagctcaccca

SEQ ID NO: 2559325 - DNA, 13 bp, Homo sapiens
tggagactcctgc

SEQ ID NO: 2559326 - DNA, 19 bp, Homo sapiens
tggagactcctgccctgtt

SEQ ID NO: 2559327 - DNA, 14 bp, Homo sapiens
tggagactctgtgg

SEQ ID NO: 2559328 - DNA, 19 bp, Homo sapiens
tggagactgcttcccatcc

SEQ ID NO: 2559329 - DNA, 12 bp, Homo sapiens
tggagagaaggc

SEQ ID NO: 2559330 - DNA, 13 bp, Homo sapiens
tggagagagggga

SEQ ID NO: 2559331 - DNA, 19 bp, Homo sapiens
tggagagccagaacctgga

SEQ ID NO: 2559332 - DNA, 18 bp, Homo sapiens
tggagagctagaacctgg

SEQ ID NO: 2559333 - DNA, 21 bp, Homo sapiens
tggagagctagaacctggaga

SEQ ID NO: 2559334 - DNA, 17 bp, Homo sapiens
tggagagctggagcctg

SEQ ID NO: 2559335 - DNA, 21 bp, Homo sapiens
tggagaggagggatgctgcct

SEQ ID NO: 2559336 - DNA, 16 bp, Homo sapiens
tggagatagggaaaga

SEQ ID NO: 2559337 - DNA, 14 bp, Homo sapiens
tggagatgcagagg

SEQ ID NO: 2559338 - DNA, 18 bp, Homo sapiens
tggagatgggatgcttgc

SEQ ID NO: 2559339 - DNA, 13 bp, Homo sapiens
tggagatgtcttc

SEQ ID NO: 2559340 - DNA, 11 bp, Homo sapiens
tggagatgttt

SEQ ID NO: 2559341 - DNA, 14 bp, Homo sapiens
tggagcagaatcag

SEQ ID NO: 2559342 - DNA, 13 bp, Homo sapiens
tggagcagaccac

SEQ ID NO: 2559343 - DNA, 17 bp, Homo sapiens
tggagcattggctgaga

SEQ ID NO: 2559344 - DNA, 22 bp, Homo sapiens
tggagccccagccccctttggg

SEQ ID NO: 2559345 - DNA, 14 bp, Homo sapiens
tggagccccatcag

SEQ ID NO: 2559346 - DNA, 23 bp, Homo sapiens
tggagccggactttcggagttgg

SEQ ID NO: 2559347 - DNA, 15 bp, Homo sapiens
tggagcctgcagggt

SEQ ID NO: 2559348 - DNA, 23 bp, Homo sapiens
tggagcctgcagggtggtgctgg

SEQ ID NO: 2559349 - DNA, 13 bp, Homo sapiens
tggagctgcctga

SEQ ID NO: 2559350 - DNA, 21 bp, Homo sapiens
tggaggaaggaaacccagctc

SEQ ID NO: 2559351 - DNA, 11 bp, Homo sapiens
tggaggagcaa

SEQ ID NO: 2559352 - DNA, 18 bp, Homo sapiens
tggaggagcaaaggctga

SEQ ID NO: 2559353 - DNA, 20 bp, Homo sapiens
tggaggagcaaaggctgaga

SEQ ID NO: 2559354 - DNA, 20 bp, Homo sapiens
tggaggagcagtgcaggcac

SEQ ID NO: 2559355 - DNA, 21 bp, Homo sapiens
tggaggagcagtgcaggcaca

SEQ ID NO: 2559356 - DNA, 16 bp, Homo sapiens
tggaggaggagcaggg

SEQ ID NO: 2559357 - DNA, 15 bp, Homo sapiens
tggaggatggagaga

SEQ ID NO: 2559358 - DNA, 20 bp, Homo sapiens
tggaggatggagagagggga

SEQ ID NO: 2559359 - DNA, 14 bp, Homo sapiens
tggaggctgtcttc

SEQ ID NO: 2559360 - DNA, 23 bp, Homo sapiens
tggaggctgtcttctcaggctct

SEQ ID NO: 2559361 - DNA, 22 bp, Homo sapiens
tggagggctagaacctggagag

SEQ ID NO: 2559362 - DNA, 23 bp, Homo sapiens
tggagggctagaacctggagagc

SEQ ID NO: 2559363 - DNA, 21 bp, Homo sapiens
tggagggctagaacctggagg

SEQ ID NO: 2559364 - DNA, 20 bp, Homo sapiens
tggagggctagaactggaga

SEQ ID NO: 2559365 - DNA, 21 bp, Homo sapiens
tggagggctagaactggagag

SEQ ID NO: 2559366 - DNA, 22 bp, Homo sapiens
tggagggctggaatctggagag

SEQ ID NO: 2559367 - DNA, 14 bp, Homo sapiens
tggaggggtgtggc

SEQ ID NO: 2559368 - DNA, 19 bp, Homo sapiens
tggagggtcccaagctggg

SEQ ID NO: 2559369 - DNA, 22 bp, Homo sapiens
tggaggtcacattcaggaagat

SEQ ID NO: 2559370 - DNA, 17 bp, Homo sapiens
tggaggtggggttggga

SEQ ID NO: 2559371 - DNA, 20 bp, Homo sapiens
tggaggtgtcaggctgctgg

SEQ ID NO: 2559372 - DNA, 21 bp, Homo sapiens
tggaggtgtcaggctgctggc

SEQ ID NO: 2559373 - DNA, 20 bp, Homo sapiens
tggaggttgataactttgct

SEQ ID NO: 2559374 - DNA, 15 bp, Homo sapiens
tggagtcatgccaag

SEQ ID NO: 2559375 - DNA, 15 bp, Homo sapiens
tggagtccagtctct

SEQ ID NO: 2559376 - DNA, 20 bp, Homo sapiens
tggagtcccctcacctcctc

SEQ ID NO: 2559377 - DNA, 13 bp, Homo sapiens
tggagtggggcag

SEQ ID NO: 2559378 - DNA, 16 bp, Homo sapiens
tggagtggggcagtag

SEQ ID NO: 2559379 - DNA, 20 bp, Homo sapiens
tggagtgtgtattgttccca

SEQ ID NO: 2559380 - DNA, 19 bp, Homo sapiens
tggagtgttccccttccac

SEQ ID NO: 2559381 - DNA, 18 bp, Homo sapiens
tggagttacattaatgtt

SEQ ID NO: 2559382 - DNA, 20 bp, Homo sapiens
tggagttcctgaacctgatg

SEQ ID NO: 2559383 - DNA, 15 bp, Homo sapiens
tggagttcttgtgcc

SEQ ID NO: 2559384 - DNA, 16 bp, Homo sapiens
tggagttcttgtgcca

SEQ ID NO: 2559385 - DNA, 23 bp, Homo sapiens
tggagtttttgtttggagagcac

SEQ ID NO: 2559386 - DNA, 15 bp, Homo sapiens
tggataaagccactg

SEQ ID NO: 2559387 - DNA, 16 bp, Homo sapiens
tggataaagccactga

SEQ ID NO: 2559388 - DNA, 21 bp, Homo sapiens
tggataacttaggtggcaagc

SEQ ID NO: 2559389 - DNA, 17 bp, Homo sapiens
tggatactgcccggggc

SEQ ID NO: 2559390 - DNA, 13 bp, Homo sapiens
tggatattttcaa

SEQ ID NO: 2559391 - DNA, 18 bp, Homo sapiens
tggatattttcaaattgt

SEQ ID NO: 2559392 - DNA, 16 bp, Homo sapiens
tggatcagtcctttga

SEQ ID NO: 2559393 - DNA, 23 bp, Homo sapiens
tggatcctagccttatcctctga

SEQ ID NO: 2559394 - DNA, 18 bp, Homo sapiens
tggatctcattggaccct

SEQ ID NO: 2559395 - DNA, 18 bp, Homo sapiens
tggatctccaaggaccag

SEQ ID NO: 2559396 - DNA, 19 bp, Homo sapiens
tggatctgtgaggggctct

SEQ ID NO: 2559397 - DNA, 17 bp, Homo sapiens
tggatgaaattttctag

SEQ ID NO: 2559398 - DNA, 19 bp, Homo sapiens
tggatgaagattctcctgt

SEQ ID NO: 2559399 - DNA, 17 bp, Homo sapiens
tggatgatgtttcgtga

SEQ ID NO: 2559400 - DNA, 13 bp, Homo sapiens
tggatgcagcctc

SEQ ID NO: 2559401 - DNA, 22 bp, Homo sapiens
tggatgcagcctcacagtcctt

SEQ ID NO: 2559402 - DNA, 15 bp, Homo sapiens
tggatgcatttctct

SEQ ID NO: 2559403 - DNA, 15 bp, Homo sapiens
tggatgcctggtggc

SEQ ID NO: 2559404 - DNA, 23 bp, Homo sapiens
tggatgcggaacccaaattacgt

SEQ ID NO: 2559405 - DNA, 17 bp, Homo sapiens
tggatgggagtgagaca

SEQ ID NO: 2559406 - DNA, 21 bp, Homo sapiens
tggatgggggaaatggtgcct

SEQ ID NO: 2559407 - DNA, 18 bp, Homo sapiens
tggatgttttaattccat

SEQ ID NO: 2559408 - DNA, 14 bp, Homo sapiens
tggattattcattt

SEQ ID NO: 2559409 - DNA, 16 bp, Homo sapiens
tggattattcatttaa

SEQ ID NO: 2559410 - DNA, 19 bp, Homo sapiens
tggattattcatttaaaat

SEQ ID NO: 2559411 - DNA, 13 bp, Homo sapiens
tggattatttaat

SEQ ID NO: 2559412 - DNA, 14 bp, Homo sapiens
tggattatttaata

SEQ ID NO: 2559413 - DNA, 23 bp, Homo sapiens
tggattatttaataacattacct

SEQ ID NO: 2559414 - DNA, 14 bp, Homo sapiens
tggattctcagata

SEQ ID NO: 2559415 - DNA, 17 bp, Homo sapiens
tggattcttatgtagca

SEQ ID NO: 2559416 - DNA, 21 bp, Homo sapiens
tggattggagatagggaaaga

SEQ ID NO: 2559417 - DNA, 20 bp, Homo sapiens
tggattggattatttaataa

SEQ ID NO: 2559418 - DNA, 21 bp, Homo sapiens
tggattggattatttaataac

SEQ ID NO: 2559419 - DNA, 23 bp, Homo sapiens
tggattggattatttaataacat

SEQ ID NO: 2559420 - DNA, 17 bp, Homo sapiens
tggatttaacagaaatg

SEQ ID NO: 2559421 - DNA, 13 bp, Homo sapiens
tggatttgaagca

SEQ ID NO: 2559422 - DNA, 19 bp, Homo sapiens
tggattttctattgttact

SEQ ID NO: 2559423 - DNA, 17 bp, Homo sapiens
tggatttttgtcttgtg

SEQ ID NO: 2559424 - DNA, 12 bp, Homo sapiens
tggcaaaaaggc

SEQ ID NO: 2559425 - DNA, 16 bp, Homo sapiens
tggcaaaaaggcagga

SEQ ID NO: 2559426 - DNA, 17 bp, Homo sapiens
tggcaaaaatggctaga

SEQ ID NO: 2559427 - DNA, 21 bp, Homo sapiens
tggcaaagggagcagaactga

SEQ ID NO: 2559428 - DNA, 21 bp, Homo sapiens
tggcaacagttagctggagct

SEQ ID NO: 2559429 - DNA, 22 bp, Homo sapiens
tggcaaccttgtctctatgcca

SEQ ID NO: 2559430 - DNA, 21 bp, Homo sapiens
tggcaagcccctgcccatctg

SEQ ID NO: 2559431 - DNA, 21 bp, Homo sapiens
tggcaagctagaacctggagg

SEQ ID NO: 2559432 - DNA, 13 bp, Homo sapiens
tggcaagctgtga

SEQ ID NO: 2559433 - DNA, 12 bp, Homo sapiens
tggcaaggctgt

SEQ ID NO: 2559434 - DNA, 17 bp, Homo sapiens
tggcaagggttcacctg

SEQ ID NO: 2559435 - DNA, 15 bp, Homo sapiens
tggcaatagtgtgtt

SEQ ID NO: 2559436 - DNA, 16 bp, Homo sapiens
tggcaatagtgtgttc

SEQ ID NO: 2559437 - DNA, 23 bp, Homo sapiens
tggcaattctttgacctcaacct

SEQ ID NO: 2559438 - DNA, 13 bp, Homo sapiens
tggcaattttgta

SEQ ID NO: 2559439 - DNA, 20 bp, Homo sapiens
tggcacagttttctgagaaa

SEQ ID NO: 2559440 - DNA, 21 bp, Homo sapiens
tggcacatcagcacgatttct

SEQ ID NO: 2559441 - DNA, 23 bp, Homo sapiens
tggcaccagaggctgcagaaggc

SEQ ID NO: 2559442 - DNA, 13 bp, Homo sapiens
tggcaccagcgaa

SEQ ID NO: 2559443 - DNA, 16 bp, Homo sapiens
tggcacccggcccctg

SEQ ID NO: 2559444 - DNA, 12 bp, Homo sapiens
tggcacctccta

SEQ ID NO: 2559445 - DNA, 17 bp, Homo sapiens
tggcactcacagacctg

SEQ ID NO: 2559446 - DNA, 22 bp, Homo sapiens
tggcactcacagacctggagcc

SEQ ID NO: 2559447 - DNA, 18 bp, Homo sapiens
tggcactgagccccccca

SEQ ID NO: 2559448 - DNA, 12 bp, Homo sapiens
tggcactgctgt

SEQ ID NO: 2559449 - DNA, 14 bp, Homo sapiens
tggcactgcttcca

SEQ ID NO: 2559450 - DNA, 19 bp, Homo sapiens
tggcactgcttccagtgag

SEQ ID NO: 2559451 - DNA, 21 bp, Homo sapiens
tggcacttagctatcagaaga

SEQ ID NO: 2559452 - DNA, 16 bp, Homo sapiens
tggcacttgcatctgt

SEQ ID NO: 2559453 - DNA, 11 bp, Homo sapiens
tggcactttga

SEQ ID NO: 2559454 - DNA, 16 bp, Homo sapiens
tggcactttttcattt

SEQ ID NO: 2559455 - DNA, 23 bp, Homo sapiens
tggcagaaagcaaatgtgacctg

SEQ ID NO: 2559456 - DNA, 16 bp, Homo sapiens
tggcagaactgagctc

SEQ ID NO: 2559457 - DNA, 21 bp, Homo sapiens
tggcagaactgagctcctctg

SEQ ID NO: 2559458 - DNA, 21 bp, Homo sapiens
tggcagaagacaccagagcag

SEQ ID NO: 2559459 - DNA, 22 bp, Homo sapiens
tggcagaatggggtgcatgaag

SEQ ID NO: 2559460 - DNA, 17 bp, Homo sapiens
tggcagagtttgtgtgt

SEQ ID NO: 2559461 - DNA, 18 bp, Homo sapiens
tggcagagtttgtgtgtt

SEQ ID NO: 2559462 - DNA, 17 bp, Homo sapiens
tggcagccttggcaaac

SEQ ID NO: 2559463 - DNA, 21 bp, Homo sapiens
tggcagctcacctctcccttg

SEQ ID NO: 2559464 - DNA, 22 bp, Homo sapiens
tggcagctcacctctcccttgg

SEQ ID NO: 2559465 - DNA, 23 bp, Homo sapiens
tggcagctcacctctcccttgga

SEQ ID NO: 2559466 - DNA, 15 bp, Homo sapiens
tggcagctcagagag

SEQ ID NO: 2559467 - DNA, 13 bp, Homo sapiens
tggcagctctcca

SEQ ID NO: 2559468 - DNA, 16 bp, Homo sapiens
tggcagctgccacgcc

SEQ ID NO: 2559469 - DNA, 22 bp, Homo sapiens
tggcagctgcggtccacccagg

SEQ ID NO: 2559470 - DNA, 13 bp, Homo sapiens
tggcagctgcttt

SEQ ID NO: 2559471 - DNA, 11 bp, Homo sapiens
tggcaggacca

SEQ ID NO: 2559472 - DNA, 18 bp, Homo sapiens
tggcaggatggcctggcc

SEQ ID NO: 2559473 - DNA, 16 bp, Homo sapiens
tggcagtgggagctgc

SEQ ID NO: 2559474 - DNA, 17 bp, Homo sapiens
tggcatagcccagacac

SEQ ID NO: 2559475 - DNA, 23 bp, Homo sapiens
tggcatcaccttaggcagggaag

SEQ ID NO: 2559476 - DNA, 18 bp, Homo sapiens
tggcattatgtccactgt

SEQ ID NO: 2559477 - DNA, 16 bp, Homo sapiens
tggcattgtccctgtg

SEQ ID NO: 2559478 - DNA, 18 bp, Homo sapiens
tggccaaattatttgtgt

SEQ ID NO: 2559479 - DNA, 18 bp, Homo sapiens
tggccaccaccccccact

SEQ ID NO: 2559480 - DNA, 16 bp, Homo sapiens
tggccaccaggctggc

SEQ ID NO: 2559481 - DNA, 18 bp, Homo sapiens
tggccaccaggctggcgc

SEQ ID NO: 2559482 - DNA, 19 bp, Homo sapiens
tggccaccaggctggcgca

SEQ ID NO: 2559483 - DNA, 19 bp, Homo sapiens
tggccacccgttctgctgg

SEQ ID NO: 2559484 - DNA, 22 bp, Homo sapiens
tggccacccgttctgctggcct

SEQ ID NO: 2559485 - DNA, 15 bp, Homo sapiens
tggccacctctctcc

SEQ ID NO: 2559486 - DNA, 21 bp, Homo sapiens
tggccacctgaggtgggccca

SEQ ID NO: 2559487 - DNA, 23 bp, Homo sapiens
tggccacctgaggtgggcccagg

SEQ ID NO: 2559488 - DNA, 17 bp, Homo sapiens
tggccaccttttcagcg

SEQ ID NO: 2559489 - DNA, 21 bp, Homo sapiens
tggccacttgggtcttccctg

SEQ ID NO: 2559490 - DNA, 23 bp, Homo sapiens
tggccagagagcctggtgctgct

SEQ ID NO: 2559491 - DNA, 14 bp, Homo sapiens
tggccagagctggg

SEQ ID NO: 2559492 - DNA, 15 bp, Homo sapiens
tggccagagctggga

SEQ ID NO: 2559493 - DNA, 18 bp, Homo sapiens
tggccagagctgggaggc

SEQ ID NO: 2559494 - DNA, 15 bp, Homo sapiens
tggccagatgcacca

SEQ ID NO: 2559495 - DNA, 20 bp, Homo sapiens
tggccagatgcaccagccct

SEQ ID NO: 2559496 - DNA, 12 bp, Homo sapiens
tggccagcccgg

SEQ ID NO: 2559497 - DNA, 13 bp, Homo sapiens
tggccagcccggc

SEQ ID NO: 2559498 - DNA, 16 bp, Homo sapiens
tggccagcccggctgg

SEQ ID NO: 2559499 - DNA, 19 bp, Homo sapiens
tggccagcccggctggttt

SEQ ID NO: 2559500 - DNA, 21 bp, Homo sapiens
tggccaggcaccccctggaga

SEQ ID NO: 2559501 - DNA, 19 bp, Homo sapiens
tggccaggcagatctgtgc

SEQ ID NO: 2559502 - DNA, 13 bp, Homo sapiens
tggccaggctggt

SEQ ID NO: 2559503 - DNA, 20 bp, Homo sapiens
tggccaggctggtctcgaac

SEQ ID NO: 2559504 - DNA, 19 bp, Homo sapiens
tggccatttagccaccatc

SEQ ID NO: 2559505 - DNA, 15 bp, Homo sapiens
tggccatttgctttt

SEQ ID NO: 2559506 - DNA, 13 bp, Homo sapiens
tggcccactgcat

SEQ ID NO: 2559507 - DNA, 22 bp, Homo sapiens
tggcccagccaaaccctgtctg

SEQ ID NO: 2559508 - DNA, 12 bp, Homo sapiens
tggcccagccct

SEQ ID NO: 2559509 - DNA, 13 bp, Homo sapiens
tggcccagccggc

SEQ ID NO: 2559510 - DNA, 14 bp, Homo sapiens
tggcccagcggccc

SEQ ID NO: 2559511 - DNA, 17 bp, Homo sapiens
tggcccagcggcccctc

SEQ ID NO: 2559512 - DNA, 15 bp, Homo sapiens
tggcccagctcccca

SEQ ID NO: 2559513 - DNA, 17 bp, Homo sapiens
tggcccccgagctgggg

SEQ ID NO: 2559514 - DNA, 19 bp, Homo sapiens
tggcccccgagctgggggc

SEQ ID NO: 2559515 - DNA, 13 bp, Homo sapiens
tggcccctcaggg

SEQ ID NO: 2559516 - DNA, 14 bp, Homo sapiens
tggcccctctgacc

SEQ ID NO: 2559517 - DNA, 15 bp, Homo sapiens
tggcccctgcccggc

SEQ ID NO: 2559518 - DNA, 11 bp, Homo sapiens
tggccccttca

SEQ ID NO: 2559519 - DNA, 16 bp, Homo sapiens
tggccctcacccctgc

SEQ ID NO: 2559520 - DNA, 18 bp, Homo sapiens
tggccctcacccctgccc

SEQ ID NO: 2559521 - DNA, 18 bp, Homo sapiens
tggccctgaggtgtgggg

SEQ ID NO: 2559522 - DNA, 22 bp, Homo sapiens
tggcccttgcagttcagcacca

SEQ ID NO: 2559523 - DNA, 21 bp, Homo sapiens
tggccgccccctgccccccag

SEQ ID NO: 2559524 - DNA, 19 bp, Homo sapiens
tggccggcaaccccagttc

SEQ ID NO: 2559525 - DNA, 23 bp, Homo sapiens
tggccgggaccccgagcctggct

SEQ ID NO: 2559526 - DNA, 23 bp, Homo sapiens
tggccgggcgcggtggctcacgc

SEQ ID NO: 2559527 - DNA, 18 bp, Homo sapiens
tggccggtctgcaagtca

SEQ ID NO: 2559528 - DNA, 20 bp, Homo sapiens
tggccggtctgcaagtcaga

SEQ ID NO: 2559529 - DNA, 21 bp, Homo sapiens
tggccggtctgcaagtcagag

SEQ ID NO: 2559530 - DNA, 19 bp, Homo sapiens
tggccgttgatgttggctg

SEQ ID NO: 2559531 - DNA, 17 bp, Homo sapiens
tggcctattatattaaa

SEQ ID NO: 2559532 - DNA, 14 bp, Homo sapiens
tggcctcaaccctc

SEQ ID NO: 2559533 - DNA, 15 bp, Homo sapiens
tggcctcaaccctcc

SEQ ID NO: 2559534 - DNA, 18 bp, Homo sapiens
tggcctcaaccctccctc

SEQ ID NO: 2559535 - DNA, 20 bp, Homo sapiens
tggcctcaaccctccctcag

SEQ ID NO: 2559536 - DNA, 13 bp, Homo sapiens
tggcctcaagatc

SEQ ID NO: 2559537 - DNA, 22 bp, Homo sapiens
tggcctcaagatcaatgaaatg

SEQ ID NO: 2559538 - DNA, 18 bp, Homo sapiens
tggcctcaagtgattctc

SEQ ID NO: 2559539 - DNA, 11 bp, Homo sapiens
tggcctcccaa

SEQ ID NO: 2559540 - DNA, 20 bp, Homo sapiens
tggcctcccaactcacccca

SEQ ID NO: 2559541 - DNA, 11 bp, Homo sapiens
tggcctcccac

SEQ ID NO: 2559542 - DNA, 22 bp, Homo sapiens
tggcctctttgtctaaaacaat

SEQ ID NO: 2559543 - DNA, 21 bp, Homo sapiens
tggcctgaagagtcctctgaa

SEQ ID NO: 2559544 - DNA, 18 bp, Homo sapiens
tggcctgagctgggatga

SEQ ID NO: 2559545 - DNA, 24 bp, Homo sapiens
tggcctgcacggtgggccttgctg

SEQ ID NO: 2559546 - DNA, 12 bp, Homo sapiens
tggcctggccag

SEQ ID NO: 2559547 - DNA, 15 bp, Homo sapiens
tggcctggccaggag

SEQ ID NO: 2559548 - DNA, 16 bp, Homo sapiens
tggcctggccaggagc

SEQ ID NO: 2559549 - DNA, 18 bp, Homo sapiens
tggcctggccaggagctc

SEQ ID NO: 2559550 - DNA, 18 bp, Homo sapiens
tggcctggcccctcaggg

SEQ ID NO: 2559551 - DNA, 16 bp, Homo sapiens
tggcctggccggcaac

SEQ ID NO: 2559552 - DNA, 17 bp, Homo sapiens
tggcctgggagagctgg

SEQ ID NO: 2559553 - DNA, 11 bp, Homo sapiens
tggcctgggca

SEQ ID NO: 2559554 - DNA, 18 bp, Homo sapiens
tggcctgtctcatcccca

SEQ ID NO: 2559555 - DNA, 15 bp, Homo sapiens
tggcctgtggcctgt

SEQ ID NO: 2559556 - DNA, 16 bp, Homo sapiens
tggcctgtgtcccatg

SEQ ID NO: 2559557 - DNA, 18 bp, Homo sapiens
tggccttccccagcctct

SEQ ID NO: 2559558 - DNA, 18 bp, Homo sapiens
tggccttgaaaccacctt

SEQ ID NO: 2559559 - DNA, 20 bp, Homo sapiens
tggcctttcatattttagct

SEQ ID NO: 2559560 - DNA, 13 bp, Homo sapiens
tggccttttccta

SEQ ID NO: 2559561 - DNA, 16 bp, Homo sapiens
tggcgcagccaaggcc

SEQ ID NO: 2559562 - DNA, 13 bp, Homo sapiens
tggcgcagtgcct

SEQ ID NO: 2559563 - DNA, 17 bp, Homo sapiens
tggcgcagtgcctctgg

SEQ ID NO: 2559564 - DNA, 14 bp, Homo sapiens
tggcggcagcagcc

SEQ ID NO: 2559565 - DNA, 13 bp, Homo sapiens
tggcgggccaagg

SEQ ID NO: 2559566 - DNA, 17 bp, Homo sapiens
tggcgggccaaggactg

SEQ ID NO: 2559567 - DNA, 12 bp, Homo sapiens
tggcgggtgggg

SEQ ID NO: 2559568 - DNA, 20 bp, Homo sapiens
tggcgtctgtcttcaagggc

SEQ ID NO: 2559569 - DNA, 22 bp, Homo sapiens
tggcgtgcagtggtgcgatctg

SEQ ID NO: 2559570 - DNA, 20 bp, Homo sapiens
tggctagaatatcctacttc

SEQ ID NO: 2559571 - DNA, 19 bp, Homo sapiens
tggctagaggccagcccca

SEQ ID NO: 2559572 - DNA, 22 bp, Homo sapiens
tggctagaggttcaaagatatt

SEQ ID NO: 2559573 - DNA, 16 bp, Homo sapiens
tggctagagtcctcac

SEQ ID NO: 2559574 - DNA, 18 bp, Homo sapiens
tggctagagtcctcactc

SEQ ID NO: 2559575 - DNA, 16 bp, Homo sapiens
tggctcaatcctctaa

SEQ ID NO: 2559576 - DNA, 13 bp, Homo sapiens
tggctcacgcctg

SEQ ID NO: 2559577 - DNA, 17 bp, Homo sapiens
tggctcacgcctgtaat

SEQ ID NO: 2559578 - DNA, 16 bp, Homo sapiens
tggctcacgtgtgtga

SEQ ID NO: 2559579 - DNA, 20 bp, Homo sapiens
tggctccagaaatgtctaaa

SEQ ID NO: 2559580 - DNA, 23 bp, Homo sapiens
tggctcccatgaccatactgagg

SEQ ID NO: 2559581 - DNA, 14 bp, Homo sapiens
tggctccctcttgg

SEQ ID NO: 2559582 - DNA, 14 bp, Homo sapiens
tggctcctcaaaca

SEQ ID NO: 2559583 - DNA, 23 bp, Homo sapiens
tggctcctgaggggcatctgccc

SEQ ID NO: 2559584 - DNA, 13 bp, Homo sapiens
tggctctccaagt

SEQ ID NO: 2559585 - DNA, 14 bp, Homo sapiens
tggctctccaagtg

SEQ ID NO: 2559586 - DNA, 14 bp, Homo sapiens
tggctctctccagg

SEQ ID NO: 2559587 - DNA, 15 bp, Homo sapiens
tggctctctccagga

SEQ ID NO: 2559588 - DNA, 19 bp, Homo sapiens
tggctctgaccgaaacagc

SEQ ID NO: 2559589 - DNA, 14 bp, Homo sapiens
tggctctgcaatgg

SEQ ID NO: 2559590 - DNA, 15 bp, Homo sapiens
tggctcttccaggct

SEQ ID NO: 2559591 - DNA, 20 bp, Homo sapiens
tggctcttccaggctgggag

SEQ ID NO: 2559592 - DNA, 21 bp, Homo sapiens
tggctcttccaggctgggaga

SEQ ID NO: 2559593 - DNA, 19 bp, Homo sapiens
tggctcttgatacccccct

SEQ ID NO: 2559594 - DNA, 20 bp, Homo sapiens
tggctcttgatacccccctc

SEQ ID NO: 2559595 - DNA, 16 bp, Homo sapiens
tggctgaaccctgtgc

SEQ ID NO: 2559596 - DNA, 23 bp, Homo sapiens
tggctgaaccctgtgctggtgtc

SEQ ID NO: 2559597 - DNA, 11 bp, Homo sapiens
tggctgaagga

SEQ ID NO: 2559598 - DNA, 15 bp, Homo sapiens
tggctgaaggactgt

SEQ ID NO: 2559599 - DNA, 20 bp, Homo sapiens
tggctgaccccaaagagcct

SEQ ID NO: 2559600 - DNA, 21 bp, Homo sapiens
tggctgaccccaaagagcctg

SEQ ID NO: 2559601 - DNA, 16 bp, Homo sapiens
tggctgactttgctct

SEQ ID NO: 2559602 - DNA, 13 bp, Homo sapiens
tggctgcagcagc

SEQ ID NO: 2559603 - DNA, 21 bp, Homo sapiens
tggctgcagcagcggtggcct

SEQ ID NO: 2559604 - DNA, 14 bp, Homo sapiens
tggctgctagcact

SEQ ID NO: 2559605 - DNA, 13 bp, Homo sapiens
tggctgctgaagg

SEQ ID NO: 2559606 - DNA, 16 bp, Homo sapiens
tggctgctgaaggctc

SEQ ID NO: 2559607 - DNA, 15 bp, Homo sapiens
tggctgcttggcctt

SEQ ID NO: 2559608 - DNA, 12 bp, Homo sapiens
tggctgggcatg

SEQ ID NO: 2559609 - DNA, 21 bp, Homo sapiens
tggctgggggcctcagtgcca

SEQ ID NO: 2559610 - DNA, 20 bp, Homo sapiens
tggctgtagaaggagacaga

SEQ ID NO: 2559611 - DNA, 17 bp, Homo sapiens
tggctgtatcttgtttt

SEQ ID NO: 2559612 - DNA, 14 bp, Homo sapiens
tggctgtcagcagg

SEQ ID NO: 2559613 - DNA, 14 bp, Homo sapiens
tggctgttctggaa

SEQ ID NO: 2559614 - DNA, 14 bp, Homo sapiens
tggcttaatgttta

SEQ ID NO: 2559615 - DNA, 15 bp, Homo sapiens
tggcttaatgtttat

SEQ ID NO: 2559616 - DNA, 22 bp, Homo sapiens
tggcttcacggaagagccttgc

SEQ ID NO: 2559617 - DNA, 14 bp, Homo sapiens
tggcttccaggtat

SEQ ID NO: 2559618 - DNA, 15 bp, Homo sapiens
tggcttccaggtatc

SEQ ID NO: 2559619 - DNA, 23 bp, Homo sapiens
tggcttccaggtatctccaggat

SEQ ID NO: 2559620 - DNA, 22 bp, Homo sapiens
tggcttcctaaaattcagtgga

SEQ ID NO: 2559621 - DNA, 16 bp, Homo sapiens
tggcttcctttcttgg

SEQ ID NO: 2559622 - DNA, 24 bp, Homo sapiens
tggcttgtatcaacactgttactt

SEQ ID NO: 2559623 - DNA, 14 bp, Homo sapiens
tggctttaatgaat

SEQ ID NO: 2559624 - DNA, 15 bp, Homo sapiens
tggctttcagcctct

SEQ ID NO: 2559625 - DNA, 22 bp, Homo sapiens
tggctttctccgactgctaggg

SEQ ID NO: 2559626 - DNA, 21 bp, Homo sapiens
tggcttttattaatgcacttt

SEQ ID NO: 2559627 - DNA, 16 bp, Homo sapiens
tggcttttgtgcatta

SEQ ID NO: 2559628 - DNA, 21 bp, Homo sapiens
tggcttttgtgcattatctag

SEQ ID NO: 2559629 - DNA, 23 bp, Homo sapiens
tgggaaaaatgcccttaaatcat

SEQ ID NO: 2559630 - DNA, 21 bp, Homo sapiens
tgggaaagaaggcaaagtccc

SEQ ID NO: 2559631 - DNA, 23 bp, Homo sapiens
tgggaaagacatccataaagaag

SEQ ID NO: 2559632 - DNA, 14 bp, Homo sapiens
tgggaaagcattgt

SEQ ID NO: 2559633 - DNA, 16 bp, Homo sapiens
tgggaaagcattgtaa

SEQ ID NO: 2559634 - DNA, 22 bp, Homo sapiens
tgggaaagccacctctccctca

SEQ ID NO: 2559635 - DNA, 16 bp, Homo sapiens
tgggaaaggagtagaa

SEQ ID NO: 2559636 - DNA, 19 bp, Homo sapiens
tgggaaatatttagcaaat

SEQ ID NO: 2559637 - DNA, 23 bp, Homo sapiens
tgggaaatggtatgagctgaggg

SEQ ID NO: 2559638 - DNA, 20 bp, Homo sapiens
tgggaacgagaggggaagag

SEQ ID NO: 2559639 - DNA, 13 bp, Homo sapiens
tgggaactagact

SEQ ID NO: 2559640 - DNA, 18 bp, Homo sapiens
tgggaagacgcctgagct

SEQ ID NO: 2559641 - DNA, 21 bp, Homo sapiens
tgggaagacgcctgagctcac

SEQ ID NO: 2559642 - DNA, 22 bp, Homo sapiens
tgggaagataggctctgcacag

SEQ ID NO: 2559643 - DNA, 12 bp, Homo sapiens
tgggaaggaggg

SEQ ID NO: 2559644 - DNA, 16 bp, Homo sapiens
tgggaaggccagctgc

SEQ ID NO: 2559645 - DNA, 14 bp, Homo sapiens
tgggaataaatatg

SEQ ID NO: 2559646 - DNA, 14 bp, Homo sapiens
tgggaatcaagatt

SEQ ID NO: 2559647 - DNA, 18 bp, Homo sapiens
tgggaatgaagcttgtgt

SEQ ID NO: 2559648 - DNA, 22 bp, Homo sapiens
tgggaatgaggcttgctgagag

SEQ ID NO: 2559649 - DNA, 16 bp, Homo sapiens
tgggaatgcggcaaga

SEQ ID NO: 2559650 - DNA, 20 bp, Homo sapiens
tgggaatgttacattgtttg

SEQ ID NO: 2559651 - DNA, 17 bp, Homo sapiens
tgggaattgtgtgatgt

SEQ ID NO: 2559652 - DNA, 12 bp, Homo sapiens
tgggacaccctg

SEQ ID NO: 2559653 - DNA, 14 bp, Homo sapiens
tgggacaccctgtg

SEQ ID NO: 2559654 - DNA, 16 bp, Homo sapiens
tgggacatgggaaagg

SEQ ID NO: 2559655 - DNA, 21 bp, Homo sapiens
tgggaccgccagatggggcct

SEQ ID NO: 2559656 - DNA, 20 bp, Homo sapiens
tgggactcaatgcactgaca

SEQ ID NO: 2559657 - DNA, 15 bp, Homo sapiens
tgggactgagccagt

SEQ ID NO: 2559658 - DNA, 13 bp, Homo sapiens
tgggacttctttt

SEQ ID NO: 2559659 - DNA, 21 bp, Homo sapiens
tgggacttcttttcacattct

SEQ ID NO: 2559660 - DNA, 18 bp, Homo sapiens
tgggagaaattgacagat

SEQ ID NO: 2559661 - DNA, 22 bp, Homo sapiens
tgggagaattcttacatgtttt

SEQ ID NO: 2559662 - DNA, 22 bp, Homo sapiens
tgggagacaagaaatccctgtt

SEQ ID NO: 2559663 - DNA, 18 bp, Homo sapiens
tgggagagcccagccatt

SEQ ID NO: 2559664 - DNA, 20 bp, Homo sapiens
tgggagaggatttttttctg

SEQ ID NO: 2559665 - DNA, 12 bp, Homo sapiens
tgggagcactgg

SEQ ID NO: 2559666 - DNA, 23 bp, Homo sapiens
tgggagcactggagtgcagggag

SEQ ID NO: 2559667 - DNA, 22 bp, Homo sapiens
tgggagccccagggtcttccct

SEQ ID NO: 2559668 - DNA, 20 bp, Homo sapiens
tgggagcctgcaaactcact

SEQ ID NO: 2559669 - DNA, 18 bp, Homo sapiens
tgggagctcctctcctgg

SEQ ID NO: 2559670 - DNA, 21 bp, Homo sapiens
tgggagctcctctcctggagg

SEQ ID NO: 2559671 - DNA, 24 bp, Homo sapiens
tgggagctgcctgttcagctccag

SEQ ID NO: 2559672 - DNA, 16 bp, Homo sapiens
tgggagcttgggaatg

SEQ ID NO: 2559673 - DNA, 24 bp, Homo sapiens
tgggaggaagcaggttgaggggct

SEQ ID NO: 2559674 - DNA, 19 bp, Homo sapiens
tgggaggacggtgcaaccc

SEQ ID NO: 2559675 - DNA, 20 bp, Homo sapiens
tgggaggacggtgcaaccca

SEQ ID NO: 2559676 - DNA, 18 bp, Homo sapiens
tgggaggattgcttgagc

SEQ ID NO: 2559677 - DNA, 22 bp, Homo sapiens
tgggaggattgcttgagctcag

SEQ ID NO: 2559678 - DNA, 18 bp, Homo sapiens
tgggaggcaagaggggtg

SEQ ID NO: 2559679 - DNA, 16 bp, Homo sapiens
tgggaggcatggccct

SEQ ID NO: 2559680 - DNA, 19 bp, Homo sapiens
tgggaggccaaggtgggag

SEQ ID NO: 2559681 - DNA, 18 bp, Homo sapiens
tgggaggccccactgggg

SEQ ID NO: 2559682 - DNA, 14 bp, Homo sapiens
tgggaggcgcgagc

SEQ ID NO: 2559683 - DNA, 13 bp, Homo sapiens
tgggaggctcacc

SEQ ID NO: 2559684 - DNA, 18 bp, Homo sapiens
tgggagggagcagacagg

SEQ ID NO: 2559685 - DNA, 19 bp, Homo sapiens
tgggagggagcagacagga

SEQ ID NO: 2559686 - DNA, 18 bp, Homo sapiens
tgggagggcagcagggct

SEQ ID NO: 2559687 - DNA, 11 bp, Homo sapiens
tgggaggggca

SEQ ID NO: 2559688 - DNA, 14 bp, Homo sapiens
tgggaggggcaggc

SEQ ID NO: 2559689 - DNA, 15 bp, Homo sapiens
tgggaggggcaggct

SEQ ID NO: 2559690 - DNA, 17 bp, Homo sapiens
tgggaggggcaggctga

SEQ ID NO: 2559691 - DNA, 19 bp, Homo sapiens
tgggaggggcaggctgaca

SEQ ID NO: 2559692 - DNA, 19 bp, Homo sapiens
tgggaggtcaaggctgcag

SEQ ID NO: 2559693 - DNA, 20 bp, Homo sapiens
tgggaggtcaaggctgcagt

SEQ ID NO: 2559694 - DNA, 15 bp, Homo sapiens
tgggagtcaagtgtg

SEQ ID NO: 2559695 - DNA, 15 bp, Homo sapiens
tgggagtgagctggt

SEQ ID NO: 2559696 - DNA, 21 bp, Homo sapiens
tgggagtgaggatgtctgggc

SEQ ID NO: 2559697 - DNA, 22 bp, Homo sapiens
tgggagtgaggatgtctgggcc

SEQ ID NO: 2559698 - DNA, 16 bp, Homo sapiens
tgggagtgggcccaat

SEQ ID NO: 2559699 - DNA, 20 bp, Homo sapiens
tgggagttttgtattcatct

SEQ ID NO: 2559700 - DNA, 20 bp, Homo sapiens
tgggatccctctgggcactg

SEQ ID NO: 2559701 - DNA, 14 bp, Homo sapiens
tgggatcctccagg

SEQ ID NO: 2559702 - DNA, 16 bp, Homo sapiens
tgggatctgcccctcc

SEQ ID NO: 2559703 - DNA, 18 bp, Homo sapiens
tgggatctgcccctccct

SEQ ID NO: 2559704 - DNA, 19 bp, Homo sapiens
tgggatctgcccctccctg

SEQ ID NO: 2559705 - DNA, 16 bp, Homo sapiens
tgggattacaggtgtg

SEQ ID NO: 2559706 - DNA, 20 bp, Homo sapiens
tgggattcccaccaaggtct

SEQ ID NO: 2559707 - DNA, 15 bp, Homo sapiens
tgggattcctgaccc

SEQ ID NO: 2559708 - DNA, 17 bp, Homo sapiens
tgggattcctgacccag

SEQ ID NO: 2559709 - DNA, 22 bp, Homo sapiens
tgggattcctgacccaggccgc

SEQ ID NO: 2559710 - DNA, 24 bp, Homo sapiens
tgggattcctgacccaggccgcag

SEQ ID NO: 2559711 - DNA, 16 bp, Homo sapiens
tgggattgagtctgtg

SEQ ID NO: 2559712 - DNA, 10 bp, Homo sapiens
tgggattgct

SEQ ID NO: 2559713 - DNA, 14 bp, Homo sapiens
tgggattgggggct

SEQ ID NO: 2559714 - DNA, 19 bp, Homo sapiens
tgggattgtggtacaatct

SEQ ID NO: 2559715 - DNA, 16 bp, Homo sapiens
tgggcaaacaggcagt

SEQ ID NO: 2559716 - DNA, 21 bp, Homo sapiens
tgggcaaagcctagtgaaggc

SEQ ID NO: 2559717 - DNA, 16 bp, Homo sapiens
tgggcaacattgctgg

SEQ ID NO: 2559718 - DNA, 16 bp, Homo sapiens
tgggcaacccccagcc

SEQ ID NO: 2559719 - DNA, 17 bp, Homo sapiens
tgggcaacccccagcct

SEQ ID NO: 2559720 - DNA, 20 bp, Homo sapiens
tgggcaacccccagcctgct

SEQ ID NO: 2559721 - DNA, 14 bp, Homo sapiens
tgggcacagtttgg

SEQ ID NO: 2559722 - DNA, 19 bp, Homo sapiens
tgggcacctggggagtggg

SEQ ID NO: 2559723 - DNA, 20 bp, Homo sapiens
tgggcacctggggagtggga

SEQ ID NO: 2559724 - DNA, 15 bp, Homo sapiens
tgggcagaaggccaa

SEQ ID NO: 2559725 - DNA, 17 bp, Homo sapiens
tgggcagaaggccaaga

SEQ ID NO: 2559726 - DNA, 17 bp, Homo sapiens
tgggcagaagggagaag

SEQ ID NO: 2559727 - DNA, 11 bp, Homo sapiens
tgggcagagca

SEQ ID NO: 2559728 - DNA, 13 bp, Homo sapiens
tgggcagagcaga

SEQ ID NO: 2559729 - DNA, 13 bp, Homo sapiens
tgggcagagccca

SEQ ID NO: 2559730 - DNA, 14 bp, Homo sapiens
tgggcagagcccaa

SEQ ID NO: 2559731 - DNA, 22 bp, Homo sapiens
tgggcagctaccatttcccttt

SEQ ID NO: 2559732 - DNA, 23 bp, Homo sapiens
tgggcaggaagtgaagagatcct

SEQ ID NO: 2559733 - DNA, 18 bp, Homo sapiens
tgggcaggactcagctcc

SEQ ID NO: 2559734 - DNA, 21 bp, Homo sapiens
tgggcaggactcagctcccca

SEQ ID NO: 2559735 - DNA, 13 bp, Homo sapiens
tgggcatggggtg

SEQ ID NO: 2559736 - DNA, 21 bp, Homo sapiens
tgggcatggggtgggcctctg

SEQ ID NO: 2559737 - DNA, 18 bp, Homo sapiens
tgggcattgatggggaag

SEQ ID NO: 2559738 - DNA, 13 bp, Homo sapiens
tgggccagcccct

SEQ ID NO: 2559739 - DNA, 15 bp, Homo sapiens
tgggccagcccctcc

SEQ ID NO: 2559740 - DNA, 16 bp, Homo sapiens
tgggccagcccctccc

SEQ ID NO: 2559741 - DNA, 20 bp, Homo sapiens
tgggccagcccctcccacca

SEQ ID NO: 2559742 - DNA, 23 bp, Homo sapiens
tgggccagcccctcccaccacag

SEQ ID NO: 2559743 - DNA, 22 bp, Homo sapiens
tgggcccaagacagatgcccca

SEQ ID NO: 2559744 - DNA, 20 bp, Homo sapiens
tgggcccaatgcactttgtt

SEQ ID NO: 2559745 - DNA, 14 bp, Homo sapiens
tgggcccagatctg

SEQ ID NO: 2559746 - DNA, 14 bp, Homo sapiens
tgggcccagctggg

SEQ ID NO: 2559747 - DNA, 17 bp, Homo sapiens
tgggcccagctgggctc

SEQ ID NO: 2559748 - DNA, 19 bp, Homo sapiens
tgggcccaggaccagctgg

SEQ ID NO: 2559749 - DNA, 19 bp, Homo sapiens
tgggcccagggacaccagc

SEQ ID NO: 2559750 - DNA, 16 bp, Homo sapiens
tgggcccccaaatgga

SEQ ID NO: 2559751 - DNA, 21 bp, Homo sapiens
tgggcccccaaatggaaatgg

SEQ ID NO: 2559752 - DNA, 23 bp, Homo sapiens
tgggcccctcatctgctcagcag

SEQ ID NO: 2559753 - DNA, 11 bp, Homo sapiens
tgggccctcct

SEQ ID NO: 2559754 - DNA, 13 bp, Homo sapiens
tgggccctctctg

SEQ ID NO: 2559755 - DNA, 13 bp, Homo sapiens
tgggccctgcctc

SEQ ID NO: 2559756 - DNA, 13 bp, Homo sapiens
tgggccctttgag

SEQ ID NO: 2559757 - DNA, 14 bp, Homo sapiens
tgggcctcctgtgt

SEQ ID NO: 2559758 - DNA, 16 bp, Homo sapiens
tgggcctcctgtgtgt

SEQ ID NO: 2559759 - DNA, 15 bp, Homo sapiens
tgggcggcacagcct

SEQ ID NO: 2559760 - DNA, 12 bp, Homo sapiens
tgggcggctgag

SEQ ID NO: 2559761 - DNA, 14 bp, Homo sapiens
tgggcggggccttg

SEQ ID NO: 2559762 - DNA, 15 bp, Homo sapiens
tgggcggggccttgc

SEQ ID NO: 2559763 - DNA, 16 bp, Homo sapiens
tgggctagttgggctt

SEQ ID NO: 2559764 - DNA, 18 bp, Homo sapiens
tgggctcccttcccacct

SEQ ID NO: 2559765 - DNA, 20 bp, Homo sapiens
tgggctcccttcccacctct

SEQ ID NO: 2559766 - DNA, 17 bp, Homo sapiens
tgggctcggaggctgcc

SEQ ID NO: 2559767 - DNA, 15 bp, Homo sapiens
tgggctctgccaccc

SEQ ID NO: 2559768 - DNA, 18 bp, Homo sapiens
tgggctctgccaccctac

SEQ ID NO: 2559769 - DNA, 12 bp, Homo sapiens
tgggctgagccc

SEQ ID NO: 2559770 - DNA, 18 bp, Homo sapiens
tgggctgagccctggcag

SEQ ID NO: 2559771 - DNA, 15 bp, Homo sapiens
tgggctgctcctcat

SEQ ID NO: 2559772 - DNA, 19 bp, Homo sapiens
tgggctggcagtcctggaa

SEQ ID NO: 2559773 - DNA, 18 bp, Homo sapiens
tgggctgggttctaccca

SEQ ID NO: 2559774 - DNA, 23 bp, Homo sapiens
tgggctgggttctacccaggtgc

SEQ ID NO: 2559775 - DNA, 15 bp, Homo sapiens
tgggctgtgagtgta

SEQ ID NO: 2559776 - DNA, 19 bp, Homo sapiens
tgggctgttggcactcaca

SEQ ID NO: 2559777 - DNA, 17 bp, Homo sapiens
tgggcttcactgtataa

SEQ ID NO: 2559778 - DNA, 20 bp, Homo sapiens
tgggcttcagtggcagctgc

SEQ ID NO: 2559779 - DNA, 19 bp, Homo sapiens
tgggcttcccagtggctgc

SEQ ID NO: 2559780 - DNA, 17 bp, Homo sapiens
tgggcttgtctgtagat

SEQ ID NO: 2559781 - DNA, 22 bp, Homo sapiens
tgggctttttttttctctttct

SEQ ID NO: 2559782 - DNA, 19 bp, Homo sapiens
tggggaacaagggtggcat

SEQ ID NO: 2559783 - DNA, 14 bp, Homo sapiens
tggggaagactgtg

SEQ ID NO: 2559784 - DNA, 18 bp, Homo sapiens
tggggacatctctttgaa

SEQ ID NO: 2559785 - DNA, 20 bp, Homo sapiens
tggggacggggggccccagt

SEQ ID NO: 2559786 - DNA, 22 bp, Homo sapiens
tggggacggggggccccagtca

SEQ ID NO: 2559787 - DNA, 17 bp, Homo sapiens
tggggagactgggctga

SEQ ID NO: 2559788 - DNA, 22 bp, Homo sapiens
tggggagccaacagaagcttcc

SEQ ID NO: 2559789 - DNA, 19 bp, Homo sapiens
tggggagcccgtctcagtg

SEQ ID NO: 2559790 - DNA, 23 bp, Homo sapiens
tggggaggcggacgttccagccg

SEQ ID NO: 2559791 - DNA, 21 bp, Homo sapiens
tggggagggccgtaccccacc

SEQ ID NO: 2559792 - DNA, 15 bp, Homo sapiens
tggggaggggcgctg

SEQ ID NO: 2559793 - DNA, 21 bp, Homo sapiens
tggggaggggcgctggcccag

SEQ ID NO: 2559794 - DNA, 23 bp, Homo sapiens
tggggaggggcgctggcccagcc

SEQ ID NO: 2559795 - DNA, 19 bp, Homo sapiens
tggggagtaggacatacca

SEQ ID NO: 2559796 - DNA, 13 bp, Homo sapiens
tggggagtgggac

SEQ ID NO: 2559797 - DNA, 19 bp, Homo sapiens
tggggagtgggacagagtc

SEQ ID NO: 2559798 - DNA, 17 bp, Homo sapiens
tggggataaaggagaag

SEQ ID NO: 2559799 - DNA, 17 bp, Homo sapiens
tggggatagatgtgtgg

SEQ ID NO: 2559800 - DNA, 15 bp, Homo sapiens
tggggatcacagaga

SEQ ID NO: 2559801 - DNA, 15 bp, Homo sapiens
tggggatgagaaagg

SEQ ID NO: 2559802 - DNA, 15 bp, Homo sapiens
tggggatttctccca

SEQ ID NO: 2559803 - DNA, 11 bp, Homo sapiens
tggggcagtgg

SEQ ID NO: 2559804 - DNA, 21 bp, Homo sapiens
tggggccagttggtccccctt

SEQ ID NO: 2559805 - DNA, 14 bp, Homo sapiens
tggggccctgcctc

SEQ ID NO: 2559806 - DNA, 18 bp, Homo sapiens
tggggcctagatccacac

SEQ ID NO: 2559807 - DNA, 11 bp, Homo sapiens
tggggcctctg

SEQ ID NO: 2559808 - DNA, 19 bp, Homo sapiens
tggggcctggacctgcctc

SEQ ID NO: 2559809 - DNA, 12 bp, Homo sapiens
tggggccttggt

SEQ ID NO: 2559810 - DNA, 15 bp, Homo sapiens
tggggcgaggcagag

SEQ ID NO: 2559811 - DNA, 19 bp, Homo sapiens
tggggcgaggcagaggaca

SEQ ID NO: 2559812 - DNA, 11 bp, Homo sapiens
tggggctcctt

SEQ ID NO: 2559813 - DNA, 21 bp, Homo sapiens
tggggctcctttctccagcca

SEQ ID NO: 2559814 - DNA, 17 bp, Homo sapiens
tggggctcgccatgccg

SEQ ID NO: 2559815 - DNA, 13 bp, Homo sapiens
tggggctctcagt

SEQ ID NO: 2559816 - DNA, 18 bp, Homo sapiens
tggggctgaccttcctcg

SEQ ID NO: 2559817 - DNA, 12 bp, Homo sapiens
tggggctgctgg

SEQ ID NO: 2559818 - DNA, 16 bp, Homo sapiens
tggggctgggcagcta

SEQ ID NO: 2559819 - DNA, 15 bp, Homo sapiens
tgggggacagggctg

SEQ ID NO: 2559820 - DNA, 18 bp, Homo sapiens
tgggggacagggctggcc

SEQ ID NO: 2559821 - DNA, 22 bp, Homo sapiens
tgggggacagggctggcccagc

SEQ ID NO: 2559822 - DNA, 14 bp, Homo sapiens
tgggggagagcagg

SEQ ID NO: 2559823 - DNA, 21 bp, Homo sapiens
tgggggagtagatctttctag

SEQ ID NO: 2559824 - DNA, 22 bp, Homo sapiens
tgggggcaggagggccctacct

SEQ ID NO: 2559825 - DNA, 16 bp, Homo sapiens
tgggggcctcagtgcc

SEQ ID NO: 2559826 - DNA, 15 bp, Homo sapiens
tgggggtagcagctg

SEQ ID NO: 2559827 - DNA, 15 bp, Homo sapiens
tgggggtctgtgtgt

SEQ ID NO: 2559828 - DNA, 19 bp, Homo sapiens
tgggggttctttcttcctc

SEQ ID NO: 2559829 - DNA, 22 bp, Homo sapiens
tgggggttctttcttcctctgc

SEQ ID NO: 2559830 - DNA, 21 bp, Homo sapiens
tggggtaccaagagactcctt

SEQ ID NO: 2559831 - DNA, 20 bp, Homo sapiens
tggggtacccactgctctgg

SEQ ID NO: 2559832 - DNA, 13 bp, Homo sapiens
tggggtagggctg

SEQ ID NO: 2559833 - DNA, 20 bp, Homo sapiens
tggggtatttaccacagcag

SEQ ID NO: 2559834 - DNA, 16 bp, Homo sapiens
tggggtcactctggca

SEQ ID NO: 2559835 - DNA, 14 bp, Homo sapiens
tggggtcagccagg

SEQ ID NO: 2559836 - DNA, 14 bp, Homo sapiens
tggggtccagggag

SEQ ID NO: 2559837 - DNA, 15 bp, Homo sapiens
tggggtgccgcctgc

SEQ ID NO: 2559838 - DNA, 20 bp, Homo sapiens
tggggtgggcctctggtttg

SEQ ID NO: 2559839 - DNA, 14 bp, Homo sapiens
tggggttcgtggaa

SEQ ID NO: 2559840 - DNA, 15 bp, Homo sapiens
tgggtaaatgcagcg

SEQ ID NO: 2559841 - DNA, 16 bp, Homo sapiens
tgggtaactagggaag

SEQ ID NO: 2559842 - DNA, 21 bp, Homo sapiens
tgggtacctattttcattgta

SEQ ID NO: 2559843 - DNA, 20 bp, Homo sapiens
tgggtacttgtggacacagc

SEQ ID NO: 2559844 - DNA, 19 bp, Homo sapiens
tgggtatattcatttcaaa

SEQ ID NO: 2559845 - DNA, 13 bp, Homo sapiens
tgggtcaaggaat

SEQ ID NO: 2559846 - DNA, 12 bp, Homo sapiens
tgggtcagtctg

SEQ ID NO: 2559847 - DNA, 18 bp, Homo sapiens
tgggtccaaataaaaact

SEQ ID NO: 2559848 - DNA, 21 bp, Homo sapiens
tgggtccaggggatgggaggt

SEQ ID NO: 2559849 - DNA, 19 bp, Homo sapiens
tgggtccaggggcccctcc

SEQ ID NO: 2559850 - DNA, 21 bp, Homo sapiens
tgggtcctgggtctttcatgg

SEQ ID NO: 2559851 - DNA, 19 bp, Homo sapiens
tgggtctgtgtctcttttc

SEQ ID NO: 2559852 - DNA, 19 bp, Homo sapiens
tgggtctgttttcctttct

SEQ ID NO: 2559853 - DNA, 15 bp, Homo sapiens
tgggtgaagggagag

SEQ ID NO: 2559854 - DNA, 23 bp, Homo sapiens
tgggtgccccccttgccagacat

SEQ ID NO: 2559855 - DNA, 14 bp, Homo sapiens
tgggtgctggctgc

SEQ ID NO: 2559856 - DNA, 15 bp, Homo sapiens
tgggtggagaagcca

SEQ ID NO: 2559857 - DNA, 22 bp, Homo sapiens
tgggtggagaagccattgtctt

SEQ ID NO: 2559858 - DNA, 23 bp, Homo sapiens
tgggtggatgcctggtggcagct

SEQ ID NO: 2559859 - DNA, 21 bp, Homo sapiens
tgggtggcaccagcagcctgg

SEQ ID NO: 2559860 - DNA, 20 bp, Homo sapiens
tgggtggggtgaggaccact

SEQ ID NO: 2559861 - DNA, 22 bp, Homo sapiens
tgggtggtaccctctggagggg

SEQ ID NO: 2559862 - DNA, 15 bp, Homo sapiens
tgggtggtggatctg

SEQ ID NO: 2559863 - DNA, 14 bp, Homo sapiens
tgggtggtggggag

SEQ ID NO: 2559864 - DNA, 16 bp, Homo sapiens
tgggttattctggagt

SEQ ID NO: 2559865 - DNA, 23 bp, Homo sapiens
tgggttcaagcgattcttctgct

SEQ ID NO: 2559866 - DNA, 20 bp, Homo sapiens
tgggttccctttccttccat

SEQ ID NO: 2559867 - DNA, 21 bp, Homo sapiens
tgggttcctcttccccactcc

SEQ ID NO: 2559868 - DNA, 15 bp, Homo sapiens
tgggttctacccagg

SEQ ID NO: 2559869 - DNA, 22 bp, Homo sapiens
tgggttctacccaggtgctagg

SEQ ID NO: 2559870 - DNA, 17 bp, Homo sapiens
tgggttctttggaagga

SEQ ID NO: 2559871 - DNA, 21 bp, Homo sapiens
tggtaaattagtatttattta

SEQ ID NO: 2559872 - DNA, 16 bp, Homo sapiens
tggtaaatttccccaa

SEQ ID NO: 2559873 - DNA, 19 bp, Homo sapiens
tggtaaatttccccaacag

SEQ ID NO: 2559874 - DNA, 22 bp, Homo sapiens
tggtaaatttccccaacagtgt

SEQ ID NO: 2559875 - DNA, 17 bp, Homo sapiens
tggtaacagttcatgtt

SEQ ID NO: 2559876 - DNA, 21 bp, Homo sapiens
tggtaacagttcatgtttgct

SEQ ID NO: 2559877 - DNA, 22 bp, Homo sapiens
tggtaagaagccgggaacagac

SEQ ID NO: 2559878 - DNA, 13 bp, Homo sapiens
tggtaagctctgg

SEQ ID NO: 2559879 - DNA, 15 bp, Homo sapiens
tggtaagctctggct

SEQ ID NO: 2559880 - DNA, 22 bp, Homo sapiens
tggtaattattttggtactttt

SEQ ID NO: 2559881 - DNA, 13 bp, Homo sapiens
tggtaattgttgc

SEQ ID NO: 2559882 - DNA, 15 bp, Homo sapiens
tggtacatggccagt

SEQ ID NO: 2559883 - DNA, 16 bp, Homo sapiens
tggtacatggccagtg

SEQ ID NO: 2559884 - DNA, 14 bp, Homo sapiens
tggtaccagataaa

SEQ ID NO: 2559885 - DNA, 13 bp, Homo sapiens
tggtacccagcca

SEQ ID NO: 2559886 - DNA, 17 bp, Homo sapiens
tggtacccagccatctg

SEQ ID NO: 2559887 - DNA, 21 bp, Homo sapiens
tggtacccagccatctgccca

SEQ ID NO: 2559888 - DNA, 13 bp, Homo sapiens
tggtactctccta

SEQ ID NO: 2559889 - DNA, 23 bp, Homo sapiens
tggtacttttatgatgtatattt

SEQ ID NO: 2559890 - DNA, 20 bp, Homo sapiens
tggtagagtgtgcctgaagt

SEQ ID NO: 2559891 - DNA, 14 bp, Homo sapiens
tggtagctcaggtg

SEQ ID NO: 2559892 - DNA, 17 bp, Homo sapiens
tggtagcttttcccttc

SEQ ID NO: 2559893 - DNA, 20 bp, Homo sapiens
tggtagcttttcccttcttt

SEQ ID NO: 2559894 - DNA, 18 bp, Homo sapiens
tggtaggactgtagaaaa

SEQ ID NO: 2559895 - DNA, 22 bp, Homo sapiens
tggtagtactcctgcaaaattt

SEQ ID NO: 2559896 - DNA, 20 bp, Homo sapiens
tggtagttagtagcatgttg

SEQ ID NO: 2559897 - DNA, 16 bp, Homo sapiens
tggtatatccaaaagc

SEQ ID NO: 2559898 - DNA, 22 bp, Homo sapiens
tggtatatccaaaagcttttta

SEQ ID NO: 2559899 - DNA, 17 bp, Homo sapiens
tggtatctgttctttaa

SEQ ID NO: 2559900 - DNA, 19 bp, Homo sapiens
tggtatctgttctttaatt

SEQ ID NO: 2559901 - DNA, 16 bp, Homo sapiens
tggtatcttaaagtgt

SEQ ID NO: 2559902 - DNA, 18 bp, Homo sapiens
tggtatgatcacggctca

SEQ ID NO: 2559903 - DNA, 19 bp, Homo sapiens
tggtatggaactctctcca

SEQ ID NO: 2559904 - DNA, 12 bp, Homo sapiens
tggtatgtgtgt

SEQ ID NO: 2559905 - DNA, 21 bp, Homo sapiens
tggtatgtgtgtgtatgctac

SEQ ID NO: 2559906 - DNA, 19 bp, Homo sapiens
tggtattcaggattacatg

SEQ ID NO: 2559907 - DNA, 16 bp, Homo sapiens
tggtcaaacaaactct

SEQ ID NO: 2559908 - DNA, 17 bp, Homo sapiens
tggtcaaaccgcactca

SEQ ID NO: 2559909 - DNA, 15 bp, Homo sapiens
tggtcaagattttga

SEQ ID NO: 2559910 - DNA, 22 bp, Homo sapiens
tggtcaatccgaagtatgaggg

SEQ ID NO: 2559911 - DNA, 13 bp, Homo sapiens
tggtcacagcctc

SEQ ID NO: 2559912 - DNA, 14 bp, Homo sapiens
tggtcacagcctcc

SEQ ID NO: 2559913 - DNA, 16 bp, Homo sapiens
tggtcacagcctcctc

SEQ ID NO: 2559914 - DNA, 18 bp, Homo sapiens
tggtcacagcctcctctg

SEQ ID NO: 2559915 - DNA, 17 bp, Homo sapiens
tggtcacaggaagtaga

SEQ ID NO: 2559916 - DNA, 19 bp, Homo sapiens
tggtcacaggactctgcct

SEQ ID NO: 2559917 - DNA, 22 bp, Homo sapiens
tggtcacaggactctgcctcct

SEQ ID NO: 2559918 - DNA, 14 bp, Homo sapiens
tggtcactgctgtc

SEQ ID NO: 2559919 - DNA, 15 bp, Homo sapiens
tggtcagccctaggg

SEQ ID NO: 2559920 - DNA, 17 bp, Homo sapiens
tggtcagcgttgcatgt

SEQ ID NO: 2559921 - DNA, 13 bp, Homo sapiens
tggtcagctccct

SEQ ID NO: 2559922 - DNA, 23 bp, Homo sapiens
tggtccaaaagattgctgaaatt

SEQ ID NO: 2559923 - DNA, 19 bp, Homo sapiens
tggtccatagagagcaaga

SEQ ID NO: 2559924 - DNA, 13 bp, Homo sapiens
tggtcccacccca

SEQ ID NO: 2559925 - DNA, 13 bp, Homo sapiens
tggtcccactcag

SEQ ID NO: 2559926 - DNA, 18 bp, Homo sapiens
tggtcccatccaggcagt

SEQ ID NO: 2559927 - DNA, 15 bp, Homo sapiens
tggtcccccttccat

SEQ ID NO: 2559928 - DNA, 23 bp, Homo sapiens
tggtcccccttccatggactttg

SEQ ID NO: 2559929 - DNA, 20 bp, Homo sapiens
tggtcctcttgcctcctgga

SEQ ID NO: 2559930 - DNA, 11 bp, Homo sapiens
tggtcctgggg

SEQ ID NO: 2559931 - DNA, 16 bp, Homo sapiens
tggtcctggggctctg

SEQ ID NO: 2559932 - DNA, 19 bp, Homo sapiens
tggtcctggggctctgtgc

SEQ ID NO: 2559933 - DNA, 20 bp, Homo sapiens
tggtcctgtgtgcagtgaag

SEQ ID NO: 2559934 - DNA, 23 bp, Homo sapiens
tggtccttccaggcccccaccac

SEQ ID NO: 2559935 - DNA, 15 bp, Homo sapiens
tggtctacactgtgc

SEQ ID NO: 2559936 - DNA, 19 bp, Homo sapiens
tggtctacactgtgctgag

SEQ ID NO: 2559937 - DNA, 17 bp, Homo sapiens
tggtctcaaactcttga

SEQ ID NO: 2559938 - DNA, 22 bp, Homo sapiens
tggtctcagcagcgaccacccc

SEQ ID NO: 2559939 - DNA, 17 bp, Homo sapiens
tggtctcctcagcctcc

SEQ ID NO: 2559940 - DNA, 16 bp, Homo sapiens
tggtctccttggaaat

SEQ ID NO: 2559941 - DNA, 14 bp, Homo sapiens
tggtctctaggctg

SEQ ID NO: 2559942 - DNA, 22 bp, Homo sapiens
tggtctctgctgaaggttgtaa

SEQ ID NO: 2559943 - DNA, 12 bp, Homo sapiens
tggtctgaatgt

SEQ ID NO: 2559944 - DNA, 19 bp, Homo sapiens
tggtctgaatgttctgaca

SEQ ID NO: 2559945 - DNA, 14 bp, Homo sapiens
tggtctgcaggcag

SEQ ID NO: 2559946 - DNA, 16 bp, Homo sapiens
tggtcttatttgtaaa

SEQ ID NO: 2559947 - DNA, 14 bp, Homo sapiens
tggtcttcccaggc

SEQ ID NO: 2559948 - DNA, 22 bp, Homo sapiens
tggtctttcctatcatggagtg

SEQ ID NO: 2559949 - DNA, 14 bp, Homo sapiens
tggtctttcctctg

SEQ ID NO: 2559950 - DNA, 13 bp, Homo sapiens
tggtctttgtaag

SEQ ID NO: 2559951 - DNA, 15 bp, Homo sapiens
tggtgaaaatgtact

SEQ ID NO: 2559952 - DNA, 22 bp, Homo sapiens
tggtgagaactactcagggaat

SEQ ID NO: 2559953 - DNA, 18 bp, Homo sapiens
tggtgaggcaggctttgt

SEQ ID NO: 2559954 - DNA, 14 bp, Homo sapiens
tggtgcaaatccta

SEQ ID NO: 2559955 - DNA, 10 bp, Homo sapiens
tggtgcatta

SEQ ID NO: 2559956 - DNA, 13 bp, Homo sapiens
tggtgcattacag

SEQ ID NO: 2559957 - DNA, 20 bp, Homo sapiens
tggtgccctgttctctacca

SEQ ID NO: 2559958 - DNA, 17 bp, Homo sapiens
tggtgcctggcctggca

SEQ ID NO: 2559959 - DNA, 11 bp, Homo sapiens
tggtgccttca

SEQ ID NO: 2559960 - DNA, 17 bp, Homo sapiens
tggtgcgatctgggttc

SEQ ID NO: 2559961 - DNA, 18 bp, Homo sapiens
tggtgctataggctggag

SEQ ID NO: 2559962 - DNA, 23 bp, Homo sapiens
tggtgctataggctggagaagct

SEQ ID NO: 2559963 - DNA, 15 bp, Homo sapiens
tggtgctcagttgta

SEQ ID NO: 2559964 - DNA, 12 bp, Homo sapiens
tggtgctggata

SEQ ID NO: 2559965 - DNA, 21 bp, Homo sapiens
tggtgctggatattttcaaat

SEQ ID NO: 2559966 - DNA, 19 bp, Homo sapiens
tggtgctgggactgagcca

SEQ ID NO: 2559967 - DNA, 12 bp, Homo sapiens
tggtgctgtggc

SEQ ID NO: 2559968 - DNA, 18 bp, Homo sapiens
tggtggaagaggggacag

SEQ ID NO: 2559969 - DNA, 18 bp, Homo sapiens
tggtggacagtcctggga

SEQ ID NO: 2559970 - DNA, 17 bp, Homo sapiens
tggtggcactgagcccc

SEQ ID NO: 2559971 - DNA, 19 bp, Homo sapiens
tggtggcagctcacctctc

SEQ ID NO: 2559972 - DNA, 23 bp, Homo sapiens
tggtggcagctcacctctccctt

SEQ ID NO: 2559973 - DNA, 14 bp, Homo sapiens
tggtggcagctgcg

SEQ ID NO: 2559974 - DNA, 20 bp, Homo sapiens
tggtggcagtgggagctgcc

SEQ ID NO: 2559975 - DNA, 23 bp, Homo sapiens
tggtggggaggggcgctggccca

SEQ ID NO: 2559976 - DNA, 17 bp, Homo sapiens
tggtgggggtagagctg

SEQ ID NO: 2559977 - DNA, 21 bp, Homo sapiens
tggtgggggtagagctgatcc

SEQ ID NO: 2559978 - DNA, 16 bp, Homo sapiens
tggtgggtccatgggc

SEQ ID NO: 2559979 - DNA, 21 bp, Homo sapiens
tggtgggttcaggggactcag

SEQ ID NO: 2559980 - DNA, 15 bp, Homo sapiens
tggtggtatctgagt

SEQ ID NO: 2559981 - DNA, 17 bp, Homo sapiens
tggtggtttcacggtgc

SEQ ID NO: 2559982 - DNA, 17 bp, Homo sapiens
tggtggtttcagaaatg

SEQ ID NO: 2559983 - DNA, 16 bp, Homo sapiens
tggtgtaataagacat

SEQ ID NO: 2559984 - DNA, 19 bp, Homo sapiens
tggtgtaataagacataac

SEQ ID NO: 2559985 - DNA, 19 bp, Homo sapiens
tggtgtagttgaactgata

SEQ ID NO: 2559986 - DNA, 16 bp, Homo sapiens
tggtgtcacttactgt

SEQ ID NO: 2559987 - DNA, 17 bp, Homo sapiens
tggtgtcacttactgtt

SEQ ID NO: 2559988 - DNA, 18 bp, Homo sapiens
tggtgtcacttactgttt

SEQ ID NO: 2559989 - DNA, 20 bp, Homo sapiens
tggtgtcacttactgtttct

SEQ ID NO: 2559990 - DNA, 14 bp, Homo sapiens
tggtgtcctgacca

SEQ ID NO: 2559991 - DNA, 19 bp, Homo sapiens
tggtgtcctgaccaccctc

SEQ ID NO: 2559992 - DNA, 20 bp, Homo sapiens
tggtgtcctgaccaccctcc

SEQ ID NO: 2559993 - DNA, 15 bp, Homo sapiens
tggtgtgaaagtcag

SEQ ID NO: 2559994 - DNA, 23 bp, Homo sapiens
tggtgtgaactaaactttcacac

SEQ ID NO: 2559995 - DNA, 11 bp, Homo sapiens
tggtgtgaagg

SEQ ID NO: 2559996 - DNA, 16 bp, Homo sapiens
tggtgtgacctgaggg

SEQ ID NO: 2559997 - DNA, 17 bp, Homo sapiens
tggtgtgacctgagggc

SEQ ID NO: 2559998 - DNA, 18 bp, Homo sapiens
tggtgtgatcgtctgact

SEQ ID NO: 2559999 - DNA, 14 bp, Homo sapiens
tggttagaaatgca

SEQ ID NO: 2560000 - DNA, 15 bp, Homo sapiens
tggttataaaagtga

SEQ ID NO: 2560001 - DNA, 20 bp, Homo sapiens
tggttataaaagtgattgtt

SEQ ID NO: 2560002 - DNA, 14 bp, Homo sapiens
tggttatggagagg

SEQ ID NO: 2560003 - DNA, 15 bp, Homo sapiens
tggttatttctctga

SEQ ID NO: 2560004 - DNA, 20 bp, Homo sapiens
tggttcagggttggcccctg

SEQ ID NO: 2560005 - DNA, 13 bp, Homo sapiens
tggttcataaatg

SEQ ID NO: 2560006 - DNA, 19 bp, Homo sapiens
tggttccatgcctgagggt

SEQ ID NO: 2560007 - DNA, 22 bp, Homo sapiens
tggttccatgcctgagggtgga

SEQ ID NO: 2560008 - DNA, 23 bp, Homo sapiens
tggttccattgtttggagacatt

SEQ ID NO: 2560009 - DNA, 20 bp, Homo sapiens
tggttcccgtttctccacct

SEQ ID NO: 2560010 - DNA, 14 bp, Homo sapiens
tggttctatttaat

SEQ ID NO: 2560011 - DNA, 19 bp, Homo sapiens
tggttcttagttctcactg

SEQ ID NO: 2560012 - DNA, 21 bp, Homo sapiens
tggttcttggtagagattcat

SEQ ID NO: 2560013 - DNA, 14 bp, Homo sapiens
tggttcttgtatta

SEQ ID NO: 2560014 - DNA, 19 bp, Homo sapiens
tggttcttgtattaagaat

SEQ ID NO: 2560015 - DNA, 12 bp, Homo sapiens
tggttgaggaaa

SEQ ID NO: 2560016 - DNA, 22 bp, Homo sapiens
tggttgagttcaggtagctgcc

SEQ ID NO: 2560017 - DNA, 16 bp, Homo sapiens
tggttggagagctaga

SEQ ID NO: 2560018 - DNA, 21 bp, Homo sapiens
tggttgttagttatagatgtc

SEQ ID NO: 2560019 - DNA, 20 bp, Homo sapiens
tggtttccacgatgaaaaac

SEQ ID NO: 2560020 - DNA, 17 bp, Homo sapiens
tggtttcccccttctac

SEQ ID NO: 2560021 - DNA, 13 bp, Homo sapiens
tggtttccttcct

SEQ ID NO: 2560022 - DNA, 17 bp, Homo sapiens
tggtttgcaaggaagcc

SEQ ID NO: 2560023 - DNA, 17 bp, Homo sapiens
tggtttgcagatgacaa

SEQ ID NO: 2560024 - DNA, 20 bp, Homo sapiens
tggtttggccatctctggat

SEQ ID NO: 2560025 - DNA, 22 bp, Homo sapiens
tggtttggggcgaggcagagga

SEQ ID NO: 2560026 - DNA, 21 bp, Homo sapiens
tggtttgtaaattaactttta

SEQ ID NO: 2560027 - DNA, 14 bp, Homo sapiens
tggttttcaaaata

SEQ ID NO: 2560028 - DNA, 15 bp, Homo sapiens
tggttttcaaaataa

SEQ ID NO: 2560029 - DNA, 20 bp, Homo sapiens
tggttttcccctccctgggt

SEQ ID NO: 2560030 - DNA, 21 bp, Homo sapiens
tggttttcccctccctgggtt

SEQ ID NO: 2560031 - DNA, 19 bp, Homo sapiens
tggttttgtaagatgctgg

SEQ ID NO: 2560032 - DNA, 22 bp, Homo sapiens
tgtaaaaaaaaaaaagttatat

SEQ ID NO: 2560033 - DNA, 20 bp, Homo sapiens
tgtaaaaattggtcacccta

SEQ ID NO: 2560034 - DNA, 16 bp, Homo sapiens
tgtaaaacctgtcaat

SEQ ID NO: 2560035 - DNA, 18 bp, Homo sapiens
tgtaaaataagaatgatt

SEQ ID NO: 2560036 - DNA, 12 bp, Homo sapiens
tgtaaaatagct

SEQ ID NO: 2560037 - DNA, 14 bp, Homo sapiens
tgtaaaatagcttg

SEQ ID NO: 2560038 - DNA, 20 bp, Homo sapiens
tgtaaaatattttgaatcaa

SEQ ID NO: 2560039 - DNA, 21 bp, Homo sapiens
tgtaaaatcttggcacagaaa

SEQ ID NO: 2560040 - DNA, 20 bp, Homo sapiens
tgtaaacaggagacaggaag

SEQ ID NO: 2560041 - DNA, 22 bp, Homo sapiens
tgtaaacatgtgttttaattcc

SEQ ID NO: 2560042 - DNA, 13 bp, Homo sapiens
tgtaaaccaaagc

SEQ ID NO: 2560043 - DNA, 22 bp, Homo sapiens
tgtaaaccacaaggctgttgca

SEQ ID NO: 2560044 - DNA, 19 bp, Homo sapiens
tgtaaacctgagtcgtaca

SEQ ID NO: 2560045 - DNA, 16 bp, Homo sapiens
tgtaaactcaaaactt

SEQ ID NO: 2560046 - DNA, 14 bp, Homo sapiens
tgtaaactgtgcac

SEQ ID NO: 2560047 - DNA, 14 bp, Homo sapiens
tgtaaactgtgtat

SEQ ID NO: 2560048 - DNA, 18 bp, Homo sapiens
tgtaaactgtgtattcca

SEQ ID NO: 2560049 - DNA, 13 bp, Homo sapiens
tgtaaagaaagag

SEQ ID NO: 2560050 - DNA, 14 bp, Homo sapiens
tgtaaagaaagaga

SEQ ID NO: 2560051 - DNA, 15 bp, Homo sapiens
tgtaaagaaagagag

SEQ ID NO: 2560052 - DNA, 16 bp, Homo sapiens
tgtaaagaaagagaga

SEQ ID NO: 2560053 - DNA, 22 bp, Homo sapiens
tgtaaagaaagagagaaaataa

SEQ ID NO: 2560054 - DNA, 21 bp, Homo sapiens
tgtaaagagacctacctcagg

SEQ ID NO: 2560055 - DNA, 22 bp, Homo sapiens
tgtaaagagacctacctcaggt

SEQ ID NO: 2560056 - DNA, 12 bp, Homo sapiens
tgtaaagcattc

SEQ ID NO: 2560057 - DNA, 18 bp, Homo sapiens
tgtaaagcattccaacaa

SEQ ID NO: 2560058 - DNA, 16 bp, Homo sapiens
tgtaaagtgtaaatcc

SEQ ID NO: 2560059 - DNA, 21 bp, Homo sapiens
tgtaaatactgtttttaacaa

SEQ ID NO: 2560060 - DNA, 15 bp, Homo sapiens
tgtaaatagctcagg

SEQ ID NO: 2560061 - DNA, 22 bp, Homo sapiens
tgtaaatatgttttttagatca

SEQ ID NO: 2560062 - DNA, 15 bp, Homo sapiens
tgtaaatattctata

SEQ ID NO: 2560063 - DNA, 12 bp, Homo sapiens
tgtaaatattta

SEQ ID NO: 2560064 - DNA, 17 bp, Homo sapiens
tgtaaattaacttttat

SEQ ID NO: 2560065 - DNA, 17 bp, Homo sapiens
tgtaacaagccacccca

SEQ ID NO: 2560066 - DNA, 15 bp, Homo sapiens
tgtaacacaagccac

SEQ ID NO: 2560067 - DNA, 24 bp, Homo sapiens
tgtaacacaagccacagaagccag

SEQ ID NO: 2560068 - DNA, 13 bp, Homo sapiens
tgtaacagaaagg

SEQ ID NO: 2560069 - DNA, 17 bp, Homo sapiens
tgtaacagaaagggcaa

SEQ ID NO: 2560070 - DNA, 22 bp, Homo sapiens
tgtaacagaaagggcaacaata

SEQ ID NO: 2560071 - DNA, 22 bp, Homo sapiens
tgtaacaggtctcctcttaaaa

SEQ ID NO: 2560072 - DNA, 17 bp, Homo sapiens
tgtaacgttgctgtggg

SEQ ID NO: 2560073 - DNA, 21 bp, Homo sapiens
tgtaactatagtccagctttg

SEQ ID NO: 2560074 - DNA, 21 bp, Homo sapiens
tgtaactggcagttttccatt

SEQ ID NO: 2560075 - DNA, 23 bp, Homo sapiens
tgtaactgtcagccgggccctga

SEQ ID NO: 2560076 - DNA, 17 bp, Homo sapiens
tgtaactttctctatga

SEQ ID NO: 2560077 - DNA, 16 bp, Homo sapiens
tgtaacttttgtaaga

SEQ ID NO: 2560078 - DNA, 19 bp, Homo sapiens
tgtaagacaatccatgtaa

SEQ ID NO: 2560079 - DNA, 18 bp, Homo sapiens
tgtaagagcaccttcctc

SEQ ID NO: 2560080 - DNA, 18 bp, Homo sapiens
tgtaagagtgtagaagca

SEQ ID NO: 2560081 - DNA, 20 bp, Homo sapiens
tgtaagagtgtagaagcatt

SEQ ID NO: 2560082 - DNA, 12 bp, Homo sapiens
tgtaagatgctg

SEQ ID NO: 2560083 - DNA, 16 bp, Homo sapiens
tgtaagctgaaaatat

SEQ ID NO: 2560084 - DNA, 14 bp, Homo sapiens
tgtaagctgtttat

SEQ ID NO: 2560085 - DNA, 15 bp, Homo sapiens
tgtaagctgtttatt

SEQ ID NO: 2560086 - DNA, 13 bp, Homo sapiens
tgtaagggaaact

SEQ ID NO: 2560087 - DNA, 12 bp, Homo sapiens
tgtaagtgtgag

SEQ ID NO: 2560088 - DNA, 13 bp, Homo sapiens
tgtaagtttcagg

SEQ ID NO: 2560089 - DNA, 15 bp, Homo sapiens
tgtaagtttcaggtg

SEQ ID NO: 2560090 - DNA, 20 bp, Homo sapiens
tgtaagtttcaggtgacatg

SEQ ID NO: 2560091 - DNA, 20 bp, Homo sapiens
tgtaataaaaagtatatgtt

SEQ ID NO: 2560092 - DNA, 12 bp, Homo sapiens
tgtaataagaca

SEQ ID NO: 2560093 - DNA, 14 bp, Homo sapiens
tgtaataagacata

SEQ ID NO: 2560094 - DNA, 18 bp, Homo sapiens
tgtaataagacataacgt

SEQ ID NO: 2560095 - DNA, 20 bp, Homo sapiens
tgtaatagaaaactgaaaat

SEQ ID NO: 2560096 - DNA, 17 bp, Homo sapiens
tgtaatataaagatgtt

SEQ ID NO: 2560097 - DNA, 14 bp, Homo sapiens
tgtaatcaataaac

SEQ ID NO: 2560098 - DNA, 16 bp, Homo sapiens
tgtaatcaataaacga

SEQ ID NO: 2560099 - DNA, 14 bp, Homo sapiens
tgtaatcaatgttt

SEQ ID NO: 2560100 - DNA, 14 bp, Homo sapiens
tgtaatcagtttta

SEQ ID NO: 2560101 - DNA, 15 bp, Homo sapiens
tgtaatcccagcact

SEQ ID NO: 2560102 - DNA, 16 bp, Homo sapiens
tgtaatcccagctact

SEQ ID NO: 2560103 - DNA, 16 bp, Homo sapiens
tgtaatccgaatctct

SEQ ID NO: 2560104 - DNA, 17 bp, Homo sapiens
tgtaatctcgtttcaaa

SEQ ID NO: 2560105 - DNA, 18 bp, Homo sapiens
tgtaatctcgtttcaaaa

SEQ ID NO: 2560106 - DNA, 19 bp, Homo sapiens
tgtaatctcgtttcaaaaa

SEQ ID NO: 2560107 - DNA, 20 bp, Homo sapiens
tgtaatgaaacaccttctct

SEQ ID NO: 2560108 - DNA, 21 bp, Homo sapiens
tgtaatgaatctaagcagcat

SEQ ID NO: 2560109 - DNA, 14 bp, Homo sapiens
tgtaatgttactga

SEQ ID NO: 2560110 - DNA, 16 bp, Homo sapiens
tgtaatgttactgatc

SEQ ID NO: 2560111 - DNA, 19 bp, Homo sapiens
tgtaatgttactgatcatg

SEQ ID NO: 2560112 - DNA, 22 bp, Homo sapiens
tgtaatgttactgatcatgcat

SEQ ID NO: 2560113 - DNA, 21 bp, Homo sapiens
tgtaattaagtactatgtatc

SEQ ID NO: 2560114 - DNA, 23 bp, Homo sapiens
tgtaattaagtactatgtatcaa

SEQ ID NO: 2560115 - DNA, 16 bp, Homo sapiens
tgtaattctaaatgaa

SEQ ID NO: 2560116 - DNA, 15 bp, Homo sapiens
tgtaattgaataaag

SEQ ID NO: 2560117 - DNA, 15 bp, Homo sapiens
tgtaattgcttacat

SEQ ID NO: 2560118 - DNA, 16 bp, Homo sapiens
tgtaattgcttacatt

SEQ ID NO: 2560119 - DNA, 17 bp, Homo sapiens
tgtaattgcttacattt

SEQ ID NO: 2560120 - DNA, 23 bp, Homo sapiens
tgtaattgcttacatttttacaa

SEQ ID NO: 2560121 - DNA, 23 bp, Homo sapiens
tgtaattgttgtttgtatgtata

SEQ ID NO: 2560122 - DNA, 20 bp, Homo sapiens
tgtaatttaaaattgtgatg

SEQ ID NO: 2560123 - DNA, 22 bp, Homo sapiens
tgtaatttaaaattgtgatgtg

SEQ ID NO: 2560124 - DNA, 14 bp, Homo sapiens
tgtaatttaaacag

SEQ ID NO: 2560125 - DNA, 19 bp, Homo sapiens
tgtaatttaaacaggccca

SEQ ID NO: 2560126 - DNA, 23 bp, Homo sapiens
tgtaatttctttgcctgttcagt

SEQ ID NO: 2560127 - DNA, 16 bp, Homo sapiens
tgtaatttgtgataca

SEQ ID NO: 2560128 - DNA, 23 bp, Homo sapiens
tgtacaaagtagaagtcttagat

SEQ ID NO: 2560129 - DNA, 15 bp, Homo sapiens
tgtacaatatttaaa

SEQ ID NO: 2560130 - DNA, 14 bp, Homo sapiens
tgtacacgggactg

SEQ ID NO: 2560131 - DNA, 15 bp, Homo sapiens
tgtacactgaatatt

SEQ ID NO: 2560132 - DNA, 17 bp, Homo sapiens
tgtacactgaatattta

SEQ ID NO: 2560133 - DNA, 21 bp, Homo sapiens
tgtacactgaatatttatatt

SEQ ID NO: 2560134 - DNA, 12 bp, Homo sapiens
tgtacacttttt

SEQ ID NO: 2560135 - DNA, 17 bp, Homo sapiens
tgtacagacgtatgctt

SEQ ID NO: 2560136 - DNA, 20 bp, Homo sapiens
tgtacagacgtatgcttatt

SEQ ID NO: 2560137 - DNA, 19 bp, Homo sapiens
tgtacagatgaatgataaa

SEQ ID NO: 2560138 - DNA, 15 bp, Homo sapiens
tgtacagtctgtcat

SEQ ID NO: 2560139 - DNA, 16 bp, Homo sapiens
tgtacagtctgtcatg

SEQ ID NO: 2560140 - DNA, 13 bp, Homo sapiens
tgtacataactga

SEQ ID NO: 2560141 - DNA, 19 bp, Homo sapiens
tgtacataactgaaaatgt

SEQ ID NO: 2560142 - DNA, 20 bp, Homo sapiens
tgtacataatgcgtgcatac

SEQ ID NO: 2560143 - DNA, 22 bp, Homo sapiens
tgtacatagcctatatttacag

SEQ ID NO: 2560144 - DNA, 15 bp, Homo sapiens
tgtacatatgtaaaa

SEQ ID NO: 2560145 - DNA, 16 bp, Homo sapiens
tgtacatatgtaaaat

SEQ ID NO: 2560146 - DNA, 23 bp, Homo sapiens
tgtacatcccatgtaacagaaag

SEQ ID NO: 2560147 - DNA, 14 bp, Homo sapiens
tgtacatctggcct

SEQ ID NO: 2560148 - DNA, 14 bp, Homo sapiens
tgtacatgaaaaca

SEQ ID NO: 2560149 - DNA, 19 bp, Homo sapiens
tgtacatggcagagtttgt

SEQ ID NO: 2560150 - DNA, 11 bp, Homo sapiens
tgtacatgtgt

SEQ ID NO: 2560151 - DNA, 22 bp, Homo sapiens
tgtacattagtcattcaataaa

SEQ ID NO: 2560152 - DNA, 20 bp, Homo sapiens
tgtacatttatgatttaata

SEQ ID NO: 2560153 - DNA, 21 bp, Homo sapiens
tgtacatttatgatttaataa

SEQ ID NO: 2560154 - DNA, 10 bp, Homo sapiens
tgtacatttc

SEQ ID NO: 2560155 - DNA, 22 bp, Homo sapiens
tgtacatttccaaattcacaag

SEQ ID NO: 2560156 - DNA, 16 bp, Homo sapiens
tgtacatttctgaaat

SEQ ID NO: 2560157 - DNA, 14 bp, Homo sapiens
tgtacctctgcctc

SEQ ID NO: 2560158 - DNA, 22 bp, Homo sapiens
tgtacctcttgagccttgaact

SEQ ID NO: 2560159 - DNA, 16 bp, Homo sapiens
tgtacgtctgacaggc

SEQ ID NO: 2560160 - DNA, 17 bp, Homo sapiens
tgtacgtctgacaggca

SEQ ID NO: 2560161 - DNA, 12 bp, Homo sapiens
tgtactacaatt

SEQ ID NO: 2560162 - DNA, 18 bp, Homo sapiens
tgtactcaggaggctgag

SEQ ID NO: 2560163 - DNA, 13 bp, Homo sapiens
tgtactcttccga

SEQ ID NO: 2560164 - DNA, 12 bp, Homo sapiens
tgtactgaaaaa

SEQ ID NO: 2560165 - DNA, 20 bp, Homo sapiens
tgtactgagccttgtaattc

SEQ ID NO: 2560166 - DNA, 22 bp, Homo sapiens
tgtactgagccttgtaattcta

SEQ ID NO: 2560167 - DNA, 12 bp, Homo sapiens
tgtactgggggt

SEQ ID NO: 2560168 - DNA, 13 bp, Homo sapiens
tgtactgggggtt

SEQ ID NO: 2560169 - DNA, 18 bp, Homo sapiens
tgtactgtaaagagacct

SEQ ID NO: 2560170 - DNA, 12 bp, Homo sapiens
tgtactgtagtt

SEQ ID NO: 2560171 - DNA, 21 bp, Homo sapiens
tgtacttaataaattcagata

SEQ ID NO: 2560172 - DNA, 22 bp, Homo sapiens
tgtacttaataaattcagatat

SEQ ID NO: 2560173 - DNA, 15 bp, Homo sapiens
tgtacttgtcaaaga

SEQ ID NO: 2560174 - DNA, 19 bp, Homo sapiens
tgtagaaaagggaactgaa

SEQ ID NO: 2560175 - DNA, 20 bp, Homo sapiens
tgtagaaaagggaactgaac

SEQ ID NO: 2560176 - DNA, 21 bp, Homo sapiens
tgtagaaaagggaactgaaca

SEQ ID NO: 2560177 - DNA, 23 bp, Homo sapiens
tgtagaaaagggaactgaacatt

SEQ ID NO: 2560178 - DNA, 21 bp, Homo sapiens
tgtagacctagggaggacctt

SEQ ID NO: 2560179 - DNA, 16 bp, Homo sapiens
tgtagagccagggtct

SEQ ID NO: 2560180 - DNA, 14 bp, Homo sapiens
tgtagagtgggagc

SEQ ID NO: 2560181 - DNA, 15 bp, Homo sapiens
tgtagagttaagaag

SEQ ID NO: 2560182 - DNA, 18 bp, Homo sapiens
tgtagagttaagaagctg

SEQ ID NO: 2560183 - DNA, 21 bp, Homo sapiens
tgtagatattgtgaagtacat

SEQ ID NO: 2560184 - DNA, 23 bp, Homo sapiens
tgtagcagtgagaaaaagctcct

SEQ ID NO: 2560185 - DNA, 16 bp, Homo sapiens
tgtagcccacacttga

SEQ ID NO: 2560186 - DNA, 16 bp, Homo sapiens
tgtagccttgcccgga

SEQ ID NO: 2560187 - DNA, 12 bp, Homo sapiens
tgtagctttgct

SEQ ID NO: 2560188 - DNA, 23 bp, Homo sapiens
tgtaggaagagtagcatttcatt

SEQ ID NO: 2560189 - DNA, 17 bp, Homo sapiens
tgtaggcataaagtcag

SEQ ID NO: 2560190 - DNA, 16 bp, Homo sapiens
tgtagggctggaccta

SEQ ID NO: 2560191 - DNA, 20 bp, Homo sapiens
tgtagtaaagccgttgttta

SEQ ID NO: 2560192 - DNA, 18 bp, Homo sapiens
tgtagtagccctttctgt

SEQ ID NO: 2560193 - DNA, 21 bp, Homo sapiens
tgtagtatcaaatattagatg

SEQ ID NO: 2560194 - DNA, 22 bp, Homo sapiens
tgtagtgaatcacgtaaagcta

SEQ ID NO: 2560195 - DNA, 17 bp, Homo sapiens
tgtagtgagatagcatt

SEQ ID NO: 2560196 - DNA, 21 bp, Homo sapiens
tgtagtgagatagcattgtga

SEQ ID NO: 2560197 - DNA, 13 bp, Homo sapiens
tgtagttaatgat

SEQ ID NO: 2560198 - DNA, 15 bp, Homo sapiens
tgtagttaggaaata

SEQ ID NO: 2560199 - DNA, 23 bp, Homo sapiens
tgtagttaggaaataaaaccttt

SEQ ID NO: 2560200 - DNA, 14 bp, Homo sapiens
tgtagttgaactga

SEQ ID NO: 2560201 - DNA, 15 bp, Homo sapiens
tgtagttgcgtggac

SEQ ID NO: 2560202 - DNA, 18 bp, Homo sapiens
tgtataaataggagagga

SEQ ID NO: 2560203 - DNA, 16 bp, Homo sapiens
tgtataagtccttgca

SEQ ID NO: 2560204 - DNA, 16 bp, Homo sapiens
tgtatacaaccctggc

SEQ ID NO: 2560205 - DNA, 15 bp, Homo sapiens
tgtatacatgccagt

SEQ ID NO: 2560206 - DNA, 23 bp, Homo sapiens
tgtatagtaaagtgataatttct

SEQ ID NO: 2560207 - DNA, 15 bp, Homo sapiens
tgtatagtgtaaaat

SEQ ID NO: 2560208 - DNA, 16 bp, Homo sapiens
tgtatagtgtaaaata

SEQ ID NO: 2560209 - DNA, 20 bp, Homo sapiens
tgtatagttaggatagcatt

SEQ ID NO: 2560210 - DNA, 19 bp, Homo sapiens
tgtatataaaatattttca

SEQ ID NO: 2560211 - DNA, 17 bp, Homo sapiens
tgtatatatattaagag

SEQ ID NO: 2560212 - DNA, 14 bp, Homo sapiens
tgtatatatgtgtg

SEQ ID NO: 2560213 - DNA, 13 bp, Homo sapiens
tgtatatcagaaa

SEQ ID NO: 2560214 - DNA, 21 bp, Homo sapiens
tgtatattatggaagatttta

SEQ ID NO: 2560215 - DNA, 12 bp, Homo sapiens
tgtatattattt

SEQ ID NO: 2560216 - DNA, 21 bp, Homo sapiens
tgtatattatttctaggaaga

SEQ ID NO: 2560217 - DNA, 14 bp, Homo sapiens
tgtatatttgtaca

SEQ ID NO: 2560218 - DNA, 17 bp, Homo sapiens
tgtatcaatgagtaaca

SEQ ID NO: 2560219 - DNA, 18 bp, Homo sapiens
tgtatcagaggcctataa

SEQ ID NO: 2560220 - DNA, 15 bp, Homo sapiens
tgtatcatagaaatg

SEQ ID NO: 2560221 - DNA, 16 bp, Homo sapiens
tgtatcatagaaatgt

SEQ ID NO: 2560222 - DNA, 17 bp, Homo sapiens
tgtatcatttgaacaac

SEQ ID NO: 2560223 - DNA, 18 bp, Homo sapiens
tgtatccattatcatgtg

SEQ ID NO: 2560224 - DNA, 22 bp, Homo sapiens
tgtatccattatcatgtgtaat

SEQ ID NO: 2560225 - DNA, 22 bp, Homo sapiens
tgtatcccccccctgtatagtt

SEQ ID NO: 2560226 - DNA, 18 bp, Homo sapiens
tgtatcctggggctccct

SEQ ID NO: 2560227 - DNA, 17 bp, Homo sapiens
tgtatcggagacagtga

SEQ ID NO: 2560228 - DNA, 18 bp, Homo sapiens
tgtatcggagacagtgat

SEQ ID NO: 2560229 - DNA, 19 bp, Homo sapiens
tgtatcgtatagctgtatt

SEQ ID NO: 2560230 - DNA, 17 bp, Homo sapiens
tgtatctctgaagcatg

SEQ ID NO: 2560231 - DNA, 22 bp, Homo sapiens
tgtatctctgaagcatgtttca

SEQ ID NO: 2560232 - DNA, 17 bp, Homo sapiens
tgtatgcaacaggcact

SEQ ID NO: 2560233 - DNA, 21 bp, Homo sapiens
tgtatgcctttaaatctgtga

SEQ ID NO: 2560234 - DNA, 22 bp, Homo sapiens
tgtatgcctttaaatctgtgat

SEQ ID NO: 2560235 - DNA, 23 bp, Homo sapiens
tgtatgcctttaaatctgtgatg

SEQ ID NO: 2560236 - DNA, 18 bp, Homo sapiens
tgtatggaaataaatgta

SEQ ID NO: 2560237 - DNA, 19 bp, Homo sapiens
tgtatggaatacagtgtta

SEQ ID NO: 2560238 - DNA, 23 bp, Homo sapiens
tgtatgggtgtgtgtttgtgtga

SEQ ID NO: 2560239 - DNA, 13 bp, Homo sapiens
tgtatgtataatt

SEQ ID NO: 2560240 - DNA, 21 bp, Homo sapiens
tgtatgtcagacatccatgtt

SEQ ID NO: 2560241 - DNA, 18 bp, Homo sapiens
tgtatgtctcgtggtagg

SEQ ID NO: 2560242 - DNA, 19 bp, Homo sapiens
tgtatgtcttggacactgt

SEQ ID NO: 2560243 - DNA, 11 bp, Homo sapiens
tgtatgtgcac

SEQ ID NO: 2560244 - DNA, 17 bp, Homo sapiens
tgtatgtgcgtgtgtgc

SEQ ID NO: 2560245 - DNA, 11 bp, Homo sapiens
tgtatgtttac

SEQ ID NO: 2560246 - DNA, 13 bp, Homo sapiens
tgtatgtttacat

SEQ ID NO: 2560247 - DNA, 12 bp, Homo sapiens
tgtattaagaat

SEQ ID NO: 2560248 - DNA, 16 bp, Homo sapiens
tgtattaagagtgaaa

SEQ ID NO: 2560249 - DNA, 14 bp, Homo sapiens
tgtattaagccact

SEQ ID NO: 2560250 - DNA, 23 bp, Homo sapiens
tgtattactagaagatgaataca

SEQ ID NO: 2560251 - DNA, 15 bp, Homo sapiens
tgtattagtcacaga

SEQ ID NO: 2560252 - DNA, 16 bp, Homo sapiens
tgtattattctgcagc

SEQ ID NO: 2560253 - DNA, 21 bp, Homo sapiens
tgtattatttcattatgtaaa

SEQ ID NO: 2560254 - DNA, 20 bp, Homo sapiens
tgtattccaagacatgtctg

SEQ ID NO: 2560255 - DNA, 16 bp, Homo sapiens
tgtattcttaaattca

SEQ ID NO: 2560256 - DNA, 16 bp, Homo sapiens
tgtattctttgatgtt

SEQ ID NO: 2560257 - DNA, 22 bp, Homo sapiens
tgtattctttgatgttaacaca

SEQ ID NO: 2560258 - DNA, 15 bp, Homo sapiens
tgtattgtaaacatg

SEQ ID NO: 2560259 - DNA, 19 bp, Homo sapiens
tgtattgtaaacatgtgtt

SEQ ID NO: 2560260 - DNA, 19 bp, Homo sapiens
tgtattgtaccttttaaca

SEQ ID NO: 2560261 - DNA, 12 bp, Homo sapiens
tgtattgttccc

SEQ ID NO: 2560262 - DNA, 13 bp, Homo sapiens
tgtattgttccca

SEQ ID NO: 2560263 - DNA, 13 bp, Homo sapiens
tgtatttaaatat

SEQ ID NO: 2560264 - DNA, 18 bp, Homo sapiens
tgtatttaacagggaggg

SEQ ID NO: 2560265 - DNA, 21 bp, Homo sapiens
tgtatttataaatatatttaa

SEQ ID NO: 2560266 - DNA, 17 bp, Homo sapiens
tgtatttatgtgtgagg

SEQ ID NO: 2560267 - DNA, 15 bp, Homo sapiens
tgtatttatttaaaa

SEQ ID NO: 2560268 - DNA, 18 bp, Homo sapiens
tgtatttattttcctccc

SEQ ID NO: 2560269 - DNA, 15 bp, Homo sapiens
tgtatttccagtgca

SEQ ID NO: 2560270 - DNA, 15 bp, Homo sapiens
tgtattttaactcat

SEQ ID NO: 2560271 - DNA, 12 bp, Homo sapiens
tgtattttccaa

SEQ ID NO: 2560272 - DNA, 22 bp, Homo sapiens
tgtattttccaagtgtgcatat

SEQ ID NO: 2560273 - DNA, 23 bp, Homo sapiens
tgtcaaaaatgtcttgggtaggc

SEQ ID NO: 2560274 - DNA, 16 bp, Homo sapiens
tgtcaaacaaagccag

SEQ ID NO: 2560275 - DNA, 12 bp, Homo sapiens
tgtcaaagaagg

SEQ ID NO: 2560276 - DNA, 15 bp, Homo sapiens
tgtcaacttcaacat

SEQ ID NO: 2560277 - DNA, 15 bp, Homo sapiens
tgtcaacttctggct

SEQ ID NO: 2560278 - DNA, 18 bp, Homo sapiens
tgtcaagtctctgctggc

SEQ ID NO: 2560279 - DNA, 18 bp, Homo sapiens
tgtcaatattaaatacag

SEQ ID NO: 2560280 - DNA, 19 bp, Homo sapiens
tgtcaatattaaatacaga

SEQ ID NO: 2560281 - DNA, 19 bp, Homo sapiens
tgtcaatttccctgactcc

SEQ ID NO: 2560282 - DNA, 23 bp, Homo sapiens
tgtcaatttccctgactcctcta

SEQ ID NO: 2560283 - DNA, 15 bp, Homo sapiens
tgtcacaccagccat

SEQ ID NO: 2560284 - DNA, 12 bp, Homo sapiens
tgtcacaggcag

SEQ ID NO: 2560285 - DNA, 15 bp, Homo sapiens
tgtcacaggcaggtc

SEQ ID NO: 2560286 - DNA, 17 bp, Homo sapiens
tgtcacaggcaggtcca

SEQ ID NO: 2560287 - DNA, 12 bp, Homo sapiens
tgtcacagggcc

SEQ ID NO: 2560288 - DNA, 20 bp, Homo sapiens
tgtcacatgaaacatttgca

SEQ ID NO: 2560289 - DNA, 22 bp, Homo sapiens
tgtcaccctccacctcttcacc

SEQ ID NO: 2560290 - DNA, 23 bp, Homo sapiens
tgtcaccgtgagcagctttggaa

SEQ ID NO: 2560291 - DNA, 20 bp, Homo sapiens
tgtcaccgtggaccttcctg

SEQ ID NO: 2560292 - DNA, 13 bp, Homo sapiens
tgtcactgtttct

SEQ ID NO: 2560293 - DNA, 15 bp, Homo sapiens
tgtcactttgctctg

SEQ ID NO: 2560294 - DNA, 17 bp, Homo sapiens
tgtcactttgctctggg

SEQ ID NO: 2560295 - DNA, 18 bp, Homo sapiens
tgtcactttgctctgggt

SEQ ID NO: 2560296 - DNA, 12 bp, Homo sapiens
tgtcagacttta

SEQ ID NO: 2560297 - DNA, 12 bp, Homo sapiens
tgtcagagctgg

SEQ ID NO: 2560298 - DNA, 13 bp, Homo sapiens
tgtcagagctggg

SEQ ID NO: 2560299 - DNA, 16 bp, Homo sapiens
tgtcagatacaatgta

SEQ ID NO: 2560300 - DNA, 21 bp, Homo sapiens
tgtcagatattttttcagaaa

SEQ ID NO: 2560301 - DNA, 23 bp, Homo sapiens
tgtcagatattttttcagaaata

SEQ ID NO: 2560302 - DNA, 13 bp, Homo sapiens
tgtcagcaggaag

SEQ ID NO: 2560303 - DNA, 22 bp, Homo sapiens
tgtcagccgagccgggcctggg

SEQ ID NO: 2560304 - DNA, 17 bp, Homo sapiens
tgtcagccgggccctga

SEQ ID NO: 2560305 - DNA, 22 bp, Homo sapiens
tgtcagccgggccctgagtaat

SEQ ID NO: 2560306 - DNA, 19 bp, Homo sapiens
tgtcagctactaatgatgt

SEQ ID NO: 2560307 - DNA, 19 bp, Homo sapiens
tgtcagctgaacctgggta

SEQ ID NO: 2560308 - DNA, 17 bp, Homo sapiens
tgtcaggaacagaagga

SEQ ID NO: 2560309 - DNA, 20 bp, Homo sapiens
tgtcaggaacagaaggatga

SEQ ID NO: 2560310 - DNA, 14 bp, Homo sapiens
tgtcaggcctgtgt

SEQ ID NO: 2560311 - DNA, 15 bp, Homo sapiens
tgtcaggctgctggc

SEQ ID NO: 2560312 - DNA, 17 bp, Homo sapiens
tgtcaggtggggcagct

SEQ ID NO: 2560313 - DNA, 18 bp, Homo sapiens
tgtcaggtggggcagctt

SEQ ID NO: 2560314 - DNA, 20 bp, Homo sapiens
tgtcagtatctgtatctctc

SEQ ID NO: 2560315 - DNA, 22 bp, Homo sapiens
tgtcagtatgtggaagtgtggg

SEQ ID NO: 2560316 - DNA, 15 bp, Homo sapiens
tgtcagtggaagaag

SEQ ID NO: 2560317 - DNA, 16 bp, Homo sapiens
tgtcataagaatgaat

SEQ ID NO: 2560318 - DNA, 15 bp, Homo sapiens
tgtcatagaaattac

SEQ ID NO: 2560319 - DNA, 15 bp, Homo sapiens
tgtcatcaattgaat

SEQ ID NO: 2560320 - DNA, 16 bp, Homo sapiens
tgtcatcagaagataa

SEQ ID NO: 2560321 - DNA, 19 bp, Homo sapiens
tgtcatcagaagataactt

SEQ ID NO: 2560322 - DNA, 18 bp, Homo sapiens
tgtcatcattgtatatat

SEQ ID NO: 2560323 - DNA, 12 bp, Homo sapiens
tgtcatgaacat

SEQ ID NO: 2560324 - DNA, 16 bp, Homo sapiens
tgtcatgaattcttat

SEQ ID NO: 2560325 - DNA, 13 bp, Homo sapiens
tgtcattaaaata

SEQ ID NO: 2560326 - DNA, 19 bp, Homo sapiens
tgtcattaaaataaataaa

SEQ ID NO: 2560327 - DNA, 18 bp, Homo sapiens
tgtcattgctgttgtccc

SEQ ID NO: 2560328 - DNA, 16 bp, Homo sapiens
tgtcatttgagcaggg

SEQ ID NO: 2560329 - DNA, 19 bp, Homo sapiens
tgtcatttgagcagggctc

SEQ ID NO: 2560330 - DNA, 22 bp, Homo sapiens
tgtcatttgagcagggctcagc

SEQ ID NO: 2560331 - DNA, 15 bp, Homo sapiens
tgtccaaactgccta

SEQ ID NO: 2560332 - DNA, 17 bp, Homo sapiens
tgtccaagaagcccagg

SEQ ID NO: 2560333 - DNA, 18 bp, Homo sapiens
tgtccaagaagcccagga

SEQ ID NO: 2560334 - DNA, 14 bp, Homo sapiens
tgtccaaggaaact

SEQ ID NO: 2560335 - DNA, 16 bp, Homo sapiens
tgtccaattctcttta

SEQ ID NO: 2560336 - DNA, 18 bp, Homo sapiens
tgtccacacccagctcag

SEQ ID NO: 2560337 - DNA, 19 bp, Homo sapiens
tgtccacagatgcctccac

SEQ ID NO: 2560338 - DNA, 16 bp, Homo sapiens
tgtccacgactgtctc

SEQ ID NO: 2560339 - DNA, 16 bp, Homo sapiens
tgtccagacagcctgt

SEQ ID NO: 2560340 - DNA, 12 bp, Homo sapiens
tgtccagcctgg

SEQ ID NO: 2560341 - DNA, 22 bp, Homo sapiens
tgtccagcctgggcagccaggc

SEQ ID NO: 2560342 - DNA, 21 bp, Homo sapiens
tgtccaggcactgctgcccag

SEQ ID NO: 2560343 - DNA, 19 bp, Homo sapiens
tgtccagggccctgagctc

SEQ ID NO: 2560344 - DNA, 20 bp, Homo sapiens
tgtccatgtggttcttcaaa

SEQ ID NO: 2560345 - DNA, 12 bp, Homo sapiens
tgtccatgtgtg

SEQ ID NO: 2560346 - DNA, 15 bp, Homo sapiens
tgtccatgtgtgtgc

SEQ ID NO: 2560347 - DNA, 18 bp, Homo sapiens
tgtcccacccccaccccc

SEQ ID NO: 2560348 - DNA, 21 bp, Homo sapiens
tgtcccacctcttctcttcct

SEQ ID NO: 2560349 - DNA, 23 bp, Homo sapiens
tgtcccacctcttctcttcctgt

SEQ ID NO: 2560350 - DNA, 16 bp, Homo sapiens
tgtcccactatctggg

SEQ ID NO: 2560351 - DNA, 17 bp, Homo sapiens
tgtcccactcaagccaa

SEQ ID NO: 2560352 - DNA, 16 bp, Homo sapiens
tgtcccaggtcctcac

SEQ ID NO: 2560353 - DNA, 16 bp, Homo sapiens
tgtcccatgacccacc

SEQ ID NO: 2560354 - DNA, 20 bp, Homo sapiens
tgtcccatgacccacccctg

SEQ ID NO: 2560355 - DNA, 18 bp, Homo sapiens
tgtcccatggacactcca

SEQ ID NO: 2560356 - DNA, 18 bp, Homo sapiens
tgtccccaccgcagacag

SEQ ID NO: 2560357 - DNA, 22 bp, Homo sapiens
tgtccccaccgcagacaggacc

SEQ ID NO: 2560358 - DNA, 15 bp, Homo sapiens
tgtcccccagctctg

SEQ ID NO: 2560359 - DNA, 18 bp, Homo sapiens
tgtccccctctgtccagg

SEQ ID NO: 2560360 - DNA, 23 bp, Homo sapiens
tgtcccctatggggatggtccac

SEQ ID NO: 2560361 - DNA, 16 bp, Homo sapiens
tgtcccggggtcctgt

SEQ ID NO: 2560362 - DNA, 12 bp, Homo sapiens
tgtccctcctgg

SEQ ID NO: 2560363 - DNA, 13 bp, Homo sapiens
tgtccctctaaag

SEQ ID NO: 2560364 - DNA, 14 bp, Homo sapiens
tgtccctgcacttg

SEQ ID NO: 2560365 - DNA, 16 bp, Homo sapiens
tgtccctttcttggcc

SEQ ID NO: 2560366 - DNA, 14 bp, Homo sapiens
tgtccgagctttga

SEQ ID NO: 2560367 - DNA, 23 bp, Homo sapiens
tgtccgctgggtggtaccctctg

SEQ ID NO: 2560368 - DNA, 18 bp, Homo sapiens
tgtcctaaggacacacta

SEQ ID NO: 2560369 - DNA, 17 bp, Homo sapiens
tgtcctactctgtgtca

SEQ ID NO: 2560370 - DNA, 17 bp, Homo sapiens
tgtcctccaagccagcg

SEQ ID NO: 2560371 - DNA, 18 bp, Homo sapiens
tgtcctccagaagcctct

SEQ ID NO: 2560372 - DNA, 22 bp, Homo sapiens
tgtcctccagaagcctctggct

SEQ ID NO: 2560373 - DNA, 13 bp, Homo sapiens
tgtcctcccatcc

SEQ ID NO: 2560374 - DNA, 17 bp, Homo sapiens
tgtcctcccatcccctg

SEQ ID NO: 2560375 - DNA, 18 bp, Homo sapiens
tgtcctcccatcccctgg

SEQ ID NO: 2560376 - DNA, 22 bp, Homo sapiens
tgtcctcccatcccctggactg

SEQ ID NO: 2560377 - DNA, 15 bp, Homo sapiens
tgtcctgaccaccct

SEQ ID NO: 2560378 - DNA, 23 bp, Homo sapiens
tgtcctgaccaccctcccctctc

SEQ ID NO: 2560379 - DNA, 18 bp, Homo sapiens
tgtcctgatggtcagctc

SEQ ID NO: 2560380 - DNA, 13 bp, Homo sapiens
tgtcctgggctgg

SEQ ID NO: 2560381 - DNA, 16 bp, Homo sapiens
tgtcctggtgtcactt

SEQ ID NO: 2560382 - DNA, 15 bp, Homo sapiens
tgtcctgtaaaggtt

SEQ ID NO: 2560383 - DNA, 20 bp, Homo sapiens
tgtcctgtagaggttttgtt

SEQ ID NO: 2560384 - DNA, 14 bp, Homo sapiens
tgtccttccctgca

SEQ ID NO: 2560385 - DNA, 18 bp, Homo sapiens
tgtccttggaagtttcat

SEQ ID NO: 2560386 - DNA, 17 bp, Homo sapiens
tgtcctttttgttatta

SEQ ID NO: 2560387 - DNA, 15 bp, Homo sapiens
tgtcgagacacttgc

SEQ ID NO: 2560388 - DNA, 22 bp, Homo sapiens
tgtcggcctctaaccccaggcc

SEQ ID NO: 2560389 - DNA, 22 bp, Homo sapiens
tgtcgttgactttagggactca

SEQ ID NO: 2560390 - DNA, 13 bp, Homo sapiens
tgtctaaaaacac

SEQ ID NO: 2560391 - DNA, 13 bp, Homo sapiens
tgtctaaaacaat

SEQ ID NO: 2560392 - DNA, 14 bp, Homo sapiens
tgtctagagtagct

SEQ ID NO: 2560393 - DNA, 15 bp, Homo sapiens
tgtctagttgtttga

SEQ ID NO: 2560394 - DNA, 22 bp, Homo sapiens
tgtctataatcccagcactttg

SEQ ID NO: 2560395 - DNA, 19 bp, Homo sapiens
tgtctattcaaaatatcaa

SEQ ID NO: 2560396 - DNA, 16 bp, Homo sapiens
tgtctcagcctcctga

SEQ ID NO: 2560397 - DNA, 21 bp, Homo sapiens
tgtctcatccatcatcatgtg

SEQ ID NO: 2560398 - DNA, 16 bp, Homo sapiens
tgtctccagaccccca

SEQ ID NO: 2560399 - DNA, 18 bp, Homo sapiens
tgtctccttaacactgag

SEQ ID NO: 2560400 - DNA, 19 bp, Homo sapiens
tgtctcctttgcaggctca

SEQ ID NO: 2560401 - DNA, 19 bp, Homo sapiens
tgtctcgtggtaggactgt

SEQ ID NO: 2560402 - DNA, 19 bp, Homo sapiens
tgtctctagccactttggt

SEQ ID NO: 2560403 - DNA, 13 bp, Homo sapiens
tgtctctgcctcc

SEQ ID NO: 2560404 - DNA, 17 bp, Homo sapiens
tgtctctgcctccctca

SEQ ID NO: 2560405 - DNA, 19 bp, Homo sapiens
tgtctctggcgtgtgggta

SEQ ID NO: 2560406 - DNA, 21 bp, Homo sapiens
tgtctctttaatgtcacaggc

SEQ ID NO: 2560407 - DNA, 22 bp, Homo sapiens
tgtctctttaatgtcacaggca

SEQ ID NO: 2560408 - DNA, 14 bp, Homo sapiens
tgtctcttttctct

SEQ ID NO: 2560409 - DNA, 18 bp, Homo sapiens
tgtctgagccctcaaagt

SEQ ID NO: 2560410 - DNA, 15 bp, Homo sapiens
tgtctgatctgtgct

SEQ ID NO: 2560411 - DNA, 16 bp, Homo sapiens
tgtctgatctgtgctt

SEQ ID NO: 2560412 - DNA, 11 bp, Homo sapiens
tgtctgccctt

SEQ ID NO: 2560413 - DNA, 15 bp, Homo sapiens
tgtctgcctcttaga

SEQ ID NO: 2560414 - DNA, 21 bp, Homo sapiens
tgtctgcgtggttcctttctc

SEQ ID NO: 2560415 - DNA, 13 bp, Homo sapiens
tgtctgtacacgt

SEQ ID NO: 2560416 - DNA, 16 bp, Homo sapiens
tgtctgtagagggccc

SEQ ID NO: 2560417 - DNA, 19 bp, Homo sapiens
tgtctgtagagggccctgg

SEQ ID NO: 2560418 - DNA, 20 bp, Homo sapiens
tgtctgtagagggccctggt

SEQ ID NO: 2560419 - DNA, 19 bp, Homo sapiens
tgtctgtctctccatctgt

SEQ ID NO: 2560420 - DNA, 12 bp, Homo sapiens
tgtctgtgtgca

SEQ ID NO: 2560421 - DNA, 21 bp, Homo sapiens
tgtctgttctacatagatgct

SEQ ID NO: 2560422 - DNA, 15 bp, Homo sapiens
tgtcttaattattat

SEQ ID NO: 2560423 - DNA, 15 bp, Homo sapiens
tgtcttcatagcaga

SEQ ID NO: 2560424 - DNA, 21 bp, Homo sapiens
tgtcttcatttcattgtatga

SEQ ID NO: 2560425 - DNA, 14 bp, Homo sapiens
tgtcttccataatg

SEQ ID NO: 2560426 - DNA, 22 bp, Homo sapiens
tgtcttcccagggtagcccgcc

SEQ ID NO: 2560427 - DNA, 18 bp, Homo sapiens
tgtcttcctgcattcacc

SEQ ID NO: 2560428 - DNA, 16 bp, Homo sapiens
tgtcttcggaaacctt

SEQ ID NO: 2560429 - DNA, 16 bp, Homo sapiens
tgtcttctcaggctct

SEQ ID NO: 2560430 - DNA, 23 bp, Homo sapiens
tgtcttctcaggctctgccctgc

SEQ ID NO: 2560431 - DNA, 22 bp, Homo sapiens
tgtcttgatgcatgcactgttc

SEQ ID NO: 2560432 - DNA, 15 bp, Homo sapiens
tgtcttgcaatggca

SEQ ID NO: 2560433 - DNA, 17 bp, Homo sapiens
tgtcttgcaatggcagc

SEQ ID NO: 2560434 - DNA, 19 bp, Homo sapiens
tgtcttggacactgtacaa

SEQ ID NO: 2560435 - DNA, 13 bp, Homo sapiens
tgtcttgtacatg

SEQ ID NO: 2560436 - DNA, 16 bp, Homo sapiens
tgtcttgtacatgtgt

SEQ ID NO: 2560437 - DNA, 17 bp, Homo sapiens
tgtcttgtacatgtgta

SEQ ID NO: 2560438 - DNA, 18 bp, Homo sapiens
tgtcttgtgtttctttag

SEQ ID NO: 2560439 - DNA, 15 bp, Homo sapiens
tgtctttcagataca

SEQ ID NO: 2560440 - DNA, 20 bp, Homo sapiens
tgtctttcagatacatggtt

SEQ ID NO: 2560441 - DNA, 15 bp, Homo sapiens
tgtctttctgagcac

SEQ ID NO: 2560442 - DNA, 23 bp, Homo sapiens
tgtcttttcttgcatgaggctag

SEQ ID NO: 2560443 - DNA, 14 bp, Homo sapiens
tgtcttttgaatat

SEQ ID NO: 2560444 - DNA, 17 bp, Homo sapiens
tgtctttttctggactg

SEQ ID NO: 2560445 - DNA, 20 bp, Homo sapiens
tgtctttttctggactgaag

SEQ ID NO: 2560446 - DNA, 21 bp, Homo sapiens
tgtcttttttttaatgtgctg

SEQ ID NO: 2560447 - DNA, 17 bp, Homo sapiens
tgtgaaaagaaaaatga

SEQ ID NO: 2560448 - DNA, 21 bp, Homo sapiens
tgtgaaaagaaaaatgagcct

SEQ ID NO: 2560449 - DNA, 23 bp, Homo sapiens
tgtgaaaagaaaaatgagcctgg

SEQ ID NO: 2560450 - DNA, 20 bp, Homo sapiens
tgtgaaaccttttttaagat

SEQ ID NO: 2560451 - DNA, 22 bp, Homo sapiens
tgtgaaaccttttttaagattt

SEQ ID NO: 2560452 - DNA, 19 bp, Homo sapiens
tgtgaaactggcactgaat

SEQ ID NO: 2560453 - DNA, 14 bp, Homo sapiens
tgtgaaaggaaaga

SEQ ID NO: 2560454 - DNA, 14 bp, Homo sapiens
tgtgaaatgaaaac

SEQ ID NO: 2560455 - DNA, 12 bp, Homo sapiens
tgtgaacattta

SEQ ID NO: 2560456 - DNA, 19 bp, Homo sapiens
tgtgaaccaccacacccag

SEQ ID NO: 2560457 - DNA, 21 bp, Homo sapiens
tgtgaaccaccacacccagcc

SEQ ID NO: 2560458 - DNA, 21 bp, Homo sapiens
tgtgaacgatttagaaagaag

SEQ ID NO: 2560459 - DNA, 18 bp, Homo sapiens
tgtgaactcagccaagca

SEQ ID NO: 2560460 - DNA, 20 bp, Homo sapiens
tgtgaactcagccaagcaca

SEQ ID NO: 2560461 - DNA, 14 bp, Homo sapiens
tgtgaagagaacca

SEQ ID NO: 2560462 - DNA, 18 bp, Homo sapiens
tgtgaagagggagaagca

SEQ ID NO: 2560463 - DNA, 18 bp, Homo sapiens
tgtgaagtgttaatacta

SEQ ID NO: 2560464 - DNA, 22 bp, Homo sapiens
tgtgaattgcctgcagagagaa

SEQ ID NO: 2560465 - DNA, 22 bp, Homo sapiens
tgtgacacatatgcaccttgtg

SEQ ID NO: 2560466 - DNA, 15 bp, Homo sapiens
tgtgacaggcagcag

SEQ ID NO: 2560467 - DNA, 16 bp, Homo sapiens
tgtgacaggcagcaga

SEQ ID NO: 2560468 - DNA, 18 bp, Homo sapiens
tgtgacatattatgtctt

SEQ ID NO: 2560469 - DNA, 16 bp, Homo sapiens
tgtgaccaatgtcttg

SEQ ID NO: 2560470 - DNA, 21 bp, Homo sapiens
tgtgacccagatcctcacaac

SEQ ID NO: 2560471 - DNA, 15 bp, Homo sapiens
tgtgacctgaagttc

SEQ ID NO: 2560472 - DNA, 14 bp, Homo sapiens
tgtgacctgagggc

SEQ ID NO: 2560473 - DNA, 18 bp, Homo sapiens
tgtgaccttagtgtttct

SEQ ID NO: 2560474 - DNA, 16 bp, Homo sapiens
tgtgactgaatttctt

SEQ ID NO: 2560475 - DNA, 13 bp, Homo sapiens
tgtgagaccccca

SEQ ID NO: 2560476 - DNA, 19 bp, Homo sapiens
tgtgagacccccacacctc

SEQ ID NO: 2560477 - DNA, 13 bp, Homo sapiens
tgtgagagaaagt

SEQ ID NO: 2560478 - DNA, 14 bp, Homo sapiens
tgtgagatgtaatt

SEQ ID NO: 2560479 - DNA, 17 bp, Homo sapiens
tgtgagcccctggtcct

SEQ ID NO: 2560480 - DNA, 21 bp, Homo sapiens
tgtgagcccctggtcctgagg

SEQ ID NO: 2560481 - DNA, 22 bp, Homo sapiens
tgtgagcccctggtcctgaggg

SEQ ID NO: 2560482 - DNA, 11 bp, Homo sapiens
tgtgaggaagc

SEQ ID NO: 2560483 - DNA, 13 bp, Homo sapiens
tgtgaggaagccg

SEQ ID NO: 2560484 - DNA, 22 bp, Homo sapiens
tgtgaggcccctggacaagcag

SEQ ID NO: 2560485 - DNA, 18 bp, Homo sapiens
tgtgagtactacagtcct

SEQ ID NO: 2560486 - DNA, 20 bp, Homo sapiens
tgtgagtactacagtcctcc

SEQ ID NO: 2560487 - DNA, 23 bp, Homo sapiens
tgtgagtactacagtcctcccat

SEQ ID NO: 2560488 - DNA, 20 bp, Homo sapiens
tgtgagtgtgtccaagtgtg

SEQ ID NO: 2560489 - DNA, 14 bp, Homo sapiens
tgtgagtgtgtgca

SEQ ID NO: 2560490 - DNA, 21 bp, Homo sapiens
tgtgagtttagtaaggctgtg

SEQ ID NO: 2560491 - DNA, 18 bp, Homo sapiens
tgtgatcccaagtgccag

SEQ ID NO: 2560492 - DNA, 17 bp, Homo sapiens
tgtgatccttttatgtt

SEQ ID NO: 2560493 - DNA, 13 bp, Homo sapiens
tgtgatcgtctga

SEQ ID NO: 2560494 - DNA, 15 bp, Homo sapiens
tgtgatgaactttct

SEQ ID NO: 2560495 - DNA, 16 bp, Homo sapiens
tgtgatgaggcagagg

SEQ ID NO: 2560496 - DNA, 16 bp, Homo sapiens
tgtgatggggccctgc

SEQ ID NO: 2560497 - DNA, 18 bp, Homo sapiens
tgtgatggggccctgcct

SEQ ID NO: 2560498 - DNA, 11 bp, Homo sapiens
tgtgatgtgtc

SEQ ID NO: 2560499 - DNA, 17 bp, Homo sapiens
tgtgattatttcacttt

SEQ ID NO: 2560500 - DNA, 18 bp, Homo sapiens
tgtgattatttcacttta

SEQ ID NO: 2560501 - DNA, 20 bp, Homo sapiens
tgtgattcaatctgtaaact

SEQ ID NO: 2560502 - DNA, 16 bp, Homo sapiens
tgtgattctaatgtct

SEQ ID NO: 2560503 - DNA, 17 bp, Homo sapiens
tgtgattctaatgtctt

SEQ ID NO: 2560504 - DNA, 17 bp, Homo sapiens
tgtgattgggaataaat

SEQ ID NO: 2560505 - DNA, 20 bp, Homo sapiens
tgtgattgggaataaatatg

SEQ ID NO: 2560506 - DNA, 22 bp, Homo sapiens
tgtgatttaatagtgttaatca

SEQ ID NO: 2560507 - DNA, 20 bp, Homo sapiens
tgtgcaagtgtctgtgtgca

SEQ ID NO: 2560508 - DNA, 22 bp, Homo sapiens
tgtgcacacacaccacacatac

SEQ ID NO: 2560509 - DNA, 17 bp, Homo sapiens
tgtgcacatctgtgtct

SEQ ID NO: 2560510 - DNA, 13 bp, Homo sapiens
tgtgcaccagggt

SEQ ID NO: 2560511 - DNA, 14 bp, Homo sapiens
tgtgcaccagggtt

SEQ ID NO: 2560512 - DNA, 14 bp, Homo sapiens
tgtgcacccatggg

SEQ ID NO: 2560513 - DNA, 22 bp, Homo sapiens
tgtgcagactcaataaaatcat

SEQ ID NO: 2560514 - DNA, 19 bp, Homo sapiens
tgtgcagccgctgagcgag

SEQ ID NO: 2560515 - DNA, 16 bp, Homo sapiens
tgtgcaggtggggaga

SEQ ID NO: 2560516 - DNA, 20 bp, Homo sapiens
tgtgcagtgaaggttgctga

SEQ ID NO: 2560517 - DNA, 17 bp, Homo sapiens
tgtgcatattgtacact

SEQ ID NO: 2560518 - DNA, 19 bp, Homo sapiens
tgtgcattatctagatact

SEQ ID NO: 2560519 - DNA, 21 bp, Homo sapiens
tgtgcatttttgtgaaatgaa

SEQ ID NO: 2560520 - DNA, 22 bp, Homo sapiens
tgtgcatttttgtgaaatgaaa

SEQ ID NO: 2560521 - DNA, 17 bp, Homo sapiens
tgtgccaatatgtattg

SEQ ID NO: 2560522 - DNA, 20 bp, Homo sapiens
tgtgccatagagtttaacac

SEQ ID NO: 2560523 - DNA, 16 bp, Homo sapiens
tgtgccatgtgccagg

SEQ ID NO: 2560524 - DNA, 22 bp, Homo sapiens
tgtgccattttaaaaaaaaagg

SEQ ID NO: 2560525 - DNA, 15 bp, Homo sapiens
tgtgccccatgcctg

SEQ ID NO: 2560526 - DNA, 20 bp, Homo sapiens
tgtgccctaaagtgtatttt

SEQ ID NO: 2560527 - DNA, 11 bp, Homo sapiens
tgtgccctggt

SEQ ID NO: 2560528 - DNA, 14 bp, Homo sapiens
tgtgcctcctcacc

SEQ ID NO: 2560529 - DNA, 16 bp, Homo sapiens
tgtgcctcctcacccc

SEQ ID NO: 2560530 - DNA, 12 bp, Homo sapiens
tgtgcctctgcc

SEQ ID NO: 2560531 - DNA, 13 bp, Homo sapiens
tgtgcctctgcct

SEQ ID NO: 2560532 - DNA, 13 bp, Homo sapiens
tgtgcctggctca

SEQ ID NO: 2560533 - DNA, 17 bp, Homo sapiens
tgtgccttggtgtgctg

SEQ ID NO: 2560534 - DNA, 15 bp, Homo sapiens
tgtgccttttatagc

SEQ ID NO: 2560535 - DNA, 16 bp, Homo sapiens
tgtgcgtgaaacacac

SEQ ID NO: 2560536 - DNA, 22 bp, Homo sapiens
tgtgcgtgaaacacaccaggct

SEQ ID NO: 2560537 - DNA, 13 bp, Homo sapiens
tgtgctagatgtg

SEQ ID NO: 2560538 - DNA, 13 bp, Homo sapiens
tgtgctatactgc

SEQ ID NO: 2560539 - DNA, 18 bp, Homo sapiens
tgtgctatactgcatact

SEQ ID NO: 2560540 - DNA, 21 bp, Homo sapiens
tgtgctatactgcatactttt

SEQ ID NO: 2560541 - DNA, 17 bp, Homo sapiens
tgtgctcccctttgcct

SEQ ID NO: 2560542 - DNA, 16 bp, Homo sapiens
tgtgctcctccttggt

SEQ ID NO: 2560543 - DNA, 23 bp, Homo sapiens
tgtgctctgatcatccactgtgc

SEQ ID NO: 2560544 - DNA, 19 bp, Homo sapiens
tgtgctgagtctgaaggct

SEQ ID NO: 2560545 - DNA, 14 bp, Homo sapiens
tgtgctgccctgcc

SEQ ID NO: 2560546 - DNA, 15 bp, Homo sapiens
tgtgctgccctgccc

SEQ ID NO: 2560547 - DNA, 18 bp, Homo sapiens
tgtgctgccctgcccacc

SEQ ID NO: 2560548 - DNA, 21 bp, Homo sapiens
tgtgctgccctgcccacctgg

SEQ ID NO: 2560549 - DNA, 14 bp, Homo sapiens
tgtgctggagccac

SEQ ID NO: 2560550 - DNA, 19 bp, Homo sapiens
tgtgctggagccactaact

SEQ ID NO: 2560551 - DNA, 19 bp, Homo sapiens
tgtgctggtgtcctgacca

SEQ ID NO: 2560552 - DNA, 17 bp, Homo sapiens
tgtgctgtgcccaagtt

SEQ ID NO: 2560553 - DNA, 13 bp, Homo sapiens
tgtgcttatgttt

SEQ ID NO: 2560554 - DNA, 14 bp, Homo sapiens
tgtgctttagcttg

SEQ ID NO: 2560555 - DNA, 16 bp, Homo sapiens
tgtgctttccagctca

SEQ ID NO: 2560556 - DNA, 20 bp, Homo sapiens
tgtgctttgactcacctgtt

SEQ ID NO: 2560557 - DNA, 14 bp, Homo sapiens
tgtgcttttcctat

SEQ ID NO: 2560558 - DNA, 16 bp, Homo sapiens
tgtggaaaaatgagag

SEQ ID NO: 2560559 - DNA, 15 bp, Homo sapiens
tgtggaaaagaaaca

SEQ ID NO: 2560560 - DNA, 20 bp, Homo sapiens
tgtggaaaagaaacacgcac

SEQ ID NO: 2560561 - DNA, 16 bp, Homo sapiens
tgtggaaagtgaattt

SEQ ID NO: 2560562 - DNA, 23 bp, Homo sapiens
tgtggaaagtgaatttgaatgaa

SEQ ID NO: 2560563 - DNA, 15 bp, Homo sapiens
tgtggaaagtgtaaa

SEQ ID NO: 2560564 - DNA, 16 bp, Homo sapiens
tgtggaaagtgtaaag

SEQ ID NO: 2560565 - DNA, 17 bp, Homo sapiens
tgtggaaagtgtaaagc

SEQ ID NO: 2560566 - DNA, 17 bp, Homo sapiens
tgtggaatctggagtga

SEQ ID NO: 2560567 - DNA, 18 bp, Homo sapiens
tgtggaatctggagtgag

SEQ ID NO: 2560568 - DNA, 13 bp, Homo sapiens
tgtggacacagct

SEQ ID NO: 2560569 - DNA, 14 bp, Homo sapiens
tgtggacacagctc

SEQ ID NO: 2560570 - DNA, 14 bp, Homo sapiens
tgtggactgtgatg

SEQ ID NO: 2560571 - DNA, 15 bp, Homo sapiens
tgtggactgtgatgc

SEQ ID NO: 2560572 - DNA, 13 bp, Homo sapiens
tgtggagaaagga

SEQ ID NO: 2560573 - DNA, 16 bp, Homo sapiens
tgtggagcccgcaccc

SEQ ID NO: 2560574 - DNA, 12 bp, Homo sapiens
tgtggaggaagg

SEQ ID NO: 2560575 - DNA, 16 bp, Homo sapiens
tgtggaggaaggattg

SEQ ID NO: 2560576 - DNA, 20 bp, Homo sapiens
tgtggaggaaggattgtaaa

SEQ ID NO: 2560577 - DNA, 16 bp, Homo sapiens
tgtggagtggggcagt

SEQ ID NO: 2560578 - DNA, 18 bp, Homo sapiens
tgtggagtggggcagtag

SEQ ID NO: 2560579 - DNA, 20 bp, Homo sapiens
tgtggatcaaccatcgcttt

SEQ ID NO: 2560580 - DNA, 14 bp, Homo sapiens
tgtggatgataaaa

SEQ ID NO: 2560581 - DNA, 22 bp, Homo sapiens
tgtggatttaacagaaatgtac

SEQ ID NO: 2560582 - DNA, 19 bp, Homo sapiens
tgtggcaatagtgggccct

SEQ ID NO: 2560583 - DNA, 14 bp, Homo sapiens
tgtggcaggcagcg

SEQ ID NO: 2560584 - DNA, 18 bp, Homo sapiens
tgtggccaagttcttagt

SEQ ID NO: 2560585 - DNA, 20 bp, Homo sapiens
tgtggccagggtgagagctg

SEQ ID NO: 2560586 - DNA, 18 bp, Homo sapiens
tgtggccgttatctggaa

SEQ ID NO: 2560587 - DNA, 13 bp, Homo sapiens
tgtggcctgtggc

SEQ ID NO: 2560588 - DNA, 20 bp, Homo sapiens
tgtggccttccatttatatg

SEQ ID NO: 2560589 - DNA, 22 bp, Homo sapiens
tgtggctcacgtgagagtgtct

SEQ ID NO: 2560590 - DNA, 15 bp, Homo sapiens
tgtggctcccctcta

SEQ ID NO: 2560591 - DNA, 17 bp, Homo sapiens
tgtggctcctatctgtg

SEQ ID NO: 2560592 - DNA, 18 bp, Homo sapiens
tgtggctcctatctgtgt

SEQ ID NO: 2560593 - DNA, 20 bp, Homo sapiens
tgtggctcctatctgtgttt

SEQ ID NO: 2560594 - DNA, 17 bp, Homo sapiens
tgtggctttcagcctct

SEQ ID NO: 2560595 - DNA, 23 bp, Homo sapiens
tgtgggaacgagaggggaagagt

SEQ ID NO: 2560596 - DNA, 21 bp, Homo sapiens
tgtgggagggagcagacagga

SEQ ID NO: 2560597 - DNA, 13 bp, Homo sapiens
tgtgggctgtgag

SEQ ID NO: 2560598 - DNA, 20 bp, Homo sapiens
tgtggggatctcaggggctg

SEQ ID NO: 2560599 - DNA, 16 bp, Homo sapiens
tgtggggatttctccc

SEQ ID NO: 2560600 - DNA, 12 bp, Homo sapiens
tgtggggccttg

SEQ ID NO: 2560601 - DNA, 20 bp, Homo sapiens
tgtggggctggtagctcagg

SEQ ID NO: 2560602 - DNA, 16 bp, Homo sapiens
tgtggtacaatctcaa

SEQ ID NO: 2560603 - DNA, 18 bp, Homo sapiens
tgtggtagggggtgtctc

SEQ ID NO: 2560604 - DNA, 20 bp, Homo sapiens
tgtggtcacaggaagtagag

SEQ ID NO: 2560605 - DNA, 16 bp, Homo sapiens
tgtggtgctgacaaag

SEQ ID NO: 2560606 - DNA, 23 bp, Homo sapiens
tgtggtgtgtccccctctgtcca

SEQ ID NO: 2560607 - DNA, 20 bp, Homo sapiens
tgtggtgtttcctggcactg

SEQ ID NO: 2560608 - DNA, 12 bp, Homo sapiens
tgtggtttcatt

SEQ ID NO: 2560609 - DNA, 16 bp, Homo sapiens
tgtggttttcccctcc

SEQ ID NO: 2560610 - DNA, 21 bp, Homo sapiens
tgtgtaaagtgtaaatccttt

SEQ ID NO: 2560611 - DNA, 21 bp, Homo sapiens
tgtgtaatagaaaactgaaaa

SEQ ID NO: 2560612 - DNA, 15 bp, Homo sapiens
tgtgtaatcaataaa

SEQ ID NO: 2560613 - DNA, 19 bp, Homo sapiens
tgtgtaatcaataaacgat

SEQ ID NO: 2560614 - DNA, 11 bp, Homo sapiens
tgtgtaattta

SEQ ID NO: 2560615 - DNA, 19 bp, Homo sapiens
tgtgtaatttaaaattgtg

SEQ ID NO: 2560616 - DNA, 23 bp, Homo sapiens
tgtgtaatttaaaattgtgatgt

SEQ ID NO: 2560617 - DNA, 19 bp, Homo sapiens
tgtgtacaaagaaataaca

SEQ ID NO: 2560618 - DNA, 15 bp, Homo sapiens
tgtgtacataactga

SEQ ID NO: 2560619 - DNA, 17 bp, Homo sapiens
tgtgtacataactgaaa

SEQ ID NO: 2560620 - DNA, 19 bp, Homo sapiens
tgtgtacatggcagagttt

SEQ ID NO: 2560621 - DNA, 16 bp, Homo sapiens
tgtgtagagttaagaa

SEQ ID NO: 2560622 - DNA, 19 bp, Homo sapiens
tgtgtagagttaagaagct

SEQ ID NO: 2560623 - DNA, 14 bp, Homo sapiens
tgtgtagcctgtgc

SEQ ID NO: 2560624 - DNA, 12 bp, Homo sapiens
tgtgtagggcgg

SEQ ID NO: 2560625 - DNA, 21 bp, Homo sapiens
tgtgtatccattatcatgtgt

SEQ ID NO: 2560626 - DNA, 24 bp, Homo sapiens
tgtgtatccattatcatgtgtaat

SEQ ID NO: 2560627 - DNA, 11 bp, Homo sapiens
tgtgtatgtgg

SEQ ID NO: 2560628 - DNA, 13 bp, Homo sapiens
tgtgtatgtgggg

SEQ ID NO: 2560629 - DNA, 19 bp, Homo sapiens
tgtgtattcattgaagtca

SEQ ID NO: 2560630 - DNA, 13 bp, Homo sapiens
tgtgtattgttcc

SEQ ID NO: 2560631 - DNA, 19 bp, Homo sapiens
tgtgtccaagtgtgtgtgc

SEQ ID NO: 2560632 - DNA, 17 bp, Homo sapiens
tgtgtccatgtgtgtgc

SEQ ID NO: 2560633 - DNA, 16 bp, Homo sapiens
tgtgtccttccctgca

SEQ ID NO: 2560634 - DNA, 16 bp, Homo sapiens
tgtgtccttgtgcatg

SEQ ID NO: 2560635 - DNA, 21 bp, Homo sapiens
tgtgtctacagagaacctgga

SEQ ID NO: 2560636 - DNA, 20 bp, Homo sapiens
tgtgtctaggcaggacctgt

SEQ ID NO: 2560637 - DNA, 13 bp, Homo sapiens
tgtgtctgtacac

SEQ ID NO: 2560638 - DNA, 16 bp, Homo sapiens
tgtgtcttaattatta

SEQ ID NO: 2560639 - DNA, 22 bp, Homo sapiens
tgtgtgaaaggaagctccactg

SEQ ID NO: 2560640 - DNA, 16 bp, Homo sapiens
tgtgtgatgaactttc

SEQ ID NO: 2560641 - DNA, 14 bp, Homo sapiens
tgtgtgatgtgcat

SEQ ID NO: 2560642 - DNA, 17 bp, Homo sapiens
tgtgtgcaccttaccaa

SEQ ID NO: 2560643 - DNA, 22 bp, Homo sapiens
tgtgtgcaccttaccaactttc

SEQ ID NO: 2560644 - DNA, 19 bp, Homo sapiens
tgtgtgcacgtacacacac

SEQ ID NO: 2560645 - DNA, 21 bp, Homo sapiens
tgtgtgccatagagtttaaca

SEQ ID NO: 2560646 - DNA, 14 bp, Homo sapiens
tgtgtgtatacatg

SEQ ID NO: 2560647 - DNA, 14 bp, Homo sapiens
tgtgtgtgtatgct

SEQ ID NO: 2560648 - DNA, 14 bp, Homo sapiens
tgtgtgtgtatgtt

SEQ ID NO: 2560649 - DNA, 11 bp, Homo sapiens
tgtgtgtgtgc

SEQ ID NO: 2560650 - DNA, 22 bp, Homo sapiens
tgtgtgttgatcccaagacaat

SEQ ID NO: 2560651 - DNA, 15 bp, Homo sapiens
tgtgtgtttaaataa

SEQ ID NO: 2560652 - DNA, 13 bp, Homo sapiens
tgtgtgtttcact

SEQ ID NO: 2560653 - DNA, 22 bp, Homo sapiens
tgtgttatcacccagaagaaaa

SEQ ID NO: 2560654 - DNA, 19 bp, Homo sapiens
tgtgttccaactgccccca

SEQ ID NO: 2560655 - DNA, 16 bp, Homo sapiens
tgtgttcccatttcag

SEQ ID NO: 2560656 - DNA, 15 bp, Homo sapiens
tgtgttcctggcaat

SEQ ID NO: 2560657 - DNA, 16 bp, Homo sapiens
tgtgttcctggcaata

SEQ ID NO: 2560658 - DNA, 15 bp, Homo sapiens
tgtgttgctatcctg

SEQ ID NO: 2560659 - DNA, 22 bp, Homo sapiens
tgtgttgggattgagtctgtgc

SEQ ID NO: 2560660 - DNA, 13 bp, Homo sapiens
tgtgtttaaataa

SEQ ID NO: 2560661 - DNA, 22 bp, Homo sapiens
tgtgtttaaataaagtatcatg

SEQ ID NO: 2560662 - DNA, 11 bp, Homo sapiens
tgtgtttgtgt

SEQ ID NO: 2560663 - DNA, 13 bp, Homo sapiens
tgtgtttgtgtga

SEQ ID NO: 2560664 - DNA, 10 bp, Homo sapiens
tgtgtttgtt

SEQ ID NO: 2560665 - DNA, 13 bp, Homo sapiens
tgtgttttctgaa

SEQ ID NO: 2560666 - DNA, 21 bp, Homo sapiens
tgtgtttttgctatcacacag

SEQ ID NO: 2560667 - DNA, 21 bp, Homo sapiens
tgttaaaagatgaaaatattt

SEQ ID NO: 2560668 - DNA, 23 bp, Homo sapiens
tgttaaaatgtattcttaaattc

SEQ ID NO: 2560669 - DNA, 22 bp, Homo sapiens
tgttaaatatcagtagaaactc

SEQ ID NO: 2560670 - DNA, 18 bp, Homo sapiens
tgttaaatgaaattgtaa

SEQ ID NO: 2560671 - DNA, 15 bp, Homo sapiens
tgttaaatttgtaag

SEQ ID NO: 2560672 - DNA, 16 bp, Homo sapiens
tgttaaatttgtaagt

SEQ ID NO: 2560673 - DNA, 17 bp, Homo sapiens
tgttaaatttgtaagtt

SEQ ID NO: 2560674 - DNA, 18 bp, Homo sapiens
tgttaacacattttgtat

SEQ ID NO: 2560675 - DNA, 20 bp, Homo sapiens
tgttaacacattttgtataa

SEQ ID NO: 2560676 - DNA, 22 bp, Homo sapiens
tgttaacacattttgtataatt

SEQ ID NO: 2560677 - DNA, 21 bp, Homo sapiens
tgttaacatggacatgatctt

SEQ ID NO: 2560678 - DNA, 17 bp, Homo sapiens
tgttaacctcagtgtca

SEQ ID NO: 2560679 - DNA, 19 bp, Homo sapiens
tgttaactcttgtctattt

SEQ ID NO: 2560680 - DNA, 20 bp, Homo sapiens
tgttaagcgtgtctgtattt

SEQ ID NO: 2560681 - DNA, 16 bp, Homo sapiens
tgttaaggaaactctt

SEQ ID NO: 2560682 - DNA, 21 bp, Homo sapiens
tgttaaggaaactcttatctc

SEQ ID NO: 2560683 - DNA, 12 bp, Homo sapiens
tgttaatcaatt

SEQ ID NO: 2560684 - DNA, 17 bp, Homo sapiens
tgttaatgaaaatgtca

SEQ ID NO: 2560685 - DNA, 19 bp, Homo sapiens
tgttaatgatagctactgt

SEQ ID NO: 2560686 - DNA, 20 bp, Homo sapiens
tgttaatggtgcaaatccta

SEQ ID NO: 2560687 - DNA, 12 bp, Homo sapiens
tgttaattatac

SEQ ID NO: 2560688 - DNA, 20 bp, Homo sapiens
tgttaattcagcactgattt

SEQ ID NO: 2560689 - DNA, 21 bp, Homo sapiens
tgttacaggcaccgagaatgt

SEQ ID NO: 2560690 - DNA, 19 bp, Homo sapiens
tgttacataagataaatgt

SEQ ID NO: 2560691 - DNA, 18 bp, Homo sapiens
tgttaccatgtcactgtg

SEQ ID NO: 2560692 - DNA, 15 bp, Homo sapiens
tgttactgaccagca

SEQ ID NO: 2560693 - DNA, 20 bp, Homo sapiens
tgttactgatcatgcattgt

SEQ ID NO: 2560694 - DNA, 18 bp, Homo sapiens
tgttacttacctaaacag

SEQ ID NO: 2560695 - DNA, 18 bp, Homo sapiens
tgttagactcttactttt

SEQ ID NO: 2560696 - DNA, 20 bp, Homo sapiens
tgttagaggttttaaagtga

SEQ ID NO: 2560697 - DNA, 21 bp, Homo sapiens
tgttagatagaatttccaata

SEQ ID NO: 2560698 - DNA, 14 bp, Homo sapiens
ttactggtccaaaa

SEQ ID NO: 2560699 - DNA, 12 bp, Homo sapiens
ttactgtacatg

SEQ ID NO: 2560700 - DNA, 22 bp, Homo sapiens
ttactgtacatgaaaacacatt

SEQ ID NO: 2560701 - DNA, 23 bp, Homo sapiens
ttactgtggaggaaggattgtaa

SEQ ID NO: 2560702 - DNA, 16 bp, Homo sapiens
ttactgtggcttctta

SEQ ID NO: 2560703 - DNA, 22 bp, Homo sapiens
ttactgtttgtcttctccccag

SEQ ID NO: 2560704 - DNA, 20 bp, Homo sapiens
ttacttaaagatttatcaaa

SEQ ID NO: 2560705 - DNA, 17 bp, Homo sapiens
ttacttatcatccacat

SEQ ID NO: 2560706 - DNA, 23 bp, Homo sapiens
ttacttatcatccacattgtttt

SEQ ID NO: 2560707 - DNA, 15 bp, Homo sapiens
ttacttcctatcaag

SEQ ID NO: 2560708 - DNA, 14 bp, Homo sapiens
ttacttgacctcct

SEQ ID NO: 2560709 - DNA, 17 bp, Homo sapiens
ttactttaaaaggagcc

SEQ ID NO: 2560710 - DNA, 13 bp, Homo sapiens
ttactttgtgaat

SEQ ID NO: 2560711 - DNA, 16 bp, Homo sapiens
ttacttttaaactgtg

SEQ ID NO: 2560712 - DNA, 19 bp, Homo sapiens
ttacttttaaactgtgtac

SEQ ID NO: 2560713 - DNA, 15 bp, Homo sapiens
ttacttttaaatgtc

SEQ ID NO: 2560714 - DNA, 18 bp, Homo sapiens
ttagaaaccttaatatgt

SEQ ID NO: 2560715 - DNA, 21 bp, Homo sapiens
ttagaaagtagccacgtatgg

SEQ ID NO: 2560716 - DNA, 15 bp, Homo sapiens
ttagaaatagacagt

SEQ ID NO: 2560717 - DNA, 22 bp, Homo sapiens
ttagaacaggcaagtgaagaaa

SEQ ID NO: 2560718 - DNA, 15 bp, Homo sapiens
ttagaagaagtgtgt

SEQ ID NO: 2560719 - DNA, 21 bp, Homo sapiens
ttagaatcagccttgaaacat

SEQ ID NO: 2560720 - DNA, 13 bp, Homo sapiens
ttagaatgaaaat

SEQ ID NO: 2560721 - DNA, 18 bp, Homo sapiens
ttagacaaatactcatgt

SEQ ID NO: 2560722 - DNA, 19 bp, Homo sapiens
ttagacaaatactcatgtg

SEQ ID NO: 2560723 - DNA, 11 bp, Homo sapiens
ttagacagagt

SEQ ID NO: 2560724 - DNA, 20 bp, Homo sapiens
ttagacagagtctcactgtt

SEQ ID NO: 2560725 - DNA, 12 bp, Homo sapiens
ttagacctcagc

SEQ ID NO: 2560726 - DNA, 16 bp, Homo sapiens
ttagacctcagcctgt

SEQ ID NO: 2560727 - DNA, 18 bp, Homo sapiens
ttagactaaggccattat

SEQ ID NO: 2560728 - DNA, 23 bp, Homo sapiens
ttagactgtaggaagagtagcat

SEQ ID NO: 2560729 - DNA, 14 bp, Homo sapiens
ttagagcctccctc

SEQ ID NO: 2560730 - DNA, 17 bp, Homo sapiens
ttagaggaaaaaaatga

SEQ ID NO: 2560731 - DNA, 19 bp, Homo sapiens
ttagaggaaaaaaatgact

SEQ ID NO: 2560732 - DNA, 12 bp, Homo sapiens
ttagaggccagc

SEQ ID NO: 2560733 - DNA, 18 bp, Homo sapiens
ttagagggaggagaatga

SEQ ID NO: 2560734 - DNA, 18 bp, Homo sapiens
ttagagggaggtgtttaa

SEQ ID NO: 2560735 - DNA, 21 bp, Homo sapiens
ttagaggttttaaagtgatta

SEQ ID NO: 2560736 - DNA, 16 bp, Homo sapiens
ttagagtgtctttcca

SEQ ID NO: 2560737 - DNA, 17 bp, Homo sapiens
ttagagtgtctttccac

SEQ ID NO: 2560738 - DNA, 14 bp, Homo sapiens
ttagatataacact

SEQ ID NO: 2560739 - DNA, 13 bp, Homo sapiens
ttagatcaaatac

SEQ ID NO: 2560740 - DNA, 13 bp, Homo sapiens
ttagatgttctaa

SEQ ID NO: 2560741 - DNA, 20 bp, Homo sapiens
ttagatgttctaagtctttc

SEQ ID NO: 2560742 - DNA, 22 bp, Homo sapiens
ttagatgttctaagtctttcca

SEQ ID NO: 2560743 - DNA, 17 bp, Homo sapiens
ttagattagctctggac

SEQ ID NO: 2560744 - DNA, 20 bp, Homo sapiens
ttagcaaagagttaatatat

SEQ ID NO: 2560745 - DNA, 22 bp, Homo sapiens
ttagcatgacaagccccaggca

SEQ ID NO: 2560746 - DNA, 24 bp, Homo sapiens
ttagcatgacaagccccaggcagg

SEQ ID NO: 2560747 - DNA, 15 bp, Homo sapiens
ttagccaggatcatg

SEQ ID NO: 2560748 - DNA, 17 bp, Homo sapiens
ttagcccccacccactt

SEQ ID NO: 2560749 - DNA, 13 bp, Homo sapiens
ttagccgggcgtg

SEQ ID NO: 2560750 - DNA, 16 bp, Homo sapiens
ttagctgttatttcta

SEQ ID NO: 2560751 - DNA, 21 bp, Homo sapiens
ttagcttagacctcagcctgt

SEQ ID NO: 2560752 - DNA, 17 bp, Homo sapiens
ttagctttactgtttgt

SEQ ID NO: 2560753 - DNA, 17 bp, Homo sapiens
ttaggaaataaaacctt

SEQ ID NO: 2560754 - DNA, 19 bp, Homo sapiens
ttaggaaataaaacctttc

SEQ ID NO: 2560755 - DNA, 20 bp, Homo sapiens
ttaggaagtgtaacagctga

SEQ ID NO: 2560756 - DNA, 18 bp, Homo sapiens
ttaggatgttgaaaaagt

SEQ ID NO: 2560757 - DNA, 14 bp, Homo sapiens
ttaggatttaacag

SEQ ID NO: 2560758 - DNA, 21 bp, Homo sapiens
ttaggatttaacagtcattta

SEQ ID NO: 2560759 - DNA, 13 bp, Homo sapiens
ttaggcagcagct

SEQ ID NO: 2560760 - DNA, 14 bp, Homo sapiens
ttaggcagggaagt

SEQ ID NO: 2560761 - DNA, 14 bp, Homo sapiens
ttagggaaaacatt

SEQ ID NO: 2560762 - DNA, 14 bp, Homo sapiens
ttagggaagggcct

SEQ ID NO: 2560763 - DNA, 18 bp, Homo sapiens
ttagggagagtcatattt

SEQ ID NO: 2560764 - DNA, 13 bp, Homo sapiens
ttaggtcaagaag

SEQ ID NO: 2560765 - DNA, 14 bp, Homo sapiens
ttaggtctcttccc

SEQ ID NO: 2560766 - DNA, 14 bp, Homo sapiens
ttagtaaagaaatg

SEQ ID NO: 2560767 - DNA, 14 bp, Homo sapiens
ttagtaaggctgtg

SEQ ID NO: 2560768 - DNA, 20 bp, Homo sapiens
ttagtaaggctgtgtacact

SEQ ID NO: 2560769 - DNA, 20 bp, Homo sapiens
ttagtaatgctacgtgtgat

SEQ ID NO: 2560770 - DNA, 21 bp, Homo sapiens
ttagtaatgctacgtgtgatt

SEQ ID NO: 2560771 - DNA, 12 bp, Homo sapiens
ttagtagcatgt

SEQ ID NO: 2560772 - DNA, 18 bp, Homo sapiens
ttagtatctaacatgtat

SEQ ID NO: 2560773 - DNA, 13 bp, Homo sapiens
ttagtccttgctt

SEQ ID NO: 2560774 - DNA, 19 bp, Homo sapiens
ttagtctactcttaagcca

SEQ ID NO: 2560775 - DNA, 19 bp, Homo sapiens
ttagtgcggacaagtttta

SEQ ID NO: 2560776 - DNA, 12 bp, Homo sapiens
ttagtggctttt

SEQ ID NO: 2560777 - DNA, 12 bp, Homo sapiens
ttagtgtttctg

SEQ ID NO: 2560778 - DNA, 16 bp, Homo sapiens
ttagtgtttctgtgca

SEQ ID NO: 2560779 - DNA, 16 bp, Homo sapiens
ttagttctttggaaat

SEQ ID NO: 2560780 - DNA, 13 bp, Homo sapiens
ttagttgctgtat

SEQ ID NO: 2560781 - DNA, 21 bp, Homo sapiens
ttagtttctgttctgtggaaa

SEQ ID NO: 2560782 - DNA, 18 bp, Homo sapiens
ttagtttttgtaatttat

SEQ ID NO: 2560783 - DNA, 19 bp, Homo sapiens
ttagtttttgtaatttatt

SEQ ID NO: 2560784 - DNA, 23 bp, Homo sapiens
ttataaaagaataaaattgcact

SEQ ID NO: 2560785 - DNA, 15 bp, Homo sapiens
ttataaatatattta

SEQ ID NO: 2560786 - DNA, 12 bp, Homo sapiens
ttataaatatga

SEQ ID NO: 2560787 - DNA, 13 bp, Homo sapiens
ttataaattatgt

SEQ ID NO: 2560788 - DNA, 16 bp, Homo sapiens
ttataaattatgttta

SEQ ID NO: 2560789 - DNA, 17 bp, Homo sapiens
ttataaattatgtttat

SEQ ID NO: 2560790 - DNA, 18 bp, Homo sapiens
ttataactcatcataaaa

SEQ ID NO: 2560791 - DNA, 20 bp, Homo sapiens
ttataactcatcataaaata

SEQ ID NO: 2560792 - DNA, 21 bp, Homo sapiens
ttataactcatcataaaataa

SEQ ID NO: 2560793 - DNA, 15 bp, Homo sapiens
ttataacttaaaaaa

SEQ ID NO: 2560794 - DNA, 22 bp, Homo sapiens
ttataataaaaggaaaagcaaa

SEQ ID NO: 2560795 - DNA, 18 bp, Homo sapiens
ttataataatgttaacat

SEQ ID NO: 2560796 - DNA, 15 bp, Homo sapiens
ttataatgaatgaaa

SEQ ID NO: 2560797 - DNA, 12 bp, Homo sapiens
ttatacaacagt

SEQ ID NO: 2560798 - DNA, 11 bp, Homo sapiens
ttatacataaa

SEQ ID NO: 2560799 - DNA, 15 bp, Homo sapiens
ttatagaatatttat

SEQ ID NO: 2560800 - DNA, 15 bp, Homo sapiens
ttatagacaaataat

SEQ ID NO: 2560801 - DNA, 21 bp, Homo sapiens
ttatagatcccccagacttta

SEQ ID NO: 2560802 - DNA, 21 bp, Homo sapiens
ttatagatgggaatgaagctt

SEQ ID NO: 2560803 - DNA, 15 bp, Homo sapiens
ttatagtatatctgg

SEQ ID NO: 2560804 - DNA, 18 bp, Homo sapiens
ttatagtatatctggaca

SEQ ID NO: 2560805 - DNA, 15 bp, Homo sapiens
ttatagtttgtacat

SEQ ID NO: 2560806 - DNA, 18 bp, Homo sapiens
ttatatagtttactattt

SEQ ID NO: 2560807 - DNA, 22 bp, Homo sapiens
ttatatattggtaacatccttt

SEQ ID NO: 2560808 - DNA, 16 bp, Homo sapiens
ttatatcagcctgagt

SEQ ID NO: 2560809 - DNA, 21 bp, Homo sapiens
ttatatcatcagcataccttt

SEQ ID NO: 2560810 - DNA, 19 bp, Homo sapiens
ttatatgaagaaaatcact

SEQ ID NO: 2560811 - DNA, 19 bp, Homo sapiens
ttatatgcttactgatata

SEQ ID NO: 2560812 - DNA, 14 bp, Homo sapiens
ttatattgtaagaa

SEQ ID NO: 2560813 - DNA, 16 bp, Homo sapiens
ttatattgtaagaaat

SEQ ID NO: 2560814 - DNA, 22 bp, Homo sapiens
ttatattgtaagaaatactgta

SEQ ID NO: 2560815 - DNA, 24 bp, Homo sapiens
ttatattgtaagaaatactgtaca

SEQ ID NO: 2560816 - DNA, 19 bp, Homo sapiens
ttatatttagttatagttt

SEQ ID NO: 2560817 - DNA, 19 bp, Homo sapiens
ttatattttactactgtgg

SEQ ID NO: 2560818 - DNA, 15 bp, Homo sapiens
ttatatttttataga

SEQ ID NO: 2560819 - DNA, 16 bp, Homo sapiens
ttatcaaaaatttcat

SEQ ID NO: 2560820 - DNA, 14 bp, Homo sapiens
ttatcaacatttgt

SEQ ID NO: 2560821 - DNA, 11 bp, Homo sapiens
ttatcaagtgt

SEQ ID NO: 2560822 - DNA, 17 bp, Homo sapiens
ttatcacatgtatgttt

SEQ ID NO: 2560823 - DNA, 18 bp, Homo sapiens
ttatcacattatttgcat

SEQ ID NO: 2560824 - DNA, 21 bp, Homo sapiens
ttatcaccagctgcctcttct

SEQ ID NO: 2560825 - DNA, 19 bp, Homo sapiens
ttatcacccagaagaaaat

SEQ ID NO: 2560826 - DNA, 18 bp, Homo sapiens
ttatcaccgtgggctccc

SEQ ID NO: 2560827 - DNA, 20 bp, Homo sapiens
ttatcagtaagaaaaagaag

SEQ ID NO: 2560828 - DNA, 20 bp, Homo sapiens
ttatcatccacattgtttta

SEQ ID NO: 2560829 - DNA, 13 bp, Homo sapiens
ttatcatgctgtc

SEQ ID NO: 2560830 - DNA, 14 bp, Homo sapiens
ttatcatgtgtaat

SEQ ID NO: 2560831 - DNA, 12 bp, Homo sapiens
ttatcattttca

SEQ ID NO: 2560832 - DNA, 16 bp, Homo sapiens
ttatcattttcaaaat

SEQ ID NO: 2560833 - DNA, 17 bp, Homo sapiens
ttatctgtgaattcaga

SEQ ID NO: 2560834 - DNA, 19 bp, Homo sapiens
ttatctgtgcgtgaaacac

SEQ ID NO: 2560835 - DNA, 18 bp, Homo sapiens
ttatctgtgtttttgaaa

SEQ ID NO: 2560836 - DNA, 17 bp, Homo sapiens
ttatcttatgccacggg

SEQ ID NO: 2560837 - DNA, 16 bp, Homo sapiens
ttatcttggactgaca

SEQ ID NO: 2560838 - DNA, 17 bp, Homo sapiens
ttatcttggactgacat

SEQ ID NO: 2560839 - DNA, 16 bp, Homo sapiens
ttatcttgtctctggg

SEQ ID NO: 2560840 - DNA, 15 bp, Homo sapiens
ttatctttcgcacag

SEQ ID NO: 2560841 - DNA, 19 bp, Homo sapiens
ttatgaaattcaccccctt

SEQ ID NO: 2560842 - DNA, 14 bp, Homo sapiens
ttatgaatgaaaaa

SEQ ID NO: 2560843 - DNA, 23 bp, Homo sapiens
ttatgacatcacttgtacaaaat

SEQ ID NO: 2560844 - DNA, 19 bp, Homo sapiens
ttatgacttcattaataat

SEQ ID NO: 2560845 - DNA, 22 bp, Homo sapiens
ttatgacttcattaataataaa

SEQ ID NO: 2560846 - DNA, 19 bp, Homo sapiens
ttatgatttttttttcata

SEQ ID NO: 2560847 - DNA, 18 bp, Homo sapiens
ttatgcaaggaaggaaag

SEQ ID NO: 2560848 - DNA, 14 bp, Homo sapiens
ttatgcatagataa

SEQ ID NO: 2560849 - DNA, 16 bp, Homo sapiens
ttatgcatgaagtaat

SEQ ID NO: 2560850 - DNA, 14 bp, Homo sapiens
ttatgctcagggtc

SEQ ID NO: 2560851 - DNA, 13 bp, Homo sapiens
ttatggcctcagc

SEQ ID NO: 2560852 - DNA, 15 bp, Homo sapiens
ttatggcctcagctg

SEQ ID NO: 2560853 - DNA, 17 bp, Homo sapiens
ttatgggaatcaagatt

SEQ ID NO: 2560854 - DNA, 13 bp, Homo sapiens
ttatgggctgggt

SEQ ID NO: 2560855 - DNA, 20 bp, Homo sapiens
ttatggtgtttctccctctc

SEQ ID NO: 2560856 - DNA, 11 bp, Homo sapiens
ttatggttttg

SEQ ID NO: 2560857 - DNA, 17 bp, Homo sapiens
ttatggttttgtgatgt

SEQ ID NO: 2560858 - DNA, 18 bp, Homo sapiens
ttatgtaagagcaccttc

SEQ ID NO: 2560859 - DNA, 21 bp, Homo sapiens
ttatgtctgctgaataataaa

SEQ ID NO: 2560860 - DNA, 13 bp, Homo sapiens
ttatgtgagagaa

SEQ ID NO: 2560861 - DNA, 19 bp, Homo sapiens
ttatgtgtgaggagctgct

SEQ ID NO: 2560862 - DNA, 14 bp, Homo sapiens
ttatgtgtgtgtgt

SEQ ID NO: 2560863 - DNA, 17 bp, Homo sapiens
ttatgttaaatcaataa

SEQ ID NO: 2560864 - DNA, 12 bp, Homo sapiens
ttattaaaatct

SEQ ID NO: 2560865 - DNA, 18 bp, Homo sapiens
ttattaaacgtatgcatg

SEQ ID NO: 2560866 - DNA, 19 bp, Homo sapiens
ttattaaatgcccagcccc

SEQ ID NO: 2560867 - DNA, 17 bp, Homo sapiens
ttattaagatggattct

SEQ ID NO: 2560868 - DNA, 19 bp, Homo sapiens
ttattaagatggattctca

SEQ ID NO: 2560869 - DNA, 15 bp, Homo sapiens
ttattaataaacatt

SEQ ID NO: 2560870 - DNA, 17 bp, Homo sapiens
ttattaatgcactttct

SEQ ID NO: 2560871 - DNA, 13 bp, Homo sapiens
ttattacctctga

SEQ ID NO: 2560872 - DNA, 20 bp, Homo sapiens
ttattagtgtatgctttgaa

SEQ ID NO: 2560873 - DNA, 20 bp, Homo sapiens
ttattataattgtatcagag

SEQ ID NO: 2560874 - DNA, 12 bp, Homo sapiens
ttattatgcatg

SEQ ID NO: 2560875 - DNA, 16 bp, Homo sapiens
ttattcaagttattgt

SEQ ID NO: 2560876 - DNA, 18 bp, Homo sapiens
ttattcaattcctctggg

SEQ ID NO: 2560877 - DNA, 14 bp, Homo sapiens
ttattcagtgtcac

SEQ ID NO: 2560878 - DNA, 12 bp, Homo sapiens
ttattcatttaa

SEQ ID NO: 2560879 - DNA, 16 bp, Homo sapiens
ttattcatttaaaatg

SEQ ID NO: 2560880 - DNA, 14 bp, Homo sapiens
ttattcatttgagt

SEQ ID NO: 2560881 - DNA, 19 bp, Homo sapiens
ttattccacatctacgttt

SEQ ID NO: 2560882 - DNA, 19 bp, Homo sapiens
ttattccatattcatgtaa

SEQ ID NO: 2560883 - DNA, 15 bp, Homo sapiens
ttattcctgtatgtt

SEQ ID NO: 2560884 - DNA, 17 bp, Homo sapiens
ttattcctgtatgttgt

SEQ ID NO: 2560885 - DNA, 19 bp, Homo sapiens
ttattgagaattttaaatt

SEQ ID NO: 2560886 - DNA, 21 bp, Homo sapiens
ttattgcaaaatagcatttgt

SEQ ID NO: 2560887 - DNA, 19 bp, Homo sapiens
ttattgcagcgattaataa

SEQ ID NO: 2560888 - DNA, 14 bp, Homo sapiens
ttattgcagtttat

SEQ ID NO: 2560889 - DNA, 22 bp, Homo sapiens
ttattgcagtttatcattcaag

SEQ ID NO: 2560890 - DNA, 13 bp, Homo sapiens
ttattgcttttat

SEQ ID NO: 2560891 - DNA, 22 bp, Homo sapiens
ttattggctgagatatgaacat

SEQ ID NO: 2560892 - DNA, 12 bp, Homo sapiens
ttattgtacctc

SEQ ID NO: 2560893 - DNA, 22 bp, Homo sapiens
ttattgtataaactatcagttt

SEQ ID NO: 2560894 - DNA, 13 bp, Homo sapiens
ttattgttccaag

SEQ ID NO: 2560895 - DNA, 22 bp, Homo sapiens
ttattgttccaagacattgtca

SEQ ID NO: 2560896 - DNA, 23 bp, Homo sapiens
ttattgttccaagacattgtcaa

SEQ ID NO: 2560897 - DNA, 15 bp, Homo sapiens
ttatttaaaagattc

SEQ ID NO: 2560898 - DNA, 10 bp, Homo sapiens
ttatttaata

SEQ ID NO: 2560899 - DNA, 18 bp, Homo sapiens
ttatttaatgaaagactg

SEQ ID NO: 2560900 - DNA, 22 bp, Homo sapiens
ttatttaatgaaagactgtaca

SEQ ID NO: 2560901 - DNA, 21 bp, Homo sapiens
ttatttactgagcttctctgt

SEQ ID NO: 2560902 - DNA, 15 bp, Homo sapiens
ttatttactgctagt

SEQ ID NO: 2560903 - DNA, 18 bp, Homo sapiens
ttatttagactcatctta

SEQ ID NO: 2560904 - DNA, 18 bp, Homo sapiens
ttatttagggaactgctt

SEQ ID NO: 2560905 - DNA, 16 bp, Homo sapiens
ttatttagttccttga

SEQ ID NO: 2560906 - DNA, 17 bp, Homo sapiens
ttatttataatcacttt

SEQ ID NO: 2560907 - DNA, 18 bp, Homo sapiens
ttatttatcagtgacaga

SEQ ID NO: 2560908 - DNA, 20 bp, Homo sapiens
ttatttatgcctctgtattt

SEQ ID NO: 2560909 - DNA, 14 bp, Homo sapiens
ttatttatttaata

SEQ ID NO: 2560910 - DNA, 23 bp, Homo sapiens
ttatttcaaaatatacattcaaa

SEQ ID NO: 2560911 - DNA, 21 bp, Homo sapiens
ttatttcactttagatgctga

SEQ ID NO: 2560912 - DNA, 11 bp, Homo sapiens
ttatttcagaa

SEQ ID NO: 2560913 - DNA, 19 bp, Homo sapiens
ttatttccaaataaaatga

SEQ ID NO: 2560914 - DNA, 14 bp, Homo sapiens
ttatttctctgatt

SEQ ID NO: 2560915 - DNA, 21 bp, Homo sapiens
ttatttgtgtaatagaaaact

SEQ ID NO: 2560916 - DNA, 14 bp, Homo sapiens
ttattttaaacaaa

SEQ ID NO: 2560917 - DNA, 12 bp, Homo sapiens
ttattttaagac

SEQ ID NO: 2560918 - DNA, 12 bp, Homo sapiens
ttattttcagta

SEQ ID NO: 2560919 - DNA, 14 bp, Homo sapiens
ttattttcagtatt

SEQ ID NO: 2560920 - DNA, 13 bp, Homo sapiens
ttattttccaaaa

SEQ ID NO: 2560921 - DNA, 11 bp, Homo sapiens
ttattttgatg

SEQ ID NO: 2560922 - DNA, 13 bp, Homo sapiens
ttattttggtact

SEQ ID NO: 2560923 - DNA, 18 bp, Homo sapiens
ttatttttacattctgaa

SEQ ID NO: 2560924 - DNA, 16 bp, Homo sapiens
ttatttttcatattgt

SEQ ID NO: 2560925 - DNA, 14 bp, Homo sapiens
ttatttttctaaaa

SEQ ID NO: 2560926 - DNA, 16 bp, Homo sapiens
ttattttttaattatt

SEQ ID NO: 2560927 - DNA, 12 bp, Homo sapiens
ttattttttcag

SEQ ID NO: 2560928 - DNA, 15 bp, Homo sapiens
ttattttttcagacc

SEQ ID NO: 2560929 - DNA, 20 bp, Homo sapiens
ttattttttcagaccgaaaa

SEQ ID NO: 2560930 - DNA, 14 bp, Homo sapiens
ttcaaaaaaacact

SEQ ID NO: 2560931 - DNA, 17 bp, Homo sapiens
ttcaaaaaaacactagt

SEQ ID NO: 2560932 - DNA, 17 bp, Homo sapiens
ttcaaaaacacagtgtt

SEQ ID NO: 2560933 - DNA, 21 bp, Homo sapiens
ttcaaaaagtctacgctctcc

SEQ ID NO: 2560934 - DNA, 14 bp, Homo sapiens
ttcaaaaagtgttt

SEQ ID NO: 2560935 - DNA, 17 bp, Homo sapiens
ttcaaaaagtgtttatt

SEQ ID NO: 2560936 - DNA, 15 bp, Homo sapiens
ttcaaaaatataact

SEQ ID NO: 2560937 - DNA, 16 bp, Homo sapiens
ttcaaaagttgaaatt

SEQ ID NO: 2560938 - DNA, 16 bp, Homo sapiens
ttcaaaatggagggaa

SEQ ID NO: 2560939 - DNA, 14 bp, Homo sapiens
ttcaaaatgtctgt

SEQ ID NO: 2560940 - DNA, 14 bp, Homo sapiens
ttcaaacacaaatg

SEQ ID NO: 2560941 - DNA, 15 bp, Homo sapiens
ttcaaacacaaatgc

SEQ ID NO: 2560942 - DNA, 17 bp, Homo sapiens
ttcaaacacaaatgcag

SEQ ID NO: 2560943 - DNA, 19 bp, Homo sapiens
ttcaaagcaccaaaataag

SEQ ID NO: 2560944 - DNA, 21 bp, Homo sapiens
ttcaaagcaccaaaataagaa

SEQ ID NO: 2560945 - DNA, 22 bp, Homo sapiens
ttcaaagctttttccagaggct

SEQ ID NO: 2560946 - DNA, 18 bp, Homo sapiens
ttcaaatagggtctaact

SEQ ID NO: 2560947 - DNA, 18 bp, Homo sapiens
ttcaaatgctgtaacttt

SEQ ID NO: 2560948 - DNA, 23 bp, Homo sapiens
ttcaacagaccccctctagaaat

SEQ ID NO: 2560949 - DNA, 16 bp, Homo sapiens
ttcaacaggagaattt

SEQ ID NO: 2560950 - DNA, 14 bp, Homo sapiens
ttcaacatcaatgt

SEQ ID NO: 2560951 - DNA, 15 bp, Homo sapiens
ttcaacatcaatgtt

SEQ ID NO: 2560952 - DNA, 16 bp, Homo sapiens
ttcaacatcaatgttc

SEQ ID NO: 2560953 - DNA, 19 bp, Homo sapiens
ttcaacatcaatgttcatt

SEQ ID NO: 2560954 - DNA, 13 bp, Homo sapiens
ttcaaccctggag

SEQ ID NO: 2560955 - DNA, 12 bp, Homo sapiens
ttcaactcagac

SEQ ID NO: 2560956 - DNA, 13 bp, Homo sapiens
ttcaactcagact

SEQ ID NO: 2560957 - DNA, 16 bp, Homo sapiens
ttcaactcagactagt

SEQ ID NO: 2560958 - DNA, 23 bp, Homo sapiens
ttcaagaaactgaggaattttct

SEQ ID NO: 2560959 - DNA, 18 bp, Homo sapiens
ttcaagacattaaatcta

SEQ ID NO: 2560960 - DNA, 18 bp, Homo sapiens
ttcaagagatttaattaa

SEQ ID NO: 2560961 - DNA, 17 bp, Homo sapiens
ttcaagcagattggaga

SEQ ID NO: 2560962 - DNA, 15 bp, Homo sapiens
ttcaagcattaagaa

SEQ ID NO: 2560963 - DNA, 20 bp, Homo sapiens
ttcaaggtggccaaattatt

SEQ ID NO: 2560964 - DNA, 16 bp, Homo sapiens
ttcaagtcacctcctt

SEQ ID NO: 2560965 - DNA, 20 bp, Homo sapiens
ttcaagtgattctcctgcct

SEQ ID NO: 2560966 - DNA, 13 bp, Homo sapiens
ttcaagttaaagt

SEQ ID NO: 2560967 - DNA, 14 bp, Homo sapiens
ttcaataaagtatc

SEQ ID NO: 2560968 - DNA, 19 bp, Homo sapiens
ttcaataaagtatctacat

SEQ ID NO: 2560969 - DNA, 20 bp, Homo sapiens
ttcaatctcccgctgctgct

SEQ ID NO: 2560970 - DNA, 15 bp, Homo sapiens
ttcaatctgtaaact

SEQ ID NO: 2560971 - DNA, 20 bp, Homo sapiens
ttcaatggtttgcaaggaag

SEQ ID NO: 2560972 - DNA, 19 bp, Homo sapiens
ttcaattaaacggattatt

SEQ ID NO: 2560973 - DNA, 17 bp, Homo sapiens
ttcaattcaacactccc

SEQ ID NO: 2560974 - DNA, 19 bp, Homo sapiens
ttcaattcagtgctgtact

SEQ ID NO: 2560975 - DNA, 16 bp, Homo sapiens
ttcaattcctctggga

SEQ ID NO: 2560976 - DNA, 15 bp, Homo sapiens
ttcaattgcatctcc

SEQ ID NO: 2560977 - DNA, 23 bp, Homo sapiens
ttcacaagacccaaaaggcagaa

SEQ ID NO: 2560978 - DNA, 13 bp, Homo sapiens
ttcacaatagaaa

SEQ ID NO: 2560979 - DNA, 20 bp, Homo sapiens
ttcacaatgaaatgctctcc

SEQ ID NO: 2560980 - DNA, 22 bp, Homo sapiens
ttcacactctcacatgtttaga

SEQ ID NO: 2560981 - DNA, 18 bp, Homo sapiens
ttcacacttccaccagcc

SEQ ID NO: 2560982 - DNA, 20 bp, Homo sapiens
ttcacacttccaccagcctg

SEQ ID NO: 2560983 - DNA, 15 bp, Homo sapiens
ttcacagctcctccc

SEQ ID NO: 2560984 - DNA, 12 bp, Homo sapiens
ttcacagtgttt

SEQ ID NO: 2560985 - DNA, 17 bp, Homo sapiens
ttcacatagagatcatc

SEQ ID NO: 2560986 - DNA, 13 bp, Homo sapiens
ttcacattcttat

SEQ ID NO: 2560987 - DNA, 20 bp, Homo sapiens
ttcacattcttataaatatg

SEQ ID NO: 2560988 - DNA, 19 bp, Homo sapiens
ttcaccagaggaatcactc

SEQ ID NO: 2560989 - DNA, 16 bp, Homo sapiens
ttcaccccctttcctg

SEQ ID NO: 2560990 - DNA, 16 bp, Homo sapiens
ttcacctgattcaact

SEQ ID NO: 2560991 - DNA, 13 bp, Homo sapiens
ttcacctgtaaac

SEQ ID NO: 2560992 - DNA, 17 bp, Homo sapiens
ttcacctgtaaacctga

SEQ ID NO: 2560993 - DNA, 20 bp, Homo sapiens
ttcacctttgtccccaccgc

SEQ ID NO: 2560994 - DNA, 23 bp, Homo sapiens
ttcacgcctgtaatcccagcact

SEQ ID NO: 2560995 - DNA, 13 bp, Homo sapiens
ttcactgccccca

SEQ ID NO: 2560996 - DNA, 16 bp, Homo sapiens
ttcactgcctttgctc

SEQ ID NO: 2560997 - DNA, 12 bp, Homo sapiens
ttcactgctgca

SEQ ID NO: 2560998 - DNA, 19 bp, Homo sapiens
ttcactgctgcaaggcctt

SEQ ID NO: 2560999 - DNA, 19 bp, Homo sapiens
ttcactggagttacattaa

SEQ ID NO: 2561000 - DNA, 22 bp, Homo sapiens
ttcactgtagaatgatttcatg

SEQ ID NO: 2561001 - DNA, 16 bp, Homo sapiens
ttcactttagatgctg

SEQ ID NO: 2561002 - DNA, 17 bp, Homo sapiens
ttcacttttgacaaagg

SEQ ID NO: 2561003 - DNA, 23 bp, Homo sapiens
ttcagaaaacccttttctacagt

SEQ ID NO: 2561004 - DNA, 15 bp, Homo sapiens
ttcagaaagaagtgg

SEQ ID NO: 2561005 - DNA, 13 bp, Homo sapiens
ttcagaaatatgt

SEQ ID NO: 2561006 - DNA, 20 bp, Homo sapiens
ttcagaaatgctgcctgcct

SEQ ID NO: 2561007 - DNA, 12 bp, Homo sapiens
ttcagaacctct

SEQ ID NO: 2561008 - DNA, 18 bp, Homo sapiens
ttcagaacctcttcccca

SEQ ID NO: 2561009 - DNA, 16 bp, Homo sapiens
ttcagaagacactgca

SEQ ID NO: 2561010 - DNA, 20 bp, Homo sapiens
ttcagaagtttggcaatagt

SEQ ID NO: 2561011 - DNA, 23 bp, Homo sapiens
ttcagaagtttggcaatagtttg

SEQ ID NO: 2561012 - DNA, 19 bp, Homo sapiens
ttcagaatcacttctgaga

SEQ ID NO: 2561013 - DNA, 15 bp, Homo sapiens
ttcagacagctgcct

SEQ ID NO: 2561014 - DNA, 17 bp, Homo sapiens
ttcagacagctgcctgg

SEQ ID NO: 2561015 - DNA, 20 bp, Homo sapiens
ttcagacatagaattaacac

SEQ ID NO: 2561016 - DNA, 21 bp, Homo sapiens
ttcagagactcagggccccag

SEQ ID NO: 2561017 - DNA, 15 bp, Homo sapiens
ttcagagactcctgc

SEQ ID NO: 2561018 - DNA, 13 bp, Homo sapiens
ttcagagagctgg

SEQ ID NO: 2561019 - DNA, 20 bp, Homo sapiens
ttcagagagggcagaggggt

SEQ ID NO: 2561020 - DNA, 23 bp, Homo sapiens
ttcagaggccctcgctgccagct

SEQ ID NO: 2561021 - DNA, 18 bp, Homo sapiens
ttcagataactgttattt

SEQ ID NO: 2561022 - DNA, 17 bp, Homo sapiens
ttcagatacaaactgca

SEQ ID NO: 2561023 - DNA, 14 bp, Homo sapiens
ttcagatataaaag

SEQ ID NO: 2561024 - DNA, 15 bp, Homo sapiens
ttcagatataaaaga

SEQ ID NO: 2561025 - DNA, 16 bp, Homo sapiens
ttcagatatatttttc

SEQ ID NO: 2561026 - DNA, 17 bp, Homo sapiens
ttcagatgtcttctgcc

SEQ ID NO: 2561027 - DNA, 20 bp, Homo sapiens
ttcagatgtcttctgcctgt

SEQ ID NO: 2561028 - DNA, 14 bp, Homo sapiens
ttcagattcccaga

SEQ ID NO: 2561029 - DNA, 14 bp, Homo sapiens
ttcagattgctttg

SEQ ID NO: 2561030 - DNA, 16 bp, Homo sapiens
ttcagatttgccttat

SEQ ID NO: 2561031 - DNA, 20 bp, Homo sapiens
ttcagcaaactcttttccca

SEQ ID NO: 2561032 - DNA, 14 bp, Homo sapiens
ttcagctaagctag

SEQ ID NO: 2561033 - DNA, 13 bp, Homo sapiens
ttcagctcactgt

SEQ ID NO: 2561034 - DNA, 23 bp, Homo sapiens
ttcagctccagctcaccagcccc

SEQ ID NO: 2561035 - DNA, 17 bp, Homo sapiens
ttcagctctgcaagaat

SEQ ID NO: 2561036 - DNA, 14 bp, Homo sapiens
ttcagcttcatttg

SEQ ID NO: 2561037 - DNA, 22 bp, Homo sapiens
ttcagcttgtaaatagctcagg

SEQ ID NO: 2561038 - DNA, 11 bp, Homo sapiens
ttcaggaagct

SEQ ID NO: 2561039 - DNA, 13 bp, Homo sapiens
ttcaggaagctca

SEQ ID NO: 2561040 - DNA, 19 bp, Homo sapiens
ttcaggaagctcagggcct

SEQ ID NO: 2561041 - DNA, 16 bp, Homo sapiens
ttcaggagcagcctca

SEQ ID NO: 2561042 - DNA, 22 bp, Homo sapiens
ttcaggagcagcctcagaacaa

SEQ ID NO: 2561043 - DNA, 17 bp, Homo sapiens
ttcaggagtcccaagga

SEQ ID NO: 2561044 - DNA, 16 bp, Homo sapiens
ttcaggatacatgtgc

SEQ ID NO: 2561045 - DNA, 13 bp, Homo sapiens
ttcaggctgcttg

SEQ ID NO: 2561046 - DNA, 16 bp, Homo sapiens
ttcaggctgcttggga

SEQ ID NO: 2561047 - DNA, 17 bp, Homo sapiens
ttcaggggactcagccc

SEQ ID NO: 2561048 - DNA, 21 bp, Homo sapiens
ttcaggggagtcccgtcagga

SEQ ID NO: 2561049 - DNA, 21 bp, Homo sapiens
ttcaggtgacatgtgaaacct

SEQ ID NO: 2561050 - DNA, 20 bp, Homo sapiens
ttcaggtgtttagttgcaga

SEQ ID NO: 2561051 - DNA, 15 bp, Homo sapiens
ttcaggttttgtaaa

SEQ ID NO: 2561052 - DNA, 15 bp, Homo sapiens
ttcagtacctggagg

SEQ ID NO: 2561053 - DNA, 20 bp, Homo sapiens
ttcagtataatttaacttca

SEQ ID NO: 2561054 - DNA, 23 bp, Homo sapiens
ttcagtataatttaacttcagag

SEQ ID NO: 2561055 - DNA, 21 bp, Homo sapiens
ttcagtattttggagaaatta

SEQ ID NO: 2561056 - DNA, 21 bp, Homo sapiens
ttcagtcatataaaagctatg

SEQ ID NO: 2561057 - DNA, 13 bp, Homo sapiens
ttcagtgccaata

SEQ ID NO: 2561058 - DNA, 19 bp, Homo sapiens
ttcagtgctgtggcctggg

SEQ ID NO: 2561059 - DNA, 21 bp, Homo sapiens
ttcagtgctgtggcctgggca

SEQ ID NO: 2561060 - DNA, 12 bp, Homo sapiens
ttcagtggagaa

SEQ ID NO: 2561061 - DNA, 16 bp, Homo sapiens
ttcagtggcagctgct

SEQ ID NO: 2561062 - DNA, 13 bp, Homo sapiens
ttcagtgtaaata

SEQ ID NO: 2561063 - DNA, 12 bp, Homo sapiens
ttcagtgtaatt

SEQ ID NO: 2561064 - DNA, 13 bp, Homo sapiens
ttcagtgtcccgg

SEQ ID NO: 2561065 - DNA, 12 bp, Homo sapiens
ttcagtgttaaa

SEQ ID NO: 2561066 - DNA, 18 bp, Homo sapiens
ttcagtgttaaatgtgat

SEQ ID NO: 2561067 - DNA, 11 bp, Homo sapiens
ttcagttacag

SEQ ID NO: 2561068 - DNA, 17 bp, Homo sapiens
ttcagttacagaaagtg

SEQ ID NO: 2561069 - DNA, 16 bp, Homo sapiens
ttcagttgatcactgg

SEQ ID NO: 2561070 - DNA, 15 bp, Homo sapiens
ttcataacctagcct

SEQ ID NO: 2561071 - DNA, 12 bp, Homo sapiens
ttcataagtatt

SEQ ID NO: 2561072 - DNA, 19 bp, Homo sapiens
ttcataagtattatgtctc

SEQ ID NO: 2561073 - DNA, 16 bp, Homo sapiens
ttcatacctacatgta

SEQ ID NO: 2561074 - DNA, 19 bp, Homo sapiens
ttcatacctacatgtattt

SEQ ID NO: 2561075 - DNA, 14 bp, Homo sapiens
ttcatagatttcct

SEQ ID NO: 2561076 - DNA, 23 bp, Homo sapiens
ttcatatgacattcatgcctggc

SEQ ID NO: 2561077 - DNA, 12 bp, Homo sapiens
ttcatattgtgc

SEQ ID NO: 2561078 - DNA, 20 bp, Homo sapiens
ttcatattgtggcacaagca

SEQ ID NO: 2561079 - DNA, 21 bp, Homo sapiens
ttcatatttacttcttataca

SEQ ID NO: 2561080 - DNA, 19 bp, Homo sapiens
ttcatcaaatggaagacac

SEQ ID NO: 2561081 - DNA, 22 bp, Homo sapiens
ttcatccaatcctcactgggtg

SEQ ID NO: 2561082 - DNA, 16 bp, Homo sapiens
ttcatctatttctgag

SEQ ID NO: 2561083 - DNA, 17 bp, Homo sapiens
ttcatctatttctgaga

SEQ ID NO: 2561084 - DNA, 23 bp, Homo sapiens
ttcatctatttttggcagtctga

SEQ ID NO: 2561085 - DNA, 21 bp, Homo sapiens
ttcatctctcagaagggaggc

SEQ ID NO: 2561086 - DNA, 23 bp, Homo sapiens
ttcatctggaaccatcagaaaca

SEQ ID NO: 2561087 - DNA, 14 bp, Homo sapiens
ttcatctgggaaag

SEQ ID NO: 2561088 - DNA, 20 bp, Homo sapiens
ttcatcttccaactcaaact

SEQ ID NO: 2561089 - DNA, 23 bp, Homo sapiens
ttcatgatttcatttcaactgtt

SEQ ID NO: 2561090 - DNA, 16 bp, Homo sapiens
ttcatgcctggcttcg

SEQ ID NO: 2561091 - DNA, 17 bp, Homo sapiens
ttcatgctcagccctga

SEQ ID NO: 2561092 - DNA, 21 bp, Homo sapiens
ttcatggggtgatgctgggct

SEQ ID NO: 2561093 - DNA, 19 bp, Homo sapiens
ttcatgtaaacaaaattta

SEQ ID NO: 2561094 - DNA, 17 bp, Homo sapiens
ttcatgtaaactgtgca

SEQ ID NO: 2561095 - DNA, 13 bp, Homo sapiens
ttcatgtttctta

SEQ ID NO: 2561096 - DNA, 14 bp, Homo sapiens
ttcatgtttgcttc

SEQ ID NO: 2561097 - DNA, 15 bp, Homo sapiens
ttcatgttttaacaa

SEQ ID NO: 2561098 - DNA, 16 bp, Homo sapiens
ttcccttggcctcaga

SEQ ID NO: 2561099 - DNA, 22 bp, Homo sapiens
ttccctttgacgccatcccagc

SEQ ID NO: 2561100 - DNA, 20 bp, Homo sapiens
ttccgaaaaatcctcttcct

SEQ ID NO: 2561101 - DNA, 13 bp, Homo sapiens
ttccgcttggagc

SEQ ID NO: 2561102 - DNA, 23 bp, Homo sapiens
ttccggattggcttgtgtgtttc

SEQ ID NO: 2561103 - DNA, 14 bp, Homo sapiens
ttccggctcctgtg

SEQ ID NO: 2561104 - DNA, 18 bp, Homo sapiens
ttccgtgacgtcactgga

SEQ ID NO: 2561105 - DNA, 14 bp, Homo sapiens
ttcctaaatgcagt

SEQ ID NO: 2561106 - DNA, 15 bp, Homo sapiens
ttcctaataaagttc

SEQ ID NO: 2561107 - DNA, 16 bp, Homo sapiens
ttcctaataaagttct

SEQ ID NO: 2561108 - DNA, 22 bp, Homo sapiens
ttcctaataaagttctgtactc

SEQ ID NO: 2561109 - DNA, 23 bp, Homo sapiens
ttcctaattttagtgacagctct

SEQ ID NO: 2561110 - DNA, 20 bp, Homo sapiens
ttcctacaagagcagcctgt

SEQ ID NO: 2561111 - DNA, 14 bp, Homo sapiens
ttcctacagcccct

SEQ ID NO: 2561112 - DNA, 16 bp, Homo sapiens
ttcctacccaaccact

SEQ ID NO: 2561113 - DNA, 19 bp, Homo sapiens
ttcctagaagttactgaat

SEQ ID NO: 2561114 - DNA, 17 bp, Homo sapiens
ttcctagcacacacttt

SEQ ID NO: 2561115 - DNA, 20 bp, Homo sapiens
ttcctataatataataaata

SEQ ID NO: 2561116 - DNA, 19 bp, Homo sapiens
ttcctatatagtttattga

SEQ ID NO: 2561117 - DNA, 12 bp, Homo sapiens
ttcctatatgca

SEQ ID NO: 2561118 - DNA, 12 bp, Homo sapiens
ttcctattgtga

SEQ ID NO: 2561119 - DNA, 19 bp, Homo sapiens
ttcctatttgttttcatgg

SEQ ID NO: 2561120 - DNA, 21 bp, Homo sapiens
ttcctatttgttttcatggtg

SEQ ID NO: 2561121 - DNA, 23 bp, Homo sapiens
ttcctcatagtatggtggctggg

SEQ ID NO: 2561122 - DNA, 15 bp, Homo sapiens
ttcctcatctgtcca

SEQ ID NO: 2561123 - DNA, 12 bp, Homo sapiens
ttcctccccagc

SEQ ID NO: 2561124 - DNA, 17 bp, Homo sapiens
ttcctcctccctcctgc

SEQ ID NO: 2561125 - DNA, 13 bp, Homo sapiens
ttcctcctgctca

SEQ ID NO: 2561126 - DNA, 11 bp, Homo sapiens
ttcctcctggg

SEQ ID NO: 2561127 - DNA, 21 bp, Homo sapiens
ttcctcctgggccctctctgc

SEQ ID NO: 2561128 - DNA, 21 bp, Homo sapiens
ttcctctattgatgtacagtc

SEQ ID NO: 2561129 - DNA, 17 bp, Homo sapiens
ttcctctcactaaactt

SEQ ID NO: 2561130 - DNA, 21 bp, Homo sapiens
ttcctctgtttctccttctga

SEQ ID NO: 2561131 - DNA, 13 bp, Homo sapiens
ttcctcttcccca

SEQ ID NO: 2561132 - DNA, 12 bp, Homo sapiens
ttcctgaaagaa

SEQ ID NO: 2561133 - DNA, 15 bp, Homo sapiens
ttcctgaaatgcagt

SEQ ID NO: 2561134 - DNA, 15 bp, Homo sapiens
ttcctgaacctgatg

SEQ ID NO: 2561135 - DNA, 14 bp, Homo sapiens
ttcctgaagctgag

SEQ ID NO: 2561136 - DNA, 13 bp, Homo sapiens
ttcctgaatccaa

SEQ ID NO: 2561137 - DNA, 20 bp, Homo sapiens
ttcctgaattctatttgctg

SEQ ID NO: 2561138 - DNA, 22 bp, Homo sapiens
ttcctgaattctatttgctggg

SEQ ID NO: 2561139 - DNA, 13 bp, Homo sapiens
ttcctgacacttt

SEQ ID NO: 2561140 - DNA, 13 bp, Homo sapiens
ttcctgacccagg

SEQ ID NO: 2561141 - DNA, 20 bp, Homo sapiens
ttcctgaggctgggctccct

SEQ ID NO: 2561142 - DNA, 19 bp, Homo sapiens
ttcctgataataattgatc

SEQ ID NO: 2561143 - DNA, 20 bp, Homo sapiens
ttcctgatatgatttaaaac

SEQ ID NO: 2561144 - DNA, 22 bp, Homo sapiens
ttcctgatggtacaggaaagct

SEQ ID NO: 2561145 - DNA, 21 bp, Homo sapiens
ttcctgcaatgaagtctctga

SEQ ID NO: 2561146 - DNA, 18 bp, Homo sapiens
ttcctgcattcacccaga

SEQ ID NO: 2561147 - DNA, 15 bp, Homo sapiens
ttcctgcatttgtga

SEQ ID NO: 2561148 - DNA, 16 bp, Homo sapiens
ttcctgcatttgtgaa

SEQ ID NO: 2561149 - DNA, 16 bp, Homo sapiens
ttcctgcctgtctcct

SEQ ID NO: 2561150 - DNA, 19 bp, Homo sapiens
ttcctgcggagtgaagagg

SEQ ID NO: 2561151 - DNA, 23 bp, Homo sapiens
ttcctgcggagtgaagaggggca

SEQ ID NO: 2561152 - DNA, 15 bp, Homo sapiens
ttcctggacactcag

SEQ ID NO: 2561153 - DNA, 22 bp, Homo sapiens
ttcctggcaatagtgtgttctg

SEQ ID NO: 2561154 - DNA, 19 bp, Homo sapiens
ttcctggtgccaatttcaa

SEQ ID NO: 2561155 - DNA, 21 bp, Homo sapiens
ttcctgtaaaaaaaaaaaagt

SEQ ID NO: 2561156 - DNA, 19 bp, Homo sapiens
ttcctgtaacacaagccac

SEQ ID NO: 2561157 - DNA, 18 bp, Homo sapiens
ttcctgtagcatcttctg

SEQ ID NO: 2561158 - DNA, 14 bp, Homo sapiens
ttcctgtcccacct

SEQ ID NO: 2561159 - DNA, 23 bp, Homo sapiens
ttcctgtttttcacattttcctt

SEQ ID NO: 2561160 - DNA, 13 bp, Homo sapiens
ttccttaaactgt

SEQ ID NO: 2561161 - DNA, 17 bp, Homo sapiens
ttccttaaactgtgtgg

SEQ ID NO: 2561162 - DNA, 20 bp, Homo sapiens
ttccttagcttagacctcag

SEQ ID NO: 2561163 - DNA, 21 bp, Homo sapiens
ttccttagcttagacctcagc

SEQ ID NO: 2561164 - DNA, 23 bp, Homo sapiens
ttccttagcttagacctcagcct

SEQ ID NO: 2561165 - DNA, 23 bp, Homo sapiens
ttccttaggtttttttccttctg

SEQ ID NO: 2561166 - DNA, 14 bp, Homo sapiens
ttccttcagggtga

SEQ ID NO: 2561167 - DNA, 20 bp, Homo sapiens
ttccttccatccctaccccc

SEQ ID NO: 2561168 - DNA, 12 bp, Homo sapiens
ttccttctttga

SEQ ID NO: 2561169 - DNA, 13 bp, Homo sapiens
ttccttctttgat

SEQ ID NO: 2561170 - DNA, 14 bp, Homo sapiens
ttccttctttgata

SEQ ID NO: 2561171 - DNA, 22 bp, Homo sapiens
ttccttctttgataatgttaaa

SEQ ID NO: 2561172 - DNA, 13 bp, Homo sapiens
ttccttgaccagc

SEQ ID NO: 2561173 - DNA, 13 bp, Homo sapiens
ttccttgcctgca

SEQ ID NO: 2561174 - DNA, 13 bp, Homo sapiens
ttccttgctaatg

SEQ ID NO: 2561175 - DNA, 18 bp, Homo sapiens
ttccttgctctgcacccc

SEQ ID NO: 2561176 - DNA, 20 bp, Homo sapiens
ttccttggactcattttaaa

SEQ ID NO: 2561177 - DNA, 14 bp, Homo sapiens
ttccttggggcagg

SEQ ID NO: 2561178 - DNA, 18 bp, Homo sapiens
ttccttggggcaggcagt

SEQ ID NO: 2561179 - DNA, 18 bp, Homo sapiens
ttccttgtatttaaatat

SEQ ID NO: 2561180 - DNA, 20 bp, Homo sapiens
ttccttgtccccacactcct

SEQ ID NO: 2561181 - DNA, 14 bp, Homo sapiens
ttcctttatattta

SEQ ID NO: 2561182 - DNA, 16 bp, Homo sapiens
ttcctttcatttactg

SEQ ID NO: 2561183 - DNA, 20 bp, Homo sapiens
ttcctttcatttactgtggc

SEQ ID NO: 2561184 - DNA, 12 bp, Homo sapiens
ttcctttctcag

SEQ ID NO: 2561185 - DNA, 20 bp, Homo sapiens
ttcctttcttggttcataaa

SEQ ID NO: 2561186 - DNA, 15 bp, Homo sapiens
ttcctttggagcttt

SEQ ID NO: 2561187 - DNA, 12 bp, Homo sapiens
ttccttttaatt

SEQ ID NO: 2561188 - DNA, 20 bp, Homo sapiens
ttccttttagcctagttcat

SEQ ID NO: 2561189 - DNA, 19 bp, Homo sapiens
ttcgcatcaaaagacaatt

SEQ ID NO: 2561190 - DNA, 20 bp, Homo sapiens
ttcgcatcaaaagacaattc

SEQ ID NO: 2561191 - DNA, 15 bp, Homo sapiens
ttcgctcctgtgtct

SEQ ID NO: 2561192 - DNA, 14 bp, Homo sapiens
ttcgggaagagagg

SEQ ID NO: 2561193 - DNA, 22 bp, Homo sapiens
ttcgggaagagaggagttcaat

SEQ ID NO: 2561194 - DNA, 23 bp, Homo sapiens
ttcgggaagagaggagttcaatg

SEQ ID NO: 2561195 - DNA, 14 bp, Homo sapiens
ttcggtttctaact

SEQ ID NO: 2561196 - DNA, 19 bp, Homo sapiens
ttcgtctgtttataaacat

SEQ ID NO: 2561197 - DNA, 14 bp, Homo sapiens
ttcgtcttctaatt

SEQ ID NO: 2561198 - DNA, 16 bp, Homo sapiens
ttcgtcttctaatttc

SEQ ID NO: 2561199 - DNA, 18 bp, Homo sapiens
ttcgtgaagtatactgta

SEQ ID NO: 2561200 - DNA, 18 bp, Homo sapiens
ttctaaatgaatgtttac

SEQ ID NO: 2561201 - DNA, 20 bp, Homo sapiens
ttctaaatgcatatcctgag

SEQ ID NO: 2561202 - DNA, 13 bp, Homo sapiens
ttctaagaagtga

SEQ ID NO: 2561203 - DNA, 15 bp, Homo sapiens
ttctaagtaaaacca

SEQ ID NO: 2561204 - DNA, 19 bp, Homo sapiens
ttctaagtaaaaccacagc

SEQ ID NO: 2561205 - DNA, 15 bp, Homo sapiens
ttctacatactatgg

SEQ ID NO: 2561206 - DNA, 14 bp, Homo sapiens
ttctaccatttcag

SEQ ID NO: 2561207 - DNA, 19 bp, Homo sapiens
ttctacccagcgagccctg

SEQ ID NO: 2561208 - DNA, 20 bp, Homo sapiens
ttctacccagcgagccctgg

SEQ ID NO: 2561209 - DNA, 14 bp, Homo sapiens
ttctacccaggtgc

SEQ ID NO: 2561210 - DNA, 20 bp, Homo sapiens
ttctaccctagccattcctg

SEQ ID NO: 2561211 - DNA, 12 bp, Homo sapiens
ttctacctccca

SEQ ID NO: 2561212 - DNA, 11 bp, Homo sapiens
ttctacctgcc

SEQ ID NO: 2561213 - DNA, 18 bp, Homo sapiens
ttctaccttgaggtcttt

SEQ ID NO: 2561214 - DNA, 14 bp, Homo sapiens
ttctactctcccat

SEQ ID NO: 2561215 - DNA, 19 bp, Homo sapiens
ttctactctcccatggctt

SEQ ID NO: 2561216 - DNA, 21 bp, Homo sapiens
ttctagaacatccctgccagc

SEQ ID NO: 2561217 - DNA, 15 bp, Homo sapiens
ttctagactttctgt

SEQ ID NO: 2561218 - DNA, 15 bp, Homo sapiens
ttctagcactggcct

SEQ ID NO: 2561219 - DNA, 16 bp, Homo sapiens
ttctagctagaaatat

SEQ ID NO: 2561220 - DNA, 19 bp, Homo sapiens
ttctagctagaaatatgat

SEQ ID NO: 2561221 - DNA, 13 bp, Homo sapiens
ttctaggcctggg

SEQ ID NO: 2561222 - DNA, 15 bp, Homo sapiens
ttctaggttctaaaa

SEQ ID NO: 2561223 - DNA, 22 bp, Homo sapiens
ttctagtctcctttgcactgag

SEQ ID NO: 2561224 - DNA, 14 bp, Homo sapiens
ttctagtctctctg

SEQ ID NO: 2561225 - DNA, 18 bp, Homo sapiens
ttctagtggtctttgtaa

SEQ ID NO: 2561226 - DNA, 19 bp, Homo sapiens
ttctagtggtctttgtaag

SEQ ID NO: 2561227 - DNA, 22 bp, Homo sapiens
ttctagtggtctttgtaagagt

SEQ ID NO: 2561228 - DNA, 23 bp, Homo sapiens
ttctatagcagattgtgtaacaa

SEQ ID NO: 2561229 - DNA, 20 bp, Homo sapiens
ttctataggaacatatgaaa

SEQ ID NO: 2561230 - DNA, 12 bp, Homo sapiens
ttctatatgaat

SEQ ID NO: 2561231 - DNA, 17 bp, Homo sapiens
ttctatcacatatttga

SEQ ID NO: 2561232 - DNA, 16 bp, Homo sapiens
ttctatgacacatgca

SEQ ID NO: 2561233 - DNA, 17 bp, Homo sapiens
ttctatgacacatgcaa

SEQ ID NO: 2561234 - DNA, 13 bp, Homo sapiens
ttctatgagaaaa

SEQ ID NO: 2561235 - DNA, 15 bp, Homo sapiens
ttctatgtagtttat

SEQ ID NO: 2561236 - DNA, 17 bp, Homo sapiens
ttctattaactttaatt

SEQ ID NO: 2561237 - DNA, 20 bp, Homo sapiens
ttctattagccagtctttac

SEQ ID NO: 2561238 - DNA, 17 bp, Homo sapiens
ttctattgacttcaatg

SEQ ID NO: 2561239 - DNA, 15 bp, Homo sapiens
ttctgaaagggacgc

SEQ ID NO: 2561240 - DNA, 17 bp, Homo sapiens
ttctgaactcaaactga

SEQ ID NO: 2561241 - DNA, 18 bp, Homo sapiens
ttctgaactcaaactgag

SEQ ID NO: 2561242 - DNA, 18 bp, Homo sapiens
ttctgaagtctactttgt

SEQ ID NO: 2561243 - DNA, 14 bp, Homo sapiens
ttctgaatgctgct

SEQ ID NO: 2561244 - DNA, 19 bp, Homo sapiens
ttctgacaaaaagtttcca

SEQ ID NO: 2561245 - DNA, 22 bp, Homo sapiens
ttctgacaaaaagtttccatat

SEQ ID NO: 2561246 - DNA, 16 bp, Homo sapiens
ttctgacccatgctgc

SEQ ID NO: 2561247 - DNA, 20 bp, Homo sapiens
ttctgacgtgccttttgcac

SEQ ID NO: 2561248 - DNA, 16 bp, Homo sapiens
ttctgactctgagcta

SEQ ID NO: 2561249 - DNA, 15 bp, Homo sapiens
ttctgagaaagacta

SEQ ID NO: 2561250 - DNA, 16 bp, Homo sapiens
ttctgagaaagactat

SEQ ID NO: 2561251 - DNA, 18 bp, Homo sapiens
ttctgagaaggtccttaa

SEQ ID NO: 2561252 - DNA, 20 bp, Homo sapiens
ttctgagcccgggctgcctg

SEQ ID NO: 2561253 - DNA, 19 bp, Homo sapiens
ttctgaggacattccaaga

SEQ ID NO: 2561254 - DNA, 20 bp, Homo sapiens
ttctgagggtccactactca

SEQ ID NO: 2561255 - DNA, 19 bp, Homo sapiens
ttctgatcctagttccacc

SEQ ID NO: 2561256 - DNA, 18 bp, Homo sapiens
ttctgatgatgtgcctgg

SEQ ID NO: 2561257 - DNA, 17 bp, Homo sapiens
ttctgattacacaaaac

SEQ ID NO: 2561258 - DNA, 14 bp, Homo sapiens
ttctgattagaaat

SEQ ID NO: 2561259 - DNA, 21 bp, Homo sapiens
ttctgcaagcacatctgcatt

SEQ ID NO: 2561260 - DNA, 21 bp, Homo sapiens
ttctgcagcatgacctgtgac

SEQ ID NO: 2561261 - DNA, 22 bp, Homo sapiens
ttctgcagcatgacctgtgacc

SEQ ID NO: 2561262 - DNA, 23 bp, Homo sapiens
ttctgcagcatgacctgtgacca

SEQ ID NO: 2561263 - DNA, 12 bp, Homo sapiens
ttctgcagctgt

SEQ ID NO: 2561264 - DNA, 16 bp, Homo sapiens
ttctgcagctgtttta

SEQ ID NO: 2561265 - DNA, 18 bp, Homo sapiens
ttctgcattttgctattg

SEQ ID NO: 2561266 - DNA, 16 bp, Homo sapiens
ttctgccagggagctt

SEQ ID NO: 2561267 - DNA, 19 bp, Homo sapiens
ttctgcccaaaaatatggt

SEQ ID NO: 2561268 - DNA, 19 bp, Homo sapiens
ttctgcccaattggaggaa

SEQ ID NO: 2561269 - DNA, 18 bp, Homo sapiens
ttctgccggccctggggc

SEQ ID NO: 2561270 - DNA, 16 bp, Homo sapiens
ttctgccgtgtgccct

SEQ ID NO: 2561271 - DNA, 14 bp, Homo sapiens
ttctgcctgttata

SEQ ID NO: 2561272 - DNA, 14 bp, Homo sapiens
ttctgccttctcat

SEQ ID NO: 2561273 - DNA, 13 bp, Homo sapiens
ttctgctcatcat

SEQ ID NO: 2561274 - DNA, 14 bp, Homo sapiens
ttctgctcatcatt

SEQ ID NO: 2561275 - DNA, 19 bp, Homo sapiens
ttctgctcatcattctctg

SEQ ID NO: 2561276 - DNA, 21 bp, Homo sapiens
ttctgctcatcattctctgtc

SEQ ID NO: 2561277 - DNA, 18 bp, Homo sapiens
ttctgctccacccttggc

SEQ ID NO: 2561278 - DNA, 13 bp, Homo sapiens
ttctgctcctctc

SEQ ID NO: 2561279 - DNA, 15 bp, Homo sapiens
ttctgctcctctcca

SEQ ID NO: 2561280 - DNA, 18 bp, Homo sapiens
ttctgctcctctccaggc

SEQ ID NO: 2561281 - DNA, 13 bp, Homo sapiens
ttctgctggataa

SEQ ID NO: 2561282 - DNA, 14 bp, Homo sapiens
ttctgctggcctgg

SEQ ID NO: 2561283 - DNA, 16 bp, Homo sapiens
ttctgcttaggagaga

SEQ ID NO: 2561284 - DNA, 14 bp, Homo sapiens
ttctgctttgctct

SEQ ID NO: 2561285 - DNA, 19 bp, Homo sapiens
ttctgcttttgaaatctgt

SEQ ID NO: 2561286 - DNA, 17 bp, Homo sapiens
ttctggaatacatgaaa

SEQ ID NO: 2561287 - DNA, 16 bp, Homo sapiens
ttctggaatgtaatca

SEQ ID NO: 2561288 - DNA, 10 bp, Homo sapiens
ttctggagcc

SEQ ID NO: 2561289 - DNA, 18 bp, Homo sapiens
ttctggataaagccactg

SEQ ID NO: 2561290 - DNA, 19 bp, Homo sapiens
ttctggataaagccactga

SEQ ID NO: 2561291 - DNA, 20 bp, Homo sapiens
ttctggatgcatttctctgg

SEQ ID NO: 2561292 - DNA, 14 bp, Homo sapiens
ttctggcctcccac

SEQ ID NO: 2561293 - DNA, 16 bp, Homo sapiens
ttctggctatgcattt

SEQ ID NO: 2561294 - DNA, 20 bp, Homo sapiens
ttctggctatgcatttgaaa

SEQ ID NO: 2561295 - DNA, 17 bp, Homo sapiens
ttctggctcctcaaaca

SEQ ID NO: 2561296 - DNA, 22 bp, Homo sapiens
ttctggctggagcctagaacag

SEQ ID NO: 2561297 - DNA, 10 bp, Homo sapiens
ttctgggaca

SEQ ID NO: 2561298 - DNA, 22 bp, Homo sapiens
ttctgggacacagttcaattct

SEQ ID NO: 2561299 - DNA, 21 bp, Homo sapiens
ttctgggagggcagcagggct

SEQ ID NO: 2561300 - DNA, 23 bp, Homo sapiens
ttctggggcccctttttactccc

SEQ ID NO: 2561301 - DNA, 18 bp, Homo sapiens
ttctggtactctcctaga

SEQ ID NO: 2561302 - DNA, 19 bp, Homo sapiens
ttctggtgaggccttgctc

SEQ ID NO: 2561303 - DNA, 19 bp, Homo sapiens
ttctggtggggtgtgttcc

SEQ ID NO: 2561304 - DNA, 14 bp, Homo sapiens
ttctggtgtgaact

SEQ ID NO: 2561305 - DNA, 20 bp, Homo sapiens
ttctggtgtgaactaaactt

SEQ ID NO: 2561306 - DNA, 21 bp, Homo sapiens
ttctggtgtgaactaaacttt

SEQ ID NO: 2561307 - DNA, 23 bp, Homo sapiens
ttctgtaaactcaaaacttaaca

SEQ ID NO: 2561308 - DNA, 18 bp, Homo sapiens
ttctgtacatagcctata

SEQ ID NO: 2561309 - DNA, 23 bp, Homo sapiens
ttctgtatacaaccctggcatta

SEQ ID NO: 2561310 - DNA, 17 bp, Homo sapiens
ttctgtcccttggagct

SEQ ID NO: 2561311 - DNA, 19 bp, Homo sapiens
ttctgtcctactctgtgtc

SEQ ID NO: 2561312 - DNA, 18 bp, Homo sapiens
ttctgtcctggtgtcact

SEQ ID NO: 2561313 - DNA, 13 bp, Homo sapiens
ttctgtctctgcc

SEQ ID NO: 2561314 - DNA, 21 bp, Homo sapiens
ttctgtctctgcctccctcac

SEQ ID NO: 2561315 - DNA, 15 bp, Homo sapiens
ttctgtggaaagtgt

SEQ ID NO: 2561316 - DNA, 16 bp, Homo sapiens
ttctgtggaaagtgta

SEQ ID NO: 2561317 - DNA, 20 bp, Homo sapiens
ttctgtggaaagtgtaaagc

SEQ ID NO: 2561318 - DNA, 21 bp, Homo sapiens
ttctgtggaaagtgtaaagca

SEQ ID NO: 2561319 - DNA, 15 bp, Homo sapiens
ttggaggggggagcc

SEQ ID NO: 2561320 - DNA, 19 bp, Homo sapiens
ttggaggggtttatgctca

SEQ ID NO: 2561321 - DNA, 21 bp, Homo sapiens
ttggagggtcccaagctgggc

SEQ ID NO: 2561322 - DNA, 16 bp, Homo sapiens
ttggagggtgtcccaa

SEQ ID NO: 2561323 - DNA, 21 bp, Homo sapiens
ttggatggagtccagggaaga

SEQ ID NO: 2561324 - DNA, 17 bp, Homo sapiens
ttggattattcatttaa

SEQ ID NO: 2561325 - DNA, 14 bp, Homo sapiens
ttggattatttaat

SEQ ID NO: 2561326 - DNA, 19 bp, Homo sapiens
ttggattatttaataacat

SEQ ID NO: 2561327 - DNA, 20 bp, Homo sapiens
ttggattatttaataacatt

SEQ ID NO: 2561328 - DNA, 14 bp, Homo sapiens
ttggattgtccccg

SEQ ID NO: 2561329 - DNA, 14 bp, Homo sapiens
ttggatttgtttaa

SEQ ID NO: 2561330 - DNA, 18 bp, Homo sapiens
ttggatttttgtcttgtg

SEQ ID NO: 2561331 - DNA, 23 bp, Homo sapiens
ttggcacagaaacacaatatttt

SEQ ID NO: 2561332 - DNA, 23 bp, Homo sapiens
ttggcactcacagacctggagcc

SEQ ID NO: 2561333 - DNA, 15 bp, Homo sapiens
ttggcccccgagctg

SEQ ID NO: 2561334 - DNA, 16 bp, Homo sapiens
ttggcccccgagctgg

SEQ ID NO: 2561335 - DNA, 19 bp, Homo sapiens
ttggcccccgagctggggg

SEQ ID NO: 2561336 - DNA, 17 bp, Homo sapiens
ttggcctcccctgctga

SEQ ID NO: 2561337 - DNA, 19 bp, Homo sapiens
ttggcctccggcctcccct

SEQ ID NO: 2561338 - DNA, 16 bp, Homo sapiens
ttggcctggaggtggg

SEQ ID NO: 2561339 - DNA, 14 bp, Homo sapiens
ttggcgggccaagg

SEQ ID NO: 2561340 - DNA, 18 bp, Homo sapiens
ttggctagaggttcaaag

SEQ ID NO: 2561341 - DNA, 21 bp, Homo sapiens
ttggctagaggttcaaagata

SEQ ID NO: 2561342 - DNA, 12 bp, Homo sapiens
ttggctcaccca

SEQ ID NO: 2561343 - DNA, 16 bp, Homo sapiens
ttggctgcttggcctt

SEQ ID NO: 2561344 - DNA, 20 bp, Homo sapiens
ttggctggatgaaattttct

SEQ ID NO: 2561345 - DNA, 21 bp, Homo sapiens
ttggctggatgaaattttcta

SEQ ID NO: 2561346 - DNA, 17 bp, Homo sapiens
ttggctgggcccagaag

SEQ ID NO: 2561347 - DNA, 18 bp, Homo sapiens
ttggctgggcccagaagg

SEQ ID NO: 2561348 - DNA, 17 bp, Homo sapiens
ttggcttactgcagcct

SEQ ID NO: 2561349 - DNA, 22 bp, Homo sapiens
ttggcttcctttcttggttcat

SEQ ID NO: 2561350 - DNA, 22 bp, Homo sapiens
ttggctttgggttgcaggacct

SEQ ID NO: 2561351 - DNA, 21 bp, Homo sapiens
ttgggaaggggacccccgccc

SEQ ID NO: 2561352 - DNA, 18 bp, Homo sapiens
ttgggaatggatcctgga

SEQ ID NO: 2561353 - DNA, 18 bp, Homo sapiens
ttgggactggggctgaag

SEQ ID NO: 2561354 - DNA, 15 bp, Homo sapiens
ttgggagcactggag

SEQ ID NO: 2561355 - DNA, 17 bp, Homo sapiens
ttgggagcttgggaatg

SEQ ID NO: 2561356 - DNA, 12 bp, Homo sapiens
ttgggaggctga

SEQ ID NO: 2561357 - DNA, 15 bp, Homo sapiens
ttgggaggctgaggc

SEQ ID NO: 2561358 - DNA, 19 bp, Homo sapiens
ttgggagtgagatgcctgc

SEQ ID NO: 2561359 - DNA, 18 bp, Homo sapiens
ttgggattcctgacccag

SEQ ID NO: 2561360 - DNA, 14 bp, Homo sapiens
ttgggattgggggc

SEQ ID NO: 2561361 - DNA, 17 bp, Homo sapiens
ttgggcccagctgggct

SEQ ID NO: 2561362 - DNA, 18 bp, Homo sapiens
ttgggcccagctgggctc

SEQ ID NO: 2561363 - DNA, 11 bp, Homo sapiens
ttgggcccagg

SEQ ID NO: 2561364 - DNA, 13 bp, Homo sapiens
ttgggcccaggga

SEQ ID NO: 2561365 - DNA, 18 bp, Homo sapiens
ttgggcggctgagagccc

SEQ ID NO: 2561366 - DNA, 19 bp, Homo sapiens
ttgtgattcaatctgtaaa

SEQ ID NO: 2561367 - DNA, 15 bp, Homo sapiens
ttgtgatttgactgt

SEQ ID NO: 2561368 - DNA, 17 bp, Homo sapiens
ttgtgatttgactgttt

SEQ ID NO: 2561369 - DNA, 12 bp, Homo sapiens
ttgtgatttttg

SEQ ID NO: 2561370 - DNA, 16 bp, Homo sapiens
ttgtgatttttgtaat

SEQ ID NO: 2561371 - DNA, 22 bp, Homo sapiens
ttgtgcattatctagatactgt

SEQ ID NO: 2561372 - DNA, 12 bp, Homo sapiens
ttgtgcatttgg

SEQ ID NO: 2561373 - DNA, 16 bp, Homo sapiens
ttgtgccaatatgtat

SEQ ID NO: 2561374 - DNA, 14 bp, Homo sapiens
ttgtgcttgtttac

SEQ ID NO: 2561375 - DNA, 21 bp, Homo sapiens
ttgtggaaaatgaaaattagg

SEQ ID NO: 2561376 - DNA, 22 bp, Homo sapiens
ttgtggaagcaaaaatctgaaa

SEQ ID NO: 2561377 - DNA, 17 bp, Homo sapiens
ttgtggacacagctctt

SEQ ID NO: 2561378 - DNA, 15 bp, Homo sapiens
ttgtggacatttaag

SEQ ID NO: 2561379 - DNA, 20 bp, Homo sapiens
ttgtggatttaacagaaatg

SEQ ID NO: 2561380 - DNA, 14 bp, Homo sapiens
ttgtggcacattct

SEQ ID NO: 2561381 - DNA, 13 bp, Homo sapiens
ttgtggcctcaga

SEQ ID NO: 2561382 - DNA, 18 bp, Homo sapiens
ttgtggctcctatctgtg

SEQ ID NO: 2561383 - DNA, 20 bp, Homo sapiens
ttgtggctgtcagcaggaag

SEQ ID NO: 2561384 - DNA, 13 bp, Homo sapiens
ttgtgggtgggag

SEQ ID NO: 2561385 - DNA, 15 bp, Homo sapiens
ttgtgtacagtgtgt

SEQ ID NO: 2561386 - DNA, 21 bp, Homo sapiens
ttgtgtatccattatcatgtg

SEQ ID NO: 2561387 - DNA, 22 bp, Homo sapiens
ttgtgtatccattatcatgtgt

SEQ ID NO: 2561388 - DNA, 21 bp, Homo sapiens
ttgtgtatcgtaaccagccag

SEQ ID NO: 2561389 - DNA, 19 bp, Homo sapiens
ttgtgtcatgtttaagaaa

SEQ ID NO: 2561390 - DNA, 13 bp, Homo sapiens
ttgtgtctgtaca

SEQ ID NO: 2561391 - DNA, 13 bp, Homo sapiens
ttgtgtgtcttaa

SEQ ID NO: 2561392 - DNA, 21 bp, Homo sapiens
ttgtgtgttatttaaatgagt

SEQ ID NO: 2561393 - DNA, 22 bp, Homo sapiens
ttgttaactcttgtctattttt

SEQ ID NO: 2561394 - DNA, 17 bp, Homo sapiens
ttgttaagatatgatgt

SEQ ID NO: 2561395 - DNA, 14 bp, Homo sapiens
ttgttaataaaagt

SEQ ID NO: 2561396 - DNA, 18 bp, Homo sapiens
ttgttaatgaaaatgtca

SEQ ID NO: 2561397 - DNA, 19 bp, Homo sapiens
ttgttaatggtttgaatat

SEQ ID NO: 2561398 - DNA, 12 bp, Homo sapiens
ttgttaccttta

SEQ ID NO: 2561399 - DNA, 17 bp, Homo sapiens
ttgttactctggttctt

SEQ ID NO: 2561400 - DNA, 21 bp, Homo sapiens
ttgttagtatgaggcatttgt

SEQ ID NO: 2561401 - DNA, 18 bp, Homo sapiens
ttgttatgtagataacaa

SEQ ID NO: 2561402 - DNA, 20 bp, Homo sapiens
ttgttcaaaatatgttcttt

SEQ ID NO: 2561403 - DNA, 21 bp, Homo sapiens
ttgttccaagacattgtcaat

SEQ ID NO: 2561404 - DNA, 12 bp, Homo sapiens
ttgttccagctc

SEQ ID NO: 2561405 - DNA, 11 bp, Homo sapiens
ttgttcccagt

SEQ ID NO: 2561406 - DNA, 14 bp, Homo sapiens
ttgttccctctccc

SEQ ID NO: 2561407 - DNA, 22 bp, Homo sapiens
ttgttctggctcttccaggctg

SEQ ID NO: 2561408 - DNA, 14 bp, Homo sapiens
ttgttcttcttaaa

SEQ ID NO: 2561409 - DNA, 13 bp, Homo sapiens
ttgttctttttat

SEQ ID NO: 2561410 - DNA, 14 bp, Homo sapiens
ttgttgacttattt

SEQ ID NO: 2561411 - DNA, 14 bp, Homo sapiens
ttgttgaggtggtc

SEQ ID NO: 2561412 - DNA, 21 bp, Homo sapiens
ttgttgaggtggtctgaatgt

SEQ ID NO: 2561413 - DNA, 21 bp, Homo sapiens
ttgttggaaaagaatacagaa

SEQ ID NO: 2561414 - DNA, 15 bp, Homo sapiens
ttgttggatcttcaa

SEQ ID NO: 2561415 - DNA, 18 bp, Homo sapiens
ttgttggcctccggcctc

SEQ ID NO: 2561416 - DNA, 23 bp, Homo sapiens
ttgttggctttcccttatcaaac

SEQ ID NO: 2561417 - DNA, 20 bp, Homo sapiens
ttgttgggattcctgaccca

SEQ ID NO: 2561418 - DNA, 21 bp, Homo sapiens
ttgttgggattcctgacccag

SEQ ID NO: 2561419 - DNA, 14 bp, Homo sapiens
ttgttgtttgccat

SEQ ID NO: 2561420 - DNA, 21 bp, Homo sapiens
ttgttgtttgccatactttgt

SEQ ID NO: 2561421 - DNA, 15 bp, Homo sapiens
ttgttgtttgtatgt

SEQ ID NO: 2561422 - DNA, 16 bp, Homo sapiens
ttgtttacttaaagat

SEQ ID NO: 2561423 - DNA, 18 bp, Homo sapiens
ttgtttcaaacacaaatg

SEQ ID NO: 2561424 - DNA, 15 bp, Homo sapiens
ttgtttcctttcact

SEQ ID NO: 2561425 - DNA, 17 bp, Homo sapiens
ttgtttctacctcccag

SEQ ID NO: 2561426 - DNA, 21 bp, Homo sapiens
ttgtttgagaaattaagtatc

SEQ ID NO: 2561427 - DNA, 15 bp, Homo sapiens
ttgtttgccatactt

SEQ ID NO: 2561428 - DNA, 16 bp, Homo sapiens
ttgtttgccatacttt

SEQ ID NO: 2561429 - DNA, 12 bp, Homo sapiens
ttgtttgctatc

SEQ ID NO: 2561430 - DNA, 13 bp, Homo sapiens
ttgtttgtatgta

SEQ ID NO: 2561431 - DNA, 12 bp, Homo sapiens
ttgtttgtttca

SEQ ID NO: 2561432 - DNA, 13 bp, Homo sapiens
ttgttttcagtgt

SEQ ID NO: 2561433 - DNA, 20 bp, Homo sapiens
ttgttttcttctgtatgtta

SEQ ID NO: 2561434 - DNA, 20 bp, Homo sapiens
ttgttttgcacactttgcca

SEQ ID NO: 2561435 - DNA, 14 bp, Homo sapiens
ttgttttgcacttt

SEQ ID NO: 2561436 - DNA, 16 bp, Homo sapiens
ttgttttgcacttttt

SEQ ID NO: 2561437 - DNA, 13 bp, Homo sapiens
ttgttttgtttta

SEQ ID NO: 2561438 - DNA, 19 bp, Homo sapiens
ttgtttttcattcagtctt

SEQ ID NO: 2561439 - DNA, 13 bp, Homo sapiens
ttgtttttccttg

SEQ ID NO: 2561440 - DNA, 16 bp, Homo sapiens
tttaaaaaaatttaag

SEQ ID NO: 2561441 - DNA, 20 bp, Homo sapiens
tttaaaaaataactaccaag

SEQ ID NO: 2561442 - DNA, 23 bp, Homo sapiens
tttaaaaatacagatagatatat

SEQ ID NO: 2561443 - DNA, 16 bp, Homo sapiens
tttaaaaatcataaac

SEQ ID NO: 2561444 - DNA, 19 bp, Homo sapiens
tttaaaaatcataaactgt

SEQ ID NO: 2561445 - DNA, 12 bp, Homo sapiens
tttaaaaatgaa

SEQ ID NO: 2561446 - DNA, 14 bp, Homo sapiens
tttaaaaatgaaat

SEQ ID NO: 2561447 - DNA, 15 bp, Homo sapiens
tttaaaacagacact

SEQ ID NO: 2561448 - DNA, 16 bp, Homo sapiens
tttaaaacatgtaata

SEQ ID NO: 2561449 - DNA, 17 bp, Homo sapiens
tttaaaagaatgggcag

SEQ ID NO: 2561450 - DNA, 18 bp, Homo sapiens
tttaaaagaatgggcagt

SEQ ID NO: 2561451 - DNA, 13 bp, Homo sapiens
tttaaaagataca

SEQ ID NO: 2561452 - DNA, 19 bp, Homo sapiens
tttaaaagttattaatatt

SEQ ID NO: 2561453 - DNA, 17 bp, Homo sapiens
tttaaaagtttcaatgt

SEQ ID NO: 2561454 - DNA, 20 bp, Homo sapiens
tttaaaagtttcaatgtgat

SEQ ID NO: 2561455 - DNA, 19 bp, Homo sapiens
tttaaaatacacactcaaa

SEQ ID NO: 2561456 - DNA, 16 bp, Homo sapiens
tttaaaatcttttcta

SEQ ID NO: 2561457 - DNA, 23 bp, Homo sapiens
tttaaacaaattcatattctgtc

SEQ ID NO: 2561458 - DNA, 16 bp, Homo sapiens
tttaaacaggcccagc

SEQ ID NO: 2561459 - DNA, 15 bp, Homo sapiens
tttaaacccatttta

SEQ ID NO: 2561460 - DNA, 17 bp, Homo sapiens
tttaaacccattttagt

SEQ ID NO: 2561461 - DNA, 22 bp, Homo sapiens
tttaaacctcacctttgtgggg

SEQ ID NO: 2561462 - DNA, 21 bp, Homo sapiens
tttaaactgtgtacataactg

SEQ ID NO: 2561463 - DNA, 14 bp, Homo sapiens
tttaaagagaggtt

SEQ ID NO: 2561464 - DNA, 21 bp, Homo sapiens
tttaaaggaaaaaatgttgga

SEQ ID NO: 2561465 - DNA, 16 bp, Homo sapiens
tttaaagtagattaga

SEQ ID NO: 2561466 - DNA, 23 bp, Homo sapiens
tttaaataaaagaaaaaatatct

SEQ ID NO: 2561467 - DNA, 19 bp, Homo sapiens
tttaaataaaagtgatcaa

SEQ ID NO: 2561468 - DNA, 12 bp, Homo sapiens
tttaaatataat

SEQ ID NO: 2561469 - DNA, 16 bp, Homo sapiens
tttaaatataattctg

SEQ ID NO: 2561470 - DNA, 14 bp, Homo sapiens
tttaaatctgtgat

SEQ ID NO: 2561471 - DNA, 15 bp, Homo sapiens
tttaaatgtaaagat

SEQ ID NO: 2561472 - DNA, 18 bp, Homo sapiens
tttaaatgtttttctatg

SEQ ID NO: 2561473 - DNA, 20 bp, Homo sapiens
tttaaattataacttaaaat

SEQ ID NO: 2561474 - DNA, 19 bp, Homo sapiens
tttaaattcacaatagaaa

SEQ ID NO: 2561475 - DNA, 21 bp, Homo sapiens
tttaaattcacaatagaaact

SEQ ID NO: 2561476 - DNA, 18 bp, Homo sapiens
tttaaattttacccttta

SEQ ID NO: 2561477 - DNA, 18 bp, Homo sapiens
tttaaatttttttcctta

SEQ ID NO: 2561478 - DNA, 15 bp, Homo sapiens
tttaacaaaaaccaa

SEQ ID NO: 2561479 - DNA, 23 bp, Homo sapiens
tttaacaactatgatttggaaaa

SEQ ID NO: 2561480 - DNA, 21 bp, Homo sapiens
tttaacaataactactgtgtt

SEQ ID NO: 2561481 - DNA, 16 bp, Homo sapiens
ttctttttattttctt

SEQ ID NO: 2561482 - DNA, 18 bp, Homo sapiens
ttcttttttttcattata

SEQ ID NO: 2561483 - DNA, 15 bp, Homo sapiens
ttgaaaaattcctat

SEQ ID NO: 2561484 - DNA, 19 bp, Homo sapiens
ttgaaaacactgttctctg

SEQ ID NO: 2561485 - DNA, 22 bp, Homo sapiens
ttgaaaacactgttctctgccc

SEQ ID NO: 2561486 - DNA, 17 bp, Homo sapiens
ttgaaaacttttctcag

SEQ ID NO: 2561487 - DNA, 13 bp, Homo sapiens
ttgaaaagacatc

SEQ ID NO: 2561488 - DNA, 23 bp, Homo sapiens
ttgaaaagactccaaagaaatgt

SEQ ID NO: 2561489 - DNA, 12 bp, Homo sapiens
ttgaaaagctat

SEQ ID NO: 2561490 - DNA, 15 bp, Homo sapiens
ttgaaacaatactca

SEQ ID NO: 2561491 - DNA, 15 bp, Homo sapiens
ttgaaagattcaggt

SEQ ID NO: 2561492 - DNA, 12 bp, Homo sapiens
ttgaaagctgtg

SEQ ID NO: 2561493 - DNA, 21 bp, Homo sapiens
ttgaaaggcattctctgaaga

SEQ ID NO: 2561494 - DNA, 18 bp, Homo sapiens
ttgaaattatgtatgttt

SEQ ID NO: 2561495 - DNA, 19 bp, Homo sapiens
ttgaaattatgtatgttta

SEQ ID NO: 2561496 - DNA, 18 bp, Homo sapiens
ttgaacactcatgctgaa

SEQ ID NO: 2561497 - DNA, 19 bp, Homo sapiens
ttgaacccgggaggcagag

SEQ ID NO: 2561498 - DNA, 16 bp, Homo sapiens
ttgaactcctggcctc

SEQ ID NO: 2561499 - DNA, 19 bp, Homo sapiens
ttgaactcttcaatctctt

SEQ ID NO: 2561500 - DNA, 19 bp, Homo sapiens
ttgaactgatagttactgt

SEQ ID NO: 2561501 - DNA, 13 bp, Homo sapiens
ttgaactttgacc

SEQ ID NO: 2561502 - DNA, 15 bp, Homo sapiens
ttgaactttgacctc

SEQ ID NO: 2561503 - DNA, 18 bp, Homo sapiens
ttgaactttgacctctgc

SEQ ID NO: 2561504 - DNA, 22 bp, Homo sapiens
ttgaactttgacctctgcagca

SEQ ID NO: 2561505 - DNA, 13 bp, Homo sapiens
ttgaagaatgaac

SEQ ID NO: 2561506 - DNA, 15 bp, Homo sapiens
ttgaagaatgaacaa

SEQ ID NO: 2561507 - DNA, 16 bp, Homo sapiens
ttgaagaatgaacaaa

SEQ ID NO: 2561508 - DNA, 20 bp, Homo sapiens
ttgaagatcgttagtatcta

SEQ ID NO: 2561509 - DNA, 15 bp, Homo sapiens
ttgaagcattttata

SEQ ID NO: 2561510 - DNA, 17 bp, Homo sapiens
ttgaagccactgaagct

SEQ ID NO: 2561511 - DNA, 14 bp, Homo sapiens
ttgaagctaagatt

SEQ ID NO: 2561512 - DNA, 23 bp, Homo sapiens
ttgaagctctggtgacaccagcc

SEQ ID NO: 2561513 - DNA, 13 bp, Homo sapiens
ttgaaggaaacag

SEQ ID NO: 2561514 - DNA, 14 bp, Homo sapiens
ttgaaggaaacagt

SEQ ID NO: 2561515 - DNA, 17 bp, Homo sapiens
ttgaaggcagaaagcaa

SEQ ID NO: 2561516 - DNA, 18 bp, Homo sapiens
ttgaagtattttgctgga

SEQ ID NO: 2561517 - DNA, 16 bp, Homo sapiens
ttgaataaaaatgcac

SEQ ID NO: 2561518 - DNA, 12 bp, Homo sapiens
ttgaataaacta

SEQ ID NO: 2561519 - DNA, 22 bp, Homo sapiens
ttgaataatggtaccagataaa

SEQ ID NO: 2561520 - DNA, 13 bp, Homo sapiens
ttgaatatattat

SEQ ID NO: 2561521 - DNA, 23 bp, Homo sapiens
ttgaatcaataatatattttctg

SEQ ID NO: 2561522 - DNA, 15 bp, Homo sapiens
ttgaatctatttaag

SEQ ID NO: 2561523 - DNA, 20 bp, Homo sapiens
ttgaatgaaaaatttaagca

SEQ ID NO: 2561524 - DNA, 20 bp, Homo sapiens
ttgaatgacaacagaagctt

SEQ ID NO: 2561525 - DNA, 22 bp, Homo sapiens
ttgaatgagatgattcagaagg

SEQ ID NO: 2561526 - DNA, 23 bp, Homo sapiens
ttgaatgagatgattcagaaggg

SEQ ID NO: 2561527 - DNA, 15 bp, Homo sapiens
ttgaatgctttttga

SEQ ID NO: 2561528 - DNA, 17 bp, Homo sapiens
ttgaatgctttttgaat

SEQ ID NO: 2561529 - DNA, 15 bp, Homo sapiens
ttgaatgggtccatt

SEQ ID NO: 2561530 - DNA, 23 bp, Homo sapiens
ttgaatggtcagcgttgcatgtc

SEQ ID NO: 2561531 - DNA, 16 bp, Homo sapiens
ttgaatggtgttgtat

SEQ ID NO: 2561532 - DNA, 23 bp, Homo sapiens
ttgaatgttatttgttattttca

SEQ ID NO: 2561533 - DNA, 22 bp, Homo sapiens
ttgaattaaattaggaataaat

SEQ ID NO: 2561534 - DNA, 14 bp, Homo sapiens
ttgacaacaaatta

SEQ ID NO: 2561535 - DNA, 22 bp, Homo sapiens
ttgacaccagctgttctgtccc

SEQ ID NO: 2561536 - DNA, 22 bp, Homo sapiens
ttgacactatatctgtatataa

SEQ ID NO: 2561537 - DNA, 15 bp, Homo sapiens
ttgacagaacactgt

SEQ ID NO: 2561538 - DNA, 17 bp, Homo sapiens
ttgacagaacactgtct

SEQ ID NO: 2561539 - DNA, 18 bp, Homo sapiens
ttgacagatcaagctgtg

SEQ ID NO: 2561540 - DNA, 10 bp, Homo sapiens
ttgacagggc

SEQ ID NO: 2561541 - DNA, 12 bp, Homo sapiens
ttgacagggcac

SEQ ID NO: 2561542 - DNA, 19 bp, Homo sapiens
ttgacagtgttgaaaatgt

SEQ ID NO: 2561543 - DNA, 22 bp, Homo sapiens
ttgaccaagcaggaagctcaga

SEQ ID NO: 2561544 - DNA, 17 bp, Homo sapiens
ttgacccacaagaaatg

SEQ ID NO: 2561545 - DNA, 16 bp, Homo sapiens
ttgacctctgcagcaa

SEQ ID NO: 2561546 - DNA, 19 bp, Homo sapiens
ttgacctgaggcccttctc

SEQ ID NO: 2561547 - DNA, 21 bp, Homo sapiens
ttgacctgcctcccttcatgc

SEQ ID NO: 2561548 - DNA, 23 bp, Homo sapiens
ttgacgaagtctcttttctttag

SEQ ID NO: 2561549 - DNA, 14 bp, Homo sapiens
ttgacgccatccca

SEQ ID NO: 2561550 - DNA, 17 bp, Homo sapiens
ttgacgccatcccagcc

SEQ ID NO: 2561551 - DNA, 23 bp, Homo sapiens
tttaacaatttcctttatattta

SEQ ID NO: 2561552 - DNA, 14 bp, Homo sapiens
tttaacagggtctc

SEQ ID NO: 2561553 - DNA, 16 bp, Homo sapiens
tttaacagtcatttaa

SEQ ID NO: 2561554 - DNA, 17 bp, Homo sapiens
tttaaccattaaaactg

SEQ ID NO: 2561555 - DNA, 22 bp, Homo sapiens
tttaacgaatgaagatgtctaa

SEQ ID NO: 2561556 - DNA, 21 bp, Homo sapiens
tttaactcagatcactactgc

SEQ ID NO: 2561557 - DNA, 22 bp, Homo sapiens
tttaactcatacctttaaagga

SEQ ID NO: 2561558 - DNA, 19 bp, Homo sapiens
tttaactttatcacattat

SEQ ID NO: 2561559 - DNA, 18 bp, Homo sapiens
tttaagaaaaaataacac

SEQ ID NO: 2561560 - DNA, 19 bp, Homo sapiens
tttaagacgtgtttgtgtt

SEQ ID NO: 2561561 - DNA, 18 bp, Homo sapiens
tttaagataataatatat

SEQ ID NO: 2561562 - DNA, 15 bp, Homo sapiens
tttaagataattata

SEQ ID NO: 2561563 - DNA, 20 bp, Homo sapiens
tttaagcactacataaactg

SEQ ID NO: 2561564 - DNA, 23 bp, Homo sapiens
tttaagcactacataaactgact

SEQ ID NO: 2561565 - DNA, 11 bp, Homo sapiens
tttaagctgtt

SEQ ID NO: 2561566 - DNA, 12 bp, Homo sapiens
tttaagctgttt

SEQ ID NO: 2561567 - DNA, 21 bp, Homo sapiens
tttaaggatgcttgtacataa

SEQ ID NO: 2561568 - DNA, 18 bp, Homo sapiens
tttaaggctaaaacttaa

SEQ ID NO: 2561569 - DNA, 22 bp, Homo sapiens
tttaagggtttgtggaaaatga

SEQ ID NO: 2561570 - DNA, 14 bp, Homo sapiens
tttaagtatttata

SEQ ID NO: 2561571 - DNA, 21 bp, Homo sapiens
tttaagtgcgtgtgtagagtt

SEQ ID NO: 2561572 - DNA, 17 bp, Homo sapiens
tttaagtgctgcattta

SEQ ID NO: 2561573 - DNA, 22 bp, Homo sapiens
tttaagtgtaactggcagtttt

SEQ ID NO: 2561574 - DNA, 20 bp, Homo sapiens
tttaataaaaaggcacctat

SEQ ID NO: 2561575 - DNA, 13 bp, Homo sapiens
tttaataaaccat

SEQ ID NO: 2561576 - DNA, 18 bp, Homo sapiens
tttctagggaaatgaaag

SEQ ID NO: 2561577 - DNA, 23 bp, Homo sapiens
tttctagtggtctttgtaagagt

SEQ ID NO: 2561578 - DNA, 15 bp, Homo sapiens
tttctatcctctgta

SEQ ID NO: 2561579 - DNA, 15 bp, Homo sapiens
tttctatgacacatg

SEQ ID NO: 2561580 - DNA, 14 bp, Homo sapiens
tttctattccaaag

SEQ ID NO: 2561581 - DNA, 13 bp, Homo sapiens
tttctattgttac

SEQ ID NO: 2561582 - DNA, 21 bp, Homo sapiens
tttctattttccctcgctggg

SEQ ID NO: 2561583 - DNA, 22 bp, Homo sapiens
tttctcaacaaagcacagtgtt

SEQ ID NO: 2561584 - DNA, 23 bp, Homo sapiens
tttctcaccgcagtcgtcgcaca

SEQ ID NO: 2561585 - DNA, 20 bp, Homo sapiens
tttctcagatccttgtttca

SEQ ID NO: 2561586 - DNA, 15 bp, Homo sapiens
tttctcagctcccat

SEQ ID NO: 2561587 - DNA, 20 bp, Homo sapiens
tttctcagctcccatttcta

SEQ ID NO: 2561588 - DNA, 15 bp, Homo sapiens
tttctcctcccagga

SEQ ID NO: 2561589 - DNA, 19 bp, Homo sapiens
tttctccttagtcttctca

SEQ ID NO: 2561590 - DNA, 16 bp, Homo sapiens
tttctcctttgataaa

SEQ ID NO: 2561591 - DNA, 17 bp, Homo sapiens
tttctctgtatagtact

SEQ ID NO: 2561592 - DNA, 18 bp, Homo sapiens
tttctctgtgtttgttcc

SEQ ID NO: 2561593 - DNA, 13 bp, Homo sapiens
tttctcttgggct

SEQ ID NO: 2561594 - DNA, 20 bp, Homo sapiens
tttctgaccaatcactgagt

SEQ ID NO: 2561595 - DNA, 13 bp, Homo sapiens
tttctgagaaaga

SEQ ID NO: 2561596 - DNA, 16 bp, Homo sapiens
tttctgagaaggtcct

SEQ ID NO: 2561597 - DNA, 19 bp, Homo sapiens
tttctgagaaggtccttaa

SEQ ID NO: 2561598 - DNA, 16 bp, Homo sapiens
tttctgagcacacttt

SEQ ID NO: 2561599 - DNA, 11 bp, Homo sapiens
tttctgagccc

SEQ ID NO: 2561600 - DNA, 21 bp, Homo sapiens
tttctgagcccgggctgcctg

SEQ ID NO: 2561601 - DNA, 14 bp, Homo sapiens
tttctgagcgatta

SEQ ID NO: 2561602 - DNA, 15 bp, Homo sapiens
tttctgagctgctct

SEQ ID NO: 2561603 - DNA, 23 bp, Homo sapiens
tttctgattgtaacgttgctgtg

SEQ ID NO: 2561604 - DNA, 19 bp, Homo sapiens
tttctgcagtagtctctgt

SEQ ID NO: 2561605 - DNA, 13 bp, Homo sapiens
tttctgcattttg

SEQ ID NO: 2561606 - DNA, 16 bp, Homo sapiens
tttctgccagggagct

SEQ ID NO: 2561607 - DNA, 13 bp, Homo sapiens
tttctgccttcct

SEQ ID NO: 2561608 - DNA, 19 bp, Homo sapiens
tttctgctggaaacagact

SEQ ID NO: 2561609 - DNA, 18 bp, Homo sapiens
tttctggaatacatgaaa

SEQ ID NO: 2561610 - DNA, 20 bp, Homo sapiens
tttctggaatacatgaaata

SEQ ID NO: 2561611 - DNA, 11 bp, Homo sapiens
tttctgtgtgc

SEQ ID NO: 2561612 - DNA, 15 bp, Homo sapiens
tttctgttctgtgga

SEQ ID NO: 2561613 - DNA, 16 bp, Homo sapiens
tttctgttctgtggaa

SEQ ID NO: 2561614 - DNA, 17 bp, Homo sapiens
tttctgttctgtggaaa

SEQ ID NO: 2561615 - DNA, 15 bp, Homo sapiens
tttctgttggtgtat

SEQ ID NO: 2561616 - DNA, 18 bp, Homo sapiens
tttctgtttcctttttta

SEQ ID NO: 2561617 - DNA, 16 bp, Homo sapiens
tttcttagctttttaa

SEQ ID NO: 2561618 - DNA, 19 bp, Homo sapiens
tttcttagctttttaattg

SEQ ID NO: 2561619 - DNA, 22 bp, Homo sapiens
tttcttagctttttaattgttg

SEQ ID NO: 2561620 - DNA, 18 bp, Homo sapiens
tttcttagggaaggatac

SEQ ID NO: 2561621 - DNA, 16 bp, Homo sapiens
tttcttagtgcctgtg

SEQ ID NO: 2561622 - DNA, 17 bp, Homo sapiens
tttcttatttcatttct

SEQ ID NO: 2561623 - DNA, 23 bp, Homo sapiens
tttcttgccaatgaggtctgaaa

SEQ ID NO: 2561624 - DNA, 21 bp, Homo sapiens
tttcttgctggttgtcatttt

SEQ ID NO: 2561625 - DNA, 19 bp, Homo sapiens
tttcttggttcataaatga

SEQ ID NO: 2561626 - DNA, 20 bp, Homo sapiens
tttctttaagataatagttt

SEQ ID NO: 2561627 - DNA, 12 bp, Homo sapiens
tttctttctagt

SEQ ID NO: 2561628 - DNA, 22 bp, Homo sapiens
tttctttgaatgctttttgaat

SEQ ID NO: 2561629 - DNA, 16 bp, Homo sapiens
tttctttgttatcaaa

SEQ ID NO: 2561630 - DNA, 22 bp, Homo sapiens
tttcttttctggaatgtaatca

SEQ ID NO: 2561631 - DNA, 22 bp, Homo sapiens
tttcttttgcccttcacagtgt

SEQ ID NO: 2561632 - DNA, 16 bp, Homo sapiens
tttcttttgtaaatgt

SEQ ID NO: 2561633 - DNA, 14 bp, Homo sapiens
tttgaaaagctatt

SEQ ID NO: 2561634 - DNA, 15 bp, Homo sapiens
tttgaaaagctatta

SEQ ID NO: 2561635 - DNA, 19 bp, Homo sapiens
tttgaaaagctattagcca

SEQ ID NO: 2561636 - DNA, 15 bp, Homo sapiens
tttgaaacaaagaag

SEQ ID NO: 2561637 - DNA, 14 bp, Homo sapiens
tttgaactcttcaa

SEQ ID NO: 2561638 - DNA, 15 bp, Homo sapiens
tttgaactgataaag

SEQ ID NO: 2561639 - DNA, 17 bp, Homo sapiens
tttgaactgataaagat

SEQ ID NO: 2561640 - DNA, 17 bp, Homo sapiens
tttgaatataaacacta

SEQ ID NO: 2561641 - DNA, 19 bp, Homo sapiens
tttgaatcaataatatatt

SEQ ID NO: 2561642 - DNA, 17 bp, Homo sapiens
tttgaatccatgcttgg

SEQ ID NO: 2561643 - DNA, 15 bp, Homo sapiens
tttgaatgaaaaatt

SEQ ID NO: 2561644 - DNA, 21 bp, Homo sapiens
tttgaatgaaaaatttaagca

SEQ ID NO: 2561645 - DNA, 23 bp, Homo sapiens
tttgaatgaaaaatttaagcatt

SEQ ID NO: 2561646 - DNA, 20 bp, Homo sapiens
tttgaatgttatttgttatt

SEQ ID NO: 2561647 - DNA, 16 bp, Homo sapiens
tttgaattttctgtgt

SEQ ID NO: 2561648 - DNA, 15 bp, Homo sapiens
tttgacaacaaatta

SEQ ID NO: 2561649 - DNA, 18 bp, Homo sapiens
tttgacactatatctgta

SEQ ID NO: 2561650 - DNA, 18 bp, Homo sapiens
tttgacagtgttgaaaat

SEQ ID NO: 2561651 - DNA, 14 bp, Homo sapiens
tttgacggatgatt

SEQ ID NO: 2561652 - DNA, 21 bp, Homo sapiens
tttgactagggattcaggctg

SEQ ID NO: 2561653 - DNA, 20 bp, Homo sapiens
tttgactgtttttacccata

SEQ ID NO: 2561654 - DNA, 13 bp, Homo sapiens
tttgagacaggag

SEQ ID NO: 2561655 - DNA, 17 bp, Homo sapiens
tttgagacagtttctta

SEQ ID NO: 2561656 - DNA, 16 bp, Homo sapiens
tttgagatcagcctgg

SEQ ID NO: 2561657 - DNA, 19 bp, Homo sapiens
tttgagcttagtgaaatta

SEQ ID NO: 2561658 - DNA, 21 bp, Homo sapiens
tttgaggatatattttcactt

SEQ ID NO: 2561659 - DNA, 15 bp, Homo sapiens
tttgaggctgcagcg

SEQ ID NO: 2561660 - DNA, 20 bp, Homo sapiens
tttgaggtttttaagcctta

SEQ ID NO: 2561661 - DNA, 21 bp, Homo sapiens
tttgagtggatgatgtttcgt

SEQ ID NO: 2561662 - DNA, 19 bp, Homo sapiens
tttgagttattttaattat

SEQ ID NO: 2561663 - DNA, 16 bp, Homo sapiens
tttgataaaataaatg

SEQ ID NO: 2561664 - DNA, 19 bp, Homo sapiens
tttgataaagtagtaaaaa

SEQ ID NO: 2561665 - DNA, 13 bp, Homo sapiens
tttgataaagttt

SEQ ID NO: 2561666 - DNA, 12 bp, Homo sapiens
tttgataatgtt

SEQ ID NO: 2561667 - DNA, 19 bp, Homo sapiens
tttgataatgttaaatttg

SEQ ID NO: 2561668 - DNA, 19 bp, Homo sapiens
tttgatacatatgtgaata

SEQ ID NO: 2561669 - DNA, 16 bp, Homo sapiens
tttgatgccaagaaag

SEQ ID NO: 2561670 - DNA, 19 bp, Homo sapiens
tttgatgctggagaggtta

SEQ ID NO: 2561671 - DNA, 11 bp, Homo sapiens
tttgatgttaa

SEQ ID NO: 2561672 - DNA, 15 bp, Homo sapiens
tttgatgttaacaca

SEQ ID NO: 2561673 - DNA, 17 bp, Homo sapiens
tttgatgttaacacatt

SEQ ID NO: 2561674 - DNA, 13 bp, Homo sapiens
tttgattaaattc

SEQ ID NO: 2561675 - DNA, 18 bp, Homo sapiens
tttgattaaattcttgca

SEQ ID NO: 2561676 - DNA, 14 bp, Homo sapiens
tttgattattgtat

SEQ ID NO: 2561677 - DNA, 14 bp, Homo sapiens
tttgatttcattaa

SEQ ID NO: 2561678 - DNA, 19 bp, Homo sapiens
tttgcaaactttattttca

SEQ ID NO: 2561679 - DNA, 21 bp, Homo sapiens
tttgcaaggaagccacagctg

SEQ ID NO: 2561680 - DNA, 21 bp, Homo sapiens
tttgcaagtcatggctgtgcc

SEQ ID NO: 2561681 - DNA, 16 bp, Homo sapiens
tttgcacagctctccg

SEQ ID NO: 2561682 - DNA, 17 bp, Homo sapiens
tttgcaccccatgctgt

SEQ ID NO: 2561683 - DNA, 18 bp, Homo sapiens
tttgcaccccatgctgtt

SEQ ID NO: 2561684 - DNA, 20 bp, Homo sapiens
tttgcaccccatgctgttga

SEQ ID NO: 2561685 - DNA, 12 bp, Homo sapiens
tttgcactgagg

SEQ ID NO: 2561686 - DNA, 16 bp, Homo sapiens
tttgcaggcatgcatg

SEQ ID NO: 2561687 - DNA, 15 bp, Homo sapiens
tttgcatatgtatga

SEQ ID NO: 2561688 - DNA, 18 bp, Homo sapiens
tttgcatggcacttgcat

SEQ ID NO: 2561689 - DNA, 20 bp, Homo sapiens
tttgcatggcacttgcatct

SEQ ID NO: 2561690 - DNA, 22 bp, Homo sapiens
tttgcatggctccagaaatgtc

SEQ ID NO: 2561691 - DNA, 14 bp, Homo sapiens
tttgcatgttccac

SEQ ID NO: 2561692 - DNA, 12 bp, Homo sapiens
tttgcattcaaa

SEQ ID NO: 2561693 - DNA, 14 bp, Homo sapiens
tttgcattcctaca

SEQ ID NO: 2561694 - DNA, 19 bp, Homo sapiens
tttgcatttaaaacagaca

SEQ ID NO: 2561695 - DNA, 16 bp, Homo sapiens
tttgccagtgggaact

SEQ ID NO: 2561696 - DNA, 18 bp, Homo sapiens
tttgccatgttggccagg

SEQ ID NO: 2561697 - DNA, 18 bp, Homo sapiens
tttgcccagaaagaagat

SEQ ID NO: 2561698 - DNA, 19 bp, Homo sapiens
tttgccctggtagggcagt

SEQ ID NO: 2561699 - DNA, 11 bp, Homo sapiens
tttgcctgtgc

SEQ ID NO: 2561700 - DNA, 12 bp, Homo sapiens
tttgcctgtgcc

SEQ ID NO: 2561701 - DNA, 12 bp, Homo sapiens
tttgccttttgc

SEQ ID NO: 2561702 - DNA, 20 bp, Homo sapiens
tttgctattgacaagtcatt

SEQ ID NO: 2561703 - DNA, 20 bp, Homo sapiens
tttgctcttcaagaaatctg

SEQ ID NO: 2561704 - DNA, 19 bp, Homo sapiens
tttgctggggccgaaagaa

SEQ ID NO: 2561705 - DNA, 17 bp, Homo sapiens
tttgcttattgttccaa

SEQ ID NO: 2561706 - DNA, 20 bp, Homo sapiens
tttgcttcataaatgaagca

SEQ ID NO: 2561707 - DNA, 16 bp, Homo sapiens
tttgcttctctctcta

SEQ ID NO: 2561708 - DNA, 14 bp, Homo sapiens
tttgcttgaaagaa

SEQ ID NO: 2561709 - DNA, 20 bp, Homo sapiens
tttgcttgcagtagattttc

SEQ ID NO: 2561710 - DNA, 21 bp, Homo sapiens
tttgcttgcagtagattttct

SEQ ID NO: 2561711 - DNA, 22 bp, Homo sapiens
tttggagaaattatttaataaa

SEQ ID NO: 2561712 - DNA, 17 bp, Homo sapiens
tttggcactggggcact

SEQ ID NO: 2561713 - DNA, 13 bp, Homo sapiens
tttggcagagttc

SEQ ID NO: 2561714 - DNA, 22 bp, Homo sapiens
tttggcaggggcagaaaactct

SEQ ID NO: 2561715 - DNA, 19 bp, Homo sapiens
tttggcgggccaaggactg

SEQ ID NO: 2561716 - DNA, 22 bp, Homo sapiens
tttgggataggaaaaatgagta

SEQ ID NO: 2561717 - DNA, 15 bp, Homo sapiens
tttgggcccagggac

SEQ ID NO: 2561718 - DNA, 13 bp, Homo sapiens
tttggggccggga

SEQ ID NO: 2561719 - DNA, 20 bp, Homo sapiens
tttggggtagctagaggaac

SEQ ID NO: 2561720 - DNA, 13 bp, Homo sapiens
tttggtccctggg

SEQ ID NO: 2561721 - DNA, 14 bp, Homo sapiens
tttggtctgggact

SEQ ID NO: 2561722 - DNA, 13 bp, Homo sapiens
tttggttctgggg

SEQ ID NO: 2561723 - DNA, 17 bp, Homo sapiens
tttggttgctttaatat

SEQ ID NO: 2561724 - DNA, 21 bp, Homo sapiens
tttgtaaaaacagcattgctt

SEQ ID NO: 2561725 - DNA, 22 bp, Homo sapiens
tttgtaaaaacagcattgcttt

SEQ ID NO: 2561726 - DNA, 21 bp, Homo sapiens
tttgtaaaagaacagtaaaca

SEQ ID NO: 2561727 - DNA, 22 bp, Homo sapiens
tttgtaaactcaaaatatttgt

SEQ ID NO: 2561728 - DNA, 22 bp, Homo sapiens
tttgtaaagtgtggtcccaaca

SEQ ID NO: 2561729 - DNA, 22 bp, Homo sapiens
tttgtaaattaacttttataaa

SEQ ID NO: 2561730 - DNA, 16 bp, Homo sapiens
tttgtaacctcagctc

SEQ ID NO: 2561731 - DNA, 18 bp, Homo sapiens
tttgtaacctcagctctg

SEQ ID NO: 2561732 - DNA, 12 bp, Homo sapiens
tttgtaagagtg

SEQ ID NO: 2561733 - DNA, 18 bp, Homo sapiens
tttgtaagagtgtagaag

SEQ ID NO: 2561734 - DNA, 23 bp, Homo sapiens
tttgtaagagtgtagaagcattc

SEQ ID NO: 2561735 - DNA, 22 bp, Homo sapiens
tttgtaagttaggtaactgtat

SEQ ID NO: 2561736 - DNA, 14 bp, Homo sapiens
tttgtaagtttcag

SEQ ID NO: 2561737 - DNA, 20 bp, Homo sapiens
tttgtaattgcttacatttt

SEQ ID NO: 2561738 - DNA, 21 bp, Homo sapiens
tttgtacaattgaacttaaat

SEQ ID NO: 2561739 - DNA, 15 bp, Homo sapiens
tttgtactgtaaaga

SEQ ID NO: 2561740 - DNA, 20 bp, Homo sapiens
tttgtactgtaaagagacct

SEQ ID NO: 2561741 - DNA, 21 bp, Homo sapiens
tttgtaggggtcaaagaaatg

SEQ ID NO: 2561742 - DNA, 17 bp, Homo sapiens
tttgtataattgtatcg

SEQ ID NO: 2561743 - DNA, 18 bp, Homo sapiens
tttgtataattgtatcgt

SEQ ID NO: 2561744 - DNA, 20 bp, Homo sapiens
tttgtataattgtatcgtat

SEQ ID NO: 2561745 - DNA, 16 bp, Homo sapiens
tttgtatagtaaagtg

SEQ ID NO: 2561746 - DNA, 22 bp, Homo sapiens
tttgtatgccaagtgagaagat

SEQ ID NO: 2561747 - DNA, 15 bp, Homo sapiens
tttgtatgtataatt

SEQ ID NO: 2561748 - DNA, 15 bp, Homo sapiens
tttgtattctctcct

SEQ ID NO: 2561749 - DNA, 16 bp, Homo sapiens
tttgtattctctgagc

SEQ ID NO: 2561750 - DNA, 21 bp, Homo sapiens
tttgtattgtttcaattgcat

SEQ ID NO: 2561751 - DNA, 10 bp, Homo sapiens
tttgtatttt

SEQ ID NO: 2561752 - DNA, 17 bp, Homo sapiens
tttgtattttgtttaaa

SEQ ID NO: 2561753 - DNA, 12 bp, Homo sapiens
tttgtcccaggt

SEQ ID NO: 2561754 - DNA, 14 bp, Homo sapiens
tttgtctaaaacaa

SEQ ID NO: 2561755 - DNA, 16 bp, Homo sapiens
tttgtctaaaacaata

SEQ ID NO: 2561756 - DNA, 19 bp, Homo sapiens
tttgtcttatatatatttc

SEQ ID NO: 2561757 - DNA, 20 bp, Homo sapiens
tttgtcttatatatatttct

SEQ ID NO: 2561758 - DNA, 21 bp, Homo sapiens
tttgtcttgtgtttctttagt

SEQ ID NO: 2561759 - DNA, 18 bp, Homo sapiens
tttgtgaatagaactctg

SEQ ID NO: 2561760 - DNA, 17 bp, Homo sapiens
tttgtgaatggattgga

SEQ ID NO: 2561761 - DNA, 14 bp, Homo sapiens
tttgtgactatata

SEQ ID NO: 2561762 - DNA, 15 bp, Homo sapiens
tttgtgatacaatgc

SEQ ID NO: 2561763 - DNA, 19 bp, Homo sapiens
tttgtgatatggagccctg

SEQ ID NO: 2561764 - DNA, 20 bp, Homo sapiens
tttgtgattcaatctgtaaa

SEQ ID NO: 2561765 - DNA, 13 bp, Homo sapiens
tttgtgctgtggg

SEQ ID NO: 2561766 - DNA, 12 bp, Homo sapiens
tttgtggaataa

SEQ ID NO: 2561767 - DNA, 14 bp, Homo sapiens
tttgtggatgtctt

SEQ ID NO: 2561768 - DNA, 20 bp, Homo sapiens
tttgtgtatttaacagggag

SEQ ID NO: 2561769 - DNA, 14 bp, Homo sapiens
tttgtgtgtagtct

SEQ ID NO: 2561770 - DNA, 13 bp, Homo sapiens
tttgtgtgtctta

SEQ ID NO: 2561771 - DNA, 18 bp, Homo sapiens
tttgtgtgttgtcttgaa

SEQ ID NO: 2561772 - DNA, 19 bp, Homo sapiens
tttgtgtgttgtcttgaaa

SEQ ID NO: 2561773 - DNA, 14 bp, Homo sapiens
tttgttctttttat

SEQ ID NO: 2561774 - DNA, 23 bp, Homo sapiens
tttgttggaaggtttggtgtgtg

SEQ ID NO: 2561775 - DNA, 14 bp, Homo sapiens
tttgtttcctttgt

SEQ ID NO: 2561776 - DNA, 15 bp, Homo sapiens
tttgtttcctttgtt

SEQ ID NO: 2561777 - DNA, 15 bp, Homo sapiens
tttgtttctacctcc

SEQ ID NO: 2561778 - DNA, 14 bp, Homo sapiens
tttgtttctgaaag

SEQ ID NO: 2561779 - DNA, 13 bp, Homo sapiens
tttgtttgaactg

SEQ ID NO: 2561780 - DNA, 22 bp, Homo sapiens
ttttaaaaatcataaactgtgt

SEQ ID NO: 2561781 - DNA, 12 bp, Homo sapiens
ttttaaaaatga

SEQ ID NO: 2561782 - DNA, 22 bp, Homo sapiens
ttttaaaaattaaatcaacctt

SEQ ID NO: 2561783 - DNA, 22 bp, Homo sapiens
ttttaaaacacttccataatct

SEQ ID NO: 2561784 - DNA, 16 bp, Homo sapiens
ttttaaaagttattaa

SEQ ID NO: 2561785 - DNA, 13 bp, Homo sapiens
ttttaaaagtttc

SEQ ID NO: 2561786 - DNA, 17 bp, Homo sapiens
ttttaaaatcttttcta

SEQ ID NO: 2561787 - DNA, 12 bp, Homo sapiens
ttttaaaatgag

SEQ ID NO: 2561788 - DNA, 23 bp, Homo sapiens
ttttaaacaaaatagaagctgta

SEQ ID NO: 2561789 - DNA, 23 bp, Homo sapiens
ttttaaactgtgtacataactga

SEQ ID NO: 2561790 - DNA, 17 bp, Homo sapiens
ttttaaataaaagtgat

SEQ ID NO: 2561791 - DNA, 11 bp, Homo sapiens
ttttaaatgca

SEQ ID NO: 2561792 - DNA, 16 bp, Homo sapiens
ttttaactagaattta

SEQ ID NO: 2561793 - DNA, 16 bp, Homo sapiens
ttttaactttaagttt

SEQ ID NO: 2561794 - DNA, 19 bp, Homo sapiens
ttttaactttaagtttcag

SEQ ID NO: 2561795 - DNA, 21 bp, Homo sapiens
ttttaagataataatatatgt

SEQ ID NO: 2561796 - DNA, 12 bp, Homo sapiens
ttttaagatttt

SEQ ID NO: 2561797 - DNA, 21 bp, Homo sapiens
ttttaagatttttctcaaagt

SEQ ID NO: 2561798 - DNA, 12 bp, Homo sapiens
ttttaagctgtt

SEQ ID NO: 2561799 - DNA, 17 bp, Homo sapiens
ttttaagtatttatata

SEQ ID NO: 2561800 - DNA, 16 bp, Homo sapiens
ttttaagtgctgcatt

SEQ ID NO: 2561801 - DNA, 21 bp, Homo sapiens
ttttaagtgctgcatttaaaa

SEQ ID NO: 2561802 - DNA, 19 bp, Homo sapiens
ttttaagtgctttgtaatg

SEQ ID NO: 2561803 - DNA, 22 bp, Homo sapiens
ttttaatcagacaaagtaattc

SEQ ID NO: 2561804 - DNA, 20 bp, Homo sapiens
ttttaatgggggtagcagct

SEQ ID NO: 2561805 - DNA, 18 bp, Homo sapiens
ttttaatgtgctgtgtaa

SEQ ID NO: 2561806 - DNA, 13 bp, Homo sapiens
ttttaattaaatg

SEQ ID NO: 2561807 - DNA, 22 bp, Homo sapiens
ttttaattaatgaaatatctgt

SEQ ID NO: 2561808 - DNA, 11 bp, Homo sapiens
ttttaattatt

SEQ ID NO: 2561809 - DNA, 17 bp, Homo sapiens
ttttaattattattctt

SEQ ID NO: 2561810 - DNA, 18 bp, Homo sapiens
ttttaattccaatatgat

SEQ ID NO: 2561811 - DNA, 19 bp, Homo sapiens
ttttaattccaatatgatg

SEQ ID NO: 2561812 - DNA, 22 bp, Homo sapiens
ttttaattccaatatgatgact

SEQ ID NO: 2561813 - DNA, 22 bp, Homo sapiens
ttttaatttatttattaagatg

SEQ ID NO: 2561814 - DNA, 13 bp, Homo sapiens
ttttaattttgta

SEQ ID NO: 2561815 - DNA, 19 bp, Homo sapiens
ttttacaaaaaagaaaaga

SEQ ID NO: 2561816 - DNA, 18 bp, Homo sapiens
ttttacaataaataatct

SEQ ID NO: 2561817 - DNA, 17 bp, Homo sapiens
ttttaccgtttcttccc

SEQ ID NO: 2561818 - DNA, 14 bp, Homo sapiens
ttttactgccactc

SEQ ID NO: 2561819 - DNA, 17 bp, Homo sapiens
ttttacttttaaactgt

SEQ ID NO: 2561820 - DNA, 20 bp, Homo sapiens
ttttacttttaaactgtgta

SEQ ID NO: 2561821 - DNA, 19 bp, Homo sapiens
ttttacttttataataaaa

SEQ ID NO: 2561822 - DNA, 20 bp, Homo sapiens
ttttagacaaatactcatgt

SEQ ID NO: 2561823 - DNA, 21 bp, Homo sapiens
ttttagacaaatactcatgtg

SEQ ID NO: 2561824 - DNA, 11 bp, Homo sapiens
ttttagcatgt

SEQ ID NO: 2561825 - DNA, 21 bp, Homo sapiens
ttttagctgatgaacttattc

SEQ ID NO: 2561826 - DNA, 20 bp, Homo sapiens
ttttaggccaaaaaaatgta

SEQ ID NO: 2561827 - DNA, 15 bp, Homo sapiens
ttttagtagagacag

SEQ ID NO: 2561828 - DNA, 13 bp, Homo sapiens
ttttagtcacttt

SEQ ID NO: 2561829 - DNA, 14 bp, Homo sapiens
ttttagtcactttt

SEQ ID NO: 2561830 - DNA, 18 bp, Homo sapiens
ttttagtgattttaataa

SEQ ID NO: 2561831 - DNA, 16 bp, Homo sapiens
ttttagttctttggaa

SEQ ID NO: 2561832 - DNA, 17 bp, Homo sapiens
ttttataaactttacct

SEQ ID NO: 2561833 - DNA, 20 bp, Homo sapiens
ttttataactagtcctttac

SEQ ID NO: 2561834 - DNA, 15 bp, Homo sapiens
ttttatatatacagt

SEQ ID NO: 2561835 - DNA, 20 bp, Homo sapiens
ttttatatcaatttaaaaaa

SEQ ID NO: 2561836 - DNA, 17 bp, Homo sapiens
ttttatattaaaataag

SEQ ID NO: 2561837 - DNA, 23 bp, Homo sapiens
ttttatattaaaataagcactgt

SEQ ID NO: 2561838 - DNA, 17 bp, Homo sapiens
ttttatcacatgtatgt

SEQ ID NO: 2561839 - DNA, 12 bp, Homo sapiens
ttttatcagtag

SEQ ID NO: 2561840 - DNA, 15 bp, Homo sapiens
ttttatcatgacatg

SEQ ID NO: 2561841 - DNA, 19 bp, Homo sapiens
ttttatcatgacatgttat

SEQ ID NO: 2561842 - DNA, 19 bp, Homo sapiens
ttttatcattttcaaaatg

SEQ ID NO: 2561843 - DNA, 19 bp, Homo sapiens
ttttatgccttttatttct

SEQ ID NO: 2561844 - DNA, 19 bp, Homo sapiens
ttttattaataaacattct

SEQ ID NO: 2561845 - DNA, 13 bp, Homo sapiens
ttttattatgcat

SEQ ID NO: 2561846 - DNA, 19 bp, Homo sapiens
ttttattgaatctatttaa

SEQ ID NO: 2561847 - DNA, 20 bp, Homo sapiens
ttttattgtataaactatca

SEQ ID NO: 2561848 - DNA, 15 bp, Homo sapiens
ttttatttattttat

SEQ ID NO: 2561849 - DNA, 11 bp, Homo sapiens
ttttattttat

SEQ ID NO: 2561850 - DNA, 17 bp, Homo sapiens
ttttcaaaataaaaatg

SEQ ID NO: 2561851 - DNA, 14 bp, Homo sapiens
ttttcaagaaactg

SEQ ID NO: 2561852 - DNA, 12 bp, Homo sapiens
ttttcaattaaa

SEQ ID NO: 2561853 - DNA, 14 bp, Homo sapiens
ttttcaattaaacg

SEQ ID NO: 2561854 - DNA, 22 bp, Homo sapiens
ttttcaattaaacggattattt

SEQ ID NO: 2561855 - DNA, 23 bp, Homo sapiens
ttttcacacaatacaataagtta

SEQ ID NO: 2561856 - DNA, 20 bp, Homo sapiens
ttttcaccccacccttcccc

SEQ ID NO: 2561857 - DNA, 23 bp, Homo sapiens
ttttcacctgtttttaagctgtt

SEQ ID NO: 2561858 - DNA, 19 bp, Homo sapiens
ttttcagatataaaagact

SEQ ID NO: 2561859 - DNA, 18 bp, Homo sapiens
ttttcagcaaactctttt

SEQ ID NO: 2561860 - DNA, 18 bp, Homo sapiens
ttttcagcgatgtatgca

SEQ ID NO: 2561861 - DNA, 16 bp, Homo sapiens
ttttcagtattttgga

SEQ ID NO: 2561862 - DNA, 15 bp, Homo sapiens
ttttcagtcatataa

SEQ ID NO: 2561863 - DNA, 14 bp, Homo sapiens
ttttcagttttcag

SEQ ID NO: 2561864 - DNA, 12 bp, Homo sapiens
ttttcataataa

SEQ ID NO: 2561865 - DNA, 16 bp, Homo sapiens
ttttcatattgtgcca

SEQ ID NO: 2561866 - DNA, 15 bp, Homo sapiens
ttttcatctgggaaa

SEQ ID NO: 2561867 - DNA, 15 bp, Homo sapiens
ttttcatctgttgtt

SEQ ID NO: 2561868 - DNA, 18 bp, Homo sapiens
ttttcatggtgaaaatgt

SEQ ID NO: 2561869 - DNA, 21 bp, Homo sapiens
ttttcatggtgaaaatgtact

SEQ ID NO: 2561870 - DNA, 18 bp, Homo sapiens
ttttccaagtgtgcatat

SEQ ID NO: 2561871 - DNA, 13 bp, Homo sapiens
ttttccactactg

SEQ ID NO: 2561872 - DNA, 15 bp, Homo sapiens
ttttccactactgct

SEQ ID NO: 2561873 - DNA, 16 bp, Homo sapiens
ttttccatgaaaacgt

SEQ ID NO: 2561874 - DNA, 18 bp, Homo sapiens
ttttccatgagtcccctg

SEQ ID NO: 2561875 - DNA, 12 bp, Homo sapiens
ttttcccctccc

SEQ ID NO: 2561876 - DNA, 18 bp, Homo sapiens
ttttccctattagagaag

SEQ ID NO: 2561877 - DNA, 22 bp, Homo sapiens
ttttccctattagagaagagat

SEQ ID NO: 2561878 - DNA, 14 bp, Homo sapiens
aacaagtgctggca

SEQ ID NO: 2561879 - DNA, 15 bp, Homo sapiens
aacaataaatgtgca

SEQ ID NO: 2561880 - DNA, 13 bp, Homo sapiens
acactccttcaca

SEQ ID NO: 2561881 - DNA, 23 bp, Homo sapiens
acactcgcccgcccactgtcctg

SEQ ID NO: 2561882 - DNA, 14 bp, Homo sapiens
acactctggctggt

SEQ ID NO: 2561883 - DNA, 20 bp, Homo sapiens
acactgaaatatacacacag

SEQ ID NO: 2561884 - DNA, 21 bp, Homo sapiens
acactgaaatatacacacagc

SEQ ID NO: 2561885 - DNA, 21 bp, Homo sapiens
acactgaagctcttgaagaca

SEQ ID NO: 2561886 - DNA, 24 bp, Homo sapiens
ctgggaagataggctctgcacaga

SEQ ID NO: 2561887 - DNA, 18 bp, Homo sapiens
ctgggaatgtattattct

SEQ ID NO: 2561888 - DNA, 22 bp, Homo sapiens
ctgggaatgtattattctgcag

SEQ ID NO: 2561889 - DNA, 20 bp, Homo sapiens
ctgggacctttagtggtggc

SEQ ID NO: 2561890 - DNA, 16 bp, Homo sapiens
ctgggactacaggcac

SEQ ID NO: 2561891 - DNA, 15 bp, Homo sapiens
ctgggactgagccag

SEQ ID NO: 2561892 - DNA, 16 bp, Homo sapiens
ctgggactgagccagt

SEQ ID NO: 2561893 - DNA, 13 bp, Homo sapiens
ctgggactggcca

SEQ ID NO: 2561894 - DNA, 18 bp, Homo sapiens
ctgggagaacctcaggct

SEQ ID NO: 2561895 - DNA, 17 bp, Homo sapiens
ctgggagagccttccag

SEQ ID NO: 2561896 - DNA, 18 bp, Homo sapiens
ctgggagagccttccagg

SEQ ID NO: 2561897 - DNA, 21 bp, Homo sapiens
ctgggagagccttccaggggt

SEQ ID NO: 2561898 - DNA, 17 bp, Homo sapiens
ctgggaggcaagagggg

SEQ ID NO: 2561899 - DNA, 22 bp, Homo sapiens
ctgggaggcatggccctggggt

SEQ ID NO: 2561900 - DNA, 11 bp, Homo sapiens
ctgggagggca

SEQ ID NO: 2561901 - DNA, 19 bp, Homo sapiens
ctgggaggtcaaggctgca

SEQ ID NO: 2561902 - DNA, 14 bp, Homo sapiens
ctgggagtcccctt

SEQ ID NO: 2561903 - DNA, 16 bp, Homo sapiens
ctgggagtgagctggt

SEQ ID NO: 2561904 - DNA, 23 bp, Homo sapiens
ctgggagttgatcgcctttccca

SEQ ID NO: 2561905 - DNA, 16 bp, Homo sapiens
atcttgaattgtaact

SEQ ID NO: 2561906 - DNA, 19 bp, Homo sapiens
atcttgaccaagcaggaag

SEQ ID NO: 2561907 - DNA, 22 bp, Homo sapiens
atcttgaccaagcaggaagctc

SEQ ID NO: 2561908 - DNA, 17 bp, Homo sapiens
atcttgactacagtcag

SEQ ID NO: 2561909 - DNA, 17 bp, Homo sapiens
atcttgctctgtaatct

SEQ ID NO: 2561910 - DNA, 14 bp, Homo sapiens
atcttggactgaca

SEQ ID NO: 2561911 - DNA, 19 bp, Homo sapiens
atcttggactgacatttag

SEQ ID NO: 2561912 - DNA, 13 bp, Homo sapiens
atcttgggactgg

SEQ ID NO: 2561913 - DNA, 23 bp, Homo sapiens
atcttgggggacagggctggccc

SEQ ID NO: 2561914 - DNA, 22 bp, Homo sapiens
atcttggtactactagatgtct

SEQ ID NO: 2561915 - DNA, 20 bp, Homo sapiens
atcttggtcagatttgaact

SEQ ID NO: 2561916 - DNA, 14 bp, Homo sapiens
atcttgtctctggg

SEQ ID NO: 2561917 - DNA, 12 bp, Homo sapiens
atctttcaggaa

SEQ ID NO: 2561918 - DNA, 13 bp, Homo sapiens
atctttctgcaga

SEQ ID NO: 2561919 - DNA, 11 bp, Homo sapiens
atctttcttct

SEQ ID NO: 2561920 - DNA, 20 bp, Homo sapiens
atctttctttacctgagacc

SEQ ID NO: 2561921 - DNA, 21 bp, Homo sapiens
atctttctttacctgagacca

SEQ ID NO: 2561922 - DNA, 21 bp, Homo sapiens
atctttcttttgattcttcct

SEQ ID NO: 2561923 - DNA, 19 bp, Homo sapiens
atctttgcaggttgctttg

SEQ ID NO: 2561924 - DNA, 22 bp, Homo sapiens
atctttgccttgggctgctcct

SEQ ID NO: 2561925 - DNA, 14 bp, Homo sapiens
atcttttcacaaat

SEQ ID NO: 2561926 - DNA, 16 bp, Homo sapiens
atcttttcacaaataa

SEQ ID NO: 2561927 - DNA, 15 bp, Homo sapiens
atcttttgtatagtt

SEQ ID NO: 2561928 - DNA, 23 bp, Homo sapiens
atcttttgtgagatgtaattgtt

SEQ ID NO: 2561929 - DNA, 16 bp, Homo sapiens
atcttttttagcataa

SEQ ID NO: 2561930 - DNA, 14 bp, Homo sapiens
atcttttttcacaa

SEQ ID NO: 2561931 - DNA, 18 bp, Homo sapiens
atgaaaaatttaagcatt

SEQ ID NO: 2561932 - DNA, 21 bp, Homo sapiens
atgaaaaatttaagcattgtt

SEQ ID NO: 2561933 - DNA, 15 bp, Homo sapiens
atgaaaacacatttt

SEQ ID NO: 2561934 - DNA, 19 bp, Homo sapiens
atgaaaacgttttattgtg

SEQ ID NO: 2561935 - DNA, 20 bp, Homo sapiens
atgaaaacgttttattgtgt

SEQ ID NO: 2561936 - DNA, 17 bp, Homo sapiens
atgaaaatacaacttaa

SEQ ID NO: 2561937 - DNA, 22 bp, Homo sapiens
atgaaaatacaacttaaataat

SEQ ID NO: 2561938 - DNA, 19 bp, Homo sapiens
atgaaaatgtcagaaacca

SEQ ID NO: 2561939 - DNA, 13 bp, Homo sapiens
atgaaaatgtctt

SEQ ID NO: 2561940 - DNA, 16 bp, Homo sapiens
atgaaacaccttctct

SEQ ID NO: 2561941 - DNA, 18 bp, Homo sapiens
atgaaacagaaacaaaaa

SEQ ID NO: 2561942 - DNA, 15 bp, Homo sapiens
atgaaacccccacac

SEQ ID NO: 2561943 - DNA, 17 bp, Homo sapiens
atgaaacccccacacac

SEQ ID NO: 2561944 - DNA, 14 bp, Homo sapiens
atgaaagaaaggcc

SEQ ID NO: 2561945 - DNA, 19 bp, Homo sapiens
atgaaagactgtacaaagt

SEQ ID NO: 2561946 - DNA, 13 bp, Homo sapiens
atgaaagaggagg

SEQ ID NO: 2561947 - DNA, 12 bp, Homo sapiens
atgaaagcatgt

SEQ ID NO: 2561948 - DNA, 21 bp, Homo sapiens
atgaaaggtttacattgtcaa

SEQ ID NO: 2561949 - DNA, 19 bp, Homo sapiens
atgaaatacacaagtaaac

SEQ ID NO: 2561950 - DNA, 22 bp, Homo sapiens
atgaaatactgtttgaggtttt

SEQ ID NO: 2561951 - DNA, 14 bp, Homo sapiens
atgaaatgaggtca

SEQ ID NO: 2561952 - DNA, 16 bp, Homo sapiens
atgaaatggttaagaa

SEQ ID NO: 2561953 - DNA, 16 bp, Homo sapiens
atgaaattacttatca

SEQ ID NO: 2561954 - DNA, 20 bp, Homo sapiens
atgaaattgtctagcagagc

SEQ ID NO: 2561955 - DNA, 23 bp, Homo sapiens
atgaaattgtctagcagagcagg

SEQ ID NO: 2561956 - DNA, 21 bp, Homo sapiens
atgaacatattgttgaaaggt

SEQ ID NO: 2561957 - DNA, 21 bp, Homo sapiens
atgaacccaggacgcttctga

SEQ ID NO: 2561958 - DNA, 22 bp, Homo sapiens
atgaacccaggacgcttctgaa

SEQ ID NO: 2561959 - DNA, 17 bp, Homo sapiens
atgaacctggagggcta

SEQ ID NO: 2561960 - DNA, 13 bp, Homo sapiens
atgaactattccc

SEQ ID NO: 2561961 - DNA, 22 bp, Homo sapiens
atgaacttcgcatcaaaagaca

SEQ ID NO: 2561962 - DNA, 19 bp, Homo sapiens
atgaagaaaagtgggccag

SEQ ID NO: 2561963 - DNA, 22 bp, Homo sapiens
atgaagaaaagtgggccagtgt

SEQ ID NO: 2561964 - DNA, 14 bp, Homo sapiens
atgaagaaagtgga

SEQ ID NO: 2561965 - DNA, 15 bp, Homo sapiens
atgaagaactgagga

SEQ ID NO: 2561966 - DNA, 16 bp, Homo sapiens
atgaagacaggacagt

SEQ ID NO: 2561967 - DNA, 18 bp, Homo sapiens
atgaagagtgagagggca

SEQ ID NO: 2561968 - DNA, 20 bp, Homo sapiens
atgaagatcatatacgtgaa

SEQ ID NO: 2561969 - DNA, 21 bp, Homo sapiens
atgaagatgtctaatagttat

SEQ ID NO: 2561970 - DNA, 19 bp, Homo sapiens
atgaagattctcctgtgct

SEQ ID NO: 2561971 - DNA, 12 bp, Homo sapiens
atgaagcccaag

SEQ ID NO: 2561972 - DNA, 14 bp, Homo sapiens
atgaagctacctca

SEQ ID NO: 2561973 - DNA, 15 bp, Homo sapiens
atgaagctacctcaa

SEQ ID NO: 2561974 - DNA, 22 bp, Homo sapiens
atgaaggcagaaaaatgtcatt

SEQ ID NO: 2561975 - DNA, 21 bp, Homo sapiens
atgaaggttaggatttaacag

SEQ ID NO: 2561976 - DNA, 14 bp, Homo sapiens
atgaagtaatatgc

SEQ ID NO: 2561977 - DNA, 21 bp, Homo sapiens
atgaagtactcatacatgtta

SEQ ID NO: 2561978 - DNA, 18 bp, Homo sapiens
atgaagtcgttgtgaggg

SEQ ID NO: 2561979 - DNA, 18 bp, Homo sapiens
atgaagtgttagatagaa

SEQ ID NO: 2561980 - DNA, 15 bp, Homo sapiens
atgaataatttccca

SEQ ID NO: 2561981 - DNA, 21 bp, Homo sapiens
atgaatacagggcatgcattt

SEQ ID NO: 2561982 - DNA, 14 bp, Homo sapiens
atgaatcaaagaca

SEQ ID NO: 2561983 - DNA, 21 bp, Homo sapiens
atgaatcccacccacatgtga

SEQ ID NO: 2561984 - DNA, 17 bp, Homo sapiens
atgaatcgcttctcttt

SEQ ID NO: 2561985 - DNA, 20 bp, Homo sapiens
atgaatcgcttctcttttga

SEQ ID NO: 2561986 - DNA, 14 bp, Homo sapiens
atgaatctaagcag

SEQ ID NO: 2561987 - DNA, 20 bp, Homo sapiens
atgaatgcccccagctggcc

SEQ ID NO: 2561988 - DNA, 23 bp, Homo sapiens
atgaatggctcactatggtgcca

SEQ ID NO: 2561989 - DNA, 18 bp, Homo sapiens
atgaatgggcaaaactga

SEQ ID NO: 2561990 - DNA, 21 bp, Homo sapiens
atgaatgggctgagctgcctg

SEQ ID NO: 2561991 - DNA, 11 bp, Homo sapiens
atgaatgttta

SEQ ID NO: 2561992 - DNA, 14 bp, Homo sapiens
atgaattaaataaa

SEQ ID NO: 2561993 - DNA, 17 bp, Homo sapiens
atgaattcttatgctta

SEQ ID NO: 2561994 - DNA, 11 bp, Homo sapiens
atgaatttaaa

SEQ ID NO: 2561995 - DNA, 14 bp, Homo sapiens
atgaatttaaatat

SEQ ID NO: 2561996 - DNA, 23 bp, Homo sapiens
atgaatttaaatataattctgta

SEQ ID NO: 2561997 - DNA, 18 bp, Homo sapiens
atgaattttcaagtaatt

SEQ ID NO: 2561998 - DNA, 22 bp, Homo sapiens
atgaatttttttcatcttctct

SEQ ID NO: 2561999 - DNA, 15 bp, Homo sapiens
atgacaactttgcca

SEQ ID NO: 2562000 - DNA, 16 bp, Homo sapiens
atgacaagccccaggc

SEQ ID NO: 2562001 - DNA, 18 bp, Homo sapiens
atgacatcaccacagttt

SEQ ID NO: 2562002 - DNA, 17 bp, Homo sapiens
atgacatgttatatatt

SEQ ID NO: 2562003 - DNA, 23 bp, Homo sapiens
atgacatgttatatattttttgt

SEQ ID NO: 2562004 - DNA, 23 bp, Homo sapiens
atgacattgctaagatgctctat

SEQ ID NO: 2562005 - DNA, 23 bp, Homo sapiens
atgaccaatattatactaagaaa

SEQ ID NO: 2562006 - DNA, 13 bp, Homo sapiens
atgacccaaagac

SEQ ID NO: 2562007 - DNA, 13 bp, Homo sapiens
atgacccacccct

SEQ ID NO: 2562008 - DNA, 14 bp, Homo sapiens
atgacccacccctg

SEQ ID NO: 2562009 - DNA, 17 bp, Homo sapiens
atgacccacccctgtgc

SEQ ID NO: 2562010 - DNA, 14 bp, Homo sapiens
atgacccaggctgg

SEQ ID NO: 2562011 - DNA, 21 bp, Homo sapiens
atgacggaagaacatagaact

SEQ ID NO: 2562012 - DNA, 14 bp, Homo sapiens
atgactaaaaatat

SEQ ID NO: 2562013 - DNA, 23 bp, Homo sapiens
atgactaaaaatattataactta

SEQ ID NO: 2562014 - DNA, 21 bp, Homo sapiens
atgactaaagagagaatgtag

SEQ ID NO: 2562015 - DNA, 22 bp, Homo sapiens
atgactagaggcagggagggga

SEQ ID NO: 2562016 - DNA, 17 bp, Homo sapiens
atgactcacatgatgca

SEQ ID NO: 2562017 - DNA, 22 bp, Homo sapiens
atgactgctccccagccctggc

SEQ ID NO: 2562018 - DNA, 17 bp, Homo sapiens
atgactgtagaatttgt

SEQ ID NO: 2562019 - DNA, 17 bp, Homo sapiens
atgacttactgtacatg

SEQ ID NO: 2562020 - DNA, 16 bp, Homo sapiens
atgacttcattaataa

SEQ ID NO: 2562021 - DNA, 23 bp, Homo sapiens
atgactttatatggatgattcag

SEQ ID NO: 2562022 - DNA, 13 bp, Homo sapiens
atgactttattgc

SEQ ID NO: 2562023 - DNA, 14 bp, Homo sapiens
atgagaaaagaggc

SEQ ID NO: 2562024 - DNA, 14 bp, Homo sapiens
atgagaactctgag

SEQ ID NO: 2562025 - DNA, 16 bp, Homo sapiens
atgagaagagggcctg

SEQ ID NO: 2562026 - DNA, 21 bp, Homo sapiens
atgagaagagggcctgtggga

SEQ ID NO: 2562027 - DNA, 21 bp, Homo sapiens
atgagacccattcctatttct

SEQ ID NO: 2562028 - DNA, 16 bp, Homo sapiens
atgagagcccagaggt

SEQ ID NO: 2562029 - DNA, 22 bp, Homo sapiens
atgagagcccagaggtaacaga

SEQ ID NO: 2562030 - DNA, 13 bp, Homo sapiens
atgagagtcactt

SEQ ID NO: 2562031 - DNA, 18 bp, Homo sapiens
atgagatcaggctctgcc

SEQ ID NO: 2562032 - DNA, 15 bp, Homo sapiens
atgagcatcaggcca

SEQ ID NO: 2562033 - DNA, 16 bp, Homo sapiens
atgagcatcaggccag

SEQ ID NO: 2562034 - DNA, 20 bp, Homo sapiens
atgagcatcaggccaggccc

SEQ ID NO: 2562035 - DNA, 22 bp, Homo sapiens
atgagcatcaggccaggccctc

SEQ ID NO: 2562036 - DNA, 14 bp, Homo sapiens
atgagcatcccagg

SEQ ID NO: 2562037 - DNA, 15 bp, Homo sapiens
atgagcatggagctg

SEQ ID NO: 2562038 - DNA, 18 bp, Homo sapiens
atgagcatggagctggcc

SEQ ID NO: 2562039 - DNA, 14 bp, Homo sapiens
atgagccagacaaa

SEQ ID NO: 2562040 - DNA, 17 bp, Homo sapiens
atgagcctcagcatcct

SEQ ID NO: 2562041 - DNA, 18 bp, Homo sapiens
atgagcctcagcatcctg

SEQ ID NO: 2562042 - DNA, 13 bp, Homo sapiens
atgagctccagac

SEQ ID NO: 2562043 - DNA, 14 bp, Homo sapiens
atgagctccagacc

SEQ ID NO: 2562044 - DNA, 15 bp, Homo sapiens
atgagctccagaccc

SEQ ID NO: 2562045 - DNA, 13 bp, Homo sapiens
atgtctgttacca

SEQ ID NO: 2562046 - DNA, 20 bp, Homo sapiens
atgtctgttaccatgtcact

SEQ ID NO: 2562047 - DNA, 21 bp, Homo sapiens
atgtcttcatacctacatgta

SEQ ID NO: 2562048 - DNA, 19 bp, Homo sapiens
atgtcttcatttcattgta

SEQ ID NO: 2562049 - DNA, 22 bp, Homo sapiens
atgtcttcgtacagttcttcgg

SEQ ID NO: 2562050 - DNA, 23 bp, Homo sapiens
atgtcttgatgcatgcactgttc

SEQ ID NO: 2562051 - DNA, 20 bp, Homo sapiens
atgtcttggacactgtacaa

SEQ ID NO: 2562052 - DNA, 17 bp, Homo sapiens
atgtcttgtacatgtgt

SEQ ID NO: 2562053 - DNA, 16 bp, Homo sapiens
atgtcttttgaatatt

SEQ ID NO: 2562054 - DNA, 18 bp, Homo sapiens
atgtctttttaagcttat

SEQ ID NO: 2562055 - DNA, 20 bp, Homo sapiens
atgtctttttaagcttattt

SEQ ID NO: 2562056 - DNA, 17 bp, Homo sapiens
atgtcttttttttaatg

SEQ ID NO: 2562057 - DNA, 16 bp, Homo sapiens
atgtgaaaatcaaata

SEQ ID NO: 2562058 - DNA, 18 bp, Homo sapiens
atgtgaaaatcaaataca

SEQ ID NO: 2562059 - DNA, 22 bp, Homo sapiens
atgtgaaaatggtccaggagaa

SEQ ID NO: 2562060 - DNA, 12 bp, Homo sapiens
atgtgaaacctt

SEQ ID NO: 2562061 - DNA, 21 bp, Homo sapiens
atgtgaaaccttttttaagat

SEQ ID NO: 2562062 - DNA, 23 bp, Homo sapiens
atgtgaaaccttttttaagattt

SEQ ID NO: 2562063 - DNA, 22 bp, Homo sapiens
atgtgaaactggattaaactta

SEQ ID NO: 2562064 - DNA, 13 bp, Homo sapiens
atgtgaacccggg

SEQ ID NO: 2562065 - DNA, 14 bp, Homo sapiens
atgtgaagtgttaa

SEQ ID NO: 2562066 - DNA, 20 bp, Homo sapiens
atgtgaagtgttaatactag

SEQ ID NO: 2562067 - DNA, 18 bp, Homo sapiens
atgtgaattgcctgcaga

SEQ ID NO: 2562068 - DNA, 18 bp, Homo sapiens
atgtgacaattttgtaca

SEQ ID NO: 2562069 - DNA, 14 bp, Homo sapiens
atgtgagactggtt

SEQ ID NO: 2562070 - DNA, 15 bp, Homo sapiens
atgtgagagaaagtg

SEQ ID NO: 2562071 - DNA, 20 bp, Homo sapiens
atgtgataaggatcagaaca

SEQ ID NO: 2562072 - DNA, 13 bp, Homo sapiens
atgtgatttaata

SEQ ID NO: 2562073 - DNA, 16 bp, Homo sapiens
atgtgattttaactct

SEQ ID NO: 2562074 - DNA, 18 bp, Homo sapiens
atgtgattttaactctgt

SEQ ID NO: 2562075 - DNA, 21 bp, Homo sapiens
atgtgcatttttgtgaaatga

SEQ ID NO: 2562076 - DNA, 15 bp, Homo sapiens
atgtgccaaggtggg

SEQ ID NO: 2562077 - DNA, 21 bp, Homo sapiens
atgtgccaggtttttggtctg

SEQ ID NO: 2562078 - DNA, 18 bp, Homo sapiens
atgtgccattttaaaaaa

SEQ ID NO: 2562079 - DNA, 18 bp, Homo sapiens
atgtgccgaatgtgcagg

SEQ ID NO: 2562080 - DNA, 22 bp, Homo sapiens
atgtggctgtatcttgtttttc

SEQ ID NO: 2562081 - DNA, 17 bp, Homo sapiens
atgtgggggtctgtgtg

SEQ ID NO: 2562082 - DNA, 16 bp, Homo sapiens
atgtgggtcaaggaat

SEQ ID NO: 2562083 - DNA, 18 bp, Homo sapiens
atgtggtgaggcaggctt

SEQ ID NO: 2562084 - DNA, 21 bp, Homo sapiens
atgtggtgggacagggaccca

SEQ ID NO: 2562085 - DNA, 22 bp, Homo sapiens
atgtgtacaaaagtttcatcct

SEQ ID NO: 2562086 - DNA, 21 bp, Homo sapiens
atgtgtacatcccatgtaaca

SEQ ID NO: 2562087 - DNA, 16 bp, Homo sapiens
atgtgtacatggcaga

SEQ ID NO: 2562088 - DNA, 15 bp, Homo sapiens
atgtgtagcctgtgc

SEQ ID NO: 2562089 - DNA, 17 bp, Homo sapiens
atgtgtagcctgtgcat

SEQ ID NO: 2562090 - DNA, 23 bp, Homo sapiens
atgtgtagcctgtgcatgtatgt

SEQ ID NO: 2562091 - DNA, 13 bp, Homo sapiens
atgtgtcctggtt

SEQ ID NO: 2562092 - DNA, 22 bp, Homo sapiens
atgtgtgaggagctgctggctt

SEQ ID NO: 2562093 - DNA, 17 bp, Homo sapiens
atgtgtgagtgtgtgca

SEQ ID NO: 2562094 - DNA, 20 bp, Homo sapiens
atgtgtgccatagagtttaa

SEQ ID NO: 2562095 - DNA, 18 bp, Homo sapiens
atgtgtgcgagtgtgtgc

SEQ ID NO: 2562096 - DNA, 20 bp, Homo sapiens
atgtgtgtagacaaatattt

SEQ ID NO: 2562097 - DNA, 22 bp, Homo sapiens
atgtgtgtccacgactgtctcc

SEQ ID NO: 2562098 - DNA, 23 bp, Homo sapiens
atgtgtgtccacgactgtctcca

SEQ ID NO: 2562099 - DNA, 15 bp, Homo sapiens
atgtgtgtgctcagg

SEQ ID NO: 2562100 - DNA, 21 bp, Homo sapiens
atgtgtgtgtatgctactaca

SEQ ID NO: 2562101 - DNA, 18 bp, Homo sapiens
atgtgtgtgtgttgtgtg

SEQ ID NO: 2562102 - DNA, 16 bp, Homo sapiens
atgtgtgtttaaataa

SEQ ID NO: 2562103 - DNA, 14 bp, Homo sapiens
atgttaaatttgta

SEQ ID NO: 2562104 - DNA, 15 bp, Homo sapiens
atgttaaatttgtaa

SEQ ID NO: 2562105 - DNA, 22 bp, Homo sapiens
atgttaaatttgtaagtttcag

SEQ ID NO: 2562106 - DNA, 12 bp, Homo sapiens
atgttaacacat

SEQ ID NO: 2562107 - DNA, 13 bp, Homo sapiens
atgttaacacatt

SEQ ID NO: 2562108 - DNA, 18 bp, Homo sapiens
atgttaacacattttgta

SEQ ID NO: 2562109 - DNA, 20 bp, Homo sapiens
atgttaacacattttgtata

SEQ ID NO: 2562110 - DNA, 23 bp, Homo sapiens
atgttaaccagaataaagttctg

SEQ ID NO: 2562111 - DNA, 17 bp, Homo sapiens
atgttaaggaaactctt

SEQ ID NO: 2562112 - DNA, 23 bp, Homo sapiens
atgttaaggaaactcttatctca

SEQ ID NO: 2562113 - DNA, 17 bp, Homo sapiens
atgttacactaagggtg

SEQ ID NO: 2562114 - DNA, 14 bp, Homo sapiens
atgttactgaccag

SEQ ID NO: 2562115 - DNA, 13 bp, Homo sapiens
atgttactgatca

SEQ ID NO: 2562116 - DNA, 16 bp, Homo sapiens
atgttactgatcatgc

SEQ ID NO: 2562117 - DNA, 19 bp, Homo sapiens
atgttactgatcatgcatt

SEQ ID NO: 2562118 - DNA, 23 bp, Homo sapiens
atgttagaggatccctctctgga

SEQ ID NO: 2562119 - DNA, 14 bp, Homo sapiens
atgttatgtaaaag

SEQ ID NO: 2562120 - DNA, 21 bp, Homo sapiens
atgttatgtaaaaggccaaac

SEQ ID NO: 2562121 - DNA, 19 bp, Homo sapiens
atgttattttttaattatt

SEQ ID NO: 2562122 - DNA, 18 bp, Homo sapiens
atgttcacttttgacaaa

SEQ ID NO: 2562123 - DNA, 20 bp, Homo sapiens
atgttcacttttgacaaagg

SEQ ID NO: 2562124 - DNA, 22 bp, Homo sapiens
atgttcacttttgacaaaggca

SEQ ID NO: 2562125 - DNA, 23 bp, Homo sapiens
atgttcagaaggttgctctagat

SEQ ID NO: 2562126 - DNA, 20 bp, Homo sapiens
atgttcagattgctttgatt

SEQ ID NO: 2562127 - DNA, 16 bp, Homo sapiens
atgttcagtgtaattt

SEQ ID NO: 2562128 - DNA, 21 bp, Homo sapiens
atgttcagtgtaatttctttg

SEQ ID NO: 2562129 - DNA, 19 bp, Homo sapiens
atgttcatcaatgaatgaa

SEQ ID NO: 2562130 - DNA, 22 bp, Homo sapiens
atgttcattgtaatgttactga

SEQ ID NO: 2562131 - DNA, 23 bp, Homo sapiens
atgttcctgaattctatttgctg

SEQ ID NO: 2562132 - DNA, 16 bp, Homo sapiens
atgttctctcttctcc

SEQ ID NO: 2562133 - DNA, 17 bp, Homo sapiens
atgttctctgaggacac

SEQ ID NO: 2562134 - DNA, 14 bp, Homo sapiens
atgttctgacatta

SEQ ID NO: 2562135 - DNA, 16 bp, Homo sapiens
atgttctgacattaac

SEQ ID NO: 2562136 - DNA, 13 bp, Homo sapiens
atgttctggccct

SEQ ID NO: 2562137 - DNA, 13 bp, Homo sapiens
atgttctgggaca

SEQ ID NO: 2562138 - DNA, 14 bp, Homo sapiens
atgttctgggacac

SEQ ID NO: 2562139 - DNA, 21 bp, Homo sapiens
atgttctgtgcctgtaaacat

SEQ ID NO: 2562140 - DNA, 12 bp, Homo sapiens
atgttgaaagat

SEQ ID NO: 2562141 - DNA, 19 bp, Homo sapiens
atgttgctcagtctccctt

SEQ ID NO: 2562142 - DNA, 21 bp, Homo sapiens
atgttggatttataaatgcta

SEQ ID NO: 2562143 - DNA, 13 bp, Homo sapiens
atgttggctggga

SEQ ID NO: 2562144 - DNA, 14 bp, Homo sapiens
atgttggtgttcca

SEQ ID NO: 2562145 - DNA, 16 bp, Homo sapiens
atgttgtgttctaata

SEQ ID NO: 2562146 - DNA, 14 bp, Homo sapiens
atgttgttatttaa

SEQ ID NO: 2562147 - DNA, 15 bp, Homo sapiens
atgttgttatttaaa

SEQ ID NO: 2562148 - DNA, 16 bp, Homo sapiens
atgtttacactctttg

SEQ ID NO: 2562149 - DNA, 21 bp, Homo sapiens
atgtttacactctttgtaaga

SEQ ID NO: 2562150 - DNA, 22 bp, Homo sapiens
atgtttacactctttgtaagag

SEQ ID NO: 2562151 - DNA, 15 bp, Homo sapiens
atgtttacagaggac

SEQ ID NO: 2562152 - DNA, 17 bp, Homo sapiens
atgtttacagaggacag

SEQ ID NO: 2562153 - DNA, 19 bp, Homo sapiens
atgtttaccttttaattaa

SEQ ID NO: 2562154 - DNA, 14 bp, Homo sapiens
atgtttagtaaact

SEQ ID NO: 2562155 - DNA, 13 bp, Homo sapiens
atgtttatataaa

SEQ ID NO: 2562156 - DNA, 14 bp, Homo sapiens
atgtttatataaat

SEQ ID NO: 2562157 - DNA, 16 bp, Homo sapiens
atgtttatataaatgc

SEQ ID NO: 2562158 - DNA, 17 bp, Homo sapiens
atgtttatataaatgct

SEQ ID NO: 2562159 - DNA, 22 bp, Homo sapiens
atgtttatgcaaggaaggaaag

SEQ ID NO: 2562160 - DNA, 14 bp, Homo sapiens
atgtttattcctga

SEQ ID NO: 2562161 - DNA, 23 bp, Homo sapiens
atgggagagtagatggtgaaatt

SEQ ID NO: 2562162 - DNA, 17 bp, Homo sapiens
atgggagccgggtctgc

SEQ ID NO: 2562163 - DNA, 15 bp, Homo sapiens
atgggagctcctctc

SEQ ID NO: 2562164 - DNA, 21 bp, Homo sapiens
atgggagctcctctcctggag

SEQ ID NO: 2562165 - DNA, 20 bp, Homo sapiens
atgggagctggttagaaatg

SEQ ID NO: 2562166 - DNA, 22 bp, Homo sapiens
atgggagctggttagaaatgca

SEQ ID NO: 2562167 - DNA, 16 bp, Homo sapiens
atgggagtgagacaga

SEQ ID NO: 2562168 - DNA, 14 bp, Homo sapiens
atgggcaaaactga

SEQ ID NO: 2562169 - DNA, 17 bp, Homo sapiens
atgggcaaaactgaatt

SEQ ID NO: 2562170 - DNA, 18 bp, Homo sapiens
atgggcaacccccagcct

SEQ ID NO: 2562171 - DNA, 19 bp, Homo sapiens
atgggcaacccccagcctg

SEQ ID NO: 2562172 - DNA, 14 bp, Homo sapiens
atgggcagagcaga

SEQ ID NO: 2562173 - DNA, 15 bp, Homo sapiens
atgggcagagcagag

SEQ ID NO: 2562174 - DNA, 15 bp, Homo sapiens
atgggcctcctgtgt

SEQ ID NO: 2562175 - DNA, 17 bp, Homo sapiens
atgggcctcctgtgtgt

SEQ ID NO: 2562176 - DNA, 18 bp, Homo sapiens
atgggcctcctgtgtgtg

SEQ ID NO: 2562177 - DNA, 23 bp, Homo sapiens
atgggctgggttctacccaggtg

SEQ ID NO: 2562178 - DNA, 15 bp, Homo sapiens
atgggcttcactgta

SEQ ID NO: 2562179 - DNA, 18 bp, Homo sapiens
atgggcttgttttcttgc

SEQ ID NO: 2562180 - DNA, 19 bp, Homo sapiens
atggggatcacagagacat

SEQ ID NO: 2562181 - DNA, 22 bp, Homo sapiens
atggggggccaacaccagggat

SEQ ID NO: 2562182 - DNA, 15 bp, Homo sapiens
atgggggtgcatttg

SEQ ID NO: 2562183 - DNA, 18 bp, Homo sapiens
atggggttggctgggccc

SEQ ID NO: 2562184 - DNA, 18 bp, Homo sapiens
atgggtaatataaagtgt

SEQ ID NO: 2562185 - DNA, 17 bp, Homo sapiens
atgggtctggctgagct

SEQ ID NO: 2562186 - DNA, 12 bp, Homo sapiens
atgggtgtgtgt

SEQ ID NO: 2562187 - DNA, 19 bp, Homo sapiens
atgggtgtgtgtttgtgtg

SEQ ID NO: 2562188 - DNA, 14 bp, Homo sapiens
atgggttgcatttg

SEQ ID NO: 2562189 - DNA, 15 bp, Homo sapiens
atggtaccagataaa

SEQ ID NO: 2562190 - DNA, 19 bp, Homo sapiens
atggtactagggggaagtg

SEQ ID NO: 2562191 - DNA, 19 bp, Homo sapiens
atggtcaccaaatcagctg

SEQ ID NO: 2562192 - DNA, 16 bp, Homo sapiens
atggtcagcgttgcat

SEQ ID NO: 2562193 - DNA, 19 bp, Homo sapiens
atggtcagcgttgcatgtc

SEQ ID NO: 2562194 - DNA, 22 bp, Homo sapiens
atggtcatctttttctctaaaa

SEQ ID NO: 2562195 - DNA, 13 bp, Homo sapiens
atggtccaggaga

SEQ ID NO: 2562196 - DNA, 16 bp, Homo sapiens
atggtccaggagaagg

SEQ ID NO: 2562197 - DNA, 19 bp, Homo sapiens
atggtccaggagaaggcca

SEQ ID NO: 2562198 - DNA, 20 bp, Homo sapiens
atggtcccatccaggcagtc

SEQ ID NO: 2562199 - DNA, 16 bp, Homo sapiens
atggtcccatctgcag

SEQ ID NO: 2562200 - DNA, 14 bp, Homo sapiens
atggtcctggggct

SEQ ID NO: 2562201 - DNA, 16 bp, Homo sapiens
atggtcgcccaggaga

SEQ ID NO: 2562202 - DNA, 19 bp, Homo sapiens
atggtgagatgcagctgga

SEQ ID NO: 2562203 - DNA, 14 bp, Homo sapiens
atggtgatgaaatg

SEQ ID NO: 2562204 - DNA, 16 bp, Homo sapiens
atggtgatgaaatgta

SEQ ID NO: 2562205 - DNA, 18 bp, Homo sapiens
atggtgcagttgacagca

SEQ ID NO: 2562206 - DNA, 20 bp, Homo sapiens
atggtgcagttgacagcagg

SEQ ID NO: 2562207 - DNA, 14 bp, Homo sapiens
atggtgctgacctc

SEQ ID NO: 2562208 - DNA, 20 bp, Homo sapiens
atggtggactcgcctgtaat

SEQ ID NO: 2562209 - DNA, 17 bp, Homo sapiens
atggtggctgggttgga

SEQ ID NO: 2562210 - DNA, 20 bp, Homo sapiens
atggtgtaataagacataac

SEQ ID NO: 2562211 - DNA, 20 bp, Homo sapiens
atggtgttgccctgagtgga

SEQ ID NO: 2562212 - DNA, 20 bp, Homo sapiens
atggttacaatcattgctga

SEQ ID NO: 2562213 - DNA, 17 bp, Homo sapiens
atggttccatgcctgag

SEQ ID NO: 2562214 - DNA, 22 bp, Homo sapiens
atggttccatgcctgagggtgg

SEQ ID NO: 2562215 - DNA, 13 bp, Homo sapiens
atggttctgtgcc

SEQ ID NO: 2562216 - DNA, 19 bp, Homo sapiens
atggttgagaaatgaataa

SEQ ID NO: 2562217 - DNA, 15 bp, Homo sapiens
atggttgccttaaag

SEQ ID NO: 2562218 - DNA, 23 bp, Homo sapiens
atggttggtaacacaaattttca

SEQ ID NO: 2562219 - DNA, 18 bp, Homo sapiens
atggttgtctgtttttgt

SEQ ID NO: 2562220 - DNA, 21 bp, Homo sapiens
atggtttgaatataaacacta

SEQ ID NO: 2562221 - DNA, 16 bp, Homo sapiens
atggtttgcaaggaag

SEQ ID NO: 2562222 - DNA, 22 bp, Homo sapiens
atgtaaaaggccaaacctctgt

SEQ ID NO: 2562223 - DNA, 21 bp, Homo sapiens
atgtaaaaggtattaaattga

SEQ ID NO: 2562224 - DNA, 16 bp, Homo sapiens
atgtaaaatgttgaat

SEQ ID NO: 2562225 - DNA, 18 bp, Homo sapiens
atgtaaacaaaatttagt

SEQ ID NO: 2562226 - DNA, 19 bp, Homo sapiens
atgtaaacaaaatttagtt

SEQ ID NO: 2562227 - DNA, 14 bp, Homo sapiens
atgtaaacaggaga

SEQ ID NO: 2562228 - DNA, 23 bp, Homo sapiens
atgtaaacataattcttgtatat

SEQ ID NO: 2562229 - DNA, 21 bp, Homo sapiens
atgtaaagatatttttatctt

SEQ ID NO: 2562230 - DNA, 12 bp, Homo sapiens
atgtaaatagtg

SEQ ID NO: 2562231 - DNA, 17 bp, Homo sapiens
atgtaaatagtgcagaa

SEQ ID NO: 2562232 - DNA, 21 bp, Homo sapiens
atgtaaatgcatctgtcctca

SEQ ID NO: 2562233 - DNA, 14 bp, Homo sapiens
atgtaacagaaagg

SEQ ID NO: 2562234 - DNA, 13 bp, Homo sapiens
atgtaacagtctg

SEQ ID NO: 2562235 - DNA, 14 bp, Homo sapiens
atgtaactagaatt

SEQ ID NO: 2562236 - DNA, 17 bp, Homo sapiens
atgtaacttttgtaaga

SEQ ID NO: 2562237 - DNA, 16 bp, Homo sapiens
atgtaagctgaaaata

SEQ ID NO: 2562238 - DNA, 14 bp, Homo sapiens
atgtaagctgttta

SEQ ID NO: 2562239 - DNA, 22 bp, Homo sapiens
atgtaagctgtttattttatat

SEQ ID NO: 2562240 - DNA, 19 bp, Homo sapiens
atgtaagggaaactgccag

SEQ ID NO: 2562241 - DNA, 16 bp, Homo sapiens
atgtaataatgtgaat

SEQ ID NO: 2562242 - DNA, 19 bp, Homo sapiens
atgtaatcttgaattgtaa

SEQ ID NO: 2562243 - DNA, 15 bp, Homo sapiens
atgtaattaagtact

SEQ ID NO: 2562244 - DNA, 23 bp, Homo sapiens
atgtaattaagtactatgtatca

SEQ ID NO: 2562245 - DNA, 13 bp, Homo sapiens
atgtacagtctgt

SEQ ID NO: 2562246 - DNA, 15 bp, Homo sapiens
atgtaccatgtacat

SEQ ID NO: 2562247 - DNA, 14 bp, Homo sapiens
atgtacgtttgtat

SEQ ID NO: 2562248 - DNA, 17 bp, Homo sapiens
atgtactcctctttaca

SEQ ID NO: 2562249 - DNA, 16 bp, Homo sapiens
atgtactctactgata

SEQ ID NO: 2562250 - DNA, 16 bp, Homo sapiens
atgtactgtagttttt

SEQ ID NO: 2562251 - DNA, 16 bp, Homo sapiens
atgtacttgtcaaaga

SEQ ID NO: 2562252 - DNA, 14 bp, Homo sapiens
atgtagaaaatttg

SEQ ID NO: 2562253 - DNA, 12 bp, Homo sapiens
atgtagaggaga

SEQ ID NO: 2562254 - DNA, 13 bp, Homo sapiens
atgtagaggagaa

SEQ ID NO: 2562255 - DNA, 18 bp, Homo sapiens
atgtagataaactcagaa

SEQ ID NO: 2562256 - DNA, 20 bp, Homo sapiens
atgtagatttatttcatcat

SEQ ID NO: 2562257 - DNA, 20 bp, Homo sapiens
atgtagcaaaacgcatggag

SEQ ID NO: 2562258 - DNA, 14 bp, Homo sapiens
atgtagctggtttc

SEQ ID NO: 2562259 - DNA, 22 bp, Homo sapiens
atgtaggaaagaccatttttcc

SEQ ID NO: 2562260 - DNA, 15 bp, Homo sapiens
atgtaggtgtctgca

SEQ ID NO: 2562261 - DNA, 21 bp, Homo sapiens
atgtaggtgtctgcacccagg

SEQ ID NO: 2562262 - DNA, 14 bp, Homo sapiens
atgtagtagtactt

SEQ ID NO: 2562263 - DNA, 21 bp, Homo sapiens
atgtagtatcaaatattagat

SEQ ID NO: 2562264 - DNA, 14 bp, Homo sapiens
atgtataatatttt

SEQ ID NO: 2562265 - DNA, 17 bp, Homo sapiens
atgtatataaacatgct

SEQ ID NO: 2562266 - DNA, 20 bp, Homo sapiens
atgtatatacccacacacat

SEQ ID NO: 2562267 - DNA, 16 bp, Homo sapiens
atgtatatgtgttcat

SEQ ID NO: 2562268 - DNA, 14 bp, Homo sapiens
atgtatgattacat

SEQ ID NO: 2562269 - DNA, 18 bp, Homo sapiens
atgtatggaatacagtgt

SEQ ID NO: 2562270 - DNA, 16 bp, Homo sapiens
atgtatgtgcactgtc

SEQ ID NO: 2562271 - DNA, 12 bp, Homo sapiens
atgtatgtttac

SEQ ID NO: 2562272 - DNA, 14 bp, Homo sapiens
atgtatgtttacat

SEQ ID NO: 2562273 - DNA, 13 bp, Homo sapiens
atgtattattctg

SEQ ID NO: 2562274 - DNA, 22 bp, Homo sapiens
atgtattatttcattatgtaaa

SEQ ID NO: 2562275 - DNA, 24 bp, Homo sapiens
atgtattcagctttagtagatatt

SEQ ID NO: 2562276 - DNA, 14 bp, Homo sapiens
atgtattgataaga

SEQ ID NO: 2562277 - DNA, 16 bp, Homo sapiens
atgtattggcctggag

SEQ ID NO: 2562278 - DNA, 19 bp, Homo sapiens
atgtattgtaaacatgtgt

SEQ ID NO: 2562279 - DNA, 13 bp, Homo sapiens
atgtattgtacct

SEQ ID NO: 2562280 - DNA, 17 bp, Homo sapiens
atgtatttataaatata

SEQ ID NO: 2562281 - DNA, 14 bp, Homo sapiens
atgtatttgtttgc

SEQ ID NO: 2562282 - DNA, 14 bp, Homo sapiens
atgtcaacttctgg

SEQ ID NO: 2562283 - DNA, 14 bp, Homo sapiens
atgtcacaggcagg

SEQ ID NO: 2562284 - DNA, 17 bp, Homo sapiens
atgtcacaggcaggtcc

SEQ ID NO: 2562285 - DNA, 19 bp, Homo sapiens
atgtcaccggatcctgggt

SEQ ID NO: 2562286 - DNA, 18 bp, Homo sapiens
atgtcagatacaatgtat

SEQ ID NO: 2562287 - DNA, 15 bp, Homo sapiens
atgtcaggaacagaa

SEQ ID NO: 2562288 - DNA, 19 bp, Homo sapiens
caagtcaggcccttatttt

SEQ ID NO: 2562289 - DNA, 16 bp, Homo sapiens
caagtcatgtgcattt

SEQ ID NO: 2562290 - DNA, 19 bp, Homo sapiens
caagtccctgttttctgag

SEQ ID NO: 2562291 - DNA, 14 bp, Homo sapiens
caagtcctcttttc

SEQ ID NO: 2562292 - DNA, 21 bp, Homo sapiens
caagtcctcttttctgagagg

SEQ ID NO: 2562293 - DNA, 14 bp, Homo sapiens
caagtcctgaagag

SEQ ID NO: 2562294 - DNA, 23 bp, Homo sapiens
caagtcctgaagaggcgggccag

SEQ ID NO: 2562295 - DNA, 15 bp, Homo sapiens
caagtcctgtgaatt

SEQ ID NO: 2562296 - DNA, 22 bp, Homo sapiens
caagtccttacctcttccggag

SEQ ID NO: 2562297 - DNA, 23 bp, Homo sapiens
caagtccttacctcttccggaga

SEQ ID NO: 2562298 - DNA, 15 bp, Homo sapiens
caagtctacagagtg

SEQ ID NO: 2562299 - DNA, 16 bp, Homo sapiens
caagtctacagagtga

SEQ ID NO: 2562300 - DNA, 21 bp, Homo sapiens
caagtctatgatgctgttgcc

SEQ ID NO: 2562301 - DNA, 23 bp, Homo sapiens
caagtctcagtggcttcatctgt

SEQ ID NO: 2562302 - DNA, 19 bp, Homo sapiens
caagtctctgctggcccag

SEQ ID NO: 2562303 - DNA, 22 bp, Homo sapiens
caagtctctgctggcccagcca

SEQ ID NO: 2562304 - DNA, 15 bp, Homo sapiens
caagtgacatctctt

SEQ ID NO: 2562305 - DNA, 19 bp, Homo sapiens
caagtgagaccctgtctca

SEQ ID NO: 2562306 - DNA, 16 bp, Homo sapiens
caagtgattctcctgc

SEQ ID NO: 2562307 - DNA, 22 bp, Homo sapiens
caagtgattctcctgcctcagc

SEQ ID NO: 2562308 - DNA, 22 bp, Homo sapiens
caagtgccactgcccgagctgg

SEQ ID NO: 2562309 - DNA, 23 bp, Homo sapiens
caagtgccactgcccgagctggt

SEQ ID NO: 2562310 - DNA, 17 bp, Homo sapiens
caagtgccagaggtggg

SEQ ID NO: 2562311 - DNA, 22 bp, Homo sapiens
caagtgccagaggtgggcaggt

SEQ ID NO: 2562312 - DNA, 20 bp, Homo sapiens
caagtgccagtcttgtgtct

SEQ ID NO: 2562313 - DNA, 22 bp, Homo sapiens
caagtgggatctgtcacaccag

SEQ ID NO: 2562314 - DNA, 17 bp, Homo sapiens
caagtggggctcgccat

SEQ ID NO: 2562315 - DNA, 15 bp, Homo sapiens
caagtgtaaaatatt

SEQ ID NO: 2562316 - DNA, 16 bp, Homo sapiens
caagtgtaaaatattt

SEQ ID NO: 2562317 - DNA, 21 bp, Homo sapiens
caagtgtaaaatattttgaat

SEQ ID NO: 2562318 - DNA, 23 bp, Homo sapiens
caagtgtaaaatattttgaatca

SEQ ID NO: 2562319 - DNA, 18 bp, Homo sapiens
caagtgtatatcagaaaa

SEQ ID NO: 2562320 - DNA, 22 bp, Homo sapiens
caagtgtggtagagtgtgcctg

SEQ ID NO: 2562321 - DNA, 23 bp, Homo sapiens
caagtgtggtagggacttaaaaa

SEQ ID NO: 2562322 - DNA, 20 bp, Homo sapiens
caagtgtgtgcacatgtgtg

SEQ ID NO: 2562323 - DNA, 11 bp, Homo sapiens
caagtgtgtgt

SEQ ID NO: 2562324 - DNA, 19 bp, Homo sapiens
caagtgttgttttttaagt

SEQ ID NO: 2562325 - DNA, 14 bp, Homo sapiens
caagttagctcagg

SEQ ID NO: 2562326 - DNA, 19 bp, Homo sapiens
caagttattgacaaactct

SEQ ID NO: 2562327 - DNA, 12 bp, Homo sapiens
caagttattgta

SEQ ID NO: 2562328 - DNA, 13 bp, Homo sapiens
caagttctagaga

SEQ ID NO: 2562329 - DNA, 21 bp, Homo sapiens
caagttctagagaagaggctg

SEQ ID NO: 2562330 - DNA, 23 bp, Homo sapiens
caagttctagagaagaggctggt

SEQ ID NO: 2562331 - DNA, 17 bp, Homo sapiens
caagttgtgcttgttta

SEQ ID NO: 2562332 - DNA, 17 bp, Homo sapiens
caagttgtggtgctgac

SEQ ID NO: 2562333 - DNA, 20 bp, Homo sapiens
caagttgtggtgctgacaaa

SEQ ID NO: 2562334 - DNA, 17 bp, Homo sapiens
caagttgtttgagaaat

SEQ ID NO: 2562335 - DNA, 21 bp, Homo sapiens
caagttgtttgagaaattaag

SEQ ID NO: 2562336 - DNA, 17 bp, Homo sapiens
caataaaaatggctcag

SEQ ID NO: 2562337 - DNA, 15 bp, Homo sapiens
caataaaatcatgta

SEQ ID NO: 2562338 - DNA, 20 bp, Homo sapiens
caataaaatcatgtacattt

SEQ ID NO: 2562339 - DNA, 15 bp, Homo sapiens
caataaaatgtgatt

SEQ ID NO: 2562340 - DNA, 13 bp, Homo sapiens
caataaaccaggt

SEQ ID NO: 2562341 - DNA, 23 bp, Homo sapiens
caataaaccaggtttagacagta

SEQ ID NO: 2562342 - DNA, 18 bp, Homo sapiens
caataaacgatttaattc

SEQ ID NO: 2562343 - DNA, 13 bp, Homo sapiens
caataaagaagag

SEQ ID NO: 2562344 - DNA, 22 bp, Homo sapiens
caataaagagttagaatgaaaa

SEQ ID NO: 2562345 - DNA, 15 bp, Homo sapiens
caataactactgtgt

SEQ ID NO: 2562346 - DNA, 20 bp, Homo sapiens
caataagaatttagggagaa

SEQ ID NO: 2562347 - DNA, 12 bp, Homo sapiens
caataagccttg

SEQ ID NO: 2562348 - DNA, 16 bp, Homo sapiens
caataatatattttct

SEQ ID NO: 2562349 - DNA, 17 bp, Homo sapiens
caatacatgctgctaat

SEQ ID NO: 2562350 - DNA, 20 bp, Homo sapiens
caatacccaaatcctctcca

SEQ ID NO: 2562351 - DNA, 23 bp, Homo sapiens
caatacccaaatcctctccagct

SEQ ID NO: 2562352 - DNA, 23 bp, Homo sapiens
caataccctttgaattggacaat

SEQ ID NO: 2562353 - DNA, 23 bp, Homo sapiens
caatagaaggatgtacatttcca

SEQ ID NO: 2562354 - DNA, 23 bp, Homo sapiens
caataggcaaaggggggaaggga

SEQ ID NO: 2562355 - DNA, 16 bp, Homo sapiens
caatagtcaagaaaaa

SEQ ID NO: 2562356 - DNA, 14 bp, Homo sapiens
caatagtgtgttct

SEQ ID NO: 2562357 - DNA, 15 bp, Homo sapiens
caatagtgtgttctg

SEQ ID NO: 2562358 - DNA, 20 bp, Homo sapiens
caatatcagttattttttga

SEQ ID NO: 2562359 - DNA, 16 bp, Homo sapiens
caatatgtattaatat

SEQ ID NO: 2562360 - DNA, 12 bp, Homo sapiens
caatattaaata

SEQ ID NO: 2562361 - DNA, 14 bp, Homo sapiens
caatattaaataca

SEQ ID NO: 2562362 - DNA, 15 bp, Homo sapiens
caatattaaatacag

SEQ ID NO: 2562363 - DNA, 14 bp, Homo sapiens
caatattataattt

SEQ ID NO: 2562364 - DNA, 14 bp, Homo sapiens
caatattatactaa

SEQ ID NO: 2562365 - DNA, 13 bp, Homo sapiens
caatattcaaatg

SEQ ID NO: 2562366 - DNA, 17 bp, Homo sapiens
caatattcgctgtgtca

SEQ ID NO: 2562367 - DNA, 16 bp, Homo sapiens
caatattgtacagttt

SEQ ID NO: 2562368 - DNA, 17 bp, Homo sapiens
caatattgtacagtttt

SEQ ID NO: 2562369 - DNA, 18 bp, Homo sapiens
caatattgtacagttttt

SEQ ID NO: 2562370 - DNA, 13 bp, Homo sapiens
caatatttaaaca

SEQ ID NO: 2562371 - DNA, 14 bp, Homo sapiens
caatatttaaacat

SEQ ID NO: 2562372 - DNA, 13 bp, Homo sapiens
caatatttgtaga

SEQ ID NO: 2562373 - DNA, 16 bp, Homo sapiens
caatattttccatgaa

SEQ ID NO: 2562374 - DNA, 19 bp, Homo sapiens
caatattttccatgaaaat

SEQ ID NO: 2562375 - DNA, 20 bp, Homo sapiens
caatattttccatgaaaatg

SEQ ID NO: 2562376 - DNA, 22 bp, Homo sapiens
caatattttccatgaaaatgca

SEQ ID NO: 2562377 - DNA, 12 bp, Homo sapiens
caatatttttct

SEQ ID NO: 2562378 - DNA, 18 bp, Homo sapiens
caatcaaaggaaaatagt

SEQ ID NO: 2562379 - DNA, 14 bp, Homo sapiens
caatcagtcccctc

SEQ ID NO: 2562380 - DNA, 16 bp, Homo sapiens
caatcagtcccctccc

SEQ ID NO: 2562381 - DNA, 17 bp, Homo sapiens
caatcatctgtgtgaaa

SEQ ID NO: 2562382 - DNA, 23 bp, Homo sapiens
caatccatgttagtttttacttt

SEQ ID NO: 2562383 - DNA, 16 bp, Homo sapiens
caatcccctccttggg

SEQ ID NO: 2562384 - DNA, 15 bp, Homo sapiens
caatcctagtgcttt

SEQ ID NO: 2562385 - DNA, 17 bp, Homo sapiens
caatcctcactgggtgg

SEQ ID NO: 2562386 - DNA, 13 bp, Homo sapiens
caatcctctaagc

SEQ ID NO: 2562387 - DNA, 17 bp, Homo sapiens
caatcctgtctttctga

SEQ ID NO: 2562388 - DNA, 14 bp, Homo sapiens
caatccttgttcag

SEQ ID NO: 2562389 - DNA, 15 bp, Homo sapiens
caatctaaccacatc

SEQ ID NO: 2562390 - DNA, 17 bp, Homo sapiens
caatctcccgctgctgc

SEQ ID NO: 2562391 - DNA, 19 bp, Homo sapiens
caatctgacattctcagga

SEQ ID NO: 2562392 - DNA, 12 bp, Homo sapiens
caatctgtaaac

SEQ ID NO: 2562393 - DNA, 18 bp, Homo sapiens
caatctgtaaactgtgta

SEQ ID NO: 2562394 - DNA, 19 bp, Homo sapiens
caatcttaaggggcagctt

SEQ ID NO: 2562395 - DNA, 15 bp, Homo sapiens
caatgaaaaaatgta

SEQ ID NO: 2562396 - DNA, 17 bp, Homo sapiens
caatgaaagtttgcact

SEQ ID NO: 2562397 - DNA, 22 bp, Homo sapiens
caatgaaatacacaagtaaaca

SEQ ID NO: 2562398 - DNA, 13 bp, Homo sapiens
caatgaaatgaat

SEQ ID NO: 2562399 - DNA, 21 bp, Homo sapiens
caatgaaatgctctcctttcc

SEQ ID NO: 2562400 - DNA, 14 bp, Homo sapiens
caatgacacagtct

SEQ ID NO: 2562401 - DNA, 19 bp, Homo sapiens
caatgacacagtcttggct

SEQ ID NO: 2562402 - DNA, 15 bp, Homo sapiens
caatgacatcttcaa

SEQ ID NO: 2562403 - DNA, 14 bp, Homo sapiens
caatgactctctgg

SEQ ID NO: 2562404 - DNA, 15 bp, Homo sapiens
caatgacttactgta

SEQ ID NO: 2562405 - DNA, 18 bp, Homo sapiens
caatgacttactgtacat

SEQ ID NO: 2562406 - DNA, 20 bp, Homo sapiens
caatgatagtaagaaaagtg

SEQ ID NO: 2562407 - DNA, 20 bp, Homo sapiens
caatgatatatggataatgc

SEQ ID NO: 2562408 - DNA, 14 bp, Homo sapiens
caatgatctaggtt

SEQ ID NO: 2562409 - DNA, 19 bp, Homo sapiens
attaaaactgaagtctgaa

SEQ ID NO: 2562410 - DNA, 21 bp, Homo sapiens
attaaaactgaagtctgaaat

SEQ ID NO: 2562411 - DNA, 14 bp, Homo sapiens
attaaaactgaatt

SEQ ID NO: 2562412 - DNA, 23 bp, Homo sapiens
attaaaagaaaataaaaaaaaga

SEQ ID NO: 2562413 - DNA, 16 bp, Homo sapiens
attaaaagaatatttt

SEQ ID NO: 2562414 - DNA, 14 bp, Homo sapiens
attaaaatcctcaa

SEQ ID NO: 2562415 - DNA, 18 bp, Homo sapiens
attaaaatgattgtaaaa

SEQ ID NO: 2562416 - DNA, 15 bp, Homo sapiens
attaaacggattatt

SEQ ID NO: 2562417 - DNA, 17 bp, Homo sapiens
attaaacggattatttt

SEQ ID NO: 2562418 - DNA, 21 bp, Homo sapiens
attaaacggattattttttca

SEQ ID NO: 2562419 - DNA, 22 bp, Homo sapiens
attaaacggattattttttcag

SEQ ID NO: 2562420 - DNA, 23 bp, Homo sapiens
attaaacggattattttttcaga

SEQ ID NO: 2562421 - DNA, 19 bp, Homo sapiens
attaaacgtatgcatgtga

SEQ ID NO: 2562422 - DNA, 20 bp, Homo sapiens
attaaacgtatgcatgtgaa

SEQ ID NO: 2562423 - DNA, 15 bp, Homo sapiens
attaaagactccagt

SEQ ID NO: 2562424 - DNA, 17 bp, Homo sapiens
attaaagctaaagtatc

SEQ ID NO: 2562425 - DNA, 18 bp, Homo sapiens
attaaagtgatactgaaa

SEQ ID NO: 2562426 - DNA, 17 bp, Homo sapiens
attaaatacagacacta

SEQ ID NO: 2562427 - DNA, 16 bp, Homo sapiens
attaaatgcccagccc

SEQ ID NO: 2562428 - DNA, 18 bp, Homo sapiens
attaaattaggaataaat

SEQ ID NO: 2562429 - DNA, 13 bp, Homo sapiens
attaaattcttgc

SEQ ID NO: 2562430 - DNA, 20 bp, Homo sapiens
attaaattcttgcaaagtat

SEQ ID NO: 2562431 - DNA, 14 bp, Homo sapiens
attaacaaattatg

SEQ ID NO: 2562432 - DNA, 11 bp, Homo sapiens
attaacactgc

SEQ ID NO: 2562433 - DNA, 21 bp, Homo sapiens
attaacagttttccatgaaaa

SEQ ID NO: 2562434 - DNA, 19 bp, Homo sapiens
attaacattgggaaatctt

SEQ ID NO: 2562435 - DNA, 21 bp, Homo sapiens
attaacattgggaaatcttat

SEQ ID NO: 2562436 - DNA, 19 bp, Homo sapiens
attaaccaaaaaagttaca

SEQ ID NO: 2562437 - DNA, 17 bp, Homo sapiens
attaaccacttcagctg

SEQ ID NO: 2562438 - DNA, 22 bp, Homo sapiens
attaacctgccagggagacaga

SEQ ID NO: 2562439 - DNA, 18 bp, Homo sapiens
attaacttctctggaaag

SEQ ID NO: 2562440 - DNA, 16 bp, Homo sapiens
attaacttttataaac

SEQ ID NO: 2562441 - DNA, 19 bp, Homo sapiens
attaacttttataaacttt

SEQ ID NO: 2562442 - DNA, 23 bp, Homo sapiens
attaacttttataaactttacct

SEQ ID NO: 2562443 - DNA, 20 bp, Homo sapiens
attaagaacacttttaataa

SEQ ID NO: 2562444 - DNA, 14 bp, Homo sapiens
attaagaagaaact

SEQ ID NO: 2562445 - DNA, 16 bp, Homo sapiens
attaagaatgaaatac

SEQ ID NO: 2562446 - DNA, 20 bp, Homo sapiens
attaagaatgaaatactgtt

SEQ ID NO: 2562447 - DNA, 21 bp, Homo sapiens
attaagaatgaaatactgttt

SEQ ID NO: 2562448 - DNA, 22 bp, Homo sapiens
attaagaatgaaatactgtttg

SEQ ID NO: 2562449 - DNA, 17 bp, Homo sapiens
attaagaggcagaaaat

SEQ ID NO: 2562450 - DNA, 15 bp, Homo sapiens
attaagatggattct

SEQ ID NO: 2562451 - DNA, 23 bp, Homo sapiens
attaagatggattctcagatatt

SEQ ID NO: 2562452 - DNA, 24 bp, Homo sapiens
attaagatggattctcagatattt

SEQ ID NO: 2562453 - DNA, 16 bp, Homo sapiens
attaagatttccaagt

SEQ ID NO: 2562454 - DNA, 17 bp, Homo sapiens
attaagccacttaaaat

SEQ ID NO: 2562455 - DNA, 15 bp, Homo sapiens
attaagccttccaca

SEQ ID NO: 2562456 - DNA, 14 bp, Homo sapiens
attaagtactatgt

SEQ ID NO: 2562457 - DNA, 18 bp, Homo sapiens
attaagtactatgtatca

SEQ ID NO: 2562458 - DNA, 19 bp, Homo sapiens
attaagtactatgtatcaa

SEQ ID NO: 2562459 - DNA, 13 bp, Homo sapiens
attaagttgttaa

SEQ ID NO: 2562460 - DNA, 14 bp, Homo sapiens
attaagttgttaat

SEQ ID NO: 2562461 - DNA, 13 bp, Homo sapiens
attaatagctttt

SEQ ID NO: 2562462 - DNA, 20 bp, Homo sapiens
attaatatggggatgcagca

SEQ ID NO: 2562463 - DNA, 14 bp, Homo sapiens
attaatattttaat

SEQ ID NO: 2562464 - DNA, 18 bp, Homo sapiens
attaatctttctttacct

SEQ ID NO: 2562465 - DNA, 13 bp, Homo sapiens
attaatgaaatat

SEQ ID NO: 2562466 - DNA, 17 bp, Homo sapiens
attaatgaaatatctgt

SEQ ID NO: 2562467 - DNA, 18 bp, Homo sapiens
attaatgaaatatctgta

SEQ ID NO: 2562468 - DNA, 19 bp, Homo sapiens
attaatgaaatatctgtat

SEQ ID NO: 2562469 - DNA, 20 bp, Homo sapiens
attaatgacacttgtcccca

SEQ ID NO: 2562470 - DNA, 11 bp, Homo sapiens
attaatgcact

SEQ ID NO: 2562471 - DNA, 13 bp, Homo sapiens
attaatgcacttt

SEQ ID NO: 2562472 - DNA, 13 bp, Homo sapiens
attaatgttaatt

SEQ ID NO: 2562473 - DNA, 19 bp, Homo sapiens
attaattcaccttccagtg

SEQ ID NO: 2562474 - DNA, 13 bp, Homo sapiens
attacacaaaaca

SEQ ID NO: 2562475 - DNA, 14 bp, Homo sapiens
attacacaaaacaa

SEQ ID NO: 2562476 - DNA, 21 bp, Homo sapiens
attacaccagcctcgtcttca

SEQ ID NO: 2562477 - DNA, 14 bp, Homo sapiens
attacacccaaaga

SEQ ID NO: 2562478 - DNA, 18 bp, Homo sapiens
attacactgtatttgtat

SEQ ID NO: 2562479 - DNA, 20 bp, Homo sapiens
attacactgtatttgtatct

SEQ ID NO: 2562480 - DNA, 19 bp, Homo sapiens
attacagagaggagaaaca

SEQ ID NO: 2562481 - DNA, 19 bp, Homo sapiens
attacagatgggcaaatta

SEQ ID NO: 2562482 - DNA, 21 bp, Homo sapiens
attacagatgggcaaattaag

SEQ ID NO: 2562483 - DNA, 16 bp, Homo sapiens
attacaggtgtgaacc

SEQ ID NO: 2562484 - DNA, 18 bp, Homo sapiens
attacataatctgtacaa

SEQ ID NO: 2562485 - DNA, 17 bp, Homo sapiens
attacatttccaaatga

SEQ ID NO: 2562486 - DNA, 22 bp, Homo sapiens
attacatttccaaatgaatgac

SEQ ID NO: 2562487 - DNA, 14 bp, Homo sapiens
attaccaacctgtt

SEQ ID NO: 2562488 - DNA, 19 bp, Homo sapiens
attaccacagacatactaa

SEQ ID NO: 2562489 - DNA, 23 bp, Homo sapiens
attaccagacggttcaccagcct

SEQ ID NO: 2562490 - DNA, 13 bp, Homo sapiens
attaccatggaga

SEQ ID NO: 2562491 - DNA, 15 bp, Homo sapiens
attaccatggagaca

SEQ ID NO: 2562492 - DNA, 13 bp, Homo sapiens
attacccaagcaa

SEQ ID NO: 2562493 - DNA, 22 bp, Homo sapiens
attaccccctcattgtttatta

SEQ ID NO: 2562494 - DNA, 13 bp, Homo sapiens
attacctcctgag

SEQ ID NO: 2562495 - DNA, 13 bp, Homo sapiens
attacctctgata

SEQ ID NO: 2562496 - DNA, 13 bp, Homo sapiens
attaccttactgt

SEQ ID NO: 2562497 - DNA, 12 bp, Homo sapiens
attaccttctcc

SEQ ID NO: 2562498 - DNA, 20 bp, Homo sapiens
attactaaggagtaatctgt

SEQ ID NO: 2562499 - DNA, 15 bp, Homo sapiens
attactacaaaattt

SEQ ID NO: 2562500 - DNA, 21 bp, Homo sapiens
attactacaaaatttgaaatt

SEQ ID NO: 2562501 - DNA, 20 bp, Homo sapiens
attactgccattcacttcat

SEQ ID NO: 2562502 - DNA, 20 bp, Homo sapiens
attactgtttgtcttctccc

SEQ ID NO: 2562503 - DNA, 22 bp, Homo sapiens
attactgtttgtcttctcccca

SEQ ID NO: 2562504 - DNA, 19 bp, Homo sapiens
attacttatcatccacatt

SEQ ID NO: 2562505 - DNA, 19 bp, Homo sapiens
attacttatttttgacagt

SEQ ID NO: 2562506 - DNA, 14 bp, Homo sapiens
attacttctgctac

SEQ ID NO: 2562507 - DNA, 23 bp, Homo sapiens
attactttaccacccccacacct

SEQ ID NO: 2562508 - DNA, 14 bp, Homo sapiens
attactttgtgaat

SEQ ID NO: 2562509 - DNA, 17 bp, Homo sapiens
attagaaattggctgga

SEQ ID NO: 2562510 - DNA, 14 bp, Homo sapiens
attagaattattta

SEQ ID NO: 2562511 - DNA, 16 bp, Homo sapiens
attagactcctcctcc

SEQ ID NO: 2562512 - DNA, 13 bp, Homo sapiens
attagagaagaga

SEQ ID NO: 2562513 - DNA, 21 bp, Homo sapiens
attagagggaggagaatgagc

SEQ ID NO: 2562514 - DNA, 13 bp, Homo sapiens
attagagggaggt

SEQ ID NO: 2562515 - DNA, 17 bp, Homo sapiens
atttaacagtcatttaa

SEQ ID NO: 2562516 - DNA, 18 bp, Homo sapiens
atttaacagtcatttaaa

SEQ ID NO: 2562517 - DNA, 13 bp, Homo sapiens
atttaactgcctt

SEQ ID NO: 2562518 - DNA, 20 bp, Homo sapiens
atttaacttgtttccaatgt

SEQ ID NO: 2562519 - DNA, 13 bp, Homo sapiens
atttaagcattgt

SEQ ID NO: 2562520 - DNA, 14 bp, Homo sapiens
atttaagcattgtt

SEQ ID NO: 2562521 - DNA, 19 bp, Homo sapiens
atttaagcctcatatttaa

SEQ ID NO: 2562522 - DNA, 12 bp, Homo sapiens
atttaataacat

SEQ ID NO: 2562523 - DNA, 19 bp, Homo sapiens
atttaataacattacctta

SEQ ID NO: 2562524 - DNA, 23 bp, Homo sapiens
atttaataacattaccttactgt

SEQ ID NO: 2562525 - DNA, 15 bp, Homo sapiens
atttaatacagcagt

SEQ ID NO: 2562526 - DNA, 15 bp, Homo sapiens
atttaatagtgttaa

SEQ ID NO: 2562527 - DNA, 19 bp, Homo sapiens
atttaatatagctattttt

SEQ ID NO: 2562528 - DNA, 13 bp, Homo sapiens
atttaatatttat

SEQ ID NO: 2562529 - DNA, 15 bp, Homo sapiens
atttaatgaaagact

SEQ ID NO: 2562530 - DNA, 21 bp, Homo sapiens
atttaatggccggctggaaat

SEQ ID NO: 2562531 - DNA, 16 bp, Homo sapiens
atttaatgtagccatg

SEQ ID NO: 2562532 - DNA, 19 bp, Homo sapiens
atttaattaatcatgaatg

SEQ ID NO: 2562533 - DNA, 15 bp, Homo sapiens
atttaattcatgttt

SEQ ID NO: 2562534 - DNA, 15 bp, Homo sapiens
atttaattctcttga

SEQ ID NO: 2562535 - DNA, 19 bp, Homo sapiens
atttaattttgacactata

SEQ ID NO: 2562536 - DNA, 19 bp, Homo sapiens
atttaatttttttgagaca

SEQ ID NO: 2562537 - DNA, 23 bp, Homo sapiens
atttaatttttttgagacagagt

SEQ ID NO: 2562538 - DNA, 20 bp, Homo sapiens
atttacaaaaatataaaata

SEQ ID NO: 2562539 - DNA, 14 bp, Homo sapiens
atttacactgggag

SEQ ID NO: 2562540 - DNA, 15 bp, Homo sapiens
atttacatatgaaat

SEQ ID NO: 2562541 - DNA, 18 bp, Homo sapiens
atttacatgaattgcatt

SEQ ID NO: 2562542 - DNA, 21 bp, Homo sapiens
atttacatgaattgcatttta

SEQ ID NO: 2562543 - DNA, 19 bp, Homo sapiens
atttacatgtattatttca

SEQ ID NO: 2562544 - DNA, 21 bp, Homo sapiens
atttaccacagcagctgaaca

SEQ ID NO: 2562545 - DNA, 15 bp, Homo sapiens
atttactaagccaca

SEQ ID NO: 2562546 - DNA, 20 bp, Homo sapiens
atttactgagcttctctgtg

SEQ ID NO: 2562547 - DNA, 21 bp, Homo sapiens
atttactgagcttctctgtga

SEQ ID NO: 2562548 - DNA, 22 bp, Homo sapiens
atttacttgccattactcaatt

SEQ ID NO: 2562549 - DNA, 17 bp, Homo sapiens
atttagagatgaattaa

SEQ ID NO: 2562550 - DNA, 13 bp, Homo sapiens
atttagcaaataa

SEQ ID NO: 2562551 - DNA, 22 bp, Homo sapiens
atttaggcagattgaaaaggac

SEQ ID NO: 2562552 - DNA, 22 bp, Homo sapiens
atttagggagaaatgttgttca

SEQ ID NO: 2562553 - DNA, 15 bp, Homo sapiens
atttagggcaaggag

SEQ ID NO: 2562554 - DNA, 15 bp, Homo sapiens
atttagtgaactacg

SEQ ID NO: 2562555 - DNA, 16 bp, Homo sapiens
atttagttatagtttc

SEQ ID NO: 2562556 - DNA, 12 bp, Homo sapiens
atttagttcttt

SEQ ID NO: 2562557 - DNA, 19 bp, Homo sapiens
atttagtttttgtaattta

SEQ ID NO: 2562558 - DNA, 19 bp, Homo sapiens
atttataactcatcataaa

SEQ ID NO: 2562559 - DNA, 21 bp, Homo sapiens
atttataactcatcataaaat

SEQ ID NO: 2562560 - DNA, 17 bp, Homo sapiens
atttataagcagattta

SEQ ID NO: 2562561 - DNA, 13 bp, Homo sapiens
atttataatcact

SEQ ID NO: 2562562 - DNA, 22 bp, Homo sapiens
atttataatcacttttttccac

SEQ ID NO: 2562563 - DNA, 17 bp, Homo sapiens
atttatactgtatatat

SEQ ID NO: 2562564 - DNA, 22 bp, Homo sapiens
atttatagtttgtacatgcatt

SEQ ID NO: 2562565 - DNA, 19 bp, Homo sapiens
atttatatacaacctgctt

SEQ ID NO: 2562566 - DNA, 17 bp, Homo sapiens
atttatatatttataac

SEQ ID NO: 2562567 - DNA, 18 bp, Homo sapiens
atttatatatttataact

SEQ ID NO: 2562568 - DNA, 19 bp, Homo sapiens
atttatatatttataactc

SEQ ID NO: 2562569 - DNA, 18 bp, Homo sapiens
atttatatttttatttta

SEQ ID NO: 2562570 - DNA, 13 bp, Homo sapiens
atttatatttttg

SEQ ID NO: 2562571 - DNA, 12 bp, Homo sapiens
atttatcaaatc

SEQ ID NO: 2562572 - DNA, 13 bp, Homo sapiens
atttatcaaatca

SEQ ID NO: 2562573 - DNA, 14 bp, Homo sapiens
atttatcaaatcag

SEQ ID NO: 2562574 - DNA, 18 bp, Homo sapiens
atttatcaatcagtataa

SEQ ID NO: 2562575 - DNA, 16 bp, Homo sapiens
atttatcacacttctg

SEQ ID NO: 2562576 - DNA, 17 bp, Homo sapiens
atttatcagtgacagag

SEQ ID NO: 2562577 - DNA, 23 bp, Homo sapiens
atttatcagtgacagagttcact

SEQ ID NO: 2562578 - DNA, 19 bp, Homo sapiens
atttatctctatttaatat

SEQ ID NO: 2562579 - DNA, 18 bp, Homo sapiens
atttatgagtttttgata

SEQ ID NO: 2562580 - DNA, 19 bp, Homo sapiens
atttatgagtttttgatag

SEQ ID NO: 2562581 - DNA, 12 bp, Homo sapiens
atttatggagga

SEQ ID NO: 2562582 - DNA, 12 bp, Homo sapiens
atttatgtaaac

SEQ ID NO: 2562583 - DNA, 23 bp, Homo sapiens
atttatgtaaactgcattagaaa

SEQ ID NO: 2562584 - DNA, 12 bp, Homo sapiens
atttatgtagat

SEQ ID NO: 2562585 - DNA, 17 bp, Homo sapiens
cacccgaggctgcccac

SEQ ID NO: 2562586 - DNA, 18 bp, Homo sapiens
cacccgaggctgcccact

SEQ ID NO: 2562587 - DNA, 16 bp, Homo sapiens
cacccgatgctgcttt

SEQ ID NO: 2562588 - DNA, 23 bp, Homo sapiens
cacccgatgctgctttcccctgt

SEQ ID NO: 2562589 - DNA, 14 bp, Homo sapiens
cacccgcctctccc

SEQ ID NO: 2562590 - DNA, 18 bp, Homo sapiens
cacccggcccctgctggt

SEQ ID NO: 2562591 - DNA, 17 bp, Homo sapiens
cacccgtggagatggga

SEQ ID NO: 2562592 - DNA, 21 bp, Homo sapiens
cacccgttctgctggcctgga

SEQ ID NO: 2562593 - DNA, 12 bp, Homo sapiens
caccctacctgt

SEQ ID NO: 2562594 - DNA, 16 bp, Homo sapiens
caccctacctgttcag

SEQ ID NO: 2562595 - DNA, 20 bp, Homo sapiens
caccctagtcccttcccctc

SEQ ID NO: 2562596 - DNA, 20 bp, Homo sapiens
caccctcagcaccccttcca

SEQ ID NO: 2562597 - DNA, 14 bp, Homo sapiens
caccctcaggcagg

SEQ ID NO: 2562598 - DNA, 13 bp, Homo sapiens
caccctcatgctg

SEQ ID NO: 2562599 - DNA, 14 bp, Homo sapiens
caccctccaccctg

SEQ ID NO: 2562600 - DNA, 16 bp, Homo sapiens
caccctccaccctgtc

SEQ ID NO: 2562601 - DNA, 18 bp, Homo sapiens
caccctccaccctgtccc

SEQ ID NO: 2562602 - DNA, 20 bp, Homo sapiens
caccctcccccgccactcct

SEQ ID NO: 2562603 - DNA, 13 bp, Homo sapiens
caccctcccctct

SEQ ID NO: 2562604 - DNA, 15 bp, Homo sapiens
caccctcccctctct

SEQ ID NO: 2562605 - DNA, 16 bp, Homo sapiens
caccctcccctctctt

SEQ ID NO: 2562606 - DNA, 23 bp, Homo sapiens
caccctccctccgatccttcctc

SEQ ID NO: 2562607 - DNA, 13 bp, Homo sapiens
caccctccctgga

SEQ ID NO: 2562608 - DNA, 15 bp, Homo sapiens
caccctccctggagt

SEQ ID NO: 2562609 - DNA, 16 bp, Homo sapiens
caccctccctggagtg

SEQ ID NO: 2562610 - DNA, 16 bp, Homo sapiens
caccctcctgtcttcc

SEQ ID NO: 2562611 - DNA, 17 bp, Homo sapiens
caccctggggagaaagt

SEQ ID NO: 2562612 - DNA, 14 bp, Homo sapiens
caccctggggcctg

SEQ ID NO: 2562613 - DNA, 16 bp, Homo sapiens
caccctgtactgttct

SEQ ID NO: 2562614 - DNA, 23 bp, Homo sapiens
caccctgtactgttctgtgtctt

SEQ ID NO: 2562615 - DNA, 17 bp, Homo sapiens
caccctgtctaaaaaac

SEQ ID NO: 2562616 - DNA, 11 bp, Homo sapiens
caccctgtgat

SEQ ID NO: 2562617 - DNA, 12 bp, Homo sapiens
caccctgtgatg

SEQ ID NO: 2562618 - DNA, 22 bp, Homo sapiens
caccctgtgatggggccctgcc

SEQ ID NO: 2562619 - DNA, 16 bp, Homo sapiens
cacccttaccatgtgc

SEQ ID NO: 2562620 - DNA, 13 bp, Homo sapiens
cacccttcccctc

SEQ ID NO: 2562621 - DNA, 23 bp, Homo sapiens
cacccttcccctccttctccctt

SEQ ID NO: 2562622 - DNA, 18 bp, Homo sapiens
cacccttctttcctcttc

SEQ ID NO: 2562623 - DNA, 17 bp, Homo sapiens
cacccttttccagctgg

SEQ ID NO: 2562624 - DNA, 21 bp, Homo sapiens
caccgaagtggactggcccct

SEQ ID NO: 2562625 - DNA, 22 bp, Homo sapiens
caccgaagtggactggcccctg

SEQ ID NO: 2562626 - DNA, 17 bp, Homo sapiens
caccgagggcgaccccg

SEQ ID NO: 2562627 - DNA, 12 bp, Homo sapiens
caccgcagacag

SEQ ID NO: 2562628 - DNA, 14 bp, Homo sapiens
caccgcagacagga

SEQ ID NO: 2562629 - DNA, 13 bp, Homo sapiens
caccgcagtcgtc

SEQ ID NO: 2562630 - DNA, 18 bp, Homo sapiens
caccgccacatggcttcc

SEQ ID NO: 2562631 - DNA, 22 bp, Homo sapiens
caccggagctttcaaagaagga

SEQ ID NO: 2562632 - DNA, 17 bp, Homo sapiens
caccggctggcctggcc

SEQ ID NO: 2562633 - DNA, 14 bp, Homo sapiens
caccgggcactcag

SEQ ID NO: 2562634 - DNA, 14 bp, Homo sapiens
caccgtactgtgga

SEQ ID NO: 2562635 - DNA, 15 bp, Homo sapiens
caccgtcatggctta

SEQ ID NO: 2562636 - DNA, 15 bp, Homo sapiens
caccgtccgccctgc

SEQ ID NO: 2562637 - DNA, 16 bp, Homo sapiens
caccgtccgccctgct

SEQ ID NO: 2562638 - DNA, 19 bp, Homo sapiens
caccgtccgccctgctcct

SEQ ID NO: 2562639 - DNA, 18 bp, Homo sapiens
caccgtggaccttcctgc

SEQ ID NO: 2562640 - DNA, 15 bp, Homo sapiens
caccgtgtaaaccaa

SEQ ID NO: 2562641 - DNA, 13 bp, Homo sapiens
cacctaagggaca

SEQ ID NO: 2562642 - DNA, 14 bp, Homo sapiens
cacctaatgtttat

SEQ ID NO: 2562643 - DNA, 21 bp, Homo sapiens
cacctaatgtttatgagccag

SEQ ID NO: 2562644 - DNA, 13 bp, Homo sapiens
cacctacagtgta

SEQ ID NO: 2562645 - DNA, 21 bp, Homo sapiens
cacctacatgaggtactgaga

SEQ ID NO: 2562646 - DNA, 22 bp, Homo sapiens
cacctaccatcagggacaggat

SEQ ID NO: 2562647 - DNA, 16 bp, Homo sapiens
cacctagctttattct

SEQ ID NO: 2562648 - DNA, 15 bp, Homo sapiens
cacctagtccagtga

SEQ ID NO: 2562649 - DNA, 19 bp, Homo sapiens
cacctataaaacaggtcaa

SEQ ID NO: 2562650 - DNA, 20 bp, Homo sapiens
cacctatctcgtgggagagc

SEQ ID NO: 2562651 - DNA, 12 bp, Homo sapiens
cacctatgtgcc

SEQ ID NO: 2562652 - DNA, 14 bp, Homo sapiens
cacctatgtgccaa

SEQ ID NO: 2562653 - DNA, 19 bp, Homo sapiens
cacctcagagtatggagct

SEQ ID NO: 2562654 - DNA, 13 bp, Homo sapiens
cacctcagcctcc

SEQ ID NO: 2562655 - DNA, 23 bp, Homo sapiens
cacctcaggccaggtgcagtggc

SEQ ID NO: 2562656 - DNA, 17 bp, Homo sapiens
cacctcagttcccttgg

SEQ ID NO: 2562657 - DNA, 19 bp, Homo sapiens
cacctcagttcccttggcc

SEQ ID NO: 2562658 - DNA, 13 bp, Homo sapiens
cacctccacagtt

SEQ ID NO: 2562659 - DNA, 18 bp, Homo sapiens
cacctccacagttcagtg

SEQ ID NO: 2562660 - DNA, 10 bp, Homo sapiens
cacctcccag

SEQ ID NO: 2562661 - DNA, 16 bp, Homo sapiens
cacctcccatcctaat

SEQ ID NO: 2562662 - DNA, 11 bp, Homo sapiens
cacctcccctc

SEQ ID NO: 2562663 - DNA, 14 bp, Homo sapiens
cacctcccctcctt

SEQ ID NO: 2562664 - DNA, 12 bp, Homo sapiens
cacctccctccc

SEQ ID NO: 2562665 - DNA, 14 bp, Homo sapiens
cacctcctgcctcg

SEQ ID NO: 2562666 - DNA, 15 bp, Homo sapiens
cacctctccaagggc

SEQ ID NO: 2562667 - DNA, 18 bp, Homo sapiens
cacctctccaagggcttc

SEQ ID NO: 2562668 - DNA, 13 bp, Homo sapiens
cacctctccctca

SEQ ID NO: 2562669 - DNA, 14 bp, Homo sapiens
cacctctccctcaa

SEQ ID NO: 2562670 - DNA, 19 bp, Homo sapiens
cacctctccctcaacaagg

SEQ ID NO: 2562671 - DNA, 13 bp, Homo sapiens
cacctctcccttg

SEQ ID NO: 2562672 - DNA, 18 bp, Homo sapiens
cacctctctcactccttg

SEQ ID NO: 2562673 - DNA, 16 bp, Homo sapiens
cacctctctcctttgc

SEQ ID NO: 2562674 - DNA, 19 bp, Homo sapiens
cacctctggactggctaga

SEQ ID NO: 2562675 - DNA, 18 bp, Homo sapiens
cacctcttctcttcctgt

SEQ ID NO: 2562676 - DNA, 15 bp, Homo sapiens
cacctgactctgaaa

SEQ ID NO: 2562677 - DNA, 23 bp, Homo sapiens
cacctgagcccggatgcttctcc

SEQ ID NO: 2562678 - DNA, 16 bp, Homo sapiens
cacctgattcaactaa

SEQ ID NO: 2562679 - DNA, 17 bp, Homo sapiens
cacctgccagcctggct

SEQ ID NO: 2562680 - DNA, 11 bp, Homo sapiens
cacctgccagg

SEQ ID NO: 2562681 - DNA, 12 bp, Homo sapiens
cacctgccaggg

SEQ ID NO: 2562682 - DNA, 17 bp, Homo sapiens
cacctgccatttgcacc

SEQ ID NO: 2562683 - DNA, 13 bp, Homo sapiens
cacctgccccctt

SEQ ID NO: 2562684 - DNA, 19 bp, Homo sapiens
cacctgcccccttctccca

SEQ ID NO: 2562685 - DNA, 13 bp, Homo sapiens
cacctgccctgcc

SEQ ID NO: 2562686 - DNA, 16 bp, Homo sapiens
cacctgcggtgctatc

SEQ ID NO: 2562687 - DNA, 17 bp, Homo sapiens
cacctgcggtgctatct

SEQ ID NO: 2562688 - DNA, 20 bp, Homo sapiens
cacctgcggtgctatctccc

SEQ ID NO: 2562689 - DNA, 19 bp, Homo sapiens
cacctgctcccaggccagt

SEQ ID NO: 2562690 - DNA, 16 bp, Homo sapiens
cacctgctggcccctc

SEQ ID NO: 2562691 - DNA, 18 bp, Homo sapiens
cacctggcactgctgtgc

SEQ ID NO: 2562692 - DNA, 11 bp, Homo sapiens
cacctggccac

SEQ ID NO: 2562693 - DNA, 12 bp, Homo sapiens
cacctggccacc

SEQ ID NO: 2562694 - DNA, 13 bp, Homo sapiens
cacctggccacct

SEQ ID NO: 2562695 - DNA, 17 bp, Homo sapiens
cacctggccacctgagg

SEQ ID NO: 2562696 - DNA, 20 bp, Homo sapiens
cacctggccacctgaggtgg

SEQ ID NO: 2562697 - DNA, 21 bp, Homo sapiens
cacctggccacctgaggtggg

SEQ ID NO: 2562698 - DNA, 12 bp, Homo sapiens
cacctggcctct

SEQ ID NO: 2562699 - DNA, 15 bp, Homo sapiens
cacctgggcacctgg

SEQ ID NO: 2562700 - DNA, 19 bp, Homo sapiens
cacctgggcacctggggag

SEQ ID NO: 2562701 - DNA, 15 bp, Homo sapiens
cacctggggagtggg

SEQ ID NO: 2562702 - DNA, 17 bp, Homo sapiens
cacctggggagtgggac

SEQ ID NO: 2562703 - DNA, 22 bp, Homo sapiens
cacctggggagtgggacagagt

SEQ ID NO: 2562704 - DNA, 14 bp, Homo sapiens
cacctggggctgct

SEQ ID NO: 2562705 - DNA, 15 bp, Homo sapiens
cacctggggctgctg

SEQ ID NO: 2562706 - DNA, 20 bp, Homo sapiens
cacctggggtgtgggaggcc

SEQ ID NO: 2562707 - DNA, 16 bp, Homo sapiens
cacctgtaaacctgag

SEQ ID NO: 2562708 - DNA, 21 bp, Homo sapiens
cacctgtaatcccagctactt

SEQ ID NO: 2562709 - DNA, 22 bp, Homo sapiens
cacctgtactcaggaggctgag

SEQ ID NO: 2562710 - DNA, 21 bp, Homo sapiens
cacctgtcaaacaaagccaga

SEQ ID NO: 2562711 - DNA, 19 bp, Homo sapiens
cacctgttgcttacaattt

SEQ ID NO: 2562712 - DNA, 17 bp, Homo sapiens
caccttaccaactttct

SEQ ID NO: 2562713 - DNA, 16 bp, Homo sapiens
caccttagacagtccc

SEQ ID NO: 2562714 - DNA, 14 bp, Homo sapiens
caccttaggcaggg

SEQ ID NO: 2562715 - DNA, 18 bp, Homo sapiens
caccttaggcagggaagt

SEQ ID NO: 2562716 - DNA, 15 bp, Homo sapiens
caccttagtggcttt

SEQ ID NO: 2562717 - DNA, 14 bp, Homo sapiens
caccttccagctcc

SEQ ID NO: 2562718 - DNA, 16 bp, Homo sapiens
caccttgacagggcac

SEQ ID NO: 2562719 - DNA, 17 bp, Homo sapiens
caccttgcaacacacag

SEQ ID NO: 2562720 - DNA, 18 bp, Homo sapiens
caccttggggcttgactt

SEQ ID NO: 2562721 - DNA, 17 bp, Homo sapiens
caccttgtgtctgtaca

SEQ ID NO: 2562722 - DNA, 18 bp, Homo sapiens
cacctttattaaaatctt

SEQ ID NO: 2562723 - DNA, 15 bp, Homo sapiens
cacctttgtccccac

SEQ ID NO: 2562724 - DNA, 17 bp, Homo sapiens
caccttttttaaggaaa

SEQ ID NO: 2562725 - DNA, 17 bp, Homo sapiens
cacgaaatgttattttt

SEQ ID NO: 2562726 - DNA, 22 bp, Homo sapiens
cacgaatttgctggggaatctc

SEQ ID NO: 2562727 - DNA, 15 bp, Homo sapiens
cacgcacacacacac

SEQ ID NO: 2562728 - DNA, 20 bp, Homo sapiens
cacgcacacacacacacagg

SEQ ID NO: 2562729 - DNA, 15 bp, Homo sapiens
cacgcacctcccatc

SEQ ID NO: 2562730 - DNA, 19 bp, Homo sapiens
cacgcacctcccatcctaa

SEQ ID NO: 2562731 - DNA, 16 bp, Homo sapiens
cacgcaggaactccca

SEQ ID NO: 2562732 - DNA, 14 bp, Homo sapiens
cacgccactgcact

SEQ ID NO: 2562733 - DNA, 16 bp, Homo sapiens
cacgccagattctttc

SEQ ID NO: 2562734 - DNA, 19 bp, Homo sapiens
cacgccagattctttcctg

SEQ ID NO: 2562735 - DNA, 15 bp, Homo sapiens
cacgcccatgtgtga

SEQ ID NO: 2562736 - DNA, 13 bp, Homo sapiens
cacgcccccactg

SEQ ID NO: 2562737 - DNA, 15 bp, Homo sapiens
cacgcccccactggt

SEQ ID NO: 2562738 - DNA, 21 bp, Homo sapiens
cacgcctatgatcccagcact

SEQ ID NO: 2562739 - DNA, 15 bp, Homo sapiens
caggtatctccagga

SEQ ID NO: 2562740 - DNA, 16 bp, Homo sapiens
caggtatctccaggat

SEQ ID NO: 2562741 - DNA, 16 bp, Homo sapiens
caggtcagggtgagga

SEQ ID NO: 2562742 - DNA, 22 bp, Homo sapiens
caggtccacggtctgttcttga

SEQ ID NO: 2562743 - DNA, 21 bp, Homo sapiens
caggtcctctgatacccagag

SEQ ID NO: 2562744 - DNA, 14 bp, Homo sapiens
caggtctcacgggc

SEQ ID NO: 2562745 - DNA, 19 bp, Homo sapiens
caggtctcccacgtgggag

SEQ ID NO: 2562746 - DNA, 20 bp, Homo sapiens
caggtctcccacgtgggaga

SEQ ID NO: 2562747 - DNA, 15 bp, Homo sapiens
caggtctcctcttaa

SEQ ID NO: 2562748 - DNA, 23 bp, Homo sapiens
caggtcttggagctgagcctctc

SEQ ID NO: 2562749 - DNA, 12 bp, Homo sapiens
caggtgacatgt

SEQ ID NO: 2562750 - DNA, 16 bp, Homo sapiens
caggtgacatgtgaaa

SEQ ID NO: 2562751 - DNA, 18 bp, Homo sapiens
caggtgacatgtgaaacc

SEQ ID NO: 2562752 - DNA, 21 bp, Homo sapiens
caggtgagaagcagaggaagg

SEQ ID NO: 2562753 - DNA, 15 bp, Homo sapiens
caggtgagcccatgg

SEQ ID NO: 2562754 - DNA, 17 bp, Homo sapiens
caggtgagcccatggcc

SEQ ID NO: 2562755 - DNA, 20 bp, Homo sapiens
caggtgagcccatggccctc

SEQ ID NO: 2562756 - DNA, 21 bp, Homo sapiens
caggtgatccacccacctcag

SEQ ID NO: 2562757 - DNA, 19 bp, Homo sapiens
caggtgcacaagctccaag

SEQ ID NO: 2562758 - DNA, 18 bp, Homo sapiens
caggtgcagcccccactg

SEQ ID NO: 2562759 - DNA, 19 bp, Homo sapiens
caggtgccagttatggcta

SEQ ID NO: 2562760 - DNA, 17 bp, Homo sapiens
caggtgcccatccctgg

SEQ ID NO: 2562761 - DNA, 12 bp, Homo sapiens
caggtgcctcca

SEQ ID NO: 2562762 - DNA, 16 bp, Homo sapiens
caggtgcctccaggtg

SEQ ID NO: 2562763 - DNA, 17 bp, Homo sapiens
caggtgcctccaggtgt

SEQ ID NO: 2562764 - DNA, 18 bp, Homo sapiens
caggtgcctccaggtgtg

SEQ ID NO: 2562765 - DNA, 19 bp, Homo sapiens
caggtgcctccaggtgtgc

SEQ ID NO: 2562766 - DNA, 14 bp, Homo sapiens
caggtgccttggag

SEQ ID NO: 2562767 - DNA, 14 bp, Homo sapiens
caggtgcgaaagga

SEQ ID NO: 2562768 - DNA, 15 bp, Homo sapiens
caggtggcaggacca

SEQ ID NO: 2562769 - DNA, 20 bp, Homo sapiens
caggtggcaggaccaggact

SEQ ID NO: 2562770 - DNA, 19 bp, Homo sapiens
caggtggccagcctggatc

SEQ ID NO: 2562771 - DNA, 17 bp, Homo sapiens
caggtgggcgtggtcac

SEQ ID NO: 2562772 - DNA, 23 bp, Homo sapiens
caggtggggagactgggctgagg

SEQ ID NO: 2562773 - DNA, 16 bp, Homo sapiens
caggtggggcagcttg

SEQ ID NO: 2562774 - DNA, 23 bp, Homo sapiens
caggtggggtcactctggcagct

SEQ ID NO: 2562775 - DNA, 21 bp, Homo sapiens
caggtggtggcactgagcccc

SEQ ID NO: 2562776 - DNA, 14 bp, Homo sapiens
caggtgtccctgca

SEQ ID NO: 2562777 - DNA, 18 bp, Homo sapiens
caggtgtccctgcacttg

SEQ ID NO: 2562778 - DNA, 21 bp, Homo sapiens
caggtgtgagtcaccaagccc

SEQ ID NO: 2562779 - DNA, 23 bp, Homo sapiens
caggtgtgagtcaccaagcccag

SEQ ID NO: 2562780 - DNA, 20 bp, Homo sapiens
caggatcagattgcatgtga

SEQ ID NO: 2562781 - DNA, 24 bp, Homo sapiens
caggatcagattgcatgtgactct

SEQ ID NO: 2562782 - DNA, 13 bp, Homo sapiens
caggatcagtctg

SEQ ID NO: 2562783 - DNA, 21 bp, Homo sapiens
caggatcatggtgtaataaga

SEQ ID NO: 2562784 - DNA, 16 bp, Homo sapiens
caggatcccaggggcc

SEQ ID NO: 2562785 - DNA, 21 bp, Homo sapiens
caggatcccaggggcccaagg

SEQ ID NO: 2562786 - DNA, 20 bp, Homo sapiens
caggatcctattctcaccag

SEQ ID NO: 2562787 - DNA, 22 bp, Homo sapiens
caggatcctattctcaccagga

SEQ ID NO: 2562788 - DNA, 15 bp, Homo sapiens
caggatgaccctgcg

SEQ ID NO: 2562789 - DNA, 17 bp, Homo sapiens
caggatgacctggataa

SEQ ID NO: 2562790 - DNA, 23 bp, Homo sapiens
caggatggccgggcgcggtggct

SEQ ID NO: 2562791 - DNA, 15 bp, Homo sapiens
caggatggcctggcc

SEQ ID NO: 2562792 - DNA, 18 bp, Homo sapiens
caggatgggggctggcct

SEQ ID NO: 2562793 - DNA, 19 bp, Homo sapiens
caggatgggggctggcctc

SEQ ID NO: 2562794 - DNA, 15 bp, Homo sapiens
caggattgaagagca

SEQ ID NO: 2562795 - DNA, 22 bp, Homo sapiens
caggatttgaactcagatctgt

SEQ ID NO: 2562796 - DNA, 16 bp, Homo sapiens
caggattttaatcttt

SEQ ID NO: 2562797 - DNA, 14 bp, Homo sapiens
caggcaaaatcctt

SEQ ID NO: 2562798 - DNA, 16 bp, Homo sapiens
caggcaaagcaagtga

SEQ ID NO: 2562799 - DNA, 15 bp, Homo sapiens
caggcaactgaggca

SEQ ID NO: 2562800 - DNA, 17 bp, Homo sapiens
caggcaactgaggcaga

SEQ ID NO: 2562801 - DNA, 18 bp, Homo sapiens
caggcaactgaggcagac

SEQ ID NO: 2562802 - DNA, 15 bp, Homo sapiens
caggcaagcacctcc

SEQ ID NO: 2562803 - DNA, 14 bp, Homo sapiens
caggcaatgctggc

SEQ ID NO: 2562804 - DNA, 16 bp, Homo sapiens
caggcaatgctggctg

SEQ ID NO: 2562805 - DNA, 20 bp, Homo sapiens
caggcaatgctggctgttgg

SEQ ID NO: 2562806 - DNA, 19 bp, Homo sapiens
caggcacacgccacctcgc

SEQ ID NO: 2562807 - DNA, 15 bp, Homo sapiens
caggcacacttcttc

SEQ ID NO: 2562808 - DNA, 15 bp, Homo sapiens
caggcaccccctgga

SEQ ID NO: 2562809 - DNA, 17 bp, Homo sapiens
caggcactgctgcccag

SEQ ID NO: 2562810 - DNA, 16 bp, Homo sapiens
caggcagatctgtgcc

SEQ ID NO: 2562811 - DNA, 18 bp, Homo sapiens
caggcagatctgtgcccc

SEQ ID NO: 2562812 - DNA, 21 bp, Homo sapiens
caggcagatctgtgccccatg

SEQ ID NO: 2562813 - DNA, 22 bp, Homo sapiens
caggcagatctgtgccccatgc

SEQ ID NO: 2562814 - DNA, 12 bp, Homo sapiens
caggcagcagag

SEQ ID NO: 2562815 - DNA, 23 bp, Homo sapiens
caggcagcagagacttgggacat

SEQ ID NO: 2562816 - DNA, 13 bp, Homo sapiens
caggcagcattta

SEQ ID NO: 2562817 - DNA, 15 bp, Homo sapiens
caggcagccaggcca

SEQ ID NO: 2562818 - DNA, 18 bp, Homo sapiens
caggcagcgatggtctca

SEQ ID NO: 2562819 - DNA, 21 bp, Homo sapiens
caggcagcgatggtctcagaa

SEQ ID NO: 2562820 - DNA, 20 bp, Homo sapiens
caggcaggaaggctgagagg

SEQ ID NO: 2562821 - DNA, 15 bp, Homo sapiens
caggcaggtccaggg

SEQ ID NO: 2562822 - DNA, 16 bp, Homo sapiens
caggcaggtgcctgga

SEQ ID NO: 2562823 - DNA, 20 bp, Homo sapiens
caggcagtcgggggctggcc

SEQ ID NO: 2562824 - DNA, 22 bp, Homo sapiens
caggcagtgatgctggatgctc

SEQ ID NO: 2562825 - DNA, 17 bp, Homo sapiens
caggcagttggccagag

SEQ ID NO: 2562826 - DNA, 16 bp, Homo sapiens
caggcataggcctggg

SEQ ID NO: 2562827 - DNA, 15 bp, Homo sapiens
caggcatcacagcta

SEQ ID NO: 2562828 - DNA, 17 bp, Homo sapiens
caggcatgcatgtgctt

SEQ ID NO: 2562829 - DNA, 16 bp, Homo sapiens
caggcatgcctgtgtg

SEQ ID NO: 2562830 - DNA, 20 bp, Homo sapiens
caggcatgttctctgaggac

SEQ ID NO: 2562831 - DNA, 16 bp, Homo sapiens
caggcattccccagga

SEQ ID NO: 2562832 - DNA, 19 bp, Homo sapiens
caggccaaggccttctcct

SEQ ID NO: 2562833 - DNA, 13 bp, Homo sapiens
caggccaccagga

SEQ ID NO: 2562834 - DNA, 16 bp, Homo sapiens
caggccacctccagaa

SEQ ID NO: 2562835 - DNA, 13 bp, Homo sapiens
caggccacctgcc

SEQ ID NO: 2562836 - DNA, 14 bp, Homo sapiens
caggccaggccacc

SEQ ID NO: 2562837 - DNA, 17 bp, Homo sapiens
caggccaggccctctgc

SEQ ID NO: 2562838 - DNA, 19 bp, Homo sapiens
caggccaggccctctgccc

SEQ ID NO: 2562839 - DNA, 21 bp, Homo sapiens
caggccaggccctctgcccac

SEQ ID NO: 2562840 - DNA, 12 bp, Homo sapiens
caggccaggctc

SEQ ID NO: 2562841 - DNA, 21 bp, Homo sapiens
caggccaggctccttcctgtc

SEQ ID NO: 2562842 - DNA, 21 bp, Homo sapiens
caggccatcatcagtggagcc

SEQ ID NO: 2562843 - DNA, 18 bp, Homo sapiens
caggccatccggccccca

SEQ ID NO: 2562844 - DNA, 18 bp, Homo sapiens
caggcccaagagatgaag

SEQ ID NO: 2562845 - DNA, 11 bp, Homo sapiens
caggcccagca

SEQ ID NO: 2562846 - DNA, 21 bp, Homo sapiens
caggcccagcattgctggttc

SEQ ID NO: 2562847 - DNA, 17 bp, Homo sapiens
caggccccaaaaccaca

SEQ ID NO: 2562848 - DNA, 13 bp, Homo sapiens
caggccccagcaa

SEQ ID NO: 2562849 - DNA, 17 bp, Homo sapiens
caggcccccaagcctgc

SEQ ID NO: 2562850 - DNA, 19 bp, Homo sapiens
caggcccccaagcctgcag

SEQ ID NO: 2562851 - DNA, 19 bp, Homo sapiens
caggcccccaggtgccagt

SEQ ID NO: 2562852 - DNA, 21 bp, Homo sapiens
caggccccgaggacccagacc

SEQ ID NO: 2562853 - DNA, 23 bp, Homo sapiens
caggccccgaggacccagaccca

SEQ ID NO: 2562854 - DNA, 13 bp, Homo sapiens
caggcccctgcca

SEQ ID NO: 2562855 - DNA, 17 bp, Homo sapiens
caggcccctgccaccct

SEQ ID NO: 2562856 - DNA, 13 bp, Homo sapiens
caggcccggctcc

SEQ ID NO: 2562857 - DNA, 19 bp, Homo sapiens
caggcccggctccaggctc

SEQ ID NO: 2562858 - DNA, 20 bp, Homo sapiens
caggcccggctccaggctcc

SEQ ID NO: 2562859 - DNA, 21 bp, Homo sapiens
caggcccttattttcaagaaa

SEQ ID NO: 2562860 - DNA, 13 bp, Homo sapiens
caggccgcagctc

SEQ ID NO: 2562861 - DNA, 20 bp, Homo sapiens
caggccggggtggagcatgg

SEQ ID NO: 2562862 - DNA, 18 bp, Homo sapiens
caggccgtcctcccgggc

SEQ ID NO: 2562863 - DNA, 12 bp, Homo sapiens
caggcctccctc

SEQ ID NO: 2562864 - DNA, 17 bp, Homo sapiens
caggcctccctctctct

SEQ ID NO: 2562865 - DNA, 23 bp, Homo sapiens
caggcctccctctctcttctgct

SEQ ID NO: 2562866 - DNA, 17 bp, Homo sapiens
caggcctctgtgtcctt

SEQ ID NO: 2562867 - DNA, 19 bp, Homo sapiens
caggcctcttggcagtcac

SEQ ID NO: 2562868 - DNA, 20 bp, Homo sapiens
caggcctgcctgttcccatt

SEQ ID NO: 2562869 - DNA, 20 bp, Homo sapiens
caggcctggcaagtgggtga

SEQ ID NO: 2562870 - DNA, 16 bp, Homo sapiens
caggcctgggtctgtg

SEQ ID NO: 2562871 - DNA, 14 bp, Homo sapiens
cagctgggaggcaa

SEQ ID NO: 2562872 - DNA, 14 bp, Homo sapiens
cagctgggcccaac

SEQ ID NO: 2562873 - DNA, 17 bp, Homo sapiens
cagctgggcccaaccct

SEQ ID NO: 2562874 - DNA, 15 bp, Homo sapiens
cagctgggctctgcc

SEQ ID NO: 2562875 - DNA, 20 bp, Homo sapiens
cagctggggcgtggggaggg

SEQ ID NO: 2562876 - DNA, 19 bp, Homo sapiens
cagctgtaagaagagactg

SEQ ID NO: 2562877 - DNA, 19 bp, Homo sapiens
cagctgtgctctggacagg

SEQ ID NO: 2562878 - DNA, 21 bp, Homo sapiens
cagctgtttaaatgtttttct

SEQ ID NO: 2562879 - DNA, 20 bp, Homo sapiens
cagctgttttagttaaattt

SEQ ID NO: 2562880 - DNA, 21 bp, Homo sapiens
cagctgttttagttaaatttc

SEQ ID NO: 2562881 - DNA, 17 bp, Homo sapiens
cagcttattcacaagac

SEQ ID NO: 2562882 - DNA, 14 bp, Homo sapiens
cagcttcaccagag

SEQ ID NO: 2562883 - DNA, 16 bp, Homo sapiens
cagcttcaccagagca

SEQ ID NO: 2562884 - DNA, 18 bp, Homo sapiens
cagcttcatttcctgtgt

SEQ ID NO: 2562885 - DNA, 15 bp, Homo sapiens
cagcttcatttgtgt

SEQ ID NO: 2562886 - DNA, 14 bp, Homo sapiens
cagcttcctaccca

SEQ ID NO: 2562887 - DNA, 20 bp, Homo sapiens
cagcttcgtttattttcaag

SEQ ID NO: 2562888 - DNA, 19 bp, Homo sapiens
cagcttctattagccagtc

SEQ ID NO: 2562889 - DNA, 19 bp, Homo sapiens
cagcttctcatcctgcagg

SEQ ID NO: 2562890 - DNA, 20 bp, Homo sapiens
cagcttctcatcctgcaggc

SEQ ID NO: 2562891 - DNA, 14 bp, Homo sapiens
cagcttctggtact

SEQ ID NO: 2562892 - DNA, 14 bp, Homo sapiens
cagcttcttcatct

SEQ ID NO: 2562893 - DNA, 18 bp, Homo sapiens
cagcttgaaactgagatg

SEQ ID NO: 2562894 - DNA, 15 bp, Homo sapiens
cagcttgagggttgg

SEQ ID NO: 2562895 - DNA, 18 bp, Homo sapiens
cagcttgagggttgggct

SEQ ID NO: 2562896 - DNA, 21 bp, Homo sapiens
cagcttgagggttgggctggt

SEQ ID NO: 2562897 - DNA, 23 bp, Homo sapiens
cagcttgatcaaaggcacacagc

SEQ ID NO: 2562898 - DNA, 12 bp, Homo sapiens
cagcttgccccg

SEQ ID NO: 2562899 - DNA, 17 bp, Homo sapiens
cagcttgggcccagctg

SEQ ID NO: 2562900 - DNA, 19 bp, Homo sapiens
cagcttgggcccagctggg

SEQ ID NO: 2562901 - DNA, 22 bp, Homo sapiens
cagcttgggcccagctgggctc

SEQ ID NO: 2562902 - DNA, 19 bp, Homo sapiens
cagcttgtaaatagctcag

SEQ ID NO: 2562903 - DNA, 22 bp, Homo sapiens
cagcttgtaaatagctcaggtg

SEQ ID NO: 2562904 - DNA, 14 bp, Homo sapiens
cagcttgtgcacaa

SEQ ID NO: 2562905 - DNA, 17 bp, Homo sapiens
cagcttgtggagcccca

SEQ ID NO: 2562906 - DNA, 15 bp, Homo sapiens
cagcttgtgttgtca

SEQ ID NO: 2562907 - DNA, 13 bp, Homo sapiens
cagctttaaacaa

SEQ ID NO: 2562908 - DNA, 18 bp, Homo sapiens
cagctttaaactcaggga

SEQ ID NO: 2562909 - DNA, 19 bp, Homo sapiens
cagctttaaactcagggac

SEQ ID NO: 2562910 - DNA, 21 bp, Homo sapiens
cagctttaaactcagggacag

SEQ ID NO: 2562911 - DNA, 19 bp, Homo sapiens
cagctttacatgcaattta

SEQ ID NO: 2562912 - DNA, 19 bp, Homo sapiens
cagctttgtgactgtatat

SEQ ID NO: 2562913 - DNA, 22 bp, Homo sapiens
cagctttgtttgttgtcagctg

SEQ ID NO: 2562914 - DNA, 23 bp, Homo sapiens
caggaaaacgggaccggccaggc

SEQ ID NO: 2562915 - DNA, 16 bp, Homo sapiens
caggaaaagctgctga

SEQ ID NO: 2562916 - DNA, 20 bp, Homo sapiens
caggaaaagctgctgacagt

SEQ ID NO: 2562917 - DNA, 19 bp, Homo sapiens
caggaaagctcagctactg

SEQ ID NO: 2562918 - DNA, 14 bp, Homo sapiens
caggaaaggctcca

SEQ ID NO: 2562919 - DNA, 17 bp, Homo sapiens
caggaaaggctccagga

SEQ ID NO: 2562920 - DNA, 21 bp, Homo sapiens
caggaaaggctccaggagcag

SEQ ID NO: 2562921 - DNA, 22 bp, Homo sapiens
caggaaaggctccaggagcagc

SEQ ID NO: 2562922 - DNA, 23 bp, Homo sapiens
caggaaatatatatgtgtgtgta

SEQ ID NO: 2562923 - DNA, 21 bp, Homo sapiens
caggaaatcaaatatgcaaag

SEQ ID NO: 2562924 - DNA, 22 bp, Homo sapiens
caggaaatcaaatatgcaaagc

SEQ ID NO: 2562925 - DNA, 13 bp, Homo sapiens
caggaaatgaaaa

SEQ ID NO: 2562926 - DNA, 21 bp, Homo sapiens
caggaacaatcgatggccttg

SEQ ID NO: 2562927 - DNA, 15 bp, Homo sapiens
caggaacagaaggat

SEQ ID NO: 2562928 - DNA, 15 bp, Homo sapiens
caggaactataaaaa

SEQ ID NO: 2562929 - DNA, 17 bp, Homo sapiens
caggaactataaaaaca

SEQ ID NO: 2562930 - DNA, 14 bp, Homo sapiens
caggaactcccagc

SEQ ID NO: 2562931 - DNA, 16 bp, Homo sapiens
caggaactcccagcaa

SEQ ID NO: 2562932 - DNA, 15 bp, Homo sapiens
caggaagcaccccat

SEQ ID NO: 2562933 - DNA, 16 bp, Homo sapiens
caggaagcaccccatg

SEQ ID NO: 2562934 - DNA, 17 bp, Homo sapiens
caggaagcaccccatgc

SEQ ID NO: 2562935 - DNA, 13 bp, Homo sapiens
caggaagcctgca

SEQ ID NO: 2562936 - DNA, 19 bp, Homo sapiens
caggaagcctgcagtcctg

SEQ ID NO: 2562937 - DNA, 17 bp, Homo sapiens
caggaagctcagactgg

SEQ ID NO: 2562938 - DNA, 13 bp, Homo sapiens
caggaagctcagg

SEQ ID NO: 2562939 - DNA, 15 bp, Homo sapiens
caggaagctcagggc

SEQ ID NO: 2562940 - DNA, 20 bp, Homo sapiens
caggaagctcagggcctggc

SEQ ID NO: 2562941 - DNA, 17 bp, Homo sapiens
caggaagctgctccgtg

SEQ ID NO: 2562942 - DNA, 18 bp, Homo sapiens
caggaagctgctccgtgc

SEQ ID NO: 2562943 - DNA, 14 bp, Homo sapiens
caggaaggaagtca

SEQ ID NO: 2562944 - DNA, 12 bp, Homo sapiens
caggaaggagag

SEQ ID NO: 2562945 - DNA, 13 bp, Homo sapiens
caggaaggagagc

SEQ ID NO: 2562946 - DNA, 18 bp, Homo sapiens
caggaaggagagcctgct

SEQ ID NO: 2562947 - DNA, 19 bp, Homo sapiens
caggaaggctgagaggaga

SEQ ID NO: 2562948 - DNA, 16 bp, Homo sapiens
caggaagtagaggagg

SEQ ID NO: 2562949 - DNA, 16 bp, Homo sapiens
caggaagtcttcaggg

SEQ ID NO: 2562950 - DNA, 12 bp, Homo sapiens
caggaataaggc

SEQ ID NO: 2562951 - DNA, 18 bp, Homo sapiens
caggacaacgaggaagcc

SEQ ID NO: 2562952 - DNA, 13 bp, Homo sapiens
caggacatgctga

SEQ ID NO: 2562953 - DNA, 17 bp, Homo sapiens
cagcatcctggcacccg

SEQ ID NO: 2562954 - DNA, 21 bp, Homo sapiens
cagcatcctggcacccggccc

SEQ ID NO: 2562955 - DNA, 23 bp, Homo sapiens
cagcatctccctcactgaaacca

SEQ ID NO: 2562956 - DNA, 14 bp, Homo sapiens
cagcattgctggtt

SEQ ID NO: 2562957 - DNA, 21 bp, Homo sapiens
cagcatttccacaccaagcag

SEQ ID NO: 2562958 - DNA, 23 bp, Homo sapiens
cagcatttccacaccaagcagca

SEQ ID NO: 2562959 - DNA, 17 bp, Homo sapiens
cagccaaagataatctc

SEQ ID NO: 2562960 - DNA, 16 bp, Homo sapiens
cagccaaagcctcctc

SEQ ID NO: 2562961 - DNA, 18 bp, Homo sapiens
cagccaaagcctcctcca

SEQ ID NO: 2562962 - DNA, 22 bp, Homo sapiens
cagccaaatgtaattgaataaa

SEQ ID NO: 2562963 - DNA, 19 bp, Homo sapiens
cagccaacaggtggcagga

SEQ ID NO: 2562964 - DNA, 15 bp, Homo sapiens
cagccaacccctgtg

SEQ ID NO: 2562965 - DNA, 21 bp, Homo sapiens
cagccaacccctgtggagccc

SEQ ID NO: 2562966 - DNA, 13 bp, Homo sapiens
cagccaagcacag

SEQ ID NO: 2562967 - DNA, 16 bp, Homo sapiens
cagccaagcacagtgg

SEQ ID NO: 2562968 - DNA, 23 bp, Homo sapiens
cagccaagcacagtggtggcagg

SEQ ID NO: 2562969 - DNA, 22 bp, Homo sapiens
cagccaaggccgaagctctggc

SEQ ID NO: 2562970 - DNA, 20 bp, Homo sapiens
cagccaagggatgaaagaga

SEQ ID NO: 2562971 - DNA, 9 bp, Homo sapiens
cagccacac

SEQ ID NO: 2562972 - DNA, 15 bp, Homo sapiens
cagccacacacacag

SEQ ID NO: 2562973 - DNA, 18 bp, Homo sapiens
cagccacacacacagaaa

SEQ ID NO: 2562974 - DNA, 12 bp, Homo sapiens
cagccacactgt

SEQ ID NO: 2562975 - DNA, 14 bp, Homo sapiens
cagccacattcctg

SEQ ID NO: 2562976 - DNA, 14 bp, Homo sapiens
cagccacggccagg

SEQ ID NO: 2562977 - DNA, 19 bp, Homo sapiens
cagccacggccaggccaga

SEQ ID NO: 2562978 - DNA, 22 bp, Homo sapiens
cagccacggccaggccagaggg

SEQ ID NO: 2562979 - DNA, 14 bp, Homo sapiens
cagccactcgggag

SEQ ID NO: 2562980 - DNA, 21 bp, Homo sapiens
cagccactcgggaggctgaga

SEQ ID NO: 2562981 - DNA, 22 bp, Homo sapiens
cagccagacctattcctcctgg

SEQ ID NO: 2562982 - DNA, 20 bp, Homo sapiens
cagccagcaatgatgtccag

SEQ ID NO: 2562983 - DNA, 11 bp, Homo sapiens
cagccagcagc

SEQ ID NO: 2562984 - DNA, 14 bp, Homo sapiens
cagccagcagccag

SEQ ID NO: 2562985 - DNA, 12 bp, Homo sapiens
cagccagctctc

SEQ ID NO: 2562986 - DNA, 12 bp, Homo sapiens
cagccaggagct

SEQ ID NO: 2562987 - DNA, 14 bp, Homo sapiens
cagccaggagctgg

SEQ ID NO: 2562988 - DNA, 22 bp, Homo sapiens
cagccaggagctgggcagaagg

SEQ ID NO: 2562989 - DNA, 12 bp, Homo sapiens
cagccaggccac

SEQ ID NO: 2562990 - DNA, 22 bp, Homo sapiens
cagccaggccacaagacccttg

SEQ ID NO: 2562991 - DNA, 12 bp, Homo sapiens
cagccaggcggg

SEQ ID NO: 2562992 - DNA, 13 bp, Homo sapiens
cagccaggcgggc

SEQ ID NO: 2562993 - DNA, 19 bp, Homo sapiens
cagccaggcgggctcaagg

SEQ ID NO: 2562994 - DNA, 20 bp, Homo sapiens
cagccaggcgggctcaagga

SEQ ID NO: 2562995 - DNA, 14 bp, Homo sapiens
cagccaggctctgt

SEQ ID NO: 2562996 - DNA, 15 bp, Homo sapiens
cagccaggctctgtg

SEQ ID NO: 2562997 - DNA, 12 bp, Homo sapiens
cagccaggctgc

SEQ ID NO: 2562998 - DNA, 16 bp, Homo sapiens
cagccaggctgccaag

SEQ ID NO: 2562999 - DNA, 15 bp, Homo sapiens
cagccagggctgcta

SEQ ID NO: 2563000 - DNA, 14 bp, Homo sapiens
cagccaggtgcctt

SEQ ID NO: 2563001 - DNA, 13 bp, Homo sapiens
cagccagtaaatg

SEQ ID NO: 2563002 - DNA, 20 bp, Homo sapiens
cagccatacttatctctctg

SEQ ID NO: 2563003 - DNA, 19 bp, Homo sapiens
cagccatcataggaaggga

SEQ ID NO: 2563004 - DNA, 13 bp, Homo sapiens
cagccatctgccc

SEQ ID NO: 2563005 - DNA, 16 bp, Homo sapiens
cagccatctgcccagg

SEQ ID NO: 2563006 - DNA, 17 bp, Homo sapiens
cagccatgtgctgcgtg

SEQ ID NO: 2563007 - DNA, 20 bp, Homo sapiens
cagccattaccatggagaca

SEQ ID NO: 2563008 - DNA, 22 bp, Homo sapiens
cagccattggctatttaaaact

SEQ ID NO: 2563009 - DNA, 14 bp, Homo sapiens
cagcccacccccct

SEQ ID NO: 2563010 - DNA, 16 bp, Homo sapiens
cagcccacccccctca

SEQ ID NO: 2563011 - DNA, 12 bp, Homo sapiens
cagcccaccctc

SEQ ID NO: 2563012 - DNA, 16 bp, Homo sapiens
cagcccaccctcctgt

SEQ ID NO: 2563013 - DNA, 17 bp, Homo sapiens
cagcccagggttccccc

SEQ ID NO: 2563014 - DNA, 19 bp, Homo sapiens
cagcccagggttcccccag

SEQ ID NO: 2563015 - DNA, 16 bp, Homo sapiens
cagcccatgcccacct

SEQ ID NO: 2563016 - DNA, 18 bp, Homo sapiens
cagagaagccccttcccc

SEQ ID NO: 2563017 - DNA, 14 bp, Homo sapiens
cagagaagtgacag

SEQ ID NO: 2563018 - DNA, 15 bp, Homo sapiens
cagagaagtgacagg

SEQ ID NO: 2563019 - DNA, 16 bp, Homo sapiens
cagagaagtgacaggg

SEQ ID NO: 2563020 - DNA, 24 bp, Homo sapiens
cagagaagtgacagggaagctaca

SEQ ID NO: 2563021 - DNA, 19 bp, Homo sapiens
cagagaatgaaagggccca

SEQ ID NO: 2563022 - DNA, 20 bp, Homo sapiens
cagagaatgaaagggcccag

SEQ ID NO: 2563023 - DNA, 21 bp, Homo sapiens
cagagaattgctgattcttga

SEQ ID NO: 2563024 - DNA, 23 bp, Homo sapiens
cagagaatttctaccatttcaga

SEQ ID NO: 2563025 - DNA, 19 bp, Homo sapiens
cagagacattcctccgagc

SEQ ID NO: 2563026 - DNA, 19 bp, Homo sapiens
cagagaccatccctgaagg

SEQ ID NO: 2563027 - DNA, 20 bp, Homo sapiens
cagagaccatccctgaaggc

SEQ ID NO: 2563028 - DNA, 22 bp, Homo sapiens
cagagactcagggccccagcac

SEQ ID NO: 2563029 - DNA, 16 bp, Homo sapiens
cagagactcctgcagg

SEQ ID NO: 2563030 - DNA, 17 bp, Homo sapiens
cagagactcctgcaggc

SEQ ID NO: 2563031 - DNA, 18 bp, Homo sapiens
cagagactcctgcaggca

SEQ ID NO: 2563032 - DNA, 19 bp, Homo sapiens
cagagactcctgcaggcag

SEQ ID NO: 2563033 - DNA, 21 bp, Homo sapiens
cagagactcctgcaggcagcc

SEQ ID NO: 2563034 - DNA, 22 bp, Homo sapiens
cagagactcctgcaggcagcca

SEQ ID NO: 2563035 - DNA, 22 bp, Homo sapiens
cagagagagaagtgcccctgct

SEQ ID NO: 2563036 - DNA, 20 bp, Homo sapiens
cagagagcaactctgagatc

SEQ ID NO: 2563037 - DNA, 18 bp, Homo sapiens
cagagagccattttgtga

SEQ ID NO: 2563038 - DNA, 12 bp, Homo sapiens
cagagagggcag

SEQ ID NO: 2563039 - DNA, 14 bp, Homo sapiens
cagagagggcaggc

SEQ ID NO: 2563040 - DNA, 12 bp, Homo sapiens
cagagagggtgg

SEQ ID NO: 2563041 - DNA, 23 bp, Homo sapiens
cagagagggtgggagtgggccca

SEQ ID NO: 2563042 - DNA, 22 bp, Homo sapiens
cagagagggtggtgacctctgc

SEQ ID NO: 2563043 - DNA, 14 bp, Homo sapiens
cagagagtcccact

SEQ ID NO: 2563044 - DNA, 20 bp, Homo sapiens
cagagagtcccactgcctca

SEQ ID NO: 2563045 - DNA, 22 bp, Homo sapiens
cagagagtcccactgcctcagg

SEQ ID NO: 2563046 - DNA, 22 bp, Homo sapiens
cagagatagtggggagacttct

SEQ ID NO: 2563047 - DNA, 21 bp, Homo sapiens
cagagattggaatgggcagct

SEQ ID NO: 2563048 - DNA, 23 bp, Homo sapiens
cagagattggaatgggcagctca

SEQ ID NO: 2563049 - DNA, 14 bp, Homo sapiens
cagagcaaaataat

SEQ ID NO: 2563050 - DNA, 20 bp, Homo sapiens
cagagcaagactctgtctca

SEQ ID NO: 2563051 - DNA, 14 bp, Homo sapiens
cagagcaagtgaga

SEQ ID NO: 2563052 - DNA, 22 bp, Homo sapiens
cagagcaccttagacagtccct

SEQ ID NO: 2563053 - DNA, 20 bp, Homo sapiens
cagagcactgggttgcaggg

SEQ ID NO: 2563054 - DNA, 18 bp, Homo sapiens
cagagcagagaccatccc

SEQ ID NO: 2563055 - DNA, 14 bp, Homo sapiens
cagagcagatgcag

SEQ ID NO: 2563056 - DNA, 15 bp, Homo sapiens
cagagcagatgcaga

SEQ ID NO: 2563057 - DNA, 20 bp, Homo sapiens
cagagcagatgcagagagcc

SEQ ID NO: 2563058 - DNA, 21 bp, Homo sapiens
cagagcagatgcagagagcca

SEQ ID NO: 2563059 - DNA, 14 bp, Homo sapiens
cagagcaggactgc

SEQ ID NO: 2563060 - DNA, 17 bp, Homo sapiens
cagagcaggaggcccct

SEQ ID NO: 2563061 - DNA, 18 bp, Homo sapiens
cagagcattacgtgagcc

SEQ ID NO: 2563062 - DNA, 20 bp, Homo sapiens
cagagcattacgtgagccag

SEQ ID NO: 2563063 - DNA, 14 bp, Homo sapiens
cagagccatggact

SEQ ID NO: 2563064 - DNA, 20 bp, Homo sapiens
cagagcccaccttggctcaa

SEQ ID NO: 2563065 - DNA, 19 bp, Homo sapiens
cagagccgtggtcctttgg

SEQ ID NO: 2563066 - DNA, 20 bp, Homo sapiens
cagagccgtggtcctttggg

SEQ ID NO: 2563067 - DNA, 16 bp, Homo sapiens
cagagcctttggatga

SEQ ID NO: 2563068 - DNA, 20 bp, Homo sapiens
cagagctacccgcagagttc

SEQ ID NO: 2563069 - DNA, 17 bp, Homo sapiens
cagagctctccagctcc

SEQ ID NO: 2563070 - DNA, 20 bp, Homo sapiens
cagagctctccagctccaag

SEQ ID NO: 2563071 - DNA, 23 bp, Homo sapiens
cagagctgggaggcatggccctg

SEQ ID NO: 2563072 - DNA, 14 bp, Homo sapiens
cagagctgggaggg

SEQ ID NO: 2563073 - DNA, 21 bp, Homo sapiens
cagagctgtttatggcctcag

SEQ ID NO: 2563074 - DNA, 22 bp, Homo sapiens
cagagctgtttatggcctcagc

SEQ ID NO: 2563075 - DNA, 19 bp, Homo sapiens
cagagcttggactggatgc

SEQ ID NO: 2563076 - DNA, 17 bp, Homo sapiens
cagaggaactgtccaga

SEQ ID NO: 2563077 - DNA, 12 bp, Homo sapiens
cagaggaagagc

SEQ ID NO: 2563078 - DNA, 16 bp, Homo sapiens
cagaggaagagcaggc

SEQ ID NO: 2563079 - DNA, 23 bp, Homo sapiens
cagaggaatcactcttgtggatg

SEQ ID NO: 2563080 - DNA, 23 bp, Homo sapiens
cagaggagagtcccagagcagga

SEQ ID NO: 2563081 - DNA, 21 bp, Homo sapiens
cagaggagtacaggtgaagca

SEQ ID NO: 2563082 - DNA, 13 bp, Homo sapiens
cagaggatggcca

SEQ ID NO: 2563083 - DNA, 15 bp, Homo sapiens
cagaggatggccagt

SEQ ID NO: 2563084 - DNA, 22 bp, Homo sapiens
cagaggatggccagtgtctgtc

SEQ ID NO: 2563085 - DNA, 13 bp, Homo sapiens
cagaggcagcccc

SEQ ID NO: 2563086 - DNA, 14 bp, Homo sapiens
cagaggcagcccca

SEQ ID NO: 2563087 - DNA, 18 bp, Homo sapiens
cagaggcagccccattct

SEQ ID NO: 2563088 - DNA, 22 bp, Homo sapiens
cagaggcagccccattctgcct

SEQ ID NO: 2563089 - DNA, 16 bp, Homo sapiens
cagaggccatgggcct

SEQ ID NO: 2563090 - DNA, 14 bp, Homo sapiens
cagaggcctgcccg

SEQ ID NO: 2563091 - DNA, 17 bp, Homo sapiens
cagaggctaattctgca

SEQ ID NO: 2563092 - DNA, 13 bp, Homo sapiens
cagaggctgcctc

SEQ ID NO: 2563093 - DNA, 23 bp, Homo sapiens
cagagggaaagtaaatatttcag

SEQ ID NO: 2563094 - DNA, 19 bp, Homo sapiens
cagagggaagaaaagagct

SEQ ID NO: 2563095 - DNA, 22 bp, Homo sapiens
cagagggaggaatcgaggaacc

SEQ ID NO: 2563096 - DNA, 16 bp, Homo sapiens
cagagggagtgacaga

SEQ ID NO: 2563097 - DNA, 22 bp, Homo sapiens
cagagggagtgacagaggcagc

SEQ ID NO: 2563098 - DNA, 23 bp, Homo sapiens
cagagggagtgacagaggcagcc

SEQ ID NO: 2563099 - DNA, 18 bp, Homo sapiens
cagagggcccaggcaggc

SEQ ID NO: 2563100 - DNA, 19 bp, Homo sapiens
cagagggcctgcaagggag

SEQ ID NO: 2563101 - DNA, 22 bp, Homo sapiens
cagagggcctgcaagggagtga

SEQ ID NO: 2563102 - DNA, 19 bp, Homo sapiens
cagaggggctttctggaga

SEQ ID NO: 2563103 - DNA, 16 bp, Homo sapiens
cagagggggtggcctc

SEQ ID NO: 2563104 - DNA, 20 bp, Homo sapiens
cagagggggtggcctcccaa

SEQ ID NO: 2563105 - DNA, 23 bp, Homo sapiens
cagagggggtggcctcccaactc

SEQ ID NO: 2563106 - DNA, 21 bp, Homo sapiens
cagaggggtaggcagagcctt

SEQ ID NO: 2563107 - DNA, 18 bp, Homo sapiens
cagaggtaaaagtgtgag

SEQ ID NO: 2563108 - DNA, 20 bp, Homo sapiens
cagaggtaaaagtgtgagca

SEQ ID NO: 2563109 - DNA, 14 bp, Homo sapiens
cagaggtaacagaa

SEQ ID NO: 2563110 - DNA, 20 bp, Homo sapiens
cagaggtctctgccggctct

SEQ ID NO: 2563111 - DNA, 17 bp, Homo sapiens
cagaggtggccagagct

SEQ ID NO: 2563112 - DNA, 19 bp, Homo sapiens
cagaggtggccagagctgg

SEQ ID NO: 2563113 - DNA, 21 bp, Homo sapiens
cagaggtggccagagctggga

SEQ ID NO: 2563114 - DNA, 13 bp, Homo sapiens
cagaggtgggcag

SEQ ID NO: 2563115 - DNA, 16 bp, Homo sapiens
cagaggtgggcaggtg

SEQ ID NO: 2563116 - DNA, 22 bp, Homo sapiens
cagaggtgggcaggtggtggca

SEQ ID NO: 2563117 - DNA, 19 bp, Homo sapiens
cagaggttatctgtcccag

SEQ ID NO: 2563118 - DNA, 17 bp, Homo sapiens
cagaggttgcagtgagc

SEQ ID NO: 2563119 - DNA, 21 bp, Homo sapiens
cagagtatgaacacctgggct

SEQ ID NO: 2563120 - DNA, 14 bp, Homo sapiens
cagagtatggagct

SEQ ID NO: 2563121 - DNA, 14 bp, Homo sapiens
cagagtccaggccc

SEQ ID NO: 2563122 - DNA, 16 bp, Homo sapiens
cagagtccaggcccca

SEQ ID NO: 2563123 - DNA, 18 bp, Homo sapiens
cagagtcggaacggagaa

SEQ ID NO: 2563124 - DNA, 13 bp, Homo sapiens
cagagtctcactg

SEQ ID NO: 2563125 - DNA, 14 bp, Homo sapiens
cagagtgagaccca

SEQ ID NO: 2563126 - DNA, 16 bp, Homo sapiens
cagagtgagactctgt

SEQ ID NO: 2563127 - DNA, 19 bp, Homo sapiens
cagagtgagactctgtctc

SEQ ID NO: 2563128 - DNA, 14 bp, Homo sapiens
cagagtgcccagaa

SEQ ID NO: 2563129 - DNA, 15 bp, Homo sapiens
cagagtgcccagaac

SEQ ID NO: 2563130 - DNA, 22 bp, Homo sapiens
cagagtggtctttctggagagg

SEQ ID NO: 2563131 - DNA, 12 bp, Homo sapiens
cagagtgtgctg

SEQ ID NO: 2563132 - DNA, 15 bp, Homo sapiens
cagagtgtgctggag

SEQ ID NO: 2563133 - DNA, 16 bp, Homo sapiens
cagagtgtgctggagg

SEQ ID NO: 2563134 - DNA, 23 bp, Homo sapiens
cagagtgtggccttcggacaact

SEQ ID NO: 2563135 - DNA, 15 bp, Homo sapiens
cagagttctgctcta

SEQ ID NO: 2563136 - DNA, 19 bp, Homo sapiens
cagagtttgtgtgttgtct

SEQ ID NO: 2563137 - DNA, 23 bp, Homo sapiens
cagataaatagtttatgattcca

SEQ ID NO: 2563138 - DNA, 17 bp, Homo sapiens
cagataaccagctgtaa

SEQ ID NO: 2563139 - DNA, 19 bp, Homo sapiens
cagataatcagcctcttaa

SEQ ID NO: 2563140 - DNA, 14 bp, Homo sapiens
cagataatgtgaaa

SEQ ID NO: 2563141 - DNA, 13 bp, Homo sapiens
cagatacaatgta

SEQ ID NO: 2563142 - DNA, 14 bp, Homo sapiens
cagatacaatgtat

SEQ ID NO: 2563143 - DNA, 23 bp, Homo sapiens
cagatacaggaaaagctgctgac

SEQ ID NO: 2563144 - DNA, 18 bp, Homo sapiens
cagatactggaagttttg

SEQ ID NO: 2563145 - DNA, 21 bp, Homo sapiens
cagatactggaagttttgcat

SEQ ID NO: 2563146 - DNA, 20 bp, Homo sapiens
cagatataaatggctggttt

SEQ ID NO: 2563147 - DNA, 15 bp, Homo sapiens
cagatatgatatgta

SEQ ID NO: 2563148 - DNA, 18 bp, Homo sapiens
cagatatgatatgtaaac

SEQ ID NO: 2563149 - DNA, 11 bp, Homo sapiens
cagatatttat

SEQ ID NO: 2563150 - DNA, 16 bp, Homo sapiens
cagatatttatatttt

SEQ ID NO: 2563151 - DNA, 21 bp, Homo sapiens
cagatatttatatttttattt

SEQ ID NO: 2563152 - DNA, 22 bp, Homo sapiens
cagatatttatatttttatttt

SEQ ID NO: 2563153 - DNA, 16 bp, Homo sapiens
cagatcactactgcag

SEQ ID NO: 2563154 - DNA, 15 bp, Homo sapiens
cagatcccagctcac

SEQ ID NO: 2563155 - DNA, 16 bp, Homo sapiens
cagatcctcacaacca

SEQ ID NO: 2563156 - DNA, 15 bp, Homo sapiens
cagatccttgtttca

SEQ ID NO: 2563157 - DNA, 19 bp, Homo sapiens
cagatctaccccttactta

SEQ ID NO: 2563158 - DNA, 20 bp, Homo sapiens
cagatctctaacttcaccat

SEQ ID NO: 2563159 - DNA, 18 bp, Homo sapiens
cagatctggtcccttgca

SEQ ID NO: 2563160 - DNA, 18 bp, Homo sapiens
cagatctgtctgatagga

SEQ ID NO: 2563161 - DNA, 12 bp, Homo sapiens
cagatctgtgcc

SEQ ID NO: 2563162 - DNA, 20 bp, Homo sapiens
cagatctgtgccccatgcct

SEQ ID NO: 2563163 - DNA, 19 bp, Homo sapiens
cagatgaatgataaactct

SEQ ID NO: 2563164 - DNA, 17 bp, Homo sapiens
cagatgagaaactcttg

SEQ ID NO: 2563165 - DNA, 21 bp, Homo sapiens
cacttttttgagtggatgatg

SEQ ID NO: 2563166 - DNA, 16 bp, Homo sapiens
cactttttttttccaa

SEQ ID NO: 2563167 - DNA, 23 bp, Homo sapiens
cactttttttttccaaaaaaata

SEQ ID NO: 2563168 - DNA, 13 bp, Homo sapiens
cagaaaaggacag

SEQ ID NO: 2563169 - DNA, 18 bp, Homo sapiens
cagaaaatatactgtaaa

SEQ ID NO: 2563170 - DNA, 16 bp, Homo sapiens
cagaaaattgcacaat

SEQ ID NO: 2563171 - DNA, 18 bp, Homo sapiens
cagaaacaaaaacactaa

SEQ ID NO: 2563172 - DNA, 18 bp, Homo sapiens
cagaaacaccctcacact

SEQ ID NO: 2563173 - DNA, 21 bp, Homo sapiens
cagaaacaccctcacactggg

SEQ ID NO: 2563174 - DNA, 18 bp, Homo sapiens
cagaaacaggtgcatctg

SEQ ID NO: 2563175 - DNA, 14 bp, Homo sapiens
cagaaaccagttat

SEQ ID NO: 2563176 - DNA, 15 bp, Homo sapiens
cagaaaccagttatg

SEQ ID NO: 2563177 - DNA, 19 bp, Homo sapiens
cagaaagatggatgtgctt

SEQ ID NO: 2563178 - DNA, 16 bp, Homo sapiens
cagaaaggttctgccc

SEQ ID NO: 2563179 - DNA, 21 bp, Homo sapiens
cagaaaggttctgcccgggaa

SEQ ID NO: 2563180 - DNA, 17 bp, Homo sapiens
cagaaagtggtgctcag

SEQ ID NO: 2563181 - DNA, 18 bp, Homo sapiens
cagaaagtggtgctcagt

SEQ ID NO: 2563182 - DNA, 22 bp, Homo sapiens
cagaaagtggtgctcagttgta

SEQ ID NO: 2563183 - DNA, 23 bp, Homo sapiens
cagaaagtggtgctcagttgtag

SEQ ID NO: 2563184 - DNA, 16 bp, Homo sapiens
cagaaatacatatttc

SEQ ID NO: 2563185 - DNA, 19 bp, Homo sapiens
cagaaatctagaagactgt

SEQ ID NO: 2563186 - DNA, 20 bp, Homo sapiens
cagaaatgagatcaggctct

SEQ ID NO: 2563187 - DNA, 16 bp, Homo sapiens
cagaaattagccgggc

SEQ ID NO: 2563188 - DNA, 23 bp, Homo sapiens
cagaaatttaattcatgtttctt

SEQ ID NO: 2563189 - DNA, 15 bp, Homo sapiens
cagaaatttttattt

SEQ ID NO: 2563190 - DNA, 19 bp, Homo sapiens
cagaaatttttatttttct

SEQ ID NO: 2563191 - DNA, 18 bp, Homo sapiens
cagaacacactccatcag

SEQ ID NO: 2563192 - DNA, 20 bp, Homo sapiens
cagaacagccgctcctgtct

SEQ ID NO: 2563193 - DNA, 16 bp, Homo sapiens
cagaacagcttcaggt

SEQ ID NO: 2563194 - DNA, 24 bp, Homo sapiens
cagaacagcttcaggttatcgaaa

SEQ ID NO: 2563195 - DNA, 18 bp, Homo sapiens
cagaacagtgattaccag

SEQ ID NO: 2563196 - DNA, 17 bp, Homo sapiens
cagaacatcattagaac

SEQ ID NO: 2563197 - DNA, 14 bp, Homo sapiens
cagaacctcttccc

SEQ ID NO: 2563198 - DNA, 15 bp, Homo sapiens
cagaacctcttcccc

SEQ ID NO: 2563199 - DNA, 18 bp, Homo sapiens
cagaacctcttccccaga

SEQ ID NO: 2563200 - DNA, 21 bp, Homo sapiens
cagaacctcttccccagaaag

SEQ ID NO: 2563201 - DNA, 21 bp, Homo sapiens
cagaaccttgttatttctcag

SEQ ID NO: 2563202 - DNA, 21 bp, Homo sapiens
cagaacggagccccaggcctc

SEQ ID NO: 2563203 - DNA, 14 bp, Homo sapiens
cagaactctttcaa

SEQ ID NO: 2563204 - DNA, 20 bp, Homo sapiens
cagaactgagctcctctggg

SEQ ID NO: 2563205 - DNA, 14 bp, Homo sapiens
cagaagaatattca

SEQ ID NO: 2563206 - DNA, 17 bp, Homo sapiens
cagaagaatattcagga

SEQ ID NO: 2563207 - DNA, 20 bp, Homo sapiens
cagaagaatattcaggactt

SEQ ID NO: 2563208 - DNA, 15 bp, Homo sapiens
cagaagataacttga

SEQ ID NO: 2563209 - DNA, 23 bp, Homo sapiens
cagaagatcccctcaggactgca

SEQ ID NO: 2563210 - DNA, 20 bp, Homo sapiens
cagaagcaacccaaatgttc

SEQ ID NO: 2563211 - DNA, 13 bp, Homo sapiens
cagaagcagctct

SEQ ID NO: 2563212 - DNA, 18 bp, Homo sapiens
cagaagcctccccagctc

SEQ ID NO: 2563213 - DNA, 14 bp, Homo sapiens
cagaagcctctggc

SEQ ID NO: 2563214 - DNA, 19 bp, Homo sapiens
cagaagcctctggctagag

SEQ ID NO: 2563215 - DNA, 19 bp, Homo sapiens
cagaagcctgaggctggga

SEQ ID NO: 2563216 - DNA, 14 bp, Homo sapiens
cagaagcttcagaa

SEQ ID NO: 2563217 - DNA, 13 bp, Homo sapiens
cagaaggaggagg

SEQ ID NO: 2563218 - DNA, 14 bp, Homo sapiens
cagaaggaggagga

SEQ ID NO: 2563219 - DNA, 18 bp, Homo sapiens
cagaaggcaaatgacttt

SEQ ID NO: 2563220 - DNA, 13 bp, Homo sapiens
cagaaggcaggga

SEQ ID NO: 2563221 - DNA, 23 bp, Homo sapiens
cagaaggcatatcagtctctgag

SEQ ID NO: 2563222 - DNA, 18 bp, Homo sapiens
cagaaggccaagaatcaa

SEQ ID NO: 2563223 - DNA, 14 bp, Homo sapiens
cagaaggccaagag

SEQ ID NO: 2563224 - DNA, 14 bp, Homo sapiens
cagaaggctcttct

SEQ ID NO: 2563225 - DNA, 19 bp, Homo sapiens
cagaagggacttcacgaag

SEQ ID NO: 2563226 - DNA, 15 bp, Homo sapiens
cagaagggagaagga

SEQ ID NO: 2563227 - DNA, 15 bp, Homo sapiens
cagaagggaggctgg

SEQ ID NO: 2563228 - DNA, 16 bp, Homo sapiens
cagaagggggccatga

SEQ ID NO: 2563229 - DNA, 20 bp, Homo sapiens
cagaaggggtttggtctggg

SEQ ID NO: 2563230 - DNA, 15 bp, Homo sapiens
cagaaggtattcctt

SEQ ID NO: 2563231 - DNA, 23 bp, Homo sapiens
cagaaggttgctctagattgaga

SEQ ID NO: 2563232 - DNA, 18 bp, Homo sapiens
cagaagtcatgaagccca

SEQ ID NO: 2563233 - DNA, 13 bp, Homo sapiens
cagaagtggagct

SEQ ID NO: 2563234 - DNA, 11 bp, Homo sapiens
cagaagtgtga

SEQ ID NO: 2563235 - DNA, 19 bp, Homo sapiens
cagaagtttctcagctccc

SEQ ID NO: 2563236 - DNA, 17 bp, Homo sapiens
cagaataatctttgggt

SEQ ID NO: 2563237 - DNA, 21 bp, Homo sapiens
cagaatcaaagcaatgcattt

SEQ ID NO: 2563238 - DNA, 15 bp, Homo sapiens
cagaatctaaagcca

SEQ ID NO: 2563239 - DNA, 16 bp, Homo sapiens
cagaatctaaagccag

SEQ ID NO: 2563240 - DNA, 17 bp, Homo sapiens
cagaatctcaaataact

SEQ ID NO: 2563241 - DNA, 18 bp, Homo sapiens
cagaatctcaaataacta

SEQ ID NO: 2563242 - DNA, 21 bp, Homo sapiens
cagaatgctagctctgagcca

SEQ ID NO: 2563243 - DNA, 16 bp, Homo sapiens
cagaatgttttactgt

SEQ ID NO: 2563244 - DNA, 15 bp, Homo sapiens
cagaattaactccat

SEQ ID NO: 2563245 - DNA, 15 bp, Homo sapiens
cagaattctctagtt

SEQ ID NO: 2563246 - DNA, 18 bp, Homo sapiens
cagaattctctagtttga

SEQ ID NO: 2563247 - DNA, 21 bp, Homo sapiens
cagaattctgctacctcactg

SEQ ID NO: 2563248 - DNA, 15 bp, Homo sapiens
cagacaacagaagtc

SEQ ID NO: 2563249 - DNA, 11 bp, Homo sapiens
cagacacacac

SEQ ID NO: 2563250 - DNA, 12 bp, Homo sapiens
cagacacacaca

SEQ ID NO: 2563251 - DNA, 14 bp, Homo sapiens
cagacacacacacg

SEQ ID NO: 2563252 - DNA, 16 bp, Homo sapiens
cagacacacacacgca

SEQ ID NO: 2563253 - DNA, 18 bp, Homo sapiens
cagacacacgcacacaca

SEQ ID NO: 2563254 - DNA, 14 bp, Homo sapiens
cagacacagaagag

SEQ ID NO: 2563255 - DNA, 22 bp, Homo sapiens
cagacacaggcccggctccagg

SEQ ID NO: 2563256 - DNA, 22 bp, Homo sapiens
cagacacatgtccaagaagccc

SEQ ID NO: 2563257 - DNA, 23 bp, Homo sapiens
cagacacatgtccaagaagccca

SEQ ID NO: 2563258 - DNA, 20 bp, Homo sapiens
cagacaccttgacagggcac

SEQ ID NO: 2563259 - DNA, 21 bp, Homo sapiens
cagacactaagttatagtata

SEQ ID NO: 2563260 - DNA, 14 bp, Homo sapiens
cagacagacacaca

SEQ ID NO: 2563261 - DNA, 19 bp, Homo sapiens
cagacagacatctctgcac

SEQ ID NO: 2563262 - DNA, 12 bp, Homo sapiens
cagacagcctgt

SEQ ID NO: 2563263 - DNA, 16 bp, Homo sapiens
cagacagcctgtatct

SEQ ID NO: 2563264 - DNA, 12 bp, Homo sapiens
cagacagctccc

SEQ ID NO: 2563265 - DNA, 17 bp, Homo sapiens
cagacagctccctctgc

SEQ ID NO: 2563266 - DNA, 14 bp, Homo sapiens
cagacagctgcctg

SEQ ID NO: 2563267 - DNA, 17 bp, Homo sapiens
cagacaggaccagggat

SEQ ID NO: 2563268 - DNA, 24 bp, Homo sapiens
cagacaggaccagggatttccatg

SEQ ID NO: 2563269 - DNA, 12 bp, Homo sapiens
cagacaggagga

SEQ ID NO: 2563270 - DNA, 22 bp, Homo sapiens
cagacaggcaagcacctcctgc

SEQ ID NO: 2563271 - DNA, 18 bp, Homo sapiens
cagacagggttcattgaa

SEQ ID NO: 2563272 - DNA, 22 bp, Homo sapiens
cacgcctatgatcccagcactt

SEQ ID NO: 2563273 - DNA, 17 bp, Homo sapiens
cacgcctcccactgggg

SEQ ID NO: 2563274 - DNA, 17 bp, Homo sapiens
cacgcctgtaatcccag

SEQ ID NO: 2563275 - DNA, 19 bp, Homo sapiens
cacgcctgtaatcccagca

SEQ ID NO: 2563276 - DNA, 21 bp, Homo sapiens
cacgcctgtaatcccagcact

SEQ ID NO: 2563277 - DNA, 19 bp, Homo sapiens
cacgcctgtaatcctagca

SEQ ID NO: 2563278 - DNA, 23 bp, Homo sapiens
cacgcgtgcacacaccagagccc

SEQ ID NO: 2563279 - DNA, 18 bp, Homo sapiens
cacgctcctccctctgag

SEQ ID NO: 2563280 - DNA, 23 bp, Homo sapiens
cacgctcctccctctgaggctgt

SEQ ID NO: 2563281 - DNA, 15 bp, Homo sapiens
cacgctggagtgcag

SEQ ID NO: 2563282 - DNA, 17 bp, Homo sapiens
cacgctggagtgcagtg

SEQ ID NO: 2563283 - DNA, 13 bp, Homo sapiens
cacgctgtctcca

SEQ ID NO: 2563284 - DNA, 14 bp, Homo sapiens
cacgctgtctccag

SEQ ID NO: 2563285 - DNA, 16 bp, Homo sapiens
cacgctgtctccagac

SEQ ID NO: 2563286 - DNA, 19 bp, Homo sapiens
cacgctgtctccagacccc

SEQ ID NO: 2563287 - DNA, 23 bp, Homo sapiens
cacgctgtctccagacccccacc

SEQ ID NO: 2563288 - DNA, 17 bp, Homo sapiens
cacgctttctagctgtt

SEQ ID NO: 2563289 - DNA, 15 bp, Homo sapiens
cacggagccactcct

SEQ ID NO: 2563290 - DNA, 18 bp, Homo sapiens
cacggagccactcctctg

SEQ ID NO: 2563291 - DNA, 20 bp, Homo sapiens
cacggcaggacaacgaggaa

SEQ ID NO: 2563292 - DNA, 15 bp, Homo sapiens
cacggccaacaaagc

SEQ ID NO: 2563293 - DNA, 14 bp, Homo sapiens
cacggccactggcc

SEQ ID NO: 2563294 - DNA, 12 bp, Homo sapiens
cacggccaggcc

SEQ ID NO: 2563295 - DNA, 15 bp, Homo sapiens
cacggccaggccaga

SEQ ID NO: 2563296 - DNA, 17 bp, Homo sapiens
cacggccaggccagagg

SEQ ID NO: 2563297 - DNA, 19 bp, Homo sapiens
cacggctcactgcagcctc

SEQ ID NO: 2563298 - DNA, 22 bp, Homo sapiens
cacgggggcagctgatacaaat

SEQ ID NO: 2563299 - DNA, 16 bp, Homo sapiens
cacggtgggccttgct

SEQ ID NO: 2563300 - DNA, 18 bp, Homo sapiens
cacggtttgaagcctgga

SEQ ID NO: 2563301 - DNA, 19 bp, Homo sapiens
cacggtttgaagcctggaa

SEQ ID NO: 2563302 - DNA, 14 bp, Homo sapiens
cacgtacacacaca

SEQ ID NO: 2563303 - DNA, 16 bp, Homo sapiens
cacgtacttaaatgaa

SEQ ID NO: 2563304 - DNA, 18 bp, Homo sapiens
cacgtgacagtgcctggg

SEQ ID NO: 2563305 - DNA, 15 bp, Homo sapiens
cacgtggagagctgg

SEQ ID NO: 2563306 - DNA, 20 bp, Homo sapiens
cacgtggcatgtggcctgtg

SEQ ID NO: 2563307 - DNA, 20 bp, Homo sapiens
cacgtgtaactgtcagccgg

SEQ ID NO: 2563308 - DNA, 22 bp, Homo sapiens
cacgtgttttattcctgtatgt

SEQ ID NO: 2563309 - DNA, 18 bp, Homo sapiens
cacgttatggtgtttctc

SEQ ID NO: 2563310 - DNA, 21 bp, Homo sapiens
cactaaattgacacttaaaaa

SEQ ID NO: 2563311 - DNA, 14 bp, Homo sapiens
cactaaccacgctg

SEQ ID NO: 2563312 - DNA, 18 bp, Homo sapiens
cactaaccacgctggacc

SEQ ID NO: 2563313 - DNA, 13 bp, Homo sapiens
cactaacctgacc

SEQ ID NO: 2563314 - DNA, 20 bp, Homo sapiens
cactaactagagcagccctg

SEQ ID NO: 2563315 - DNA, 15 bp, Homo sapiens
cactaatacaccagg

SEQ ID NO: 2563316 - DNA, 17 bp, Homo sapiens
cactaatttgatgttta

SEQ ID NO: 2563317 - DNA, 21 bp, Homo sapiens
cactacactccagcctgagca

SEQ ID NO: 2563318 - DNA, 14 bp, Homo sapiens
cactacattctgtt

SEQ ID NO: 2563319 - DNA, 18 bp, Homo sapiens
cactactcctctgcagtg

SEQ ID NO: 2563320 - DNA, 19 bp, Homo sapiens
cactactcctctgcagtgc

SEQ ID NO: 2563321 - DNA, 19 bp, Homo sapiens
cactagcccaatgaaatga

SEQ ID NO: 2563322 - DNA, 23 bp, Homo sapiens
cactagcccaatgaaatgaatta

SEQ ID NO: 2563323 - DNA, 18 bp, Homo sapiens
cactaggactctgaggct

SEQ ID NO: 2563324 - DNA, 17 bp, Homo sapiens
cactagttttgtgccag

SEQ ID NO: 2563325 - DNA, 19 bp, Homo sapiens
cactataaatggtgttttt

SEQ ID NO: 2563326 - DNA, 14 bp, Homo sapiens
cactatacagattc

SEQ ID NO: 2563327 - DNA, 21 bp, Homo sapiens
cactatagcctaggtgacaga

SEQ ID NO: 2563328 - DNA, 19 bp, Homo sapiens
cactatatctgtatataaa

SEQ ID NO: 2563329 - DNA, 21 bp, Homo sapiens
cactatgaagatgtttcaaaa

SEQ ID NO: 2563330 - DNA, 17 bp, Homo sapiens
cactatgttgcccaggc

SEQ ID NO: 2563331 - DNA, 18 bp, Homo sapiens
cactatgttgcccaggca

SEQ ID NO: 2563332 - DNA, 19 bp, Homo sapiens
cactatgttgcccaggcag

SEQ ID NO: 2563333 - DNA, 20 bp, Homo sapiens
cactatgttgcccaggcagg

SEQ ID NO: 2563334 - DNA, 21 bp, Homo sapiens
cactatgttgcccaggcaggt

SEQ ID NO: 2563335 - DNA, 17 bp, Homo sapiens
cactatttttatttata

SEQ ID NO: 2563336 - DNA, 17 bp, Homo sapiens
cactcaaaagctgggca

SEQ ID NO: 2563337 - DNA, 20 bp, Homo sapiens
cactcaaattaatctttctt

SEQ ID NO: 2563338 - DNA, 20 bp, Homo sapiens
cactcaagaagcaggctaca

SEQ ID NO: 2563339 - DNA, 17 bp, Homo sapiens
cactcaatgcagccaga

SEQ ID NO: 2563340 - DNA, 18 bp, Homo sapiens
cactcacacagccaggtg

SEQ ID NO: 2563341 - DNA, 22 bp, Homo sapiens
cactcacacagccaggtgcctt

SEQ ID NO: 2563342 - DNA, 23 bp, Homo sapiens
cactcacacagccaggtgccttg

SEQ ID NO: 2563343 - DNA, 21 bp, Homo sapiens
cactcacacaggacccccttc

SEQ ID NO: 2563344 - DNA, 16 bp, Homo sapiens
cactcacagacctgga

SEQ ID NO: 2563345 - DNA, 19 bp, Homo sapiens
cactcacagacctggagcc

SEQ ID NO: 2563346 - DNA, 21 bp, Homo sapiens
cactcaccagtgtcccctcca

SEQ ID NO: 2563347 - DNA, 16 bp, Homo sapiens
cactcacccatgtgcc

SEQ ID NO: 2563348 - DNA, 14 bp, Homo sapiens
cactcactcctgag

SEQ ID NO: 2563349 - DNA, 15 bp, Homo sapiens
cactcactcctgaga

SEQ ID NO: 2563350 - DNA, 17 bp, Homo sapiens
cactcagaagacactga

SEQ ID NO: 2563351 - DNA, 19 bp, Homo sapiens
cactcagaagacactgatg

SEQ ID NO: 2563352 - DNA, 12 bp, Homo sapiens
cactcagacctg

SEQ ID NO: 2563353 - DNA, 20 bp, Homo sapiens
cactcaggaggctgaggcag

SEQ ID NO: 2563354 - DNA, 19 bp, Homo sapiens
cactcaggccaacaagcca

SEQ ID NO: 2563355 - DNA, 13 bp, Homo sapiens
cactcatgctgaa

SEQ ID NO: 2563356 - DNA, 17 bp, Homo sapiens
cactcatgctgaaagcc

SEQ ID NO: 2563357 - DNA, 13 bp, Homo sapiens
cactcattcctgt

SEQ ID NO: 2563358 - DNA, 18 bp, Homo sapiens
cactccaattaaggattt

SEQ ID NO: 2563359 - DNA, 22 bp, Homo sapiens
cactccaattaaggattttatg

SEQ ID NO: 2563360 - DNA, 21 bp, Homo sapiens
cactccagcctgagcaacaga

SEQ ID NO: 2563361 - DNA, 16 bp, Homo sapiens
cactccagcctgggcg

SEQ ID NO: 2563362 - DNA, 21 bp, Homo sapiens
cactccagcctgggcgacaga

SEQ ID NO: 2563363 - DNA, 13 bp, Homo sapiens
cactcccaagtct

SEQ ID NO: 2563364 - DNA, 13 bp, Homo sapiens
cactcccaggcag

SEQ ID NO: 2563365 - DNA, 13 bp, Homo sapiens
cactcccagtgct

SEQ ID NO: 2563366 - DNA, 15 bp, Homo sapiens
cactccccaccttca

SEQ ID NO: 2563367 - DNA, 14 bp, Homo sapiens
cactcccctgcact

SEQ ID NO: 2563368 - DNA, 17 bp, Homo sapiens
cactcccctgcactgga

SEQ ID NO: 2563369 - DNA, 15 bp, Homo sapiens
cactccctccatcaa

SEQ ID NO: 2563370 - DNA, 12 bp, Homo sapiens
cactccctgcaa

SEQ ID NO: 2563371 - DNA, 22 bp, Homo sapiens
cactcccttcccatgacccagg

SEQ ID NO: 2563372 - DNA, 17 bp, Homo sapiens
cactcccttctacctgc

SEQ ID NO: 2563373 - DNA, 23 bp, Homo sapiens
cactcccttctacctgccactca

SEQ ID NO: 2563374 - DNA, 22 bp, Homo sapiens
cactccggtgtgcctgcagccc

SEQ ID NO: 2563375 - DNA, 18 bp, Homo sapiens
cactcctacacctaactc

SEQ ID NO: 2563376 - DNA, 20 bp, Homo sapiens
cactcctctgactcagggct

SEQ ID NO: 2563377 - DNA, 21 bp, Homo sapiens
cactcctctgactcagggctc

SEQ ID NO: 2563378 - DNA, 14 bp, Homo sapiens
cactcctgagaccc

SEQ ID NO: 2563379 - DNA, 16 bp, Homo sapiens
cactcctgagacccct

SEQ ID NO: 2563380 - DNA, 12 bp, Homo sapiens
cactcctggggc

SEQ ID NO: 2563381 - DNA, 22 bp, Homo sapiens
cactcgcccgcccactgtcctg

SEQ ID NO: 2563382 - DNA, 18 bp, Homo sapiens
cactcgggaggctgagac

SEQ ID NO: 2563383 - DNA, 22 bp, Homo sapiens
cactcgggaggctgagacagga

SEQ ID NO: 2563384 - DNA, 17 bp, Homo sapiens
cactctaccctatacaa

SEQ ID NO: 2563385 - DNA, 19 bp, Homo sapiens
cactctaccctcccacccc

SEQ ID NO: 2563386 - DNA, 12 bp, Homo sapiens
cactctccccac

SEQ ID NO: 2563387 - DNA, 14 bp, Homo sapiens
cactctccccacac

SEQ ID NO: 2563388 - DNA, 21 bp, Homo sapiens
cactctccccacactaacctg

SEQ ID NO: 2563389 - DNA, 20 bp, Homo sapiens
cactctccttgctacccaga

SEQ ID NO: 2563390 - DNA, 17 bp, Homo sapiens
cactctgcctctgcctg

SEQ ID NO: 2563391 - DNA, 20 bp, Homo sapiens
cactctgcctctgcctgcat

SEQ ID NO: 2563392 - DNA, 15 bp, Homo sapiens
cactctggcagctca

SEQ ID NO: 2563393 - DNA, 12 bp, Homo sapiens
cactctggcctc

SEQ ID NO: 2563394 - DNA, 13 bp, Homo sapiens
cactctggcctca

SEQ ID NO: 2563395 - DNA, 15 bp, Homo sapiens
cactctgggctccag

SEQ ID NO: 2563396 - DNA, 17 bp, Homo sapiens
cactctgttatttagac

SEQ ID NO: 2563397 - DNA, 20 bp, Homo sapiens
cacatgtcaccgtggacctt

SEQ ID NO: 2563398 - DNA, 11 bp, Homo sapiens
caccccttccc

SEQ ID NO: 2563399 - DNA, 13 bp, Homo sapiens
caccccttcccca

SEQ ID NO: 2563400 - DNA, 14 bp, Homo sapiens
caccccttccccac

SEQ ID NO: 2563401 - DNA, 18 bp, Homo sapiens
caccccttccccactgcc

SEQ ID NO: 2563402 - DNA, 16 bp, Homo sapiens
cacccgactcctcaaa

SEQ ID NO: 2563403 - DNA, 12 bp, Homo sapiens
cacccgaggctg

SEQ ID NO: 2563404 - DNA, 21 bp, Homo sapiens
ctcaatttttggttgaataaa

SEQ ID NO: 2563405 - DNA, 17 bp, Homo sapiens
ctcacaagaagaccaga

SEQ ID NO: 2563406 - DNA, 21 bp, Homo sapiens
ctcacacaggacccccttccc

SEQ ID NO: 2563407 - DNA, 24 bp, Homo sapiens
ctcacacatgagcatcaggccagg

SEQ ID NO: 2563408 - DNA, 23 bp, Homo sapiens
ctcacacccaccgtccgccctgc

SEQ ID NO: 2563409 - DNA, 21 bp, Homo sapiens
ctcacaccgcgtctggtgaca

SEQ ID NO: 2563410 - DNA, 14 bp, Homo sapiens
ctcacagacctgga

SEQ ID NO: 2563411 - DNA, 23 bp, Homo sapiens
ctcacagacctggagcccctggg

SEQ ID NO: 2563412 - DNA, 17 bp, Homo sapiens
ctcacagtccttaccag

SEQ ID NO: 2563413 - DNA, 23 bp, Homo sapiens
ctcacagtccttaccagcagagc

SEQ ID NO: 2563414 - DNA, 24 bp, Homo sapiens
ctcaccagtgtcccctccactgtc

SEQ ID NO: 2563415 - DNA, 15 bp, Homo sapiens
ctcaccccagcccca

SEQ ID NO: 2563416 - DNA, 22 bp, Homo sapiens
ctcaccccatcccacaccctgg

SEQ ID NO: 2563417 - DNA, 15 bp, Homo sapiens
ctcacccccttctcc

SEQ ID NO: 2563418 - DNA, 15 bp, Homo sapiens
ctcacccctgccctg

SEQ ID NO: 2563419 - DNA, 17 bp, Homo sapiens
ctcacccctgccctggg

SEQ ID NO: 2563420 - DNA, 18 bp, Homo sapiens
ctcacccctgccctggga

SEQ ID NO: 2563421 - DNA, 19 bp, Homo sapiens
ctcaccctgagccccttcc

SEQ ID NO: 2563422 - DNA, 15 bp, Homo sapiens
ctcaccctgctacac

SEQ ID NO: 2563423 - DNA, 15 bp, Homo sapiens
ctcaccgcagtcgtc

SEQ ID NO: 2563424 - DNA, 17 bp, Homo sapiens
ctcacctaactcatact

SEQ ID NO: 2563425 - DNA, 14 bp, Homo sapiens
ctcacctctccctt

SEQ ID NO: 2563426 - DNA, 22 bp, Homo sapiens
ctcacctctggactggctagag

SEQ ID NO: 2563427 - DNA, 16 bp, Homo sapiens
ctcacctgctggcccc

SEQ ID NO: 2563428 - DNA, 19 bp, Homo sapiens
ctcacctgctggcccctca

SEQ ID NO: 2563429 - DNA, 21 bp, Homo sapiens
ctcacctgctggcccctcacc

SEQ ID NO: 2563430 - DNA, 20 bp, Homo sapiens
ctcacctgggcacctgggga

SEQ ID NO: 2563431 - DNA, 11 bp, Homo sapiens
ctcacctgggg

SEQ ID NO: 2563432 - DNA, 12 bp, Homo sapiens
ctcacctggggt

SEQ ID NO: 2563433 - DNA, 20 bp, Homo sapiens
ctcacctgttgcttacaatt

SEQ ID NO: 2563434 - DNA, 18 bp, Homo sapiens
ctcaccttgcaacacaca

SEQ ID NO: 2563435 - DNA, 18 bp, Homo sapiens
ctcacgcctgtaatccca

SEQ ID NO: 2563436 - DNA, 17 bp, Homo sapiens
ctcactatcctacccca

SEQ ID NO: 2563437 - DNA, 15 bp, Homo sapiens
ctcactatggtgcca

SEQ ID NO: 2563438 - DNA, 21 bp, Homo sapiens
ctcactatgttgcccaggcag

SEQ ID NO: 2563439 - DNA, 22 bp, Homo sapiens
ctcactatgttgcccaggcagg

SEQ ID NO: 2563440 - DNA, 22 bp, Homo sapiens
ctcactcccttctacctgccac

SEQ ID NO: 2563441 - DNA, 11 bp, Homo sapiens
ctcactctgtc

SEQ ID NO: 2563442 - DNA, 22 bp, Homo sapiens
ctcactctgtcgcccagtctgg

SEQ ID NO: 2563443 - DNA, 19 bp, Homo sapiens
ctcactgccatgccagctt

SEQ ID NO: 2563444 - DNA, 14 bp, Homo sapiens
ctcactgctcaaga

SEQ ID NO: 2563445 - DNA, 22 bp, Homo sapiens
ctcactggggtcctggggcctc

SEQ ID NO: 2563446 - DNA, 24 bp, Homo sapiens
ctcactgtgggaaggccagctgcc

SEQ ID NO: 2563447 - DNA, 20 bp, Homo sapiens
ctcactgtggtgtctgtgtt

SEQ ID NO: 2563448 - DNA, 12 bp, Homo sapiens
ctcactgttccc

SEQ ID NO: 2563449 - DNA, 21 bp, Homo sapiens
ctcactgttgaattttctcta

SEQ ID NO: 2563450 - DNA, 14 bp, Homo sapiens
ctcactgttgccca

SEQ ID NO: 2563451 - DNA, 15 bp, Homo sapiens
ctcactgttgcccag

SEQ ID NO: 2563452 - DNA, 21 bp, Homo sapiens
ctcactgttgcccaggctggc

SEQ ID NO: 2563453 - DNA, 20 bp, Homo sapiens
ctcacttccatacagctcta

SEQ ID NO: 2563454 - DNA, 15 bp, Homo sapiens
ctcacttttctccat

SEQ ID NO: 2563455 - DNA, 17 bp, Homo sapiens
ctcagaaatttttattt

SEQ ID NO: 2563456 - DNA, 15 bp, Homo sapiens
ctcagaagacactga

SEQ ID NO: 2563457 - DNA, 20 bp, Homo sapiens
ctcagaagacactgatgggc

SEQ ID NO: 2563458 - DNA, 22 bp, Homo sapiens
ctcagaagacactgatgggcaa

SEQ ID NO: 2563459 - DNA, 16 bp, Homo sapiens
ctcagaagcctgaggc

SEQ ID NO: 2563460 - DNA, 18 bp, Homo sapiens
ctcagaagcctgaggctg

SEQ ID NO: 2563461 - DNA, 20 bp, Homo sapiens
ctcagaaggctcttctgact

SEQ ID NO: 2563462 - DNA, 20 bp, Homo sapiens
ctcagaagggaggctggggt

SEQ ID NO: 2563463 - DNA, 19 bp, Homo sapiens
ctcagaaggtattcctttt

SEQ ID NO: 2563464 - DNA, 16 bp, Homo sapiens
ctcagaatctcaaata

SEQ ID NO: 2563465 - DNA, 16 bp, Homo sapiens
ctcagaccagctcttc

SEQ ID NO: 2563466 - DNA, 23 bp, Homo sapiens
ctcagagagggcaggcatgaagt

SEQ ID NO: 2563467 - DNA, 18 bp, Homo sapiens
ctcagagagggtgggagt

SEQ ID NO: 2563468 - DNA, 20 bp, Homo sapiens
ctcagagatgtgcacccatg

SEQ ID NO: 2563469 - DNA, 16 bp, Homo sapiens
ctcagaggctgttctt

SEQ ID NO: 2563470 - DNA, 16 bp, Homo sapiens
ctcagagtatggagct

SEQ ID NO: 2563471 - DNA, 14 bp, Homo sapiens
ctcagagtccaggc

SEQ ID NO: 2563472 - DNA, 14 bp, Homo sapiens
ctcagatatttata

SEQ ID NO: 2563473 - DNA, 18 bp, Homo sapiens
ctcagatcactactgcag

SEQ ID NO: 2563474 - DNA, 20 bp, Homo sapiens
ctcagatcactactgcagtc

SEQ ID NO: 2563475 - DNA, 15 bp, Homo sapiens
ctcagatctgtctga

SEQ ID NO: 2563476 - DNA, 19 bp, Homo sapiens
ctcagcaaaagatgcttct

SEQ ID NO: 2563477 - DNA, 21 bp, Homo sapiens
ctcagcaaaagatgcttctca

SEQ ID NO: 2563478 - DNA, 15 bp, Homo sapiens
ctcagcaccccttcc

SEQ ID NO: 2563479 - DNA, 13 bp, Homo sapiens
ctcagcatcctgg

SEQ ID NO: 2563480 - DNA, 16 bp, Homo sapiens
ctcagcatcctggcac

SEQ ID NO: 2563481 - DNA, 18 bp, Homo sapiens
ctcagcatcctggcaccc

SEQ ID NO: 2563482 - DNA, 13 bp, Homo sapiens
ctcagcatgcatc

SEQ ID NO: 2563483 - DNA, 13 bp, Homo sapiens
ctcagccaagcac

SEQ ID NO: 2563484 - DNA, 16 bp, Homo sapiens
ctcagccaagcacagt

SEQ ID NO: 2563485 - DNA, 17 bp, Homo sapiens
ctcagccaagcacagtg

SEQ ID NO: 2563486 - DNA, 20 bp, Homo sapiens
ctcagccaagcacagtggtg

SEQ ID NO: 2563487 - DNA, 17 bp, Homo sapiens
ctcagcccacccccctc

SEQ ID NO: 2563488 - DNA, 11 bp, Homo sapiens
ctcagcccctc

SEQ ID NO: 2563489 - DNA, 13 bp, Homo sapiens
ctcagcccctctt

SEQ ID NO: 2563490 - DNA, 18 bp, Homo sapiens
ctcagcccctcttgcccc

SEQ ID NO: 2563491 - DNA, 18 bp, Homo sapiens
ctcagccctgactggtgc

SEQ ID NO: 2563492 - DNA, 19 bp, Homo sapiens
ctcagccctgactggtgct

SEQ ID NO: 2563493 - DNA, 14 bp, Homo sapiens
ctcagcctcccaaa

SEQ ID NO: 2563494 - DNA, 13 bp, Homo sapiens
ctcagcctcccga

SEQ ID NO: 2563495 - DNA, 19 bp, Homo sapiens
ctcagcctcccgaatagct

SEQ ID NO: 2563496 - DNA, 22 bp, Homo sapiens
ctcagcctcccgaatagctggg

SEQ ID NO: 2563497 - DNA, 23 bp, Homo sapiens
ctcagcctcccgaatagctggga

SEQ ID NO: 2563498 - DNA, 18 bp, Homo sapiens
ctcagcctcctcatctgg

SEQ ID NO: 2563499 - DNA, 12 bp, Homo sapiens
ctcagcctggtg

SEQ ID NO: 2563500 - DNA, 18 bp, Homo sapiens
ctcagcctggtgggcctc

SEQ ID NO: 2563501 - DNA, 19 bp, Homo sapiens
ctcagcctggtgggcctcc

SEQ ID NO: 2563502 - DNA, 16 bp, Homo sapiens
ctcagcctgtgctgcc

SEQ ID NO: 2563503 - DNA, 23 bp, Homo sapiens
ctcagccttccccttgcccaggg

SEQ ID NO: 2563504 - DNA, 14 bp, Homo sapiens
ctcagcgaatgaat

SEQ ID NO: 2563505 - DNA, 18 bp, Homo sapiens
ctcagcggggacagctcc

SEQ ID NO: 2563506 - DNA, 19 bp, Homo sapiens
ctcagcggggacagctcct

SEQ ID NO: 2563507 - DNA, 23 bp, Homo sapiens
ctcagcgtttttttgtttttaat

SEQ ID NO: 2563508 - DNA, 19 bp, Homo sapiens
ctcagctccaggtggctct

SEQ ID NO: 2563509 - DNA, 19 bp, Homo sapiens
ctcagctcccaaggctctg

SEQ ID NO: 2563510 - DNA, 16 bp, Homo sapiens
ctcagctcccatttct

SEQ ID NO: 2563511 - DNA, 14 bp, Homo sapiens
ctcagctgcctcac

SEQ ID NO: 2563512 - DNA, 14 bp, Homo sapiens
ctcagcttcctacc

SEQ ID NO: 2563513 - DNA, 21 bp, Homo sapiens
ctcagctttttgtcttttctg

SEQ ID NO: 2563514 - DNA, 22 bp, Homo sapiens
ctcaggaaatcaaatatgcaaa

SEQ ID NO: 2563515 - DNA, 15 bp, Homo sapiens
ctcaggactcctctc

SEQ ID NO: 2563516 - DNA, 19 bp, Homo sapiens
ctcaggactgcaacaggct

SEQ ID NO: 2563517 - DNA, 14 bp, Homo sapiens
ctcaggaggctgag

SEQ ID NO: 2563518 - DNA, 18 bp, Homo sapiens
ctcaggagtttgagacca

SEQ ID NO: 2563519 - DNA, 14 bp, Homo sapiens
ctcaggatgcccag

SEQ ID NO: 2563520 - DNA, 22 bp, Homo sapiens
ctcaggatgcccagggccactc

SEQ ID NO: 2563521 - DNA, 14 bp, Homo sapiens
ctcaggcagctcaa

SEQ ID NO: 2563522 - DNA, 15 bp, Homo sapiens
ctcaggcagctcaag

SEQ ID NO: 2563523 - DNA, 15 bp, Homo sapiens
ctcaggcaggtggga

SEQ ID NO: 2563524 - DNA, 18 bp, Homo sapiens
ctcaggcaggtgggatgg

SEQ ID NO: 2563525 - DNA, 20 bp, Homo sapiens
ctcaggcataggcctgggtg

SEQ ID NO: 2563526 - DNA, 21 bp, Homo sapiens
ctcaggcataggcctgggtgc

SEQ ID NO: 2563527 - DNA, 18 bp, Homo sapiens
ctcaggcatgcctgtgtg

SEQ ID NO: 2563528 - DNA, 15 bp, Homo sapiens
ctcaggccacaccgg

SEQ ID NO: 2563529 - DNA, 13 bp, Homo sapiens
ctcaggccacctg

SEQ ID NO: 2563530 - DNA, 19 bp, Homo sapiens
ctcaggccacctgccccct

SEQ ID NO: 2563531 - DNA, 22 bp, Homo sapiens
ctcaggccacctgcccccttct

SEQ ID NO: 2563532 - DNA, 23 bp, Homo sapiens
ctcaggccacctgcccccttctc

SEQ ID NO: 2563533 - DNA, 15 bp, Homo sapiens
ctcaggccaggtgca

SEQ ID NO: 2563534 - DNA, 13 bp, Homo sapiens
ctcaggctctgcc

SEQ ID NO: 2563535 - DNA, 15 bp, Homo sapiens
ctcaggctctgccct

SEQ ID NO: 2563536 - DNA, 17 bp, Homo sapiens
ctcaggctctgccctgc

SEQ ID NO: 2563537 - DNA, 17 bp, Homo sapiens
ctcaggcttccttggca

SEQ ID NO: 2563538 - DNA, 15 bp, Homo sapiens
ctcaggcttgaaatg

SEQ ID NO: 2563539 - DNA, 17 bp, Homo sapiens
ctcagggaaaagcagct

SEQ ID NO: 2563540 - DNA, 20 bp, Homo sapiens
ctcagggaaaagcagctctc

SEQ ID NO: 2563541 - DNA, 22 bp, Homo sapiens
ctcagggaaaagcagctctccc

SEQ ID NO: 2563542 - DNA, 23 bp, Homo sapiens
ctcagggaaaagcagctctcccc

SEQ ID NO: 2563543 - DNA, 17 bp, Homo sapiens
ctcagggaaaggccagt

SEQ ID NO: 2563544 - DNA, 16 bp, Homo sapiens
ctcagggacagagcca

SEQ ID NO: 2563545 - DNA, 18 bp, Homo sapiens
ctcagggacagagccatg

SEQ ID NO: 2563546 - DNA, 18 bp, Homo sapiens
ctcagggcctggctcagg

SEQ ID NO: 2563547 - DNA, 22 bp, Homo sapiens
ctcagggctaaacgggcattgc

SEQ ID NO: 2563548 - DNA, 16 bp, Homo sapiens
ctcagggctcctgcct

SEQ ID NO: 2563549 - DNA, 23 bp, Homo sapiens
ctcagggctcctgccttctgtcc

SEQ ID NO: 2563550 - DNA, 14 bp, Homo sapiens
ctcagggctcctgg

SEQ ID NO: 2563551 - DNA, 17 bp, Homo sapiens
ctcagggctcctgggtt

SEQ ID NO: 2563552 - DNA, 17 bp, Homo sapiens
ctcagggtccctggtgg

SEQ ID NO: 2563553 - DNA, 23 bp, Homo sapiens
ctatcatttttgtacagtttgct

SEQ ID NO: 2563554 - DNA, 17 bp, Homo sapiens
ctatccacagagagtcc

SEQ ID NO: 2563555 - DNA, 19 bp, Homo sapiens
ctatcctggctctttggag

SEQ ID NO: 2563556 - DNA, 14 bp, Homo sapiens
ctatctaaatgttg

SEQ ID NO: 2563557 - DNA, 16 bp, Homo sapiens
ctatctcccccagccc

SEQ ID NO: 2563558 - DNA, 17 bp, Homo sapiens
ctatctctgtgtgcaca

SEQ ID NO: 2563559 - DNA, 22 bp, Homo sapiens
ctatctggtcaacctcctggac

SEQ ID NO: 2563560 - DNA, 14 bp, Homo sapiens
ctatcttaattttg

SEQ ID NO: 2563561 - DNA, 15 bp, Homo sapiens
ctatcttaattttgg

SEQ ID NO: 2563562 - DNA, 23 bp, Homo sapiens
ctatcttaattttggttgtattc

SEQ ID NO: 2563563 - DNA, 18 bp, Homo sapiens
ctatcttgctctgtaatc

SEQ ID NO: 2563564 - DNA, 19 bp, Homo sapiens
ctatctttgccaccctcat

SEQ ID NO: 2563565 - DNA, 17 bp, Homo sapiens
ctatgaacttctctcag

SEQ ID NO: 2563566 - DNA, 23 bp, Homo sapiens
ctatgaatgggcaaaactgaatt

SEQ ID NO: 2563567 - DNA, 15 bp, Homo sapiens
ctatgactgctcccc

SEQ ID NO: 2563568 - DNA, 22 bp, Homo sapiens
ctatgcaatatatctaaattga

SEQ ID NO: 2563569 - DNA, 20 bp, Homo sapiens
ctatgcacatatggactctg

SEQ ID NO: 2563570 - DNA, 22 bp, Homo sapiens
ctatgcacatatggactctgca

SEQ ID NO: 2563571 - DNA, 20 bp, Homo sapiens
ctatgcatatcagttgagct

SEQ ID NO: 2563572 - DNA, 14 bp, Homo sapiens
ctatggatggcttc

SEQ ID NO: 2563573 - DNA, 16 bp, Homo sapiens
ctatggatggcttcta

SEQ ID NO: 2563574 - DNA, 17 bp, Homo sapiens
ctatggctggccactgc

SEQ ID NO: 2563575 - DNA, 14 bp, Homo sapiens
ctatgggagcccca

SEQ ID NO: 2563576 - DNA, 16 bp, Homo sapiens
ctatgggagccccagg

SEQ ID NO: 2563577 - DNA, 21 bp, Homo sapiens
ctatggggagaaaagacatga

SEQ ID NO: 2563578 - DNA, 19 bp, Homo sapiens
ctatggggatagatgtgtg

SEQ ID NO: 2563579 - DNA, 19 bp, Homo sapiens
ctatgggggcactgaggac

SEQ ID NO: 2563580 - DNA, 20 bp, Homo sapiens
ctatggtgagatgcagctgg

SEQ ID NO: 2563581 - DNA, 21 bp, Homo sapiens
ctatggtgccaatggaacctc

SEQ ID NO: 2563582 - DNA, 13 bp, Homo sapiens
ctatgtatttgca

SEQ ID NO: 2563583 - DNA, 23 bp, Homo sapiens
ctatgtcatttgctggagctctg

SEQ ID NO: 2563584 - DNA, 16 bp, Homo sapiens
ctatgtcccttgctgt

SEQ ID NO: 2563585 - DNA, 18 bp, Homo sapiens
ctatgtcctaaggacaca

SEQ ID NO: 2563586 - DNA, 23 bp, Homo sapiens
ctatgtcctaaggacacactaat

SEQ ID NO: 2563587 - DNA, 18 bp, Homo sapiens
ctatgttctaagaagtga

SEQ ID NO: 2563588 - DNA, 16 bp, Homo sapiens
ctatgttgcccaggca

SEQ ID NO: 2563589 - DNA, 19 bp, Homo sapiens
ctatgttgcccaggcaggt

SEQ ID NO: 2563590 - DNA, 22 bp, Homo sapiens
ctatgtttttgttcaaagccag

SEQ ID NO: 2563591 - DNA, 23 bp, Homo sapiens
ctattaagatttccaagtgccaa

SEQ ID NO: 2563592 - DNA, 14 bp, Homo sapiens
ctattagactgtag

SEQ ID NO: 2563593 - DNA, 15 bp, Homo sapiens
ctattagagaagaga

SEQ ID NO: 2563594 - DNA, 16 bp, Homo sapiens
ctattataatttaatg

SEQ ID NO: 2563595 - DNA, 14 bp, Homo sapiens
ctattatagccaca

SEQ ID NO: 2563596 - DNA, 14 bp, Homo sapiens
ctattatattaaaa

SEQ ID NO: 2563597 - DNA, 16 bp, Homo sapiens
ctattcaaacagtctc

SEQ ID NO: 2563598 - DNA, 18 bp, Homo sapiens
ctattcaaacagtctcag

SEQ ID NO: 2563599 - DNA, 23 bp, Homo sapiens
ctattcaaggtggccaaattatt

SEQ ID NO: 2563600 - DNA, 23 bp, Homo sapiens
ctattcagcttcgtttattttca

SEQ ID NO: 2563601 - DNA, 17 bp, Homo sapiens
ctattcagttcccagaa

SEQ ID NO: 2563602 - DNA, 18 bp, Homo sapiens
ctattcagttcccagaat

SEQ ID NO: 2563603 - DNA, 19 bp, Homo sapiens
ctattcccacacctccaca

SEQ ID NO: 2563604 - DNA, 14 bp, Homo sapiens
ctattcctcctggg

SEQ ID NO: 2563605 - DNA, 12 bp, Homo sapiens
ctattctctctt

SEQ ID NO: 2563606 - DNA, 19 bp, Homo sapiens
ctattgatgtacagtctgt

SEQ ID NO: 2563607 - DNA, 13 bp, Homo sapiens
ctattgtaaatat

SEQ ID NO: 2563608 - DNA, 15 bp, Homo sapiens
ctattgtcattaaag

SEQ ID NO: 2563609 - DNA, 22 bp, Homo sapiens
ctattgtcccctagcaaggcat

SEQ ID NO: 2563610 - DNA, 13 bp, Homo sapiens
ctattgtgatttg

SEQ ID NO: 2563611 - DNA, 14 bp, Homo sapiens
ctattgtgatttga

SEQ ID NO: 2563612 - DNA, 22 bp, Homo sapiens
ctattgtttattctttttaaag

SEQ ID NO: 2563613 - DNA, 21 bp, Homo sapiens
ctattgtttctttaagaaagt

SEQ ID NO: 2563614 - DNA, 12 bp, Homo sapiens
ctatttaatatt

SEQ ID NO: 2563615 - DNA, 13 bp, Homo sapiens
ctatttagcatga

SEQ ID NO: 2563616 - DNA, 18 bp, Homo sapiens
ctatttagcatgacaagc

SEQ ID NO: 2563617 - DNA, 19 bp, Homo sapiens
ctatttatctgtgtttttg

SEQ ID NO: 2563618 - DNA, 14 bp, Homo sapiens
ctatttccattcca

SEQ ID NO: 2563619 - DNA, 21 bp, Homo sapiens
ctatttccccaggggaaaatg

SEQ ID NO: 2563620 - DNA, 15 bp, Homo sapiens
ctatttctcctccat

SEQ ID NO: 2563621 - DNA, 23 bp, Homo sapiens
ctatttgccatgggcttcactgt

SEQ ID NO: 2563622 - DNA, 23 bp, Homo sapiens
ctatttgttttcttctgtatgtt

SEQ ID NO: 2563623 - DNA, 18 bp, Homo sapiens
ctattttgaaaaattcct

SEQ ID NO: 2563624 - DNA, 15 bp, Homo sapiens
ctatttttatttata

SEQ ID NO: 2563625 - DNA, 18 bp, Homo sapiens
ctatttttatttatattt

SEQ ID NO: 2563626 - DNA, 21 bp, Homo sapiens
ctcaaaaaaaaaaaaatgcac

SEQ ID NO: 2563627 - DNA, 18 bp, Homo sapiens
ctcaaaaaaagaaaaaga

SEQ ID NO: 2563628 - DNA, 20 bp, Homo sapiens
ctcaaaacttaacatattta

SEQ ID NO: 2563629 - DNA, 13 bp, Homo sapiens
ctcaaaatatttg

SEQ ID NO: 2563630 - DNA, 16 bp, Homo sapiens
ctcaaacaacactggt

SEQ ID NO: 2563631 - DNA, 12 bp, Homo sapiens
ctcaaacactgc

SEQ ID NO: 2563632 - DNA, 18 bp, Homo sapiens
ctcaaaccaaatcactga

SEQ ID NO: 2563633 - DNA, 13 bp, Homo sapiens
ctcaaacctcctc

SEQ ID NO: 2563634 - DNA, 15 bp, Homo sapiens
ctcaaacctgtttaa

SEQ ID NO: 2563635 - DNA, 14 bp, Homo sapiens
ctcaaactcctgac

SEQ ID NO: 2563636 - DNA, 20 bp, Homo sapiens
ctcaaactcttgacctcagg

SEQ ID NO: 2563637 - DNA, 22 bp, Homo sapiens
ctcaaagacaatgttattttcc

SEQ ID NO: 2563638 - DNA, 14 bp, Homo sapiens
ctcaaagttttgaa

SEQ ID NO: 2563639 - DNA, 17 bp, Homo sapiens
ctcaaagttttgaaaag

SEQ ID NO: 2563640 - DNA, 13 bp, Homo sapiens
ctcaaataaaata

SEQ ID NO: 2563641 - DNA, 12 bp, Homo sapiens
ctcaaataacta

SEQ ID NO: 2563642 - DNA, 17 bp, Homo sapiens
ctcaaatgacccaaaga

SEQ ID NO: 2563643 - DNA, 22 bp, Homo sapiens
ctcaaatgctcagaccagctct

SEQ ID NO: 2563644 - DNA, 23 bp, Homo sapiens
ctcaaattaatctttctttacct

SEQ ID NO: 2563645 - DNA, 13 bp, Homo sapiens
ctcaaatttctaa

SEQ ID NO: 2563646 - DNA, 14 bp, Homo sapiens
ctcaaatttctaaa

SEQ ID NO: 2563647 - DNA, 19 bp, Homo sapiens
ctcaacaagggagagacct

SEQ ID NO: 2563648 - DNA, 20 bp, Homo sapiens
ctcaacacccaactgtctcg

SEQ ID NO: 2563649 - DNA, 21 bp, Homo sapiens
ctcaacacctctgcacaagct

SEQ ID NO: 2563650 - DNA, 20 bp, Homo sapiens
ctcaacatgagtcaagagca

SEQ ID NO: 2563651 - DNA, 20 bp, Homo sapiens
ctcaaccatcccctccgtgg

SEQ ID NO: 2563652 - DNA, 18 bp, Homo sapiens
ctcaaccccaccacttct

SEQ ID NO: 2563653 - DNA, 18 bp, Homo sapiens
ctcaaccctccctcagcc

SEQ ID NO: 2563654 - DNA, 21 bp, Homo sapiens
ctcaaccctccctcagcccct

SEQ ID NO: 2563655 - DNA, 22 bp, Homo sapiens
ctcaaccctccctcagcccctc

SEQ ID NO: 2563656 - DNA, 22 bp, Homo sapiens
ctcaacctaccaccccttcctg

SEQ ID NO: 2563657 - DNA, 23 bp, Homo sapiens
ctcaacctaccaccccttcctgt

SEQ ID NO: 2563658 - DNA, 13 bp, Homo sapiens
ctcaacctcctgg

SEQ ID NO: 2563659 - DNA, 13 bp, Homo sapiens
ctcaacctgtgat

SEQ ID NO: 2563660 - DNA, 21 bp, Homo sapiens
ctcaacctgtgatgaggggag

SEQ ID NO: 2563661 - DNA, 18 bp, Homo sapiens
ctcaacgttgctccccat

SEQ ID NO: 2563662 - DNA, 13 bp, Homo sapiens
ctcaactgcctac

SEQ ID NO: 2563663 - DNA, 15 bp, Homo sapiens
ctcaactgcctactc

SEQ ID NO: 2563664 - DNA, 19 bp, Homo sapiens
ctcaagaagacatggagac

SEQ ID NO: 2563665 - DNA, 15 bp, Homo sapiens
ctcaagaagcaggct

SEQ ID NO: 2563666 - DNA, 23 bp, Homo sapiens
ctcaagaagcaggctacactgac

SEQ ID NO: 2563667 - DNA, 22 bp, Homo sapiens
ctcaagccaagcagccaagctc

SEQ ID NO: 2563668 - DNA, 20 bp, Homo sapiens
ctcaagccaatcccctcctt

SEQ ID NO: 2563669 - DNA, 17 bp, Homo sapiens
ctcaagcccgcggggac

SEQ ID NO: 2563670 - DNA, 22 bp, Homo sapiens
ctcaagccctgcagtcacagct

SEQ ID NO: 2563671 - DNA, 18 bp, Homo sapiens
ctcaaggacttgaaagca

SEQ ID NO: 2563672 - DNA, 19 bp, Homo sapiens
ctcaaggacttgaaagcat

SEQ ID NO: 2563673 - DNA, 20 bp, Homo sapiens
ctcaaggacttgaaagcatc

SEQ ID NO: 2563674 - DNA, 15 bp, Homo sapiens
ctcaaggcgtgagga

SEQ ID NO: 2563675 - DNA, 20 bp, Homo sapiens
ctcaagtcactcccaagccc

SEQ ID NO: 2563676 - DNA, 17 bp, Homo sapiens
ctcaagtcttccctgat

SEQ ID NO: 2563677 - DNA, 19 bp, Homo sapiens
ctcaagtgattctcctgcc

SEQ ID NO: 2563678 - DNA, 14 bp, Homo sapiens
ctcaagttgaaaga

SEQ ID NO: 2563679 - DNA, 19 bp, Homo sapiens
ctcaagtttttcagaaagc

SEQ ID NO: 2563680 - DNA, 20 bp, Homo sapiens
ctcaagtttttcagaaagca

SEQ ID NO: 2563681 - DNA, 23 bp, Homo sapiens
ctcaataaaatcatgtacatttc

SEQ ID NO: 2563682 - DNA, 16 bp, Homo sapiens
ctcaataaatgattct

SEQ ID NO: 2563683 - DNA, 11 bp, Homo sapiens
ctcaatatttt

SEQ ID NO: 2563684 - DNA, 14 bp, Homo sapiens
ctcaatccatgttc

SEQ ID NO: 2563685 - DNA, 14 bp, Homo sapiens
ctcaatcctctaag

SEQ ID NO: 2563686 - DNA, 18 bp, Homo sapiens
ctcaatgtgaccaggggt

SEQ ID NO: 2563687 - DNA, 19 bp, Homo sapiens
ctcaattccccctggccac

SEQ ID NO: 2563688 - DNA, 23 bp, Homo sapiens
ctacaagagcagcctgtggcatc

SEQ ID NO: 2563689 - DNA, 19 bp, Homo sapiens
ctacaagctaaaattagat

SEQ ID NO: 2563690 - DNA, 16 bp, Homo sapiens
ctacaatttaaagcaa

SEQ ID NO: 2563691 - DNA, 23 bp, Homo sapiens
ctacaattttctcccaggaagct

SEQ ID NO: 2563692 - DNA, 14 bp, Homo sapiens
ctacacagggatgt

SEQ ID NO: 2563693 - DNA, 18 bp, Homo sapiens
ctacacccttttccagct

SEQ ID NO: 2563694 - DNA, 14 bp, Homo sapiens
ctacactccagcct

SEQ ID NO: 2563695 - DNA, 16 bp, Homo sapiens
ctacactccagcctga

SEQ ID NO: 2563696 - DNA, 17 bp, Homo sapiens
ctacactgtgctgagtc

SEQ ID NO: 2563697 - DNA, 16 bp, Homo sapiens
ctacagacttctccag

SEQ ID NO: 2563698 - DNA, 22 bp, Homo sapiens
ctacagagaacctggagttcct

SEQ ID NO: 2563699 - DNA, 16 bp, Homo sapiens
ctacagagcttccctg

SEQ ID NO: 2563700 - DNA, 18 bp, Homo sapiens
ctacagagcttccctgac

SEQ ID NO: 2563701 - DNA, 15 bp, Homo sapiens
ctacagaggccatgg

SEQ ID NO: 2563702 - DNA, 15 bp, Homo sapiens
ctacagatagtcaaa

SEQ ID NO: 2563703 - DNA, 20 bp, Homo sapiens
ctacaggaagcaccccatgc

SEQ ID NO: 2563704 - DNA, 18 bp, Homo sapiens
ctacaggagagggaagag

SEQ ID NO: 2563705 - DNA, 15 bp, Homo sapiens
ctacaggagtgagca

SEQ ID NO: 2563706 - DNA, 22 bp, Homo sapiens
ctacaggcacacgccacctcgc

SEQ ID NO: 2563707 - DNA, 16 bp, Homo sapiens
ctacaggtgtgagtca

SEQ ID NO: 2563708 - DNA, 18 bp, Homo sapiens
ctacaggttacaacagat

SEQ ID NO: 2563709 - DNA, 15 bp, Homo sapiens
ctacagtcaggaaag

SEQ ID NO: 2563710 - DNA, 16 bp, Homo sapiens
ctacagtcctcccatc

SEQ ID NO: 2563711 - DNA, 17 bp, Homo sapiens
ctacagtcctcccatct

SEQ ID NO: 2563712 - DNA, 23 bp, Homo sapiens
ctacagttagggttgagttactt

SEQ ID NO: 2563713 - DNA, 21 bp, Homo sapiens
ctacagttgaaaaacagctga

SEQ ID NO: 2563714 - DNA, 23 bp, Homo sapiens
ctacatactttcatcctgactct

SEQ ID NO: 2563715 - DNA, 16 bp, Homo sapiens
ctacatcttctgcctt

SEQ ID NO: 2563716 - DNA, 18 bp, Homo sapiens
ctacatcttttttcacaa

SEQ ID NO: 2563717 - DNA, 14 bp, Homo sapiens
ctacatgaaacaga

SEQ ID NO: 2563718 - DNA, 15 bp, Homo sapiens
ctacatgaggtactg

SEQ ID NO: 2563719 - DNA, 20 bp, Homo sapiens
ctacatgaggtactgagagt

SEQ ID NO: 2563720 - DNA, 22 bp, Homo sapiens
ctacatgatctagagccagtta

SEQ ID NO: 2563721 - DNA, 20 bp, Homo sapiens
ctacatggagtatatgtcaa

SEQ ID NO: 2563722 - DNA, 15 bp, Homo sapiens
ctaccaaagcacctt

SEQ ID NO: 2563723 - DNA, 18 bp, Homo sapiens
ctaccaatagattcccca

SEQ ID NO: 2563724 - DNA, 14 bp, Homo sapiens
ctaccaatgcatgc

SEQ ID NO: 2563725 - DNA, 13 bp, Homo sapiens
ctaccacagtgtc

SEQ ID NO: 2563726 - DNA, 15 bp, Homo sapiens
ctaccacagtgtctg

SEQ ID NO: 2563727 - DNA, 17 bp, Homo sapiens
ctaccaccccttcctgt

SEQ ID NO: 2563728 - DNA, 14 bp, Homo sapiens
ctaccacctcccca

SEQ ID NO: 2563729 - DNA, 16 bp, Homo sapiens
ctaccacctccccagc

SEQ ID NO: 2563730 - DNA, 18 bp, Homo sapiens
ctaccactgtcttcttca

SEQ ID NO: 2563731 - DNA, 20 bp, Homo sapiens
ctaccagactgtgtattcat

SEQ ID NO: 2563732 - DNA, 20 bp, Homo sapiens
ctaccagcgcccgctgggct

SEQ ID NO: 2563733 - DNA, 15 bp, Homo sapiens
ctaccaggtgttcta

SEQ ID NO: 2563734 - DNA, 19 bp, Homo sapiens
ctaccatgaacagaaaaca

SEQ ID NO: 2563735 - DNA, 13 bp, Homo sapiens
ctaccatttcaga

SEQ ID NO: 2563736 - DNA, 13 bp, Homo sapiens
ctacccaaccact

SEQ ID NO: 2563737 - DNA, 17 bp, Homo sapiens
ctacccagcgagccctg

SEQ ID NO: 2563738 - DNA, 18 bp, Homo sapiens
ctacccagcgagccctgg

SEQ ID NO: 2563739 - DNA, 19 bp, Homo sapiens
ctacccccagggttgaggg

SEQ ID NO: 2563740 - DNA, 14 bp, Homo sapiens
ctacccgggaaggg

SEQ ID NO: 2563741 - DNA, 20 bp, Homo sapiens
ctacccgggaagggggctgg

SEQ ID NO: 2563742 - DNA, 19 bp, Homo sapiens
ctaccctagccattcctgg

SEQ ID NO: 2563743 - DNA, 14 bp, Homo sapiens
ctaccctcccaccc

SEQ ID NO: 2563744 - DNA, 16 bp, Homo sapiens
ctaccctcccaccccc

SEQ ID NO: 2563745 - DNA, 15 bp, Homo sapiens
ctaccctcgggccca

SEQ ID NO: 2563746 - DNA, 17 bp, Homo sapiens
ctaccctcttagaaaaa

SEQ ID NO: 2563747 - DNA, 18 bp, Homo sapiens
ctaccctgagctgaggca

SEQ ID NO: 2563748 - DNA, 18 bp, Homo sapiens
ctaccctttttctccagc

SEQ ID NO: 2563749 - DNA, 19 bp, Homo sapiens
ctaccctttttctccagct

SEQ ID NO: 2563750 - DNA, 17 bp, Homo sapiens
ctacctcactggggtcc

SEQ ID NO: 2563751 - DNA, 18 bp, Homo sapiens
ctacctcaggcagctcaa

SEQ ID NO: 2563752 - DNA, 13 bp, Homo sapiens
ctacctcaggttg

SEQ ID NO: 2563753 - DNA, 22 bp, Homo sapiens
ctacctcaggttgctggttgct

SEQ ID NO: 2563754 - DNA, 15 bp, Homo sapiens
ctacctgaggggcct

SEQ ID NO: 2563755 - DNA, 19 bp, Homo sapiens
ctacctgccactcacacag

SEQ ID NO: 2563756 - DNA, 22 bp, Homo sapiens
ctacctgccactcacacagcca

SEQ ID NO: 2563757 - DNA, 20 bp, Homo sapiens
ctacctgttcagtgtcccgg

SEQ ID NO: 2563758 - DNA, 21 bp, Homo sapiens
ctacctgttcagtgtcccggg

SEQ ID NO: 2563759 - DNA, 19 bp, Homo sapiens
ctaccttaaaatgtaaaac

SEQ ID NO: 2563760 - DNA, 18 bp, Homo sapiens
ctaccttccagttcctca

SEQ ID NO: 2563761 - DNA, 13 bp, Homo sapiens
ctaccttctgtag

SEQ ID NO: 2563762 - DNA, 23 bp, Homo sapiens
ctaccttgaggtcttttgacatg

SEQ ID NO: 2563763 - DNA, 19 bp, Homo sapiens
ctaccttgtgacccagcac

SEQ ID NO: 2563764 - DNA, 15 bp, Homo sapiens
ctactagatgtcttt

SEQ ID NO: 2563765 - DNA, 16 bp, Homo sapiens
ctactcaagaggctga

SEQ ID NO: 2563766 - DNA, 15 bp, Homo sapiens
ctactcacagtctct

SEQ ID NO: 2563767 - DNA, 17 bp, Homo sapiens
ctactcctacctcagcc

SEQ ID NO: 2563768 - DNA, 18 bp, Homo sapiens
ctactcctacctcagcct

SEQ ID NO: 2563769 - DNA, 21 bp, Homo sapiens
ctactcctacctcagcctaga

SEQ ID NO: 2563770 - DNA, 21 bp, Homo sapiens
ctactcctctgcagtgccttg

SEQ ID NO: 2563771 - DNA, 19 bp, Homo sapiens
ctactctgttccttcacat

SEQ ID NO: 2563772 - DNA, 22 bp, Homo sapiens
ctactctgttccttcacatcct

SEQ ID NO: 2563773 - DNA, 21 bp, Homo sapiens
ctactcttaagtttctcagct

SEQ ID NO: 2563774 - DNA, 16 bp, Homo sapiens
ctactgatttcctttg

SEQ ID NO: 2563775 - DNA, 19 bp, Homo sapiens
ctactgtcctacccaccct

SEQ ID NO: 2563776 - DNA, 20 bp, Homo sapiens
ctactgtcctacccaccctc

SEQ ID NO: 2563777 - DNA, 20 bp, Homo sapiens
ctactgtctcactgaaacat

SEQ ID NO: 2563778 - DNA, 13 bp, Homo sapiens
ctactgtgactga

SEQ ID NO: 2563779 - DNA, 14 bp, Homo sapiens
ctactgtggaaaaa

SEQ ID NO: 2563780 - DNA, 15 bp, Homo sapiens
ctactgtggaaaaat

SEQ ID NO: 2563781 - DNA, 22 bp, Homo sapiens
ctactgtggaaaaatatttaag

SEQ ID NO: 2563782 - DNA, 20 bp, Homo sapiens
ctactgtgttcctggcaata

SEQ ID NO: 2563783 - DNA, 16 bp, Homo sapiens
ctagaaacagatcttg

SEQ ID NO: 2563784 - DNA, 23 bp, Homo sapiens
ctagaaatgatccccagctgttt

SEQ ID NO: 2563785 - DNA, 23 bp, Homo sapiens
ctagaaatttttcagatgcttct

SEQ ID NO: 2563786 - DNA, 19 bp, Homo sapiens
ctagaacacaggcaaaatc

SEQ ID NO: 2563787 - DNA, 21 bp, Homo sapiens
ctagaacacaggcaaaatcct

SEQ ID NO: 2563788 - DNA, 17 bp, Homo sapiens
ctagaacctagaagggc

SEQ ID NO: 2563789 - DNA, 14 bp, Homo sapiens
ctagaacctggagg

SEQ ID NO: 2563790 - DNA, 21 bp, Homo sapiens
ctagaagatgaatacaaacaa

SEQ ID NO: 2563791 - DNA, 22 bp, Homo sapiens
ctagaagattttgaaattttta

SEQ ID NO: 2563792 - DNA, 23 bp, Homo sapiens
ctagaagggccagtcctgcctgg

SEQ ID NO: 2563793 - DNA, 21 bp, Homo sapiens
ctagaatatcctacttctcca

SEQ ID NO: 2563794 - DNA, 20 bp, Homo sapiens
ctagaatctggagagctaga

SEQ ID NO: 2563795 - DNA, 16 bp, Homo sapiens
ctagaattccctctct

SEQ ID NO: 2563796 - DNA, 15 bp, Homo sapiens
ctagacattctgtcg

SEQ ID NO: 2563797 - DNA, 16 bp, Homo sapiens
ctagacattctgtcgc

SEQ ID NO: 2563798 - DNA, 22 bp, Homo sapiens
ctagactcaaggttcccagaga

SEQ ID NO: 2563799 - DNA, 23 bp, Homo sapiens
ctagactcaaggttcccagagat

SEQ ID NO: 2563800 - DNA, 13 bp, Homo sapiens
ctagactttctgt

SEQ ID NO: 2563801 - DNA, 17 bp, Homo sapiens
ctagagaacgcagccct

SEQ ID NO: 2563802 - DNA, 18 bp, Homo sapiens
ctagagaacgcagcccta

SEQ ID NO: 2563803 - DNA, 19 bp, Homo sapiens
ctagagaagaggctggtgc

SEQ ID NO: 2563804 - DNA, 18 bp, Homo sapiens
cgtggaggaatgctcccc

SEQ ID NO: 2563805 - DNA, 21 bp, Homo sapiens
cgtggcagataatcagcctct

SEQ ID NO: 2563806 - DNA, 23 bp, Homo sapiens
cgtggcatagcccagacacagaa

SEQ ID NO: 2563807 - DNA, 21 bp, Homo sapiens
cgtggcatgtggcctgtggcc

SEQ ID NO: 2563808 - DNA, 11 bp, Homo sapiens
cgtggccagcc

SEQ ID NO: 2563809 - DNA, 16 bp, Homo sapiens
cgtggcccagagaagc

SEQ ID NO: 2563810 - DNA, 17 bp, Homo sapiens
cgtgggagcgtgggagg

SEQ ID NO: 2563811 - DNA, 17 bp, Homo sapiens
cgtgggcggggccttgc

SEQ ID NO: 2563812 - DNA, 18 bp, Homo sapiens
cgtggtgttatttaaaga

SEQ ID NO: 2563813 - DNA, 19 bp, Homo sapiens
cgtggtgttatttaaagaa

SEQ ID NO: 2563814 - DNA, 14 bp, Homo sapiens
cgtgtatcctgggg

SEQ ID NO: 2563815 - DNA, 16 bp, Homo sapiens
cgtgtcacctgtgctt

SEQ ID NO: 2563816 - DNA, 14 bp, Homo sapiens
cgtgtctgtattta

SEQ ID NO: 2563817 - DNA, 22 bp, Homo sapiens
cgtgtgtgcaagtgtctgtgtg

SEQ ID NO: 2563818 - DNA, 11 bp, Homo sapiens
cgtgtttgcac

SEQ ID NO: 2563819 - DNA, 21 bp, Homo sapiens
cgtgttttattcctgtatgtt

SEQ ID NO: 2563820 - DNA, 22 bp, Homo sapiens
cgttatgtgtgtatatgtatgt

SEQ ID NO: 2563821 - DNA, 14 bp, Homo sapiens
cgttattataattg

SEQ ID NO: 2563822 - DNA, 14 bp, Homo sapiens
cgttctcacaccca

SEQ ID NO: 2563823 - DNA, 12 bp, Homo sapiens
cgttctctgcct

SEQ ID NO: 2563824 - DNA, 19 bp, Homo sapiens
cgttgaggatgaggccgct

SEQ ID NO: 2563825 - DNA, 17 bp, Homo sapiens
cgttgatgttggctggg

SEQ ID NO: 2563826 - DNA, 18 bp, Homo sapiens
cgttgtttacttaaagat

SEQ ID NO: 2563827 - DNA, 13 bp, Homo sapiens
cgtttcaaaaaca

SEQ ID NO: 2563828 - DNA, 19 bp, Homo sapiens
cgtttctaaaggctacctt

SEQ ID NO: 2563829 - DNA, 21 bp, Homo sapiens
cgtttctaaaggctacctttg

SEQ ID NO: 2563830 - DNA, 14 bp, Homo sapiens
cgtttgtatgtgtg

SEQ ID NO: 2563831 - DNA, 15 bp, Homo sapiens
cgtttgtatgtgtgt

SEQ ID NO: 2563832 - DNA, 14 bp, Homo sapiens
cgttttattgtgtt

SEQ ID NO: 2563833 - DNA, 15 bp, Homo sapiens
cgttttggaagctct

SEQ ID NO: 2563834 - DNA, 13 bp, Homo sapiens
cgtttttccttta

SEQ ID NO: 2563835 - DNA, 20 bp, Homo sapiens
ctaaaaaaaaaaaagtatta

SEQ ID NO: 2563836 - DNA, 11 bp, Homo sapiens
ctaaaaaacag

SEQ ID NO: 2563837 - DNA, 22 bp, Homo sapiens
ctaaaacctgagctagaagctg

SEQ ID NO: 2563838 - DNA, 23 bp, Homo sapiens
ctaaaaggtatgcaatcaaatct

SEQ ID NO: 2563839 - DNA, 15 bp, Homo sapiens
ctaaaagtaaacatt

SEQ ID NO: 2563840 - DNA, 18 bp, Homo sapiens
ctaaaattccactgcgtt

SEQ ID NO: 2563841 - DNA, 12 bp, Homo sapiens
ctaaacagatat

SEQ ID NO: 2563842 - DNA, 17 bp, Homo sapiens
ctaaaccttagtactga

SEQ ID NO: 2563843 - DNA, 18 bp, Homo sapiens
ctaaaccttagtactgag

SEQ ID NO: 2563844 - DNA, 15 bp, Homo sapiens
ctaaactatcttttt

SEQ ID NO: 2563845 - DNA, 16 bp, Homo sapiens
ctaaagagagaatgta

SEQ ID NO: 2563846 - DNA, 18 bp, Homo sapiens
ctaaagaggctgaaagag

SEQ ID NO: 2563847 - DNA, 17 bp, Homo sapiens
ctaaagcccaacctcct

SEQ ID NO: 2563848 - DNA, 15 bp, Homo sapiens
ctaaaggctaccttt

SEQ ID NO: 2563849 - DNA, 16 bp, Homo sapiens
ctaaaggctacctttg

SEQ ID NO: 2563850 - DNA, 20 bp, Homo sapiens
ctaaagtatgtaaagtatgt

SEQ ID NO: 2563851 - DNA, 15 bp, Homo sapiens
ctaaagtgagctcta

SEQ ID NO: 2563852 - DNA, 24 bp, Homo sapiens
ctaaatacctgccctgacatgcac

SEQ ID NO: 2563853 - DNA, 17 bp, Homo sapiens
ctaaatcctttactgtt

SEQ ID NO: 2563854 - DNA, 21 bp, Homo sapiens
ctaaatctccaaaataaaact

SEQ ID NO: 2563855 - DNA, 12 bp, Homo sapiens
ctaaatgaatgt

SEQ ID NO: 2563856 - DNA, 15 bp, Homo sapiens
ctaaatgctgaaaaa

SEQ ID NO: 2563857 - DNA, 18 bp, Homo sapiens
ctaaatggtcgcccagga

SEQ ID NO: 2563858 - DNA, 19 bp, Homo sapiens
ctaaatggtcgcccaggag

SEQ ID NO: 2563859 - DNA, 15 bp, Homo sapiens
ctaaatgtaacagtc

SEQ ID NO: 2563860 - DNA, 18 bp, Homo sapiens
ctaaatgtaacagtctga

SEQ ID NO: 2563861 - DNA, 21 bp, Homo sapiens
ctaaatgtggagaaactgtag

SEQ ID NO: 2563862 - DNA, 12 bp, Homo sapiens
ctaaattgaata

SEQ ID NO: 2563863 - DNA, 13 bp, Homo sapiens
ctaaattgaataa

SEQ ID NO: 2563864 - DNA, 14 bp, Homo sapiens
ctaaattgaataat

SEQ ID NO: 2563865 - DNA, 23 bp, Homo sapiens
ctaaattgacacttaaaaatggt

SEQ ID NO: 2563866 - DNA, 15 bp, Homo sapiens
ctaacaatgacattt

SEQ ID NO: 2563867 - DNA, 13 bp, Homo sapiens
ctaacaccagcgt

SEQ ID NO: 2563868 - DNA, 21 bp, Homo sapiens
ctaacaccagcgtttgagggg

SEQ ID NO: 2563869 - DNA, 17 bp, Homo sapiens
ctaacactggcccctag

SEQ ID NO: 2563870 - DNA, 17 bp, Homo sapiens
ctaacagataagcaaga

SEQ ID NO: 2563871 - DNA, 13 bp, Homo sapiens
ctaaccccaggcc

SEQ ID NO: 2563872 - DNA, 16 bp, Homo sapiens
ctaaccccaggccccg

SEQ ID NO: 2563873 - DNA, 21 bp, Homo sapiens
ctaaccctcagaaacactggg

SEQ ID NO: 2563874 - DNA, 20 bp, Homo sapiens
ctaaccctcccatggcacct

SEQ ID NO: 2563875 - DNA, 19 bp, Homo sapiens
ctaacccttatcaccagct

SEQ ID NO: 2563876 - DNA, 11 bp, Homo sapiens
ctaacctgacc

SEQ ID NO: 2563877 - DNA, 16 bp, Homo sapiens
ctaacttcaccatatt

SEQ ID NO: 2563878 - DNA, 17 bp, Homo sapiens
ctaacttggagccccag

SEQ ID NO: 2563879 - DNA, 20 bp, Homo sapiens
ctaacttggagccccagtgc

SEQ ID NO: 2563880 - DNA, 22 bp, Homo sapiens
ctaacttgtctttggaccctga

SEQ ID NO: 2563881 - DNA, 22 bp, Homo sapiens
ctaagaaaagatacgactttat

SEQ ID NO: 2563882 - DNA, 20 bp, Homo sapiens
ctaagagccatttaggggcc

SEQ ID NO: 2563883 - DNA, 13 bp, Homo sapiens
ctaagagctcccg

SEQ ID NO: 2563884 - DNA, 15 bp, Homo sapiens
ctaagcaaaatgtga

SEQ ID NO: 2563885 - DNA, 18 bp, Homo sapiens
ctaagcaaaatgtgatat

SEQ ID NO: 2563886 - DNA, 21 bp, Homo sapiens
ctaagcatagcaaacagagga

SEQ ID NO: 2563887 - DNA, 16 bp, Homo sapiens
ctaagcctacctgctc

SEQ ID NO: 2563888 - DNA, 23 bp, Homo sapiens
ctaagcctacctgctctccaagt

SEQ ID NO: 2563889 - DNA, 22 bp, Homo sapiens
ctaagcggaccagcctccctgt

SEQ ID NO: 2563890 - DNA, 15 bp, Homo sapiens
ctaagctaaccccct

SEQ ID NO: 2563891 - DNA, 21 bp, Homo sapiens
ctaagctattcagtaataact

SEQ ID NO: 2563892 - DNA, 22 bp, Homo sapiens
ctaagctttgccagctgctgct

SEQ ID NO: 2563893 - DNA, 14 bp, Homo sapiens
ctaaggacacacta

SEQ ID NO: 2563894 - DNA, 16 bp, Homo sapiens
ctaaggacatttccca

SEQ ID NO: 2563895 - DNA, 15 bp, Homo sapiens
ctaaggatctctcag

SEQ ID NO: 2563896 - DNA, 17 bp, Homo sapiens
ctaaggatctctcagga

SEQ ID NO: 2563897 - DNA, 23 bp, Homo sapiens
ctaaggatctctcaggagcacag

SEQ ID NO: 2563898 - DNA, 20 bp, Homo sapiens
ctaaggatgtcacagggcca

SEQ ID NO: 2563899 - DNA, 16 bp, Homo sapiens
ctaaggcgtggagctg

SEQ ID NO: 2563900 - DNA, 18 bp, Homo sapiens
ctaagggtgtaagtaatt

SEQ ID NO: 2563901 - DNA, 19 bp, Homo sapiens
ctaaggtcattaccacagg

SEQ ID NO: 2563902 - DNA, 15 bp, Homo sapiens
ctaaggtgtgctctg

SEQ ID NO: 2563903 - DNA, 16 bp, Homo sapiens
ctaaggtgtgctctga

SEQ ID NO: 2563904 - DNA, 19 bp, Homo sapiens
ctaagtaaaaccacagcag

SEQ ID NO: 2563905 - DNA, 14 bp, Homo sapiens
ctaagtctttccat

SEQ ID NO: 2563906 - DNA, 20 bp, Homo sapiens
ctaagtgatcctcccacctc

SEQ ID NO: 2563907 - DNA, 17 bp, Homo sapiens
ctaatagacaatttatt

SEQ ID NO: 2563908 - DNA, 21 bp, Homo sapiens
ctaatatatttttatatttag

SEQ ID NO: 2563909 - DNA, 13 bp, Homo sapiens
ctaatatggcaaa

SEQ ID NO: 2563910 - DNA, 14 bp, Homo sapiens
ctaatattaaaaat

SEQ ID NO: 2563911 - DNA, 20 bp, Homo sapiens
cggcgtcagcctccagcctc

SEQ ID NO: 2563912 - DNA, 23 bp, Homo sapiens
cggcgtcagcctccagcctctgt

SEQ ID NO: 2563913 - DNA, 19 bp, Homo sapiens
cggctcactgcagcctcaa

SEQ ID NO: 2563914 - DNA, 14 bp, Homo sapiens
cggctccaggctcc

SEQ ID NO: 2563915 - DNA, 13 bp, Homo sapiens
cggctcctgtgct

SEQ ID NO: 2563916 - DNA, 14 bp, Homo sapiens
cggctcctgtgctt

SEQ ID NO: 2563917 - DNA, 23 bp, Homo sapiens
cggctcctgtgctttccctgaac

SEQ ID NO: 2563918 - DNA, 11 bp, Homo sapiens
cggctgagagc

SEQ ID NO: 2563919 - DNA, 15 bp, Homo sapiens
cggctgagagcccca

SEQ ID NO: 2563920 - DNA, 19 bp, Homo sapiens
cggctgagagccccagctg

SEQ ID NO: 2563921 - DNA, 11 bp, Homo sapiens
cggctgctgag

SEQ ID NO: 2563922 - DNA, 21 bp, Homo sapiens
cggctggagaccatgcagagc

SEQ ID NO: 2563923 - DNA, 18 bp, Homo sapiens
cggctggcctggcccctc

SEQ ID NO: 2563924 - DNA, 17 bp, Homo sapiens
cggctggttttgtaaga

SEQ ID NO: 2563925 - DNA, 22 bp, Homo sapiens
cggctggttttgtaagatgctg

SEQ ID NO: 2563926 - DNA, 20 bp, Homo sapiens
cgggaaagccagtgactcca

SEQ ID NO: 2563927 - DNA, 22 bp, Homo sapiens
cgggaaagccagtgactccagg

SEQ ID NO: 2563928 - DNA, 20 bp, Homo sapiens
cgggaagagaggagttcaat

SEQ ID NO: 2563929 - DNA, 19 bp, Homo sapiens
cgggaagggggctgggaca

SEQ ID NO: 2563930 - DNA, 16 bp, Homo sapiens
cgggaaggtcaccagc

SEQ ID NO: 2563931 - DNA, 15 bp, Homo sapiens
cgggacacctgccct

SEQ ID NO: 2563932 - DNA, 14 bp, Homo sapiens
cgggagcagtgtct

SEQ ID NO: 2563933 - DNA, 20 bp, Homo sapiens
cgggagcagtgtcttccata

SEQ ID NO: 2563934 - DNA, 23 bp, Homo sapiens
cgggagcagtgtcttccataatg

SEQ ID NO: 2563935 - DNA, 13 bp, Homo sapiens
cgggaggctgaga

SEQ ID NO: 2563936 - DNA, 19 bp, Homo sapiens
cgggaggctgagacaggag

SEQ ID NO: 2563937 - DNA, 17 bp, Homo sapiens
cgggaggtcgaggcagg

SEQ ID NO: 2563938 - DNA, 20 bp, Homo sapiens
cgggaggtcgaggcaggagg

SEQ ID NO: 2563939 - DNA, 16 bp, Homo sapiens
cgggatggtcctgggg

SEQ ID NO: 2563940 - DNA, 14 bp, Homo sapiens
cgggccacagagaa

SEQ ID NO: 2563941 - DNA, 23 bp, Homo sapiens
cgggccagccaggcgggctcaag

SEQ ID NO: 2563942 - DNA, 13 bp, Homo sapiens
cgggcccacctgg

SEQ ID NO: 2563943 - DNA, 18 bp, Homo sapiens
cgggcccacctggccacc

SEQ ID NO: 2563944 - DNA, 23 bp, Homo sapiens
cgggcccagcccccacagtgctg

SEQ ID NO: 2563945 - DNA, 18 bp, Homo sapiens
cgggcccgttgaggatga

SEQ ID NO: 2563946 - DNA, 22 bp, Homo sapiens
cgggcccgttgaggatgaggcc

SEQ ID NO: 2563947 - DNA, 21 bp, Homo sapiens
cgggcccttcccacaggacat

SEQ ID NO: 2563948 - DNA, 17 bp, Homo sapiens
cgggcgagtcactgcct

SEQ ID NO: 2563949 - DNA, 13 bp, Homo sapiens
cgggctctgcctc

SEQ ID NO: 2563950 - DNA, 14 bp, Homo sapiens
cgggctgccctgcc

SEQ ID NO: 2563951 - DNA, 16 bp, Homo sapiens
cgggctgggagctctg

SEQ ID NO: 2563952 - DNA, 17 bp, Homo sapiens
cggggacagaggcctgc

SEQ ID NO: 2563953 - DNA, 18 bp, Homo sapiens
cggggacagaggcctgcc

SEQ ID NO: 2563954 - DNA, 21 bp, Homo sapiens
cggggacagaggcctgcccgg

SEQ ID NO: 2563955 - DNA, 22 bp, Homo sapiens
cggggacagctccttctgtcct

SEQ ID NO: 2563956 - DNA, 23 bp, Homo sapiens
cggggacagctccttctgtccta

SEQ ID NO: 2563957 - DNA, 19 bp, Homo sapiens
cggggagtttctttcctgc

SEQ ID NO: 2563958 - DNA, 14 bp, Homo sapiens
cggggccccagggc

SEQ ID NO: 2563959 - DNA, 13 bp, Homo sapiens
cgggggcagctga

SEQ ID NO: 2563960 - DNA, 13 bp, Homo sapiens
cgggggctggcct

SEQ ID NO: 2563961 - DNA, 15 bp, Homo sapiens
cgggggctggcctag

SEQ ID NO: 2563962 - DNA, 23 bp, Homo sapiens
cggggggccccagtcagcctctc

SEQ ID NO: 2563963 - DNA, 23 bp, Homo sapiens
cgggtgggggtggaataaaatac

SEQ ID NO: 2563964 - DNA, 16 bp, Homo sapiens
cgggttgtgtgtctgt

SEQ ID NO: 2563965 - DNA, 17 bp, Homo sapiens
cgggttgtgtgtctgtt

SEQ ID NO: 2563966 - DNA, 15 bp, Homo sapiens
cggtccacccaggag

SEQ ID NO: 2563967 - DNA, 20 bp, Homo sapiens
cggtccacccaggagccccg

SEQ ID NO: 2563968 - DNA, 14 bp, Homo sapiens
cggtcccacactgg

SEQ ID NO: 2563969 - DNA, 21 bp, Homo sapiens
cggtgctatctcccccagccc

SEQ ID NO: 2563970 - DNA, 22 bp, Homo sapiens
cggtgctatctcccccagcccc

SEQ ID NO: 2563971 - DNA, 23 bp, Homo sapiens
cggtgctatctcccccagcccca

SEQ ID NO: 2563972 - DNA, 11 bp, Homo sapiens
cggtggcctct

SEQ ID NO: 2563973 - DNA, 20 bp, Homo sapiens
cggtggctgacacctgtaat

SEQ ID NO: 2563974 - DNA, 23 bp, Homo sapiens
cggtgggcacccaccctgggacc

SEQ ID NO: 2563975 - DNA, 19 bp, Homo sapiens
cggtgggccttgtcccctg

SEQ ID NO: 2563976 - DNA, 16 bp, Homo sapiens
cggtgtgggctgtgtc

SEQ ID NO: 2563977 - DNA, 13 bp, Homo sapiens
cggttcaccagcc

SEQ ID NO: 2563978 - DNA, 14 bp, Homo sapiens
cggttcaccagcct

SEQ ID NO: 2563979 - DNA, 16 bp, Homo sapiens
cggttcaccagcctct

SEQ ID NO: 2563980 - DNA, 16 bp, Homo sapiens
cgtaaagctagaaatg

SEQ ID NO: 2563981 - DNA, 20 bp, Homo sapiens
cgtaaatacacaacacacac

SEQ ID NO: 2563982 - DNA, 13 bp, Homo sapiens
cgtaaccagccag

SEQ ID NO: 2563983 - DNA, 19 bp, Homo sapiens
cgtaacccaactctcctgg

SEQ ID NO: 2563984 - DNA, 22 bp, Homo sapiens
cgtacagttcttcgggaagaga

SEQ ID NO: 2563985 - DNA, 14 bp, Homo sapiens
cgtacatgtgaggc

SEQ ID NO: 2563986 - DNA, 22 bp, Homo sapiens
cgtacttagcagctatctctca

SEQ ID NO: 2563987 - DNA, 16 bp, Homo sapiens
cgtagccagctgctcc

SEQ ID NO: 2563988 - DNA, 19 bp, Homo sapiens
cgtagccagctgctcccca

SEQ ID NO: 2563989 - DNA, 22 bp, Homo sapiens
cgtagcttctaccatgaacaga

SEQ ID NO: 2563990 - DNA, 12 bp, Homo sapiens
cgtatagctgta

SEQ ID NO: 2563991 - DNA, 16 bp, Homo sapiens
cgtatagctgtattga

SEQ ID NO: 2563992 - DNA, 20 bp, Homo sapiens
cgtatgtctgttaccatgtc

SEQ ID NO: 2563993 - DNA, 14 bp, Homo sapiens
cgtcaccacctctc

SEQ ID NO: 2563994 - DNA, 16 bp, Homo sapiens
cgtcaccatctcaggc

SEQ ID NO: 2563995 - DNA, 12 bp, Homo sapiens
cgtcagcctcca

SEQ ID NO: 2563996 - DNA, 13 bp, Homo sapiens
cgtcagcctccag

SEQ ID NO: 2563997 - DNA, 16 bp, Homo sapiens
cgtcagcctccagcct

SEQ ID NO: 2563998 - DNA, 19 bp, Homo sapiens
cgtcatggcttaatgttta

SEQ ID NO: 2563999 - DNA, 16 bp, Homo sapiens
cgtccacggctctagg

SEQ ID NO: 2564000 - DNA, 15 bp, Homo sapiens
cgtccgccctgctcc

SEQ ID NO: 2564001 - DNA, 22 bp, Homo sapiens
cgtccgccctgctcctccctgg

SEQ ID NO: 2564002 - DNA, 14 bp, Homo sapiens
cgtcctcccgggcc

SEQ ID NO: 2564003 - DNA, 18 bp, Homo sapiens
cgtcctcccgggccctcc

SEQ ID NO: 2564004 - DNA, 13 bp, Homo sapiens
cgtcctcctctgt

SEQ ID NO: 2564005 - DNA, 15 bp, Homo sapiens
cgtcctcctctgtga

SEQ ID NO: 2564006 - DNA, 13 bp, Homo sapiens
cgtcgcacagtct

SEQ ID NO: 2564007 - DNA, 16 bp, Homo sapiens
cgtcgcacagtctctc

SEQ ID NO: 2564008 - DNA, 15 bp, Homo sapiens
cctttctttttcttc

SEQ ID NO: 2564009 - DNA, 17 bp, Homo sapiens
cctttctttttcttctt

SEQ ID NO: 2564010 - DNA, 15 bp, Homo sapiens
cctttgacctgcctc

SEQ ID NO: 2564011 - DNA, 22 bp, Homo sapiens
cctttgacgccatcccagcccc

SEQ ID NO: 2564012 - DNA, 13 bp, Homo sapiens
cctttgagacagt

SEQ ID NO: 2564013 - DNA, 17 bp, Homo sapiens
cctttgagacagtttct

SEQ ID NO: 2564014 - DNA, 19 bp, Homo sapiens
cctttgagacagtttctta

SEQ ID NO: 2564015 - DNA, 19 bp, Homo sapiens
cctttgagtgcagtcctga

SEQ ID NO: 2564016 - DNA, 22 bp, Homo sapiens
cctttgagtgcagtcctgatca

SEQ ID NO: 2564017 - DNA, 16 bp, Homo sapiens
cctttgcactgagggc

SEQ ID NO: 2564018 - DNA, 13 bp, Homo sapiens
cctttgcaggcat

SEQ ID NO: 2564019 - DNA, 15 bp, Homo sapiens
cctttggccattcca

SEQ ID NO: 2564020 - DNA, 14 bp, Homo sapiens
cctttgggcccagg

SEQ ID NO: 2564021 - DNA, 16 bp, Homo sapiens
cctttgggcccaggga

SEQ ID NO: 2564022 - DNA, 19 bp, Homo sapiens
cctttgtatattatttcta

SEQ ID NO: 2564023 - DNA, 22 bp, Homo sapiens
cctttgtattctctcctgtacc

SEQ ID NO: 2564024 - DNA, 23 bp, Homo sapiens
cctttgtattctctcctgtacct

SEQ ID NO: 2564025 - DNA, 16 bp, Homo sapiens
cctttgtccccaccgc

SEQ ID NO: 2564026 - DNA, 18 bp, Homo sapiens
cctttgtccccaccgcag

SEQ ID NO: 2564027 - DNA, 14 bp, Homo sapiens
cctttgtcttgtca

SEQ ID NO: 2564028 - DNA, 17 bp, Homo sapiens
cctttgtgaggaagccg

SEQ ID NO: 2564029 - DNA, 13 bp, Homo sapiens
cctttgtgtttct

SEQ ID NO: 2564030 - DNA, 23 bp, Homo sapiens
cctttgttttgatgtttgtggcc

SEQ ID NO: 2564031 - DNA, 21 bp, Homo sapiens
ccttttagcctagttcatcca

SEQ ID NO: 2564032 - DNA, 16 bp, Homo sapiens
ccttttatagctatta

SEQ ID NO: 2564033 - DNA, 15 bp, Homo sapiens
ccttttatgttattt

SEQ ID NO: 2564034 - DNA, 21 bp, Homo sapiens
ccttttccatttgaaagaaag

SEQ ID NO: 2564035 - DNA, 22 bp, Homo sapiens
ccttttctagcccgaatacaaa

SEQ ID NO: 2564036 - DNA, 22 bp, Homo sapiens
ccttttctgcattttgctattg

SEQ ID NO: 2564037 - DNA, 18 bp, Homo sapiens
ccttttcttttctaccct

SEQ ID NO: 2564038 - DNA, 21 bp, Homo sapiens
ccttttgaaattaacctctca

SEQ ID NO: 2564039 - DNA, 12 bp, Homo sapiens
ccttttggcccc

SEQ ID NO: 2564040 - DNA, 14 bp, Homo sapiens
cctttttactcccc

SEQ ID NO: 2564041 - DNA, 18 bp, Homo sapiens
cctttttatttgcatgtg

SEQ ID NO: 2564042 - DNA, 13 bp, Homo sapiens
cctttttccttgt

SEQ ID NO: 2564043 - DNA, 14 bp, Homo sapiens
cctttttccttgtc

SEQ ID NO: 2564044 - DNA, 16 bp, Homo sapiens
cctttttctccagctg

SEQ ID NO: 2564045 - DNA, 18 bp, Homo sapiens
cctttttctccctctgga

SEQ ID NO: 2564046 - DNA, 16 bp, Homo sapiens
cctttttctttataaa

SEQ ID NO: 2564047 - DNA, 13 bp, Homo sapiens
ccttttttaaaaa

SEQ ID NO: 2564048 - DNA, 23 bp, Homo sapiens
ccttttttgataaagtttctcag

SEQ ID NO: 2564049 - DNA, 22 bp, Homo sapiens
ccttttttggctgctgaaggct

SEQ ID NO: 2564050 - DNA, 21 bp, Homo sapiens
cgaaaaatcctcttcctctga

SEQ ID NO: 2564051 - DNA, 13 bp, Homo sapiens
cgaaaaccaggcc

SEQ ID NO: 2564052 - DNA, 21 bp, Homo sapiens
cgaaagaacagtccattgaaa

SEQ ID NO: 2564053 - DNA, 17 bp, Homo sapiens
cgaaataacaatgttaa

SEQ ID NO: 2564054 - DNA, 14 bp, Homo sapiens
cgaaatgttatttt

SEQ ID NO: 2564055 - DNA, 20 bp, Homo sapiens
cgaacatggaactcattcct

SEQ ID NO: 2564056 - DNA, 22 bp, Homo sapiens
cgaacatggaactcattcctgc

SEQ ID NO: 2564057 - DNA, 16 bp, Homo sapiens
cgaacgacaatagctt

SEQ ID NO: 2564058 - DNA, 14 bp, Homo sapiens
cgaactggctgcaa

SEQ ID NO: 2564059 - DNA, 16 bp, Homo sapiens
cgaactgttgtataaa

SEQ ID NO: 2564060 - DNA, 13 bp, Homo sapiens
cgaagacacagac

SEQ ID NO: 2564061 - DNA, 14 bp, Homo sapiens
cgaagcccaggccc

SEQ ID NO: 2564062 - DNA, 15 bp, Homo sapiens
cgaagctcagcccac

SEQ ID NO: 2564063 - DNA, 16 bp, Homo sapiens
cgaagctcagcccacc

SEQ ID NO: 2564064 - DNA, 19 bp, Homo sapiens
cgaagtggactggcccctg

SEQ ID NO: 2564065 - DNA, 14 bp, Homo sapiens
cgaatcatttgttc

SEQ ID NO: 2564066 - DNA, 14 bp, Homo sapiens
cgaattaatagctt

SEQ ID NO: 2564067 - DNA, 15 bp, Homo sapiens
cgacaaccgatgctc

SEQ ID NO: 2564068 - DNA, 16 bp, Homo sapiens
cgacagagcgagactt

SEQ ID NO: 2564069 - DNA, 21 bp, Homo sapiens
cgaccacccctgcctccaccc

SEQ ID NO: 2564070 - DNA, 19 bp, Homo sapiens
cgacccttgccgtctacct

SEQ ID NO: 2564071 - DNA, 19 bp, Homo sapiens
cgaccgaggctggagctgg

SEQ ID NO: 2564072 - DNA, 14 bp, Homo sapiens
cgacctcagccttc

SEQ ID NO: 2564073 - DNA, 12 bp, Homo sapiens
cgacctttacct

SEQ ID NO: 2564074 - DNA, 13 bp, Homo sapiens
cgactctgacctc

SEQ ID NO: 2564075 - DNA, 16 bp, Homo sapiens
cgactgcacagcggcc

SEQ ID NO: 2564076 - DNA, 17 bp, Homo sapiens
cgactgtgacctgtggg

SEQ ID NO: 2564077 - DNA, 19 bp, Homo sapiens
cgactgtgacctgtgggga

SEQ ID NO: 2564078 - DNA, 16 bp, Homo sapiens
cgacttgcatttttgc

SEQ ID NO: 2564079 - DNA, 20 bp, Homo sapiens
cgagaagctgctctggaatt

SEQ ID NO: 2564080 - DNA, 14 bp, Homo sapiens
cgagacacttgcct

SEQ ID NO: 2564081 - DNA, 21 bp, Homo sapiens
cgagagacttgtggcctggga

SEQ ID NO: 2564082 - DNA, 15 bp, Homo sapiens
cgagagtctgtctca

SEQ ID NO: 2564083 - DNA, 17 bp, Homo sapiens
cgagcagtcctgcctca

SEQ ID NO: 2564084 - DNA, 23 bp, Homo sapiens
cgagcagtcctgcctcagcctcc

SEQ ID NO: 2564085 - DNA, 13 bp, Homo sapiens
cgagcatgcctgg

SEQ ID NO: 2564086 - DNA, 18 bp, Homo sapiens
cgagcatgcctggatggg

SEQ ID NO: 2564087 - DNA, 18 bp, Homo sapiens
cctgaggtgggcccagga

SEQ ID NO: 2564088 - DNA, 19 bp, Homo sapiens
cctgaggtgggcccaggac

SEQ ID NO: 2564089 - DNA, 23 bp, Homo sapiens
cctgaggtgggcccaggaccagc

SEQ ID NO: 2564090 - DNA, 22 bp, Homo sapiens
cctgaggtgtgggggctgcagc

SEQ ID NO: 2564091 - DNA, 23 bp, Homo sapiens
cctgaggtgtgggggctgcagca

SEQ ID NO: 2564092 - DNA, 23 bp, Homo sapiens
cctgagtaatcgcttaaagatgt

SEQ ID NO: 2564093 - DNA, 19 bp, Homo sapiens
cctgagtagctggattaca

SEQ ID NO: 2564094 - DNA, 20 bp, Homo sapiens
cctgagtagctggattacag

SEQ ID NO: 2564095 - DNA, 15 bp, Homo sapiens
cctgagtgcctggcc

SEQ ID NO: 2564096 - DNA, 18 bp, Homo sapiens
cctgagtggatctccaag

SEQ ID NO: 2564097 - DNA, 23 bp, Homo sapiens
cctgagtggatctccaaggacca

SEQ ID NO: 2564098 - DNA, 20 bp, Homo sapiens
cctgatatgatttaaaacat

SEQ ID NO: 2564099 - DNA, 13 bp, Homo sapiens
cctgatcagagcc

SEQ ID NO: 2564100 - DNA, 23 bp, Homo sapiens
cctgatcgccaacctttccccca

SEQ ID NO: 2564101 - DNA, 20 bp, Homo sapiens
cctgatgctccctcccctgc

SEQ ID NO: 2564102 - DNA, 23 bp, Homo sapiens
cctgatgctccctcccctgccct

SEQ ID NO: 2564103 - DNA, 22 bp, Homo sapiens
cctgatgcttcttcagagactc

SEQ ID NO: 2564104 - DNA, 21 bp, Homo sapiens
cctgatggcacttagctatca

SEQ ID NO: 2564105 - DNA, 21 bp, Homo sapiens
cctgatggtacaggaaagctc

SEQ ID NO: 2564106 - DNA, 23 bp, Homo sapiens
cctgatggtcagctcccttctct

SEQ ID NO: 2564107 - DNA, 16 bp, Homo sapiens
cctgattcaactaaaa

SEQ ID NO: 2564108 - DNA, 20 bp, Homo sapiens
cctgattgtgtatattcata

SEQ ID NO: 2564109 - DNA, 15 bp, Homo sapiens
cctgattgtgtctct

SEQ ID NO: 2564110 - DNA, 23 bp, Homo sapiens
cctgattgtgtctcttggtcctg

SEQ ID NO: 2564111 - DNA, 22 bp, Homo sapiens
cctgattttttttccttttaat

SEQ ID NO: 2564112 - DNA, 17 bp, Homo sapiens
cctgcaaaaggactctc

SEQ ID NO: 2564113 - DNA, 22 bp, Homo sapiens
cctgcaaaatttgatgccagga

SEQ ID NO: 2564114 - DNA, 16 bp, Homo sapiens
cctgcaaactcactgc

SEQ ID NO: 2564115 - DNA, 17 bp, Homo sapiens
cctgcaagggctcccca

SEQ ID NO: 2564116 - DNA, 20 bp, Homo sapiens
cctgcaagggctccccactg

SEQ ID NO: 2564117 - DNA, 19 bp, Homo sapiens
cctgcaatgaagtctctga

SEQ ID NO: 2564118 - DNA, 20 bp, Homo sapiens
cctgcacaaagcccttccat

SEQ ID NO: 2564119 - DNA, 20 bp, Homo sapiens
cctgcacggtgggccttgct

SEQ ID NO: 2564120 - DNA, 22 bp, Homo sapiens
cctgcacggtgggccttgctgg

SEQ ID NO: 2564121 - DNA, 15 bp, Homo sapiens
cctgcactggagtcc

SEQ ID NO: 2564122 - DNA, 21 bp, Homo sapiens
cctgcactggggagcccgtct

SEQ ID NO: 2564123 - DNA, 13 bp, Homo sapiens
cctgcagagagaa

SEQ ID NO: 2564124 - DNA, 15 bp, Homo sapiens
cctgcagagagaagc

SEQ ID NO: 2564125 - DNA, 18 bp, Homo sapiens
cctggcccctcagggtcc

SEQ ID NO: 2564126 - DNA, 20 bp, Homo sapiens
cctggcccctcagggtccct

SEQ ID NO: 2564127 - DNA, 14 bp, Homo sapiens
cctggccgccccct

SEQ ID NO: 2564128 - DNA, 15 bp, Homo sapiens
cctggccgccccctg

SEQ ID NO: 2564129 - DNA, 21 bp, Homo sapiens
cctggccggcaaccccagttc

SEQ ID NO: 2564130 - DNA, 23 bp, Homo sapiens
cctggccggcaaccccagttctg

SEQ ID NO: 2564131 - DNA, 21 bp, Homo sapiens
cctggcctccggcgtcagcct

SEQ ID NO: 2564132 - DNA, 21 bp, Homo sapiens
cctggcctctgcactcccctg

SEQ ID NO: 2564133 - DNA, 13 bp, Homo sapiens
cctggcctgagct

SEQ ID NO: 2564134 - DNA, 14 bp, Homo sapiens
cctggcctgagctg

SEQ ID NO: 2564135 - DNA, 12 bp, Homo sapiens
cctggcctggca

SEQ ID NO: 2564136 - DNA, 16 bp, Homo sapiens
cctggcctggcacaca

SEQ ID NO: 2564137 - DNA, 19 bp, Homo sapiens
cctggcctggcacacatca

SEQ ID NO: 2564138 - DNA, 15 bp, Homo sapiens
cctggcctggcttct

SEQ ID NO: 2564139 - DNA, 14 bp, Homo sapiens
cctggcctgtgcct

SEQ ID NO: 2564140 - DNA, 13 bp, Homo sapiens
cctggcctgttct

SEQ ID NO: 2564141 - DNA, 19 bp, Homo sapiens
cctggcctgttctgttttg

SEQ ID NO: 2564142 - DNA, 14 bp, Homo sapiens
cctggcctttcata

SEQ ID NO: 2564143 - DNA, 16 bp, Homo sapiens
cctggctcagagccag

SEQ ID NO: 2564144 - DNA, 20 bp, Homo sapiens
cctggctccaaaccctcgag

SEQ ID NO: 2564145 - DNA, 21 bp, Homo sapiens
cctggctcccatgaccatact

SEQ ID NO: 2564146 - DNA, 20 bp, Homo sapiens
cctggctctgaccgaaacag

SEQ ID NO: 2564147 - DNA, 22 bp, Homo sapiens
cctggctctgcaatgggcactg

SEQ ID NO: 2564148 - DNA, 23 bp, Homo sapiens
cctggctgaccccaaagagcctg

SEQ ID NO: 2564149 - DNA, 12 bp, Homo sapiens
cctggctgccct

SEQ ID NO: 2564150 - DNA, 14 bp, Homo sapiens
cctggctgccctgg

SEQ ID NO: 2564151 - DNA, 13 bp, Homo sapiens
cctggcttctgga

SEQ ID NO: 2564152 - DNA, 14 bp, Homo sapiens
cctggcttctggag

SEQ ID NO: 2564153 - DNA, 21 bp, Homo sapiens
cctggcttctggagcccttgg

SEQ ID NO: 2564154 - DNA, 18 bp, Homo sapiens
cctgggaaatattcccta

SEQ ID NO: 2564155 - DNA, 17 bp, Homo sapiens
cctgggagaacctcagg

SEQ ID NO: 2564156 - DNA, 19 bp, Homo sapiens
cctgggagaacctcaggct

SEQ ID NO: 2564157 - DNA, 16 bp, Homo sapiens
cctgggaggcggagag

SEQ ID NO: 2564158 - DNA, 20 bp, Homo sapiens
cctgggatccctcatcctca

SEQ ID NO: 2564159 - DNA, 15 bp, Homo sapiens
cctgggatctgctcg

SEQ ID NO: 2564160 - DNA, 22 bp, Homo sapiens
cctgggatgtccacagatgcct

SEQ ID NO: 2564161 - DNA, 21 bp, Homo sapiens
cctgggcaaatgaatggctca

SEQ ID NO: 2564162 - DNA, 17 bp, Homo sapiens
cctgggcagccaggctg

SEQ ID NO: 2564163 - DNA, 18 bp, Homo sapiens
cctgggcagccaggctgc

SEQ ID NO: 2564164 - DNA, 22 bp, Homo sapiens
cctgggcatatccaccacctcc

SEQ ID NO: 2564165 - DNA, 23 bp, Homo sapiens
cctgggcatatccaccacctccc

SEQ ID NO: 2564166 - DNA, 22 bp, Homo sapiens
cctgggcccctcatctgctcag

SEQ ID NO: 2564167 - DNA, 15 bp, Homo sapiens
cctgggccctctctg

SEQ ID NO: 2564168 - DNA, 18 bp, Homo sapiens
cctgggccctctctgctc

SEQ ID NO: 2564169 - DNA, 12 bp, Homo sapiens
cctgggcgccct

SEQ ID NO: 2564170 - DNA, 15 bp, Homo sapiens
cctgggcgccctgga

SEQ ID NO: 2564171 - DNA, 19 bp, Homo sapiens
cctgggcgccctggaagcc

SEQ ID NO: 2564172 - DNA, 15 bp, Homo sapiens
cctgggctacaagga

SEQ ID NO: 2564173 - DNA, 16 bp, Homo sapiens
cctgggctcggaggct

SEQ ID NO: 2564174 - DNA, 18 bp, Homo sapiens
cctgggctcggaggctgc

SEQ ID NO: 2564175 - DNA, 12 bp, Homo sapiens
cctgggctctgc

SEQ ID NO: 2564176 - DNA, 24 bp, Homo sapiens
cctgggctctgccccagctctggc

SEQ ID NO: 2564177 - DNA, 16 bp, Homo sapiens
cctgggctctgggagc

SEQ ID NO: 2564178 - DNA, 17 bp, Homo sapiens
cctgggctctgggagca

SEQ ID NO: 2564179 - DNA, 17 bp, Homo sapiens
cctggggcctggacctg

SEQ ID NO: 2564180 - DNA, 19 bp, Homo sapiens
cctggggcctggacctgcc

SEQ ID NO: 2564181 - DNA, 22 bp, Homo sapiens
cctggggctaggctggagccca

SEQ ID NO: 2564182 - DNA, 15 bp, Homo sapiens
cctggggctcctttc

SEQ ID NO: 2564183 - DNA, 21 bp, Homo sapiens
cctggggctcctttctccagc

SEQ ID NO: 2564184 - DNA, 14 bp, Homo sapiens
cctggggctgctgg

SEQ ID NO: 2564185 - DNA, 19 bp, Homo sapiens
cctgggggcagggagagga

SEQ ID NO: 2564186 - DNA, 22 bp, Homo sapiens
cctgggggttctttcttcctct

SEQ ID NO: 2564187 - DNA, 23 bp, Homo sapiens
cctgggggttctttcttcctctg

SEQ ID NO: 2564188 - DNA, 15 bp, Homo sapiens
cctgggtcagtctgg

SEQ ID NO: 2564189 - DNA, 19 bp, Homo sapiens
cctgggtcagtctggtggg

SEQ ID NO: 2564190 - DNA, 14 bp, Homo sapiens
cctgggtctgtgtc

SEQ ID NO: 2564191 - DNA, 19 bp, Homo sapiens
cctgggtgggtggtgggga

SEQ ID NO: 2564192 - DNA, 21 bp, Homo sapiens
cctgggtgggtggtggggagg

SEQ ID NO: 2564193 - DNA, 21 bp, Homo sapiens
cctgggtggtctgcaggcagg

SEQ ID NO: 2564194 - DNA, 22 bp, Homo sapiens
cctgggttcagaaatgctgcct

SEQ ID NO: 2564195 - DNA, 23 bp, Homo sapiens
cctgggttcagaaatgctgcctg

SEQ ID NO: 2564196 - DNA, 19 bp, Homo sapiens
cctgggttttgtattctct

SEQ ID NO: 2564197 - DNA, 20 bp, Homo sapiens
cctgggttttgtattctctg

SEQ ID NO: 2564198 - DNA, 14 bp, Homo sapiens
cctggtacccagcc

SEQ ID NO: 2564199 - DNA, 17 bp, Homo sapiens
cctggtaccctcctggc

SEQ ID NO: 2564200 - DNA, 16 bp, Homo sapiens
cctggtactcaagccc

SEQ ID NO: 2564201 - DNA, 17 bp, Homo sapiens
cctggtagaatagatat

SEQ ID NO: 2564202 - DNA, 21 bp, Homo sapiens
cctggtcacaggactctgcct

SEQ ID NO: 2564203 - DNA, 14 bp, Homo sapiens
cctggtccctggga

SEQ ID NO: 2564204 - DNA, 16 bp, Homo sapiens
cctggtcttgagatgt

SEQ ID NO: 2564205 - DNA, 15 bp, Homo sapiens
cctggtgctgcctct

SEQ ID NO: 2564206 - DNA, 13 bp, Homo sapiens
cctggtgctgctg

SEQ ID NO: 2564207 - DNA, 12 bp, Homo sapiens
cctggtggacag

SEQ ID NO: 2564208 - DNA, 17 bp, Homo sapiens
cctggtggcagctcacc

SEQ ID NO: 2564209 - DNA, 19 bp, Homo sapiens
cctggtggcagctcacctc

SEQ ID NO: 2564210 - DNA, 22 bp, Homo sapiens
cctggtggcagctcacctctcc

SEQ ID NO: 2564211 - DNA, 17 bp, Homo sapiens
cctggtggcagctgcgg

SEQ ID NO: 2564212 - DNA, 13 bp, Homo sapiens
cctggtggcagtg

SEQ ID NO: 2564213 - DNA, 18 bp, Homo sapiens
cctggtggcagtgggagc

SEQ ID NO: 2564214 - DNA, 21 bp, Homo sapiens
cctggtggcagtgggagctgc

SEQ ID NO: 2564215 - DNA, 18 bp, Homo sapiens
cctggtgggcctcctctg

SEQ ID NO: 2564216 - DNA, 18 bp, Homo sapiens
ccttcagggtgatgccag

SEQ ID NO: 2564217 - DNA, 18 bp, Homo sapiens
ccttcagttatgattttt

SEQ ID NO: 2564218 - DNA, 17 bp, Homo sapiens
ccttcatctccagggag

SEQ ID NO: 2564219 - DNA, 12 bp, Homo sapiens
ccttcatgcatg

SEQ ID NO: 2564220 - DNA, 15 bp, Homo sapiens
ccttcatgcatggaa

SEQ ID NO: 2564221 - DNA, 21 bp, Homo sapiens
ccttcattaccttttttgata

SEQ ID NO: 2564222 - DNA, 18 bp, Homo sapiens
ccttcatttcaggaggga

SEQ ID NO: 2564223 - DNA, 15 bp, Homo sapiens
ccttccacaccccca

SEQ ID NO: 2564224 - DNA, 18 bp, Homo sapiens
ccttccacgctgtctcca

SEQ ID NO: 2564225 - DNA, 19 bp, Homo sapiens
ccttccacgctgtctccag

SEQ ID NO: 2564226 - DNA, 13 bp, Homo sapiens
ccttccaggcccc

SEQ ID NO: 2564227 - DNA, 13 bp, Homo sapiens
ccttccaggggtg

SEQ ID NO: 2564228 - DNA, 11 bp, Homo sapiens
ccttccataat

SEQ ID NO: 2564229 - DNA, 23 bp, Homo sapiens
ccttccatagcctaatccctggg

SEQ ID NO: 2564230 - DNA, 15 bp, Homo sapiens
ccttccatcccagag

SEQ ID NO: 2564231 - DNA, 19 bp, Homo sapiens
ccttccatccctaccccct

SEQ ID NO: 2564232 - DNA, 19 bp, Homo sapiens
ccttccatgtcgcctctgc

SEQ ID NO: 2564233 - DNA, 23 bp, Homo sapiens
ccttccatgtcgcctctgcattc

SEQ ID NO: 2564234 - DNA, 16 bp, Homo sapiens
ccttcccaaaggactc

SEQ ID NO: 2564235 - DNA, 21 bp, Homo sapiens
ccttcccaaaggactccaccc

SEQ ID NO: 2564236 - DNA, 14 bp, Homo sapiens
ccttcccacctctc

SEQ ID NO: 2564237 - DNA, 19 bp, Homo sapiens
ccttcccacctctctcact

SEQ ID NO: 2564238 - DNA, 15 bp, Homo sapiens
ccttcccactcaccc

SEQ ID NO: 2564239 - DNA, 18 bp, Homo sapiens
ccttcccatgacccaggc

SEQ ID NO: 2564240 - DNA, 15 bp, Homo sapiens
ccttccccagcctct

SEQ ID NO: 2564241 - DNA, 20 bp, Homo sapiens
ccttccccctcccagggcca

SEQ ID NO: 2564242 - DNA, 16 bp, Homo sapiens
ccttcccctccttctc

SEQ ID NO: 2564243 - DNA, 18 bp, Homo sapiens
ccttccccttgcccaggg

SEQ ID NO: 2564244 - DNA, 22 bp, Homo sapiens
ccttccccttgcccagggctca

SEQ ID NO: 2564245 - DNA, 19 bp, Homo sapiens
ccttccgtaacccaactct

SEQ ID NO: 2564246 - DNA, 15 bp, Homo sapiens
ccttcctctgcagct

SEQ ID NO: 2564247 - DNA, 16 bp, Homo sapiens
ccttcctctgcagctg

SEQ ID NO: 2564248 - DNA, 14 bp, Homo sapiens
ccttcctgccacca

SEQ ID NO: 2564249 - DNA, 20 bp, Homo sapiens
ccttcctggagactgcccag

SEQ ID NO: 2564250 - DNA, 19 bp, Homo sapiens
ccttcctgtcccacctctt

SEQ ID NO: 2564251 - DNA, 23 bp, Homo sapiens
ccttccttgaccagcagatccca

SEQ ID NO: 2564252 - DNA, 20 bp, Homo sapiens
ccttcgcggtggaaggcccg

SEQ ID NO: 2564253 - DNA, 14 bp, Homo sapiens
ccttctacctgcca

SEQ ID NO: 2564254 - DNA, 15 bp, Homo sapiens
ccttctacctgccac

SEQ ID NO: 2564255 - DNA, 16 bp, Homo sapiens
ccttctacctgccact

SEQ ID NO: 2564256 - DNA, 18 bp, Homo sapiens
ccttctacctgccactca

SEQ ID NO: 2564257 - DNA, 13 bp, Homo sapiens
ccttctcatcact

SEQ ID NO: 2564258 - DNA, 17 bp, Homo sapiens
ccttctcatcactcccc

SEQ ID NO: 2564259 - DNA, 11 bp, Homo sapiens
ccttctccatc

SEQ ID NO: 2564260 - DNA, 17 bp, Homo sapiens
ccttctccatctctctg

SEQ ID NO: 2564261 - DNA, 21 bp, Homo sapiens
ccttctccatctctctggccc

SEQ ID NO: 2564262 - DNA, 14 bp, Homo sapiens
ccttctcccatgag

SEQ ID NO: 2564263 - DNA, 15 bp, Homo sapiens
ccttctccttcacct

SEQ ID NO: 2564264 - DNA, 19 bp, Homo sapiens
ccttctccttcacctttgt

SEQ ID NO: 2564265 - DNA, 14 bp, Homo sapiens
ccttctctgaagga

SEQ ID NO: 2564266 - DNA, 20 bp, Homo sapiens
ccttctctgctccaccacat

SEQ ID NO: 2564267 - DNA, 22 bp, Homo sapiens
ccttctctgctccaccacatcc

SEQ ID NO: 2564268 - DNA, 21 bp, Homo sapiens
ccttctctgtagggaactctg

SEQ ID NO: 2564269 - DNA, 20 bp, Homo sapiens
ccttctgaaaaagtatcctg

SEQ ID NO: 2564270 - DNA, 17 bp, Homo sapiens
ccttctgacccatgctg

SEQ ID NO: 2564271 - DNA, 20 bp, Homo sapiens
ccttctgctggataaaatga

SEQ ID NO: 2564272 - DNA, 21 bp, Homo sapiens
ccttctgctggataaaatgag

SEQ ID NO: 2564273 - DNA, 22 bp, Homo sapiens
ccttctgtaaaggtttttggaa

SEQ ID NO: 2564274 - DNA, 16 bp, Homo sapiens
ccttctgtcctggtgt

SEQ ID NO: 2564275 - DNA, 19 bp, Homo sapiens
ccttctgtcctggtgtcac

SEQ ID NO: 2564276 - DNA, 22 bp, Homo sapiens
ccttctgtcctggtgtcactta

SEQ ID NO: 2564277 - DNA, 18 bp, Homo sapiens
ccttcttctttttgctgt

SEQ ID NO: 2564278 - DNA, 22 bp, Homo sapiens
ccttcttctttttgctgttgtt

SEQ ID NO: 2564279 - DNA, 17 bp, Homo sapiens
ccttctttcctcttccc

SEQ ID NO: 2564280 - DNA, 14 bp, Homo sapiens
ccttctttttcttc

SEQ ID NO: 2564281 - DNA, 20 bp, Homo sapiens
ccttgaacactgggggaggg

SEQ ID NO: 2564282 - DNA, 18 bp, Homo sapiens
ccttgaagaacctctcac

SEQ ID NO: 2564283 - DNA, 13 bp, Homo sapiens
ccttgaagatatc

SEQ ID NO: 2564284 - DNA, 14 bp, Homo sapiens
ccttgacagggcac

SEQ ID NO: 2564285 - DNA, 17 bp, Homo sapiens
ccggcagttctgggtgc

SEQ ID NO: 2564286 - DNA, 14 bp, Homo sapiens
ccggcatggctggg

SEQ ID NO: 2564287 - DNA, 16 bp, Homo sapiens
ccggccacctgcggtg

SEQ ID NO: 2564288 - DNA, 18 bp, Homo sapiens
ccggccacctgcggtgct

SEQ ID NO: 2564289 - DNA, 13 bp, Homo sapiens
ccggccccagcca

SEQ ID NO: 2564290 - DNA, 14 bp, Homo sapiens
ccggccccagccag

SEQ ID NO: 2564291 - DNA, 20 bp, Homo sapiens
ccggccccctggtctctggt

SEQ ID NO: 2564292 - DNA, 19 bp, Homo sapiens
ccggccccggccccagcca

SEQ ID NO: 2564293 - DNA, 13 bp, Homo sapiens
ccggcccctgctg

SEQ ID NO: 2564294 - DNA, 19 bp, Homo sapiens
ccggccctgggctcggagg

SEQ ID NO: 2564295 - DNA, 13 bp, Homo sapiens
ccggccctggggc

SEQ ID NO: 2564296 - DNA, 16 bp, Homo sapiens
ccggcctctctggcct

SEQ ID NO: 2564297 - DNA, 16 bp, Homo sapiens
ccggcctgctcccagc

SEQ ID NO: 2564298 - DNA, 21 bp, Homo sapiens
ccggcgcttgccactagggct

SEQ ID NO: 2564299 - DNA, 13 bp, Homo sapiens
ccggcgtcagcct

SEQ ID NO: 2564300 - DNA, 17 bp, Homo sapiens
ccggcgtcagcctccag

SEQ ID NO: 2564301 - DNA, 22 bp, Homo sapiens
ccggcgtcagcctccagcctct

SEQ ID NO: 2564302 - DNA, 23 bp, Homo sapiens
ccggcgtcagcctccagcctctg

SEQ ID NO: 2564303 - DNA, 13 bp, Homo sapiens
ccggctggcctgg

SEQ ID NO: 2564304 - DNA, 17 bp, Homo sapiens
ccggctggcctggcccc

SEQ ID NO: 2564305 - DNA, 17 bp, Homo sapiens
ccgggaagggggctggg

SEQ ID NO: 2564306 - DNA, 18 bp, Homo sapiens
ccgggaccccgagcctgg

SEQ ID NO: 2564307 - DNA, 15 bp, Homo sapiens
ccgggagctgctgcc

SEQ ID NO: 2564308 - DNA, 22 bp, Homo sapiens
ccgggaggcagaggttgcagtg

SEQ ID NO: 2564309 - DNA, 18 bp, Homo sapiens
ccgggccctcccttggaa

SEQ ID NO: 2564310 - DNA, 15 bp, Homo sapiens
ccgggccctgagtaa

SEQ ID NO: 2564311 - DNA, 15 bp, Homo sapiens
ccgggcgcggccagc

SEQ ID NO: 2564312 - DNA, 17 bp, Homo sapiens
ccgggcgcggccagccc

SEQ ID NO: 2564313 - DNA, 15 bp, Homo sapiens
ccgggctctgcctcc

SEQ ID NO: 2564314 - DNA, 12 bp, Homo sapiens
ccgggctgcctg

SEQ ID NO: 2564315 - DNA, 17 bp, Homo sapiens
ccgggctgcctgggctg

SEQ ID NO: 2564316 - DNA, 18 bp, Homo sapiens
ccgggctgggagctctgc

SEQ ID NO: 2564317 - DNA, 12 bp, Homo sapiens
ccggggtcctgt

SEQ ID NO: 2564318 - DNA, 20 bp, Homo sapiens
ccgggtttggcgggccaagg

SEQ ID NO: 2564319 - DNA, 20 bp, Homo sapiens
ccggtctgcaagtcagagga

SEQ ID NO: 2564320 - DNA, 15 bp, Homo sapiens
ccggtgtgcctgcag

SEQ ID NO: 2564321 - DNA, 20 bp, Homo sapiens
ccggtttcgaagttgatgca

SEQ ID NO: 2564322 - DNA, 21 bp, Homo sapiens
ccggtttcgaagttgatgcaa

SEQ ID NO: 2564323 - DNA, 17 bp, Homo sapiens
ccgtaataattattatt

SEQ ID NO: 2564324 - DNA, 17 bp, Homo sapiens
ccgtaccccaccctcag

SEQ ID NO: 2564325 - DNA, 18 bp, Homo sapiens
ccgtaccccaccctcagc

SEQ ID NO: 2564326 - DNA, 20 bp, Homo sapiens
ccgtaccccaccctcagcac

SEQ ID NO: 2564327 - DNA, 13 bp, Homo sapiens
ccgtcacagcctc

SEQ ID NO: 2564328 - DNA, 17 bp, Homo sapiens
ccgtcagccaaatgtaa

SEQ ID NO: 2564329 - DNA, 16 bp, Homo sapiens
ccgtcatgttcctcaa

SEQ ID NO: 2564330 - DNA, 16 bp, Homo sapiens
ccgtcctcccgggccc

SEQ ID NO: 2564331 - DNA, 22 bp, Homo sapiens
ccgtcgaggggctctcagctca

SEQ ID NO: 2564332 - DNA, 13 bp, Homo sapiens
ccgtctctctccc

SEQ ID NO: 2564333 - DNA, 19 bp, Homo sapiens
ccgtctctctcccatggag

SEQ ID NO: 2564334 - DNA, 22 bp, Homo sapiens
ccgtctctctcccatggagccc

SEQ ID NO: 2564335 - DNA, 13 bp, Homo sapiens
ccgtctgtgaatt

SEQ ID NO: 2564336 - DNA, 15 bp, Homo sapiens
ccgtcttcagcctag

SEQ ID NO: 2564337 - DNA, 20 bp, Homo sapiens
ccgtgacagactcctgagga

SEQ ID NO: 2564338 - DNA, 14 bp, Homo sapiens
ccgtgaggatgtca

SEQ ID NO: 2564339 - DNA, 14 bp, Homo sapiens
ccgtgagttctcag

SEQ ID NO: 2564340 - DNA, 18 bp, Homo sapiens
ccgtgagttctcagggct

SEQ ID NO: 2564341 - DNA, 20 bp, Homo sapiens
ccgtgcttgtttgctcacct

SEQ ID NO: 2564342 - DNA, 16 bp, Homo sapiens
ccgtggaccttcctgc

SEQ ID NO: 2564343 - DNA, 23 bp, Homo sapiens
ccgtggcatcaccttaggcaggg

SEQ ID NO: 2564344 - DNA, 18 bp, Homo sapiens
ccgtgggcggggccttgc

SEQ ID NO: 2564345 - DNA, 16 bp, Homo sapiens
ccgtgtggccccttca

SEQ ID NO: 2564346 - DNA, 21 bp, Homo sapiens
ccgttattataattgtatcag

SEQ ID NO: 2564347 - DNA, 15 bp, Homo sapiens
ccgttctgctggcct

SEQ ID NO: 2564348 - DNA, 22 bp, Homo sapiens
cctaaaaggaaatctcacccca

SEQ ID NO: 2564349 - DNA, 18 bp, Homo sapiens
cctaactcatactgtgct

SEQ ID NO: 2564350 - DNA, 17 bp, Homo sapiens
cctaaggacacactaat

SEQ ID NO: 2564351 - DNA, 17 bp, Homo sapiens
cctaaggatctctcagg

SEQ ID NO: 2564352 - DNA, 19 bp, Homo sapiens
cctaaggatctctcaggag

SEQ ID NO: 2564353 - DNA, 19 bp, Homo sapiens
cctaagggctcaccgtggc

SEQ ID NO: 2564354 - DNA, 18 bp, Homo sapiens
cctaataaacatccttca

SEQ ID NO: 2564355 - DNA, 21 bp, Homo sapiens
cctaataaagttctgtactca

SEQ ID NO: 2564356 - DNA, 17 bp, Homo sapiens
cctaatcaggctgaggt

SEQ ID NO: 2564357 - DNA, 22 bp, Homo sapiens
cctaatccctgggcattgcttt

SEQ ID NO: 2564358 - DNA, 12 bp, Homo sapiens
cctaatgctgca

SEQ ID NO: 2564359 - DNA, 13 bp, Homo sapiens
cctacaccattcc

SEQ ID NO: 2564360 - DNA, 19 bp, Homo sapiens
cctacatgaaacagaaaca

SEQ ID NO: 2564361 - DNA, 18 bp, Homo sapiens
cctacatgctttgtgaac

SEQ ID NO: 2564362 - DNA, 18 bp, Homo sapiens
cctaccaatagattcccc

SEQ ID NO: 2564363 - DNA, 13 bp, Homo sapiens
cctaccaatgcat

SEQ ID NO: 2564364 - DNA, 15 bp, Homo sapiens
cctaccaatgcatgc

SEQ ID NO: 2564365 - DNA, 22 bp, Homo sapiens
cctaccaatgcatgcagccact

SEQ ID NO: 2564366 - DNA, 14 bp, Homo sapiens
cctaccacagtgtc

SEQ ID NO: 2564367 - DNA, 15 bp, Homo sapiens
cctaccacagtgtct

SEQ ID NO: 2564368 - DNA, 13 bp, Homo sapiens
cctaccacccctt

SEQ ID NO: 2564369 - DNA, 13 bp, Homo sapiens
cctaccacctccc

SEQ ID NO: 2564370 - DNA, 19 bp, Homo sapiens
cctaccagcgcccgctggg

SEQ ID NO: 2564371 - DNA, 20 bp, Homo sapiens
cctaccagcgcccgctgggc

SEQ ID NO: 2564372 - DNA, 21 bp, Homo sapiens
cctaccagcgcccgctgggct

SEQ ID NO: 2564373 - DNA, 16 bp, Homo sapiens
cctaccatcagggaca

SEQ ID NO: 2564374 - DNA, 17 bp, Homo sapiens
cctacccacacctctgc

SEQ ID NO: 2564375 - DNA, 20 bp, Homo sapiens
cctacccacacctctgccag

SEQ ID NO: 2564376 - DNA, 18 bp, Homo sapiens
cctaccccaattccttgt

SEQ ID NO: 2564377 - DNA, 11 bp, Homo sapiens
cctaccccaca

SEQ ID NO: 2564378 - DNA, 12 bp, Homo sapiens
cctaccccacac

SEQ ID NO: 2564379 - DNA, 20 bp, Homo sapiens
cctaccccacaccaggccgt

SEQ ID NO: 2564380 - DNA, 23 bp, Homo sapiens
cctaccccacaccaggccgtcct

SEQ ID NO: 2564381 - DNA, 19 bp, Homo sapiens
cctaccctcgggcccacct

SEQ ID NO: 2564382 - DNA, 18 bp, Homo sapiens
cctacctcagcctagacc

SEQ ID NO: 2564383 - DNA, 14 bp, Homo sapiens
cctacctcaggttg

SEQ ID NO: 2564384 - DNA, 12 bp, Homo sapiens
cctacctgctct

SEQ ID NO: 2564385 - DNA, 16 bp, Homo sapiens
cctacctgctctccaa

SEQ ID NO: 2564386 - DNA, 16 bp, Homo sapiens
cctacctgtgcctgac

SEQ ID NO: 2564387 - DNA, 23 bp, Homo sapiens
cctacttctttgctttgcccagc

SEQ ID NO: 2564388 - DNA, 16 bp, Homo sapiens
cctacttcttttgctc

SEQ ID NO: 2564389 - DNA, 15 bp, Homo sapiens
cctactttgactttt

SEQ ID NO: 2564390 - DNA, 22 bp, Homo sapiens
cctagaaacgtttggaacaatc

SEQ ID NO: 2564391 - DNA, 15 bp, Homo sapiens
cctagaaatacatgg

SEQ ID NO: 2564392 - DNA, 21 bp, Homo sapiens
cctagaagagtgtgaaaagga

SEQ ID NO: 2564393 - DNA, 13 bp, Homo sapiens
cctagaagggcta

SEQ ID NO: 2564394 - DNA, 19 bp, Homo sapiens
cctagaagttactgaatgc

SEQ ID NO: 2564395 - DNA, 19 bp, Homo sapiens
cctagactgtaaacctctc

SEQ ID NO: 2564396 - DNA, 13 bp, Homo sapiens
cctagagcctgcc

SEQ ID NO: 2564397 - DNA, 17 bp, Homo sapiens
cctagatccacacacag

SEQ ID NO: 2564398 - DNA, 14 bp, Homo sapiens
cctagccattcctg

SEQ ID NO: 2564399 - DNA, 15 bp, Homo sapiens
cctagccgacctcag

SEQ ID NO: 2564400 - DNA, 16 bp, Homo sapiens
cctagccgacctcagc

SEQ ID NO: 2564401 - DNA, 18 bp, Homo sapiens
cctagccgacctcagcct

SEQ ID NO: 2564402 - DNA, 19 bp, Homo sapiens
cctagccgacctcagcctt

SEQ ID NO: 2564403 - DNA, 23 bp, Homo sapiens
cctagcctgtgcctctgggactg

SEQ ID NO: 2564404 - DNA, 22 bp, Homo sapiens
cctagctgcacagggcagctgg

SEQ ID NO: 2564405 - DNA, 23 bp, Homo sapiens
cctagctgcacagggcagctggg

SEQ ID NO: 2564406 - DNA, 14 bp, Homo sapiens
cctagctgctacaa

SEQ ID NO: 2564407 - DNA, 15 bp, Homo sapiens
cctagctgctacaaa

SEQ ID NO: 2564408 - DNA, 23 bp, Homo sapiens
cctaggccacaccatctcctttc

SEQ ID NO: 2564409 - DNA, 15 bp, Homo sapiens
cctaggctccacccc

SEQ ID NO: 2564410 - DNA, 22 bp, Homo sapiens
cctagggaagggtggtggagcc

SEQ ID NO: 2564411 - DNA, 16 bp, Homo sapiens
cctagggcctggtcca

SEQ ID NO: 2564412 - DNA, 13 bp, Homo sapiens
cctaggtgacaga

SEQ ID NO: 2564413 - DNA, 15 bp, Homo sapiens
cctagtaagtgcctt

SEQ ID NO: 2564414 - DNA, 21 bp, Homo sapiens
cctagttcatccaatcctcac

SEQ ID NO: 2564415 - DNA, 13 bp, Homo sapiens
cctagttccacca

SEQ ID NO: 2564416 - DNA, 21 bp, Homo sapiens
cctagttccaccatcaagcca

SEQ ID NO: 2564417 - DNA, 14 bp, Homo sapiens
cctagtttccctga

SEQ ID NO: 2564418 - DNA, 13 bp, Homo sapiens
cctagttttccat

SEQ ID NO: 2564419 - DNA, 15 bp, Homo sapiens
cctagttttccatgc

SEQ ID NO: 2564420 - DNA, 23 bp, Homo sapiens
cctataaaacaggtcaatacagt

SEQ ID NO: 2564421 - DNA, 17 bp, Homo sapiens
cctataaagtaaagcta

SEQ ID NO: 2564422 - DNA, 14 bp, Homo sapiens
cctatagtcccagc

SEQ ID NO: 2564423 - DNA, 13 bp, Homo sapiens
cctcccactgggg

SEQ ID NO: 2564424 - DNA, 15 bp, Homo sapiens
cctcccactggggtc

SEQ ID NO: 2564425 - DNA, 17 bp, Homo sapiens
cctcccagtacctcctg

SEQ ID NO: 2564426 - DNA, 17 bp, Homo sapiens
cctcccatcacccgcta

SEQ ID NO: 2564427 - DNA, 16 bp, Homo sapiens
cctccccaaccctgcc

SEQ ID NO: 2564428 - DNA, 22 bp, Homo sapiens
cctccccacggccgctccaggg

SEQ ID NO: 2564429 - DNA, 16 bp, Homo sapiens
cctccccagcaggtgg

SEQ ID NO: 2564430 - DNA, 20 bp, Homo sapiens
cctccccattagagtcagcc

SEQ ID NO: 2564431 - DNA, 15 bp, Homo sapiens
cctcccccagagggg

SEQ ID NO: 2564432 - DNA, 17 bp, Homo sapiens
cctccccctcccccttc

SEQ ID NO: 2564433 - DNA, 12 bp, Homo sapiens
cctcccccttct

SEQ ID NO: 2564434 - DNA, 16 bp, Homo sapiens
cctcccctctctgcac

SEQ ID NO: 2564435 - DNA, 21 bp, Homo sapiens
cctcccctctcttgcacccgc

SEQ ID NO: 2564436 - DNA, 16 bp, Homo sapiens
cctcccctgccagggc

SEQ ID NO: 2564437 - DNA, 13 bp, Homo sapiens
cctcccctgccct

SEQ ID NO: 2564438 - DNA, 13 bp, Homo sapiens
cctcccctgggga

SEQ ID NO: 2564439 - DNA, 14 bp, Homo sapiens
cctcccctggggac

SEQ ID NO: 2564440 - DNA, 23 bp, Homo sapiens
cctcccctggggacagcaagggc

SEQ ID NO: 2564441 - DNA, 20 bp, Homo sapiens
cctcccgaatagctgggact

SEQ ID NO: 2564442 - DNA, 17 bp, Homo sapiens
cctcccgagtagctggg

SEQ ID NO: 2564443 - DNA, 18 bp, Homo sapiens
cctcccgagtagctggga

SEQ ID NO: 2564444 - DNA, 15 bp, Homo sapiens
cctcccggcatggga

SEQ ID NO: 2564445 - DNA, 19 bp, Homo sapiens
cctcccggcatgggaaagc

SEQ ID NO: 2564446 - DNA, 13 bp, Homo sapiens
ccctcctggctct

SEQ ID NO: 2564447 - DNA, 18 bp, Homo sapiens
ccctcctgtcttcccagg

SEQ ID NO: 2564448 - DNA, 16 bp, Homo sapiens
ccctccttccttgacc

SEQ ID NO: 2564449 - DNA, 18 bp, Homo sapiens
ccctccttccttgaccag

SEQ ID NO: 2564450 - DNA, 17 bp, Homo sapiens
ccctccttgcctcctgt

SEQ ID NO: 2564451 - DNA, 19 bp, Homo sapiens
ccctccttgctctgcaggc

SEQ ID NO: 2564452 - DNA, 20 bp, Homo sapiens
ccctccttgctctgcaggca

SEQ ID NO: 2564453 - DNA, 22 bp, Homo sapiens
ccctcgaggcggatctttggac

SEQ ID NO: 2564454 - DNA, 13 bp, Homo sapiens
ccctcgcccccgc

SEQ ID NO: 2564455 - DNA, 14 bp, Homo sapiens
ccctcgctgcttct

SEQ ID NO: 2564456 - DNA, 15 bp, Homo sapiens
ccctcgctgcttctg

SEQ ID NO: 2564457 - DNA, 14 bp, Homo sapiens
ccctcgggcccacc

SEQ ID NO: 2564458 - DNA, 18 bp, Homo sapiens
cccagggcacttcacaga

SEQ ID NO: 2564459 - DNA, 18 bp, Homo sapiens
cccagggccactctgcct

SEQ ID NO: 2564460 - DNA, 15 bp, Homo sapiens
cccagggccagggcc

SEQ ID NO: 2564461 - DNA, 18 bp, Homo sapiens
cccagggccagggccctg

SEQ ID NO: 2564462 - DNA, 20 bp, Homo sapiens
cccagggccagggccctgca

SEQ ID NO: 2564463 - DNA, 21 bp, Homo sapiens
cccagggccagggccctgcag

SEQ ID NO: 2564464 - DNA, 22 bp, Homo sapiens
cccagggccagggccctgcaga

SEQ ID NO: 2564465 - DNA, 15 bp, Homo sapiens
cccagggctcagcct

SEQ ID NO: 2564466 - DNA, 18 bp, Homo sapiens
cccagggctcagcctggt

SEQ ID NO: 2564467 - DNA, 16 bp, Homo sapiens
cccaggggagccctcc

SEQ ID NO: 2564468 - DNA, 19 bp, Homo sapiens
cccaggggagccctccacg

SEQ ID NO: 2564469 - DNA, 13 bp, Homo sapiens
cccagggtagccc

SEQ ID NO: 2564470 - DNA, 17 bp, Homo sapiens
cccagggtagcccgcct

SEQ ID NO: 2564471 - DNA, 22 bp, Homo sapiens
cccagggtagcccgcctgccag

SEQ ID NO: 2564472 - DNA, 23 bp, Homo sapiens
cccagggtcttccctacctcagg

SEQ ID NO: 2564473 - DNA, 19 bp, Homo sapiens
cccagggttaatagggcct

SEQ ID NO: 2564474 - DNA, 15 bp, Homo sapiens
cccaggtcctctgat

SEQ ID NO: 2564475 - DNA, 14 bp, Homo sapiens
cccagtacctcctg

SEQ ID NO: 2564476 - DNA, 18 bp, Homo sapiens
cccagtcagcctctctcc

SEQ ID NO: 2564477 - DNA, 16 bp, Homo sapiens
cccagtcctggcctgg

SEQ ID NO: 2564478 - DNA, 22 bp, Homo sapiens
cccagtcctggcctggcttctc

SEQ ID NO: 2564479 - DNA, 23 bp, Homo sapiens
cccagtcctggcctggcttctcc

SEQ ID NO: 2564480 - DNA, 14 bp, Homo sapiens
cccagtccttccac

SEQ ID NO: 2564481 - DNA, 17 bp, Homo sapiens
cccagtccttccacctc

SEQ ID NO: 2564482 - DNA, 15 bp, Homo sapiens
cccagtctacccaga

SEQ ID NO: 2564483 - DNA, 16 bp, Homo sapiens
cccagtctacccagag

SEQ ID NO: 2564484 - DNA, 15 bp, Homo sapiens
cccagtctctggcag

SEQ ID NO: 2564485 - DNA, 20 bp, Homo sapiens
cccagtctctggcagttctg

SEQ ID NO: 2564486 - DNA, 18 bp, Homo sapiens
cccagtgacacttcagag

SEQ ID NO: 2564487 - DNA, 13 bp, Homo sapiens
cccagtgcccaca

SEQ ID NO: 2564488 - DNA, 18 bp, Homo sapiens
cccagtgccgagaaggaa

SEQ ID NO: 2564489 - DNA, 22 bp, Homo sapiens
cccagtggccactcagcttcct

SEQ ID NO: 2564490 - DNA, 21 bp, Homo sapiens
cccagtggcctcaaccctccc

SEQ ID NO: 2564491 - DNA, 15 bp, Homo sapiens
cccagtgggaggcgc

SEQ ID NO: 2564492 - DNA, 20 bp, Homo sapiens
cccagtgggaggcgcgagcc

SEQ ID NO: 2564493 - DNA, 14 bp, Homo sapiens
cccagtgggagggg

SEQ ID NO: 2564494 - DNA, 20 bp, Homo sapiens
cccagtgggaggggcaggct

SEQ ID NO: 2564495 - DNA, 22 bp, Homo sapiens
cccagttcaggagtcccaagga

SEQ ID NO: 2564496 - DNA, 14 bp, Homo sapiens
cccagttctgctcc

SEQ ID NO: 2564497 - DNA, 16 bp, Homo sapiens
cccagttctgctcctc

SEQ ID NO: 2564498 - DNA, 23 bp, Homo sapiens
cccagttctgctcctctccaggc

SEQ ID NO: 2564499 - DNA, 17 bp, Homo sapiens
cccagtttctgcctctg

SEQ ID NO: 2564500 - DNA, 15 bp, Homo sapiens
cccacccctgtgctc

SEQ ID NO: 2564501 - DNA, 12 bp, Homo sapiens
cccaccctcagc

SEQ ID NO: 2564502 - DNA, 21 bp, Homo sapiens
cccaccctcagcaccccttcc

SEQ ID NO: 2564503 - DNA, 14 bp, Homo sapiens
cccaccctcctgtc

SEQ ID NO: 2564504 - DNA, 19 bp, Homo sapiens
cccaccctcctgtcttccc

SEQ ID NO: 2564505 - DNA, 15 bp, Homo sapiens
cccaccctgggctct

SEQ ID NO: 2564506 - DNA, 15 bp, Homo sapiens
cccaccgcagacagg

SEQ ID NO: 2564507 - DNA, 18 bp, Homo sapiens
cccaccgcagacaggacc

SEQ ID NO: 2564508 - DNA, 19 bp, Homo sapiens
cccaccgcagacaggacca

SEQ ID NO: 2564509 - DNA, 23 bp, Homo sapiens
cccaccgtccgccctgctcctcc

SEQ ID NO: 2564510 - DNA, 16 bp, Homo sapiens
cccacctatgtgccaa

SEQ ID NO: 2564511 - DNA, 13 bp, Homo sapiens
cccacctctctca

SEQ ID NO: 2564512 - DNA, 14 bp, Homo sapiens
cccacctctctcac

SEQ ID NO: 2564513 - DNA, 20 bp, Homo sapiens
cccacctgcccatcacaggg

SEQ ID NO: 2564514 - DNA, 23 bp, Homo sapiens
cccacctgcccatcacagggttg

SEQ ID NO: 2564515 - DNA, 12 bp, Homo sapiens
cccacctggcca

SEQ ID NO: 2564516 - DNA, 17 bp, Homo sapiens
cccacctggccacctga

SEQ ID NO: 2564517 - DNA, 13 bp, Homo sapiens
cccacctgggacc

SEQ ID NO: 2564518 - DNA, 22 bp, Homo sapiens
cccacctgtcaaacaaagccag

SEQ ID NO: 2564519 - DNA, 22 bp, Homo sapiens
cccaccttggctcaagtcctct

SEQ ID NO: 2564520 - DNA, 19 bp, Homo sapiens
cccaccttggctgcaggga

SEQ ID NO: 2564521 - DNA, 21 bp, Homo sapiens
cccaccttgttggagcctgca

SEQ ID NO: 2564522 - DNA, 17 bp, Homo sapiens
cccacgcccccactggt

SEQ ID NO: 2564523 - DNA, 19 bp, Homo sapiens
cccacgcccccactggtga

SEQ ID NO: 2564524 - DNA, 14 bp, Homo sapiens
cccacgctggagtg

SEQ ID NO: 2564525 - DNA, 19 bp, Homo sapiens
cccacgctggagtgcagtg

SEQ ID NO: 2564526 - DNA, 21 bp, Homo sapiens
cccacggccgctccaggggtg

SEQ ID NO: 2564527 - DNA, 12 bp, Homo sapiens
cccacgtgggag

SEQ ID NO: 2564528 - DNA, 16 bp, Homo sapiens
cccactcaagccaagc

SEQ ID NO: 2564529 - DNA, 17 bp, Homo sapiens
cccactccccaccttca

SEQ ID NO: 2564530 - DNA, 15 bp, Homo sapiens
cccactctccccaca

SEQ ID NO: 2564531 - DNA, 15 bp, Homo sapiens
cccactgcctcaggt

SEQ ID NO: 2564532 - DNA, 16 bp, Homo sapiens
cccactgcctcaggtt

SEQ ID NO: 2564533 - DNA, 14 bp, Homo sapiens
cccactgcctgccc

SEQ ID NO: 2564534 - DNA, 15 bp, Homo sapiens
cccactgcctgccca

SEQ ID NO: 2564535 - DNA, 19 bp, Homo sapiens
cccactgcttttggtctgt

SEQ ID NO: 2564536 - DNA, 22 bp, Homo sapiens
cccactgcttttggtctgtgtg

SEQ ID NO: 2564537 - DNA, 23 bp, Homo sapiens
cccactgcttttggtctgtgtga

SEQ ID NO: 2564538 - DNA, 15 bp, Homo sapiens
cccactggcagcatc

SEQ ID NO: 2564539 - DNA, 21 bp, Homo sapiens
cccactggggtccagggagca

SEQ ID NO: 2564540 - DNA, 13 bp, Homo sapiens
cccactgtcctgg

SEQ ID NO: 2564541 - DNA, 18 bp, Homo sapiens
cccactgtcctgggcgcc

SEQ ID NO: 2564542 - DNA, 22 bp, Homo sapiens
cccactgtcctgggcgccctgg

SEQ ID NO: 2564543 - DNA, 23 bp, Homo sapiens
cccactgtcctgggcgccctgga

SEQ ID NO: 2564544 - DNA, 20 bp, Homo sapiens
cccagaaaaaaaaaaactta

SEQ ID NO: 2564545 - DNA, 19 bp, Homo sapiens
cccagaacctgtccttgca

SEQ ID NO: 2564546 - DNA, 20 bp, Homo sapiens
cccagaactggactcaggat

SEQ ID NO: 2564547 - DNA, 19 bp, Homo sapiens
cccagaataagttattgca

SEQ ID NO: 2564548 - DNA, 15 bp, Homo sapiens
cccagacacagaaga

SEQ ID NO: 2564549 - DNA, 23 bp, Homo sapiens
cccagacagacatctctgcaccc

SEQ ID NO: 2564550 - DNA, 12 bp, Homo sapiens
cccagacagctc

SEQ ID NO: 2564551 - DNA, 21 bp, Homo sapiens
cccagacagctccctctgcct

SEQ ID NO: 2564552 - DNA, 15 bp, Homo sapiens
ccatgaggcctcagt

SEQ ID NO: 2564553 - DNA, 15 bp, Homo sapiens
ccatgagtcccctgt

SEQ ID NO: 2564554 - DNA, 12 bp, Homo sapiens
ccatgatgctgg

SEQ ID NO: 2564555 - DNA, 19 bp, Homo sapiens
ccatgatggtgctgacctc

SEQ ID NO: 2564556 - DNA, 13 bp, Homo sapiens
ccatgcccacctg

SEQ ID NO: 2564557 - DNA, 15 bp, Homo sapiens
ccatgcctgagggtg

SEQ ID NO: 2564558 - DNA, 18 bp, Homo sapiens
ccatgcctgagggtggag

SEQ ID NO: 2564559 - DNA, 22 bp, Homo sapiens
ccatgcctgcccccctcatctc

SEQ ID NO: 2564560 - DNA, 20 bp, Homo sapiens
ccatgcgtgtttctgactct

SEQ ID NO: 2564561 - DNA, 15 bp, Homo sapiens
ccatgctcctggccc

SEQ ID NO: 2564562 - DNA, 16 bp, Homo sapiens
ccatgctgccctgtga

SEQ ID NO: 2564563 - DNA, 14 bp, Homo sapiens
ccatgctgcctcca

SEQ ID NO: 2564564 - DNA, 22 bp, Homo sapiens
ccatgctgttgattgctaaatg

SEQ ID NO: 2564565 - DNA, 15 bp, Homo sapiens
ccatgcttgggtgta

SEQ ID NO: 2564566 - DNA, 18 bp, Homo sapiens
ccatggaatgcttgaaaa

SEQ ID NO: 2564567 - DNA, 14 bp, Homo sapiens
ccatggacactcca

SEQ ID NO: 2564568 - DNA, 22 bp, Homo sapiens
ccatggactctacactgtgaac

SEQ ID NO: 2564569 - DNA, 14 bp, Homo sapiens
ccatggactttgtt

SEQ ID NO: 2564570 - DNA, 15 bp, Homo sapiens
ccatggagagctgga

SEQ ID NO: 2564571 - DNA, 22 bp, Homo sapiens
ccatggagagctggagcctggt

SEQ ID NO: 2564572 - DNA, 16 bp, Homo sapiens
ccatggagccccagcc

SEQ ID NO: 2564573 - DNA, 17 bp, Homo sapiens
ccatggagccccagccc

SEQ ID NO: 2564574 - DNA, 19 bp, Homo sapiens
ccatggcgtgtccctctcg

SEQ ID NO: 2564575 - DNA, 15 bp, Homo sapiens
ccatgggaccaaacc

SEQ ID NO: 2564576 - DNA, 13 bp, Homo sapiens
ccatgggcctcct

SEQ ID NO: 2564577 - DNA, 14 bp, Homo sapiens
ccatgggcctcctg

SEQ ID NO: 2564578 - DNA, 15 bp, Homo sapiens
ccatgggcctcctgt

SEQ ID NO: 2564579 - DNA, 17 bp, Homo sapiens
ccatgggcctcctgtgt

SEQ ID NO: 2564580 - DNA, 13 bp, Homo sapiens
ccatgggcttcac

SEQ ID NO: 2564581 - DNA, 21 bp, Homo sapiens
ccatgggcttcactgtataaa

SEQ ID NO: 2564582 - DNA, 20 bp, Homo sapiens
ccatggtgaattaatcactt

SEQ ID NO: 2564583 - DNA, 16 bp, Homo sapiens
ccatgtaacagaaagg

SEQ ID NO: 2564584 - DNA, 18 bp, Homo sapiens
ccatgtaaggtatcagtt

SEQ ID NO: 2564585 - DNA, 16 bp, Homo sapiens
ccatgtacatgaagaa

SEQ ID NO: 2564586 - DNA, 14 bp, Homo sapiens
ccatgtagaagctg

SEQ ID NO: 2564587 - DNA, 23 bp, Homo sapiens
ccatgtcaccggatcctgggtgg

SEQ ID NO: 2564588 - DNA, 15 bp, Homo sapiens
ccatgtccttagcac

SEQ ID NO: 2564589 - DNA, 18 bp, Homo sapiens
ccatgtcgcgctcagcat

SEQ ID NO: 2564590 - DNA, 13 bp, Homo sapiens
ccatgtcggcctc

SEQ ID NO: 2564591 - DNA, 15 bp, Homo sapiens
ccatgtcggcctcta

SEQ ID NO: 2564592 - DNA, 16 bp, Homo sapiens
ccatgtgcctgatcca

SEQ ID NO: 2564593 - DNA, 17 bp, Homo sapiens
ccatgtggtggcacagg

SEQ ID NO: 2564594 - DNA, 18 bp, Homo sapiens
ccatgtggtggcacaggc

SEQ ID NO: 2564595 - DNA, 17 bp, Homo sapiens
ccatgtgtcctggttcc

SEQ ID NO: 2564596 - DNA, 18 bp, Homo sapiens
ccatgtgtgagtgtgtgc

SEQ ID NO: 2564597 - DNA, 19 bp, Homo sapiens
ccatgtgtgtgcaagtgtg

SEQ ID NO: 2564598 - DNA, 22 bp, Homo sapiens
ccatgttaatttcatgtgtcaa

SEQ ID NO: 2564599 - DNA, 14 bp, Homo sapiens
ccatgttggccagg

SEQ ID NO: 2564600 - DNA, 16 bp, Homo sapiens
ccatgttggccaggct

SEQ ID NO: 2564601 - DNA, 18 bp, Homo sapiens
ccatgttggccaggctgg

SEQ ID NO: 2564602 - DNA, 14 bp, Homo sapiens
ccatgtttctctgg

SEQ ID NO: 2564603 - DNA, 16 bp, Homo sapiens
ccatgtttctctggcc

SEQ ID NO: 2564604 - DNA, 14 bp, Homo sapiens
ccattaccatggag

SEQ ID NO: 2564605 - DNA, 16 bp, Homo sapiens
ccattagagtcagcct

SEQ ID NO: 2564606 - DNA, 20 bp, Homo sapiens
ccattcattccattctggaa

SEQ ID NO: 2564607 - DNA, 14 bp, Homo sapiens
ccattccctgcctg

SEQ ID NO: 2564608 - DNA, 22 bp, Homo sapiens
ccattcctgggaaatattccct

SEQ ID NO: 2564609 - DNA, 17 bp, Homo sapiens
ccattcctggtacccag

SEQ ID NO: 2564610 - DNA, 14 bp, Homo sapiens
ccattctacacaga

SEQ ID NO: 2564611 - DNA, 17 bp, Homo sapiens
ccattctccacctgcca

SEQ ID NO: 2564612 - DNA, 20 bp, Homo sapiens
ccattctccacctgccaggg

SEQ ID NO: 2564613 - DNA, 14 bp, Homo sapiens
ccattctctctcct

SEQ ID NO: 2564614 - DNA, 16 bp, Homo sapiens
ccattctgaccatttc

SEQ ID NO: 2564615 - DNA, 15 bp, Homo sapiens
ccacctccctcacca

SEQ ID NO: 2564616 - DNA, 14 bp, Homo sapiens
ccacctctctcact

SEQ ID NO: 2564617 - DNA, 16 bp, Homo sapiens
ccacctctctcactcc

SEQ ID NO: 2564618 - DNA, 15 bp, Homo sapiens
ccacctctctttttc

SEQ ID NO: 2564619 - DNA, 23 bp, Homo sapiens
ccacctcttctcttcctgtaaca

SEQ ID NO: 2564620 - DNA, 14 bp, Homo sapiens
ccacctgccaggga

SEQ ID NO: 2564621 - DNA, 16 bp, Homo sapiens
ccacctgccagggaca

SEQ ID NO: 2564622 - DNA, 15 bp, Homo sapiens
ccacctggccacctg

SEQ ID NO: 2564623 - DNA, 18 bp, Homo sapiens
ccacctggccacctgagg

SEQ ID NO: 2564624 - DNA, 14 bp, Homo sapiens
ccacctggcctctg

SEQ ID NO: 2564625 - DNA, 16 bp, Homo sapiens
ccacctggcctctgca

SEQ ID NO: 2564626 - DNA, 19 bp, Homo sapiens
ccacctgtcaaacaaagcc

SEQ ID NO: 2564627 - DNA, 11 bp, Homo sapiens
ccacctgtctc

SEQ ID NO: 2564628 - DNA, 15 bp, Homo sapiens
ccacctgtctcagcc

SEQ ID NO: 2564629 - DNA, 14 bp, Homo sapiens
ccacctgtcttcaa

SEQ ID NO: 2564630 - DNA, 14 bp, Homo sapiens
ccaccttggctcaa

SEQ ID NO: 2564631 - DNA, 15 bp, Homo sapiens
ccaccttggctgcag

SEQ ID NO: 2564632 - DNA, 19 bp, Homo sapiens
ccaccttggctgcagggag

SEQ ID NO: 2564633 - DNA, 18 bp, Homo sapiens
ccaccttgttggagcctg

SEQ ID NO: 2564634 - DNA, 19 bp, Homo sapiens
ccaccttgttggagcctgc

SEQ ID NO: 2564635 - DNA, 20 bp, Homo sapiens
ccaccttgttggagcctgca

SEQ ID NO: 2564636 - DNA, 20 bp, Homo sapiens
ccacctttattaaaatctta

SEQ ID NO: 2564637 - DNA, 14 bp, Homo sapiens
ccaccttttcagcg

SEQ ID NO: 2564638 - DNA, 19 bp, Homo sapiens
ccacgaatttgctggggaa

SEQ ID NO: 2564639 - DNA, 16 bp, Homo sapiens
ccacgactgtctccat

SEQ ID NO: 2564640 - DNA, 13 bp, Homo sapiens
ccacgcactccat

SEQ ID NO: 2564641 - DNA, 19 bp, Homo sapiens
ccacgcccccactggtgac

SEQ ID NO: 2564642 - DNA, 17 bp, Homo sapiens
ccacgcctgtaatccca

SEQ ID NO: 2564643 - DNA, 13 bp, Homo sapiens
ccacgcttctctt

SEQ ID NO: 2564644 - DNA, 15 bp, Homo sapiens
ccacgcttctctttg

SEQ ID NO: 2564645 - DNA, 17 bp, Homo sapiens
ccacggactccagtctg

SEQ ID NO: 2564646 - DNA, 16 bp, Homo sapiens
ccacggccactggcca

SEQ ID NO: 2564647 - DNA, 13 bp, Homo sapiens
ccacggccaggcc

SEQ ID NO: 2564648 - DNA, 15 bp, Homo sapiens
ccacggccaggccag

SEQ ID NO: 2564649 - DNA, 16 bp, Homo sapiens
ccacggccgctccagg

SEQ ID NO: 2564650 - DNA, 17 bp, Homo sapiens
ccacggtggtcactgga

SEQ ID NO: 2564651 - DNA, 17 bp, Homo sapiens
ccacgtgacagtgcctg

SEQ ID NO: 2564652 - DNA, 22 bp, Homo sapiens
ccacgtgtaactgtcagccggg

SEQ ID NO: 2564653 - DNA, 11 bp, Homo sapiens
ccactaactag

SEQ ID NO: 2564654 - DNA, 14 bp, Homo sapiens
ccactacactccag

SEQ ID NO: 2564655 - DNA, 18 bp, Homo sapiens
ccactacactccagcctg

SEQ ID NO: 2564656 - DNA, 15 bp, Homo sapiens
ccactacattctgtt

SEQ ID NO: 2564657 - DNA, 16 bp, Homo sapiens
ccactacattctgtta

SEQ ID NO: 2564658 - DNA, 14 bp, Homo sapiens
ccactatctgggtg

SEQ ID NO: 2564659 - DNA, 20 bp, Homo sapiens
ccactcaaattaatctttct

SEQ ID NO: 2564660 - DNA, 13 bp, Homo sapiens
ccactcacacagc

SEQ ID NO: 2564661 - DNA, 20 bp, Homo sapiens
ccactcaggaggctgaggca

SEQ ID NO: 2564662 - DNA, 14 bp, Homo sapiens
ccactcccaggcag

SEQ ID NO: 2564663 - DNA, 14 bp, Homo sapiens
ccactcccagtgct

SEQ ID NO: 2564664 - DNA, 13 bp, Homo sapiens
ccactccctgcaa

SEQ ID NO: 2564665 - DNA, 20 bp, Homo sapiens
ccactcctctgactcagggc

SEQ ID NO: 2564666 - DNA, 15 bp, Homo sapiens
ccactcctgtacact

SEQ ID NO: 2564667 - DNA, 19 bp, Homo sapiens
ccactctaccctcccaccc

SEQ ID NO: 2564668 - DNA, 21 bp, Homo sapiens
ccactctaccctcccaccccc

SEQ ID NO: 2564669 - DNA, 21 bp, Homo sapiens
ccactctaggggtcaggctcc

SEQ ID NO: 2564670 - DNA, 23 bp, Homo sapiens
ccactctaggggtcaggctccat

SEQ ID NO: 2564671 - DNA, 12 bp, Homo sapiens
ccactctccttg

SEQ ID NO: 2564672 - DNA, 14 bp, Homo sapiens
ccactctgcctctg

SEQ ID NO: 2564673 - DNA, 16 bp, Homo sapiens
ccactctgcctctgcc

SEQ ID NO: 2564674 - DNA, 22 bp, Homo sapiens
ccactctgtgcctgaccttgag

SEQ ID NO: 2564675 - DNA, 21 bp, Homo sapiens
ccactgaagtagtgtgcagtt

SEQ ID NO: 2564676 - DNA, 17 bp, Homo sapiens
ccactgacagcctccca

SEQ ID NO: 2564677 - DNA, 22 bp, Homo sapiens
ccactgatagatgtctattctt

SEQ ID NO: 2564678 - DNA, 13 bp, Homo sapiens
ccactgcaccggg

SEQ ID NO: 2564679 - DNA, 17 bp, Homo sapiens
ccactgcactccagcct

SEQ ID NO: 2564680 - DNA, 20 bp, Homo sapiens
ccactgcactccagcctggg

SEQ ID NO: 2564681 - DNA, 21 bp, Homo sapiens
ccactgcactccagcctgggc

SEQ ID NO: 2564682 - DNA, 13 bp, Homo sapiens
ccactgcagaaga

SEQ ID NO: 2564683 - DNA, 23 bp, Homo sapiens
ccactgcatcgtttcatcttcca

SEQ ID NO: 2564684 - DNA, 16 bp, Homo sapiens
ccactgcccgagctgg

SEQ ID NO: 2564685 - DNA, 23 bp, Homo sapiens
ccactgcccgagctggtgcatta

SEQ ID NO: 2564686 - DNA, 13 bp, Homo sapiens
ccactgcctcagg

SEQ ID NO: 2564687 - DNA, 14 bp, Homo sapiens
ccactgcctcaggt

SEQ ID NO: 2564688 - DNA, 13 bp, Homo sapiens
ccactgcctcttc

SEQ ID NO: 2564689 - DNA, 14 bp, Homo sapiens
ccactgcctgccca

SEQ ID NO: 2564690 - DNA, 15 bp, Homo sapiens
ccactgcctgcccac

SEQ ID NO: 2564691 - DNA, 14 bp, Homo sapiens
ccactgcctttgac

SEQ ID NO: 2564692 - DNA, 22 bp, Homo sapiens
ccactgcttttggtctgtgtga

SEQ ID NO: 2564693 - DNA, 21 bp, Homo sapiens
ccactggacttgagcttggca

SEQ ID NO: 2564694 - DNA, 11 bp, Homo sapiens
ccactggaggt

SEQ ID NO: 2564695 - DNA, 14 bp, Homo sapiens
ccactggccaccag

SEQ ID NO: 2564696 - DNA, 18 bp, Homo sapiens
ccactggccaccaggctg

SEQ ID NO: 2564697 - DNA, 19 bp, Homo sapiens
ccactggccaccaggctgg

SEQ ID NO: 2564698 - DNA, 22 bp, Homo sapiens
ccactggggaaataacagctgt

SEQ ID NO: 2564699 - DNA, 18 bp, Homo sapiens
ccactggggtccagggag

SEQ ID NO: 2564700 - DNA, 18 bp, Homo sapiens
ccactgtaaaatgaaatt

SEQ ID NO: 2564701 - DNA, 14 bp, Homo sapiens
ccactgtcaccctc

SEQ ID NO: 2564702 - DNA, 19 bp, Homo sapiens
ccactgtcactgtttctct

SEQ ID NO: 2564703 - DNA, 12 bp, Homo sapiens
ccactgtcctgg

SEQ ID NO: 2564704 - DNA, 13 bp, Homo sapiens
ccactgtcctggg

SEQ ID NO: 2564705 - DNA, 14 bp, Homo sapiens
ccactgtcctgggc

SEQ ID NO: 2564706 - DNA, 16 bp, Homo sapiens
ccactgtcctgggcgc

SEQ ID NO: 2564707 - DNA, 15 bp, Homo sapiens
ccactgtgaagagaa

SEQ ID NO: 2564708 - DNA, 15 bp, Homo sapiens
ccactgtgccatgtg

SEQ ID NO: 2564709 - DNA, 17 bp, Homo sapiens
ccacttaaaaaatgtcc

SEQ ID NO: 2564710 - DNA, 22 bp, Homo sapiens
ccacttaccttcaataaagtat

SEQ ID NO: 2564711 - DNA, 17 bp, Homo sapiens
ccacttcaagtgaccac

SEQ ID NO: 2564712 - DNA, 21 bp, Homo sapiens
ccacttcattcttgaaagctg

SEQ ID NO: 2564713 - DNA, 19 bp, Homo sapiens
ccacttcttgttccccact

SEQ ID NO: 2564714 - DNA, 21 bp, Homo sapiens
ccacttggctacacagggatg

SEQ ID NO: 2564715 - DNA, 21 bp, Homo sapiens
ccagccatacttatctctctg

SEQ ID NO: 2564716 - DNA, 20 bp, Homo sapiens
ccagccatctgcccaggggt

SEQ ID NO: 2564717 - DNA, 19 bp, Homo sapiens
ccagccattaccatggaga

SEQ ID NO: 2564718 - DNA, 21 bp, Homo sapiens
ccagccattaccatggagaca

SEQ ID NO: 2564719 - DNA, 13 bp, Homo sapiens
ccagcccaccctc

SEQ ID NO: 2564720 - DNA, 22 bp, Homo sapiens
ccagcccaccctcctgtcttcc

SEQ ID NO: 2564721 - DNA, 17 bp, Homo sapiens
ccagcccacttctgcca

SEQ ID NO: 2564722 - DNA, 16 bp, Homo sapiens
ccagccccacccagga

SEQ ID NO: 2564723 - DNA, 16 bp, Homo sapiens
ccagccccagtgccca

SEQ ID NO: 2564724 - DNA, 21 bp, Homo sapiens
ccagcccccacagtgctgtct

SEQ ID NO: 2564725 - DNA, 21 bp, Homo sapiens
ccagccccctttgggcccagg

SEQ ID NO: 2564726 - DNA, 22 bp, Homo sapiens
ccagccccctttgggcccaggg

SEQ ID NO: 2564727 - DNA, 18 bp, Homo sapiens
ccagccccggccctgggc

SEQ ID NO: 2564728 - DNA, 12 bp, Homo sapiens
ccagcccctccc

SEQ ID NO: 2564729 - DNA, 13 bp, Homo sapiens
ccagcccctccca

SEQ ID NO: 2564730 - DNA, 15 bp, Homo sapiens
ccagcccctcccacc

SEQ ID NO: 2564731 - DNA, 21 bp, Homo sapiens
ccagcccctggatgcagcctc

SEQ ID NO: 2564732 - DNA, 10 bp, Homo sapiens
ccagcccctt

SEQ ID NO: 2564733 - DNA, 17 bp, Homo sapiens
ccagccccttctgaccc

SEQ ID NO: 2564734 - DNA, 14 bp, Homo sapiens
ccagcccggcctgc

SEQ ID NO: 2564735 - DNA, 15 bp, Homo sapiens
ccagccctatggatg

SEQ ID NO: 2564736 - DNA, 24 bp, Homo sapiens
ccagccctgctggccgcctcaccc

SEQ ID NO: 2564737 - DNA, 14 bp, Homo sapiens
ccagccctggctga

SEQ ID NO: 2564738 - DNA, 18 bp, Homo sapiens
ccagccctggctgaagga

SEQ ID NO: 2564739 - DNA, 20 bp, Homo sapiens
ccagccctggtctcagcagc

SEQ ID NO: 2564740 - DNA, 14 bp, Homo sapiens
ccagccctgtggaa

SEQ ID NO: 2564741 - DNA, 16 bp, Homo sapiens
ccagcccttagcaggg

SEQ ID NO: 2564742 - DNA, 20 bp, Homo sapiens
ccagcccttgagctccccaa

SEQ ID NO: 2564743 - DNA, 23 bp, Homo sapiens
ccagccgccattgccaccaggag

SEQ ID NO: 2564744 - DNA, 14 bp, Homo sapiens
ccagccggcatggc

SEQ ID NO: 2564745 - DNA, 20 bp, Homo sapiens
ccagccgtgatgctcaggct

SEQ ID NO: 2564746 - DNA, 21 bp, Homo sapiens
ccagccgtgatgctcaggctt

SEQ ID NO: 2564747 - DNA, 21 bp, Homo sapiens
ccagcctccaagctccatctc

SEQ ID NO: 2564748 - DNA, 13 bp, Homo sapiens
ccagcctctcccc

SEQ ID NO: 2564749 - DNA, 14 bp, Homo sapiens
ccagcctctcccct

SEQ ID NO: 2564750 - DNA, 20 bp, Homo sapiens
ccagcctgcctggcaggctg

SEQ ID NO: 2564751 - DNA, 12 bp, Homo sapiens
ccagcctggcca

SEQ ID NO: 2564752 - DNA, 23 bp, Homo sapiens
ccagcctggctcccacaggcagc

SEQ ID NO: 2564753 - DNA, 21 bp, Homo sapiens
ccagcctggcttctggagccc

SEQ ID NO: 2564754 - DNA, 23 bp, Homo sapiens
ccagcctgtcccatggacactcc

SEQ ID NO: 2564755 - DNA, 20 bp, Homo sapiens
ccagccttcctctgcagctg

SEQ ID NO: 2564756 - DNA, 18 bp, Homo sapiens
ccagccttctttgcttgc

SEQ ID NO: 2564757 - DNA, 20 bp, Homo sapiens
ccagccttgaccattctcca

SEQ ID NO: 2564758 - DNA, 20 bp, Homo sapiens
ccagcctttctcccaggcca

SEQ ID NO: 2564759 - DNA, 20 bp, Homo sapiens
ccagcctttgatcaggtggg

SEQ ID NO: 2564760 - DNA, 21 bp, Homo sapiens
ccagcgtcccagtctctggca

SEQ ID NO: 2564761 - DNA, 17 bp, Homo sapiens
ccagcgtttgaggggct

SEQ ID NO: 2564762 - DNA, 22 bp, Homo sapiens
ccagcgtttgaggggctggcct

SEQ ID NO: 2564763 - DNA, 21 bp, Homo sapiens
ccagctaaggacatttcccag

SEQ ID NO: 2564764 - DNA, 23 bp, Homo sapiens
ccagctaaggacatttcccaggg

SEQ ID NO: 2564765 - DNA, 21 bp, Homo sapiens
ccagctaatctgtagggctgg

SEQ ID NO: 2564766 - DNA, 16 bp, Homo sapiens
ccagctaccctttttc

SEQ ID NO: 2564767 - DNA, 14 bp, Homo sapiens
ccagctactcagaa

SEQ ID NO: 2564768 - DNA, 16 bp, Homo sapiens
ccagctactcagaagc

SEQ ID NO: 2564769 - DNA, 15 bp, Homo sapiens
ccagctacttcctcc

SEQ ID NO: 2564770 - DNA, 17 bp, Homo sapiens
ccagctacttcctcctc

SEQ ID NO: 2564771 - DNA, 22 bp, Homo sapiens
ccagctatgttatattgaaaaa

SEQ ID NO: 2564772 - DNA, 17 bp, Homo sapiens
ccagctcaatggactgg

SEQ ID NO: 2564773 - DNA, 15 bp, Homo sapiens
ccagctcaccagccc

SEQ ID NO: 2564774 - DNA, 17 bp, Homo sapiens
ccagctcaccccccaca

SEQ ID NO: 2564775 - DNA, 15 bp, Homo sapiens
cagtcttgcagcagg

SEQ ID NO: 2564776 - DNA, 16 bp, Homo sapiens
cagtcttggctcactg

SEQ ID NO: 2564777 - DNA, 13 bp, Homo sapiens
cagtcttgtgctt

SEQ ID NO: 2564778 - DNA, 15 bp, Homo sapiens
cagtgaaaatgtaag

SEQ ID NO: 2564779 - DNA, 14 bp, Homo sapiens
cagtgaaagcatca

SEQ ID NO: 2564780 - DNA, 21 bp, Homo sapiens
cagtgaaccaaagagactgga

SEQ ID NO: 2564781 - DNA, 17 bp, Homo sapiens
cagtgaatgattcagtg

SEQ ID NO: 2564782 - DNA, 16 bp, Homo sapiens
cagtgacacttcagag

SEQ ID NO: 2564783 - DNA, 18 bp, Homo sapiens
cagtgacacttcagagag

SEQ ID NO: 2564784 - DNA, 20 bp, Homo sapiens
cagtgacagagttcactata

SEQ ID NO: 2564785 - DNA, 18 bp, Homo sapiens
cagtgacctgaggaagcg

SEQ ID NO: 2564786 - DNA, 19 bp, Homo sapiens
cagtgacctgaggaagcgt

SEQ ID NO: 2564787 - DNA, 15 bp, Homo sapiens
cagtgactccaggag

SEQ ID NO: 2564788 - DNA, 21 bp, Homo sapiens
cagtgactccaggagaggagc

SEQ ID NO: 2564789 - DNA, 21 bp, Homo sapiens
cagtgagaaaaagctcctgtc

SEQ ID NO: 2564790 - DNA, 19 bp, Homo sapiens
cagtgagattacagaggaa

SEQ ID NO: 2564791 - DNA, 20 bp, Homo sapiens
cagtgagattacagaggaag

SEQ ID NO: 2564792 - DNA, 22 bp, Homo sapiens
cagtgagcttggaaaggaccag

SEQ ID NO: 2564793 - DNA, 19 bp, Homo sapiens
cagtgaggctctgcccttg

SEQ ID NO: 2564794 - DNA, 18 bp, Homo sapiens
cagtgagtcgaggacagg

SEQ ID NO: 2564795 - DNA, 19 bp, Homo sapiens
cagtgagtcgaggacaggg

SEQ ID NO: 2564796 - DNA, 20 bp, Homo sapiens
cagtgagtcgaggacaggga

SEQ ID NO: 2564797 - DNA, 18 bp, Homo sapiens
cagtgatatggcagaaga

SEQ ID NO: 2564798 - DNA, 23 bp, Homo sapiens
cagtgatatggcagaagacacca

SEQ ID NO: 2564799 - DNA, 18 bp, Homo sapiens
cagtgattaccagggact

SEQ ID NO: 2564800 - DNA, 11 bp, Homo sapiens
cagtgcaagag

SEQ ID NO: 2564801 - DNA, 18 bp, Homo sapiens
cagtgcaagagactctgg

SEQ ID NO: 2564802 - DNA, 24 bp, Homo sapiens
cagtgcaagagactctggcctcca

SEQ ID NO: 2564803 - DNA, 23 bp, Homo sapiens
cagtgccaagcacagtgcctgca

SEQ ID NO: 2564804 - DNA, 12 bp, Homo sapiens
cagtgcccacag

SEQ ID NO: 2564805 - DNA, 21 bp, Homo sapiens
cagtgcccacaggatcagtct

SEQ ID NO: 2564806 - DNA, 14 bp, Homo sapiens
cagtgcccctagct

SEQ ID NO: 2564807 - DNA, 18 bp, Homo sapiens
gttaggaaataaaacctt

SEQ ID NO: 2564808 - DNA, 23 bp, Homo sapiens
gttaggatttaacagtcatttaa

SEQ ID NO: 2564809 - DNA, 23 bp, Homo sapiens
gttagggaaaacattccatcctt

SEQ ID NO: 2564810 - DNA, 13 bp, Homo sapiens
gttagggaatggc

SEQ ID NO: 2564811 - DNA, 21 bp, Homo sapiens
gttaggtagagggagttgtca

SEQ ID NO: 2564812 - DNA, 16 bp, Homo sapiens
gttagtatctaacatg

SEQ ID NO: 2564813 - DNA, 17 bp, Homo sapiens
gttagtatctaacatgt

SEQ ID NO: 2564814 - DNA, 12 bp, Homo sapiens
gttagtcatttg

SEQ ID NO: 2564815 - DNA, 22 bp, Homo sapiens
gttagtcatttgctgagcatgt

SEQ ID NO: 2564816 - DNA, 21 bp, Homo sapiens
gttagtctactcttaagccat

SEQ ID NO: 2564817 - DNA, 22 bp, Homo sapiens
gttagtctactcttaagccatc

SEQ ID NO: 2564818 - DNA, 17 bp, Homo sapiens
gttagttatagatgtct

SEQ ID NO: 2564819 - DNA, 19 bp, Homo sapiens
gttagttatagatgtctag

SEQ ID NO: 2564820 - DNA, 14 bp, Homo sapiens
gttagtttttactt

SEQ ID NO: 2564821 - DNA, 16 bp, Homo sapiens
gttataaaagtgattg

SEQ ID NO: 2564822 - DNA, 19 bp, Homo sapiens
gttatactgtcggtttttt

SEQ ID NO: 2564823 - DNA, 15 bp, Homo sapiens
gttatagtatatctg

SEQ ID NO: 2564824 - DNA, 20 bp, Homo sapiens
gttatattttactactgtgg

SEQ ID NO: 2564825 - DNA, 23 bp, Homo sapiens
gttatcaaacttcagctgtactt

SEQ ID NO: 2564826 - DNA, 22 bp, Homo sapiens
gttatcaccgtgggctccctga

SEQ ID NO: 2564827 - DNA, 15 bp, Homo sapiens
gttatcgaaataaca

SEQ ID NO: 2564828 - DNA, 17 bp, Homo sapiens
gttatcgaaataacaat

SEQ ID NO: 2564829 - DNA, 15 bp, Homo sapiens
gttatggtgtttctc

SEQ ID NO: 2564830 - DNA, 22 bp, Homo sapiens
gttattagagattacctcctga

SEQ ID NO: 2564831 - DNA, 13 bp, Homo sapiens
gttattctggagt

SEQ ID NO: 2564832 - DNA, 16 bp, Homo sapiens
gttattgacaaactct

SEQ ID NO: 2564833 - DNA, 13 bp, Homo sapiens
gttattgcagttt

SEQ ID NO: 2564834 - DNA, 11 bp, Homo sapiens
gttatttaaat

SEQ ID NO: 2564835 - DNA, 19 bp, Homo sapiens
gttatttgttattttcagt

SEQ ID NO: 2564836 - DNA, 21 bp, Homo sapiens
gttattttattgattattact

SEQ ID NO: 2564837 - DNA, 17 bp, Homo sapiens
gttattttcagtatttt

SEQ ID NO: 2564838 - DNA, 19 bp, Homo sapiens
gttatttttacattctgaa

SEQ ID NO: 2564839 - DNA, 22 bp, Homo sapiens
gttatttttgtttcttccaaag

SEQ ID NO: 2564840 - DNA, 16 bp, Homo sapiens
gttattttttaattat

SEQ ID NO: 2564841 - DNA, 21 bp, Homo sapiens
gttcaaagatattttgctttg

SEQ ID NO: 2564842 - DNA, 12 bp, Homo sapiens
gttcaaagccag

SEQ ID NO: 2564843 - DNA, 13 bp, Homo sapiens
gttcaaagccagc

SEQ ID NO: 2564844 - DNA, 15 bp, Homo sapiens
gttcaacttccagaa

SEQ ID NO: 2564845 - DNA, 18 bp, Homo sapiens
gttcaagcgattcttctg

SEQ ID NO: 2564846 - DNA, 19 bp, Homo sapiens
gttcaagcgattcttctgc

SEQ ID NO: 2564847 - DNA, 21 bp, Homo sapiens
gttcaatgatctaggtttaac

SEQ ID NO: 2564848 - DNA, 15 bp, Homo sapiens
gttcactaaagcagt

SEQ ID NO: 2564849 - DNA, 19 bp, Homo sapiens
gttcagaaatgctgcctgc

SEQ ID NO: 2564850 - DNA, 21 bp, Homo sapiens
gttcagaaatgctgcctgcct

SEQ ID NO: 2564851 - DNA, 17 bp, Homo sapiens
gttcagagactcagggc

SEQ ID NO: 2564852 - DNA, 13 bp, Homo sapiens
gttcagctccagc

SEQ ID NO: 2564853 - DNA, 16 bp, Homo sapiens
gttcagctccagctca

SEQ ID NO: 2564854 - DNA, 17 bp, Homo sapiens
gttcagctccagctcac

SEQ ID NO: 2564855 - DNA, 17 bp, Homo sapiens
gttcaggtaacaggcag

SEQ ID NO: 2564856 - DNA, 16 bp, Homo sapiens
gttcagtacctggagg

SEQ ID NO: 2564857 - DNA, 17 bp, Homo sapiens
gttcagtggcagggctc

SEQ ID NO: 2564858 - DNA, 22 bp, Homo sapiens
gttcagtggcagggctcaggat

SEQ ID NO: 2564859 - DNA, 16 bp, Homo sapiens
gttcagtgtcccgggc

SEQ ID NO: 2564860 - DNA, 12 bp, Homo sapiens
gttcagttacag

SEQ ID NO: 2564861 - DNA, 13 bp, Homo sapiens
gttcagttacaga

SEQ ID NO: 2564862 - DNA, 14 bp, Homo sapiens
gttcagttacagaa

SEQ ID NO: 2564863 - DNA, 13 bp, Homo sapiens
gttcataaatgaa

SEQ ID NO: 2564864 - DNA, 15 bp, Homo sapiens
gttcatccaatcctc

SEQ ID NO: 2564865 - DNA, 21 bp, Homo sapiens
gttcatccaatcctcactggg

SEQ ID NO: 2564866 - DNA, 14 bp, Homo sapiens
gttcatgagaatct

SEQ ID NO: 2564867 - DNA, 16 bp, Homo sapiens
gttcattaaagcatga

SEQ ID NO: 2564868 - DNA, 19 bp, Homo sapiens
gttcattgtaatgttactg

SEQ ID NO: 2564869 - DNA, 20 bp, Homo sapiens
gttcatttcaaatacatctt

SEQ ID NO: 2564870 - DNA, 15 bp, Homo sapiens
gttccaaatgaatgt

SEQ ID NO: 2564871 - DNA, 13 bp, Homo sapiens
gttccaagacatt

SEQ ID NO: 2564872 - DNA, 14 bp, Homo sapiens
gttccaagacattg

SEQ ID NO: 2564873 - DNA, 16 bp, Homo sapiens
gttccaagacattgtc

SEQ ID NO: 2564874 - DNA, 13 bp, Homo sapiens
gttccagcctgcc

SEQ ID NO: 2564875 - DNA, 12 bp, Homo sapiens
gttccagctctt

SEQ ID NO: 2564876 - DNA, 16 bp, Homo sapiens
gttccagctctttgaa

SEQ ID NO: 2564877 - DNA, 23 bp, Homo sapiens
gttccatgaagaccacatccaca

SEQ ID NO: 2564878 - DNA, 16 bp, Homo sapiens
gttccatgatgctggg

SEQ ID NO: 2564879 - DNA, 19 bp, Homo sapiens
gttcccaccaggctgctca

SEQ ID NO: 2564880 - DNA, 18 bp, Homo sapiens
gttccccatctgggtcct

SEQ ID NO: 2564881 - DNA, 23 bp, Homo sapiens
gttccccatctgggtccttgcac

SEQ ID NO: 2564882 - DNA, 13 bp, Homo sapiens
gttcccccagccc

SEQ ID NO: 2564883 - DNA, 16 bp, Homo sapiens
gttcccccagccctgt

SEQ ID NO: 2564884 - DNA, 20 bp, Homo sapiens
gttcccctagtaagtgcctt

SEQ ID NO: 2564885 - DNA, 21 bp, Homo sapiens
gttcccctagtaagtgccttc

SEQ ID NO: 2564886 - DNA, 23 bp, Homo sapiens
gttcccctagtaagtgccttcca

SEQ ID NO: 2564887 - DNA, 13 bp, Homo sapiens
gttcccctcactg

SEQ ID NO: 2564888 - DNA, 14 bp, Homo sapiens
gttcccgtttctcc

SEQ ID NO: 2564889 - DNA, 12 bp, Homo sapiens
gttccctctgag

SEQ ID NO: 2564890 - DNA, 22 bp, Homo sapiens
gttccctctgagaattccaagg

SEQ ID NO: 2564891 - DNA, 16 bp, Homo sapiens
gttcccttggcctcag

SEQ ID NO: 2564892 - DNA, 20 bp, Homo sapiens
gttccctttgacgccatccc

SEQ ID NO: 2564893 - DNA, 22 bp, Homo sapiens
gttcctatggctggccactgca

SEQ ID NO: 2564894 - DNA, 18 bp, Homo sapiens
gttcctattgtcattaaa

SEQ ID NO: 2564895 - DNA, 16 bp, Homo sapiens
gttcctgaacctgatg

SEQ ID NO: 2564896 - DNA, 15 bp, Homo sapiens
gttcctgcaatgaag

SEQ ID NO: 2564897 - DNA, 20 bp, Homo sapiens
gttcctgcggagtgaagagg

SEQ ID NO: 2564898 - DNA, 20 bp, Homo sapiens
gttccttctggtgtctgctt

SEQ ID NO: 2564899 - DNA, 23 bp, Homo sapiens
gttccttgatctgtatatacaat

SEQ ID NO: 2564900 - DNA, 16 bp, Homo sapiens
gttcgagaccagtctg

SEQ ID NO: 2564901 - DNA, 19 bp, Homo sapiens
gttctaaaaattgtgatca

SEQ ID NO: 2564902 - DNA, 20 bp, Homo sapiens
gttctacctcaggcagctca

SEQ ID NO: 2564903 - DNA, 15 bp, Homo sapiens
gttctatttaatgga

SEQ ID NO: 2564904 - DNA, 18 bp, Homo sapiens
gttctatttcagtgccaa

SEQ ID NO: 2564905 - DNA, 14 bp, Homo sapiens
gttctatttggaat

SEQ ID NO: 2564906 - DNA, 15 bp, Homo sapiens
gttctatttggaatt

SEQ ID NO: 2564907 - DNA, 17 bp, Homo sapiens
gttctcacacccaccgt

SEQ ID NO: 2564908 - DNA, 12 bp, Homo sapiens
gttctcactgtt

SEQ ID NO: 2564909 - DNA, 13 bp, Homo sapiens
gttctccttttcc

SEQ ID NO: 2564910 - DNA, 15 bp, Homo sapiens
gttctctcttctcca

SEQ ID NO: 2564911 - DNA, 14 bp, Homo sapiens
gttctctgaggaca

SEQ ID NO: 2564912 - DNA, 17 bp, Homo sapiens
gttctctgccctccaag

SEQ ID NO: 2564913 - DNA, 15 bp, Homo sapiens
gttctgacattaaca

SEQ ID NO: 2564914 - DNA, 23 bp, Homo sapiens
gttctgacattaacagttttcca

SEQ ID NO: 2564915 - DNA, 15 bp, Homo sapiens
gttctgctcatcatt

SEQ ID NO: 2564916 - DNA, 13 bp, Homo sapiens
gttctgctcctct

SEQ ID NO: 2564917 - DNA, 15 bp, Homo sapiens
gttctgctcctctcc

SEQ ID NO: 2564918 - DNA, 17 bp, Homo sapiens
gttctgctcctctccag

SEQ ID NO: 2564919 - DNA, 18 bp, Homo sapiens
gttctgctcctctccagg

SEQ ID NO: 2564920 - DNA, 23 bp, Homo sapiens
gttctggccctcacccctgccct

SEQ ID NO: 2564921 - DNA, 16 bp, Homo sapiens
gttctggctcttccag

SEQ ID NO: 2564922 - DNA, 20 bp, Homo sapiens
gttctggctgccccaacctg

SEQ ID NO: 2564923 - DNA, 19 bp, Homo sapiens
gttctggtgaggccttgct

SEQ ID NO: 2564924 - DNA, 20 bp, Homo sapiens
gttctggtgaggccttgctc

SEQ ID NO: 2564925 - DNA, 12 bp, Homo sapiens
gttctgtggaaa

SEQ ID NO: 2564926 - DNA, 16 bp, Homo sapiens
gttctgtggaaagtgt

SEQ ID NO: 2564927 - DNA, 22 bp, Homo sapiens
gttctgtggaaagtgtaaagca

SEQ ID NO: 2564928 - DNA, 22 bp, Homo sapiens
gttctgtgtctttcacagctcc

SEQ ID NO: 2564929 - DNA, 23 bp, Homo sapiens
gttctgtgtctttcacagctcct

SEQ ID NO: 2564930 - DNA, 15 bp, Homo sapiens
gttcttaattgcact

SEQ ID NO: 2564931 - DNA, 19 bp, Homo sapiens
gttcttagttgctgtatgt

SEQ ID NO: 2564932 - DNA, 17 bp, Homo sapiens
gttcttagtttgcagtt

SEQ ID NO: 2564933 - DNA, 16 bp, Homo sapiens
gttcttcgggaagaga

SEQ ID NO: 2564934 - DNA, 16 bp, Homo sapiens
gttcttggtagagatt

SEQ ID NO: 2564935 - DNA, 18 bp, Homo sapiens
gttcttggtttgtaaatt

SEQ ID NO: 2564936 - DNA, 21 bp, Homo sapiens
gttcttggtttgtaaattaac

SEQ ID NO: 2564937 - DNA, 15 bp, Homo sapiens
gttctttctggagtc

SEQ ID NO: 2564938 - DNA, 16 bp, Homo sapiens
gttctttcttcctctg

SEQ ID NO: 2564939 - DNA, 18 bp, Homo sapiens
gttctttcttcctctgct

SEQ ID NO: 2564940 - DNA, 18 bp, Homo sapiens
gttctttggaaggagtga

SEQ ID NO: 2564941 - DNA, 17 bp, Homo sapiens
gttgaaaaacagctgag

SEQ ID NO: 2564942 - DNA, 15 bp, Homo sapiens
gttgaaagagtccta

SEQ ID NO: 2564943 - DNA, 18 bp, Homo sapiens
gttgacagttcatatgta

SEQ ID NO: 2564944 - DNA, 15 bp, Homo sapiens
gttgaccccagagga

SEQ ID NO: 2564945 - DNA, 19 bp, Homo sapiens
gttgacttgacagaacact

SEQ ID NO: 2564946 - DNA, 10 bp, Homo sapiens
gttgagcccc

SEQ ID NO: 2564947 - DNA, 15 bp, Homo sapiens
gttgagccccaagtc

SEQ ID NO: 2564948 - DNA, 14 bp, Homo sapiens
gttgagccttttcc

SEQ ID NO: 2564949 - DNA, 13 bp, Homo sapiens
gttgagctgtttt

SEQ ID NO: 2564950 - DNA, 13 bp, Homo sapiens
gttgataactttg

SEQ ID NO: 2564951 - DNA, 15 bp, Homo sapiens
gttgataactttgct

SEQ ID NO: 2564952 - DNA, 17 bp, Homo sapiens
gttgataactttgcttg

SEQ ID NO: 2564953 - DNA, 23 bp, Homo sapiens
gttgatagcaagtgaatttttct

SEQ ID NO: 2564954 - DNA, 19 bp, Homo sapiens
gttgatagcacagaccctg

SEQ ID NO: 2564955 - DNA, 23 bp, Homo sapiens
gttgatagcacagaccctgccct

SEQ ID NO: 2564956 - DNA, 12 bp, Homo sapiens
gttgatagttta

SEQ ID NO: 2564957 - DNA, 20 bp, Homo sapiens
gttgatcactggcaatgaaa

SEQ ID NO: 2564958 - DNA, 17 bp, Homo sapiens
gtgcatttgaggtctgt

SEQ ID NO: 2564959 - DNA, 22 bp, Homo sapiens
gtgcatttttgtgaaatgaaaa

SEQ ID NO: 2564960 - DNA, 20 bp, Homo sapiens
gtgccaacaatcctagtgct

SEQ ID NO: 2564961 - DNA, 22 bp, Homo sapiens
gtgccaacactcaagaagcagg

SEQ ID NO: 2564962 - DNA, 14 bp, Homo sapiens
gtgccaagcacagt

SEQ ID NO: 2564963 - DNA, 18 bp, Homo sapiens
gtgccaagcacagtgcct

SEQ ID NO: 2564964 - DNA, 19 bp, Homo sapiens
gtgccaagcacagtgcctg

SEQ ID NO: 2564965 - DNA, 19 bp, Homo sapiens
gtgccaatatgtattgtaa

SEQ ID NO: 2564966 - DNA, 20 bp, Homo sapiens
gtgccaatatgtattgtaaa

SEQ ID NO: 2564967 - DNA, 12 bp, Homo sapiens
gtgccagcaact

SEQ ID NO: 2564968 - DNA, 22 bp, Homo sapiens
gtgccagccgtgatgctcaggc

SEQ ID NO: 2564969 - DNA, 13 bp, Homo sapiens
gtgccagccttcc

SEQ ID NO: 2564970 - DNA, 16 bp, Homo sapiens
gtgccaggaccagtca

SEQ ID NO: 2564971 - DNA, 18 bp, Homo sapiens
gtgccaggactccccagg

SEQ ID NO: 2564972 - DNA, 16 bp, Homo sapiens
gtgccagggcagcact

SEQ ID NO: 2564973 - DNA, 16 bp, Homo sapiens
gtgcccaagctcagaa

SEQ ID NO: 2564974 - DNA, 21 bp, Homo sapiens
gtgccccatgcctgtccagcc

SEQ ID NO: 2564975 - DNA, 20 bp, Homo sapiens
gtgccccccttgccagacat

SEQ ID NO: 2564976 - DNA, 13 bp, Homo sapiens
gtgccccctcctc

SEQ ID NO: 2564977 - DNA, 20 bp, Homo sapiens
gtgccccctcctctcccatc

SEQ ID NO: 2564978 - DNA, 17 bp, Homo sapiens
gtgccccctctaccatt

SEQ ID NO: 2564979 - DNA, 14 bp, Homo sapiens
gtgccgacagaagg

SEQ ID NO: 2564980 - DNA, 14 bp, Homo sapiens
gtgccgcctgcccg

SEQ ID NO: 2564981 - DNA, 20 bp, Homo sapiens
gtgcctccaccaccactggc

SEQ ID NO: 2564982 - DNA, 15 bp, Homo sapiens
gtgcctccaggtgtg

SEQ ID NO: 2564983 - DNA, 22 bp, Homo sapiens
gtgcctccttccacctccctcc

SEQ ID NO: 2564984 - DNA, 15 bp, Homo sapiens
gtgcctctgcctgtc

SEQ ID NO: 2564985 - DNA, 23 bp, Homo sapiens
gtgcctgcctgggagttttgtat

SEQ ID NO: 2564986 - DNA, 12 bp, Homo sapiens
gtgcctggcctg

SEQ ID NO: 2564987 - DNA, 15 bp, Homo sapiens
gtgcctgggaatgta

SEQ ID NO: 2564988 - DNA, 16 bp, Homo sapiens
gtgcctgggaatgtat

SEQ ID NO: 2564989 - DNA, 20 bp, Homo sapiens
gtgccttccatgtcggcctc

SEQ ID NO: 2564990 - DNA, 20 bp, Homo sapiens
gtgccttggggaatttcctc

SEQ ID NO: 2564991 - DNA, 21 bp, Homo sapiens
gtgccttggggaatttcctct

SEQ ID NO: 2564992 - DNA, 18 bp, Homo sapiens
gtgccttttgcacccctc

SEQ ID NO: 2564993 - DNA, 22 bp, Homo sapiens
gtgccttttgcacccctcccat

SEQ ID NO: 2564994 - DNA, 14 bp, Homo sapiens
gtgccttttgccat

SEQ ID NO: 2564995 - DNA, 23 bp, Homo sapiens
gtgcgagtgtgtgcatgtgtgtg

SEQ ID NO: 2564996 - DNA, 21 bp, Homo sapiens
gtgcgatctgggttcactgca

SEQ ID NO: 2564997 - DNA, 22 bp, Homo sapiens
gtgcgccgagtctgtctctgtc

SEQ ID NO: 2564998 - DNA, 14 bp, Homo sapiens
gtgcgcctacagga

SEQ ID NO: 2564999 - DNA, 15 bp, Homo sapiens
gtgcgtgaaacacac

SEQ ID NO: 2565000 - DNA, 14 bp, Homo sapiens
gtgcgtgggtgaag

SEQ ID NO: 2565001 - DNA, 13 bp, Homo sapiens
gtgcgtgtgtgca

SEQ ID NO: 2565002 - DNA, 14 bp, Homo sapiens
gtgcgtgtttgcac

SEQ ID NO: 2565003 - DNA, 21 bp, Homo sapiens
gtgctaataacagtgcatatt

SEQ ID NO: 2565004 - DNA, 21 bp, Homo sapiens
gtgctacaaaaacacagcaag

SEQ ID NO: 2565005 - DNA, 22 bp, Homo sapiens
gtgctaggaacactccttcaca

SEQ ID NO: 2565006 - DNA, 21 bp, Homo sapiens
gtgctatactgcatacttttt

SEQ ID NO: 2565007 - DNA, 18 bp, Homo sapiens
gtgctataggctggagaa

SEQ ID NO: 2565008 - DNA, 21 bp, Homo sapiens
gtgctataggctggagaagct

SEQ ID NO: 2565009 - DNA, 15 bp, Homo sapiens
gtgctatctccccca

SEQ ID NO: 2565010 - DNA, 18 bp, Homo sapiens
gtgctatctcccccagcc

SEQ ID NO: 2565011 - DNA, 16 bp, Homo sapiens
gtgctcatttcaggat

SEQ ID NO: 2565012 - DNA, 13 bp, Homo sapiens
gtgctccgtgcct

SEQ ID NO: 2565013 - DNA, 17 bp, Homo sapiens
gtgctccgtgcctccac

SEQ ID NO: 2565014 - DNA, 18 bp, Homo sapiens
gtgctccgtgcctccacc

SEQ ID NO: 2565015 - DNA, 13 bp, Homo sapiens
gtgctctggacag

SEQ ID NO: 2565016 - DNA, 17 bp, Homo sapiens
gtgctctggacaggcat

SEQ ID NO: 2565017 - DNA, 23 bp, Homo sapiens
gtgctgaatggttttcaaaataa

SEQ ID NO: 2565018 - DNA, 15 bp, Homo sapiens
gtgctgacggaagcc

SEQ ID NO: 2565019 - DNA, 12 bp, Homo sapiens
gtgctgagtctg

SEQ ID NO: 2565020 - DNA, 16 bp, Homo sapiens
gtgctgagtctgaagg

SEQ ID NO: 2565021 - DNA, 22 bp, Homo sapiens
gtgctgatcgtgctaaattttc

SEQ ID NO: 2565022 - DNA, 20 bp, Homo sapiens
gtgctgcatttaaaagatac

SEQ ID NO: 2565023 - DNA, 19 bp, Homo sapiens
gtgctgccatccaggttca

SEQ ID NO: 2565024 - DNA, 20 bp, Homo sapiens
gtgctgccctgcccacctgg

SEQ ID NO: 2565025 - DNA, 23 bp, Homo sapiens
gtgctgccctgcccacctggcct

SEQ ID NO: 2565026 - DNA, 19 bp, Homo sapiens
gtgctgcctctacctgaca

SEQ ID NO: 2565027 - DNA, 15 bp, Homo sapiens
gtgctgctgctgctg

SEQ ID NO: 2565028 - DNA, 14 bp, Homo sapiens
gtgctggaggactg

SEQ ID NO: 2565029 - DNA, 18 bp, Homo sapiens
gtgctggcaccaccaggc

SEQ ID NO: 2565030 - DNA, 22 bp, Homo sapiens
gtgctgggactgagccagtccc

SEQ ID NO: 2565031 - DNA, 20 bp, Homo sapiens
gtgctgggattacaggcgtg

SEQ ID NO: 2565032 - DNA, 19 bp, Homo sapiens
gtgctggtgtcctgaccac

SEQ ID NO: 2565033 - DNA, 15 bp, Homo sapiens
gtgctgtgcccaagt

SEQ ID NO: 2565034 - DNA, 14 bp, Homo sapiens
gtgctgtggccagg

SEQ ID NO: 2565035 - DNA, 23 bp, Homo sapiens
gtgctgtggccagggtgagagct

SEQ ID NO: 2565036 - DNA, 13 bp, Homo sapiens
gtgctgtgtaaag

SEQ ID NO: 2565037 - DNA, 22 bp, Homo sapiens
gtgcttaagcagaagcattaac

SEQ ID NO: 2565038 - DNA, 17 bp, Homo sapiens
gtgcttcgggcccttcc

SEQ ID NO: 2565039 - DNA, 16 bp, Homo sapiens
gtgcttgccacagagc

SEQ ID NO: 2565040 - DNA, 13 bp, Homo sapiens
gtgcttggaggaa

SEQ ID NO: 2565041 - DNA, 15 bp, Homo sapiens
gtgcttgtgtgtgtg

SEQ ID NO: 2565042 - DNA, 23 bp, Homo sapiens
gtgcttgtttgctcacctggggt

SEQ ID NO: 2565043 - DNA, 13 bp, Homo sapiens
gtgctttccagct

SEQ ID NO: 2565044 - DNA, 16 bp, Homo sapiens
gtgctttccagctcac

SEQ ID NO: 2565045 - DNA, 19 bp, Homo sapiens
gtgcttttcctatttgttt

SEQ ID NO: 2565046 - DNA, 14 bp, Homo sapiens
gtggaaaaatattt

SEQ ID NO: 2565047 - DNA, 19 bp, Homo sapiens
gtggaaagtgaatttgaat

SEQ ID NO: 2565048 - DNA, 16 bp, Homo sapiens
gtggaaagtgtaaagc

SEQ ID NO: 2565049 - DNA, 19 bp, Homo sapiens
gtggaaattaagaagaaac

SEQ ID NO: 2565050 - DNA, 20 bp, Homo sapiens
gtggaaattaagaagaaact

SEQ ID NO: 2565051 - DNA, 21 bp, Homo sapiens
gtggaaccactgactactggc

SEQ ID NO: 2565052 - DNA, 22 bp, Homo sapiens
gtggaacgtttttcctgttctt

SEQ ID NO: 2565053 - DNA, 16 bp, Homo sapiens
gtggaagaagagggag

SEQ ID NO: 2565054 - DNA, 16 bp, Homo sapiens
gtggaagaggggacag

SEQ ID NO: 2565055 - DNA, 19 bp, Homo sapiens
gtggaagtgtgggtctgtg

SEQ ID NO: 2565056 - DNA, 20 bp, Homo sapiens
gtggaagtgtgggtctgtgt

SEQ ID NO: 2565057 - DNA, 14 bp, Homo sapiens
gtggaataaaatac

SEQ ID NO: 2565058 - DNA, 19 bp, Homo sapiens
gtggaatagtatcctccag

SEQ ID NO: 2565059 - DNA, 21 bp, Homo sapiens
gtggaatagtatcctccaggt

SEQ ID NO: 2565060 - DNA, 22 bp, Homo sapiens
gtggaatagtatcctccaggtt

SEQ ID NO: 2565061 - DNA, 23 bp, Homo sapiens
gtggaatagtatcctccaggttt

SEQ ID NO: 2565062 - DNA, 17 bp, Homo sapiens
gtggacacagctcttct

SEQ ID NO: 2565063 - DNA, 23 bp, Homo sapiens
gtggacacagctcttctccaggc

SEQ ID NO: 2565064 - DNA, 13 bp, Homo sapiens
gtcctccagaagc

SEQ ID NO: 2565065 - DNA, 20 bp, Homo sapiens
gtcctccagaagcctctggc

SEQ ID NO: 2565066 - DNA, 19 bp, Homo sapiens
gtcctcccatcccctggac

SEQ ID NO: 2565067 - DNA, 21 bp, Homo sapiens
gtcctcccatcccctggactg

SEQ ID NO: 2565068 - DNA, 14 bp, Homo sapiens
gtcctcccatctca

SEQ ID NO: 2565069 - DNA, 23 bp, Homo sapiens
gtcctcccatctcacacatgagc

SEQ ID NO: 2565070 - DNA, 13 bp, Homo sapiens
gtcctccccttgg

SEQ ID NO: 2565071 - DNA, 17 bp, Homo sapiens
gtcctcccgggccctcc

SEQ ID NO: 2565072 - DNA, 22 bp, Homo sapiens
gtcctcctaccgaaaccttgcc

SEQ ID NO: 2565073 - DNA, 12 bp, Homo sapiens
gtcctcctctgt

SEQ ID NO: 2565074 - DNA, 23 bp, Homo sapiens
gtcctcctggtgggtccaggggc

SEQ ID NO: 2565075 - DNA, 16 bp, Homo sapiens
gtcctctctggctggg

SEQ ID NO: 2565076 - DNA, 18 bp, Homo sapiens
gtcctctctggctgggga

SEQ ID NO: 2565077 - DNA, 19 bp, Homo sapiens
gtcctctgatacccagagc

SEQ ID NO: 2565078 - DNA, 21 bp, Homo sapiens
gtcctctggatggcaccagag

SEQ ID NO: 2565079 - DNA, 13 bp, Homo sapiens
gtcctcttctgca

SEQ ID NO: 2565080 - DNA, 15 bp, Homo sapiens
gtcctctttcaaagg

SEQ ID NO: 2565081 - DNA, 17 bp, Homo sapiens
gtcctgaagaggcgggc

SEQ ID NO: 2565082 - DNA, 20 bp, Homo sapiens
gtcctgaagaggcgggccag

SEQ ID NO: 2565083 - DNA, 14 bp, Homo sapiens
gtcctgaccaccct

SEQ ID NO: 2565084 - DNA, 17 bp, Homo sapiens
gtcctgaccaccctccc

SEQ ID NO: 2565085 - DNA, 23 bp, Homo sapiens
gtcctgaccaccctcccctctct

SEQ ID NO: 2565086 - DNA, 15 bp, Homo sapiens
gtcctgatcagagcc

SEQ ID NO: 2565087 - DNA, 19 bp, Homo sapiens
gtcctgcagtctggctgag

SEQ ID NO: 2565088 - DNA, 17 bp, Homo sapiens
gtcctgcctcagcctcc

SEQ ID NO: 2565089 - DNA, 19 bp, Homo sapiens
gtcctgcgtcgaagctttg

SEQ ID NO: 2565090 - DNA, 19 bp, Homo sapiens
gtcctgctgcagttgccag

SEQ ID NO: 2565091 - DNA, 19 bp, Homo sapiens
gtcctggagcagaccaccc

SEQ ID NO: 2565092 - DNA, 14 bp, Homo sapiens
gtcctggcctggct

SEQ ID NO: 2565093 - DNA, 19 bp, Homo sapiens
gtcctgggagaacctcagg

SEQ ID NO: 2565094 - DNA, 17 bp, Homo sapiens
gtcctgggagtgagctg

SEQ ID NO: 2565095 - DNA, 18 bp, Homo sapiens
gtcctgggagtgagctgg

SEQ ID NO: 2565096 - DNA, 19 bp, Homo sapiens
gtcctgggagtgagctggt

SEQ ID NO: 2565097 - DNA, 19 bp, Homo sapiens
gtcctgggcgccctggaag

SEQ ID NO: 2565098 - DNA, 23 bp, Homo sapiens
gtccttaaacagggcatctccag

SEQ ID NO: 2565099 - DNA, 16 bp, Homo sapiens
gtccttaccagcagag

SEQ ID NO: 2565100 - DNA, 15 bp, Homo sapiens
gtccttcacctcact

SEQ ID NO: 2565101 - DNA, 15 bp, Homo sapiens
gtccttcagatggaa

SEQ ID NO: 2565102 - DNA, 14 bp, Homo sapiens
gtccttccacctcg

SEQ ID NO: 2565103 - DNA, 11 bp, Homo sapiens
gtccttgaaaa

SEQ ID NO: 2565104 - DNA, 18 bp, Homo sapiens
gtccttgcacccctcact

SEQ ID NO: 2565105 - DNA, 22 bp, Homo sapiens
gtccttgctggttttctggatg

SEQ ID NO: 2565106 - DNA, 17 bp, Homo sapiens
gtccttggaagtttcat

SEQ ID NO: 2565107 - DNA, 16 bp, Homo sapiens
gtcctttatgtggaaa

SEQ ID NO: 2565108 - DNA, 20 bp, Homo sapiens
gtcctttatgtggaaaacag

SEQ ID NO: 2565109 - DNA, 21 bp, Homo sapiens
gtcctttatgtggaaaacaga

SEQ ID NO: 2565110 - DNA, 20 bp, Homo sapiens
gtcctttccaaggcttctcc

SEQ ID NO: 2565111 - DNA, 14 bp, Homo sapiens
gtcgcccagtctgg

SEQ ID NO: 2565112 - DNA, 23 bp, Homo sapiens
gtcgcccagtctggaatgcagtg

SEQ ID NO: 2565113 - DNA, 18 bp, Homo sapiens
gtcgctctgctggcctgg

SEQ ID NO: 2565114 - DNA, 20 bp, Homo sapiens
gtcgctctgctggcctggcc

SEQ ID NO: 2565115 - DNA, 20 bp, Homo sapiens
gtcggcctctaaccccaggc

SEQ ID NO: 2565116 - DNA, 22 bp, Homo sapiens
gtcggcctctaaccccaggccc

SEQ ID NO: 2565117 - DNA, 17 bp, Homo sapiens
gtcggggggacagctcc

SEQ ID NO: 2565118 - DNA, 23 bp, Homo sapiens
gtcgggttttattgtttaaaatc

SEQ ID NO: 2565119 - DNA, 22 bp, Homo sapiens
gtcgtggcagataatcagcctc

SEQ ID NO: 2565120 - DNA, 19 bp, Homo sapiens
gtcgttgactttagggact

SEQ ID NO: 2565121 - DNA, 14 bp, Homo sapiens
gtctaaaacaataa

SEQ ID NO: 2565122 - DNA, 16 bp, Homo sapiens
gtctaaatatttcctt

SEQ ID NO: 2565123 - DNA, 15 bp, Homo sapiens
gtctacactgtgctg

SEQ ID NO: 2565124 - DNA, 17 bp, Homo sapiens
gtctacccagagaagcc

SEQ ID NO: 2565125 - DNA, 13 bp, Homo sapiens
gtctacctgaggg

SEQ ID NO: 2565126 - DNA, 16 bp, Homo sapiens
gtctacctgaggggcc

SEQ ID NO: 2565127 - DNA, 17 bp, Homo sapiens
gtctactcttaagccat

SEQ ID NO: 2565128 - DNA, 21 bp, Homo sapiens
gtctagaagttgtttgtcatc

SEQ ID NO: 2565129 - DNA, 23 bp, Homo sapiens
gtctaggcaggacctgtggccaa

SEQ ID NO: 2565130 - DNA, 20 bp, Homo sapiens
gtctataatcccagcacttt

SEQ ID NO: 2565131 - DNA, 21 bp, Homo sapiens
gtctataatcccagcactttg

SEQ ID NO: 2565132 - DNA, 14 bp, Homo sapiens
gtctatatgtttgt

SEQ ID NO: 2565133 - DNA, 13 bp, Homo sapiens
gtctatccacaga

SEQ ID NO: 2565134 - DNA, 14 bp, Homo sapiens
gtctatgggactca

SEQ ID NO: 2565135 - DNA, 22 bp, Homo sapiens
gtctatgtaaatgcatctgtcc

SEQ ID NO: 2565136 - DNA, 21 bp, Homo sapiens
gtctcaacccttttgtctgcc

SEQ ID NO: 2565137 - DNA, 19 bp, Homo sapiens
gtctcaagggctagcatcc

SEQ ID NO: 2565138 - DNA, 21 bp, Homo sapiens
gtctcactatgttgcccaggc

SEQ ID NO: 2565139 - DNA, 16 bp, Homo sapiens
gtctcactctgtcgcc

SEQ ID NO: 2565140 - DNA, 22 bp, Homo sapiens
gtctcactctgtcgcccagtct

SEQ ID NO: 2565141 - DNA, 18 bp, Homo sapiens
gtctcactgttgcccagg

SEQ ID NO: 2565142 - DNA, 20 bp, Homo sapiens
gtctcactgttgcccaggct

SEQ ID NO: 2565143 - DNA, 21 bp, Homo sapiens
gtctcactgttgcccaggctg

SEQ ID NO: 2565144 - DNA, 22 bp, Homo sapiens
gtctcacttgtgcagtgttgac

SEQ ID NO: 2565145 - DNA, 15 bp, Homo sapiens
gtctcaggacctagg

SEQ ID NO: 2565146 - DNA, 12 bp, Homo sapiens
gtctcaggagca

SEQ ID NO: 2565147 - DNA, 16 bp, Homo sapiens
gtctcaggagcatggg

SEQ ID NO: 2565148 - DNA, 21 bp, Homo sapiens
gtctcagtttgtgtgtcttaa

SEQ ID NO: 2565149 - DNA, 11 bp, Homo sapiens
gtctcatgtgt

SEQ ID NO: 2565150 - DNA, 21 bp, Homo sapiens
gtctccagtatccactttgca

SEQ ID NO: 2565151 - DNA, 20 bp, Homo sapiens
gtctccagtggttgctgttg

SEQ ID NO: 2565152 - DNA, 14 bp, Homo sapiens
gtctccatggccct

SEQ ID NO: 2565153 - DNA, 15 bp, Homo sapiens
gtctcccttctccca

SEQ ID NO: 2565154 - DNA, 14 bp, Homo sapiens
gtctcctcactccc

SEQ ID NO: 2565155 - DNA, 13 bp, Homo sapiens
gtctcctcagcct

SEQ ID NO: 2565156 - DNA, 20 bp, Homo sapiens
gtctcctttgcactgagggc

SEQ ID NO: 2565157 - DNA, 16 bp, Homo sapiens
gtctcggactaagcct

SEQ ID NO: 2565158 - DNA, 13 bp, Homo sapiens
gtctctaggctgg

SEQ ID NO: 2565159 - DNA, 16 bp, Homo sapiens
gtctctagtgctgtga

SEQ ID NO: 2565160 - DNA, 13 bp, Homo sapiens
gtctctctcccat

SEQ ID NO: 2565161 - DNA, 16 bp, Homo sapiens
gtctctctcccatgga

SEQ ID NO: 2565162 - DNA, 19 bp, Homo sapiens
gtctctctctctctacaaa

SEQ ID NO: 2565163 - DNA, 14 bp, Homo sapiens
gtctctgagggctt

SEQ ID NO: 2565164 - DNA, 21 bp, Homo sapiens
gtctctgagggcttcctttgg

SEQ ID NO: 2565165 - DNA, 18 bp, Homo sapiens
gtctctgccggctctttc

SEQ ID NO: 2565166 - DNA, 13 bp, Homo sapiens
gtctctggcctgt

SEQ ID NO: 2565167 - DNA, 14 bp, Homo sapiens
gtctcttctgagct

SEQ ID NO: 2565168 - DNA, 13 bp, Homo sapiens
gtctcttgaggga

SEQ ID NO: 2565169 - DNA, 23 bp, Homo sapiens
gtctcttgagggagcttagccaa

SEQ ID NO: 2565170 - DNA, 20 bp, Homo sapiens
gtctcttggtcctgctgcag

SEQ ID NO: 2565171 - DNA, 17 bp, Homo sapiens
gtctctttaatcttcag

SEQ ID NO: 2565172 - DNA, 23 bp, Homo sapiens
gtctctttaatgtcacaggcagg

SEQ ID NO: 2565173 - DNA, 14 bp, Homo sapiens
gtctgaatgttctg

SEQ ID NO: 2565174 - DNA, 15 bp, Homo sapiens
gtctgaatgttctga

SEQ ID NO: 2565175 - DNA, 18 bp, Homo sapiens
gtctgaatgttctgacat

SEQ ID NO: 2565176 - DNA, 22 bp, Homo sapiens
gtctgacaggcaatgctggctg

SEQ ID NO: 2565177 - DNA, 14 bp, Homo sapiens
gtctgactgtgtgt

SEQ ID NO: 2565178 - DNA, 18 bp, Homo sapiens
gtctgaggaatccagacc

SEQ ID NO: 2565179 - DNA, 22 bp, Homo sapiens
gtctgaggggcaactgagtctg

SEQ ID NO: 2565180 - DNA, 19 bp, Homo sapiens
gtctgatcgtgacgctgaa

SEQ ID NO: 2565181 - DNA, 20 bp, Homo sapiens
gtctgatcgtgacgctgaat

SEQ ID NO: 2565182 - DNA, 21 bp, Homo sapiens
gtctgatctgtgctttccagc

SEQ ID NO: 2565183 - DNA, 23 bp, Homo sapiens
gtctgatctgtgctttccagctc

SEQ ID NO: 2565184 - DNA, 24 bp, Homo sapiens
gtctgatctgtgctttccagctca

SEQ ID NO: 2565185 - DNA, 17 bp, Homo sapiens
gtctgattcccaagctc

SEQ ID NO: 2565186 - DNA, 21 bp, Homo sapiens
gtctgattcccaagctctgct

SEQ ID NO: 2565187 - DNA, 16 bp, Homo sapiens
gtctgatttgtgatga

SEQ ID NO: 2565188 - DNA, 22 bp, Homo sapiens
gtctgcaagattctgaaacatt

SEQ ID NO: 2565189 - DNA, 13 bp, Homo sapiens
gtctgcaagtcag

SEQ ID NO: 2565190 - DNA, 16 bp, Homo sapiens
gtctgcaagtcagagg

SEQ ID NO: 2565191 - DNA, 12 bp, Homo sapiens
gtctgcaggcag

SEQ ID NO: 2565192 - DNA, 16 bp, Homo sapiens
gtctgctgccctccat

SEQ ID NO: 2565193 - DNA, 18 bp, Homo sapiens
gtctgctgccctccatcc

SEQ ID NO: 2565194 - DNA, 16 bp, Homo sapiens
gtctggctgagccctg

SEQ ID NO: 2565195 - DNA, 15 bp, Homo sapiens
gtctggctgagctga

SEQ ID NO: 2565196 - DNA, 15 bp, Homo sapiens
gtctggcttcacaga

SEQ ID NO: 2565197 - DNA, 20 bp, Homo sapiens
gtctgggacttccttgctct

SEQ ID NO: 2565198 - DNA, 16 bp, Homo sapiens
gtctgggagaaattga

SEQ ID NO: 2565199 - DNA, 13 bp, Homo sapiens
gtctggtgggagg

SEQ ID NO: 2565200 - DNA, 16 bp, Homo sapiens
gtctggttttaacaat

SEQ ID NO: 2565201 - DNA, 20 bp, Homo sapiens
gtctgtacacgtgtcctgta

SEQ ID NO: 2565202 - DNA, 19 bp, Homo sapiens
gtctgtagagggccctggt

SEQ ID NO: 2565203 - DNA, 22 bp, Homo sapiens
gtctgtagagggccctggtgtt

SEQ ID NO: 2565204 - DNA, 19 bp, Homo sapiens
gtctgtatttatgtgtgag

SEQ ID NO: 2565205 - DNA, 22 bp, Homo sapiens
gtctgtcatgaacatgttcctg

SEQ ID NO: 2565206 - DNA, 23 bp, Homo sapiens
gtctgtcccggggtcctgtggca

SEQ ID NO: 2565207 - DNA, 20 bp, Homo sapiens
gtctgtggctttcagcctct

SEQ ID NO: 2565208 - DNA, 11 bp, Homo sapiens
gtctgtgtgtg

SEQ ID NO: 2565209 - DNA, 12 bp, Homo sapiens
gtctgtgtgtgt

SEQ ID NO: 2565210 - DNA, 22 bp, Homo sapiens
gtctgtgtgtttatgtgtgtgt

SEQ ID NO: 2565211 - DNA, 16 bp, Homo sapiens
gtctgttaacttaata

SEQ ID NO: 2565212 - DNA, 17 bp, Homo sapiens
gtctgtttataaacatt

SEQ ID NO: 2565213 - DNA, 13 bp, Homo sapiens
gtctgttttatga

SEQ ID NO: 2565214 - DNA, 15 bp, Homo sapiens
gtcagccagggccag

SEQ ID NO: 2565215 - DNA, 16 bp, Homo sapiens
gtcagccagggccagg

SEQ ID NO: 2565216 - DNA, 16 bp, Homo sapiens
gtcagccgggccctga

SEQ ID NO: 2565217 - DNA, 12 bp, Homo sapiens
gtcagcctccag

SEQ ID NO: 2565218 - DNA, 14 bp, Homo sapiens
gtcagcctccagcc

SEQ ID NO: 2565219 - DNA, 16 bp, Homo sapiens
gtcagcctccagcctc

SEQ ID NO: 2565220 - DNA, 11 bp, Homo sapiens
gtcagcctctc

SEQ ID NO: 2565221 - DNA, 20 bp, Homo sapiens
gtcagcctctctcccagtct

SEQ ID NO: 2565222 - DNA, 21 bp, Homo sapiens
gtcagcctctctcccagtcta

SEQ ID NO: 2565223 - DNA, 21 bp, Homo sapiens
gtcagctcccctcggagaaga

SEQ ID NO: 2565224 - DNA, 18 bp, Homo sapiens
gtcagctttgccttccac

SEQ ID NO: 2565225 - DNA, 15 bp, Homo sapiens
gtcaggaacagaagg

SEQ ID NO: 2565226 - DNA, 12 bp, Homo sapiens
gtcaggagagca

SEQ ID NO: 2565227 - DNA, 21 bp, Homo sapiens
gtcaggcccttattttcaaga

SEQ ID NO: 2565228 - DNA, 15 bp, Homo sapiens
gtcaggcctgtgtgt

SEQ ID NO: 2565229 - DNA, 13 bp, Homo sapiens
gtcaggctgctgg

SEQ ID NO: 2565230 - DNA, 16 bp, Homo sapiens
gtcaggctgctggcgc

SEQ ID NO: 2565231 - DNA, 16 bp, Homo sapiens
gtcagggaccaaggac

SEQ ID NO: 2565232 - DNA, 19 bp, Homo sapiens
gtcagggcccaagtccctg

SEQ ID NO: 2565233 - DNA, 14 bp, Homo sapiens
gtcaggggcagctg

SEQ ID NO: 2565234 - DNA, 18 bp, Homo sapiens
gtcaggtggggcagcttg

SEQ ID NO: 2565235 - DNA, 21 bp, Homo sapiens
gtcagtatctgtatctctctc

SEQ ID NO: 2565236 - DNA, 17 bp, Homo sapiens
gtcagtatgtggaagtg

SEQ ID NO: 2565237 - DNA, 19 bp, Homo sapiens
gtcagtcatgatggcacca

SEQ ID NO: 2565238 - DNA, 23 bp, Homo sapiens
gtcagtgaggcccagggagaggc

SEQ ID NO: 2565239 - DNA, 18 bp, Homo sapiens
gtcataactaaataaagc

SEQ ID NO: 2565240 - DNA, 13 bp, Homo sapiens
gtcatagaaatta

SEQ ID NO: 2565241 - DNA, 22 bp, Homo sapiens
gtcatagaaattacacccaaag

SEQ ID NO: 2565242 - DNA, 12 bp, Homo sapiens
gtcatattttga

SEQ ID NO: 2565243 - DNA, 20 bp, Homo sapiens
gtcatattttgattattgta

SEQ ID NO: 2565244 - DNA, 17 bp, Homo sapiens
gtcatcacttttcagtg

SEQ ID NO: 2565245 - DNA, 16 bp, Homo sapiens
gtcatctcagctggat

SEQ ID NO: 2565246 - DNA, 16 bp, Homo sapiens
gtcatctggtagattt

SEQ ID NO: 2565247 - DNA, 20 bp, Homo sapiens
gtcatcttgaccaagcagga

SEQ ID NO: 2565248 - DNA, 18 bp, Homo sapiens
gtcatctttttctctaaa

SEQ ID NO: 2565249 - DNA, 20 bp, Homo sapiens
gtcatgaattcttatgctta

SEQ ID NO: 2565250 - DNA, 18 bp, Homo sapiens
gtcatgagctgagcaggg

SEQ ID NO: 2565251 - DNA, 16 bp, Homo sapiens
gtcatgcaaaggctgg

SEQ ID NO: 2565252 - DNA, 15 bp, Homo sapiens
gtcatgcccccctca

SEQ ID NO: 2565253 - DNA, 20 bp, Homo sapiens
gtcatggcttaatgtttatt

SEQ ID NO: 2565254 - DNA, 20 bp, Homo sapiens
gtcatgtaagctgaaaatat

SEQ ID NO: 2565255 - DNA, 17 bp, Homo sapiens
gtcatgttccttcaaga

SEQ ID NO: 2565256 - DNA, 23 bp, Homo sapiens
gtcatgttggtcaaaagctggat

SEQ ID NO: 2565257 - DNA, 12 bp, Homo sapiens
gtcattaaaggt

SEQ ID NO: 2565258 - DNA, 11 bp, Homo sapiens
gtcattaaatg

SEQ ID NO: 2565259 - DNA, 16 bp, Homo sapiens
gtcattagactcctcc

SEQ ID NO: 2565260 - DNA, 18 bp, Homo sapiens
gtcattgctgttgtccct

SEQ ID NO: 2565261 - DNA, 22 bp, Homo sapiens
gtcattgctgttgtccctctgc

SEQ ID NO: 2565262 - DNA, 21 bp, Homo sapiens
gtcatttgagcagggctcagc

SEQ ID NO: 2565263 - DNA, 17 bp, Homo sapiens
gtccaaagcagggtctg

SEQ ID NO: 2565264 - DNA, 11 bp, Homo sapiens
gtccaaataaa

SEQ ID NO: 2565265 - DNA, 22 bp, Homo sapiens
gtccaaatgtcctccagaagcc

SEQ ID NO: 2565266 - DNA, 20 bp, Homo sapiens
gtccaacccgaggcccgcat

SEQ ID NO: 2565267 - DNA, 15 bp, Homo sapiens
gtccaagaagcccag

SEQ ID NO: 2565268 - DNA, 17 bp, Homo sapiens
gtccaaggaaaccacag

SEQ ID NO: 2565269 - DNA, 22 bp, Homo sapiens
gtccaaggaaaccacagctgct

SEQ ID NO: 2565270 - DNA, 15 bp, Homo sapiens
gtccaagtgtgtgtg

SEQ ID NO: 2565271 - DNA, 12 bp, Homo sapiens
gtccaatcctat

SEQ ID NO: 2565272 - DNA, 19 bp, Homo sapiens
gtccaatttgtaaaaacag

SEQ ID NO: 2565273 - DNA, 13 bp, Homo sapiens
gtccacaggaagt

SEQ ID NO: 2565274 - DNA, 20 bp, Homo sapiens
gtccacccacctatgtgcca

SEQ ID NO: 2565275 - DNA, 16 bp, Homo sapiens
gtccacccaggagccc

SEQ ID NO: 2565276 - DNA, 23 bp, Homo sapiens
gtccacccaggagccccgaggcc

SEQ ID NO: 2565277 - DNA, 15 bp, Homo sapiens
gtccactcccagtgc

SEQ ID NO: 2565278 - DNA, 14 bp, Homo sapiens
gtccactgtgtata

SEQ ID NO: 2565279 - DNA, 15 bp, Homo sapiens
gtccagaagaatatt

SEQ ID NO: 2565280 - DNA, 22 bp, Homo sapiens
gtccagaagaatattcaggact

SEQ ID NO: 2565281 - DNA, 14 bp, Homo sapiens
gtccagacagcctg

SEQ ID NO: 2565282 - DNA, 15 bp, Homo sapiens
gtccagacagcctgt

SEQ ID NO: 2565283 - DNA, 20 bp, Homo sapiens
gtccagagagagaagtgccc

SEQ ID NO: 2565284 - DNA, 23 bp, Homo sapiens
gtccagagagagaagtgcccctg

SEQ ID NO: 2565285 - DNA, 22 bp, Homo sapiens
gtccagatttacactgggagag

SEQ ID NO: 2565286 - DNA, 21 bp, Homo sapiens
ggctgggttctacccaggtgc

SEQ ID NO: 2565287 - DNA, 22 bp, Homo sapiens
ggctgggttctacccaggtgct

SEQ ID NO: 2565288 - DNA, 14 bp, Homo sapiens
ggctgggttggagg

SEQ ID NO: 2565289 - DNA, 15 bp, Homo sapiens
ggctggtagctcagg

SEQ ID NO: 2565290 - DNA, 15 bp, Homo sapiens
ggctggtgccagcct

SEQ ID NO: 2565291 - DNA, 19 bp, Homo sapiens
ggctgtatcccatgagcct

SEQ ID NO: 2565292 - DNA, 20 bp, Homo sapiens
ggctgtatcccatgagcctc

SEQ ID NO: 2565293 - DNA, 13 bp, Homo sapiens
ggctgtgaggccc

SEQ ID NO: 2565294 - DNA, 13 bp, Homo sapiens
ggctgtgcctctg

SEQ ID NO: 2565295 - DNA, 20 bp, Homo sapiens
ggctgtgctccctggttctg

SEQ ID NO: 2565296 - DNA, 21 bp, Homo sapiens
ggctgtgggcctcaaggactt

SEQ ID NO: 2565297 - DNA, 20 bp, Homo sapiens
ggctgttggctgggggcctc

SEQ ID NO: 2565298 - DNA, 12 bp, Homo sapiens
ggcttaatgttt

SEQ ID NO: 2565299 - DNA, 16 bp, Homo sapiens
ggcttaatgtttattc

SEQ ID NO: 2565300 - DNA, 14 bp, Homo sapiens
ggcttagtcactga

SEQ ID NO: 2565301 - DNA, 21 bp, Homo sapiens
ggcttcacggaagagccttgc

SEQ ID NO: 2565302 - DNA, 19 bp, Homo sapiens
ggcttcactgtataaatag

SEQ ID NO: 2565303 - DNA, 21 bp, Homo sapiens
ggcttcactgtataaatagga

SEQ ID NO: 2565304 - DNA, 17 bp, Homo sapiens
ggcttcagcatatttat

SEQ ID NO: 2565305 - DNA, 16 bp, Homo sapiens
ggcttcagtggcagct

SEQ ID NO: 2565306 - DNA, 18 bp, Homo sapiens
ggcttcagtggcagctgc

SEQ ID NO: 2565307 - DNA, 12 bp, Homo sapiens
ggcttccaggta

SEQ ID NO: 2565308 - DNA, 22 bp, Homo sapiens
ggcttccatttgtgtgtgtgca

SEQ ID NO: 2565309 - DNA, 20 bp, Homo sapiens
ggcttcccagtggctgctgc

SEQ ID NO: 2565310 - DNA, 21 bp, Homo sapiens
ggcttcccagtggctgctgcc

SEQ ID NO: 2565311 - DNA, 16 bp, Homo sapiens
ggcttcctcatagtat

SEQ ID NO: 2565312 - DNA, 14 bp, Homo sapiens
ggcttctctctgtg

SEQ ID NO: 2565313 - DNA, 13 bp, Homo sapiens
ggcttctgcaccc

SEQ ID NO: 2565314 - DNA, 21 bp, Homo sapiens
ggcttctgcaccctccaccct

SEQ ID NO: 2565315 - DNA, 16 bp, Homo sapiens
ggcttctggagccctt

SEQ ID NO: 2565316 - DNA, 18 bp, Homo sapiens
ggcttctggagcccttgg

SEQ ID NO: 2565317 - DNA, 16 bp, Homo sapiens
ggcttgccacagctct

SEQ ID NO: 2565318 - DNA, 14 bp, Homo sapiens
ggcttgcctgcagg

SEQ ID NO: 2565319 - DNA, 23 bp, Homo sapiens
ggcttgggcttccatttgtgtgt

SEQ ID NO: 2565320 - DNA, 16 bp, Homo sapiens
ggctttcccttatcaa

SEQ ID NO: 2565321 - DNA, 20 bp, Homo sapiens
ggcttttattaatgcacttt

SEQ ID NO: 2565322 - DNA, 10 bp, Homo sapiens
ggcttttgtg

SEQ ID NO: 2565323 - DNA, 16 bp, Homo sapiens
ggctttttttttctct

SEQ ID NO: 2565324 - DNA, 17 bp, Homo sapiens
ggctttttttttctctt

SEQ ID NO: 2565325 - DNA, 15 bp, Homo sapiens
gggaaagccacctct

SEQ ID NO: 2565326 - DNA, 15 bp, Homo sapiens
gggaaaggatatttt

SEQ ID NO: 2565327 - DNA, 14 bp, Homo sapiens
gggaaatggtgcct

SEQ ID NO: 2565328 - DNA, 20 bp, Homo sapiens
gggaacccaagtccaagcat

SEQ ID NO: 2565329 - DNA, 23 bp, Homo sapiens
gggaactcacctggggctgctgg

SEQ ID NO: 2565330 - DNA, 16 bp, Homo sapiens
gggaagaaagagaagg

SEQ ID NO: 2565331 - DNA, 15 bp, Homo sapiens
gggaagacgaggccc

SEQ ID NO: 2565332 - DNA, 18 bp, Homo sapiens
gggaagagaggagttcaa

SEQ ID NO: 2565333 - DNA, 22 bp, Homo sapiens
gggaagagaggagttcaatgat

SEQ ID NO: 2565334 - DNA, 23 bp, Homo sapiens
gggaagagaggagttcaatgatc

SEQ ID NO: 2565335 - DNA, 17 bp, Homo sapiens
gggaagagtgtactggg

SEQ ID NO: 2565336 - DNA, 20 bp, Homo sapiens
gggaaggagggttagggagg

SEQ ID NO: 2565337 - DNA, 16 bp, Homo sapiens
gggaaggatacaaaag

SEQ ID NO: 2565338 - DNA, 13 bp, Homo sapiens
gggaagggccagt

SEQ ID NO: 2565339 - DNA, 14 bp, Homo sapiens
gggaagggggctgg

SEQ ID NO: 2565340 - DNA, 12 bp, Homo sapiens
gggaatatttta

SEQ ID NO: 2565341 - DNA, 12 bp, Homo sapiens
gggaatcaagat

SEQ ID NO: 2565342 - DNA, 24 bp, Homo sapiens
gggaatgaagcttgtgtatccatt

SEQ ID NO: 2565343 - DNA, 20 bp, Homo sapiens
gggaatgaggcttgctgaga

SEQ ID NO: 2565344 - DNA, 21 bp, Homo sapiens
gggaatgaggcttgctgagag

SEQ ID NO: 2565345 - DNA, 21 bp, Homo sapiens
gggaatgtttgcctctgcctc

SEQ ID NO: 2565346 - DNA, 13 bp, Homo sapiens
gggaatttcctct

SEQ ID NO: 2565347 - DNA, 18 bp, Homo sapiens
gggacaaaacccaccttg

SEQ ID NO: 2565348 - DNA, 14 bp, Homo sapiens
gggacaccagccag

SEQ ID NO: 2565349 - DNA, 15 bp, Homo sapiens
gggacagaggcctgc

SEQ ID NO: 2565350 - DNA, 15 bp, Homo sapiens
gggacagagtctggg

SEQ ID NO: 2565351 - DNA, 12 bp, Homo sapiens
gggacagctcct

SEQ ID NO: 2565352 - DNA, 15 bp, Homo sapiens
gggacagctccttct

SEQ ID NO: 2565353 - DNA, 14 bp, Homo sapiens
gggacagggctcgc

SEQ ID NO: 2565354 - DNA, 12 bp, Homo sapiens
gggacagggctg

SEQ ID NO: 2565355 - DNA, 18 bp, Homo sapiens
gggacagggctggcccag

SEQ ID NO: 2565356 - DNA, 20 bp, Homo sapiens
gggacagggctggcccagcc

SEQ ID NO: 2565357 - DNA, 15 bp, Homo sapiens
gggacatctctttga

SEQ ID NO: 2565358 - DNA, 15 bp, Homo sapiens
gggacattgggaagg

SEQ ID NO: 2565359 - DNA, 16 bp, Homo sapiens
gggaccaactgggccc

SEQ ID NO: 2565360 - DNA, 19 bp, Homo sapiens
gggaccaaggcaaggcagg

SEQ ID NO: 2565361 - DNA, 23 bp, Homo sapiens
gggaccaaggcaaggcaggtgcc

SEQ ID NO: 2565362 - DNA, 13 bp, Homo sapiens
gggacccctcctc

SEQ ID NO: 2565363 - DNA, 23 bp, Homo sapiens
gggaccgccagatggggcctctg

SEQ ID NO: 2565364 - DNA, 22 bp, Homo sapiens
gggacctcccctgaggctcagg

SEQ ID NO: 2565365 - DNA, 12 bp, Homo sapiens
gggacctctccc

SEQ ID NO: 2565366 - DNA, 23 bp, Homo sapiens
gggacctctcccagggtccctgg

SEQ ID NO: 2565367 - DNA, 17 bp, Homo sapiens
gggactcaatgcactga

SEQ ID NO: 2565368 - DNA, 20 bp, Homo sapiens
gggactcaatttctccccag

SEQ ID NO: 2565369 - DNA, 16 bp, Homo sapiens
gggactcagccctgag

SEQ ID NO: 2565370 - DNA, 19 bp, Homo sapiens
gggactctgaagcctctgg

SEQ ID NO: 2565371 - DNA, 13 bp, Homo sapiens
gggactgagccag

SEQ ID NO: 2565372 - DNA, 21 bp, Homo sapiens
gggactgaggggaggggagca

SEQ ID NO: 2565373 - DNA, 21 bp, Homo sapiens
gggactgtctttcagatacat

SEQ ID NO: 2565374 - DNA, 17 bp, Homo sapiens
gggacttggaagctccg

SEQ ID NO: 2565375 - DNA, 14 bp, Homo sapiens
gggagaacctcagg

SEQ ID NO: 2565376 - DNA, 15 bp, Homo sapiens
gggagaatcatgtga

SEQ ID NO: 2565377 - DNA, 14 bp, Homo sapiens
gggagacactggcc

SEQ ID NO: 2565378 - DNA, 14 bp, Homo sapiens
gggagactgggctg

SEQ ID NO: 2565379 - DNA, 16 bp, Homo sapiens
gggagactgggctgag

SEQ ID NO: 2565380 - DNA, 14 bp, Homo sapiens
gggagagcaggctg

SEQ ID NO: 2565381 - DNA, 14 bp, Homo sapiens
gggagagccagctc

SEQ ID NO: 2565382 - DNA, 15 bp, Homo sapiens
gggagagccagctcc

SEQ ID NO: 2565383 - DNA, 19 bp, Homo sapiens
gggagagccttccaggggt

SEQ ID NO: 2565384 - DNA, 21 bp, Homo sapiens
gggagaggatttttttctgag

SEQ ID NO: 2565385 - DNA, 22 bp, Homo sapiens
gggagaggccatgattcgccca

SEQ ID NO: 2565386 - DNA, 16 bp, Homo sapiens
gggagaggtgccagca

SEQ ID NO: 2565387 - DNA, 13 bp, Homo sapiens
gggagcagagaca

SEQ ID NO: 2565388 - DNA, 16 bp, Homo sapiens
gggagcatggctgtga

SEQ ID NO: 2565389 - DNA, 12 bp, Homo sapiens
gggagccagggc

SEQ ID NO: 2565390 - DNA, 21 bp, Homo sapiens
gggagccccagggtcttccct

SEQ ID NO: 2565391 - DNA, 16 bp, Homo sapiens
gggagcccccgccccg

SEQ ID NO: 2565392 - DNA, 16 bp, Homo sapiens
gggagccgctggcaga

SEQ ID NO: 2565393 - DNA, 20 bp, Homo sapiens
gggagctcctctcctggagg

SEQ ID NO: 2565394 - DNA, 22 bp, Homo sapiens
gggagctcctctcctggaggat

SEQ ID NO: 2565395 - DNA, 12 bp, Homo sapiens
gggagctctgca

SEQ ID NO: 2565396 - DNA, 13 bp, Homo sapiens
gggagctgcctgt

SEQ ID NO: 2565397 - DNA, 24 bp, Homo sapiens
gggaggaaatttgaatgggtccat

SEQ ID NO: 2565398 - DNA, 21 bp, Homo sapiens
gggaggaccagggcagggcca

SEQ ID NO: 2565399 - DNA, 14 bp, Homo sapiens
gggaggagaatgag

SEQ ID NO: 2565400 - DNA, 17 bp, Homo sapiens
gggaggatcactggagc

SEQ ID NO: 2565401 - DNA, 20 bp, Homo sapiens
gggaggcagaggttgcagtg

SEQ ID NO: 2565402 - DNA, 11 bp, Homo sapiens
gggaggcccca

SEQ ID NO: 2565403 - DNA, 17 bp, Homo sapiens
gggaggcctaggcgggc

SEQ ID NO: 2565404 - DNA, 14 bp, Homo sapiens
gggaggcgcgagcc

SEQ ID NO: 2565405 - DNA, 21 bp, Homo sapiens
gggaggcggacgttccagccg

SEQ ID NO: 2565406 - DNA, 18 bp, Homo sapiens
gggaggcggagagtacag

SEQ ID NO: 2565407 - DNA, 14 bp, Homo sapiens
gggagggctccaga

SEQ ID NO: 2565408 - DNA, 17 bp, Homo sapiens
gggagggctccagacac

SEQ ID NO: 2565409 - DNA, 20 bp, Homo sapiens
gggaggggcgctggcccagc

SEQ ID NO: 2565410 - DNA, 21 bp, Homo sapiens
gggaggggcgctggcccagcc

SEQ ID NO: 2565411 - DNA, 15 bp, Homo sapiens
gggaggtcgaggcag

SEQ ID NO: 2565412 - DNA, 17 bp, Homo sapiens
gggaggtgggatcctcc

SEQ ID NO: 2565413 - DNA, 17 bp, Homo sapiens
gggagtccccttttctt

SEQ ID NO: 2565414 - DNA, 23 bp, Homo sapiens
gggagtctgaagcagatgcaaag

SEQ ID NO: 2565415 - DNA, 20 bp, Homo sapiens
gggagtgggacagagtctgg

SEQ ID NO: 2565416 - DNA, 21 bp, Homo sapiens
gggagtttctttcctgccttc

SEQ ID NO: 2565417 - DNA, 13 bp, Homo sapiens
gggatagagagag

SEQ ID NO: 2565418 - DNA, 13 bp, Homo sapiens
gggatagatgtgt

SEQ ID NO: 2565419 - DNA, 14 bp, Homo sapiens
gggatagatgtgtg

SEQ ID NO: 2565420 - DNA, 15 bp, Homo sapiens
gggatataggagagg

SEQ ID NO: 2565421 - DNA, 16 bp, Homo sapiens
gggatataggagagga

SEQ ID NO: 2565422 - DNA, 16 bp, Homo sapiens
gggatcctccaggtgc

SEQ ID NO: 2565423 - DNA, 15 bp, Homo sapiens
gggatgaaagagaag

SEQ ID NO: 2565424 - DNA, 20 bp, Homo sapiens
gggatgacatgcactcagct

SEQ ID NO: 2565425 - DNA, 15 bp, Homo sapiens
ggtgcgatctgggtt

SEQ ID NO: 2565426 - DNA, 21 bp, Homo sapiens
ggtgctacaaaaacacagcaa

SEQ ID NO: 2565427 - DNA, 19 bp, Homo sapiens
ggtgctatctcccccagcc

SEQ ID NO: 2565428 - DNA, 20 bp, Homo sapiens
ggtgctatctcccccagccc

SEQ ID NO: 2565429 - DNA, 15 bp, Homo sapiens
ggtgctccaggcagg

SEQ ID NO: 2565430 - DNA, 15 bp, Homo sapiens
ggtgctgccatccag

SEQ ID NO: 2565431 - DNA, 17 bp, Homo sapiens
ggtgctgcctctacctg

SEQ ID NO: 2565432 - DNA, 14 bp, Homo sapiens
ggtgctgggactga

SEQ ID NO: 2565433 - DNA, 16 bp, Homo sapiens
ggtgctgtggccaggg

SEQ ID NO: 2565434 - DNA, 16 bp, Homo sapiens
ggtggaagaggggaca

SEQ ID NO: 2565435 - DNA, 17 bp, Homo sapiens
ggtggacagtcctggga

SEQ ID NO: 2565436 - DNA, 15 bp, Homo sapiens
ggtggacatggcccc

SEQ ID NO: 2565437 - DNA, 12 bp, Homo sapiens
ggtggacccagg

SEQ ID NO: 2565438 - DNA, 15 bp, Homo sapiens
ggtggactcgcctgt

SEQ ID NO: 2565439 - DNA, 13 bp, Homo sapiens
ggtggagaagcca

SEQ ID NO: 2565440 - DNA, 15 bp, Homo sapiens
ggtggagaagccatt

SEQ ID NO: 2565441 - DNA, 16 bp, Homo sapiens
ggtggatcacctgagg

SEQ ID NO: 2565442 - DNA, 13 bp, Homo sapiens
ggtggatgcctgg

SEQ ID NO: 2565443 - DNA, 21 bp, Homo sapiens
ggtggatgcctggtggcagct

SEQ ID NO: 2565444 - DNA, 13 bp, Homo sapiens
ggtggcaagagcc

SEQ ID NO: 2565445 - DNA, 15 bp, Homo sapiens
ggtggcactgagccc

SEQ ID NO: 2565446 - DNA, 16 bp, Homo sapiens
ggtggcactgagcccc

SEQ ID NO: 2565447 - DNA, 15 bp, Homo sapiens
ggtggcagctgcggt

SEQ ID NO: 2565448 - DNA, 17 bp, Homo sapiens
ggtggcaggaccaggac

SEQ ID NO: 2565449 - DNA, 18 bp, Homo sapiens
ggtggcaggaccaggact

SEQ ID NO: 2565450 - DNA, 17 bp, Homo sapiens
ggtggcatcccagtggc

SEQ ID NO: 2565451 - DNA, 19 bp, Homo sapiens
ggtggcccacgcctgtaat

SEQ ID NO: 2565452 - DNA, 22 bp, Homo sapiens
ggtggcctcccaactcacccca

SEQ ID NO: 2565453 - DNA, 23 bp, Homo sapiens
ggtggcctcccaactcaccccag

SEQ ID NO: 2565454 - DNA, 12 bp, Homo sapiens
ggtggcctcggg

SEQ ID NO: 2565455 - DNA, 22 bp, Homo sapiens
ggtggcctcgggacacctgccc

SEQ ID NO: 2565456 - DNA, 23 bp, Homo sapiens
ggtggcctctccttgtggcctgg

SEQ ID NO: 2565457 - DNA, 20 bp, Homo sapiens
ggtggctcccggagggccct

SEQ ID NO: 2565458 - DNA, 12 bp, Homo sapiens
ggtggctgggtt

SEQ ID NO: 2565459 - DNA, 16 bp, Homo sapiens
ggtgggagagcccagc

SEQ ID NO: 2565460 - DNA, 20 bp, Homo sapiens
ggtgggaggatctcttgagc

SEQ ID NO: 2565461 - DNA, 17 bp, Homo sapiens
ggtgggcacccaccctg

SEQ ID NO: 2565462 - DNA, 16 bp, Homo sapiens
ggtgggcaggtggtgg

SEQ ID NO: 2565463 - DNA, 18 bp, Homo sapiens
ggtgggcccaggaccagc

SEQ ID NO: 2565464 - DNA, 21 bp, Homo sapiens
ggtgggcgtggtcactgctgt

SEQ ID NO: 2565465 - DNA, 15 bp, Homo sapiens
ggtgggctgagccct

SEQ ID NO: 2565466 - DNA, 11 bp, Homo sapiens
gtaagatgctg

SEQ ID NO: 2565467 - DNA, 14 bp, Homo sapiens
gtaaggtgagggaa

SEQ ID NO: 2565468 - DNA, 23 bp, Homo sapiens
gtaagtaattatcgggaacagtg

SEQ ID NO: 2565469 - DNA, 14 bp, Homo sapiens
gtaagtgccttcca

SEQ ID NO: 2565470 - DNA, 21 bp, Homo sapiens
gtaagtttaaaggatgttggt

SEQ ID NO: 2565471 - DNA, 13 bp, Homo sapiens
gtaagtttcaggt

SEQ ID NO: 2565472 - DNA, 16 bp, Homo sapiens
gtaagtttcaggtgac

SEQ ID NO: 2565473 - DNA, 17 bp, Homo sapiens
gtaatatgcacacattt

SEQ ID NO: 2565474 - DNA, 17 bp, Homo sapiens
gtaatccatcactagcc

SEQ ID NO: 2565475 - DNA, 15 bp, Homo sapiens
gtaatcccagcactt

SEQ ID NO: 2565476 - DNA, 20 bp, Homo sapiens
gtaatcccagcactttggga

SEQ ID NO: 2565477 - DNA, 16 bp, Homo sapiens
gtaatcccagctactt

SEQ ID NO: 2565478 - DNA, 20 bp, Homo sapiens
gtaatcccagctacttggga

SEQ ID NO: 2565479 - DNA, 22 bp, Homo sapiens
gtaatctccacagtcaaagaag

SEQ ID NO: 2565480 - DNA, 18 bp, Homo sapiens
gtaatctcgtttcaaaaa

SEQ ID NO: 2565481 - DNA, 21 bp, Homo sapiens
gtaatgatatagccagaaaaa

SEQ ID NO: 2565482 - DNA, 14 bp, Homo sapiens
gtaatgttactgat

SEQ ID NO: 2565483 - DNA, 23 bp, Homo sapiens
gtaatgttactgatcatgcattg

SEQ ID NO: 2565484 - DNA, 14 bp, Homo sapiens
gtaattaagtacta

SEQ ID NO: 2565485 - DNA, 20 bp, Homo sapiens
gtaattatcgggaacagtgt

SEQ ID NO: 2565486 - DNA, 17 bp, Homo sapiens
gtaattattttggtact

SEQ ID NO: 2565487 - DNA, 18 bp, Homo sapiens
gtaattctaaatgaatgt

SEQ ID NO: 2565488 - DNA, 15 bp, Homo sapiens
gtaattgaacttatc

SEQ ID NO: 2565489 - DNA, 12 bp, Homo sapiens
gtaattgcttac

SEQ ID NO: 2565490 - DNA, 15 bp, Homo sapiens
gtaattgcttacatt

SEQ ID NO: 2565491 - DNA, 14 bp, Homo sapiens
gtaattgtgaaaaa

SEQ ID NO: 2565492 - DNA, 23 bp, Homo sapiens
gtaattgttgtttgtatgtataa

SEQ ID NO: 2565493 - DNA, 20 bp, Homo sapiens
gtaatttaaaattgtgatgt

SEQ ID NO: 2565494 - DNA, 14 bp, Homo sapiens
gtaatttaaacagg

SEQ ID NO: 2565495 - DNA, 21 bp, Homo sapiens
gtaatttaaacaggcccagca

SEQ ID NO: 2565496 - DNA, 14 bp, Homo sapiens
gtaatttctttgcc

SEQ ID NO: 2565497 - DNA, 22 bp, Homo sapiens
gtaatttctttgcctgttcagt

SEQ ID NO: 2565498 - DNA, 15 bp, Homo sapiens
gtaatttgtgataca

SEQ ID NO: 2565499 - DNA, 21 bp, Homo sapiens
gtaatttttttaatttacaaa

SEQ ID NO: 2565500 - DNA, 19 bp, Homo sapiens
gtacaaaaaaaaagtttta

SEQ ID NO: 2565501 - DNA, 20 bp, Homo sapiens
gtacaaaaaaaaagttttat

SEQ ID NO: 2565502 - DNA, 16 bp, Homo sapiens
gtacaaaataaacaaa

SEQ ID NO: 2565503 - DNA, 17 bp, Homo sapiens
gtacaaggcgatcccat

SEQ ID NO: 2565504 - DNA, 12 bp, Homo sapiens
gtacaatattta

SEQ ID NO: 2565505 - DNA, 13 bp, Homo sapiens
gtacaatatttaa

SEQ ID NO: 2565506 - DNA, 14 bp, Homo sapiens
gtacaatatttaaa

SEQ ID NO: 2565507 - DNA, 20 bp, Homo sapiens
gtacacagctctagacactg

SEQ ID NO: 2565508 - DNA, 13 bp, Homo sapiens
gtacagaaagctg

SEQ ID NO: 2565509 - DNA, 14 bp, Homo sapiens
gtacagaaagctgc

SEQ ID NO: 2565510 - DNA, 12 bp, Homo sapiens
gtacagagccca

SEQ ID NO: 2565511 - DNA, 18 bp, Homo sapiens
gtacagagcccacgcccc

SEQ ID NO: 2565512 - DNA, 22 bp, Homo sapiens
gtacagagcccacgcccccact

SEQ ID NO: 2565513 - DNA, 16 bp, Homo sapiens
gtacagtcttgtatta

SEQ ID NO: 2565514 - DNA, 12 bp, Homo sapiens
gtacagttcttc

SEQ ID NO: 2565515 - DNA, 12 bp, Homo sapiens
gtacagttttta

SEQ ID NO: 2565516 - DNA, 20 bp, Homo sapiens
gtacatcccatgtaacagaa

SEQ ID NO: 2565517 - DNA, 23 bp, Homo sapiens
gtacatcccatgtaacagaaagg

SEQ ID NO: 2565518 - DNA, 14 bp, Homo sapiens
gtacatctggcctt

SEQ ID NO: 2565519 - DNA, 19 bp, Homo sapiens
gtacatggaataacatgta

SEQ ID NO: 2565520 - DNA, 16 bp, Homo sapiens
gtacatttatgattta

SEQ ID NO: 2565521 - DNA, 19 bp, Homo sapiens
gtacatttatgatttaata

SEQ ID NO: 2565522 - DNA, 18 bp, Homo sapiens
gtacatttccctgtgctg

SEQ ID NO: 2565523 - DNA, 15 bp, Homo sapiens
gtacattttgtaaca

SEQ ID NO: 2565524 - DNA, 14 bp, Homo sapiens
gtaccaatcatttt

SEQ ID NO: 2565525 - DNA, 14 bp, Homo sapiens
gtaccactcaggcc

SEQ ID NO: 2565526 - DNA, 16 bp, Homo sapiens
gtacccactgctctgg

SEQ ID NO: 2565527 - DNA, 19 bp, Homo sapiens
gtaccccaccctcagcacc

SEQ ID NO: 2565528 - DNA, 23 bp, Homo sapiens
gtaccccaccctcagcacccctt

SEQ ID NO: 2565529 - DNA, 17 bp, Homo sapiens
gtaccctcctggctctt

SEQ ID NO: 2565530 - DNA, 17 bp, Homo sapiens
gtaccctctcagctcca

SEQ ID NO: 2565531 - DNA, 23 bp, Homo sapiens
gtaccgccttgcacactcagaag

SEQ ID NO: 2565532 - DNA, 13 bp, Homo sapiens
gtacctataaagt

SEQ ID NO: 2565533 - DNA, 14 bp, Homo sapiens
gtacctataaagta

SEQ ID NO: 2565534 - DNA, 14 bp, Homo sapiens
gtacctgaaaagta

SEQ ID NO: 2565535 - DNA, 23 bp, Homo sapiens
gtacctgaaaagtaacttggctt

SEQ ID NO: 2565536 - DNA, 18 bp, Homo sapiens
gtaccttgaacactgggg

SEQ ID NO: 2565537 - DNA, 23 bp, Homo sapiens
gtaccttgaacactgggggaggg

SEQ ID NO: 2565538 - DNA, 21 bp, Homo sapiens
gtaccttttgaggagccccag

SEQ ID NO: 2565539 - DNA, 23 bp, Homo sapiens
gtaccttttgaggagccccagct

SEQ ID NO: 2565540 - DNA, 14 bp, Homo sapiens
gtacgttgtgcatt

SEQ ID NO: 2565541 - DNA, 17 bp, Homo sapiens
gtacgttgtgcatttgg

SEQ ID NO: 2565542 - DNA, 17 bp, Homo sapiens
gtacgtttgtatgtgtg

SEQ ID NO: 2565543 - DNA, 17 bp, Homo sapiens
gtactatgtatcaatga

SEQ ID NO: 2565544 - DNA, 16 bp, Homo sapiens
gtactcctgcaaaatt

SEQ ID NO: 2565545 - DNA, 21 bp, Homo sapiens
gtactcctgcaaaattttata

SEQ ID NO: 2565546 - DNA, 16 bp, Homo sapiens
gtactggcatggtacg

SEQ ID NO: 2565547 - DNA, 14 bp, Homo sapiens
gtactgtagttttt

SEQ ID NO: 2565548 - DNA, 23 bp, Homo sapiens
gtactgttctcttcttgaacact

SEQ ID NO: 2565549 - DNA, 14 bp, Homo sapiens
gtactgttctgtgt

SEQ ID NO: 2565550 - DNA, 15 bp, Homo sapiens
gtactgttctgtgtc

SEQ ID NO: 2565551 - DNA, 16 bp, Homo sapiens
gtacttagcagctatc

SEQ ID NO: 2565552 - DNA, 19 bp, Homo sapiens
gtacttctccaccctgctc

SEQ ID NO: 2565553 - DNA, 20 bp, Homo sapiens
gtacttctccaccctgctct

SEQ ID NO: 2565554 - DNA, 14 bp, Homo sapiens
gtacttgtcaaaga

SEQ ID NO: 2565555 - DNA, 21 bp, Homo sapiens
gtacttgtggacacagctctt

SEQ ID NO: 2565556 - DNA, 20 bp, Homo sapiens
gtagaaaagggaactgaaca

SEQ ID NO: 2565557 - DNA, 16 bp, Homo sapiens
gtagaaataatatgca

SEQ ID NO: 2565558 - DNA, 21 bp, Homo sapiens
gtagaaatatctgaaaatgta

SEQ ID NO: 2565559 - DNA, 13 bp, Homo sapiens
gtagaagagggat

SEQ ID NO: 2565560 - DNA, 15 bp, Homo sapiens
gtagaagcattcctt

SEQ ID NO: 2565561 - DNA, 13 bp, Homo sapiens
gtagaaggagaca

SEQ ID NO: 2565562 - DNA, 18 bp, Homo sapiens
gtagaatgtattgtacct

SEQ ID NO: 2565563 - DNA, 22 bp, Homo sapiens
gtagacaagcaattagacaaga

SEQ ID NO: 2565564 - DNA, 16 bp, Homo sapiens
gtagaccaaaataaaa

SEQ ID NO: 2565565 - DNA, 13 bp, Homo sapiens
gtagagacagggt

SEQ ID NO: 2565566 - DNA, 10 bp, Homo sapiens
gtagagccag

SEQ ID NO: 2565567 - DNA, 11 bp, Homo sapiens
gtagagccagg

SEQ ID NO: 2565568 - DNA, 13 bp, Homo sapiens
gtagagtgggagc

SEQ ID NO: 2565569 - DNA, 12 bp, Homo sapiens
gtagagttaaga

SEQ ID NO: 2565570 - DNA, 20 bp, Homo sapiens
gtagagtttgaaggaggtga

SEQ ID NO: 2565571 - DNA, 17 bp, Homo sapiens
gtagatcagagcagcag

SEQ ID NO: 2565572 - DNA, 19 bp, Homo sapiens
gtagattctgtggaacaag

SEQ ID NO: 2565573 - DNA, 16 bp, Homo sapiens
gtagatttatttcatc

SEQ ID NO: 2565574 - DNA, 21 bp, Homo sapiens
gtagattttaaaagttattaa

SEQ ID NO: 2565575 - DNA, 21 bp, Homo sapiens
gtagcaagttctagagaagag

SEQ ID NO: 2565576 - DNA, 13 bp, Homo sapiens
gtagcagctggac

SEQ ID NO: 2565577 - DNA, 19 bp, Homo sapiens
gtagcatttcattcttctc

SEQ ID NO: 2565578 - DNA, 15 bp, Homo sapiens
gtagcccgcctgcca

SEQ ID NO: 2565579 - DNA, 14 bp, Homo sapiens
gtagctagaggaac

SEQ ID NO: 2565580 - DNA, 11 bp, Homo sapiens
gtagctcaggt

SEQ ID NO: 2565581 - DNA, 22 bp, Homo sapiens
gtagctctaggagggctggcaa

SEQ ID NO: 2565582 - DNA, 18 bp, Homo sapiens
gtagctgggactacaggc

SEQ ID NO: 2565583 - DNA, 20 bp, Homo sapiens
gtagctgtaaggcatgaagg

SEQ ID NO: 2565584 - DNA, 22 bp, Homo sapiens
gtagcttaccagaagcttccat

SEQ ID NO: 2565585 - DNA, 17 bp, Homo sapiens
gtagctttcccaaataa

SEQ ID NO: 2565586 - DNA, 19 bp, Homo sapiens
gtaggaaaaataaaaacag

SEQ ID NO: 2565587 - DNA, 18 bp, Homo sapiens
gtaggaaggttaatgttc

SEQ ID NO: 2565588 - DNA, 13 bp, Homo sapiens
gtaggcagagcct

SEQ ID NO: 2565589 - DNA, 17 bp, Homo sapiens
gtaggctcaactaggga

SEQ ID NO: 2565590 - DNA, 19 bp, Homo sapiens
gtaggctcaactagggagt

SEQ ID NO: 2565591 - DNA, 15 bp, Homo sapiens
gtagggaactctggg

SEQ ID NO: 2565592 - DNA, 16 bp, Homo sapiens
gtagggcgggaggatg

SEQ ID NO: 2565593 - DNA, 16 bp, Homo sapiens
gtagggttataataat

SEQ ID NO: 2565594 - DNA, 20 bp, Homo sapiens
gtaggttggaagctagctcc

SEQ ID NO: 2565595 - DNA, 17 bp, Homo sapiens
gtagtcaagattgtgtt

SEQ ID NO: 2565596 - DNA, 12 bp, Homo sapiens
gtagtcccagcc

SEQ ID NO: 2565597 - DNA, 12 bp, Homo sapiens
gtagtcccagct

SEQ ID NO: 2565598 - DNA, 16 bp, Homo sapiens
gtagttaggaaataaa

SEQ ID NO: 2565599 - DNA, 12 bp, Homo sapiens
gtagttgtcttt

SEQ ID NO: 2565600 - DNA, 17 bp, Homo sapiens
gtagtttttcttcaaca

SEQ ID NO: 2565601 - DNA, 12 bp, Homo sapiens
gtataaaaacaa

SEQ ID NO: 2565602 - DNA, 23 bp, Homo sapiens
gtataaagcaactgttatgaaat

SEQ ID NO: 2565603 - DNA, 13 bp, Homo sapiens
gtataaataggag

SEQ ID NO: 2565604 - DNA, 12 bp, Homo sapiens
gtataaatttat

SEQ ID NO: 2565605 - DNA, 14 bp, Homo sapiens
gtataaatttattt

SEQ ID NO: 2565606 - DNA, 22 bp, Homo sapiens
gtataacaggttattttagttt

SEQ ID NO: 2565607 - DNA, 12 bp, Homo sapiens
gtatacatgcca

SEQ ID NO: 2565608 - DNA, 15 bp, Homo sapiens
gtatacctgattttt

SEQ ID NO: 2565609 - DNA, 15 bp, Homo sapiens
gtatagaaatgctgg

SEQ ID NO: 2565610 - DNA, 22 bp, Homo sapiens
gtatagaaatgctggtttttca

SEQ ID NO: 2565611 - DNA, 23 bp, Homo sapiens
gtatagaaatgctggtttttcag

SEQ ID NO: 2565612 - DNA, 14 bp, Homo sapiens
gtatagctgtattg

SEQ ID NO: 2565613 - DNA, 19 bp, Homo sapiens
gtatagctgtattgaatca

SEQ ID NO: 2565614 - DNA, 16 bp, Homo sapiens
gtatagtgtaaaataa

SEQ ID NO: 2565615 - DNA, 16 bp, Homo sapiens
gtatataaaatatttt

SEQ ID NO: 2565616 - DNA, 22 bp, Homo sapiens
gtatataaaggaaaaaagagaa

SEQ ID NO: 2565617 - DNA, 16 bp, Homo sapiens
gtatatacgcatctat

SEQ ID NO: 2565618 - DNA, 18 bp, Homo sapiens
gatgcaatgtgctactga

SEQ ID NO: 2565619 - DNA, 19 bp, Homo sapiens
gatgcagcctcacagtcct

SEQ ID NO: 2565620 - DNA, 22 bp, Homo sapiens
gatgcatctaccgctcttggga

SEQ ID NO: 2565621 - DNA, 18 bp, Homo sapiens
gatgcattaaaagaaaat

SEQ ID NO: 2565622 - DNA, 11 bp, Homo sapiens
gatgccaggac

SEQ ID NO: 2565623 - DNA, 14 bp, Homo sapiens
gatgccaggttcta

SEQ ID NO: 2565624 - DNA, 15 bp, Homo sapiens
gatgcccactgagga

SEQ ID NO: 2565625 - DNA, 21 bp, Homo sapiens
gatgcccagggccactctgcc

SEQ ID NO: 2565626 - DNA, 15 bp, Homo sapiens
gatgcctgattgcca

SEQ ID NO: 2565627 - DNA, 16 bp, Homo sapiens
gatgcctggtggcagc

SEQ ID NO: 2565628 - DNA, 14 bp, Homo sapiens
gatgcgcactgcat

SEQ ID NO: 2565629 - DNA, 21 bp, Homo sapiens
gatgctcaggcttgaaatgca

SEQ ID NO: 2565630 - DNA, 15 bp, Homo sapiens
gatgctccctcccct

SEQ ID NO: 2565631 - DNA, 13 bp, Homo sapiens
gatgctccttggg

SEQ ID NO: 2565632 - DNA, 21 bp, Homo sapiens
gatgctccttgggccctttga

SEQ ID NO: 2565633 - DNA, 18 bp, Homo sapiens
gatgctgatgttcagtgt

SEQ ID NO: 2565634 - DNA, 12 bp, Homo sapiens
gatgctgctttc

SEQ ID NO: 2565635 - DNA, 15 bp, Homo sapiens
gatgctgctttcccc

SEQ ID NO: 2565636 - DNA, 15 bp, Homo sapiens
gatgctggagaggtt

SEQ ID NO: 2565637 - DNA, 18 bp, Homo sapiens
gatgctggatgctccttc

SEQ ID NO: 2565638 - DNA, 22 bp, Homo sapiens
gatgctggatgtctgccaattt

SEQ ID NO: 2565639 - DNA, 19 bp, Homo sapiens
gatgctgggttggtgcaca

SEQ ID NO: 2565640 - DNA, 13 bp, Homo sapiens
gatgctgtttgac

SEQ ID NO: 2565641 - DNA, 21 bp, Homo sapiens
gatgcttcttcagagactcct

SEQ ID NO: 2565642 - DNA, 16 bp, Homo sapiens
gatgcttgtacataat

SEQ ID NO: 2565643 - DNA, 15 bp, Homo sapiens
gatggaaaaggaaga

SEQ ID NO: 2565644 - DNA, 22 bp, Homo sapiens
gatggaacccttttggcccccg

SEQ ID NO: 2565645 - DNA, 22 bp, Homo sapiens
gatggaaccgcaggaagctgct

SEQ ID NO: 2565646 - DNA, 21 bp, Homo sapiens
gatggaagttgcagtgagctg

SEQ ID NO: 2565647 - DNA, 13 bp, Homo sapiens
gatggaatgatgg

SEQ ID NO: 2565648 - DNA, 23 bp, Homo sapiens
gatggagactggtcctgtgtgca

SEQ ID NO: 2565649 - DNA, 20 bp, Homo sapiens
gatggagccagctctgcatt

SEQ ID NO: 2565650 - DNA, 19 bp, Homo sapiens
gatggagttcttgtgccat

SEQ ID NO: 2565651 - DNA, 19 bp, Homo sapiens
gatggatatatgtttttga

SEQ ID NO: 2565652 - DNA, 21 bp, Homo sapiens
gatggattccaaccccaactc

SEQ ID NO: 2565653 - DNA, 16 bp, Homo sapiens
gatggattctcagata

SEQ ID NO: 2565654 - DNA, 22 bp, Homo sapiens
gatggattctcagatatttata

SEQ ID NO: 2565655 - DNA, 20 bp, Homo sapiens
gatggcaaagaaggagagca

SEQ ID NO: 2565656 - DNA, 21 bp, Homo sapiens
gatggcacttataaccaaagc

SEQ ID NO: 2565657 - DNA, 21 bp, Homo sapiens
gatggcaggatggcctggcca

SEQ ID NO: 2565658 - DNA, 22 bp, Homo sapiens
gatggcaggatggcctggccag

SEQ ID NO: 2565659 - DNA, 21 bp, Homo sapiens
gatggcatcctgtgaagtcct

SEQ ID NO: 2565660 - DNA, 16 bp, Homo sapiens
gatggcgggtgggggt

SEQ ID NO: 2565661 - DNA, 18 bp, Homo sapiens
gatggctgtgcctctgcc

SEQ ID NO: 2565662 - DNA, 21 bp, Homo sapiens
gatggctttgaatgcggccca

SEQ ID NO: 2565663 - DNA, 18 bp, Homo sapiens
gatgggaaggagggaggt

SEQ ID NO: 2565664 - DNA, 13 bp, Homo sapiens
gatgggaatgaag

SEQ ID NO: 2565665 - DNA, 20 bp, Homo sapiens
gatgggagctcctctcctgg

SEQ ID NO: 2565666 - DNA, 23 bp, Homo sapiens
gatgggagctcctctcctggagg

SEQ ID NO: 2565667 - DNA, 20 bp, Homo sapiens
gatgggatggtggagggcca

SEQ ID NO: 2565668 - DNA, 16 bp, Homo sapiens
gatgggcccaattctt

SEQ ID NO: 2565669 - DNA, 13 bp, Homo sapiens
gatggggccctgc

SEQ ID NO: 2565670 - DNA, 15 bp, Homo sapiens
gatggggctgcaccg

SEQ ID NO: 2565671 - DNA, 19 bp, Homo sapiens
gatggggctgcaccggctg

SEQ ID NO: 2565672 - DNA, 22 bp, Homo sapiens
gatgggtctggtttgcagagct

SEQ ID NO: 2565673 - DNA, 22 bp, Homo sapiens
gatgggttctaattttggatgg

SEQ ID NO: 2565674 - DNA, 23 bp, Homo sapiens
gatgggttctaattttggatgga

SEQ ID NO: 2565675 - DNA, 13 bp, Homo sapiens
gatggtcctgggg

SEQ ID NO: 2565676 - DNA, 14 bp, Homo sapiens
gatggtggagggcc

SEQ ID NO: 2565677 - DNA, 12 bp, Homo sapiens
gatgtaaagtga

SEQ ID NO: 2565678 - DNA, 17 bp, Homo sapiens
gatgtacagtctgtcat

SEQ ID NO: 2565679 - DNA, 19 bp, Homo sapiens
gatgtaccatgaaacaaag

SEQ ID NO: 2565680 - DNA, 19 bp, Homo sapiens
gatgtatgcagctatctgg

SEQ ID NO: 2565681 - DNA, 18 bp, Homo sapiens
gatgtcccaacttgtaaa

SEQ ID NO: 2565682 - DNA, 21 bp, Homo sapiens
gatgtccctttcttggccagt

SEQ ID NO: 2565683 - DNA, 21 bp, Homo sapiens
gatgtcctcaccacatgcgga

SEQ ID NO: 2565684 - DNA, 14 bp, Homo sapiens
gatgtctaatagtt

SEQ ID NO: 2565685 - DNA, 14 bp, Homo sapiens
gatgtcttcatacc

SEQ ID NO: 2565686 - DNA, 14 bp, Homo sapiens
gatgtcttctgcct

SEQ ID NO: 2565687 - DNA, 16 bp, Homo sapiens
gatgtcttctgcctgt

SEQ ID NO: 2565688 - DNA, 14 bp, Homo sapiens
gatgtgaacacatc

SEQ ID NO: 2565689 - DNA, 23 bp, Homo sapiens
gatgtgaattgcctgcagagaga

SEQ ID NO: 2565690 - DNA, 15 bp, Homo sapiens
gatgtgcatgggagc

SEQ ID NO: 2565691 - DNA, 21 bp, Homo sapiens
gatgtgcatttttgtgaaatg

SEQ ID NO: 2565692 - DNA, 23 bp, Homo sapiens
gatgtgcatttttgtgaaatgaa

SEQ ID NO: 2565693 - DNA, 13 bp, Homo sapiens
gatgtgcctgggt

SEQ ID NO: 2565694 - DNA, 17 bp, Homo sapiens
gatgtggagtggggcag

SEQ ID NO: 2565695 - DNA, 22 bp, Homo sapiens
gatgtgggagggagcagacagg

SEQ ID NO: 2565696 - DNA, 20 bp, Homo sapiens
gatgtgggggaagacctggc

SEQ ID NO: 2565697 - DNA, 15 bp, Homo sapiens
gatgtggtgcctgag

SEQ ID NO: 2565698 - DNA, 22 bp, Homo sapiens
gatgtggtgcctgaggtctgta

SEQ ID NO: 2565699 - DNA, 19 bp, Homo sapiens
gatgttaacacattttgta

SEQ ID NO: 2565700 - DNA, 22 bp, Homo sapiens
gatgttaacacattttgtataa

SEQ ID NO: 2565701 - DNA, 15 bp, Homo sapiens
gatgttcagtgtaat

SEQ ID NO: 2565702 - DNA, 19 bp, Homo sapiens
gatgttgaaaaagttctgc

SEQ ID NO: 2565703 - DNA, 15 bp, Homo sapiens
gccaagtttatatac

SEQ ID NO: 2565704 - DNA, 13 bp, Homo sapiens
gccaatatgtatt

SEQ ID NO: 2565705 - DNA, 17 bp, Homo sapiens
gccaatatgtattgtaa

SEQ ID NO: 2565706 - DNA, 23 bp, Homo sapiens
gccaatatgtattgtaaacatgt

SEQ ID NO: 2565707 - DNA, 15 bp, Homo sapiens
gccaatcaagggcaa

SEQ ID NO: 2565708 - DNA, 19 bp, Homo sapiens
gccaatcccctccttgggc

SEQ ID NO: 2565709 - DNA, 20 bp, Homo sapiens
gccaatttcaagttccaagt

SEQ ID NO: 2565710 - DNA, 15 bp, Homo sapiens
gccacaaataaaatg

SEQ ID NO: 2565711 - DNA, 16 bp, Homo sapiens
gccacaagacccttgt

SEQ ID NO: 2565712 - DNA, 10 bp, Homo sapiens
gccacacaca

SEQ ID NO: 2565713 - DNA, 12 bp, Homo sapiens
gccacacacaca

SEQ ID NO: 2565714 - DNA, 18 bp, Homo sapiens
gccacacacacagaaaat

SEQ ID NO: 2565715 - DNA, 23 bp, Homo sapiens
gccacacatcacccttaccatgt

SEQ ID NO: 2565716 - DNA, 19 bp, Homo sapiens
gccacaccatctcctttca

SEQ ID NO: 2565717 - DNA, 22 bp, Homo sapiens
gccacaccctcccccgccactc

SEQ ID NO: 2565718 - DNA, 13 bp, Homo sapiens
gcctgcccaggcc

SEQ ID NO: 2565719 - DNA, 18 bp, Homo sapiens
gcctgcccaggcccctgc

SEQ ID NO: 2565720 - DNA, 19 bp, Homo sapiens
gcctgcccaggcccctgcc

SEQ ID NO: 2565721 - DNA, 22 bp, Homo sapiens
gcctgcccaggcccctgccacc

SEQ ID NO: 2565722 - DNA, 16 bp, Homo sapiens
gcctgcccctcccaga

SEQ ID NO: 2565723 - DNA, 14 bp, Homo sapiens
gcctgcctggagcg

SEQ ID NO: 2565724 - DNA, 16 bp, Homo sapiens
gcctgccttgaagcca

SEQ ID NO: 2565725 - DNA, 23 bp, Homo sapiens
gcctgccttgaagccactgaagc

SEQ ID NO: 2565726 - DNA, 18 bp, Homo sapiens
gcctgcgcccaccccgct

SEQ ID NO: 2565727 - DNA, 20 bp, Homo sapiens
gcctgcgttttggaagctct

SEQ ID NO: 2565728 - DNA, 20 bp, Homo sapiens
gcctgctcccagcagcccta

SEQ ID NO: 2565729 - DNA, 14 bp, Homo sapiens
gcctggaagacaga

SEQ ID NO: 2565730 - DNA, 12 bp, Homo sapiens
gcctggagaagc

SEQ ID NO: 2565731 - DNA, 15 bp, Homo sapiens
gcctggagaagctga

SEQ ID NO: 2565732 - DNA, 16 bp, Homo sapiens
gcctggatggggctgc

SEQ ID NO: 2565733 - DNA, 18 bp, Homo sapiens
gcctggcagaactgagct

SEQ ID NO: 2565734 - DNA, 14 bp, Homo sapiens
gcctggcaggctgt

SEQ ID NO: 2565735 - DNA, 15 bp, Homo sapiens
gcctggccaaaggga

SEQ ID NO: 2565736 - DNA, 14 bp, Homo sapiens
gcctggccacctct

SEQ ID NO: 2565737 - DNA, 17 bp, Homo sapiens
gcctggccacctctctc

SEQ ID NO: 2565738 - DNA, 18 bp, Homo sapiens
gcctggccacctctctcc

SEQ ID NO: 2565739 - DNA, 21 bp, Homo sapiens
gcctggccagatgcaccagcc

SEQ ID NO: 2565740 - DNA, 19 bp, Homo sapiens
gcctggccaggagctcttc

SEQ ID NO: 2565741 - DNA, 12 bp, Homo sapiens
gcctggccaggc

SEQ ID NO: 2565742 - DNA, 14 bp, Homo sapiens
gcctggccaggcag

SEQ ID NO: 2565743 - DNA, 22 bp, Homo sapiens
gcctggcccctcagggtccctg

SEQ ID NO: 2565744 - DNA, 18 bp, Homo sapiens
gcctggcctgagctggga

SEQ ID NO: 2565745 - DNA, 20 bp, Homo sapiens
gcctggcctgagctgggatg

SEQ ID NO: 2565746 - DNA, 14 bp, Homo sapiens
gcctggctcagagc

SEQ ID NO: 2565747 - DNA, 13 bp, Homo sapiens
gcctggctcaggt

SEQ ID NO: 2565748 - DNA, 14 bp, Homo sapiens
gctagggtggccct

SEQ ID NO: 2565749 - DNA, 19 bp, Homo sapiens
gctaggtgggccagcccct

SEQ ID NO: 2565750 - DNA, 20 bp, Homo sapiens
gctaggtgggccagcccctc

SEQ ID NO: 2565751 - DNA, 22 bp, Homo sapiens
gctagtgtggtgtttcctggca

SEQ ID NO: 2565752 - DNA, 18 bp, Homo sapiens
gctatagctacaggaagc

SEQ ID NO: 2565753 - DNA, 16 bp, Homo sapiens
gctataggctggagaa

SEQ ID NO: 2565754 - DNA, 15 bp, Homo sapiens
gctatatccatgtac

SEQ ID NO: 2565755 - DNA, 19 bp, Homo sapiens
gctatatctatatataatt

SEQ ID NO: 2565756 - DNA, 13 bp, Homo sapiens
gctatctccccca

SEQ ID NO: 2565757 - DNA, 16 bp, Homo sapiens
gctatctctgtgtgca

SEQ ID NO: 2565758 - DNA, 13 bp, Homo sapiens
gctatgcatttga

SEQ ID NO: 2565759 - DNA, 21 bp, Homo sapiens
gctatgggagccccagggtct

SEQ ID NO: 2565760 - DNA, 18 bp, Homo sapiens
gctatggggagaaaagac

SEQ ID NO: 2565761 - DNA, 11 bp, Homo sapiens
gctatgtgact

SEQ ID NO: 2565762 - DNA, 23 bp, Homo sapiens
gctattactaaggagtaatctgt

SEQ ID NO: 2565763 - DNA, 15 bp, Homo sapiens
gctattactgtctgg

SEQ ID NO: 2565764 - DNA, 18 bp, Homo sapiens
gctattagccaggatcat

SEQ ID NO: 2565765 - DNA, 21 bp, Homo sapiens
gctattattttcactgtagaa

SEQ ID NO: 2565766 - DNA, 13 bp, Homo sapiens
gctattgtaaata

SEQ ID NO: 2565767 - DNA, 22 bp, Homo sapiens
gctatttaaaaaaaaaagagga

SEQ ID NO: 2565768 - DNA, 23 bp, Homo sapiens
gctcaaaatttgaagaatgaaca

SEQ ID NO: 2565769 - DNA, 12 bp, Homo sapiens
gctcaaaggcac

SEQ ID NO: 2565770 - DNA, 16 bp, Homo sapiens
gctcaaaggcacagtg

SEQ ID NO: 2565771 - DNA, 21 bp, Homo sapiens
gctcaaaggcacagtgaaggc

SEQ ID NO: 2565772 - DNA, 21 bp, Homo sapiens
gctcaagaagacatggagact

SEQ ID NO: 2565773 - DNA, 23 bp, Homo sapiens
gctcaaggaaagggggtcccagt

SEQ ID NO: 2565774 - DNA, 17 bp, Homo sapiens
gctcaagtcttccctga

SEQ ID NO: 2565775 - DNA, 19 bp, Homo sapiens
gctcaatattcctgaatga

SEQ ID NO: 2565776 - DNA, 17 bp, Homo sapiens
gctcaccccccacactc

SEQ ID NO: 2565777 - DNA, 16 bp, Homo sapiens
gctcacccccttctcc

SEQ ID NO: 2565778 - DNA, 22 bp, Homo sapiens
gctcacccccttctccatccac

SEQ ID NO: 2565779 - DNA, 12 bp, Homo sapiens
gctcacctgggg

SEQ ID NO: 2565780 - DNA, 22 bp, Homo sapiens
gctcacctgttgcttacaattt

SEQ ID NO: 2565781 - DNA, 22 bp, Homo sapiens
gctcacgcctatgatcccagca

SEQ ID NO: 2565782 - DNA, 15 bp, Homo sapiens
gctcacgtgtgtgac

SEQ ID NO: 2565783 - DNA, 16 bp, Homo sapiens
gctcactcggcaccct

SEQ ID NO: 2565784 - DNA, 11 bp, Homo sapiens
gctcactgcag

SEQ ID NO: 2565785 - DNA, 12 bp, Homo sapiens
gctcactgcagc

SEQ ID NO: 2565786 - DNA, 13 bp, Homo sapiens
gctcactgcagcc

SEQ ID NO: 2565787 - DNA, 14 bp, Homo sapiens
gctcactgcagcct

SEQ ID NO: 2565788 - DNA, 16 bp, Homo sapiens
gctcactgcagcctca

SEQ ID NO: 2565789 - DNA, 23 bp, Homo sapiens
gctcacttctgggcttcatctgg

SEQ ID NO: 2565790 - DNA, 14 bp, Homo sapiens
gctcagagagggtg

SEQ ID NO: 2565791 - DNA, 17 bp, Homo sapiens
gctcagcaaaagatgct

SEQ ID NO: 2565792 - DNA, 20 bp, Homo sapiens
gctcagcaaaagatgcttct

SEQ ID NO: 2565793 - DNA, 13 bp, Homo sapiens
gctctgatccctc

SEQ ID NO: 2565794 - DNA, 23 bp, Homo sapiens
gctctgatccctctacagagctt

SEQ ID NO: 2565795 - DNA, 23 bp, Homo sapiens
gctctgcaagaattgaagcagga

SEQ ID NO: 2565796 - DNA, 15 bp, Homo sapiens
gctctgcacagatgg

SEQ ID NO: 2565797 - DNA, 15 bp, Homo sapiens
gctctgcaggcacct

SEQ ID NO: 2565798 - DNA, 16 bp, Homo sapiens
gctctgcatgcggccc

SEQ ID NO: 2565799 - DNA, 21 bp, Homo sapiens
gctctgcatgcggcccagccc

SEQ ID NO: 2565800 - DNA, 12 bp, Homo sapiens
gctctgccccag

SEQ ID NO: 2565801 - DNA, 15 bp, Homo sapiens
gctctgccccagagg

SEQ ID NO: 2565802 - DNA, 23 bp, Homo sapiens
gctctgcccttggttaggcattg

SEQ ID NO: 2565803 - DNA, 14 bp, Homo sapiens
gctctgcctcccat

SEQ ID NO: 2565804 - DNA, 15 bp, Homo sapiens
gctctgcctcccatc

SEQ ID NO: 2565805 - DNA, 14 bp, Homo sapiens
gctctgctcctctc

SEQ ID NO: 2565806 - DNA, 19 bp, Homo sapiens
gctctgctcctctccccag

SEQ ID NO: 2565807 - DNA, 21 bp, Homo sapiens
gctctgctcctctccccagca

SEQ ID NO: 2565808 - DNA, 13 bp, Homo sapiens
gctctgctgacag

SEQ ID NO: 2565809 - DNA, 19 bp, Homo sapiens
gctctgctgacagacacag

SEQ ID NO: 2565810 - DNA, 13 bp, Homo sapiens
gctctgctggcct

SEQ ID NO: 2565811 - DNA, 22 bp, Homo sapiens
gctctggaaaatgtgacccaga

SEQ ID NO: 2565812 - DNA, 14 bp, Homo sapiens
gctctggaagagag

SEQ ID NO: 2565813 - DNA, 15 bp, Homo sapiens
gctctggaagagagg

SEQ ID NO: 2565814 - DNA, 16 bp, Homo sapiens
gctctggacaggcatg

SEQ ID NO: 2565815 - DNA, 21 bp, Homo sapiens
gctctggacaggcatgttctc

SEQ ID NO: 2565816 - DNA, 22 bp, Homo sapiens
gctctggacaggcatgttctct

SEQ ID NO: 2565817 - DNA, 19 bp, Homo sapiens
gctctggctgaaccctgtg

SEQ ID NO: 2565818 - DNA, 16 bp, Homo sapiens
gctctgtcacccaggc

SEQ ID NO: 2565819 - DNA, 16 bp, Homo sapiens
gctctgtcctgggagt

SEQ ID NO: 2565820 - DNA, 15 bp, Homo sapiens
gctctgtgctgaccc

SEQ ID NO: 2565821 - DNA, 18 bp, Homo sapiens
gctctgtgctgaccctcc

SEQ ID NO: 2565822 - DNA, 21 bp, Homo sapiens
gctctgtgctgaccctcctgt

SEQ ID NO: 2565823 - DNA, 12 bp, Homo sapiens
gctcttcaggcc

SEQ ID NO: 2565824 - DNA, 18 bp, Homo sapiens
gctcttcaggcctccctc

SEQ ID NO: 2565825 - DNA, 12 bp, Homo sapiens
gctcttccaggc

SEQ ID NO: 2565826 - DNA, 19 bp, Homo sapiens
gctcttccaggctgggaga

SEQ ID NO: 2565827 - DNA, 14 bp, Homo sapiens
gctcttctccaggc

SEQ ID NO: 2565828 - DNA, 21 bp, Homo sapiens
gctcttctgactactgggcaa

SEQ ID NO: 2565829 - DNA, 14 bp, Homo sapiens
gctcttctgccggc

SEQ ID NO: 2565830 - DNA, 21 bp, Homo sapiens
gctcttctgccggccctgggg

SEQ ID NO: 2565831 - DNA, 12 bp, Homo sapiens
gctcttcttaaa

SEQ ID NO: 2565832 - DNA, 19 bp, Homo sapiens
gctcttgatacccccctct

SEQ ID NO: 2565833 - DNA, 12 bp, Homo sapiens
gctcttgccctt

SEQ ID NO: 2565834 - DNA, 19 bp, Homo sapiens
gctcttgcccttccctgtc

SEQ ID NO: 2565835 - DNA, 22 bp, Homo sapiens
gctcttgcccttccctgtccct

SEQ ID NO: 2565836 - DNA, 23 bp, Homo sapiens
gctcttgcccttccctgtccctc

SEQ ID NO: 2565837 - DNA, 20 bp, Homo sapiens
gctcttgctaatcagtgtct

SEQ ID NO: 2565838 - DNA, 23 bp, Homo sapiens
gctcttgctaatcagtgtctcac

SEQ ID NO: 2565839 - DNA, 14 bp, Homo sapiens
gctctttagccagt

SEQ ID NO: 2565840 - DNA, 18 bp, Homo sapiens
gctctttccttgctcaac

SEQ ID NO: 2565841 - DNA, 22 bp, Homo sapiens
gctctttggggtcagccagggc

SEQ ID NO: 2565842 - DNA, 20 bp, Homo sapiens
gctgaaaacctaagtccttt

SEQ ID NO: 2565843 - DNA, 11 bp, Homo sapiens
gctgaaaatat

SEQ ID NO: 2565844 - DNA, 20 bp, Homo sapiens
gctgaacactccaattaagg

SEQ ID NO: 2565845 - DNA, 13 bp, Homo sapiens
gctgaaccctgtg

SEQ ID NO: 2565846 - DNA, 16 bp, Homo sapiens
gctgaaccctgtgctg

SEQ ID NO: 2565847 - DNA, 20 bp, Homo sapiens
gctgaaccctgtgctggtgt

SEQ ID NO: 2565848 - DNA, 21 bp, Homo sapiens
gctgaaccctgtgctggtgtc

SEQ ID NO: 2565849 - DNA, 13 bp, Homo sapiens
gctgaagctgcct

SEQ ID NO: 2565850 - DNA, 15 bp, Homo sapiens
gctgaagctgcctgc

SEQ ID NO: 2565851 - DNA, 12 bp, Homo sapiens
gctgaaggactg

SEQ ID NO: 2565852 - DNA, 20 bp, Homo sapiens
gctgaaggctcgagcatgcc

SEQ ID NO: 2565853 - DNA, 20 bp, Homo sapiens
gctgaagggaccttgaaggg

SEQ ID NO: 2565854 - DNA, 12 bp, Homo sapiens
gctgaataaatg

SEQ ID NO: 2565855 - DNA, 17 bp, Homo sapiens
gctgaatacagaggcaa

SEQ ID NO: 2565856 - DNA, 15 bp, Homo sapiens
gctgaatccagatca

SEQ ID NO: 2565857 - DNA, 23 bp, Homo sapiens
gctgaatgttgggactgctaaat

SEQ ID NO: 2565858 - DNA, 21 bp, Homo sapiens
gctgacaaccaccgctcccca

SEQ ID NO: 2565859 - DNA, 22 bp, Homo sapiens
gctgacaaccaccgctccccag

SEQ ID NO: 2565860 - DNA, 17 bp, Homo sapiens
gctgacacaaacctgcc

SEQ ID NO: 2565861 - DNA, 18 bp, Homo sapiens
gctgacagacacaggccc

SEQ ID NO: 2565862 - DNA, 13 bp, Homo sapiens
gctgaccaagaga

SEQ ID NO: 2565863 - DNA, 20 bp, Homo sapiens
gctgaccaagagagaaagaa

SEQ ID NO: 2565864 - DNA, 22 bp, Homo sapiens
gctgacccagccccttgagaaa

SEQ ID NO: 2565865 - DNA, 18 bp, Homo sapiens
gctgaccccaaagagcct

SEQ ID NO: 2565866 - DNA, 19 bp, Homo sapiens
gctgaccccaaagagcctg

SEQ ID NO: 2565867 - DNA, 14 bp, Homo sapiens
gctgaccctcctgt

SEQ ID NO: 2565868 - DNA, 15 bp, Homo sapiens
gctgaccctcctgtt

SEQ ID NO: 2565869 - DNA, 14 bp, Homo sapiens
gctgacctccacag

SEQ ID NO: 2565870 - DNA, 18 bp, Homo sapiens
gctgacctctgttgtcct

SEQ ID NO: 2565871 - DNA, 18 bp, Homo sapiens
gctgaccttcctcgcaga

SEQ ID NO: 2565872 - DNA, 22 bp, Homo sapiens
gctgaccttcctcgcagagagg

SEQ ID NO: 2565873 - DNA, 17 bp, Homo sapiens
gctgacggtgcagtctg

SEQ ID NO: 2565874 - DNA, 18 bp, Homo sapiens
gctgactttgctctttct

SEQ ID NO: 2565875 - DNA, 14 bp, Homo sapiens
gctgagaacactgt

SEQ ID NO: 2565876 - DNA, 23 bp, Homo sapiens
gctgagaaccctgcgtggggaca

SEQ ID NO: 2565877 - DNA, 19 bp, Homo sapiens
gctgagactggatactgcc

SEQ ID NO: 2565878 - DNA, 20 bp, Homo sapiens
gctgagactggatactgccc

SEQ ID NO: 2565879 - DNA, 22 bp, Homo sapiens
ggacagggctggcccagccctg

SEQ ID NO: 2565880 - DNA, 19 bp, Homo sapiens
ggacagtatttgtggggag

SEQ ID NO: 2565881 - DNA, 13 bp, Homo sapiens
ggacagtcctggg

SEQ ID NO: 2565882 - DNA, 14 bp, Homo sapiens
ggacagtcctggga

SEQ ID NO: 2565883 - DNA, 23 bp, Homo sapiens
ggacagtgcttcagcctgaggct

SEQ ID NO: 2565884 - DNA, 15 bp, Homo sapiens
ggacatagagaggga

SEQ ID NO: 2565885 - DNA, 18 bp, Homo sapiens
ggacatagcgaatacaaa

SEQ ID NO: 2565886 - DNA, 20 bp, Homo sapiens
ggacatccccccgccaaaag

SEQ ID NO: 2565887 - DNA, 14 bp, Homo sapiens
ggacatcctcttct

SEQ ID NO: 2565888 - DNA, 15 bp, Homo sapiens
ggacatctctttgaa

SEQ ID NO: 2565889 - DNA, 17 bp, Homo sapiens
ggacatgttttgataaa

SEQ ID NO: 2565890 - DNA, 17 bp, Homo sapiens
ggacattccaagacagt

SEQ ID NO: 2565891 - DNA, 14 bp, Homo sapiens
ggacatttctctaa

SEQ ID NO: 2565892 - DNA, 15 bp, Homo sapiens
ggacattttttcagt

SEQ ID NO: 2565893 - DNA, 17 bp, Homo sapiens
ggaccaaccctgtttcc

SEQ ID NO: 2565894 - DNA, 22 bp, Homo sapiens
ggaccaaggcaaggcaggtgcc

SEQ ID NO: 2565895 - DNA, 13 bp, Homo sapiens
ggaccacacctcc

SEQ ID NO: 2565896 - DNA, 21 bp, Homo sapiens
ggaccacacctccctgaacca

SEQ ID NO: 2565897 - DNA, 19 bp, Homo sapiens
ggaccagaagccaaagact

SEQ ID NO: 2565898 - DNA, 22 bp, Homo sapiens
ggaccagctggggcgtggggag

SEQ ID NO: 2565899 - DNA, 21 bp, Homo sapiens
ggaccaggactatagcccagg

SEQ ID NO: 2565900 - DNA, 19 bp, Homo sapiens
ggaccagtcaacctgggca

SEQ ID NO: 2565901 - DNA, 14 bp, Homo sapiens
ggacccagacccag

SEQ ID NO: 2565902 - DNA, 18 bp, Homo sapiens
ggaccccatctgtgaata

SEQ ID NO: 2565903 - DNA, 20 bp, Homo sapiens
ggaccccatctgtgaataag

SEQ ID NO: 2565904 - DNA, 16 bp, Homo sapiens
ggacccccgccccctg

SEQ ID NO: 2565905 - DNA, 20 bp, Homo sapiens
ggacccccgccccctgccct

SEQ ID NO: 2565906 - DNA, 22 bp, Homo sapiens
ggacccccgccccctgccctcc

SEQ ID NO: 2565907 - DNA, 23 bp, Homo sapiens
ggacccccgccccctgccctccc

SEQ ID NO: 2565908 - DNA, 14 bp, Homo sapiens
ggacccccttcccc

SEQ ID NO: 2565909 - DNA, 15 bp, Homo sapiens
ggaccccgagcctgg

SEQ ID NO: 2565910 - DNA, 21 bp, Homo sapiens
ggaccccgagcctggctccaa

SEQ ID NO: 2565911 - DNA, 11 bp, Homo sapiens
ggaccctgagg

SEQ ID NO: 2565912 - DNA, 12 bp, Homo sapiens
ggaccctgaggc

SEQ ID NO: 2565913 - DNA, 14 bp, Homo sapiens
ggaccctgaggccc

SEQ ID NO: 2565914 - DNA, 21 bp, Homo sapiens
ggacccttcccttgagccctc

SEQ ID NO: 2565915 - DNA, 22 bp, Homo sapiens
ggaccgccagatggggcctctg

SEQ ID NO: 2565916 - DNA, 23 bp, Homo sapiens
ggacctcaggtgagaagcagagg

SEQ ID NO: 2565917 - DNA, 15 bp, Homo sapiens
ggacctctcccaggg

SEQ ID NO: 2565918 - DNA, 16 bp, Homo sapiens
ggacctctgctctgag

SEQ ID NO: 2565919 - DNA, 22 bp, Homo sapiens
ggacctgcctcctgcctgcccc

SEQ ID NO: 2565920 - DNA, 17 bp, Homo sapiens
ggacctggtgctgcctc

SEQ ID NO: 2565921 - DNA, 13 bp, Homo sapiens
ggaccttcctgcc

SEQ ID NO: 2565922 - DNA, 15 bp, Homo sapiens
ggacgccacccagca

SEQ ID NO: 2565923 - DNA, 17 bp, Homo sapiens
ggacgctacccgggaag

SEQ ID NO: 2565924 - DNA, 19 bp, Homo sapiens
ggacgctacccgggaaggg

SEQ ID NO: 2565925 - DNA, 17 bp, Homo sapiens
ggacgctccctgctcca

SEQ ID NO: 2565926 - DNA, 22 bp, Homo sapiens
ggacggcctgatgctccctccc

SEQ ID NO: 2565927 - DNA, 18 bp, Homo sapiens
ggacggtgctccaggcag

SEQ ID NO: 2565928 - DNA, 16 bp, Homo sapiens
ggacgttccagccggc

SEQ ID NO: 2565929 - DNA, 16 bp, Homo sapiens
ggactaagcctacctg

SEQ ID NO: 2565930 - DNA, 14 bp, Homo sapiens
ggactacaggtgtg

SEQ ID NO: 2565931 - DNA, 14 bp, Homo sapiens
ggactagaacctgg

SEQ ID NO: 2565932 - DNA, 16 bp, Homo sapiens
ggactcaatgcactga

SEQ ID NO: 2565933 - DNA, 18 bp, Homo sapiens
ggactcaatgcactgaca

SEQ ID NO: 2565934 - DNA, 22 bp, Homo sapiens
ggactcaatgcactgacattgt

SEQ ID NO: 2565935 - DNA, 18 bp, Homo sapiens
ggactcaatttctcccca

SEQ ID NO: 2565936 - DNA, 18 bp, Homo sapiens
ggactcaggatgcccagg

SEQ ID NO: 2565937 - DNA, 20 bp, Homo sapiens
ggactccacccatcctatca

SEQ ID NO: 2565938 - DNA, 14 bp, Homo sapiens
ggactccagactct

SEQ ID NO: 2565939 - DNA, 14 bp, Homo sapiens
ggactccccaggcc

SEQ ID NO: 2565940 - DNA, 18 bp, Homo sapiens
ggactccccaggccaggc

SEQ ID NO: 2565941 - DNA, 19 bp, Homo sapiens
ggactccccaggccaggcc

SEQ ID NO: 2565942 - DNA, 20 bp, Homo sapiens
ggactccctcctcacctctg

SEQ ID NO: 2565943 - DNA, 16 bp, Homo sapiens
ggactccggccctcct

SEQ ID NO: 2565944 - DNA, 12 bp, Homo sapiens
ggactcctctgt

SEQ ID NO: 2565945 - DNA, 15 bp, Homo sapiens
ggactcctctgtcca

SEQ ID NO: 2565946 - DNA, 21 bp, Homo sapiens
ggactctcagtctctgagcag

SEQ ID NO: 2565947 - DNA, 19 bp, Homo sapiens
ggactctgaagcctctggg

SEQ ID NO: 2565948 - DNA, 21 bp, Homo sapiens
ggactctgcacatgtcttgta

SEQ ID NO: 2565949 - DNA, 17 bp, Homo sapiens
ggactctggggttttta

SEQ ID NO: 2565950 - DNA, 17 bp, Homo sapiens
ggactgaaaacctctcc

SEQ ID NO: 2565951 - DNA, 19 bp, Homo sapiens
ggactgaagcctgcaggag

SEQ ID NO: 2565952 - DNA, 17 bp, Homo sapiens
ggactgagccagtccca

SEQ ID NO: 2565953 - DNA, 17 bp, Homo sapiens
ggactgagggactctga

SEQ ID NO: 2565954 - DNA, 23 bp, Homo sapiens
ggactgcacagcgtcctgtccac

SEQ ID NO: 2565955 - DNA, 20 bp, Homo sapiens
ggactgccttgaatatcccc

SEQ ID NO: 2565956 - DNA, 15 bp, Homo sapiens
ggactggaaccaggg

SEQ ID NO: 2565957 - DNA, 14 bp, Homo sapiens
ggactggcccctgg

SEQ ID NO: 2565958 - DNA, 15 bp, Homo sapiens
ggactggcccctggg

SEQ ID NO: 2565959 - DNA, 17 bp, Homo sapiens
ggactggcccctgggtc

SEQ ID NO: 2565960 - DNA, 22 bp, Homo sapiens
ggactggctagagtcctcactc

SEQ ID NO: 2565961 - DNA, 21 bp, Homo sapiens
ggactgggtttggaccccagc

SEQ ID NO: 2565962 - DNA, 24 bp, Homo sapiens
ggactgggtttggaccccagctgg

SEQ ID NO: 2565963 - DNA, 20 bp, Homo sapiens
ggactgttttttcctgagct

SEQ ID NO: 2565964 - DNA, 21 bp, Homo sapiens
ggactgttttttcctgagctt

SEQ ID NO: 2565965 - DNA, 23 bp, Homo sapiens
ggactgttttttcctgagcttgg

SEQ ID NO: 2565966 - DNA, 14 bp, Homo sapiens
ggacttggaagctc

SEQ ID NO: 2565967 - DNA, 17 bp, Homo sapiens
ggactttccaccccctc

SEQ ID NO: 2565968 - DNA, 20 bp, Homo sapiens
ggactttcctaaatgtttaa

SEQ ID NO: 2565969 - DNA, 11 bp, Homo sapiens
ggagaaacaca

SEQ ID NO: 2565970 - DNA, 15 bp, Homo sapiens
ggagaacctcaggct

SEQ ID NO: 2565971 - DNA, 17 bp, Homo sapiens
ggagaaccttgtgcctg

SEQ ID NO: 2565972 - DNA, 18 bp, Homo sapiens
ggagaactagaacctgga

SEQ ID NO: 2565973 - DNA, 22 bp, Homo sapiens
ggagaactagaacctggagggc

SEQ ID NO: 2565974 - DNA, 15 bp, Homo sapiens
ggagaagagctgttc

SEQ ID NO: 2565975 - DNA, 13 bp, Homo sapiens
ggagaagcatgaa

SEQ ID NO: 2565976 - DNA, 12 bp, Homo sapiens
ggagaagccatt

SEQ ID NO: 2565977 - DNA, 17 bp, Homo sapiens
ggagaagccattgtctt

SEQ ID NO: 2565978 - DNA, 14 bp, Homo sapiens
ggagaagggatgga

SEQ ID NO: 2565979 - DNA, 15 bp, Homo sapiens
ggagaatcacttgaa

SEQ ID NO: 2565980 - DNA, 19 bp, Homo sapiens
ggagaatcatgtgaacccg

SEQ ID NO: 2565981 - DNA, 16 bp, Homo sapiens
ggagaattttactgtg

SEQ ID NO: 2565982 - DNA, 16 bp, Homo sapiens
gctgccgcctcccagc

SEQ ID NO: 2565983 - DNA, 18 bp, Homo sapiens
gctgccgcctcccagcct

SEQ ID NO: 2565984 - DNA, 19 bp, Homo sapiens
gctgccgcctcccagcctg

SEQ ID NO: 2565985 - DNA, 20 bp, Homo sapiens
gctgccgcctcccagcctgg

SEQ ID NO: 2565986 - DNA, 21 bp, Homo sapiens
gctgcctctacctgacactcc

SEQ ID NO: 2565987 - DNA, 13 bp, Homo sapiens
gctgcctcttctg

SEQ ID NO: 2565988 - DNA, 16 bp, Homo sapiens
gctgcctgggatccct

SEQ ID NO: 2565989 - DNA, 12 bp, Homo sapiens
gctgcctgtagt

SEQ ID NO: 2565990 - DNA, 15 bp, Homo sapiens
gctgcctgtagttag

SEQ ID NO: 2565991 - DNA, 16 bp, Homo sapiens
gctgcctgtagttagg

SEQ ID NO: 2565992 - DNA, 18 bp, Homo sapiens
gctgcctgttcagctcca

SEQ ID NO: 2565993 - DNA, 15 bp, Homo sapiens
gctgcggtccaccca

SEQ ID NO: 2565994 - DNA, 18 bp, Homo sapiens
gctgcggtccacccagga

SEQ ID NO: 2565995 - DNA, 21 bp, Homo sapiens
gctgctacaaagaagacatgt

SEQ ID NO: 2565996 - DNA, 14 bp, Homo sapiens
gctgctacccagaa

SEQ ID NO: 2565997 - DNA, 23 bp, Homo sapiens
gctgctacttaattcctttctca

SEQ ID NO: 2565998 - DNA, 21 bp, Homo sapiens
gctgctcagggaaaagcagct

SEQ ID NO: 2565999 - DNA, 19 bp, Homo sapiens
gctgctcatctgatttttg

SEQ ID NO: 2566000 - DNA, 19 bp, Homo sapiens
gctgctccccagcagcgga

SEQ ID NO: 2566001 - DNA, 13 bp, Homo sapiens
gctgctcctcatg

SEQ ID NO: 2566002 - DNA, 22 bp, Homo sapiens
gctgctctgaattagtccttgc

SEQ ID NO: 2566003 - DNA, 16 bp, Homo sapiens
gctgctgaagctgcct

SEQ ID NO: 2566004 - DNA, 14 bp, Homo sapiens
gctgctgaaggctc

SEQ ID NO: 2566005 - DNA, 18 bp, Homo sapiens
gctgctgacctccacagc

SEQ ID NO: 2566006 - DNA, 19 bp, Homo sapiens
gctgctgacctccacagct

SEQ ID NO: 2566007 - DNA, 13 bp, Homo sapiens
gctgctgcccagg

SEQ ID NO: 2566008 - DNA, 15 bp, Homo sapiens
gctgctgcccaggcc

SEQ ID NO: 2566009 - DNA, 16 bp, Homo sapiens
gctgctgtccctcccc

SEQ ID NO: 2566010 - DNA, 21 bp, Homo sapiens
gctgcttccctctgcctgtcc

SEQ ID NO: 2566011 - DNA, 18 bp, Homo sapiens
gctgctttcccctgtggg

SEQ ID NO: 2566012 - DNA, 19 bp, Homo sapiens
gctgctttttgaggtggca

SEQ ID NO: 2566013 - DNA, 23 bp, Homo sapiens
gctggaaaagggtcttgggaaat

SEQ ID NO: 2566014 - DNA, 22 bp, Homo sapiens
gctggaccttgaactgggtact

SEQ ID NO: 2566015 - DNA, 21 bp, Homo sapiens
gctggacggggactggggatg

SEQ ID NO: 2566016 - DNA, 21 bp, Homo sapiens
gctggactctcagtctctgag

SEQ ID NO: 2566017 - DNA, 17 bp, Homo sapiens
gctggagaccatgcaga

SEQ ID NO: 2566018 - DNA, 18 bp, Homo sapiens
gctggagactcctaggca

SEQ ID NO: 2566019 - DNA, 13 bp, Homo sapiens
gctggagaggtta

SEQ ID NO: 2566020 - DNA, 17 bp, Homo sapiens
gctggagcctggtgccc

SEQ ID NO: 2566021 - DNA, 21 bp, Homo sapiens
gctggaggactagaacctgga

SEQ ID NO: 2566022 - DNA, 23 bp, Homo sapiens
gctggaggactagaacctggagg

SEQ ID NO: 2566023 - DNA, 16 bp, Homo sapiens
gctggaggtggggcct

SEQ ID NO: 2566024 - DNA, 12 bp, Homo sapiens
gctggagtgcag

SEQ ID NO: 2566025 - DNA, 22 bp, Homo sapiens
gctggagtgcagtgagccgaga

SEQ ID NO: 2566026 - DNA, 23 bp, Homo sapiens
gctggatcacagctgctttctgt

SEQ ID NO: 2566027 - DNA, 15 bp, Homo sapiens
gctggcaaagacaga

SEQ ID NO: 2566028 - DNA, 20 bp, Homo sapiens
gctggcaaaggtggctctcc

SEQ ID NO: 2566029 - DNA, 16 bp, Homo sapiens
gctggcagctctccag

SEQ ID NO: 2566030 - DNA, 19 bp, Homo sapiens
gctggccactgcacagagc

SEQ ID NO: 2566031 - DNA, 11 bp, Homo sapiens
gctggcccagc

SEQ ID NO: 2566032 - DNA, 12 bp, Homo sapiens
gctggcccagcc

SEQ ID NO: 2566033 - DNA, 16 bp, Homo sapiens
gctggcccagccctgc

SEQ ID NO: 2566034 - DNA, 20 bp, Homo sapiens
gctggcccagccctgctggc

SEQ ID NO: 2566035 - DNA, 20 bp, Homo sapiens
gctggcccagccggcctctc

SEQ ID NO: 2566036 - DNA, 23 bp, Homo sapiens
gctggcccagccggcctctctgg

SEQ ID NO: 2566037 - DNA, 14 bp, Homo sapiens
gctggcccctcacc

SEQ ID NO: 2566038 - DNA, 22 bp, Homo sapiens
gctggcccgtgacagactcctg

SEQ ID NO: 2566039 - DNA, 19 bp, Homo sapiens
gctggccgagggtcctggc

SEQ ID NO: 2566040 - DNA, 15 bp, Homo sapiens
gctggcctggatctc

SEQ ID NO: 2566041 - DNA, 17 bp, Homo sapiens
gctggcctggcccctca

SEQ ID NO: 2566042 - DNA, 18 bp, Homo sapiens
gctggcctggcccctcag

SEQ ID NO: 2566043 - DNA, 13 bp, Homo sapiens
gctggccttcctg

SEQ ID NO: 2566044 - DNA, 19 bp, Homo sapiens
gctggccttcctgccctac

SEQ ID NO: 2566045 - DNA, 16 bp, Homo sapiens
gctggcgcagccaagg

SEQ ID NO: 2566046 - DNA, 17 bp, Homo sapiens
gctggcgcagccaaggc

SEQ ID NO: 2566047 - DNA, 12 bp, Homo sapiens
gctggcgcctct

SEQ ID NO: 2566048 - DNA, 16 bp, Homo sapiens
gctggcgcctctgcaa

SEQ ID NO: 2566049 - DNA, 14 bp, Homo sapiens
gctggcgtgcagtg

SEQ ID NO: 2566050 - DNA, 15 bp, Homo sapiens
gctggcgtgcagtgg

SEQ ID NO: 2566051 - DNA, 19 bp, Homo sapiens
gctggctgttggctggggg

SEQ ID NO: 2566052 - DNA, 20 bp, Homo sapiens
gctggctgttggctgggggc

SEQ ID NO: 2566053 - DNA, 23 bp, Homo sapiens
gctggctgttggctgggggcctc

SEQ ID NO: 2566054 - DNA, 16 bp, Homo sapiens
gctgggaactcacctg

SEQ ID NO: 2566055 - DNA, 21 bp, Homo sapiens
gctgggaactcacctggggct

SEQ ID NO: 2566056 - DNA, 23 bp, Homo sapiens
gctgggaactcacctggggctgc

SEQ ID NO: 2566057 - DNA, 21 bp, Homo sapiens
gcttcagcctgaggctgagac

SEQ ID NO: 2566058 - DNA, 17 bp, Homo sapiens
gcttcaggttatcgaaa

SEQ ID NO: 2566059 - DNA, 22 bp, Homo sapiens
gcttcaggttatcgaaataaca

SEQ ID NO: 2566060 - DNA, 14 bp, Homo sapiens
gcttcagtggcagc

SEQ ID NO: 2566061 - DNA, 18 bp, Homo sapiens
gcttcagtggcagctgct

SEQ ID NO: 2566062 - DNA, 18 bp, Homo sapiens
gcttcataaatgaagcag

SEQ ID NO: 2566063 - DNA, 22 bp, Homo sapiens
gcttcataaatgaagcagcttt

SEQ ID NO: 2566064 - DNA, 16 bp, Homo sapiens
gcttcatgacattcct

SEQ ID NO: 2566065 - DNA, 14 bp, Homo sapiens
gcttcatgccagct

SEQ ID NO: 2566066 - DNA, 17 bp, Homo sapiens
gcttcatggcagaaggc

SEQ ID NO: 2566067 - DNA, 16 bp, Homo sapiens
gcttcattagagcagg

SEQ ID NO: 2566068 - DNA, 16 bp, Homo sapiens
gcttcatttcctgtgt

SEQ ID NO: 2566069 - DNA, 12 bp, Homo sapiens
gcttccaatttt

SEQ ID NO: 2566070 - DNA, 19 bp, Homo sapiens
gcttccagagagtcctctg

SEQ ID NO: 2566071 - DNA, 20 bp, Homo sapiens
gcttccagagagtcctctgg

SEQ ID NO: 2566072 - DNA, 21 bp, Homo sapiens
gcttccagagagtcctctgga

SEQ ID NO: 2566073 - DNA, 20 bp, Homo sapiens
gcttccaggtatctccagga

SEQ ID NO: 2566074 - DNA, 15 bp, Homo sapiens
gcttccagtgaggct

SEQ ID NO: 2566075 - DNA, 22 bp, Homo sapiens
gcttccagtgaggctctgccct

SEQ ID NO: 2566076 - DNA, 20 bp, Homo sapiens
gcttccatttgtgtgtgtgc

SEQ ID NO: 2566077 - DNA, 12 bp, Homo sapiens
gcttcccatcct

SEQ ID NO: 2566078 - DNA, 19 bp, Homo sapiens
gcttcccattgtggctcct

SEQ ID NO: 2566079 - DNA, 17 bp, Homo sapiens
gcttccctctgcctgtc

SEQ ID NO: 2566080 - DNA, 18 bp, Homo sapiens
gcttccctgactcattct

SEQ ID NO: 2566081 - DNA, 23 bp, Homo sapiens
gcttcctacccacacctctgcca

SEQ ID NO: 2566082 - DNA, 21 bp, Homo sapiens
gcttcgaggcccagcgacctc

SEQ ID NO: 2566083 - DNA, 18 bp, Homo sapiens
gcttcgggcccttcccac

SEQ ID NO: 2566084 - DNA, 14 bp, Homo sapiens
gcttcgtttatttt

SEQ ID NO: 2566085 - DNA, 16 bp, Homo sapiens
gcttcgtttattttca

SEQ ID NO: 2566086 - DNA, 20 bp, Homo sapiens
gcttctatcccaggaggtgg

SEQ ID NO: 2566087 - DNA, 18 bp, Homo sapiens
gcttctcatcctgcaggc

SEQ ID NO: 2566088 - DNA, 14 bp, Homo sapiens
gcttctctacagac

SEQ ID NO: 2566089 - DNA, 19 bp, Homo sapiens
gcttctctgtgaacgattt

SEQ ID NO: 2566090 - DNA, 21 bp, Homo sapiens
gcttctgcaccctccaccctg

SEQ ID NO: 2566091 - DNA, 13 bp, Homo sapiens
gcttctgcctgca

SEQ ID NO: 2566092 - DNA, 12 bp, Homo sapiens
gcttctggagcc

SEQ ID NO: 2566093 - DNA, 18 bp, Homo sapiens
gcttctggagcccttggg

SEQ ID NO: 2566094 - DNA, 15 bp, Homo sapiens
gcttctggtactctc

SEQ ID NO: 2566095 - DNA, 21 bp, Homo sapiens
gcttcttaatcttttcacaaa

SEQ ID NO: 2566096 - DNA, 15 bp, Homo sapiens
gcttcttcagagact

SEQ ID NO: 2566097 - DNA, 21 bp, Homo sapiens
gcttcttcctatttgccatgg

SEQ ID NO: 2566098 - DNA, 23 bp, Homo sapiens
gcttcttttagttgtatctcttt

SEQ ID NO: 2566099 - DNA, 20 bp, Homo sapiens
gcttgaaagaaaatatgcat

SEQ ID NO: 2566100 - DNA, 22 bp, Homo sapiens
gcttgaagatcgttagtatcta

SEQ ID NO: 2566101 - DNA, 20 bp, Homo sapiens
gcttgagggttgggctggtg

SEQ ID NO: 2566102 - DNA, 23 bp, Homo sapiens
gcttgcataataagctaaagagg

SEQ ID NO: 2566103 - DNA, 13 bp, Homo sapiens
gcttgcctagggc

SEQ ID NO: 2566104 - DNA, 15 bp, Homo sapiens
gcttgcctctctgtt

SEQ ID NO: 2566105 - DNA, 14 bp, Homo sapiens
gcttgctcattttt

SEQ ID NO: 2566106 - DNA, 12 bp, Homo sapiens
gcttgctgagag

SEQ ID NO: 2566107 - DNA, 18 bp, Homo sapiens
gcttggaaactggatgag

SEQ ID NO: 2566108 - DNA, 21 bp, Homo sapiens
gcttggaaagcatcacctcag

SEQ ID NO: 2566109 - DNA, 14 bp, Homo sapiens
gcttggagcagagg

SEQ ID NO: 2566110 - DNA, 13 bp, Homo sapiens
gcttggcagctga

SEQ ID NO: 2566111 - DNA, 18 bp, Homo sapiens
gcttggccagaagggggc

SEQ ID NO: 2566112 - DNA, 14 bp, Homo sapiens
gcttggctgcttgg

SEQ ID NO: 2566113 - DNA, 14 bp, Homo sapiens
gcttgggacaaatc

SEQ ID NO: 2566114 - DNA, 19 bp, Homo sapiens
gcttgggaccgccagatgg

SEQ ID NO: 2566115 - DNA, 15 bp, Homo sapiens
gcttgggcccagctg

SEQ ID NO: 2566116 - DNA, 18 bp, Homo sapiens
gcttgggcccagctgggc

SEQ ID NO: 2566117 - DNA, 23 bp, Homo sapiens
gcttgggcttccatttgtgtgtg

SEQ ID NO: 2566118 - DNA, 18 bp, Homo sapiens
gcttgggtggagaagcca

SEQ ID NO: 2566119 - DNA, 22 bp, Homo sapiens
gcttggtggatgaaatgtcagt

SEQ ID NO: 2566120 - DNA, 18 bp, Homo sapiens
gcttgtaaatagctcagg

SEQ ID NO: 2566121 - DNA, 20 bp, Homo sapiens
gcttgtaaatagctcaggtg

SEQ ID NO: 2566122 - DNA, 14 bp, Homo sapiens
gcttgtatagtgta

SEQ ID NO: 2566123 - DNA, 17 bp, Homo sapiens
gcttgtatcaacactgt

SEQ ID NO: 2566124 - DNA, 13 bp, Homo sapiens
gcttgtcagagct

SEQ ID NO: 2566125 - DNA, 14 bp, Homo sapiens
gcttgtcagagctg

SEQ ID NO: 2566126 - DNA, 17 bp, Homo sapiens
gcttgtcagagctggga

SEQ ID NO: 2566127 - DNA, 18 bp, Homo sapiens
gcttgtcagagctgggag

SEQ ID NO: 2566128 - DNA, 20 bp, Homo sapiens
gcttgtggagccccacactg

SEQ ID NO: 2566129 - DNA, 23 bp, Homo sapiens
gcttgtggattgagggtaggagg

SEQ ID NO: 2566130 - DNA, 16 bp, Homo sapiens
gcttgtgtgtttcact

SEQ ID NO: 2566131 - DNA, 19 bp, Homo sapiens
gcttgtgtgtttcactttt

SEQ ID NO: 2566132 - DNA, 14 bp, Homo sapiens
gcttgttggatttt

SEQ ID NO: 2566133 - DNA, 15 bp, Homo sapiens
gcttgtttcctagca

SEQ ID NO: 2566134 - DNA, 19 bp, Homo sapiens
gcttgtttgctcacctggg

SEQ ID NO: 2566135 - DNA, 13 bp, Homo sapiens
gctttaaacaaat

SEQ ID NO: 2566136 - DNA, 17 bp, Homo sapiens
gctttaaacaaattcat

SEQ ID NO: 2566137 - DNA, 22 bp, Homo sapiens
gctttaaacattggttcttgta

SEQ ID NO: 2566138 - DNA, 22 bp, Homo sapiens
gctttaaactcagggacagagc

SEQ ID NO: 2566139 - DNA, 17 bp, Homo sapiens
gctttattttttaagta

SEQ ID NO: 2566140 - DNA, 19 bp, Homo sapiens
gctttattttttaagtatt

SEQ ID NO: 2566141 - DNA, 16 bp, Homo sapiens
gctttcaattccgtag

SEQ ID NO: 2566142 - DNA, 14 bp, Homo sapiens
ggataggagcctgc

SEQ ID NO: 2566143 - DNA, 21 bp, Homo sapiens
ggataggagttcacttcatct

SEQ ID NO: 2566144 - DNA, 16 bp, Homo sapiens
ggatatagttttactt

SEQ ID NO: 2566145 - DNA, 14 bp, Homo sapiens
ggatcacagggccc

SEQ ID NO: 2566146 - DNA, 18 bp, Homo sapiens
ggatcactggagcccagg

SEQ ID NO: 2566147 - DNA, 21 bp, Homo sapiens
ggatcagatgaactcttagaa

SEQ ID NO: 2566148 - DNA, 16 bp, Homo sapiens
ggatcagattgcatgt

SEQ ID NO: 2566149 - DNA, 16 bp, Homo sapiens
ggatcatggtgtaata

SEQ ID NO: 2566150 - DNA, 18 bp, Homo sapiens
ggatccctcatctgtccc

SEQ ID NO: 2566151 - DNA, 18 bp, Homo sapiens
ggatcctagccttatcct

SEQ ID NO: 2566152 - DNA, 14 bp, Homo sapiens
ggatcctattctca

SEQ ID NO: 2566153 - DNA, 23 bp, Homo sapiens
ggatcggaggcttgtcagagctg

SEQ ID NO: 2566154 - DNA, 13 bp, Homo sapiens
ggatctaccagca

SEQ ID NO: 2566155 - DNA, 10 bp, Homo sapiens
ggatctcagg

SEQ ID NO: 2566156 - DNA, 21 bp, Homo sapiens
ggatctggtagggggaaaatg

SEQ ID NO: 2566157 - DNA, 16 bp, Homo sapiens
ggatcttgcattccca

SEQ ID NO: 2566158 - DNA, 22 bp, Homo sapiens
ggatcttgcattcccagtggtc

SEQ ID NO: 2566159 - DNA, 21 bp, Homo sapiens
ggatctttggacagaagcagc

SEQ ID NO: 2566160 - DNA, 14 bp, Homo sapiens
ggatgaatgaggtc

SEQ ID NO: 2566161 - DNA, 22 bp, Homo sapiens
ggatgaatgaggtcccaggcag

SEQ ID NO: 2566162 - DNA, 23 bp, Homo sapiens
ggatgaatgtatgtgcactgtca

SEQ ID NO: 2566163 - DNA, 21 bp, Homo sapiens
ggatgaattccaaattctgct

SEQ ID NO: 2566164 - DNA, 15 bp, Homo sapiens
ggatgacatgtccct

SEQ ID NO: 2566165 - DNA, 20 bp, Homo sapiens
ggatgacatgtccctacacc

SEQ ID NO: 2566166 - DNA, 21 bp, Homo sapiens
ggatgagaatttgagtgctct

SEQ ID NO: 2566167 - DNA, 23 bp, Homo sapiens
ggatgagaatttgagtgctctga

SEQ ID NO: 2566168 - DNA, 20 bp, Homo sapiens
ggatgagagcccagaggtaa

SEQ ID NO: 2566169 - DNA, 20 bp, Homo sapiens
ggatgagcatggagctggcc

SEQ ID NO: 2566170 - DNA, 23 bp, Homo sapiens
ggatgagtacccaaaagctcagc

SEQ ID NO: 2566171 - DNA, 16 bp, Homo sapiens
ggatgatctaggaaga

SEQ ID NO: 2566172 - DNA, 15 bp, Homo sapiens
ggatgatgcctcatg

SEQ ID NO: 2566173 - DNA, 17 bp, Homo sapiens
ggatgattggattattc

SEQ ID NO: 2566174 - DNA, 16 bp, Homo sapiens
ggatgcagagtcagca

SEQ ID NO: 2566175 - DNA, 17 bp, Homo sapiens
ggatgcagcctcacagt

SEQ ID NO: 2566176 - DNA, 19 bp, Homo sapiens
ggatgcctggtggcagctg

SEQ ID NO: 2566177 - DNA, 21 bp, Homo sapiens
ggatgctcctcccttctctac

SEQ ID NO: 2566178 - DNA, 14 bp, Homo sapiens
ggatgctgcctgag

SEQ ID NO: 2566179 - DNA, 19 bp, Homo sapiens
ggatggaaaaggaagacta

SEQ ID NO: 2566180 - DNA, 17 bp, Homo sapiens
ggatggaatgatgggtc

SEQ ID NO: 2566181 - DNA, 19 bp, Homo sapiens
ggatggaggggtggtcctg

SEQ ID NO: 2566182 - DNA, 16 bp, Homo sapiens
ggatggcctggccagg

SEQ ID NO: 2566183 - DNA, 15 bp, Homo sapiens
ggatgggagtgagac

SEQ ID NO: 2566184 - DNA, 20 bp, Homo sapiens
ggatgggggaaatggtgcct

SEQ ID NO: 2566185 - DNA, 14 bp, Homo sapiens
ggatggtcctgggg

SEQ ID NO: 2566186 - DNA, 22 bp, Homo sapiens
ggatggtcctggggctctgtgc

SEQ ID NO: 2566187 - DNA, 16 bp, Homo sapiens
ggatgtacatttccaa

SEQ ID NO: 2566188 - DNA, 17 bp, Homo sapiens
ggatgtcttccttggag

SEQ ID NO: 2566189 - DNA, 22 bp, Homo sapiens
ggatgtgaattgcctgcagaga

SEQ ID NO: 2566190 - DNA, 23 bp, Homo sapiens
ggatgtgggagggagcagacagg

SEQ ID NO: 2566191 - DNA, 15 bp, Homo sapiens
ggatgttctgggaca

SEQ ID NO: 2566192 - DNA, 16 bp, Homo sapiens
ggatgttctgggacac

SEQ ID NO: 2566193 - DNA, 22 bp, Homo sapiens
ggatgttgaaaaagttctgcag

SEQ ID NO: 2566194 - DNA, 23 bp, Homo sapiens
ggattaaacttaatctaaatgga

SEQ ID NO: 2566195 - DNA, 17 bp, Homo sapiens
ggattagggagagaaga

SEQ ID NO: 2566196 - DNA, 20 bp, Homo sapiens
ggattattttttcagaccga

SEQ ID NO: 2566197 - DNA, 19 bp, Homo sapiens
ggattcctgacccaggccg

SEQ ID NO: 2566198 - DNA, 20 bp, Homo sapiens
ggattcctgacccaggccgc

SEQ ID NO: 2566199 - DNA, 13 bp, Homo sapiens
ggattctgggagg

SEQ ID NO: 2566200 - DNA, 23 bp, Homo sapiens
ggattctgtacatgcattgagct

SEQ ID NO: 2566201 - DNA, 14 bp, Homo sapiens
ggattgaagccctc

SEQ ID NO: 2566202 - DNA, 20 bp, Homo sapiens
ggattgatcggagcctcctc

SEQ ID NO: 2566203 - DNA, 14 bp, Homo sapiens
ggattgctgccact

SEQ ID NO: 2566204 - DNA, 18 bp, Homo sapiens
ggattggggaagactgtg

SEQ ID NO: 2566205 - DNA, 16 bp, Homo sapiens
ggattgtccccgaccc

SEQ ID NO: 2566206 - DNA, 17 bp, Homo sapiens
ggatttaacagaaatgt

SEQ ID NO: 2566207 - DNA, 18 bp, Homo sapiens
ggatttataaatgctatt

SEQ ID NO: 2566208 - DNA, 19 bp, Homo sapiens
ggatttccagccagggctg

SEQ ID NO: 2566209 - DNA, 13 bp, Homo sapiens
ggatttctcccag

SEQ ID NO: 2566210 - DNA, 13 bp, Homo sapiens
ggatttgaagcaa

SEQ ID NO: 2566211 - DNA, 22 bp, Homo sapiens
ggatttgccccttcccatctct

SEQ ID NO: 2566212 - DNA, 19 bp, Homo sapiens
ggatttgggttggaagtga

SEQ ID NO: 2566213 - DNA, 21 bp, Homo sapiens
ggattttgatccaagctggtc

SEQ ID NO: 2566214 - DNA, 21 bp, Homo sapiens
ggcaaagggagcagaactgaa

SEQ ID NO: 2566215 - DNA, 13 bp, Homo sapiens
ggcaaatgcccaa

SEQ ID NO: 2566216 - DNA, 21 bp, Homo sapiens
ggcaaccacaggcagcattta

SEQ ID NO: 2566217 - DNA, 16 bp, Homo sapiens
ggcaaccccagttctg

SEQ ID NO: 2566218 - DNA, 17 bp, Homo sapiens
ggcaacccccagcctgc

SEQ ID NO: 2566219 - DNA, 18 bp, Homo sapiens
ggcaacccccagcctgct

SEQ ID NO: 2566220 - DNA, 19 bp, Homo sapiens
ggcaacccccagcctgcta

SEQ ID NO: 2566221 - DNA, 19 bp, Homo sapiens
ggcaactgaggcagacagc

SEQ ID NO: 2566222 - DNA, 19 bp, Homo sapiens
ggcaactgcattggctttg

SEQ ID NO: 2566223 - DNA, 22 bp, Homo sapiens
ggcaactttccttgttccccat

SEQ ID NO: 2566224 - DNA, 18 bp, Homo sapiens
ggcaagaaggaattgact

SEQ ID NO: 2566225 - DNA, 22 bp, Homo sapiens
ggcaagcttggctgtagaagga

SEQ ID NO: 2566226 - DNA, 14 bp, Homo sapiens
ggcaaggacacaga

SEQ ID NO: 2566227 - DNA, 14 bp, Homo sapiens
ggcaaggctgtgct

SEQ ID NO: 2566228 - DNA, 18 bp, Homo sapiens
ggcaatagtgtgttctga

SEQ ID NO: 2566229 - DNA, 14 bp, Homo sapiens
ggcaatgctggctg

SEQ ID NO: 2566230 - DNA, 23 bp, Homo sapiens
ggcaatgctggctgttggctggg

SEQ ID NO: 2566231 - DNA, 20 bp, Homo sapiens
ggcacaatggctaattccca

SEQ ID NO: 2566232 - DNA, 13 bp, Homo sapiens
ggcacacacctgt

SEQ ID NO: 2566233 - DNA, 21 bp, Homo sapiens
ggcacacacctgtagtcccag

SEQ ID NO: 2566234 - DNA, 19 bp, Homo sapiens
ggcacacgcctcccactgg

SEQ ID NO: 2566235 - DNA, 20 bp, Homo sapiens
ggcacagcaactctaagact

SEQ ID NO: 2566236 - DNA, 13 bp, Homo sapiens
ggcacagccttct

SEQ ID NO: 2566237 - DNA, 18 bp, Homo sapiens
ggcacagcggggccccag

SEQ ID NO: 2566238 - DNA, 21 bp, Homo sapiens
ggcacagttttctgagaaaga

SEQ ID NO: 2566239 - DNA, 18 bp, Homo sapiens
ggcacatcctatgcaata

SEQ ID NO: 2566240 - DNA, 14 bp, Homo sapiens
ggcacatggaggag

SEQ ID NO: 2566241 - DNA, 18 bp, Homo sapiens
ggcacatttaagagacag

SEQ ID NO: 2566242 - DNA, 22 bp, Homo sapiens
ggcaccactgcactccagcctg

SEQ ID NO: 2566243 - DNA, 22 bp, Homo sapiens
ggcaccagaggctgcagaaggc

SEQ ID NO: 2566244 - DNA, 15 bp, Homo sapiens
ggcaccagcagcctg

SEQ ID NO: 2566245 - DNA, 20 bp, Homo sapiens
ggcacccacaagtgccactg

SEQ ID NO: 2566246 - DNA, 23 bp, Homo sapiens
ggcacccaccatcatgtctggct

SEQ ID NO: 2566247 - DNA, 16 bp, Homo sapiens
ggcaccccctggagag

SEQ ID NO: 2566248 - DNA, 15 bp, Homo sapiens
ggcacccggcccctg

SEQ ID NO: 2566249 - DNA, 16 bp, Homo sapiens
ggcacccggcccctgc

SEQ ID NO: 2566250 - DNA, 17 bp, Homo sapiens
ggcacccggcccctgct

SEQ ID NO: 2566251 - DNA, 19 bp, Homo sapiens
ggcacccggcccctgctgg

SEQ ID NO: 2566252 - DNA, 20 bp, Homo sapiens
ggcacccggcccctgctggt

SEQ ID NO: 2566253 - DNA, 20 bp, Homo sapiens
ggcacccttctttcctcttc

SEQ ID NO: 2566254 - DNA, 22 bp, Homo sapiens
ggcacccttctttcctcttccc

SEQ ID NO: 2566255 - DNA, 15 bp, Homo sapiens
ggcaccgagaatgtt

SEQ ID NO: 2566256 - DNA, 17 bp, Homo sapiens
ggcacctggggagtggg

SEQ ID NO: 2566257 - DNA, 21 bp, Homo sapiens
ggcacgcttgcgtatgtctgt

SEQ ID NO: 2566258 - DNA, 17 bp, Homo sapiens
ggcgcagtgcctctggt

SEQ ID NO: 2566259 - DNA, 16 bp, Homo sapiens
ggcgccctggaagccg

SEQ ID NO: 2566260 - DNA, 19 bp, Homo sapiens
ggcgccggcgggcgggccg

SEQ ID NO: 2566261 - DNA, 14 bp, Homo sapiens
ggcgcggccagccc

SEQ ID NO: 2566262 - DNA, 12 bp, Homo sapiens
ggcgctggccca

SEQ ID NO: 2566263 - DNA, 17 bp, Homo sapiens
ggcggacgttccagccg

SEQ ID NO: 2566264 - DNA, 14 bp, Homo sapiens
ggcggcacagcctt

SEQ ID NO: 2566265 - DNA, 15 bp, Homo sapiens
ggcggcacagccttc

SEQ ID NO: 2566266 - DNA, 14 bp, Homo sapiens
ggcggcagcagcca

SEQ ID NO: 2566267 - DNA, 22 bp, Homo sapiens
ggcgggcacctatagtcccagc

SEQ ID NO: 2566268 - DNA, 17 bp, Homo sapiens
ggcgggccaaggactgc

SEQ ID NO: 2566269 - DNA, 14 bp, Homo sapiens
ggcgggccagccag

SEQ ID NO: 2566270 - DNA, 21 bp, Homo sapiens
ggcggtgggcacccaccctgg

SEQ ID NO: 2566271 - DNA, 22 bp, Homo sapiens
ggcggtgggcacccaccctggg

SEQ ID NO: 2566272 - DNA, 15 bp, Homo sapiens
ggcgtgaggatggga

SEQ ID NO: 2566273 - DNA, 14 bp, Homo sapiens
ggcgtgcagtggtg

SEQ ID NO: 2566274 - DNA, 15 bp, Homo sapiens
ggcgtggagctgcct

SEQ ID NO: 2566275 - DNA, 19 bp, Homo sapiens
ggctaaggcgtggagctgc

SEQ ID NO: 2566276 - DNA, 22 bp, Homo sapiens
ggctaaggcgtggagctgcctg

SEQ ID NO: 2566277 - DNA, 12 bp, Homo sapiens
ggctacacaggg

SEQ ID NO: 2566278 - DNA, 15 bp, Homo sapiens
ggctacacagggatg

SEQ ID NO: 2566279 - DNA, 21 bp, Homo sapiens
ggctagaacctagaagggcta

SEQ ID NO: 2566280 - DNA, 22 bp, Homo sapiens
ggctagaacctggagagctaga

SEQ ID NO: 2566281 - DNA, 22 bp, Homo sapiens
ggctagaatctggagagctaga

SEQ ID NO: 2566282 - DNA, 20 bp, Homo sapiens
ggctagaggccagccccacc

SEQ ID NO: 2566283 - DNA, 14 bp, Homo sapiens
ggctagagtcctca

SEQ ID NO: 2566284 - DNA, 20 bp, Homo sapiens
ggctagagtgcagtggcatg

SEQ ID NO: 2566285 - DNA, 16 bp, Homo sapiens
ggctaggacccctcca

SEQ ID NO: 2566286 - DNA, 13 bp, Homo sapiens
ggctaggtacaca

SEQ ID NO: 2566287 - DNA, 19 bp, Homo sapiens
ggctatagctacaggaagc

SEQ ID NO: 2566288 - DNA, 13 bp, Homo sapiens
ggctatgcatttg

SEQ ID NO: 2566289 - DNA, 21 bp, Homo sapiens
ggctatggggatagatgtgtg

SEQ ID NO: 2566290 - DNA, 17 bp, Homo sapiens
ggctcacgcctgtaatc

SEQ ID NO: 2566291 - DNA, 23 bp, Homo sapiens
ggctcacgcctgtaatcccagca

SEQ ID NO: 2566292 - DNA, 16 bp, Homo sapiens
ggctcactgcagcctc

SEQ ID NO: 2566293 - DNA, 14 bp, Homo sapiens
ggctcagagtgggg

SEQ ID NO: 2566294 - DNA, 10 bp, Homo sapiens
ggctcagcct

SEQ ID NO: 2566295 - DNA, 12 bp, Homo sapiens
ggctcagcctgg

SEQ ID NO: 2566296 - DNA, 13 bp, Homo sapiens
ggctcagcctggt

SEQ ID NO: 2566297 - DNA, 12 bp, Homo sapiens
ggctcaggaaaa

SEQ ID NO: 2566298 - DNA, 14 bp, Homo sapiens
ggctcagtctcagg

SEQ ID NO: 2566299 - DNA, 17 bp, Homo sapiens
ggctccaaaccctcgag

SEQ ID NO: 2566300 - DNA, 16 bp, Homo sapiens
ggctccagagggcact

SEQ ID NO: 2566301 - DNA, 12 bp, Homo sapiens
ggctccaggagc

SEQ ID NO: 2566302 - DNA, 13 bp, Homo sapiens
ggctccaggagca

SEQ ID NO: 2566303 - DNA, 17 bp, Homo sapiens
ggctccaggagcagcca

SEQ ID NO: 2566304 - DNA, 19 bp, Homo sapiens
ggctccaggagcagccaca

SEQ ID NO: 2566305 - DNA, 11 bp, Homo sapiens
ggctccaggct

SEQ ID NO: 2566306 - DNA, 13 bp, Homo sapiens
ggctccaggctcc

SEQ ID NO: 2566307 - DNA, 16 bp, Homo sapiens
ggctccaggctccttt

SEQ ID NO: 2566308 - DNA, 19 bp, Homo sapiens
ggctcccatgaccatactg

SEQ ID NO: 2566309 - DNA, 21 bp, Homo sapiens
ggctccccatgtgtcctggtt

SEQ ID NO: 2566310 - DNA, 22 bp, Homo sapiens
ggctccccatgtgtcctggttc

SEQ ID NO: 2566311 - DNA, 18 bp, Homo sapiens
ggctccctgactgggagt

SEQ ID NO: 2566312 - DNA, 21 bp, Homo sapiens
ggctccctgtaacctcttcag

SEQ ID NO: 2566313 - DNA, 13 bp, Homo sapiens
ggctcccttccca

SEQ ID NO: 2566314 - DNA, 12 bp, Homo sapiens
ggctcctgtgct

SEQ ID NO: 2566315 - DNA, 20 bp, Homo sapiens
ggctcctgtgctactttgcc

SEQ ID NO: 2566316 - DNA, 20 bp, Homo sapiens
ggctccttcccatcgctgtc

SEQ ID NO: 2566317 - DNA, 20 bp, Homo sapiens
ggctcctttctccagccagc

SEQ ID NO: 2566318 - DNA, 21 bp, Homo sapiens
ggctcctttctccagccagca

SEQ ID NO: 2566319 - DNA, 18 bp, Homo sapiens
ggctctacaactgagtcc

SEQ ID NO: 2566320 - DNA, 14 bp, Homo sapiens
ggctctcagctcag

SEQ ID NO: 2566321 - DNA, 17 bp, Homo sapiens
ggctctccaagtgccag

SEQ ID NO: 2566322 - DNA, 13 bp, Homo sapiens
ggctctccagtta

SEQ ID NO: 2566323 - DNA, 20 bp, Homo sapiens
ggctctcctcagaagaaaga

SEQ ID NO: 2566324 - DNA, 22 bp, Homo sapiens
ggctctctatagcaccagggct

SEQ ID NO: 2566325 - DNA, 13 bp, Homo sapiens
ggctctctccagg

SEQ ID NO: 2566326 - DNA, 14 bp, Homo sapiens
ggctctctccagga

SEQ ID NO: 2566327 - DNA, 13 bp, Homo sapiens
ggctctgaccagt

SEQ ID NO: 2566328 - DNA, 17 bp, Homo sapiens
ggctctgaggtgcctgt

SEQ ID NO: 2566329 - DNA, 20 bp, Homo sapiens
ggctctgcaatgggcactgg

SEQ ID NO: 2566330 - DNA, 17 bp, Homo sapiens
ggctctgccccagaggc

SEQ ID NO: 2566331 - DNA, 23 bp, Homo sapiens
ggctctgccccagctctggcttc

SEQ ID NO: 2566332 - DNA, 12 bp, Homo sapiens
ggctctgccctt

SEQ ID NO: 2566333 - DNA, 13 bp, Homo sapiens
ggctctgcctccc

SEQ ID NO: 2566334 - DNA, 15 bp, Homo sapiens
ggctctgtgcaggga

SEQ ID NO: 2566335 - DNA, 20 bp, Homo sapiens
ggctctgtgctgaccctcct

SEQ ID NO: 2566336 - DNA, 12 bp, Homo sapiens
ggctcttccagg

SEQ ID NO: 2566337 - DNA, 18 bp, Homo sapiens
ggctcttccaggctggga

SEQ ID NO: 2566338 - DNA, 17 bp, Homo sapiens
ggctcttctccccagag

SEQ ID NO: 2566339 - DNA, 14 bp, Homo sapiens
ggctcttctgacta

SEQ ID NO: 2566340 - DNA, 14 bp, Homo sapiens
ggctctttccttgc

SEQ ID NO: 2566341 - DNA, 20 bp, Homo sapiens
ggctgaaagaggccaatgcc

SEQ ID NO: 2566342 - DNA, 11 bp, Homo sapiens
ggctgaaagcc

SEQ ID NO: 2566343 - DNA, 15 bp, Homo sapiens
ggctgaaccctgtgc

SEQ ID NO: 2566344 - DNA, 20 bp, Homo sapiens
ggctgaaccctgtgctggtg

SEQ ID NO: 2566345 - DNA, 14 bp, Homo sapiens
ggctgaaggactgt

SEQ ID NO: 2566346 - DNA, 18 bp, Homo sapiens
ggctgaaggactgtgaca

SEQ ID NO: 2566347 - DNA, 18 bp, Homo sapiens
ggctgaccccaaagagcc

SEQ ID NO: 2566348 - DNA, 19 bp, Homo sapiens
ggctgaccccaaagagcct

SEQ ID NO: 2566349 - DNA, 23 bp, Homo sapiens
ggctgaccttcctcgcagagagg

SEQ ID NO: 2566350 - DNA, 24 bp, Homo sapiens
ggctgactagaagggccagtcctg

SEQ ID NO: 2566351 - DNA, 14 bp, Homo sapiens
ggctgagaacactg

SEQ ID NO: 2566352 - DNA, 17 bp, Homo sapiens
ggctgagaaccctgcgt

SEQ ID NO: 2566353 - DNA, 15 bp, Homo sapiens
ggctgagacaggaga

SEQ ID NO: 2566354 - DNA, 13 bp, Homo sapiens
ggctgagccctgg

SEQ ID NO: 2566355 - DNA, 15 bp, Homo sapiens
ggctgagctctctgt

SEQ ID NO: 2566356 - DNA, 20 bp, Homo sapiens
ggctgagctctctgtgggct

SEQ ID NO: 2566357 - DNA, 22 bp, Homo sapiens
ggctgaggaaaggccagctggc

SEQ ID NO: 2566358 - DNA, 20 bp, Homo sapiens
ggctgaggaggcctccatct

SEQ ID NO: 2566359 - DNA, 15 bp, Homo sapiens
ggctgagggagcctg

SEQ ID NO: 2566360 - DNA, 15 bp, Homo sapiens
ggctgatggagtaaa

SEQ ID NO: 2566361 - DNA, 13 bp, Homo sapiens
ggctgcagcagcg

SEQ ID NO: 2566362 - DNA, 22 bp, Homo sapiens
ggctgcagcagcggtggcctct

SEQ ID NO: 2566363 - DNA, 15 bp, Homo sapiens
ggctgcagtgagcca

SEQ ID NO: 2566364 - DNA, 23 bp, Homo sapiens
ggctgcatctgggattcccacca

SEQ ID NO: 2566365 - DNA, 17 bp, Homo sapiens
ggctgccaaggccagag

SEQ ID NO: 2566366 - DNA, 18 bp, Homo sapiens
ggctgccatgtgaagagg

SEQ ID NO: 2566367 - DNA, 19 bp, Homo sapiens
ggctgcccccggccccctg

SEQ ID NO: 2566368 - DNA, 15 bp, Homo sapiens
ggctgccctggccct

SEQ ID NO: 2566369 - DNA, 16 bp, Homo sapiens
ggctgccctggccctg

SEQ ID NO: 2566370 - DNA, 22 bp, Homo sapiens
ggctgccctggccctgaggtgt

SEQ ID NO: 2566371 - DNA, 17 bp, Homo sapiens
ggctgcctgggctgttg

SEQ ID NO: 2566372 - DNA, 18 bp, Homo sapiens
ggctgctgaaggctcgag

SEQ ID NO: 2566373 - DNA, 16 bp, Homo sapiens
ggctgctgacctccac

SEQ ID NO: 2566374 - DNA, 21 bp, Homo sapiens
ggctgctgacctccacagctt

SEQ ID NO: 2566375 - DNA, 14 bp, Homo sapiens
ggctgctgcccagg

SEQ ID NO: 2566376 - DNA, 13 bp, Homo sapiens
ggctgctggcctg

SEQ ID NO: 2566377 - DNA, 18 bp, Homo sapiens
ggctgctggcgcctctgc

SEQ ID NO: 2566378 - DNA, 15 bp, Homo sapiens
ggctgctgtgtgcct

SEQ ID NO: 2566379 - DNA, 22 bp, Homo sapiens
ggctggaacagattcacactgt

SEQ ID NO: 2566380 - DNA, 16 bp, Homo sapiens
ggctggaatctggaga

SEQ ID NO: 2566381 - DNA, 20 bp, Homo sapiens
ggctggaatctggagagcta

SEQ ID NO: 2566382 - DNA, 15 bp, Homo sapiens
ggctggacgtggtgg

SEQ ID NO: 2566383 - DNA, 19 bp, Homo sapiens
ggctggagaccatgcagag

SEQ ID NO: 2566384 - DNA, 19 bp, Homo sapiens
ggctggagacgggtgggcg

SEQ ID NO: 2566385 - DNA, 13 bp, Homo sapiens
ggctggagctggc

SEQ ID NO: 2566386 - DNA, 15 bp, Homo sapiens
ggctggatgaaattt

SEQ ID NO: 2566387 - DNA, 15 bp, Homo sapiens
ggctggatgtggtgg

SEQ ID NO: 2566388 - DNA, 19 bp, Homo sapiens
ggctggatgtggtggcata

SEQ ID NO: 2566389 - DNA, 20 bp, Homo sapiens
ggctggcagctctccagtca

SEQ ID NO: 2566390 - DNA, 14 bp, Homo sapiens
ggctggcaggtatg

SEQ ID NO: 2566391 - DNA, 23 bp, Homo sapiens
ggctggccactgcacagagctct

SEQ ID NO: 2566392 - DNA, 16 bp, Homo sapiens
ggctggcccagccctg

SEQ ID NO: 2566393 - DNA, 21 bp, Homo sapiens
ggctggcccagccctgctggc

SEQ ID NO: 2566394 - DNA, 13 bp, Homo sapiens
ggctggcctggcc

SEQ ID NO: 2566395 - DNA, 13 bp, Homo sapiens
ggctggccttcct

SEQ ID NO: 2566396 - DNA, 14 bp, Homo sapiens
ggctggcgcagcca

SEQ ID NO: 2566397 - DNA, 17 bp, Homo sapiens
ggctggcgcagccaagg

SEQ ID NO: 2566398 - DNA, 20 bp, Homo sapiens
ggctggcgtgcagtggtgcg

SEQ ID NO: 2566399 - DNA, 14 bp, Homo sapiens
ggctggctgcagtg

SEQ ID NO: 2566400 - DNA, 16 bp, Homo sapiens
ggctgggatgggcctg

SEQ ID NO: 2566401 - DNA, 13 bp, Homo sapiens
ggctgggcttcag

SEQ ID NO: 2566402 - DNA, 17 bp, Homo sapiens
ggctgggcttcagtggc

SEQ ID NO: 2566403 - DNA, 21 bp, Homo sapiens
ggctgggcttcagtggcagct

SEQ ID NO: 2566404 - DNA, 22 bp, Homo sapiens
gattctcagggtctctgctgcc

SEQ ID NO: 2566405 - DNA, 23 bp, Homo sapiens
gattctcagggtctctgctgccg

SEQ ID NO: 2566406 - DNA, 15 bp, Homo sapiens
gattctcctgcctca

SEQ ID NO: 2566407 - DNA, 19 bp, Homo sapiens
gattctcctgcctcagcct

SEQ ID NO: 2566408 - DNA, 20 bp, Homo sapiens
gattctcctgcctcagcctc

SEQ ID NO: 2566409 - DNA, 20 bp, Homo sapiens
gattcttctgcttcagcctc

SEQ ID NO: 2566410 - DNA, 18 bp, Homo sapiens
gattctttcctgaggctg

SEQ ID NO: 2566411 - DNA, 20 bp, Homo sapiens
gattctttttaaagtgtttc

SEQ ID NO: 2566412 - DNA, 15 bp, Homo sapiens
gattgaaaacttttc

SEQ ID NO: 2566413 - DNA, 23 bp, Homo sapiens
gattgacgggactgttggtattg

SEQ ID NO: 2566414 - DNA, 13 bp, Homo sapiens
gattgaggcctgc

SEQ ID NO: 2566415 - DNA, 23 bp, Homo sapiens
gattgcaccactgcactccagcc

SEQ ID NO: 2566416 - DNA, 23 bp, Homo sapiens
gattgcaggagtccctgccatca

SEQ ID NO: 2566417 - DNA, 22 bp, Homo sapiens
gattgcgtggaattgtgctgag

SEQ ID NO: 2566418 - DNA, 15 bp, Homo sapiens
gattgctatgaatga

SEQ ID NO: 2566419 - DNA, 18 bp, Homo sapiens
gattgcttaaaatagcaa

SEQ ID NO: 2566420 - DNA, 16 bp, Homo sapiens
gattggacggcctgat

SEQ ID NO: 2566421 - DNA, 22 bp, Homo sapiens
gattggatacgcatcagacaga

SEQ ID NO: 2566422 - DNA, 14 bp, Homo sapiens
gattggattattca

SEQ ID NO: 2566423 - DNA, 15 bp, Homo sapiens
gattggattattcat

SEQ ID NO: 2566424 - DNA, 20 bp, Homo sapiens
gattggattattcatttaaa

SEQ ID NO: 2566425 - DNA, 13 bp, Homo sapiens
gattggattattt

SEQ ID NO: 2566426 - DNA, 22 bp, Homo sapiens
gattggctcacccaagcaaggc

SEQ ID NO: 2566427 - DNA, 18 bp, Homo sapiens
gattggcttgtgtgtttc

SEQ ID NO: 2566428 - DNA, 17 bp, Homo sapiens
gattgggggctggtgcc

SEQ ID NO: 2566429 - DNA, 20 bp, Homo sapiens
gattgtaaaatagcttgtat

SEQ ID NO: 2566430 - DNA, 19 bp, Homo sapiens
gattgtaacgttgctgtgg

SEQ ID NO: 2566431 - DNA, 13 bp, Homo sapiens
gatttaacagaaa

SEQ ID NO: 2566432 - DNA, 15 bp, Homo sapiens
gatttaacagaaatg

SEQ ID NO: 2566433 - DNA, 16 bp, Homo sapiens
gatttaacagaaatgt

SEQ ID NO: 2566434 - DNA, 17 bp, Homo sapiens
gatttaacagtcattta

SEQ ID NO: 2566435 - DNA, 22 bp, Homo sapiens
gatttaagggatggaaaaggaa

SEQ ID NO: 2566436 - DNA, 14 bp, Homo sapiens
gatttaataaaata

SEQ ID NO: 2566437 - DNA, 14 bp, Homo sapiens
gatttaatagtgtt

SEQ ID NO: 2566438 - DNA, 15 bp, Homo sapiens
gatttaatagtgtta

SEQ ID NO: 2566439 - DNA, 12 bp, Homo sapiens
gatttaattctc

SEQ ID NO: 2566440 - DNA, 18 bp, Homo sapiens
gatttatttcatcatatt

SEQ ID NO: 2566441 - DNA, 20 bp, Homo sapiens
gatttcaggatactctgtca

SEQ ID NO: 2566442 - DNA, 18 bp, Homo sapiens
gatttcatgctatctctg

SEQ ID NO: 2566443 - DNA, 19 bp, Homo sapiens
gatttccagccagggctgc

SEQ ID NO: 2566444 - DNA, 23 bp, Homo sapiens
gatttctagaaagcctgttcccc

SEQ ID NO: 2566445 - DNA, 11 bp, Homo sapiens
gatttctgttt

SEQ ID NO: 2566446 - DNA, 11 bp, Homo sapiens
gatttctttcc

SEQ ID NO: 2566447 - DNA, 13 bp, Homo sapiens
gatttgaactcag

SEQ ID NO: 2566448 - DNA, 13 bp, Homo sapiens
gatttgactgttt

SEQ ID NO: 2566449 - DNA, 18 bp, Homo sapiens
gatttgactgtttttacc

SEQ ID NO: 2566450 - DNA, 15 bp, Homo sapiens
gatttgatgctggag

SEQ ID NO: 2566451 - DNA, 12 bp, Homo sapiens
gatttggaaaaa

SEQ ID NO: 2566452 - DNA, 20 bp, Homo sapiens
gattttaacaaaagcaagac

SEQ ID NO: 2566453 - DNA, 15 bp, Homo sapiens
gattttaacaataac

SEQ ID NO: 2566454 - DNA, 23 bp, Homo sapiens
gattttaacaataactactgtgt

SEQ ID NO: 2566455 - DNA, 13 bp, Homo sapiens
gattttaattttg

SEQ ID NO: 2566456 - DNA, 22 bp, Homo sapiens
gattttatctttcgcacagcag

SEQ ID NO: 2566457 - DNA, 19 bp, Homo sapiens
gattttcaaagctttttcc

SEQ ID NO: 2566458 - DNA, 17 bp, Homo sapiens
gattttctattgttact

SEQ ID NO: 2566459 - DNA, 22 bp, Homo sapiens
gattttctattgttactctggt

SEQ ID NO: 2566460 - DNA, 24 bp, Homo sapiens
gattttctttaaaagaatgggcag

SEQ ID NO: 2566461 - DNA, 13 bp, Homo sapiens
gattttgcctgtg

SEQ ID NO: 2566462 - DNA, 16 bp, Homo sapiens
gattttgctgtagaag

SEQ ID NO: 2566463 - DNA, 12 bp, Homo sapiens
gatttttctcaa

SEQ ID NO: 2566464 - DNA, 15 bp, Homo sapiens
gatttttgtaagaca

SEQ ID NO: 2566465 - DNA, 15 bp, Homo sapiens
gatttttgtcttgtg

SEQ ID NO: 2566466 - DNA, 20 bp, Homo sapiens
gattttttacagctgcctgc

SEQ ID NO: 2566467 - DNA, 22 bp, Homo sapiens
gcaaaacagcgtttaagactgt

SEQ ID NO: 2566468 - DNA, 16 bp, Homo sapiens
gcaaaagactaattta

SEQ ID NO: 2566469 - DNA, 15 bp, Homo sapiens
gcaaaagatgcttct

SEQ ID NO: 2566470 - DNA, 17 bp, Homo sapiens
gcaaaagatgcttctca

SEQ ID NO: 2566471 - DNA, 13 bp, Homo sapiens
gcaaaataatttt

SEQ ID NO: 2566472 - DNA, 20 bp, Homo sapiens
gcaaaatcatggaatggtta

SEQ ID NO: 2566473 - DNA, 16 bp, Homo sapiens
gcaaaattcccaggga

SEQ ID NO: 2566474 - DNA, 10 bp, Homo sapiens
gcaaaatttc

SEQ ID NO: 2566475 - DNA, 20 bp, Homo sapiens
gcaaaatttgatgccaggac

SEQ ID NO: 2566476 - DNA, 21 bp, Homo sapiens
gcaaaatttgatgccaggaca

SEQ ID NO: 2566477 - DNA, 16 bp, Homo sapiens
gcaaaattttatagct

SEQ ID NO: 2566478 - DNA, 17 bp, Homo sapiens
gcaaacacacaaaggta

SEQ ID NO: 2566479 - DNA, 15 bp, Homo sapiens
gcaaaccacactgga

SEQ ID NO: 2566480 - DNA, 18 bp, Homo sapiens
gcaaaccacactggactc

SEQ ID NO: 2566481 - DNA, 20 bp, Homo sapiens
gcaaaccacactggactccg

SEQ ID NO: 2566482 - DNA, 19 bp, Homo sapiens
gcaaacccatcaacaaaaa

SEQ ID NO: 2566483 - DNA, 19 bp, Homo sapiens
gcaaactaagcccccgctg

SEQ ID NO: 2566484 - DNA, 23 bp, Homo sapiens
gcaaacttggaatttgtaacctc

SEQ ID NO: 2566485 - DNA, 15 bp, Homo sapiens
gcaaagacagaagcc

SEQ ID NO: 2566486 - DNA, 16 bp, Homo sapiens
gcaaagacagaagcct

SEQ ID NO: 2566487 - DNA, 17 bp, Homo sapiens
gcaaagacagaagcctc

SEQ ID NO: 2566488 - DNA, 18 bp, Homo sapiens
gcaaagaggcaagaggct

SEQ ID NO: 2566489 - DNA, 12 bp, Homo sapiens
gcaaagatcaaa

SEQ ID NO: 2566490 - DNA, 22 bp, Homo sapiens
gcaaagcaccagcttctccagg

SEQ ID NO: 2566491 - DNA, 23 bp, Homo sapiens
gcaaaggactgttttttcctgag

SEQ ID NO: 2566492 - DNA, 17 bp, Homo sapiens
gcaaagggagcagaact

SEQ ID NO: 2566493 - DNA, 18 bp, Homo sapiens
gcaaagggagcagaactg

SEQ ID NO: 2566494 - DNA, 20 bp, Homo sapiens
gcaaaggggctgaaagaaca

SEQ ID NO: 2566495 - DNA, 18 bp, Homo sapiens
gcaaaggtggctctccag

SEQ ID NO: 2566496 - DNA, 21 bp, Homo sapiens
gcaaagtcatgcaaaggctgg

SEQ ID NO: 2566497 - DNA, 23 bp, Homo sapiens
gcaaagtcatgcaaaggctggga

SEQ ID NO: 2566498 - DNA, 23 bp, Homo sapiens
gcaaagttccctacttcctgtga

SEQ ID NO: 2566499 - DNA, 15 bp, Homo sapiens
gcaaatcagaaactt

SEQ ID NO: 2566500 - DNA, 20 bp, Homo sapiens
gcaaatcagaaacttgtgaa

SEQ ID NO: 2566501 - DNA, 19 bp, Homo sapiens
gcaaatcctatgtgatttt

SEQ ID NO: 2566502 - DNA, 12 bp, Homo sapiens
gcaaatgacttt

SEQ ID NO: 2566503 - DNA, 13 bp, Homo sapiens
gcaaatgactttg

SEQ ID NO: 2566504 - DNA, 23 bp, Homo sapiens
gcaacacaagctggaagcacatg

SEQ ID NO: 2566505 - DNA, 17 bp, Homo sapiens
gcaacagtagcatagga

SEQ ID NO: 2566506 - DNA, 19 bp, Homo sapiens
gcaaccccagttctgctcc

SEQ ID NO: 2566507 - DNA, 21 bp, Homo sapiens
gcaaccccagttctgctcctc

SEQ ID NO: 2566508 - DNA, 24 bp, Homo sapiens
gcaaccccagttctgctcctctcc

SEQ ID NO: 2566509 - DNA, 17 bp, Homo sapiens
gcaacccccagcctgct

SEQ ID NO: 2566510 - DNA, 18 bp, Homo sapiens
gcaacccccagcctgcta

SEQ ID NO: 2566511 - DNA, 19 bp, Homo sapiens
gcaacctccgcctcttggg

SEQ ID NO: 2566512 - DNA, 20 bp, Homo sapiens
gcaacctccgcctcttgggt

SEQ ID NO: 2566513 - DNA, 14 bp, Homo sapiens
gcaacctgggtcca

SEQ ID NO: 2566514 - DNA, 18 bp, Homo sapiens
gcaacctgggtccaaata

SEQ ID NO: 2566515 - DNA, 13 bp, Homo sapiens
gcaactgaataaa

SEQ ID NO: 2566516 - DNA, 13 bp, Homo sapiens
gcaactgaggcag

SEQ ID NO: 2566517 - DNA, 14 bp, Homo sapiens
gcaactgaggcaga

SEQ ID NO: 2566518 - DNA, 15 bp, Homo sapiens
gcaactgaggcagac

SEQ ID NO: 2566519 - DNA, 19 bp, Homo sapiens
gcaactgaggcagacagca

SEQ ID NO: 2566520 - DNA, 22 bp, Homo sapiens
gcaactgaggcagacagcagct

SEQ ID NO: 2566521 - DNA, 18 bp, Homo sapiens
gcaactgcattggctttg

SEQ ID NO: 2566522 - DNA, 20 bp, Homo sapiens
gcaactgttatgaaataaag

SEQ ID NO: 2566523 - DNA, 21 bp, Homo sapiens
gcaactgttatgaaataaaga

SEQ ID NO: 2566524 - DNA, 19 bp, Homo sapiens
gcaacttgtctttttctgg

SEQ ID NO: 2566525 - DNA, 14 bp, Homo sapiens
gcaagaaggaattg

SEQ ID NO: 2566526 - DNA, 17 bp, Homo sapiens
gcaagaattgaagcagg

SEQ ID NO: 2566527 - DNA, 20 bp, Homo sapiens
gcaagagactctggcctcca

SEQ ID NO: 2566528 - DNA, 17 bp, Homo sapiens
gcaagaggggtggagac

SEQ ID NO: 2566529 - DNA, 13 bp, Homo sapiens
gcaagattgctta

SEQ ID NO: 2566530 - DNA, 15 bp, Homo sapiens
gcaagcacctcctgc

SEQ ID NO: 2566531 - DNA, 20 bp, Homo sapiens
gcaagcacctcctgcctcga

SEQ ID NO: 2566532 - DNA, 19 bp, Homo sapiens
gcaagctagaacctggagg

SEQ ID NO: 2566533 - DNA, 13 bp, Homo sapiens
gcaaggaaggaaa

SEQ ID NO: 2566534 - DNA, 14 bp, Homo sapiens
gcaaggaaggaaag

SEQ ID NO: 2566535 - DNA, 15 bp, Homo sapiens
gcaaggaccaggact

SEQ ID NO: 2566536 - DNA, 21 bp, Homo sapiens
gcaaggaccaggactccctcc

SEQ ID NO: 2566537 - DNA, 19 bp, Homo sapiens
gcaagggccatgctgaagg

SEQ ID NO: 2566538 - DNA, 14 bp, Homo sapiens
gcaagggtgatggg

SEQ ID NO: 2566539 - DNA, 14 bp, Homo sapiens
gcaaggtcattttt

SEQ ID NO: 2566540 - DNA, 14 bp, Homo sapiens
gcaaggtgctcaca

SEQ ID NO: 2566541 - DNA, 21 bp, Homo sapiens
gcaaggtgctcacaccccatt

SEQ ID NO: 2566542 - DNA, 23 bp, Homo sapiens
gcaagtatgttttagcatgtgtt

SEQ ID NO: 2566543 - DNA, 13 bp, Homo sapiens
gcaagtcagggtt

SEQ ID NO: 2566544 - DNA, 13 bp, Homo sapiens
gcaagtgagagct

SEQ ID NO: 2566545 - DNA, 13 bp, Homo sapiens
gcaagtgtgtgca

SEQ ID NO: 2566546 - DNA, 19 bp, Homo sapiens
gcaagtgtgtgcatgtgtg

SEQ ID NO: 2566547 - DNA, 21 bp, Homo sapiens
gcaagtgtgtgcatgtgtgcg

SEQ ID NO: 2566548 - DNA, 15 bp, Homo sapiens
gcactgcttccagtg

SEQ ID NO: 2566549 - DNA, 18 bp, Homo sapiens
gcactgcttccagtgagg

SEQ ID NO: 2566550 - DNA, 15 bp, Homo sapiens
gcactggagtgcagg

SEQ ID NO: 2566551 - DNA, 16 bp, Homo sapiens
gcactggagtgcaggg

SEQ ID NO: 2566552 - DNA, 11 bp, Homo sapiens
gcactggcctg

SEQ ID NO: 2566553 - DNA, 17 bp, Homo sapiens
gcactggctctctccag

SEQ ID NO: 2566554 - DNA, 19 bp, Homo sapiens
gcactggctctctccagga

SEQ ID NO: 2566555 - DNA, 18 bp, Homo sapiens
gcactggggagcccgtct

SEQ ID NO: 2566556 - DNA, 22 bp, Homo sapiens
gcactggggagcccgtctcagt

SEQ ID NO: 2566557 - DNA, 23 bp, Homo sapiens
gcactggggagcccgtctcagtg

SEQ ID NO: 2566558 - DNA, 16 bp, Homo sapiens
gcactgggggcagcgg

SEQ ID NO: 2566559 - DNA, 18 bp, Homo sapiens
gcactgggttgcagggga

SEQ ID NO: 2566560 - DNA, 21 bp, Homo sapiens
gcactgggttgcaggggattg

SEQ ID NO: 2566561 - DNA, 16 bp, Homo sapiens
gcactgtcactttgct

SEQ ID NO: 2566562 - DNA, 14 bp, Homo sapiens
gcactgtgctaata

SEQ ID NO: 2566563 - DNA, 16 bp, Homo sapiens
gcactgttccagcctg

SEQ ID NO: 2566564 - DNA, 17 bp, Homo sapiens
gcacttagctatcagaa

SEQ ID NO: 2566565 - DNA, 14 bp, Homo sapiens
gcacttcacagagt

SEQ ID NO: 2566566 - DNA, 22 bp, Homo sapiens
gcacttcgggaggtcgaggcag

SEQ ID NO: 2566567 - DNA, 22 bp, Homo sapiens
gcacttgcacgcccatgtgtga

SEQ ID NO: 2566568 - DNA, 16 bp, Homo sapiens
gcacttgcagactcta

SEQ ID NO: 2566569 - DNA, 14 bp, Homo sapiens
gcacttgcatctgt

SEQ ID NO: 2566570 - DNA, 22 bp, Homo sapiens
gcacttggagccaagggttcag

SEQ ID NO: 2566571 - DNA, 15 bp, Homo sapiens
gcacttgtatatacg

SEQ ID NO: 2566572 - DNA, 17 bp, Homo sapiens
gcactttcctcctggca

SEQ ID NO: 2566573 - DNA, 20 bp, Homo sapiens
gcactttctatcctctgtaa

SEQ ID NO: 2566574 - DNA, 16 bp, Homo sapiens
gcactttgggaggctg

SEQ ID NO: 2566575 - DNA, 21 bp, Homo sapiens
gcactttgggaggctgaggcg

SEQ ID NO: 2566576 - DNA, 22 bp, Homo sapiens
gcactttgttctggctcttcca

SEQ ID NO: 2566577 - DNA, 16 bp, Homo sapiens
gcactttttaattcac

SEQ ID NO: 2566578 - DNA, 20 bp, Homo sapiens
gcactttttcatttgcctat

SEQ ID NO: 2566579 - DNA, 20 bp, Homo sapiens
gcagaaagcaaaattatgtt

SEQ ID NO: 2566580 - DNA, 23 bp, Homo sapiens
gcagaaagcaaatgtgacctgtg

SEQ ID NO: 2566581 - DNA, 18 bp, Homo sapiens
gcagaaaggttctgcccg

SEQ ID NO: 2566582 - DNA, 14 bp, Homo sapiens
gcagaacactaacc

SEQ ID NO: 2566583 - DNA, 12 bp, Homo sapiens
gcagaacagtga

SEQ ID NO: 2566584 - DNA, 18 bp, Homo sapiens
gcagaacagtgattacca

SEQ ID NO: 2566585 - DNA, 14 bp, Homo sapiens
gcagaactgagctc

SEQ ID NO: 2566586 - DNA, 16 bp, Homo sapiens
gcagaactgagctcct

SEQ ID NO: 2566587 - DNA, 22 bp, Homo sapiens
gcagaagaatgggaatatttta

SEQ ID NO: 2566588 - DNA, 14 bp, Homo sapiens
gcagaagacaccag

SEQ ID NO: 2566589 - DNA, 14 bp, Homo sapiens
gcagaagacagtat

SEQ ID NO: 2566590 - DNA, 13 bp, Homo sapiens
gcagaagcattaa

SEQ ID NO: 2566591 - DNA, 23 bp, Homo sapiens
gcagaatcctaggctccacccca

SEQ ID NO: 2566592 - DNA, 17 bp, Homo sapiens
gcagaatcctggccctc

SEQ ID NO: 2566593 - DNA, 18 bp, Homo sapiens
gcagacagcagctcaggc

SEQ ID NO: 2566594 - DNA, 21 bp, Homo sapiens
gcagacagcagctcaggcaca

SEQ ID NO: 2566595 - DNA, 12 bp, Homo sapiens
gcagacaggacc

SEQ ID NO: 2566596 - DNA, 13 bp, Homo sapiens
gcagacaggacca

SEQ ID NO: 2566597 - DNA, 19 bp, Homo sapiens
gcagacaggcaagcacctc

SEQ ID NO: 2566598 - DNA, 23 bp, Homo sapiens
gcagacaggcaagcacctcctgc

SEQ ID NO: 2566599 - DNA, 21 bp, Homo sapiens
gcagaccaccccgcctgccct

SEQ ID NO: 2566600 - DNA, 14 bp, Homo sapiens
gcagacctgtcctc

SEQ ID NO: 2566601 - DNA, 15 bp, Homo sapiens
gcagactctacagag

SEQ ID NO: 2566602 - DNA, 17 bp, Homo sapiens
gcagactctacagaggc

SEQ ID NO: 2566603 - DNA, 22 bp, Homo sapiens
gcagactctacagaggccatgg

SEQ ID NO: 2566604 - DNA, 16 bp, Homo sapiens
gcagagaaagaagaga

SEQ ID NO: 2566605 - DNA, 20 bp, Homo sapiens
gcagagaatgaaagggccca

SEQ ID NO: 2566606 - DNA, 17 bp, Homo sapiens
gcagagacaggacctga

SEQ ID NO: 2566607 - DNA, 17 bp, Homo sapiens
gcagagaccatccctga

SEQ ID NO: 2566608 - DNA, 12 bp, Homo sapiens
gcagagacttgg

SEQ ID NO: 2566609 - DNA, 12 bp, Homo sapiens
gcagagagaagc

SEQ ID NO: 2566610 - DNA, 13 bp, Homo sapiens
gcagagagaagcc

SEQ ID NO: 2566611 - DNA, 15 bp, Homo sapiens
gcagagaggccaggt

SEQ ID NO: 2566612 - DNA, 22 bp, Homo sapiens
gcagagattggaatgggcagct

SEQ ID NO: 2566613 - DNA, 19 bp, Homo sapiens
gcagagcaccttagacagt

SEQ ID NO: 2566614 - DNA, 22 bp, Homo sapiens
gcagagcaccttagacagtccc

SEQ ID NO: 2566615 - DNA, 24 bp, Homo sapiens
gcagagcaccttagacagtccctg

SEQ ID NO: 2566616 - DNA, 19 bp, Homo sapiens
gcagagcagagaccatccc

SEQ ID NO: 2566617 - DNA, 20 bp, Homo sapiens
gcagagcagagaccatccct

SEQ ID NO: 2566618 - DNA, 14 bp, Homo sapiens
gcagagcaggggca

SEQ ID NO: 2566619 - DNA, 14 bp, Homo sapiens
gcagagctctgccg

SEQ ID NO: 2566620 - DNA, 17 bp, Homo sapiens
gcagagcttggactgga

SEQ ID NO: 2566621 - DNA, 12 bp, Homo sapiens
gcagaggcactg

SEQ ID NO: 2566622 - DNA, 12 bp, Homo sapiens
gcagaggggctt

SEQ ID NO: 2566623 - DNA, 16 bp, Homo sapiens
gcagaggggctttctg

SEQ ID NO: 2566624 - DNA, 21 bp, Homo sapiens
gcagaggggctttctggagag

SEQ ID NO: 2566625 - DNA, 23 bp, Homo sapiens
gcagaggtggccagagctgggag

SEQ ID NO: 2566626 - DNA, 23 bp, Homo sapiens
gcagaggttgcagtgagccgaga

SEQ ID NO: 2566627 - DNA, 22 bp, Homo sapiens
gcagagtcctgcacagttttct

SEQ ID NO: 2566628 - DNA, 18 bp, Homo sapiens
gcagataaacagtagtga

SEQ ID NO: 2566629 - DNA, 19 bp, Homo sapiens
gcagataatcagcctctta

SEQ ID NO: 2566630 - DNA, 22 bp, Homo sapiens
gcagatacaggaaaagctgctg

SEQ ID NO: 2566631 - DNA, 13 bp, Homo sapiens
gcagatgacaaaa

SEQ ID NO: 2566632 - DNA, 15 bp, Homo sapiens
gcagatgcaaagagg

SEQ ID NO: 2566633 - DNA, 18 bp, Homo sapiens
gcagatgcaaagaggcaa

SEQ ID NO: 2566634 - DNA, 22 bp, Homo sapiens
gcagatgcaaagaggcaagagg

SEQ ID NO: 2566635 - DNA, 17 bp, Homo sapiens
gcagattgaaaaggaca

SEQ ID NO: 2566636 - DNA, 16 bp, Homo sapiens
gcagcaataaagcagc

SEQ ID NO: 2566637 - DNA, 16 bp, Homo sapiens
gcagcactcacacagg

SEQ ID NO: 2566638 - DNA, 15 bp, Homo sapiens
gcagcagaggcactg

SEQ ID NO: 2566639 - DNA, 20 bp, Homo sapiens
gcagcagggctaccctgagc

SEQ ID NO: 2566640 - DNA, 18 bp, Homo sapiens
gcagcagtgaaaacaagt

SEQ ID NO: 2566641 - DNA, 19 bp, Homo sapiens
gcagcagtgtgaggccagg

SEQ ID NO: 2566642 - DNA, 23 bp, Homo sapiens
gcagcatattcaggaagctcagg

SEQ ID NO: 2566643 - DNA, 21 bp, Homo sapiens
gcagccaaacccatgaggcaa

SEQ ID NO: 2566644 - DNA, 23 bp, Homo sapiens
gcagccaaggccgaagctctggc

SEQ ID NO: 2566645 - DNA, 16 bp, Homo sapiens
gcagccacattcctga

SEQ ID NO: 2566646 - DNA, 18 bp, Homo sapiens
gcagccagctctcagcca

SEQ ID NO: 2566647 - DNA, 12 bp, Homo sapiens
gcagccaggcca

SEQ ID NO: 2566648 - DNA, 12 bp, Homo sapiens
gcagccaggctg

SEQ ID NO: 2566649 - DNA, 17 bp, Homo sapiens
gcagccaggctgccaag

SEQ ID NO: 2566650 - DNA, 17 bp, Homo sapiens
gcagcccaggccggggt

SEQ ID NO: 2566651 - DNA, 15 bp, Homo sapiens
gcagcccatgcccac

SEQ ID NO: 2566652 - DNA, 17 bp, Homo sapiens
gcagcccatgcccacct

SEQ ID NO: 2566653 - DNA, 21 bp, Homo sapiens
gcagccccattctgcctgccc

SEQ ID NO: 2566654 - DNA, 23 bp, Homo sapiens
gcagccccgcgcctccttccttg

SEQ ID NO: 2566655 - DNA, 21 bp, Homo sapiens
gcagcccgtgtggccccttca

SEQ ID NO: 2566656 - DNA, 17 bp, Homo sapiens
gcagccctagagcctgc

SEQ ID NO: 2566657 - DNA, 18 bp, Homo sapiens
gcagccctggagtcatgc

SEQ ID NO: 2566658 - DNA, 12 bp, Homo sapiens
gcagcccttgct

SEQ ID NO: 2566659 - DNA, 14 bp, Homo sapiens
gcagccgagctcgt

SEQ ID NO: 2566660 - DNA, 16 bp, Homo sapiens
gcagccgctgagcgag

SEQ ID NO: 2566661 - DNA, 20 bp, Homo sapiens
gcagcctcaacctcctgggc

SEQ ID NO: 2566662 - DNA, 22 bp, Homo sapiens
gcagcctcaacctcctgggcta

SEQ ID NO: 2566663 - DNA, 15 bp, Homo sapiens
gcagcctcacagtcc

SEQ ID NO: 2566664 - DNA, 14 bp, Homo sapiens
gcagcctccctctg

SEQ ID NO: 2566665 - DNA, 22 bp, Homo sapiens
gcagcctgtggcatctttgcct

SEQ ID NO: 2566666 - DNA, 15 bp, Homo sapiens
gcagccttggcaaac

SEQ ID NO: 2566667 - DNA, 17 bp, Homo sapiens
gcagcctttgcctcccc

SEQ ID NO: 2566668 - DNA, 18 bp, Homo sapiens
gcagcctttgcctccccg

SEQ ID NO: 2566669 - DNA, 13 bp, Homo sapiens
gcagcgaccaccc

SEQ ID NO: 2566670 - DNA, 15 bp, Homo sapiens
gcagcgaccacccct

SEQ ID NO: 2566671 - DNA, 16 bp, Homo sapiens
gcagcgaccgccccct

SEQ ID NO: 2566672 - DNA, 24 bp, Homo sapiens
gcagcgagttgtggaaagcctctg

SEQ ID NO: 2566673 - DNA, 21 bp, Homo sapiens
gcagcggggcgaagcccaggc

SEQ ID NO: 2566674 - DNA, 14 bp, Homo sapiens
gcagctcaaaggca

SEQ ID NO: 2566675 - DNA, 14 bp, Homo sapiens
gcagctcacctctc

SEQ ID NO: 2566676 - DNA, 16 bp, Homo sapiens
gcagctcacctctccc

SEQ ID NO: 2566677 - DNA, 14 bp, Homo sapiens
gcagctcagagagg

SEQ ID NO: 2566678 - DNA, 15 bp, Homo sapiens
gcagctcttgccctt

SEQ ID NO: 2566679 - DNA, 16 bp, Homo sapiens
gcagctgatacaaatt

SEQ ID NO: 2566680 - DNA, 14 bp, Homo sapiens
gcagctgccagaga

SEQ ID NO: 2566681 - DNA, 20 bp, Homo sapiens
gcagctgcttttgtctatgg

SEQ ID NO: 2566682 - DNA, 15 bp, Homo sapiens
gcagctggactaccc

SEQ ID NO: 2566683 - DNA, 19 bp, Homo sapiens
gcagctgggcccaaccctg

SEQ ID NO: 2566684 - DNA, 23 bp, Homo sapiens
gcagctgggcccaaccctgtctg

SEQ ID NO: 2566685 - DNA, 21 bp, Homo sapiens
gcagctgttttagttaaattt

SEQ ID NO: 2566686 - DNA, 15 bp, Homo sapiens
gcagcttattcacaa

SEQ ID NO: 2566687 - DNA, 14 bp, Homo sapiens
gcagcttcaccaga

SEQ ID NO: 2566688 - DNA, 19 bp, Homo sapiens
gcagcttgagggttgggct

SEQ ID NO: 2566689 - DNA, 21 bp, Homo sapiens
gcagcttgagggttgggctgg

SEQ ID NO: 2566690 - DNA, 12 bp, Homo sapiens
gcagcttgcccc

SEQ ID NO: 2566691 - DNA, 14 bp, Homo sapiens
gcagcttgccccgg

SEQ ID NO: 2566692 - DNA, 16 bp, Homo sapiens
gcatctccaggaaggc

SEQ ID NO: 2566693 - DNA, 12 bp, Homo sapiens
gcatctcccaga

SEQ ID NO: 2566694 - DNA, 21 bp, Homo sapiens
gcatctcccagataatgtgaa

SEQ ID NO: 2566695 - DNA, 21 bp, Homo sapiens
gcatctcttgaggccaggagt

SEQ ID NO: 2566696 - DNA, 14 bp, Homo sapiens
gcatctgcccctcc

SEQ ID NO: 2566697 - DNA, 18 bp, Homo sapiens
gcatctgctaataaaacc

SEQ ID NO: 2566698 - DNA, 20 bp, Homo sapiens
gcatctgggattcccaccaa

SEQ ID NO: 2566699 - DNA, 23 bp, Homo sapiens
gcatctgggattcccaccaaggt

SEQ ID NO: 2566700 - DNA, 17 bp, Homo sapiens
gcatctgggtagctgta

SEQ ID NO: 2566701 - DNA, 16 bp, Homo sapiens
gcatcttactgaaggt

SEQ ID NO: 2566702 - DNA, 19 bp, Homo sapiens
gcatcttctggagtctcca

SEQ ID NO: 2566703 - DNA, 23 bp, Homo sapiens
gcatcttctggagtctccagtgg

SEQ ID NO: 2566704 - DNA, 15 bp, Homo sapiens
gcatctttgccttgg

SEQ ID NO: 2566705 - DNA, 18 bp, Homo sapiens
gcatctttgccttgggct

SEQ ID NO: 2566706 - DNA, 22 bp, Homo sapiens
gcatctttgccttgggctgctc

SEQ ID NO: 2566707 - DNA, 13 bp, Homo sapiens
gcatgaaggtttc

SEQ ID NO: 2566708 - DNA, 18 bp, Homo sapiens
gcatgacaagccccaggc

SEQ ID NO: 2566709 - DNA, 21 bp, Homo sapiens
gcatgacaagccccaggcagg

SEQ ID NO: 2566710 - DNA, 21 bp, Homo sapiens
gcatgcactgttccccctgtg

SEQ ID NO: 2566711 - DNA, 17 bp, Homo sapiens
gcatgcctggatggggc

SEQ ID NO: 2566712 - DNA, 22 bp, Homo sapiens
gcatgcctggatggggctgcac

SEQ ID NO: 2566713 - DNA, 15 bp, Homo sapiens
gcatgcctgtgtgac

SEQ ID NO: 2566714 - DNA, 14 bp, Homo sapiens
gcatgcggcccagc

SEQ ID NO: 2566715 - DNA, 15 bp, Homo sapiens
gcatgcggcccagcc

SEQ ID NO: 2566716 - DNA, 20 bp, Homo sapiens
gcatgcggcccagcccggct

SEQ ID NO: 2566717 - DNA, 23 bp, Homo sapiens
gcatggaaattcccttcatctgg

SEQ ID NO: 2566718 - DNA, 15 bp, Homo sapiens
gcatggagaataaac

SEQ ID NO: 2566719 - DNA, 15 bp, Homo sapiens
gcatggagctggccg

SEQ ID NO: 2566720 - DNA, 17 bp, Homo sapiens
gcatggagtgtgtattg

SEQ ID NO: 2566721 - DNA, 20 bp, Homo sapiens
gcatggcacttgcatctgtg

SEQ ID NO: 2566722 - DNA, 18 bp, Homo sapiens
gcatggcatcacctccac

SEQ ID NO: 2566723 - DNA, 16 bp, Homo sapiens
gcatggccctggggtc

SEQ ID NO: 2566724 - DNA, 15 bp, Homo sapiens
gcatggctgtgagga

SEQ ID NO: 2566725 - DNA, 20 bp, Homo sapiens
gcatgggaaagccacctctc

SEQ ID NO: 2566726 - DNA, 13 bp, Homo sapiens
gcatgggcctggc

SEQ ID NO: 2566727 - DNA, 23 bp, Homo sapiens
gcatggggataaaggagaaggca

SEQ ID NO: 2566728 - DNA, 18 bp, Homo sapiens
gcatgtaccatttgcatg

SEQ ID NO: 2566729 - DNA, 15 bp, Homo sapiens
gcatgtatgtcttgg

SEQ ID NO: 2566730 - DNA, 15 bp, Homo sapiens
gcatgtgactctgaa

SEQ ID NO: 2566731 - DNA, 16 bp, Homo sapiens
gcatgtggcctgtggc

SEQ ID NO: 2566732 - DNA, 12 bp, Homo sapiens
gcatgtgtattt

SEQ ID NO: 2566733 - DNA, 20 bp, Homo sapiens
gcatgtgtatttccagtgca

SEQ ID NO: 2566734 - DNA, 15 bp, Homo sapiens
gcatgttctctgagg

SEQ ID NO: 2566735 - DNA, 21 bp, Homo sapiens
gcatgttctctgaggacacta

SEQ ID NO: 2566736 - DNA, 18 bp, Homo sapiens
gcatgttgagccaggcct

SEQ ID NO: 2566737 - DNA, 16 bp, Homo sapiens
gcatgttgctgaggag

SEQ ID NO: 2566738 - DNA, 15 bp, Homo sapiens
gcatgtttcatgttt

SEQ ID NO: 2566739 - DNA, 17 bp, Homo sapiens
gcatgtttgtgattgac

SEQ ID NO: 2566740 - DNA, 19 bp, Homo sapiens
gcatgttttccagctcctc

SEQ ID NO: 2566741 - DNA, 18 bp, Homo sapiens
gcattaactaatctattg

SEQ ID NO: 2566742 - DNA, 22 bp, Homo sapiens
gcattaactaatctattgggtt

SEQ ID NO: 2566743 - DNA, 16 bp, Homo sapiens
gcattacatttccaaa

SEQ ID NO: 2566744 - DNA, 17 bp, Homo sapiens
gcattacgtgagccagg

SEQ ID NO: 2566745 - DNA, 21 bp, Homo sapiens
gcattagaaatagacagtata

SEQ ID NO: 2566746 - DNA, 15 bp, Homo sapiens
gcattagaattattt

SEQ ID NO: 2566747 - DNA, 18 bp, Homo sapiens
gcattatatttgtaaatt

SEQ ID NO: 2566748 - DNA, 12 bp, Homo sapiens
gcattcacccag

SEQ ID NO: 2566749 - DNA, 19 bp, Homo sapiens
gcattcacccagacagctc

SEQ ID NO: 2566750 - DNA, 20 bp, Homo sapiens
gcattcacccagacagctcc

SEQ ID NO: 2566751 - DNA, 18 bp, Homo sapiens
gcattccaacaaagggtt

SEQ ID NO: 2566752 - DNA, 12 bp, Homo sapiens
gcattccccagg

SEQ ID NO: 2566753 - DNA, 14 bp, Homo sapiens
gcattccccaggag

SEQ ID NO: 2566754 - DNA, 15 bp, Homo sapiens
gcattccccaggagg

SEQ ID NO: 2566755 - DNA, 18 bp, Homo sapiens
gcattccccaggaggcca

SEQ ID NO: 2566756 - DNA, 21 bp, Homo sapiens
gcattccccaggaggccagcc

SEQ ID NO: 2566757 - DNA, 19 bp, Homo sapiens
gcattcctgatatgattta

SEQ ID NO: 2566758 - DNA, 15 bp, Homo sapiens
gcattccttctttga

SEQ ID NO: 2566759 - DNA, 22 bp, Homo sapiens
gcattctgccgtgtgccctcgg

SEQ ID NO: 2566760 - DNA, 18 bp, Homo sapiens
gcattctttctgtattga

SEQ ID NO: 2566761 - DNA, 21 bp, Homo sapiens
gcattgagaactgcatatgtt

SEQ ID NO: 2566762 - DNA, 16 bp, Homo sapiens
gcattgccaagggctt

SEQ ID NO: 2566763 - DNA, 13 bp, Homo sapiens
gcattgctggttc

SEQ ID NO: 2566764 - DNA, 16 bp, Homo sapiens
gcattgttgaggtggt

SEQ ID NO: 2566765 - DNA, 18 bp, Homo sapiens
gcattgtttgcttattgt

SEQ ID NO: 2566766 - DNA, 23 bp, Homo sapiens
gcattgtttgcttattgttccaa

SEQ ID NO: 2566767 - DNA, 16 bp, Homo sapiens
gcatttaaaagataca

SEQ ID NO: 2566768 - DNA, 18 bp, Homo sapiens
gcatttaaaagatacagt

SEQ ID NO: 2566769 - DNA, 15 bp, Homo sapiens
gcatttactttgtgt

SEQ ID NO: 2566770 - DNA, 19 bp, Homo sapiens
gcatttatggtcaacactt

SEQ ID NO: 2566771 - DNA, 13 bp, Homo sapiens
gcatttctctggg

SEQ ID NO: 2566772 - DNA, 13 bp, Homo sapiens
gcatttgagaaat

SEQ ID NO: 2566773 - DNA, 18 bp, Homo sapiens
gcatttgaggtctgttct

SEQ ID NO: 2566774 - DNA, 20 bp, Homo sapiens
gcatttgaggtctgttcttt

SEQ ID NO: 2566775 - DNA, 14 bp, Homo sapiens
gcatttgagtttat

SEQ ID NO: 2566776 - DNA, 17 bp, Homo sapiens
gcatttgctgaatacag

SEQ ID NO: 2566777 - DNA, 12 bp, Homo sapiens
gcattttattct

SEQ ID NO: 2566778 - DNA, 13 bp, Homo sapiens
gcattttgctatt

SEQ ID NO: 2566779 - DNA, 19 bp, Homo sapiens
gcattttgctattgtaaat

SEQ ID NO: 2566780 - DNA, 21 bp, Homo sapiens
gcatttttgatttatgcatgg

SEQ ID NO: 2566781 - DNA, 16 bp, Homo sapiens
gccaaaaaaagacagg

SEQ ID NO: 2566782 - DNA, 15 bp, Homo sapiens
gccaaaagctgctca

SEQ ID NO: 2566783 - DNA, 15 bp, Homo sapiens
gccaaaccctgtctg

SEQ ID NO: 2566784 - DNA, 17 bp, Homo sapiens
gccaaacctctgttcag

SEQ ID NO: 2566785 - DNA, 19 bp, Homo sapiens
gccaaagcctcctccagcc

SEQ ID NO: 2566786 - DNA, 22 bp, Homo sapiens
gccaaagctaggcctggccaga

SEQ ID NO: 2566787 - DNA, 23 bp, Homo sapiens
gccaaaggagggtcaggaaggat

SEQ ID NO: 2566788 - DNA, 16 bp, Homo sapiens
gccaaatgtaattgaa

SEQ ID NO: 2566789 - DNA, 18 bp, Homo sapiens
gccaaatgtaattgaata

SEQ ID NO: 2566790 - DNA, 19 bp, Homo sapiens
gccaaattatttgtgtaat

SEQ ID NO: 2566791 - DNA, 18 bp, Homo sapiens
gccaacaaagctgttgat

SEQ ID NO: 2566792 - DNA, 14 bp, Homo sapiens
gccaacaccaggga

SEQ ID NO: 2566793 - DNA, 19 bp, Homo sapiens
gccaacagaagcttccatt

SEQ ID NO: 2566794 - DNA, 20 bp, Homo sapiens
gccaacagtcaaaacagaga

SEQ ID NO: 2566795 - DNA, 20 bp, Homo sapiens
gccaacatcgtgaaaccctg

SEQ ID NO: 2566796 - DNA, 22 bp, Homo sapiens
gccaacatcgtgaaaccctgtc

SEQ ID NO: 2566797 - DNA, 15 bp, Homo sapiens
gccaacccctgtgga

SEQ ID NO: 2566798 - DNA, 23 bp, Homo sapiens
gccaacgacaaagccaaactctg

SEQ ID NO: 2566799 - DNA, 15 bp, Homo sapiens
gccaacttgagggcc

SEQ ID NO: 2566800 - DNA, 14 bp, Homo sapiens
gccaacttgtaaat

SEQ ID NO: 2566801 - DNA, 17 bp, Homo sapiens
gccaacttgtaaataca

SEQ ID NO: 2566802 - DNA, 16 bp, Homo sapiens
gccaagagcagaggca

SEQ ID NO: 2566803 - DNA, 18 bp, Homo sapiens
gccaagatcgcgccactg

SEQ ID NO: 2566804 - DNA, 13 bp, Homo sapiens
gccaagcaacctg

SEQ ID NO: 2566805 - DNA, 18 bp, Homo sapiens
gccaagcactgtgctcag

SEQ ID NO: 2566806 - DNA, 22 bp, Homo sapiens
gccaagccctccccatcccatg

SEQ ID NO: 2566807 - DNA, 23 bp, Homo sapiens
gccaagctcaggaccaggcaatg

SEQ ID NO: 2566808 - DNA, 17 bp, Homo sapiens
gccaagctccttgggag

SEQ ID NO: 2566809 - DNA, 20 bp, Homo sapiens
gccaaggccagagtggcctg

SEQ ID NO: 2566810 - DNA, 20 bp, Homo sapiens
gccaaggccgaagctctggc

SEQ ID NO: 2566811 - DNA, 19 bp, Homo sapiens
gccaaggctggagtgcagt

SEQ ID NO: 2566812 - DNA, 21 bp, Homo sapiens
gccaagggatgaaagagaagg

SEQ ID NO: 2566813 - DNA, 19 bp, Homo sapiens
gccaaggtgggctgagccc

SEQ ID NO: 2566814 - DNA, 22 bp, Homo sapiens
gccaaggtgggctgagccctgg

SEQ ID NO: 2566815 - DNA, 16 bp, Homo sapiens
gccaagtaagaaagtg

SEQ ID NO: 2566816 - DNA, 12 bp, Homo sapiens
gccaagtccaga

SEQ ID NO: 2566817 - DNA, 14 bp, Homo sapiens
gccaagtccagatt

SEQ ID NO: 2566818 - DNA, 15 bp, Homo sapiens
gaggcccttctctcc

SEQ ID NO: 2566819 - DNA, 20 bp, Homo sapiens
gaggcccttctctccagccc

SEQ ID NO: 2566820 - DNA, 21 bp, Homo sapiens
gaggcccttctctccagcccc

SEQ ID NO: 2566821 - DNA, 22 bp, Homo sapiens
gaggcccttctctccagcccct

SEQ ID NO: 2566822 - DNA, 23 bp, Homo sapiens
gaggcccttctctccagcccctg

SEQ ID NO: 2566823 - DNA, 24 bp, Homo sapiens
gaggcccttctctccagcccctgg

SEQ ID NO: 2566824 - DNA, 18 bp, Homo sapiens
gaggcctactcttccatc

SEQ ID NO: 2566825 - DNA, 22 bp, Homo sapiens
gaggcctctcattccagaggaa

SEQ ID NO: 2566826 - DNA, 24 bp, Homo sapiens
gaggcctcttggacctctgctctg

SEQ ID NO: 2566827 - DNA, 20 bp, Homo sapiens
gaggcctgaggatgagctgg

SEQ ID NO: 2566828 - DNA, 12 bp, Homo sapiens
gaggcctgcccg

SEQ ID NO: 2566829 - DNA, 18 bp, Homo sapiens
gaggcctggagtaacaca

SEQ ID NO: 2566830 - DNA, 14 bp, Homo sapiens
gaggccttctctga

SEQ ID NO: 2566831 - DNA, 15 bp, Homo sapiens
gaggccttgagaggc

SEQ ID NO: 2566832 - DNA, 20 bp, Homo sapiens
gaggcggagcttgcagtgag

SEQ ID NO: 2566833 - DNA, 15 bp, Homo sapiens
gaggcgggagaatca

SEQ ID NO: 2566834 - DNA, 15 bp, Homo sapiens
gaggcgggccagcca

SEQ ID NO: 2566835 - DNA, 17 bp, Homo sapiens
gaggcgggccagccagg

SEQ ID NO: 2566836 - DNA, 14 bp, Homo sapiens
gaggctccagaggg

SEQ ID NO: 2566837 - DNA, 16 bp, Homo sapiens
gaggctgaggcaagag

SEQ ID NO: 2566838 - DNA, 9 bp, Homo sapiens
gaggctgcc

SEQ ID NO: 2566839 - DNA, 21 bp, Homo sapiens
gaggctgcccccggccccctg

SEQ ID NO: 2566840 - DNA, 22 bp, Homo sapiens
gaggctgcccccggccccctgg

SEQ ID NO: 2566841 - DNA, 12 bp, Homo sapiens
gaggctggcagg

SEQ ID NO: 2566842 - DNA, 13 bp, Homo sapiens
gaggctggcaggt

SEQ ID NO: 2566843 - DNA, 22 bp, Homo sapiens
gaggctggtgctgtggccaggg

SEQ ID NO: 2566844 - DNA, 12 bp, Homo sapiens
gaggctgtagga

SEQ ID NO: 2566845 - DNA, 20 bp, Homo sapiens
gaggcttccagagagtcctc

SEQ ID NO: 2566846 - DNA, 15 bp, Homo sapiens
gaggcttgctgagag

SEQ ID NO: 2566847 - DNA, 15 bp, Homo sapiens
gaggcttggaaagca

SEQ ID NO: 2566848 - DNA, 18 bp, Homo sapiens
gaggcttgggaccgccag

SEQ ID NO: 2566849 - DNA, 17 bp, Homo sapiens
gaggcttgtcagagctg

SEQ ID NO: 2566850 - DNA, 18 bp, Homo sapiens
gagggaccaactgggccc

SEQ ID NO: 2566851 - DNA, 12 bp, Homo sapiens
gagggaccagcc

SEQ ID NO: 2566852 - DNA, 15 bp, Homo sapiens
gagggacgcctgggg

SEQ ID NO: 2566853 - DNA, 14 bp, Homo sapiens
gagggagaagcatg

SEQ ID NO: 2566854 - DNA, 12 bp, Homo sapiens
gagggagatgga

SEQ ID NO: 2566855 - DNA, 22 bp, Homo sapiens
gagggagcaagtccttcccttt

SEQ ID NO: 2566856 - DNA, 12 bp, Homo sapiens
gagggagcagac

SEQ ID NO: 2566857 - DNA, 15 bp, Homo sapiens
gagggagcttagcca

SEQ ID NO: 2566858 - DNA, 12 bp, Homo sapiens
gagggaggaggc

SEQ ID NO: 2566859 - DNA, 17 bp, Homo sapiens
gagggaggaggccacct

SEQ ID NO: 2566860 - DNA, 14 bp, Homo sapiens
gagggagggagggc

SEQ ID NO: 2566861 - DNA, 15 bp, Homo sapiens
gagggagggagggct

SEQ ID NO: 2566862 - DNA, 16 bp, Homo sapiens
gagggagggctccaga

SEQ ID NO: 2566863 - DNA, 20 bp, Homo sapiens
gagggagggctccagacaca

SEQ ID NO: 2566864 - DNA, 13 bp, Homo sapiens
gagggagggggct

SEQ ID NO: 2566865 - DNA, 15 bp, Homo sapiens
gagggaggtgtttaa

SEQ ID NO: 2566866 - DNA, 13 bp, Homo sapiens
gagggagtgacag

SEQ ID NO: 2566867 - DNA, 16 bp, Homo sapiens
gagggagtgacagagg

SEQ ID NO: 2566868 - DNA, 12 bp, Homo sapiens
gagggcacacac

SEQ ID NO: 2566869 - DNA, 21 bp, Homo sapiens
gagggcagaaaggttctgccc

SEQ ID NO: 2566870 - DNA, 22 bp, Homo sapiens
gagggcagaaaggttctgcccg

SEQ ID NO: 2566871 - DNA, 16 bp, Homo sapiens
gagggcagcagggcta

SEQ ID NO: 2566872 - DNA, 19 bp, Homo sapiens
gagggcagcagggctaccc

SEQ ID NO: 2566873 - DNA, 16 bp, Homo sapiens
gagggccacatgggag

SEQ ID NO: 2566874 - DNA, 16 bp, Homo sapiens
gagggccacgggtctg

SEQ ID NO: 2566875 - DNA, 15 bp, Homo sapiens
gagggcccagagcag

SEQ ID NO: 2566876 - DNA, 18 bp, Homo sapiens
gagggcccagagcaggaa

SEQ ID NO: 2566877 - DNA, 20 bp, Homo sapiens
gagggcccagagcaggaagc

SEQ ID NO: 2566878 - DNA, 13 bp, Homo sapiens
gagggcccaggca

SEQ ID NO: 2566879 - DNA, 17 bp, Homo sapiens
gagggcccctctgccca

SEQ ID NO: 2566880 - DNA, 17 bp, Homo sapiens
gagggccctgagctgag

SEQ ID NO: 2566881 - DNA, 12 bp, Homo sapiens
gagggccctggt

SEQ ID NO: 2566882 - DNA, 17 bp, Homo sapiens
gagggccgtaccccacc

SEQ ID NO: 2566883 - DNA, 18 bp, Homo sapiens
gagggccgtaccccaccc

SEQ ID NO: 2566884 - DNA, 17 bp, Homo sapiens
gagggcctgcaagggag

SEQ ID NO: 2566885 - DNA, 23 bp, Homo sapiens
gagggcgaccccgtcacagcctc

SEQ ID NO: 2566886 - DNA, 19 bp, Homo sapiens
gagggctagaacctggaga

SEQ ID NO: 2566887 - DNA, 20 bp, Homo sapiens
gagggctagaacctggcagg

SEQ ID NO: 2566888 - DNA, 18 bp, Homo sapiens
gagggctagaactggaga

SEQ ID NO: 2566889 - DNA, 18 bp, Homo sapiens
gagggctagaatctggag

SEQ ID NO: 2566890 - DNA, 21 bp, Homo sapiens
gagggctagaatctggagagc

SEQ ID NO: 2566891 - DNA, 12 bp, Homo sapiens
gagggctccaga

SEQ ID NO: 2566892 - DNA, 21 bp, Homo sapiens
gagggctggaatctggagagc

SEQ ID NO: 2566893 - DNA, 14 bp, Homo sapiens
gaggggaagggcca

SEQ ID NO: 2566894 - DNA, 18 bp, Homo sapiens
gaggggaataatagaaga

SEQ ID NO: 2566895 - DNA, 19 bp, Homo sapiens
gaggggaataatagaagaa

SEQ ID NO: 2566896 - DNA, 19 bp, Homo sapiens
gaggggacaaaacccacct

SEQ ID NO: 2566897 - DNA, 15 bp, Homo sapiens
gaggggcagcccttg

SEQ ID NO: 2566898 - DNA, 16 bp, Homo sapiens
gaggggcagcccttgc

SEQ ID NO: 2566899 - DNA, 16 bp, Homo sapiens
gaggggcgctggccca

SEQ ID NO: 2566900 - DNA, 18 bp, Homo sapiens
gaggggcgctggcccagc

SEQ ID NO: 2566901 - DNA, 12 bp, Homo sapiens
gaggggctctca

SEQ ID NO: 2566902 - DNA, 16 bp, Homo sapiens
gatacagttactcaga

SEQ ID NO: 2566903 - DNA, 19 bp, Homo sapiens
gatacagttactcagaatt

SEQ ID NO: 2566904 - DNA, 23 bp, Homo sapiens
gatacagttactcagaattctct

SEQ ID NO: 2566905 - DNA, 12 bp, Homo sapiens
gatacatgtgcc

SEQ ID NO: 2566906 - DNA, 21 bp, Homo sapiens
gatacccccctctgtcttgtg

SEQ ID NO: 2566907 - DNA, 16 bp, Homo sapiens
gatacgcatcagacag

SEQ ID NO: 2566908 - DNA, 20 bp, Homo sapiens
gatactaaaagttcttctcc

SEQ ID NO: 2566909 - DNA, 11 bp, Homo sapiens
gatactacagt

SEQ ID NO: 2566910 - DNA, 20 bp, Homo sapiens
gatactggaagttttgcatt

SEQ ID NO: 2566911 - DNA, 17 bp, Homo sapiens
gatactgtatcatgaca

SEQ ID NO: 2566912 - DNA, 13 bp, Homo sapiens
gatagatgtgtgg

SEQ ID NO: 2566913 - DNA, 13 bp, Homo sapiens
gatagcagggcat

SEQ ID NO: 2566914 - DNA, 23 bp, Homo sapiens
gatagcatttttgatttatgcat

SEQ ID NO: 2566915 - DNA, 20 bp, Homo sapiens
gatagccttccgtaacccaa

SEQ ID NO: 2566916 - DNA, 16 bp, Homo sapiens
gatagctaacatttta

SEQ ID NO: 2566917 - DNA, 20 bp, Homo sapiens
gatagctaacattttaaata

SEQ ID NO: 2566918 - DNA, 22 bp, Homo sapiens
gatagctaacattttaaataaa

SEQ ID NO: 2566919 - DNA, 17 bp, Homo sapiens
gataggagcctgctggt

SEQ ID NO: 2566920 - DNA, 18 bp, Homo sapiens
gatagtagcatacattta

SEQ ID NO: 2566921 - DNA, 23 bp, Homo sapiens
gatagtgggcaccccactgcaat

SEQ ID NO: 2566922 - DNA, 17 bp, Homo sapiens
gatagttactgttgtga

SEQ ID NO: 2566923 - DNA, 18 bp, Homo sapiens
gatataaaagactgacca

SEQ ID NO: 2566924 - DNA, 13 bp, Homo sapiens
gatataaataaaa

SEQ ID NO: 2566925 - DNA, 15 bp, Homo sapiens
gatataaatggctgg

SEQ ID NO: 2566926 - DNA, 18 bp, Homo sapiens
gatatacacggatgactt

SEQ ID NO: 2566927 - DNA, 19 bp, Homo sapiens
gatatatgtttttgaaggc

SEQ ID NO: 2566928 - DNA, 23 bp, Homo sapiens
gatatattttacaattttttatc

SEQ ID NO: 2566929 - DNA, 17 bp, Homo sapiens
gatatatttttaagata

SEQ ID NO: 2566930 - DNA, 20 bp, Homo sapiens
gatatctgagggaggaggcc

SEQ ID NO: 2566931 - DNA, 14 bp, Homo sapiens
gatatgaaaaatat

SEQ ID NO: 2566932 - DNA, 14 bp, Homo sapiens
gatatgcttagtaa

SEQ ID NO: 2566933 - DNA, 16 bp, Homo sapiens
gatatgcttagtaatg

SEQ ID NO: 2566934 - DNA, 15 bp, Homo sapiens
gatatggagccctgt

SEQ ID NO: 2566935 - DNA, 15 bp, Homo sapiens
gatatggcagaagac

SEQ ID NO: 2566936 - DNA, 17 bp, Homo sapiens
gatatgggacatttttg

SEQ ID NO: 2566937 - DNA, 19 bp, Homo sapiens
gatatgtaaacataattct

SEQ ID NO: 2566938 - DNA, 16 bp, Homo sapiens
gatattaaaggagtta

SEQ ID NO: 2566939 - DNA, 15 bp, Homo sapiens
gatattattcttgta

SEQ ID NO: 2566940 - DNA, 19 bp, Homo sapiens
gatattccatgaatgtatc

SEQ ID NO: 2566941 - DNA, 22 bp, Homo sapiens
gatattgtcagagttctgctct

SEQ ID NO: 2566942 - DNA, 13 bp, Homo sapiens
gatatttatatat

SEQ ID NO: 2566943 - DNA, 23 bp, Homo sapiens
gatatttctatttcctggaatgg

SEQ ID NO: 2566944 - DNA, 18 bp, Homo sapiens
gatattttcaaattgtat

SEQ ID NO: 2566945 - DNA, 18 bp, Homo sapiens
gatatttttccatttttt

SEQ ID NO: 2566946 - DNA, 17 bp, Homo sapiens
gatatttttttcttttc

SEQ ID NO: 2566947 - DNA, 23 bp, Homo sapiens
gatcaaaaggttaataaagtaat

SEQ ID NO: 2566948 - DNA, 20 bp, Homo sapiens
gatcaaaataaaaagtgaca

SEQ ID NO: 2566949 - DNA, 17 bp, Homo sapiens
gatcaaaggcacacagc

SEQ ID NO: 2566950 - DNA, 14 bp, Homo sapiens
gatcaagaaagtgt

SEQ ID NO: 2566951 - DNA, 16 bp, Homo sapiens
gatcaaggagaggagg

SEQ ID NO: 2566952 - DNA, 19 bp, Homo sapiens
gatcaataaaatgtgattt

SEQ ID NO: 2566953 - DNA, 21 bp, Homo sapiens
gatcaataaaatgtgattttt

SEQ ID NO: 2566954 - DNA, 12 bp, Homo sapiens
gatcaatgacag

SEQ ID NO: 2566955 - DNA, 14 bp, Homo sapiens
gatcaatgacagag

SEQ ID NO: 2566956 - DNA, 19 bp, Homo sapiens
gatcacagagacattcctc

SEQ ID NO: 2566957 - DNA, 14 bp, Homo sapiens
gatcacagcctctg

SEQ ID NO: 2566958 - DNA, 17 bp, Homo sapiens
gatcacagctgctttct

SEQ ID NO: 2566959 - DNA, 20 bp, Homo sapiens
gatcacagctgctttctgtt

SEQ ID NO: 2566960 - DNA, 22 bp, Homo sapiens
gatcaccagcccggcctgctcc

SEQ ID NO: 2566961 - DNA, 23 bp, Homo sapiens
gatcacgccactgcactccagcc

SEQ ID NO: 2566962 - DNA, 12 bp, Homo sapiens
gatcacggctca

SEQ ID NO: 2566963 - DNA, 23 bp, Homo sapiens
gatcacggctcactgcagcctca

SEQ ID NO: 2566964 - DNA, 12 bp, Homo sapiens
gatcactactgc

SEQ ID NO: 2566965 - DNA, 14 bp, Homo sapiens
gatcactactgcag

SEQ ID NO: 2566966 - DNA, 22 bp, Homo sapiens
gatcagaccttggatcagatga

SEQ ID NO: 2566967 - DNA, 18 bp, Homo sapiens
gatcagttataagtagca

SEQ ID NO: 2566968 - DNA, 13 bp, Homo sapiens
gatcatccactgt

SEQ ID NO: 2566969 - DNA, 13 bp, Homo sapiens
gatcatgcattgt

SEQ ID NO: 2566970 - DNA, 14 bp, Homo sapiens
gatcatgcattgtt

SEQ ID NO: 2566971 - DNA, 21 bp, Homo sapiens
gatcatggtgtaataagacat

SEQ ID NO: 2566972 - DNA, 18 bp, Homo sapiens
gatcatttgttggaatga

SEQ ID NO: 2566973 - DNA, 15 bp, Homo sapiens
gatcattttcccccc

SEQ ID NO: 2566974 - DNA, 16 bp, Homo sapiens
gatccaagctggtccc

SEQ ID NO: 2566975 - DNA, 17 bp, Homo sapiens
gatccaagctggtccca

SEQ ID NO: 2566976 - DNA, 14 bp, Homo sapiens
gatccacacacaga

SEQ ID NO: 2566977 - DNA, 19 bp, Homo sapiens
gatccacacacagaggaag

SEQ ID NO: 2566978 - DNA, 22 bp, Homo sapiens
gatccacccacctcagcctccc

SEQ ID NO: 2566979 - DNA, 19 bp, Homo sapiens
gacttcttttcacattctt

SEQ ID NO: 2566980 - DNA, 21 bp, Homo sapiens
gacttcttttcacattcttat

SEQ ID NO: 2566981 - DNA, 22 bp, Homo sapiens
gacttcttttcacattcttata

SEQ ID NO: 2566982 - DNA, 13 bp, Homo sapiens
gacttgaaagcat

SEQ ID NO: 2566983 - DNA, 14 bp, Homo sapiens
gacttgaaagcatc

SEQ ID NO: 2566984 - DNA, 13 bp, Homo sapiens
gacttgcattttt

SEQ ID NO: 2566985 - DNA, 19 bp, Homo sapiens
gacttggcaacagaagcag

SEQ ID NO: 2566986 - DNA, 20 bp, Homo sapiens
gacttggggagatggagttc

SEQ ID NO: 2566987 - DNA, 16 bp, Homo sapiens
gacttggtcaccagct

SEQ ID NO: 2566988 - DNA, 19 bp, Homo sapiens
gacttgtatatttgtacaa

SEQ ID NO: 2566989 - DNA, 13 bp, Homo sapiens
gacttgtgtctct

SEQ ID NO: 2566990 - DNA, 16 bp, Homo sapiens
gacttgtgtctctgtg

SEQ ID NO: 2566991 - DNA, 23 bp, Homo sapiens
gactttctcagcctctgaatatg

SEQ ID NO: 2566992 - DNA, 19 bp, Homo sapiens
gactttggctgcatgcgag

SEQ ID NO: 2566993 - DNA, 13 bp, Homo sapiens
gactttgtgatcc

SEQ ID NO: 2566994 - DNA, 19 bp, Homo sapiens
gacttttccaaccctcatc

SEQ ID NO: 2566995 - DNA, 20 bp, Homo sapiens
gacttttccaaccctcatca

SEQ ID NO: 2566996 - DNA, 17 bp, Homo sapiens
gagaaaaagctcctgtc

SEQ ID NO: 2566997 - DNA, 21 bp, Homo sapiens
gagaaaacgtcttgcttggga

SEQ ID NO: 2566998 - DNA, 9 bp, Homo sapiens
gagaaaaga

SEQ ID NO: 2566999 - DNA, 10 bp, Homo sapiens
gagaaaagaa

SEQ ID NO: 2567000 - DNA, 19 bp, Homo sapiens
gagaaaagaaaaaaaaaga

SEQ ID NO: 2567001 - DNA, 12 bp, Homo sapiens
gagaaaataaaa

SEQ ID NO: 2567002 - DNA, 14 bp, Homo sapiens
gagaaacagagaca

SEQ ID NO: 2567003 - DNA, 23 bp, Homo sapiens
gagaaaccttattgtacctctct

SEQ ID NO: 2567004 - DNA, 15 bp, Homo sapiens
gagaaagactattca

SEQ ID NO: 2567005 - DNA, 18 bp, Homo sapiens
gagaaagactattcaaac

SEQ ID NO: 2567006 - DNA, 16 bp, Homo sapiens
gagaaaggttgaagca

SEQ ID NO: 2567007 - DNA, 12 bp, Homo sapiens
gagaaatgcata

SEQ ID NO: 2567008 - DNA, 20 bp, Homo sapiens
gagaaccctgcgtggggaca

SEQ ID NO: 2567009 - DNA, 18 bp, Homo sapiens
gagaacctaagtttcagt

SEQ ID NO: 2567010 - DNA, 19 bp, Homo sapiens
gagaacctggagttcctga

SEQ ID NO: 2567011 - DNA, 15 bp, Homo sapiens
gagaacgcagcccta

SEQ ID NO: 2567012 - DNA, 24 bp, Homo sapiens
gagaacgcagccctagagcctgcc

SEQ ID NO: 2567013 - DNA, 19 bp, Homo sapiens
gagaactagaacctggagg

SEQ ID NO: 2567014 - DNA, 23 bp, Homo sapiens
gagaactcatccctaatgctgca

SEQ ID NO: 2567015 - DNA, 15 bp, Homo sapiens
gagaagacaaaatta

SEQ ID NO: 2567016 - DNA, 13 bp, Homo sapiens
gagaagagctgtt

SEQ ID NO: 2567017 - DNA, 21 bp, Homo sapiens
gagaagaggctggtgctgtgg

SEQ ID NO: 2567018 - DNA, 15 bp, Homo sapiens
gagaagagggcctgt

SEQ ID NO: 2567019 - DNA, 12 bp, Homo sapiens
gagaagcactgt

SEQ ID NO: 2567020 - DNA, 15 bp, Homo sapiens
gagaagcggctggca

SEQ ID NO: 2567021 - DNA, 17 bp, Homo sapiens
gagaagctcccaggaac

SEQ ID NO: 2567022 - DNA, 12 bp, Homo sapiens
gagaaggaagcc

SEQ ID NO: 2567023 - DNA, 11 bp, Homo sapiens
gagaaggagcc

SEQ ID NO: 2567024 - DNA, 23 bp, Homo sapiens
gagaagtcttagacttgaaatac

SEQ ID NO: 2567025 - DNA, 23 bp, Homo sapiens
gagaagtgacagggaagctacag

SEQ ID NO: 2567026 - DNA, 23 bp, Homo sapiens
gagaagtgcccctgctgcctccc

SEQ ID NO: 2567027 - DNA, 17 bp, Homo sapiens
gagaagtttctggccct

SEQ ID NO: 2567028 - DNA, 14 bp, Homo sapiens
gagaatcacttgaa

SEQ ID NO: 2567029 - DNA, 17 bp, Homo sapiens
gagaatgagggccaaga

SEQ ID NO: 2567030 - DNA, 16 bp, Homo sapiens
gagaattcttacatgt

SEQ ID NO: 2567031 - DNA, 22 bp, Homo sapiens
gagaattcttacatgttttctt

SEQ ID NO: 2567032 - DNA, 17 bp, Homo sapiens
gagaattgggattacat

SEQ ID NO: 2567033 - DNA, 17 bp, Homo sapiens
gagacacttgccttctt

SEQ ID NO: 2567034 - DNA, 14 bp, Homo sapiens
gagacagagctggt

SEQ ID NO: 2567035 - DNA, 19 bp, Homo sapiens
gagacagagttttcactct

SEQ ID NO: 2567036 - DNA, 14 bp, Homo sapiens
gagacagcccgggc

SEQ ID NO: 2567037 - DNA, 18 bp, Homo sapiens
gagacagcccgggctctg

SEQ ID NO: 2567038 - DNA, 20 bp, Homo sapiens
gagacagcccgggctctgcc

SEQ ID NO: 2567039 - DNA, 24 bp, Homo sapiens
gagacagcccgggctctgcctccc

SEQ ID NO: 2567040 - DNA, 18 bp, Homo sapiens
gagacagctctgcatact

SEQ ID NO: 2567041 - DNA, 20 bp, Homo sapiens
gagacagctctgcatactca

SEQ ID NO: 2567042 - DNA, 12 bp, Homo sapiens
gagacaggaagg

SEQ ID NO: 2567043 - DNA, 17 bp, Homo sapiens
gagacagtgatctccat

SEQ ID NO: 2567044 - DNA, 14 bp, Homo sapiens
gagacagtgggaaa

SEQ ID NO: 2567045 - DNA, 15 bp, Homo sapiens
gagacagtgggaaat

SEQ ID NO: 2567046 - DNA, 16 bp, Homo sapiens
gagacagtgggaaata

SEQ ID NO: 2567047 - DNA, 21 bp, Homo sapiens
gagacagtttcttagcttttt

SEQ ID NO: 2567048 - DNA, 18 bp, Homo sapiens
gagaccaaggcgggagca

SEQ ID NO: 2567049 - DNA, 14 bp, Homo sapiens
gagaccagcctggc

SEQ ID NO: 2567050 - DNA, 19 bp, Homo sapiens
gagaccagcctgggcagca

SEQ ID NO: 2567051 - DNA, 17 bp, Homo sapiens
gagaccaggagggcact

SEQ ID NO: 2567052 - DNA, 14 bp, Homo sapiens
gagaccaggcaaag

SEQ ID NO: 2567053 - DNA, 20 bp, Homo sapiens
gagaccagttgggagcactg

SEQ ID NO: 2567054 - DNA, 22 bp, Homo sapiens
gagaccagttgggagcactgga

SEQ ID NO: 2567055 - DNA, 18 bp, Homo sapiens
gagaccatccctgaaggc

SEQ ID NO: 2567056 - DNA, 21 bp, Homo sapiens
gagaccatccctgaaggcccc

SEQ ID NO: 2567057 - DNA, 18 bp, Homo sapiens
gagaccatgcagagcgcc

SEQ ID NO: 2567058 - DNA, 13 bp, Homo sapiens
gagacccccacac

SEQ ID NO: 2567059 - DNA, 14 bp, Homo sapiens
gagacccccacacc

SEQ ID NO: 2567060 - DNA, 14 bp, Homo sapiens
gagacccctggcct

SEQ ID NO: 2567061 - DNA, 15 bp, Homo sapiens
gagacccctggcctc

SEQ ID NO: 2567062 - DNA, 17 bp, Homo sapiens
gagacccctggcctccg

SEQ ID NO: 2567063 - DNA, 14 bp, Homo sapiens
gagacctacctcag

SEQ ID NO: 2567064 - DNA, 17 bp, Homo sapiens
gagacctacctcaggtt

SEQ ID NO: 2567065 - DNA, 21 bp, Homo sapiens
gagacctacctcaggttgctg

SEQ ID NO: 2567066 - DNA, 18 bp, Homo sapiens
gagacctcatcaggatga

SEQ ID NO: 2567067 - DNA, 13 bp, Homo sapiens
gagacctcctgcc

SEQ ID NO: 2567068 - DNA, 15 bp, Homo sapiens
gagacctcctgcctc

SEQ ID NO: 2567069 - DNA, 14 bp, Homo sapiens
gagacggagtccca

SEQ ID NO: 2567070 - DNA, 15 bp, Homo sapiens
gagacggtcgagcag

SEQ ID NO: 2567071 - DNA, 15 bp, Homo sapiens
gagacgtgtacatag

SEQ ID NO: 2567072 - DNA, 16 bp, Homo sapiens
gagacgtgtacatagt

SEQ ID NO: 2567073 - DNA, 15 bp, Homo sapiens
gagactaagccctgt

SEQ ID NO: 2567074 - DNA, 16 bp, Homo sapiens
gagactaagccctgtc

SEQ ID NO: 2567075 - DNA, 22 bp, Homo sapiens
gagactaagccctgtcgagaca

SEQ ID NO: 2567076 - DNA, 18 bp, Homo sapiens
gagactccgtctcaagga

SEQ ID NO: 2567077 - DNA, 16 bp, Homo sapiens
gagactcctaggcagg

SEQ ID NO: 2567078 - DNA, 14 bp, Homo sapiens
gagactcctgcagg

SEQ ID NO: 2567079 - DNA, 17 bp, Homo sapiens
gagactcctgcaggcag

SEQ ID NO: 2567080 - DNA, 17 bp, Homo sapiens
gagactcctgccctgtt

SEQ ID NO: 2567081 - DNA, 19 bp, Homo sapiens
gagactgcgggatggtcct

SEQ ID NO: 2567082 - DNA, 23 bp, Homo sapiens
gagactgcttcccatcctaccct

SEQ ID NO: 2567083 - DNA, 13 bp, Homo sapiens
gagactgggaaga

SEQ ID NO: 2567084 - DNA, 14 bp, Homo sapiens
gagactgggctgag

SEQ ID NO: 2567085 - DNA, 21 bp, Homo sapiens
gagactgggctgagggagcct

SEQ ID NO: 2567086 - DNA, 13 bp, Homo sapiens
gagagaaaataaa

SEQ ID NO: 2567087 - DNA, 21 bp, Homo sapiens
gagagaaaataaaaagttaaa

SEQ ID NO: 2567088 - DNA, 22 bp, Homo sapiens
gagagaaagtgtgagcaaacta

SEQ ID NO: 2567089 - DNA, 21 bp, Homo sapiens
gagagaagtgcccctgctgcc

SEQ ID NO: 2567090 - DNA, 14 bp, Homo sapiens
gagagaccaggcaa

SEQ ID NO: 2567091 - DNA, 17 bp, Homo sapiens
gagagacctcatcagga

SEQ ID NO: 2567092 - DNA, 18 bp, Homo sapiens
gagagacctcatcaggat

SEQ ID NO: 2567093 - DNA, 17 bp, Homo sapiens
gacctgtaacttttgta

SEQ ID NO: 2567094 - DNA, 17 bp, Homo sapiens
gacctgtcatgcccccc

SEQ ID NO: 2567095 - DNA, 15 bp, Homo sapiens
gacctgtcctcctgg

SEQ ID NO: 2567096 - DNA, 19 bp, Homo sapiens
gacctgtcctcctggtggg

SEQ ID NO: 2567097 - DNA, 15 bp, Homo sapiens
gacctgtgaccagca

SEQ ID NO: 2567098 - DNA, 17 bp, Homo sapiens
gacctgtgaccagcact

SEQ ID NO: 2567099 - DNA, 20 bp, Homo sapiens
gacctgtggggatttctccc

SEQ ID NO: 2567100 - DNA, 22 bp, Homo sapiens
gaccttagtgtttctgtgcatg

SEQ ID NO: 2567101 - DNA, 23 bp, Homo sapiens
gaccttagtgtttctgtgcatgg

SEQ ID NO: 2567102 - DNA, 14 bp, Homo sapiens
gaccttatctgtgc

SEQ ID NO: 2567103 - DNA, 22 bp, Homo sapiens
gaccttatctgtgcgtgaaaca

SEQ ID NO: 2567104 - DNA, 19 bp, Homo sapiens
gaccttcaccaaacatact

SEQ ID NO: 2567105 - DNA, 16 bp, Homo sapiens
gaccttcctcgcagag

SEQ ID NO: 2567106 - DNA, 19 bp, Homo sapiens
gaccttcctcgcagagagg

SEQ ID NO: 2567107 - DNA, 16 bp, Homo sapiens
gaccttcctgccacca

SEQ ID NO: 2567108 - DNA, 23 bp, Homo sapiens
gaccttcctgccaccagtcactg

SEQ ID NO: 2567109 - DNA, 19 bp, Homo sapiens
gaccttgaagggtaaagaa

SEQ ID NO: 2567110 - DNA, 23 bp, Homo sapiens
gaccttgcaacttcatgtcaact

SEQ ID NO: 2567111 - DNA, 14 bp, Homo sapiens
gaccttgttgcatg

SEQ ID NO: 2567112 - DNA, 22 bp, Homo sapiens
gacctttagtggtggccattta

SEQ ID NO: 2567113 - DNA, 22 bp, Homo sapiens
gaccttttcaacttggcttcct

SEQ ID NO: 2567114 - DNA, 17 bp, Homo sapiens
gacgaggccctcgggcc

SEQ ID NO: 2567115 - DNA, 13 bp, Homo sapiens
gacgccatcccag

SEQ ID NO: 2567116 - DNA, 21 bp, Homo sapiens
gacgccggggacagaggcctg

SEQ ID NO: 2567117 - DNA, 20 bp, Homo sapiens
gacgcctgccctccccagag

SEQ ID NO: 2567118 - DNA, 16 bp, Homo sapiens
gacgctacccgggaag

SEQ ID NO: 2567119 - DNA, 23 bp, Homo sapiens
gacgctacccgggaagggggctg

SEQ ID NO: 2567120 - DNA, 13 bp, Homo sapiens
gacgctgaataaa

SEQ ID NO: 2567121 - DNA, 12 bp, Homo sapiens
gacgctgtgctg

SEQ ID NO: 2567122 - DNA, 21 bp, Homo sapiens
gacgctgtgctgccctgccca

SEQ ID NO: 2567123 - DNA, 21 bp, Homo sapiens
gacggagtcccaccttggctg

SEQ ID NO: 2567124 - DNA, 15 bp, Homo sapiens
gacggcctgatgctc

SEQ ID NO: 2567125 - DNA, 20 bp, Homo sapiens
gacggcctgatgctccctcc

SEQ ID NO: 2567126 - DNA, 17 bp, Homo sapiens
gacggggggccccagtc

SEQ ID NO: 2567127 - DNA, 22 bp, Homo sapiens
gacggggggccccagtcagcct

SEQ ID NO: 2567128 - DNA, 17 bp, Homo sapiens
gacggtgctccaggcag

SEQ ID NO: 2567129 - DNA, 18 bp, Homo sapiens
gacgtcccttttttctct

SEQ ID NO: 2567130 - DNA, 22 bp, Homo sapiens
gacgtgattcaattcaacactc

SEQ ID NO: 2567131 - DNA, 18 bp, Homo sapiens
gacgtgcacctgtactca

SEQ ID NO: 2567132 - DNA, 14 bp, Homo sapiens
gacgtgtttgtgtt

SEQ ID NO: 2567133 - DNA, 13 bp, Homo sapiens
gacgttccagccg

SEQ ID NO: 2567134 - DNA, 13 bp, Homo sapiens
gactaattgtata

SEQ ID NO: 2567135 - DNA, 13 bp, Homo sapiens
gactacaggcacc

SEQ ID NO: 2567136 - DNA, 21 bp, Homo sapiens
gactacaggtgtgagtcacca

SEQ ID NO: 2567137 - DNA, 14 bp, Homo sapiens
gactacatttagag

SEQ ID NO: 2567138 - DNA, 15 bp, Homo sapiens
gactagaggcaggga

SEQ ID NO: 2567139 - DNA, 20 bp, Homo sapiens
gactagagggacctctccca

SEQ ID NO: 2567140 - DNA, 18 bp, Homo sapiens
gactagggattcaggctg

SEQ ID NO: 2567141 - DNA, 21 bp, Homo sapiens
gactagggattcaggctgctt

SEQ ID NO: 2567142 - DNA, 22 bp, Homo sapiens
gactatctaaatgttgaaagat

SEQ ID NO: 2567143 - DNA, 21 bp, Homo sapiens
gactatgaatgggcaaaactg

SEQ ID NO: 2567144 - DNA, 16 bp, Homo sapiens
gactattcaaacagtc

SEQ ID NO: 2567145 - DNA, 14 bp, Homo sapiens
gactcaaaccaaat

SEQ ID NO: 2567146 - DNA, 17 bp, Homo sapiens
gactcacaagaagacca

SEQ ID NO: 2567147 - DNA, 22 bp, Homo sapiens
gactcacaagaagaccagactg

SEQ ID NO: 2567148 - DNA, 23 bp, Homo sapiens
gactcacttatcccaagagaatg

SEQ ID NO: 2567149 - DNA, 11 bp, Homo sapiens
gactcagccct

SEQ ID NO: 2567150 - DNA, 17 bp, Homo sapiens
gactcagctccccagag

SEQ ID NO: 2567151 - DNA, 20 bp, Homo sapiens
gactcagctccccagagtcc

SEQ ID NO: 2567152 - DNA, 15 bp, Homo sapiens
gactcaggatgccca

SEQ ID NO: 2567153 - DNA, 16 bp, Homo sapiens
gactcaggatgcccag

SEQ ID NO: 2567154 - DNA, 23 bp, Homo sapiens
gactcaggatgcccagggccact

SEQ ID NO: 2567155 - DNA, 18 bp, Homo sapiens
gactcagggccccagcac

SEQ ID NO: 2567156 - DNA, 20 bp, Homo sapiens
gactcagggccccagcacta

SEQ ID NO: 2567157 - DNA, 12 bp, Homo sapiens
gactcagggctc

SEQ ID NO: 2567158 - DNA, 16 bp, Homo sapiens
gactcagggctcctgg

SEQ ID NO: 2567159 - DNA, 21 bp, Homo sapiens
gactcaggttgtagtaaagaa

SEQ ID NO: 2567160 - DNA, 12 bp, Homo sapiens
gactcagtgttc

SEQ ID NO: 2567161 - DNA, 13 bp, Homo sapiens
gactcattctgaa

SEQ ID NO: 2567162 - DNA, 16 bp, Homo sapiens
gactcattctgaagga

SEQ ID NO: 2567163 - DNA, 21 bp, Homo sapiens
gactcattttaaaaaatggaa

SEQ ID NO: 2567164 - DNA, 12 bp, Homo sapiens
gactccaaagaa

SEQ ID NO: 2567165 - DNA, 15 bp, Homo sapiens
gactccaaagaaatg

SEQ ID NO: 2567166 - DNA, 16 bp, Homo sapiens
gactccaaagaaatgt

SEQ ID NO: 2567167 - DNA, 16 bp, Homo sapiens
gactccagactctctg

SEQ ID NO: 2567168 - DNA, 20 bp, Homo sapiens
gactccagcctgcctggcag

SEQ ID NO: 2567169 - DNA, 16 bp, Homo sapiens
gactccaggagaggag

SEQ ID NO: 2567170 - DNA, 15 bp, Homo sapiens
gactccccaggccag

SEQ ID NO: 2567171 - DNA, 13 bp, Homo sapiens
gactccctcctca

SEQ ID NO: 2567172 - DNA, 24 bp, Homo sapiens
gactccctcctcacctctggactg

SEQ ID NO: 2567173 - DNA, 15 bp, Homo sapiens
gactccgctggaggt

SEQ ID NO: 2567174 - DNA, 22 bp, Homo sapiens
gactccggccctcctaccctgc

SEQ ID NO: 2567175 - DNA, 13 bp, Homo sapiens
gactcctgcaggc

SEQ ID NO: 2567176 - DNA, 17 bp, Homo sapiens
gactcctgcaggcagcc

SEQ ID NO: 2567177 - DNA, 19 bp, Homo sapiens
gactcctgcaggcagccag

SEQ ID NO: 2567178 - DNA, 16 bp, Homo sapiens
gactcctgtgcaactt

SEQ ID NO: 2567179 - DNA, 20 bp, Homo sapiens
gactcgtctgactgtgtgtg

SEQ ID NO: 2567180 - DNA, 15 bp, Homo sapiens
gactctacagaggcc

SEQ ID NO: 2567181 - DNA, 19 bp, Homo sapiens
gactctacctcatatcagt

SEQ ID NO: 2567182 - DNA, 23 bp, Homo sapiens
gactctacctcatatcagtttgc

SEQ ID NO: 2567183 - DNA, 14 bp, Homo sapiens
gactctcaaatctt

SEQ ID NO: 2567184 - DNA, 20 bp, Homo sapiens
gactctcagtctctgagcag

SEQ ID NO: 2567185 - DNA, 12 bp, Homo sapiens
gactctctgtga

SEQ ID NO: 2567186 - DNA, 18 bp, Homo sapiens
gactctgaaatctgaaga

SEQ ID NO: 2567187 - DNA, 18 bp, Homo sapiens
gactctgaagcctctggg

SEQ ID NO: 2567188 - DNA, 21 bp, Homo sapiens
gactctgaatctttttcagaa

SEQ ID NO: 2567189 - DNA, 23 bp, Homo sapiens
gactctgacctcttggccacaga

SEQ ID NO: 2567190 - DNA, 10 bp, Homo sapiens
gactctgccc

SEQ ID NO: 2567191 - DNA, 12 bp, Homo sapiens
gactctgccccc

SEQ ID NO: 2567192 - DNA, 16 bp, Homo sapiens
gactctgccccctgct

SEQ ID NO: 2567193 - DNA, 22 bp, Homo sapiens
gactctgtcaatttccctgact

SEQ ID NO: 2567194 - DNA, 19 bp, Homo sapiens
gactctgtctcaaaaaaac

SEQ ID NO: 2567195 - DNA, 17 bp, Homo sapiens
gactctgtggggccttg

SEQ ID NO: 2567196 - DNA, 19 bp, Homo sapiens
gactcttgttttcagtttc

SEQ ID NO: 2567197 - DNA, 18 bp, Homo sapiens
gactctttggtggctttg

SEQ ID NO: 2567198 - DNA, 19 bp, Homo sapiens
gactctttggtggctttgc

SEQ ID NO: 2567199 - DNA, 20 bp, Homo sapiens
gactctttttagggccaggc

SEQ ID NO: 2567200 - DNA, 18 bp, Homo sapiens
gactgaaaacctctcctc

SEQ ID NO: 2567201 - DNA, 20 bp, Homo sapiens
gactgaaaacctctcctcat

SEQ ID NO: 2567202 - DNA, 14 bp, Homo sapiens
gactgaatttcttt

SEQ ID NO: 2567203 - DNA, 14 bp, Homo sapiens
gactgagcacctgc

SEQ ID NO: 2567204 - DNA, 15 bp, Homo sapiens
gactgagcacctgct

SEQ ID NO: 2567205 - DNA, 19 bp, Homo sapiens
gactgagtaagaaatgctg

SEQ ID NO: 2567206 - DNA, 22 bp, Homo sapiens
gactgagtcctcgtagccatct

SEQ ID NO: 2567207 - DNA, 16 bp, Homo sapiens
gactgccgaccgaggc

SEQ ID NO: 2567208 - DNA, 20 bp, Homo sapiens
gactgcgatcttcagagcag

SEQ ID NO: 2567209 - DNA, 14 bp, Homo sapiens
gactgctaaataaa

SEQ ID NO: 2567210 - DNA, 15 bp, Homo sapiens
gactggaaccaggga

SEQ ID NO: 2567211 - DNA, 18 bp, Homo sapiens
gactggaagcacagcttc

SEQ ID NO: 2567212 - DNA, 18 bp, Homo sapiens
gactggcacagttttctg

SEQ ID NO: 2567213 - DNA, 14 bp, Homo sapiens
gactggcccctggg

SEQ ID NO: 2567214 - DNA, 22 bp, Homo sapiens
gactggcccctgggtcagtctg

SEQ ID NO: 2567215 - DNA, 20 bp, Homo sapiens
gactggctagagtcctcact

SEQ ID NO: 2567216 - DNA, 22 bp, Homo sapiens
gaaataactccttcttgtagta

SEQ ID NO: 2567217 - DNA, 15 bp, Homo sapiens
gaaatactgtttgag

SEQ ID NO: 2567218 - DNA, 17 bp, Homo sapiens
gaaatatatatgtgtgt

SEQ ID NO: 2567219 - DNA, 14 bp, Homo sapiens
gaaatatcatttat

SEQ ID NO: 2567220 - DNA, 19 bp, Homo sapiens
gaaatatctgaaaatgtat

SEQ ID NO: 2567221 - DNA, 17 bp, Homo sapiens
gaaatatgcacaatagc

SEQ ID NO: 2567222 - DNA, 13 bp, Homo sapiens
gaaatatgcatct

SEQ ID NO: 2567223 - DNA, 19 bp, Homo sapiens
gaaatattaaaccctggat

SEQ ID NO: 2567224 - DNA, 17 bp, Homo sapiens
gaaatcaaatatgcaaa

SEQ ID NO: 2567225 - DNA, 21 bp, Homo sapiens
gaaatcaaatatgcaaagcac

SEQ ID NO: 2567226 - DNA, 15 bp, Homo sapiens
gaaatctagtatttc

SEQ ID NO: 2567227 - DNA, 20 bp, Homo sapiens
gaaatctgtgcctgagaaca

SEQ ID NO: 2567228 - DNA, 13 bp, Homo sapiens
gaaatgaataatt

SEQ ID NO: 2567229 - DNA, 18 bp, Homo sapiens
gaaatgaataatttccca

SEQ ID NO: 2567230 - DNA, 15 bp, Homo sapiens
gaaatgagaaggcag

SEQ ID NO: 2567231 - DNA, 18 bp, Homo sapiens
gaaatgagatcaggctct

SEQ ID NO: 2567232 - DNA, 18 bp, Homo sapiens
gaaatgaggtcagagcct

SEQ ID NO: 2567233 - DNA, 18 bp, Homo sapiens
gaaatgctgatggataac

SEQ ID NO: 2567234 - DNA, 16 bp, Homo sapiens
gaaatgctgcctgcct

SEQ ID NO: 2567235 - DNA, 17 bp, Homo sapiens
gaaatggcttgaagcca

SEQ ID NO: 2567236 - DNA, 14 bp, Homo sapiens
gaaatgggcagagc

SEQ ID NO: 2567237 - DNA, 16 bp, Homo sapiens
gaaatgggcagagcag

SEQ ID NO: 2567238 - DNA, 22 bp, Homo sapiens
gaaatgtaagggaaactgccag

SEQ ID NO: 2567239 - DNA, 17 bp, Homo sapiens
gaaattacacccaaaga

SEQ ID NO: 2567240 - DNA, 20 bp, Homo sapiens
gaaattaccagagttgttct

SEQ ID NO: 2567241 - DNA, 19 bp, Homo sapiens
gaaattactacaaaatttg

SEQ ID NO: 2567242 - DNA, 21 bp, Homo sapiens
gaaattacttatcatccacat

SEQ ID NO: 2567243 - DNA, 13 bp, Homo sapiens
gaaattagggccc

SEQ ID NO: 2567244 - DNA, 18 bp, Homo sapiens
gaaattatgtatgtttac

SEQ ID NO: 2567245 - DNA, 17 bp, Homo sapiens
gaaattatttaataaaa

SEQ ID NO: 2567246 - DNA, 22 bp, Homo sapiens
gaaattcccttcatctggaacc

SEQ ID NO: 2567247 - DNA, 12 bp, Homo sapiens
gaaattgacaga

SEQ ID NO: 2567248 - DNA, 22 bp, Homo sapiens
gaaattggaacagaatgtttta

SEQ ID NO: 2567249 - DNA, 21 bp, Homo sapiens
gaaattgtctagcagagcagg

SEQ ID NO: 2567250 - DNA, 23 bp, Homo sapiens
gaaatttaattcatgtttcttaa

SEQ ID NO: 2567251 - DNA, 15 bp, Homo sapiens
gaaattttatatgct

SEQ ID NO: 2567252 - DNA, 14 bp, Homo sapiens
gaaattttccaatg

SEQ ID NO: 2567253 - DNA, 20 bp, Homo sapiens
gaaattttctagactttctg

SEQ ID NO: 2567254 - DNA, 20 bp, Homo sapiens
gaaatttttcagatgcttct

SEQ ID NO: 2567255 - DNA, 23 bp, Homo sapiens
gacatactaaccagcagaaatgc

SEQ ID NO: 2567256 - DNA, 20 bp, Homo sapiens
gacatagaattaacacatga

SEQ ID NO: 2567257 - DNA, 20 bp, Homo sapiens
gacatagagagggagaagaa

SEQ ID NO: 2567258 - DNA, 22 bp, Homo sapiens
gacatcacttgtacaaaataaa

SEQ ID NO: 2567259 - DNA, 20 bp, Homo sapiens
gacatcagtggcatggctcc

SEQ ID NO: 2567260 - DNA, 16 bp, Homo sapiens
gacatccataaagaag

SEQ ID NO: 2567261 - DNA, 23 bp, Homo sapiens
gacatccccccgccaaaagctgc

SEQ ID NO: 2567262 - DNA, 16 bp, Homo sapiens
gacatctcaggggcca

SEQ ID NO: 2567263 - DNA, 22 bp, Homo sapiens
gacatctcaggggccagaggaa

SEQ ID NO: 2567264 - DNA, 17 bp, Homo sapiens
gacatctctgcaccctg

SEQ ID NO: 2567265 - DNA, 16 bp, Homo sapiens
gacatctctttgaatt

SEQ ID NO: 2567266 - DNA, 21 bp, Homo sapiens
gacatctgtttctaaatgttt

SEQ ID NO: 2567267 - DNA, 19 bp, Homo sapiens
gacatgagtgcgtgctcag

SEQ ID NO: 2567268 - DNA, 15 bp, Homo sapiens
gacatgctgaagcca

SEQ ID NO: 2567269 - DNA, 17 bp, Homo sapiens
gacatggacccggagct

SEQ ID NO: 2567270 - DNA, 20 bp, Homo sapiens
gacatggagactcctgccct

SEQ ID NO: 2567271 - DNA, 21 bp, Homo sapiens
gacatggcttgccacagctct

SEQ ID NO: 2567272 - DNA, 16 bp, Homo sapiens
gacatggggaggaagg

SEQ ID NO: 2567273 - DNA, 17 bp, Homo sapiens
gacatgtctgttctaca

SEQ ID NO: 2567274 - DNA, 17 bp, Homo sapiens
gacatgtcttttcttgc

SEQ ID NO: 2567275 - DNA, 15 bp, Homo sapiens
gacatgtgaaacctt

SEQ ID NO: 2567276 - DNA, 23 bp, Homo sapiens
gacatgtgaaaccttttttaaga

SEQ ID NO: 2567277 - DNA, 20 bp, Homo sapiens
gacatgttttgataaagtag

SEQ ID NO: 2567278 - DNA, 18 bp, Homo sapiens
gacatgtttttgttttct

SEQ ID NO: 2567279 - DNA, 14 bp, Homo sapiens
gacattaacagttt

SEQ ID NO: 2567280 - DNA, 18 bp, Homo sapiens
gacattaacagttttcca

SEQ ID NO: 2567281 - DNA, 16 bp, Homo sapiens
gacattcatgcctggc

SEQ ID NO: 2567282 - DNA, 22 bp, Homo sapiens
gacattcctaaactatcttttt

SEQ ID NO: 2567283 - DNA, 14 bp, Homo sapiens
gacattctgccagg

SEQ ID NO: 2567284 - DNA, 18 bp, Homo sapiens
gacattgctaagatgctc

SEQ ID NO: 2567285 - DNA, 23 bp, Homo sapiens
gacattgctttactgtcaaaata

SEQ ID NO: 2567286 - DNA, 11 bp, Homo sapiens
gacatttccca

SEQ ID NO: 2567287 - DNA, 17 bp, Homo sapiens
gaccaaaatccccttct

SEQ ID NO: 2567288 - DNA, 17 bp, Homo sapiens
gaccaaacctagcccct

SEQ ID NO: 2567289 - DNA, 17 bp, Homo sapiens
gaccaaccctgtttcct

SEQ ID NO: 2567290 - DNA, 17 bp, Homo sapiens
gaccaactagacattct

SEQ ID NO: 2567291 - DNA, 18 bp, Homo sapiens
gaccaactagacattctg

SEQ ID NO: 2567292 - DNA, 20 bp, Homo sapiens
gaccaactagacattctgtc

SEQ ID NO: 2567293 - DNA, 15 bp, Homo sapiens
gaccaagcaggaagc

SEQ ID NO: 2567294 - DNA, 17 bp, Homo sapiens
gaccaagcaggaagctc

SEQ ID NO: 2567295 - DNA, 16 bp, Homo sapiens
gaccaaggacccctca

SEQ ID NO: 2567296 - DNA, 21 bp, Homo sapiens
gaccaagttataaatcaatgt

SEQ ID NO: 2567297 - DNA, 20 bp, Homo sapiens
gaccaatattatactaagaa

SEQ ID NO: 2567298 - DNA, 18 bp, Homo sapiens
gaccaatattcaaatgcg

SEQ ID NO: 2567299 - DNA, 18 bp, Homo sapiens
gaccaatattgtacagtt

SEQ ID NO: 2567300 - DNA, 21 bp, Homo sapiens
gaccaatattgtacagttttt

SEQ ID NO: 2567301 - DNA, 18 bp, Homo sapiens
gaccacaaaacttttcta

SEQ ID NO: 2567302 - DNA, 16 bp, Homo sapiens
gaccacaccctgtact

SEQ ID NO: 2567303 - DNA, 23 bp, Homo sapiens
gaccacacttcctgtccagagag

SEQ ID NO: 2567304 - DNA, 21 bp, Homo sapiens
gaccacagggttcaaaatgtc

SEQ ID NO: 2567305 - DNA, 17 bp, Homo sapiens
gaccaccctcccctctc

SEQ ID NO: 2567306 - DNA, 18 bp, Homo sapiens
gaccactgcagaagacag

SEQ ID NO: 2567307 - DNA, 21 bp, Homo sapiens
gaccagagccccacacggagg

SEQ ID NO: 2567308 - DNA, 20 bp, Homo sapiens
gaccagcagatcccagctca

SEQ ID NO: 2567309 - DNA, 11 bp, Homo sapiens
gaccagcctgg

SEQ ID NO: 2567310 - DNA, 23 bp, Homo sapiens
gaccagcctgttggacccgctct

SEQ ID NO: 2567311 - DNA, 17 bp, Homo sapiens
gaccaggactccctcct

SEQ ID NO: 2567312 - DNA, 21 bp, Homo sapiens
gaccaggactccctcctcacc

SEQ ID NO: 2567313 - DNA, 23 bp, Homo sapiens
gaccaggactccctcctcacctc

SEQ ID NO: 2567314 - DNA, 16 bp, Homo sapiens
gaccaggagggcactg

SEQ ID NO: 2567315 - DNA, 22 bp, Homo sapiens
gaccaggggtgatttcagagag

SEQ ID NO: 2567316 - DNA, 15 bp, Homo sapiens
gaccagttgggagca

SEQ ID NO: 2567317 - DNA, 16 bp, Homo sapiens
gaccataacagccaac

SEQ ID NO: 2567318 - DNA, 20 bp, Homo sapiens
gaccataatgttacattatt

SEQ ID NO: 2567319 - DNA, 16 bp, Homo sapiens
gaccatccctgaaggc

SEQ ID NO: 2567320 - DNA, 18 bp, Homo sapiens
gaccatccctgaaggccc

SEQ ID NO: 2567321 - DNA, 22 bp, Homo sapiens
gaccattctccacctgccaggg

SEQ ID NO: 2567322 - DNA, 16 bp, Homo sapiens
gacccaaaaggcagaa

SEQ ID NO: 2567323 - DNA, 19 bp, Homo sapiens
gacccaaaaggcagaagca

SEQ ID NO: 2567324 - DNA, 20 bp, Homo sapiens
gacccaaaaggcagaagcaa

SEQ ID NO: 2567325 - DNA, 13 bp, Homo sapiens
gacccaaagacca

SEQ ID NO: 2567326 - DNA, 15 bp, Homo sapiens
gacccacaagaaatg

SEQ ID NO: 2567327 - DNA, 22 bp, Homo sapiens
gacccacaagaaatgaaagcag

SEQ ID NO: 2567328 - DNA, 16 bp, Homo sapiens
gacccacccctgtgct

SEQ ID NO: 2567329 - DNA, 17 bp, Homo sapiens
gacccacccctgtgctc

SEQ ID NO: 2567330 - DNA, 11 bp, Homo sapiens
gacccactgct

SEQ ID NO: 2567331 - DNA, 16 bp, Homo sapiens
gacccagacccagtgg

SEQ ID NO: 2567332 - DNA, 17 bp, Homo sapiens
gacccagcactgcccaa

SEQ ID NO: 2567333 - DNA, 13 bp, Homo sapiens
gacccaggccgca

SEQ ID NO: 2567334 - DNA, 19 bp, Homo sapiens
gacccaggccgcagctctt

SEQ ID NO: 2567335 - DNA, 22 bp, Homo sapiens
gacccaggccgcagctcttgcc

SEQ ID NO: 2567336 - DNA, 13 bp, Homo sapiens
gacccaggctggg

SEQ ID NO: 2567337 - DNA, 16 bp, Homo sapiens
gacccatgctgccctg

SEQ ID NO: 2567338 - DNA, 17 bp, Homo sapiens
gacccatgctgccctgt

SEQ ID NO: 2567339 - DNA, 18 bp, Homo sapiens
gacccatgctgccctgtg

SEQ ID NO: 2567340 - DNA, 20 bp, Homo sapiens
gacccatgctgccctgtgag

SEQ ID NO: 2567341 - DNA, 23 bp, Homo sapiens
gaccccaaacaccttccagctcc

SEQ ID NO: 2567342 - DNA, 19 bp, Homo sapiens
gaccccaaagagcctggag

SEQ ID NO: 2567343 - DNA, 21 bp, Homo sapiens
gaccccaaagagcctggagaa

SEQ ID NO: 2567344 - DNA, 20 bp, Homo sapiens
gaccccacccaagcttggca

SEQ ID NO: 2567345 - DNA, 12 bp, Homo sapiens
gaccccagctgg

SEQ ID NO: 2567346 - DNA, 13 bp, Homo sapiens
gaccccagctggg

SEQ ID NO: 2567347 - DNA, 14 bp, Homo sapiens
gaccccagctggga

SEQ ID NO: 2567348 - DNA, 13 bp, Homo sapiens
gacccccacccct

SEQ ID NO: 2567349 - DNA, 22 bp, Homo sapiens
gacccccaccccttccccactg

SEQ ID NO: 2567350 - DNA, 20 bp, Homo sapiens
gaccccccaccaccagccgg

SEQ ID NO: 2567351 - DNA, 22 bp, Homo sapiens
gacccctcaccttgcaacacac

SEQ ID NO: 2567352 - DNA, 11 bp, Homo sapiens
gacccctcctc

SEQ ID NO: 2567353 - DNA, 16 bp, Homo sapiens
gacccctcctcccttt

SEQ ID NO: 2567354 - DNA, 21 bp, Homo sapiens
gacccggagctaacactggcc

SEQ ID NO: 2567355 - DNA, 15 bp, Homo sapiens
gacccggaggccaca

SEQ ID NO: 2567356 - DNA, 18 bp, Homo sapiens
gaccctaagaccggcggc

SEQ ID NO: 2567357 - DNA, 14 bp, Homo sapiens
gaccctacaggaga

SEQ ID NO: 2567358 - DNA, 16 bp, Homo sapiens
gaccctattgctgctt

SEQ ID NO: 2567359 - DNA, 18 bp, Homo sapiens
gaccctcctgttgcaccc

SEQ ID NO: 2567360 - DNA, 20 bp, Homo sapiens
gaccctcctgttgcacccag

SEQ ID NO: 2567361 - DNA, 20 bp, Homo sapiens
gaccctctgaatggtccagg

SEQ ID NO: 2567362 - DNA, 10 bp, Homo sapiens
gaccctgagg

SEQ ID NO: 2567363 - DNA, 23 bp, Homo sapiens
gaccctgaggcccagagggcctg

SEQ ID NO: 2567364 - DNA, 12 bp, Homo sapiens
gaccctgccctg

SEQ ID NO: 2567365 - DNA, 21 bp, Homo sapiens
gaccctgcgaaggggccctgg

SEQ ID NO: 2567366 - DNA, 23 bp, Homo sapiens
gaccctgtctcaaaaaaagaaaa

SEQ ID NO: 2567367 - DNA, 19 bp, Homo sapiens
gacccttcccttgagccct

SEQ ID NO: 2567368 - DNA, 20 bp, Homo sapiens
gacccttgccgtctacctga

SEQ ID NO: 2567369 - DNA, 23 bp, Homo sapiens
gacccttgccgtctacctgaggg

SEQ ID NO: 2567370 - DNA, 23 bp, Homo sapiens
gaccctttagccaaacccttgtc

SEQ ID NO: 2567371 - DNA, 17 bp, Homo sapiens
gaccgaggctggagctg

SEQ ID NO: 2567372 - DNA, 12 bp, Homo sapiens
gaccgccccctc

SEQ ID NO: 2567373 - DNA, 16 bp, Homo sapiens
gaccgccccctcctct

SEQ ID NO: 2567374 - DNA, 18 bp, Homo sapiens
gaccgtgggcggggcctt

SEQ ID NO: 2567375 - DNA, 13 bp, Homo sapiens
gacctacctcagg

SEQ ID NO: 2567376 - DNA, 20 bp, Homo sapiens
gacctagggatgttctggcc

SEQ ID NO: 2567377 - DNA, 23 bp, Homo sapiens
gacctagggatgttctggccctc

SEQ ID NO: 2567378 - DNA, 15 bp, Homo sapiens
gacctatcacttcca

SEQ ID NO: 2567379 - DNA, 16 bp, Homo sapiens
gacctattcctcctgg

SEQ ID NO: 2567380 - DNA, 17 bp, Homo sapiens
gacctattcctcctggg

SEQ ID NO: 2567381 - DNA, 13 bp, Homo sapiens
gacctcaacctgt

SEQ ID NO: 2567382 - DNA, 18 bp, Homo sapiens
gacctcagagtccaggcc

SEQ ID NO: 2567383 - DNA, 11 bp, Homo sapiens
gacctcagcct

SEQ ID NO: 2567384 - DNA, 12 bp, Homo sapiens
gacctcagcctg

SEQ ID NO: 2567385 - DNA, 13 bp, Homo sapiens
gacctcagccttc

SEQ ID NO: 2567386 - DNA, 14 bp, Homo sapiens
gacctcagccttcc

SEQ ID NO: 2567387 - DNA, 20 bp, Homo sapiens
gacctcagccttccccttgc

SEQ ID NO: 2567388 - DNA, 21 bp, Homo sapiens
gacctcaggtgagaagcagag

SEQ ID NO: 2567389 - DNA, 21 bp, Homo sapiens
gacctcagttttatcattttc

SEQ ID NO: 2567390 - DNA, 10 bp, Homo sapiens
gacctcatca

SEQ ID NO: 2567391 - DNA, 23 bp, Homo sapiens
gacctcccagccctatggatgtg

SEQ ID NO: 2567392 - DNA, 19 bp, Homo sapiens
gacctctccatcttcagct

SEQ ID NO: 2567393 - DNA, 16 bp, Homo sapiens
gaaaatatactgtaaa

SEQ ID NO: 2567394 - DNA, 19 bp, Homo sapiens
gaaaatatactgtaaagaa

SEQ ID NO: 2567395 - DNA, 23 bp, Homo sapiens
gaaaatatactgtaaagaaagag

SEQ ID NO: 2567396 - DNA, 12 bp, Homo sapiens
gaaaatatgcat

SEQ ID NO: 2567397 - DNA, 19 bp, Homo sapiens
gaaaatcaaatacatactt

SEQ ID NO: 2567398 - DNA, 14 bp, Homo sapiens
gaaaatcagcctgc

SEQ ID NO: 2567399 - DNA, 20 bp, Homo sapiens
gaaaatcagcctgctccagc

SEQ ID NO: 2567400 - DNA, 20 bp, Homo sapiens
gaaaatctaatattaaaaat

SEQ ID NO: 2567401 - DNA, 23 bp, Homo sapiens
gaaaatgctgtattagtcacaga

SEQ ID NO: 2567402 - DNA, 17 bp, Homo sapiens
gaaaatgtaagctgttt

SEQ ID NO: 2567403 - DNA, 21 bp, Homo sapiens
gaaaatgtcagaaaccagtta

SEQ ID NO: 2567404 - DNA, 13 bp, Homo sapiens
gaaaattaacact

SEQ ID NO: 2567405 - DNA, 18 bp, Homo sapiens
gaaaattaggatttcatg

SEQ ID NO: 2567406 - DNA, 18 bp, Homo sapiens
gaaaattttgatgtttta

SEQ ID NO: 2567407 - DNA, 22 bp, Homo sapiens
gaaacaaagcttagcaggagag

SEQ ID NO: 2567408 - DNA, 15 bp, Homo sapiens
gaaacaacagcttta

SEQ ID NO: 2567409 - DNA, 21 bp, Homo sapiens
gaaacaatactcataatgtga

SEQ ID NO: 2567410 - DNA, 22 bp, Homo sapiens
gaaacaatactcataatgtgaa

SEQ ID NO: 2567411 - DNA, 17 bp, Homo sapiens
gaaacacaccaggctgt

SEQ ID NO: 2567412 - DNA, 23 bp, Homo sapiens
gaaacacaccaggctgtgggcct

SEQ ID NO: 2567413 - DNA, 22 bp, Homo sapiens
gaaacaccctcacactgggact

SEQ ID NO: 2567414 - DNA, 22 bp, Homo sapiens
gaaacagaaacaaaaacactaa

SEQ ID NO: 2567415 - DNA, 12 bp, Homo sapiens
gaaacagaggct

SEQ ID NO: 2567416 - DNA, 18 bp, Homo sapiens
gaaaccacagctgctgga

SEQ ID NO: 2567417 - DNA, 16 bp, Homo sapiens
gaaacccagctctggt

SEQ ID NO: 2567418 - DNA, 18 bp, Homo sapiens
gaaacccagctctggtcc

SEQ ID NO: 2567419 - DNA, 19 bp, Homo sapiens
gaaacccagctctggtcca

SEQ ID NO: 2567420 - DNA, 17 bp, Homo sapiens
gaaaccccatctctact

SEQ ID NO: 2567421 - DNA, 17 bp, Homo sapiens
gaaaccttattgtacct

SEQ ID NO: 2567422 - DNA, 17 bp, Homo sapiens
gaaaccttggtgtagtt

SEQ ID NO: 2567423 - DNA, 19 bp, Homo sapiens
gaaacctttagggcagctt

SEQ ID NO: 2567424 - DNA, 20 bp, Homo sapiens
gaaacctttagggcagcttg

SEQ ID NO: 2567425 - DNA, 18 bp, Homo sapiens
gaaaccttttttaagatt

SEQ ID NO: 2567426 - DNA, 19 bp, Homo sapiens
gaaaccttttttaagattt

SEQ ID NO: 2567427 - DNA, 21 bp, Homo sapiens
gaaaccttttttaagattttt

SEQ ID NO: 2567428 - DNA, 22 bp, Homo sapiens
gaaaccttttttaagatttttc

SEQ ID NO: 2567429 - DNA, 23 bp, Homo sapiens
gaaaccttttttaagatttttct

SEQ ID NO: 2567430 - DNA, 13 bp, Homo sapiens
gaaactaggtctg

SEQ ID NO: 2567431 - DNA, 18 bp, Homo sapiens
gaaactaggtctgatatt

SEQ ID NO: 2567432 - DNA, 18 bp, Homo sapiens
gaaactcacctgctggcc

SEQ ID NO: 2567433 - DNA, 23 bp, Homo sapiens
gaaactcacctgctggcccctca

SEQ ID NO: 2567434 - DNA, 20 bp, Homo sapiens
gaaactccaccttgcgggga

SEQ ID NO: 2567435 - DNA, 20 bp, Homo sapiens
gaaactcttatctcagtcat

SEQ ID NO: 2567436 - DNA, 19 bp, Homo sapiens
gaaactctttttgggctcc

SEQ ID NO: 2567437 - DNA, 18 bp, Homo sapiens
gaaactgaggaattttct

SEQ ID NO: 2567438 - DNA, 15 bp, Homo sapiens
gaaactgcagggaaa

SEQ ID NO: 2567439 - DNA, 15 bp, Homo sapiens
gaaactgccagcaac

SEQ ID NO: 2567440 - DNA, 20 bp, Homo sapiens
gaaactgttcccacctgctg

SEQ ID NO: 2567441 - DNA, 19 bp, Homo sapiens
gaaacttatttttttctga

SEQ ID NO: 2567442 - DNA, 20 bp, Homo sapiens
gaaacttatttttttctgat

SEQ ID NO: 2567443 - DNA, 21 bp, Homo sapiens
gaaagaaacccgacagaggga

SEQ ID NO: 2567444 - DNA, 15 bp, Homo sapiens
gaaagaaagaaggaa

SEQ ID NO: 2567445 - DNA, 11 bp, Homo sapiens
gaaagaaggaa

SEQ ID NO: 2567446 - DNA, 16 bp, Homo sapiens
gaaagaatgaaagagt

SEQ ID NO: 2567447 - DNA, 16 bp, Homo sapiens
gaaagacagcttctca

SEQ ID NO: 2567448 - DNA, 23 bp, Homo sapiens
gaaagacatccataaagaagcaa

SEQ ID NO: 2567449 - DNA, 15 bp, Homo sapiens
gaaagactattcaaa

SEQ ID NO: 2567450 - DNA, 23 bp, Homo sapiens
gaaagactattcaaacagtctca

SEQ ID NO: 2567451 - DNA, 15 bp, Homo sapiens
gaaagagaaggtggg

SEQ ID NO: 2567452 - DNA, 14 bp, Homo sapiens
gaaagagagaaaat

SEQ ID NO: 2567453 - DNA, 21 bp, Homo sapiens
gaaagagagaaaataaaaagt

SEQ ID NO: 2567454 - DNA, 22 bp, Homo sapiens
gaaagagagaaaataaaaagtt

SEQ ID NO: 2567455 - DNA, 23 bp, Homo sapiens
gaaagagagaaaataaaaagtta

SEQ ID NO: 2567456 - DNA, 22 bp, Homo sapiens
gaaagatggctgtgcctctgcc

SEQ ID NO: 2567457 - DNA, 20 bp, Homo sapiens
gaaagcagatacctcaccct

SEQ ID NO: 2567458 - DNA, 14 bp, Homo sapiens
gaaagcagctgaac

SEQ ID NO: 2567459 - DNA, 14 bp, Homo sapiens
gaaagcagggactt

SEQ ID NO: 2567460 - DNA, 17 bp, Homo sapiens
gaaagcatcacctcagg

SEQ ID NO: 2567461 - DNA, 18 bp, Homo sapiens
gaaagccacctctccctc

SEQ ID NO: 2567462 - DNA, 16 bp, Homo sapiens
gaaagccagtgactcc

SEQ ID NO: 2567463 - DNA, 19 bp, Homo sapiens
gaaagccagtgactccagg

SEQ ID NO: 2567464 - DNA, 17 bp, Homo sapiens
gaaagccctgagctttc

SEQ ID NO: 2567465 - DNA, 21 bp, Homo sapiens
gaaagccctgagctttctgct

SEQ ID NO: 2567466 - DNA, 18 bp, Homo sapiens
gaaagctcctagcagaga

SEQ ID NO: 2567467 - DNA, 14 bp, Homo sapiens
gaaaggattcatgt

SEQ ID NO: 2567468 - DNA, 16 bp, Homo sapiens
gaaaggcattctctga

SEQ ID NO: 2567469 - DNA, 21 bp, Homo sapiens
gaaaggctcagtctcaggagc

SEQ ID NO: 2567470 - DNA, 22 bp, Homo sapiens
gaaaggctcagtctcaggagca

SEQ ID NO: 2567471 - DNA, 15 bp, Homo sapiens
gaaaggctctgaaag

SEQ ID NO: 2567472 - DNA, 22 bp, Homo sapiens
gaaagggacttggaagctccgc

SEQ ID NO: 2567473 - DNA, 16 bp, Homo sapiens
gaaagggggtcccagt

SEQ ID NO: 2567474 - DNA, 17 bp, Homo sapiens
gaaagggggtcccagtg

SEQ ID NO: 2567475 - DNA, 18 bp, Homo sapiens
gaaagggggtcccagtgg

SEQ ID NO: 2567476 - DNA, 19 bp, Homo sapiens
gaaagggtgctgcttccct

SEQ ID NO: 2567477 - DNA, 23 bp, Homo sapiens
gaaagggtgtttttctgttttat

SEQ ID NO: 2567478 - DNA, 21 bp, Homo sapiens
gaaagtacttctccaccctgc

SEQ ID NO: 2567479 - DNA, 20 bp, Homo sapiens
gaaagtcagatgcccagagg

SEQ ID NO: 2567480 - DNA, 21 bp, Homo sapiens
gaaagtgatatcccccagcct

SEQ ID NO: 2567481 - DNA, 16 bp, Homo sapiens
gaaagtggtgctcagt

SEQ ID NO: 2567482 - DNA, 13 bp, Homo sapiens
gaaagtgtaaagc

SEQ ID NO: 2567483 - DNA, 16 bp, Homo sapiens
gaaagtgtaaagcatt

SEQ ID NO: 2567484 - DNA, 17 bp, Homo sapiens
gaaagttacaaattgct

SEQ ID NO: 2567485 - DNA, 19 bp, Homo sapiens
gaaagttgcacggctgctg

SEQ ID NO: 2567486 - DNA, 17 bp, Homo sapiens
gaaataaaacctttcaa

SEQ ID NO: 2567487 - DNA, 18 bp, Homo sapiens
gaaataaaacctttcaaa

SEQ ID NO: 2567488 - DNA, 18 bp, Homo sapiens
gaaataaagttggtgaca

SEQ ID NO: 2567489 - DNA, 17 bp, Homo sapiens
gaaataacaatgttaag

SEQ ID NO: 2567490 - DNA, 18 bp, Homo sapiens
gaaataacaatgttaagg

SEQ ID NO: 2567491 - DNA, 18 bp, Homo sapiens
cttgaaaaatgtgcaaaa

SEQ ID NO: 2567492 - DNA, 18 bp, Homo sapiens
cttgaaagcatccatgtg

SEQ ID NO: 2567493 - DNA, 19 bp, Homo sapiens
cttgaaatataggaactta

SEQ ID NO: 2567494 - DNA, 22 bp, Homo sapiens
cttgaaatgaaagtataactga

SEQ ID NO: 2567495 - DNA, 13 bp, Homo sapiens
cttgaaattttaa

SEQ ID NO: 2567496 - DNA, 15 bp, Homo sapiens
cttgaaattttaacc

SEQ ID NO: 2567497 - DNA, 20 bp, Homo sapiens
cttgaacactcatgctgaaa

SEQ ID NO: 2567498 - DNA, 16 bp, Homo sapiens
cttgaacactggggga

SEQ ID NO: 2567499 - DNA, 13 bp, Homo sapiens
cttgaactcctgg

SEQ ID NO: 2567500 - DNA, 14 bp, Homo sapiens
cttgaactcctggc

SEQ ID NO: 2567501 - DNA, 16 bp, Homo sapiens
cttgaactgggtactt

SEQ ID NO: 2567502 - DNA, 20 bp, Homo sapiens
cttgaactgggtacttgtgg

SEQ ID NO: 2567503 - DNA, 12 bp, Homo sapiens
cttgaagcagta

SEQ ID NO: 2567504 - DNA, 13 bp, Homo sapiens
cttgaagccactg

SEQ ID NO: 2567505 - DNA, 18 bp, Homo sapiens
cttgaagccactgaagct

SEQ ID NO: 2567506 - DNA, 16 bp, Homo sapiens
cttgaagggtaaagaa

SEQ ID NO: 2567507 - DNA, 20 bp, Homo sapiens
cttgaatttctaaaaaacag

SEQ ID NO: 2567508 - DNA, 14 bp, Homo sapiens
cttgacagaacact

SEQ ID NO: 2567509 - DNA, 16 bp, Homo sapiens
cttgacagaacactgt

SEQ ID NO: 2567510 - DNA, 13 bp, Homo sapiens
cttgacagggcac

SEQ ID NO: 2567511 - DNA, 19 bp, Homo sapiens
cttgaccaagcaggaagct

SEQ ID NO: 2567512 - DNA, 11 bp, Homo sapiens
cttgaccagca

SEQ ID NO: 2567513 - DNA, 20 bp, Homo sapiens
cttgaccattctccacctgc

SEQ ID NO: 2567514 - DNA, 21 bp, Homo sapiens
cttgaccattctccacctgcc

SEQ ID NO: 2567515 - DNA, 16 bp, Homo sapiens
cttgacccatctcccc

SEQ ID NO: 2567516 - DNA, 12 bp, Homo sapiens
cttgagaaacct

SEQ ID NO: 2567517 - DNA, 16 bp, Homo sapiens
cttgagagaccaggca

SEQ ID NO: 2567518 - DNA, 20 bp, Homo sapiens
cttgagagtagatggtttga

SEQ ID NO: 2567519 - DNA, 20 bp, Homo sapiens
cttgagcaagttccttctgg

SEQ ID NO: 2567520 - DNA, 12 bp, Homo sapiens
cttgagcccagg

SEQ ID NO: 2567521 - DNA, 15 bp, Homo sapiens
cttgagcccaggagt

SEQ ID NO: 2567522 - DNA, 15 bp, Homo sapiens
cttgagccttgaact

SEQ ID NO: 2567523 - DNA, 19 bp, Homo sapiens
cttgagccttgaactttga

SEQ ID NO: 2567524 - DNA, 13 bp, Homo sapiens
cttgagctgagat

SEQ ID NO: 2567525 - DNA, 18 bp, Homo sapiens
cttgaggaaacaacagct

SEQ ID NO: 2567526 - DNA, 20 bp, Homo sapiens
cttgaggaaacaacagcttt

SEQ ID NO: 2567527 - DNA, 22 bp, Homo sapiens
cttgaggaggggcaggtaaact

SEQ ID NO: 2567528 - DNA, 24 bp, Homo sapiens
cttgaggcttagctttgctctgcc

SEQ ID NO: 2567529 - DNA, 19 bp, Homo sapiens
cttgagggcccagagcagg

SEQ ID NO: 2567530 - DNA, 19 bp, Homo sapiens
cttgagggttgggctggtg

SEQ ID NO: 2567531 - DNA, 21 bp, Homo sapiens
cttgagggttgggctggtgtc

SEQ ID NO: 2567532 - DNA, 19 bp, Homo sapiens
cttgagttgattcagctct

SEQ ID NO: 2567533 - DNA, 16 bp, Homo sapiens
cttgatacccccctct

SEQ ID NO: 2567534 - DNA, 20 bp, Homo sapiens
cttgatacccccctctgtct

SEQ ID NO: 2567535 - DNA, 21 bp, Homo sapiens
cttgatacccccctctgtctt

SEQ ID NO: 2567536 - DNA, 20 bp, Homo sapiens
cttgatctgtatatacaata

SEQ ID NO: 2567537 - DNA, 12 bp, Homo sapiens
cttgatgtgcct

SEQ ID NO: 2567538 - DNA, 18 bp, Homo sapiens
cttgattcacaatgaaat

SEQ ID NO: 2567539 - DNA, 12 bp, Homo sapiens
cttgatttttgc

SEQ ID NO: 2567540 - DNA, 16 bp, Homo sapiens
cttgcaaaaagggtca

SEQ ID NO: 2567541 - DNA, 12 bp, Homo sapiens
cttgcaaagtat

SEQ ID NO: 2567542 - DNA, 20 bp, Homo sapiens
cttgcaacttcatgtcaact

SEQ ID NO: 2567543 - DNA, 22 bp, Homo sapiens
cttgcaagaatcagtgcaaaga

SEQ ID NO: 2567544 - DNA, 18 bp, Homo sapiens
cttgcaatggcagccttg

SEQ ID NO: 2567545 - DNA, 17 bp, Homo sapiens
cttgcaatttctaccta

SEQ ID NO: 2567546 - DNA, 15 bp, Homo sapiens
cttgcacccgcctct

SEQ ID NO: 2567547 - DNA, 16 bp, Homo sapiens
cttgcacctctgacct

SEQ ID NO: 2567548 - DNA, 20 bp, Homo sapiens
cttgcagactctacagaggc

SEQ ID NO: 2567549 - DNA, 19 bp, Homo sapiens
cttgcagcactcacacagg

SEQ ID NO: 2567550 - DNA, 22 bp, Homo sapiens
cttgcagcactcacacaggacc

SEQ ID NO: 2567551 - DNA, 12 bp, Homo sapiens
cttgcagcagga

SEQ ID NO: 2567552 - DNA, 13 bp, Homo sapiens
cttgcagcaggat

SEQ ID NO: 2567553 - DNA, 23 bp, Homo sapiens
cttgcagcaggatctagaggggg

SEQ ID NO: 2567554 - DNA, 14 bp, Homo sapiens
cttgcagtagattt

SEQ ID NO: 2567555 - DNA, 22 bp, Homo sapiens
cttgcagtagattttctttaaa

SEQ ID NO: 2567556 - DNA, 22 bp, Homo sapiens
cttgcagttcagcaccacccta

SEQ ID NO: 2567557 - DNA, 15 bp, Homo sapiens
cttgcatccaactcc

SEQ ID NO: 2567558 - DNA, 14 bp, Homo sapiens
cttgcattcccagt

SEQ ID NO: 2567559 - DNA, 18 bp, Homo sapiens
cttgcattgaatatatta

SEQ ID NO: 2567560 - DNA, 14 bp, Homo sapiens
cttgcattgcagag

SEQ ID NO: 2567561 - DNA, 13 bp, Homo sapiens
cttgcatttttgc

SEQ ID NO: 2567562 - DNA, 14 bp, Homo sapiens
cttgccacagctct

SEQ ID NO: 2567563 - DNA, 18 bp, Homo sapiens
cttgccaccccaccctcc

SEQ ID NO: 2567564 - DNA, 20 bp, Homo sapiens
cttgccaccccaccctccct

SEQ ID NO: 2567565 - DNA, 16 bp, Homo sapiens
cttgccagacatgtgg

SEQ ID NO: 2567566 - DNA, 20 bp, Homo sapiens
cttgcccagggctcagcctg

SEQ ID NO: 2567567 - DNA, 21 bp, Homo sapiens
cttgcccagggctcagcctgg

SEQ ID NO: 2567568 - DNA, 23 bp, Homo sapiens
cttgcccagggctcagcctggtg

SEQ ID NO: 2567569 - DNA, 20 bp, Homo sapiens
cttgcccagtttcagggcta

SEQ ID NO: 2567570 - DNA, 14 bp, Homo sapiens
cttgccccccaccc

SEQ ID NO: 2567571 - DNA, 16 bp, Homo sapiens
cttgccccccacccca

SEQ ID NO: 2567572 - DNA, 19 bp, Homo sapiens
cttgccccccaccccagcc

SEQ ID NO: 2567573 - DNA, 17 bp, Homo sapiens
cttgcccggattctggg

SEQ ID NO: 2567574 - DNA, 14 bp, Homo sapiens
cttgccctgacctc

SEQ ID NO: 2567575 - DNA, 14 bp, Homo sapiens
cttgccctgttaaa

SEQ ID NO: 2567576 - DNA, 22 bp, Homo sapiens
cttgccctgttaaaagatgaaa

SEQ ID NO: 2567577 - DNA, 12 bp, Homo sapiens
cttgcccttccc

SEQ ID NO: 2567578 - DNA, 16 bp, Homo sapiens
ctttgggcccagggac

SEQ ID NO: 2567579 - DNA, 17 bp, Homo sapiens
ctttgggttaagcatta

SEQ ID NO: 2567580 - DNA, 19 bp, Homo sapiens
ctttgtaagagtgtagaag

SEQ ID NO: 2567581 - DNA, 20 bp, Homo sapiens
ctttgtaagagtgtagaagc

SEQ ID NO: 2567582 - DNA, 22 bp, Homo sapiens
ctttgtaagagtgtagaagcat

SEQ ID NO: 2567583 - DNA, 23 bp, Homo sapiens
ctttgtaagagtgtagaagcatt

SEQ ID NO: 2567584 - DNA, 19 bp, Homo sapiens
ctttgtaatcgttatgtgt

SEQ ID NO: 2567585 - DNA, 21 bp, Homo sapiens
ctttgtaatcgttatgtgtgt

SEQ ID NO: 2567586 - DNA, 13 bp, Homo sapiens
ctttgtaatggga

SEQ ID NO: 2567587 - DNA, 20 bp, Homo sapiens
ctttgtatgtcatttccttc

SEQ ID NO: 2567588 - DNA, 20 bp, Homo sapiens
ctttgtatttttacttttaa

SEQ ID NO: 2567589 - DNA, 22 bp, Homo sapiens
ctttgtccccaccgcagacagg

SEQ ID NO: 2567590 - DNA, 15 bp, Homo sapiens
ctttgtcccggggct

SEQ ID NO: 2567591 - DNA, 17 bp, Homo sapiens
ctttgtcctttttgtta

SEQ ID NO: 2567592 - DNA, 15 bp, Homo sapiens
ctttgtctgaaaaat

SEQ ID NO: 2567593 - DNA, 15 bp, Homo sapiens
ctttgtgaggaagcc

SEQ ID NO: 2567594 - DNA, 12 bp, Homo sapiens
ctttgtgatttt

SEQ ID NO: 2567595 - DNA, 19 bp, Homo sapiens
ctttgtgatttttgtaatt

SEQ ID NO: 2567596 - DNA, 17 bp, Homo sapiens
ctttgtggatgtcttcc

SEQ ID NO: 2567597 - DNA, 16 bp, Homo sapiens
ctttgtgtagctttgc

SEQ ID NO: 2567598 - DNA, 23 bp, Homo sapiens
ctttgtgtttctattgacttcaa

SEQ ID NO: 2567599 - DNA, 18 bp, Homo sapiens
ctttgttagtttctccaa

SEQ ID NO: 2567600 - DNA, 16 bp, Homo sapiens
ctttgttctggctctt

SEQ ID NO: 2567601 - DNA, 16 bp, Homo sapiens
ctttgttgcccaggct

SEQ ID NO: 2567602 - DNA, 20 bp, Homo sapiens
cttttaaacctcacctttgt

SEQ ID NO: 2567603 - DNA, 12 bp, Homo sapiens
cttttaaactgt

SEQ ID NO: 2567604 - DNA, 23 bp, Homo sapiens
cttttaaaggggcagaaaaactc

SEQ ID NO: 2567605 - DNA, 21 bp, Homo sapiens
cttttaacacctgatgtgtac

SEQ ID NO: 2567606 - DNA, 23 bp, Homo sapiens
cttttaattaatgaaatatctgt

SEQ ID NO: 2567607 - DNA, 14 bp, Homo sapiens
cttttaattttcct

SEQ ID NO: 2567608 - DNA, 13 bp, Homo sapiens
cttttacatactg

SEQ ID NO: 2567609 - DNA, 20 bp, Homo sapiens
cttttagttgtatctctttt

SEQ ID NO: 2567610 - DNA, 21 bp, Homo sapiens
cttttagttgtatctcttttg

SEQ ID NO: 2567611 - DNA, 19 bp, Homo sapiens
cttttatcacgatattatt

SEQ ID NO: 2567612 - DNA, 18 bp, Homo sapiens
cttttatgttatttatat

SEQ ID NO: 2567613 - DNA, 16 bp, Homo sapiens
cttttattaatgcact

SEQ ID NO: 2567614 - DNA, 16 bp, Homo sapiens
cttttattgtataaac

SEQ ID NO: 2567615 - DNA, 19 bp, Homo sapiens
cttttattgtataaactat

SEQ ID NO: 2567616 - DNA, 14 bp, Homo sapiens
cttttcacaaataa

SEQ ID NO: 2567617 - DNA, 14 bp, Homo sapiens
cttttcacattctt

SEQ ID NO: 2567618 - DNA, 19 bp, Homo sapiens
cttttcacattcttataaa

SEQ ID NO: 2567619 - DNA, 22 bp, Homo sapiens
cttttcataacctagccttaga

SEQ ID NO: 2567620 - DNA, 16 bp, Homo sapiens
cttttcatctgggaaa

SEQ ID NO: 2567621 - DNA, 14 bp, Homo sapiens
cttttcccttcttt

SEQ ID NO: 2567622 - DNA, 19 bp, Homo sapiens
cttttcctattttcagccc

SEQ ID NO: 2567623 - DNA, 23 bp, Homo sapiens
cttttcctcccttgggttctgat

SEQ ID NO: 2567624 - DNA, 18 bp, Homo sapiens
cttttctaggctacaatt

SEQ ID NO: 2567625 - DNA, 13 bp, Homo sapiens
cttttctctttct

SEQ ID NO: 2567626 - DNA, 12 bp, Homo sapiens
cttttctgcaga

SEQ ID NO: 2567627 - DNA, 15 bp, Homo sapiens
cttttctgcagaggg

SEQ ID NO: 2567628 - DNA, 23 bp, Homo sapiens
cttttcttgcatgaggctagtgt

SEQ ID NO: 2567629 - DNA, 20 bp, Homo sapiens
cttttcttttctaccctagc

SEQ ID NO: 2567630 - DNA, 20 bp, Homo sapiens
cttttgaatccatgcttggg

SEQ ID NO: 2567631 - DNA, 21 bp, Homo sapiens
cttttgaatccatgcttgggt

SEQ ID NO: 2567632 - DNA, 23 bp, Homo sapiens
cttttgaatccatgcttgggtgt

SEQ ID NO: 2567633 - DNA, 22 bp, Homo sapiens
cttttgataatcaactgggctg

SEQ ID NO: 2567634 - DNA, 14 bp, Homo sapiens
cttttgcaaacttt

SEQ ID NO: 2567635 - DNA, 12 bp, Homo sapiens
cttttgcacccc

SEQ ID NO: 2567636 - DNA, 15 bp, Homo sapiens
cttttgcacccctcc

SEQ ID NO: 2567637 - DNA, 18 bp, Homo sapiens
cttttgcacccctcccat

SEQ ID NO: 2567638 - DNA, 20 bp, Homo sapiens
cttttgcacccctcccatta

SEQ ID NO: 2567639 - DNA, 21 bp, Homo sapiens
cttttgcccttcacagtgttt

SEQ ID NO: 2567640 - DNA, 15 bp, Homo sapiens
cttttgccctttgat

SEQ ID NO: 2567641 - DNA, 18 bp, Homo sapiens
cttttgccgttattaaaa

SEQ ID NO: 2567642 - DNA, 15 bp, Homo sapiens
cttttggcttccatg

SEQ ID NO: 2567643 - DNA, 20 bp, Homo sapiens
cttttggtaaagactggctt

SEQ ID NO: 2567644 - DNA, 20 bp, Homo sapiens
cttttggttaagtctgtttt

SEQ ID NO: 2567645 - DNA, 13 bp, Homo sapiens
cttttgtaagaca

SEQ ID NO: 2567646 - DNA, 20 bp, Homo sapiens
cttttgtaagacaaaggttt

SEQ ID NO: 2567647 - DNA, 14 bp, Homo sapiens
cttttgtatagttg

SEQ ID NO: 2567648 - DNA, 14 bp, Homo sapiens
cttttgtcccagaa

SEQ ID NO: 2567649 - DNA, 14 bp, Homo sapiens
cttttgtgaacttt

SEQ ID NO: 2567650 - DNA, 13 bp, Homo sapiens
cttttgtgcatta

SEQ ID NO: 2567651 - DNA, 18 bp, Homo sapiens
cttttgtgcattatctag

SEQ ID NO: 2567652 - DNA, 23 bp, Homo sapiens
cttttgtgtacagtgtgtaaagt

SEQ ID NO: 2567653 - DNA, 11 bp, Homo sapiens
cttttgttctt

SEQ ID NO: 2567654 - DNA, 22 bp, Homo sapiens
cttttgttcttggtttgtaaat

SEQ ID NO: 2567655 - DNA, 20 bp, Homo sapiens
ctttttaaatgtaaagatat

SEQ ID NO: 2567656 - DNA, 14 bp, Homo sapiens
ctttttaataaaaa

SEQ ID NO: 2567657 - DNA, 15 bp, Homo sapiens
ctttttaataaaaag

SEQ ID NO: 2567658 - DNA, 15 bp, Homo sapiens
ctttttactcccctt

SEQ ID NO: 2567659 - DNA, 13 bp, Homo sapiens
ctttttatttgca

SEQ ID NO: 2567660 - DNA, 17 bp, Homo sapiens
ctttttcatatgttgct

SEQ ID NO: 2567661 - DNA, 12 bp, Homo sapiens
ctttttcatttg

SEQ ID NO: 2567662 - DNA, 22 bp, Homo sapiens
ctttttccagacacttttttga

SEQ ID NO: 2567663 - DNA, 17 bp, Homo sapiens
ctttttccccaaagtct

SEQ ID NO: 2567664 - DNA, 21 bp, Homo sapiens
ctttttctccagctgggctct

SEQ ID NO: 2567665 - DNA, 17 bp, Homo sapiens
cttccctcatctctcct

SEQ ID NO: 2567666 - DNA, 15 bp, Homo sapiens
cttccctccctatct

SEQ ID NO: 2567667 - DNA, 11 bp, Homo sapiens
cttccctctgc

SEQ ID NO: 2567668 - DNA, 19 bp, Homo sapiens
cttccctctgcctgtccct

SEQ ID NO: 2567669 - DNA, 22 bp, Homo sapiens
cttccctgtattttctttctct

SEQ ID NO: 2567670 - DNA, 14 bp, Homo sapiens
cttccctgtccctc

SEQ ID NO: 2567671 - DNA, 15 bp, Homo sapiens
cttccctgtccctct

SEQ ID NO: 2567672 - DNA, 16 bp, Homo sapiens
cttcccttctccatct

SEQ ID NO: 2567673 - DNA, 15 bp, Homo sapiens
cttcccttgagccct

SEQ ID NO: 2567674 - DNA, 22 bp, Homo sapiens
cttccgaaaaatcctcttcctc

SEQ ID NO: 2567675 - DNA, 23 bp, Homo sapiens
cttccgaaaaatcctcttcctct

SEQ ID NO: 2567676 - DNA, 18 bp, Homo sapiens
cttccggctcctgtgctt

SEQ ID NO: 2567677 - DNA, 17 bp, Homo sapiens
cttccgtaacccaactc

SEQ ID NO: 2567678 - DNA, 23 bp, Homo sapiens
cttccgtaacccaactctcctgg

SEQ ID NO: 2567679 - DNA, 24 bp, Homo sapiens
cttcctacaagagcagcctgtggc

SEQ ID NO: 2567680 - DNA, 22 bp, Homo sapiens
cttcctacccacacctctgcca

SEQ ID NO: 2567681 - DNA, 14 bp, Homo sapiens
cttcctcacttcca

SEQ ID NO: 2567682 - DNA, 21 bp, Homo sapiens
cttcctcccaagtggtgccta

SEQ ID NO: 2567683 - DNA, 15 bp, Homo sapiens
cttcctccctcattc

SEQ ID NO: 2567684 - DNA, 20 bp, Homo sapiens
cttcctccgaggccagtacc

SEQ ID NO: 2567685 - DNA, 17 bp, Homo sapiens
cttcctcctccccactt

SEQ ID NO: 2567686 - DNA, 16 bp, Homo sapiens
cttcctcctccctcct

SEQ ID NO: 2567687 - DNA, 22 bp, Homo sapiens
cttcctcctgggccctctctgc

SEQ ID NO: 2567688 - DNA, 12 bp, Homo sapiens
cttcctctgagg

SEQ ID NO: 2567689 - DNA, 19 bp, Homo sapiens
cttcctctgcagctgacct

SEQ ID NO: 2567690 - DNA, 12 bp, Homo sapiens
cttcctctgctg

SEQ ID NO: 2567691 - DNA, 15 bp, Homo sapiens
cttcctgacacttta

SEQ ID NO: 2567692 - DNA, 16 bp, Homo sapiens
cttcctgacactttaa

SEQ ID NO: 2567693 - DNA, 22 bp, Homo sapiens
cttcctgtaacacaagccacag

SEQ ID NO: 2567694 - DNA, 23 bp, Homo sapiens
cttcctgtaacacaagccacaga

SEQ ID NO: 2567695 - DNA, 19 bp, Homo sapiens
cttcctgtccagagagaga

SEQ ID NO: 2567696 - DNA, 21 bp, Homo sapiens
cttcctgtcccacctcttctc

SEQ ID NO: 2567697 - DNA, 13 bp, Homo sapiens
cttcctgtgactt

SEQ ID NO: 2567698 - DNA, 16 bp, Homo sapiens
cttcctgtttgggccc

SEQ ID NO: 2567699 - DNA, 16 bp, Homo sapiens
cttcctgtttttcaca

SEQ ID NO: 2567700 - DNA, 14 bp, Homo sapiens
cttccttgaccagc

SEQ ID NO: 2567701 - DNA, 15 bp, Homo sapiens
cttccttgaccagca

SEQ ID NO: 2567702 - DNA, 22 bp, Homo sapiens
cttccttgaccagcagatccca

SEQ ID NO: 2567703 - DNA, 15 bp, Homo sapiens
cttccttgctctccc

SEQ ID NO: 2567704 - DNA, 16 bp, Homo sapiens
cttccttgctctgcac

SEQ ID NO: 2567705 - DNA, 17 bp, Homo sapiens
cttccttgctctgcacc

SEQ ID NO: 2567706 - DNA, 20 bp, Homo sapiens
cttccttgctgtcctaggcc

SEQ ID NO: 2567707 - DNA, 20 bp, Homo sapiens
cttccttggactcattttaa

SEQ ID NO: 2567708 - DNA, 15 bp, Homo sapiens
cttcgactcaggatc

SEQ ID NO: 2567709 - DNA, 17 bp, Homo sapiens
cttcgagcactgtccag

SEQ ID NO: 2567710 - DNA, 21 bp, Homo sapiens
cttcgcatcaaaagacaattc

SEQ ID NO: 2567711 - DNA, 14 bp, Homo sapiens
cttcgctcctgtgt

SEQ ID NO: 2567712 - DNA, 16 bp, Homo sapiens
cttcgctcctgtgtct

SEQ ID NO: 2567713 - DNA, 19 bp, Homo sapiens
cttcggaaaccttggtgta

SEQ ID NO: 2567714 - DNA, 23 bp, Homo sapiens
cttcgggaagagaggagttcaat

SEQ ID NO: 2567715 - DNA, 19 bp, Homo sapiens
cttcgggaggtcgaggcag

SEQ ID NO: 2567716 - DNA, 17 bp, Homo sapiens
cttcgggcccttcccac

SEQ ID NO: 2567717 - DNA, 14 bp, Homo sapiens
cttcgtacagttct

SEQ ID NO: 2567718 - DNA, 13 bp, Homo sapiens
cttctaaatgcat

SEQ ID NO: 2567719 - DNA, 15 bp, Homo sapiens
cttctaaatgcatat

SEQ ID NO: 2567720 - DNA, 23 bp, Homo sapiens
cttctaagtaaaaccacagcagt

SEQ ID NO: 2567721 - DNA, 18 bp, Homo sapiens
cttctaatatatttttat

SEQ ID NO: 2567722 - DNA, 17 bp, Homo sapiens
cttctaccatgaacaga

SEQ ID NO: 2567723 - DNA, 12 bp, Homo sapiens
cttctacctgcc

SEQ ID NO: 2567724 - DNA, 14 bp, Homo sapiens
cttctacctgccac

SEQ ID NO: 2567725 - DNA, 17 bp, Homo sapiens
cttctacctgccactca

SEQ ID NO: 2567726 - DNA, 21 bp, Homo sapiens
cttctacttctgcccttgcca

SEQ ID NO: 2567727 - DNA, 13 bp, Homo sapiens
cttctagaaccag

SEQ ID NO: 2567728 - DNA, 23 bp, Homo sapiens
cttctatggactggttgttgcca

SEQ ID NO: 2567729 - DNA, 18 bp, Homo sapiens
cttctattagccagtctt

SEQ ID NO: 2567730 - DNA, 19 bp, Homo sapiens
cttctcaaacctgtttaaa

SEQ ID NO: 2567731 - DNA, 16 bp, Homo sapiens
cttctcagaaggcaaa

SEQ ID NO: 2567732 - DNA, 15 bp, Homo sapiens
cttctcaggctctgc

SEQ ID NO: 2567733 - DNA, 19 bp, Homo sapiens
cttctcaggctctgccctg

SEQ ID NO: 2567734 - DNA, 18 bp, Homo sapiens
cttctcatcactcccctc

SEQ ID NO: 2567735 - DNA, 15 bp, Homo sapiens
cttctcatcctgcag

SEQ ID NO: 2567736 - DNA, 17 bp, Homo sapiens
cttctcatcctgcaggc

SEQ ID NO: 2567737 - DNA, 19 bp, Homo sapiens
cttctccaattctgcccaa

SEQ ID NO: 2567738 - DNA, 15 bp, Homo sapiens
cttctccaccctgct

SEQ ID NO: 2567739 - DNA, 17 bp, Homo sapiens
cttctccaccctgctct

SEQ ID NO: 2567740 - DNA, 21 bp, Homo sapiens
cttctccaccctgctctccga

SEQ ID NO: 2567741 - DNA, 12 bp, Homo sapiens
cttctccaggct

SEQ ID NO: 2567742 - DNA, 13 bp, Homo sapiens
cttctccagggtc

SEQ ID NO: 2567743 - DNA, 20 bp, Homo sapiens
cttctccaggtctcacgggc

SEQ ID NO: 2567744 - DNA, 13 bp, Homo sapiens
cttctccatctct

SEQ ID NO: 2567745 - DNA, 13 bp, Homo sapiens
cttctcccacact

SEQ ID NO: 2567746 - DNA, 21 bp, Homo sapiens
cttctcgaccacgggaagcat

SEQ ID NO: 2567747 - DNA, 15 bp, Homo sapiens
cttctctacagactt

SEQ ID NO: 2567748 - DNA, 19 bp, Homo sapiens
cttctctccagcccctgga

SEQ ID NO: 2567749 - DNA, 13 bp, Homo sapiens
cttctctctgtgg

SEQ ID NO: 2567750 - DNA, 11 bp, Homo sapiens
cttctctgaag

SEQ ID NO: 2567751 - DNA, 13 bp, Homo sapiens
cttctctgaagga

SEQ ID NO: 2567752 - DNA, 11 bp, Homo sapiens
cttctctgctc

SEQ ID NO: 2567753 - DNA, 15 bp, Homo sapiens
cttctctgctccacc

SEQ ID NO: 2567754 - DNA, 20 bp, Homo sapiens
cttctctggagccaagtcca

SEQ ID NO: 2567755 - DNA, 22 bp, Homo sapiens
cttctctggagccaagtccaga

SEQ ID NO: 2567756 - DNA, 21 bp, Homo sapiens
cttctctgtgaacgatttaga

SEQ ID NO: 2567757 - DNA, 22 bp, Homo sapiens
cttctgaactcaaactgaggaa

SEQ ID NO: 2567758 - DNA, 14 bp, Homo sapiens
cttctgaccacact

SEQ ID NO: 2567759 - DNA, 15 bp, Homo sapiens
cttctgaccacactt

SEQ ID NO: 2567760 - DNA, 23 bp, Homo sapiens
cttctgaccacacttcctgtcca

SEQ ID NO: 2567761 - DNA, 18 bp, Homo sapiens
cttctgacccatgctgcc

SEQ ID NO: 2567762 - DNA, 22 bp, Homo sapiens
cttagcttagacctcagcctgt

SEQ ID NO: 2567763 - DNA, 23 bp, Homo sapiens
cttagcttagacctcagcctgtg

SEQ ID NO: 2567764 - DNA, 16 bp, Homo sapiens
cttagctttttaattg

SEQ ID NO: 2567765 - DNA, 17 bp, Homo sapiens
cttaggaagagaaacca

SEQ ID NO: 2567766 - DNA, 18 bp, Homo sapiens
cttaggagcagagctctg

SEQ ID NO: 2567767 - DNA, 14 bp, Homo sapiens
cttaggatgtgtgc

SEQ ID NO: 2567768 - DNA, 16 bp, Homo sapiens
cttaggatgtgtgcat

SEQ ID NO: 2567769 - DNA, 18 bp, Homo sapiens
cttaggatgtgtgcatgt

SEQ ID NO: 2567770 - DNA, 19 bp, Homo sapiens
cttagggaaggatacaaaa

SEQ ID NO: 2567771 - DNA, 16 bp, Homo sapiens
cttaggggctgctgac

SEQ ID NO: 2567772 - DNA, 18 bp, Homo sapiens
cttaggtacttattccag

SEQ ID NO: 2567773 - DNA, 23 bp, Homo sapiens
cttaggttggcaaaaaggcagga

SEQ ID NO: 2567774 - DNA, 22 bp, Homo sapiens
cttagtaatgctacgtgtgatt

SEQ ID NO: 2567775 - DNA, 14 bp, Homo sapiens
cttagtactgagtt

SEQ ID NO: 2567776 - DNA, 20 bp, Homo sapiens
cttagtcactgagacagccc

SEQ ID NO: 2567777 - DNA, 22 bp, Homo sapiens
cttagtcactgagacagcccgg

SEQ ID NO: 2567778 - DNA, 13 bp, Homo sapiens
cttagtctcagtt

SEQ ID NO: 2567779 - DNA, 23 bp, Homo sapiens
cttagtctcagtttgtgtgtctt

SEQ ID NO: 2567780 - DNA, 17 bp, Homo sapiens
cttagtgaaattacttc

SEQ ID NO: 2567781 - DNA, 13 bp, Homo sapiens
cttagtggctttt

SEQ ID NO: 2567782 - DNA, 22 bp, Homo sapiens
cttagtggcttttttcctcctg

SEQ ID NO: 2567783 - DNA, 17 bp, Homo sapiens
cttagtggttccccacc

SEQ ID NO: 2567784 - DNA, 16 bp, Homo sapiens
cttagtgtttctgtgc

SEQ ID NO: 2567785 - DNA, 14 bp, Homo sapiens
cttagttctcactg

SEQ ID NO: 2567786 - DNA, 19 bp, Homo sapiens
cttagtttggattcttatg

SEQ ID NO: 2567787 - DNA, 14 bp, Homo sapiens
cttatagaatattt

SEQ ID NO: 2567788 - DNA, 20 bp, Homo sapiens
cttatagaatatttattacc

SEQ ID NO: 2567789 - DNA, 23 bp, Homo sapiens
cttatagtcaatgtttcttttat

SEQ ID NO: 2567790 - DNA, 17 bp, Homo sapiens
cttatatatgtgaacat

SEQ ID NO: 2567791 - DNA, 21 bp, Homo sapiens
cttatattaatattcctcagt

SEQ ID NO: 2567792 - DNA, 14 bp, Homo sapiens
cttatattgtaaga

SEQ ID NO: 2567793 - DNA, 12 bp, Homo sapiens
cttatcaagtgt

SEQ ID NO: 2567794 - DNA, 15 bp, Homo sapiens
ctgggcaaagcctag

SEQ ID NO: 2567795 - DNA, 19 bp, Homo sapiens
ctgggcaatgatggcaatt

SEQ ID NO: 2567796 - DNA, 22 bp, Homo sapiens
ctgggcacacgcctcccactgg

SEQ ID NO: 2567797 - DNA, 17 bp, Homo sapiens
ctgggcacctggggagt

SEQ ID NO: 2567798 - DNA, 19 bp, Homo sapiens
ctgggcacctggggagtgg

SEQ ID NO: 2567799 - DNA, 16 bp, Homo sapiens
ctgggcagaaggccaa

SEQ ID NO: 2567800 - DNA, 13 bp, Homo sapiens
ctgggcagacctt

SEQ ID NO: 2567801 - DNA, 17 bp, Homo sapiens
ctgggcagcatagcaag

SEQ ID NO: 2567802 - DNA, 18 bp, Homo sapiens
ctgggcagccaggctgcc

SEQ ID NO: 2567803 - DNA, 20 bp, Homo sapiens
ctgggcaggttggtgggggc

SEQ ID NO: 2567804 - DNA, 23 bp, Homo sapiens
ctgggcatagatgcaggtgagcc

SEQ ID NO: 2567805 - DNA, 17 bp, Homo sapiens
ctgggcattgctttcca

SEQ ID NO: 2567806 - DNA, 19 bp, Homo sapiens
ctgggccaactcacctgag

SEQ ID NO: 2567807 - DNA, 18 bp, Homo sapiens
ctgggccaagttcctcta

SEQ ID NO: 2567808 - DNA, 13 bp, Homo sapiens
ctgggccagagta

SEQ ID NO: 2567809 - DNA, 14 bp, Homo sapiens
ctgggcccaaccct

SEQ ID NO: 2567810 - DNA, 18 bp, Homo sapiens
ctgggcccaaccctgtct

SEQ ID NO: 2567811 - DNA, 23 bp, Homo sapiens
ctgggcccagaaggttgtgatga

SEQ ID NO: 2567812 - DNA, 24 bp, Homo sapiens
ctgggccccaaacgggctgccctg

SEQ ID NO: 2567813 - DNA, 14 bp, Homo sapiens
ctgggccccagccc

SEQ ID NO: 2567814 - DNA, 16 bp, Homo sapiens
ctgggccccagcccac

SEQ ID NO: 2567815 - DNA, 18 bp, Homo sapiens
ctgggccccagcccaccc

SEQ ID NO: 2567816 - DNA, 19 bp, Homo sapiens
ctgggccccagcccaccct

SEQ ID NO: 2567817 - DNA, 21 bp, Homo sapiens
ctgggcccctcatctgctcag

SEQ ID NO: 2567818 - DNA, 15 bp, Homo sapiens
ctgggcgccctggaa

SEQ ID NO: 2567819 - DNA, 19 bp, Homo sapiens
ctgggctcccttcccacct

SEQ ID NO: 2567820 - DNA, 17 bp, Homo sapiens
ctgggctcggaggctgc

SEQ ID NO: 2567821 - DNA, 13 bp, Homo sapiens
ctgggctctgcca

SEQ ID NO: 2567822 - DNA, 14 bp, Homo sapiens
ctgggctctgccac

SEQ ID NO: 2567823 - DNA, 21 bp, Homo sapiens
ctgggctctgccaccctacct

SEQ ID NO: 2567824 - DNA, 18 bp, Homo sapiens
ctgggctctgggagcagc

SEQ ID NO: 2567825 - DNA, 15 bp, Homo sapiens
ctgggctgagcccct

SEQ ID NO: 2567826 - DNA, 16 bp, Homo sapiens
ctgggctgagggagcc

SEQ ID NO: 2567827 - DNA, 18 bp, Homo sapiens
ctgggctgagggagcctg

SEQ ID NO: 2567828 - DNA, 19 bp, Homo sapiens
ctgggctgagggagcctgg

SEQ ID NO: 2567829 - DNA, 22 bp, Homo sapiens
ctgggcttcagtggcagctgct

SEQ ID NO: 2567830 - DNA, 19 bp, Homo sapiens
ctgggcttcatctggcaac

SEQ ID NO: 2567831 - DNA, 19 bp, Homo sapiens
ctggggaaataacagctgt

SEQ ID NO: 2567832 - DNA, 19 bp, Homo sapiens
ctggggacggggggcccca

SEQ ID NO: 2567833 - DNA, 23 bp, Homo sapiens
ctggggacggggggccccagtca

SEQ ID NO: 2567834 - DNA, 13 bp, Homo sapiens
ctggggagaaagt

SEQ ID NO: 2567835 - DNA, 14 bp, Homo sapiens
ctggggagaaagta

SEQ ID NO: 2567836 - DNA, 12 bp, Homo sapiens
ctggggagcccg

SEQ ID NO: 2567837 - DNA, 20 bp, Homo sapiens
ctggggagcccgtctcagtg

SEQ ID NO: 2567838 - DNA, 15 bp, Homo sapiens
ctggggatgtgggag

SEQ ID NO: 2567839 - DNA, 21 bp, Homo sapiens
ctggggcaagtccctgactct

SEQ ID NO: 2567840 - DNA, 23 bp, Homo sapiens
ctggggcctcggagcctcatccg

SEQ ID NO: 2567841 - DNA, 14 bp, Homo sapiens
ctggggctcccttc

SEQ ID NO: 2567842 - DNA, 15 bp, Homo sapiens
ctggggctctgggat

SEQ ID NO: 2567843 - DNA, 14 bp, Homo sapiens
ctggggctgacctt

SEQ ID NO: 2567844 - DNA, 18 bp, Homo sapiens
ctggggctgaccttcctc

SEQ ID NO: 2567845 - DNA, 12 bp, Homo sapiens
ctggggctgctg

SEQ ID NO: 2567846 - DNA, 15 bp, Homo sapiens
ctggggctgctggcc

SEQ ID NO: 2567847 - DNA, 16 bp, Homo sapiens
ctggggctgctggcct

SEQ ID NO: 2567848 - DNA, 15 bp, Homo sapiens
ctggggctggcacaa

SEQ ID NO: 2567849 - DNA, 13 bp, Homo sapiens
ctgggggaagaag

SEQ ID NO: 2567850 - DNA, 14 bp, Homo sapiens
ctgggggagtggaa

SEQ ID NO: 2567851 - DNA, 14 bp, Homo sapiens
ctgggggccatgag

SEQ ID NO: 2567852 - DNA, 18 bp, Homo sapiens
ctgggggccatgagctcc

SEQ ID NO: 2567853 - DNA, 17 bp, Homo sapiens
ctgggggcctcagtgcc

SEQ ID NO: 2567854 - DNA, 14 bp, Homo sapiens
ctgggggtgccagg

SEQ ID NO: 2567855 - DNA, 16 bp, Homo sapiens
ctgggggttgcggggg

SEQ ID NO: 2567856 - DNA, 16 bp, Homo sapiens
ctggggtaccaagaga

SEQ ID NO: 2567857 - DNA, 18 bp, Homo sapiens
ctggggtcctggggcctc

SEQ ID NO: 2567858 - DNA, 16 bp, Homo sapiens
ctgggtaaatgcagcg

SEQ ID NO: 2567859 - DNA, 20 bp, Homo sapiens
ctgggtaactagggaagata

SEQ ID NO: 2567860 - DNA, 18 bp, Homo sapiens
ctgggtacttgtggacac

SEQ ID NO: 2567861 - DNA, 13 bp, Homo sapiens
ctgggtcagtctg

SEQ ID NO: 2567862 - DNA, 21 bp, Homo sapiens
ctgggtcagtctggtgggagg

SEQ ID NO: 2567863 - DNA, 13 bp, Homo sapiens
ctgggtccaaata

SEQ ID NO: 2567864 - DNA, 16 bp, Homo sapiens
ctgggtccaaataaaa

SEQ ID NO: 2567865 - DNA, 15 bp, Homo sapiens
ctgggtctgtgtctc

SEQ ID NO: 2567866 - DNA, 17 bp, Homo sapiens
ctgggtctgtgtctctt

SEQ ID NO: 2567867 - DNA, 23 bp, Homo sapiens
ctgggtgacagagcaagactctg

SEQ ID NO: 2567868 - DNA, 16 bp, Homo sapiens
ctgggtggcctcggga

SEQ ID NO: 2567869 - DNA, 23 bp, Homo sapiens
ctgggtggcctcgggacacctgc

SEQ ID NO: 2567870 - DNA, 12 bp, Homo sapiens
ctgggtgggtgg

SEQ ID NO: 2567871 - DNA, 16 bp, Homo sapiens
ctgggtggtaccctct

SEQ ID NO: 2567872 - DNA, 19 bp, Homo sapiens
ctgggtggtctgcaggcag

SEQ ID NO: 2567873 - DNA, 21 bp, Homo sapiens
ctgggttcagaaatgctgcct

SEQ ID NO: 2567874 - DNA, 20 bp, Homo sapiens
ctgggttccctttccttcca

SEQ ID NO: 2567875 - DNA, 13 bp, Homo sapiens
ctgggttggaaaa

SEQ ID NO: 2567876 - DNA, 18 bp, Homo sapiens
ctgggttggaaaacagta

SEQ ID NO: 2567877 - DNA, 15 bp, Homo sapiens
ctgggttggagggtg

SEQ ID NO: 2567878 - DNA, 16 bp, Homo sapiens
ctgggttggtgcacag

SEQ ID NO: 2567879 - DNA, 19 bp, Homo sapiens
ctgggttggtgcacagtga

SEQ ID NO: 2567880 - DNA, 15 bp, Homo sapiens
ctgggtttggacccc

SEQ ID NO: 2567881 - DNA, 22 bp, Homo sapiens
ctgggttttgtattctctgagc

SEQ ID NO: 2567882 - DNA, 18 bp, Homo sapiens
ctggtaacagttcatgtt

SEQ ID NO: 2567883 - DNA, 16 bp, Homo sapiens
ctggtacccagccatc

SEQ ID NO: 2567884 - DNA, 23 bp, Homo sapiens
ctggtacccagccatctgcccag

SEQ ID NO: 2567885 - DNA, 16 bp, Homo sapiens
ctggtactctcctaga

SEQ ID NO: 2567886 - DNA, 12 bp, Homo sapiens
ctggtagggcag

SEQ ID NO: 2567887 - DNA, 14 bp, Homo sapiens
ctggtattcctgcc

SEQ ID NO: 2567888 - DNA, 19 bp, Homo sapiens
ctggtcacagcctcctctg

SEQ ID NO: 2567889 - DNA, 22 bp, Homo sapiens
ctggtcacaggactctgcctcc

SEQ ID NO: 2567890 - DNA, 21 bp, Homo sapiens
ctggtccagggaagctggccg

SEQ ID NO: 2567891 - DNA, 16 bp, Homo sapiens
ctggtccatgatggag

SEQ ID NO: 2567892 - DNA, 19 bp, Homo sapiens
ctggtccatgatggagtca

SEQ ID NO: 2567893 - DNA, 17 bp, Homo sapiens
ctggtcccttgcagcta

SEQ ID NO: 2567894 - DNA, 19 bp, Homo sapiens
ctggtcctgagggtcccca

SEQ ID NO: 2567895 - DNA, 19 bp, Homo sapiens
ctggtccttccaggccccc

SEQ ID NO: 2567896 - DNA, 14 bp, Homo sapiens
ctggtctctaggct

SEQ ID NO: 2567897 - DNA, 15 bp, Homo sapiens
ctggtctttcctctg

SEQ ID NO: 2567898 - DNA, 16 bp, Homo sapiens
ctggtgacaccagcct

SEQ ID NO: 2567899 - DNA, 17 bp, Homo sapiens
ctggtgaggccttgctc

SEQ ID NO: 2567900 - DNA, 23 bp, Homo sapiens
ctggtgagtcttggcggcagcag

SEQ ID NO: 2567901 - DNA, 12 bp, Homo sapiens
ctggtgcagtgg

SEQ ID NO: 2567902 - DNA, 16 bp, Homo sapiens
ctggtgcattacagag

SEQ ID NO: 2567903 - DNA, 18 bp, Homo sapiens
ctggtgcattacagagag

SEQ ID NO: 2567904 - DNA, 19 bp, Homo sapiens
ctggtgcattacagagagg

SEQ ID NO: 2567905 - DNA, 21 bp, Homo sapiens
ctggtgccagccttcctctgc

SEQ ID NO: 2567906 - DNA, 21 bp, Homo sapiens
ctggtgcctcaccccttgcca

SEQ ID NO: 2567907 - DNA, 19 bp, Homo sapiens
ctggtgctataggctggag

SEQ ID NO: 2567908 - DNA, 20 bp, Homo sapiens
ctggtgctataggctggaga

SEQ ID NO: 2567909 - DNA, 12 bp, Homo sapiens
ctggtgctgctg

SEQ ID NO: 2567910 - DNA, 23 bp, Homo sapiens
ctggtgctgtggccagggtgaga

SEQ ID NO: 2567911 - DNA, 15 bp, Homo sapiens
ctggtggacagtcct

SEQ ID NO: 2567912 - DNA, 21 bp, Homo sapiens
ctggtggacagtcctgggaga

SEQ ID NO: 2567913 - DNA, 12 bp, Homo sapiens
ctggtggcagct

SEQ ID NO: 2567914 - DNA, 20 bp, Homo sapiens
ctggtggcagctcacctctc

SEQ ID NO: 2567915 - DNA, 14 bp, Homo sapiens
ctggtggcagtggg

SEQ ID NO: 2567916 - DNA, 19 bp, Homo sapiens
ctggtggcagtgggagctg

SEQ ID NO: 2567917 - DNA, 17 bp, Homo sapiens
ctggtgggtccaggggc

SEQ ID NO: 2567918 - DNA, 22 bp, Homo sapiens
ctggtgggtccaggggcccctc

SEQ ID NO: 2567919 - DNA, 16 bp, Homo sapiens
ctggtggtttcacggt

SEQ ID NO: 2567920 - DNA, 20 bp, Homo sapiens
ctggtggtttcacggtgcca

SEQ ID NO: 2567921 - DNA, 18 bp, Homo sapiens
ctggtgtcacttactgtt

SEQ ID NO: 2567922 - DNA, 12 bp, Homo sapiens
ctggtgtcctga

SEQ ID NO: 2567923 - DNA, 13 bp, Homo sapiens
ctggtgtcctgac

SEQ ID NO: 2567924 - DNA, 14 bp, Homo sapiens
ctggtgtcctgacc

SEQ ID NO: 2567925 - DNA, 16 bp, Homo sapiens
ctggtgtgaactaaac

SEQ ID NO: 2567926 - DNA, 21 bp, Homo sapiens
ctggttcccgtttctccacct

SEQ ID NO: 2567927 - DNA, 16 bp, Homo sapiens
ctggttctatttaatg

SEQ ID NO: 2567928 - DNA, 18 bp, Homo sapiens
ctggttctatttaatgga

SEQ ID NO: 2567929 - DNA, 23 bp, Homo sapiens
ctggttctgatgatgtgcctggg

SEQ ID NO: 2567930 - DNA, 14 bp, Homo sapiens
ctggttgctgtgtg

SEQ ID NO: 2567931 - DNA, 23 bp, Homo sapiens
ctggtttcatttctactgtgact

SEQ ID NO: 2567932 - DNA, 22 bp, Homo sapiens
ctggtttgactccgctggaggt

SEQ ID NO: 2567933 - DNA, 15 bp, Homo sapiens
ctggtttggaatgct

SEQ ID NO: 2567934 - DNA, 17 bp, Homo sapiens
ctggtttggaatgcttc

SEQ ID NO: 2567935 - DNA, 16 bp, Homo sapiens
ctggtttggggcgagg

SEQ ID NO: 2567936 - DNA, 17 bp, Homo sapiens
ctggtttggggcgaggc

SEQ ID NO: 2567937 - DNA, 20 bp, Homo sapiens
ctggttttctggatggttcc

SEQ ID NO: 2567938 - DNA, 14 bp, Homo sapiens
ctggttttgctatt

SEQ ID NO: 2567939 - DNA, 21 bp, Homo sapiens
ctggcacggtggctcaggcct

SEQ ID NO: 2567940 - DNA, 16 bp, Homo sapiens
ctggcactataatgta

SEQ ID NO: 2567941 - DNA, 13 bp, Homo sapiens
ctggcactgcttc

SEQ ID NO: 2567942 - DNA, 14 bp, Homo sapiens
ctggcactgcttcc

SEQ ID NO: 2567943 - DNA, 15 bp, Homo sapiens
ctggcactgcttcca

SEQ ID NO: 2567944 - DNA, 16 bp, Homo sapiens
ctggcactgcttccag

SEQ ID NO: 2567945 - DNA, 21 bp, Homo sapiens
ctggcacttggagacttgtat

SEQ ID NO: 2567946 - DNA, 13 bp, Homo sapiens
ctggcagaactga

SEQ ID NO: 2567947 - DNA, 16 bp, Homo sapiens
ctggcagaactgagct

SEQ ID NO: 2567948 - DNA, 17 bp, Homo sapiens
ctggcagaactgagctc

SEQ ID NO: 2567949 - DNA, 18 bp, Homo sapiens
ctggcagaactgagctcc

SEQ ID NO: 2567950 - DNA, 20 bp, Homo sapiens
ctggcagaactgagctcctc

SEQ ID NO: 2567951 - DNA, 13 bp, Homo sapiens
ctggcagaaggga

SEQ ID NO: 2567952 - DNA, 11 bp, Homo sapiens
ctggcagccca

SEQ ID NO: 2567953 - DNA, 14 bp, Homo sapiens
ctggcagctcagag

SEQ ID NO: 2567954 - DNA, 13 bp, Homo sapiens
ctggcagctctcc

SEQ ID NO: 2567955 - DNA, 14 bp, Homo sapiens
ctggcagctctcca

SEQ ID NO: 2567956 - DNA, 17 bp, Homo sapiens
ctggcagctctccagtc

SEQ ID NO: 2567957 - DNA, 18 bp, Homo sapiens
ctggcagctctccagtca

SEQ ID NO: 2567958 - DNA, 20 bp, Homo sapiens
ctggcaggatgaccctgcga

SEQ ID NO: 2567959 - DNA, 19 bp, Homo sapiens
ctggcagtggaactaagaa

SEQ ID NO: 2567960 - DNA, 22 bp, Homo sapiens
ctggcattagaattatttaaac

SEQ ID NO: 2567961 - DNA, 17 bp, Homo sapiens
ctggcattgtccctgtg

SEQ ID NO: 2567962 - DNA, 16 bp, Homo sapiens
ctggccaacggggtga

SEQ ID NO: 2567963 - DNA, 15 bp, Homo sapiens
ctggccaccaggctg

SEQ ID NO: 2567964 - DNA, 16 bp, Homo sapiens
ctggccaccaggctgg

SEQ ID NO: 2567965 - DNA, 17 bp, Homo sapiens
ctggccaccaggctggc

SEQ ID NO: 2567966 - DNA, 19 bp, Homo sapiens
ctggccaccaggctggcgc

SEQ ID NO: 2567967 - DNA, 22 bp, Homo sapiens
ctggccaccaggctggcgcagc

SEQ ID NO: 2567968 - DNA, 18 bp, Homo sapiens
ctggccacctctctcctt

SEQ ID NO: 2567969 - DNA, 17 bp, Homo sapiens
ctggccacctgaggtgg

SEQ ID NO: 2567970 - DNA, 18 bp, Homo sapiens
ctggccacctgaggtggg

SEQ ID NO: 2567971 - DNA, 15 bp, Homo sapiens
ctggccactgcacag

SEQ ID NO: 2567972 - DNA, 18 bp, Homo sapiens
ctggccactgcacagagc

SEQ ID NO: 2567973 - DNA, 19 bp, Homo sapiens
ctggccagatgcaccagcc

SEQ ID NO: 2567974 - DNA, 20 bp, Homo sapiens
ctggccagatgcaccagccc

SEQ ID NO: 2567975 - DNA, 21 bp, Homo sapiens
ctggccagatgcaccagccct

SEQ ID NO: 2567976 - DNA, 13 bp, Homo sapiens
ctggccaggagct

SEQ ID NO: 2567977 - DNA, 23 bp, Homo sapiens
ctggccagggcctggaagacaga

SEQ ID NO: 2567978 - DNA, 10 bp, Homo sapiens
ctggcccagc

SEQ ID NO: 2567979 - DNA, 11 bp, Homo sapiens
ctggcccagcc

SEQ ID NO: 2567980 - DNA, 13 bp, Homo sapiens
ctggcccagccaa

SEQ ID NO: 2567981 - DNA, 14 bp, Homo sapiens
ctggcccagccctg

SEQ ID NO: 2567982 - DNA, 19 bp, Homo sapiens
ctggcccagccctgctggc

SEQ ID NO: 2567983 - DNA, 22 bp, Homo sapiens
ctggcccagccctgctggccgc

SEQ ID NO: 2567984 - DNA, 12 bp, Homo sapiens
ctggcccagccg

SEQ ID NO: 2567985 - DNA, 13 bp, Homo sapiens
ctggcccagccgg

SEQ ID NO: 2567986 - DNA, 19 bp, Homo sapiens
ctggcccagccggcctctc

SEQ ID NO: 2567987 - DNA, 22 bp, Homo sapiens
ctggcccagccggcctctctgg

SEQ ID NO: 2567988 - DNA, 12 bp, Homo sapiens
ctggcccagcgg

SEQ ID NO: 2567989 - DNA, 13 bp, Homo sapiens
ctggcccagcggc

SEQ ID NO: 2567990 - DNA, 17 bp, Homo sapiens
ctggccccatggtcagc

SEQ ID NO: 2567991 - DNA, 12 bp, Homo sapiens
ctggccccgccg

SEQ ID NO: 2567992 - DNA, 16 bp, Homo sapiens
ctggccccgccgcctg

SEQ ID NO: 2567993 - DNA, 13 bp, Homo sapiens
ctggcccctgggt

SEQ ID NO: 2567994 - DNA, 14 bp, Homo sapiens
ctggcccctgggtc

SEQ ID NO: 2567995 - DNA, 16 bp, Homo sapiens
ctggcccgtgacagac

SEQ ID NO: 2567996 - DNA, 23 bp, Homo sapiens
ctggcccgtgacagactcctgag

SEQ ID NO: 2567997 - DNA, 22 bp, Homo sapiens
ctggccctcacccctgccctgg

SEQ ID NO: 2567998 - DNA, 16 bp, Homo sapiens
ctggccctctgtgttg

SEQ ID NO: 2567999 - DNA, 13 bp, Homo sapiens
ctggccctgaggt

SEQ ID NO: 2568000 - DNA, 19 bp, Homo sapiens
ctggccctgaggtgtgggg

SEQ ID NO: 2568001 - DNA, 20 bp, Homo sapiens
ctggccgagggtcctggctc

SEQ ID NO: 2568002 - DNA, 21 bp, Homo sapiens
ctggccgagggtcctggctcc

SEQ ID NO: 2568003 - DNA, 16 bp, Homo sapiens
ctggccgcctcacccc

SEQ ID NO: 2568004 - DNA, 22 bp, Homo sapiens
ctggccggtctgcaagtcagag

SEQ ID NO: 2568005 - DNA, 22 bp, Homo sapiens
ctggccgttgatgttggctggg

SEQ ID NO: 2568006 - DNA, 21 bp, Homo sapiens
ctggcctaggagatatctgag

SEQ ID NO: 2568007 - DNA, 15 bp, Homo sapiens
ctggcctcccacccg

SEQ ID NO: 2568008 - DNA, 22 bp, Homo sapiens
ctggcctccggcgtcagcctcc

SEQ ID NO: 2568009 - DNA, 12 bp, Homo sapiens
ctggcctctgca

SEQ ID NO: 2568010 - DNA, 13 bp, Homo sapiens
ctggcctctgcac

SEQ ID NO: 2568011 - DNA, 18 bp, Homo sapiens
ctggcctctgcactcccc

SEQ ID NO: 2568012 - DNA, 20 bp, Homo sapiens
ctggcctctgcactcccctg

SEQ ID NO: 2568013 - DNA, 21 bp, Homo sapiens
ctggcctctgcactcccctgc

SEQ ID NO: 2568014 - DNA, 18 bp, Homo sapiens
ctggcctggactgttttc

SEQ ID NO: 2568015 - DNA, 15 bp, Homo sapiens
ctggcctggatctcc

SEQ ID NO: 2568016 - DNA, 22 bp, Homo sapiens
ctggcctggcacacatcaggag

SEQ ID NO: 2568017 - DNA, 17 bp, Homo sapiens
ctggcctggcccctcag

SEQ ID NO: 2568018 - DNA, 24 bp, Homo sapiens
ctggcctggcccctcagggtccct

SEQ ID NO: 2568019 - DNA, 15 bp, Homo sapiens
ctggcctggccggca

SEQ ID NO: 2568020 - DNA, 13 bp, Homo sapiens
ctggcctggcttc

SEQ ID NO: 2568021 - DNA, 12 bp, Homo sapiens
ctggcctgttct

SEQ ID NO: 2568022 - DNA, 17 bp, Homo sapiens
ctggccttccacttggc

SEQ ID NO: 2568023 - DNA, 16 bp, Homo sapiens
ctggccttcctgccct

SEQ ID NO: 2568024 - DNA, 19 bp, Homo sapiens
ctggcgacagttttccttc

SEQ ID NO: 2568025 - DNA, 13 bp, Homo sapiens
ctggcgcagccaa

SEQ ID NO: 2568026 - DNA, 19 bp, Homo sapiens
ctggcgccatcgccgggac

SEQ ID NO: 2568027 - DNA, 21 bp, Homo sapiens
ctggcgtagaagtttttgtac

SEQ ID NO: 2568028 - DNA, 22 bp, Homo sapiens
ctggcgtagaagtttttgtact

SEQ ID NO: 2568029 - DNA, 18 bp, Homo sapiens
ctggcgtcatgcaaagtc

SEQ ID NO: 2568030 - DNA, 15 bp, Homo sapiens
ctggcgtgcagtggt

SEQ ID NO: 2568031 - DNA, 19 bp, Homo sapiens
ctggctagagtcctcactc

SEQ ID NO: 2568032 - DNA, 14 bp, Homo sapiens
ctggctatgcattt

SEQ ID NO: 2568033 - DNA, 14 bp, Homo sapiens
ctggctccctcttg

SEQ ID NO: 2568034 - DNA, 16 bp, Homo sapiens
ctggctcctgaggggc

SEQ ID NO: 2568035 - DNA, 15 bp, Homo sapiens
ctggctctccaagtg

SEQ ID NO: 2568036 - DNA, 20 bp, Homo sapiens
ctggctctccaagtgccaga

SEQ ID NO: 2568037 - DNA, 22 bp, Homo sapiens
ctggctctccaagtgccagagg

SEQ ID NO: 2568038 - DNA, 13 bp, Homo sapiens
ctggctctctcca

SEQ ID NO: 2568039 - DNA, 16 bp, Homo sapiens
ctggctctctccagga

SEQ ID NO: 2568040 - DNA, 18 bp, Homo sapiens
ctggctcttccaggctgg

SEQ ID NO: 2568041 - DNA, 24 bp, Homo sapiens
ctggctcttccaggctgggagagc

SEQ ID NO: 2568042 - DNA, 15 bp, Homo sapiens
ctggctcttctgccc

SEQ ID NO: 2568043 - DNA, 17 bp, Homo sapiens
ctggctcttctgcccaa

SEQ ID NO: 2568044 - DNA, 22 bp, Homo sapiens
ctggctcttgatacccccctct

SEQ ID NO: 2568045 - DNA, 22 bp, Homo sapiens
ctggctctttggagatcaagga

SEQ ID NO: 2568046 - DNA, 17 bp, Homo sapiens
ctggctgaaccctgtgc

SEQ ID NO: 2568047 - DNA, 19 bp, Homo sapiens
ctggctgaaccctgtgctg

SEQ ID NO: 2568048 - DNA, 13 bp, Homo sapiens
ctggctgcccaga

SEQ ID NO: 2568049 - DNA, 16 bp, Homo sapiens
ctggctgccccaacct

SEQ ID NO: 2568050 - DNA, 16 bp, Homo sapiens
ctggctgccctggccc

SEQ ID NO: 2568051 - DNA, 17 bp, Homo sapiens
ctggctgccctggccct

SEQ ID NO: 2568052 - DNA, 20 bp, Homo sapiens
ctggctgccctggccctgag

SEQ ID NO: 2568053 - DNA, 23 bp, Homo sapiens
ctggctgccctggccctgaggtg

SEQ ID NO: 2568054 - DNA, 14 bp, Homo sapiens
ctggctggaaggga

SEQ ID NO: 2568055 - DNA, 12 bp, Homo sapiens
ctggctggagcc

SEQ ID NO: 2568056 - DNA, 14 bp, Homo sapiens
ctggctgggcatgg

SEQ ID NO: 2568057 - DNA, 15 bp, Homo sapiens
ctggctgggcatgga

SEQ ID NO: 2568058 - DNA, 15 bp, Homo sapiens
ctggcttccaggtat

SEQ ID NO: 2568059 - DNA, 22 bp, Homo sapiens
ctggcttccaggtatctccagg

SEQ ID NO: 2568060 - DNA, 23 bp, Homo sapiens
ctggcttccaggtatctccagga

SEQ ID NO: 2568061 - DNA, 15 bp, Homo sapiens
ctggcttctggagcc

SEQ ID NO: 2568062 - DNA, 20 bp, Homo sapiens
ctggcttctggagcccttgg

SEQ ID NO: 2568063 - DNA, 23 bp, Homo sapiens
ctggcttttattaatgcactttc

SEQ ID NO: 2568064 - DNA, 17 bp, Homo sapiens
ctgggaaaataccccat

SEQ ID NO: 2568065 - DNA, 19 bp, Homo sapiens
ctgggaaatgagaaggcag

SEQ ID NO: 2568066 - DNA, 22 bp, Homo sapiens
ctgggaaatgagaaggcagcca

SEQ ID NO: 2568067 - DNA, 19 bp, Homo sapiens
ctgggaagacgcctgagct

SEQ ID NO: 2568068 - DNA, 20 bp, Homo sapiens
ctgggaagataggctctgca

SEQ ID NO: 2568069 - DNA, 13 bp, Homo sapiens
ctgggaagggaag

SEQ ID NO: 2568070 - DNA, 23 bp, Homo sapiens
ctgggaatgtattattctgcagc

SEQ ID NO: 2568071 - DNA, 16 bp, Homo sapiens
ctgggaccacgtgaga

SEQ ID NO: 2568072 - DNA, 13 bp, Homo sapiens
ctgggacctttag

SEQ ID NO: 2568073 - DNA, 15 bp, Homo sapiens
ctgggactacaggca

SEQ ID NO: 2568074 - DNA, 17 bp, Homo sapiens
ctgggactacaggcacc

SEQ ID NO: 2568075 - DNA, 21 bp, Homo sapiens
ctgggactacaggcacccacc

SEQ ID NO: 2568076 - DNA, 13 bp, Homo sapiens
ctgggactgagcc

SEQ ID NO: 2568077 - DNA, 14 bp, Homo sapiens
ctgggactggccag

SEQ ID NO: 2568078 - DNA, 20 bp, Homo sapiens
ctgggacttccttgctctcc

SEQ ID NO: 2568079 - DNA, 18 bp, Homo sapiens
ctgggagaggtgccagca

SEQ ID NO: 2568080 - DNA, 23 bp, Homo sapiens
ctgggagaggtgccagcaactga

SEQ ID NO: 2568081 - DNA, 13 bp, Homo sapiens
ctgggagctctgc

SEQ ID NO: 2568082 - DNA, 13 bp, Homo sapiens
ctgggaggaagca

SEQ ID NO: 2568083 - DNA, 18 bp, Homo sapiens
ctgggaggcaagaggggt

SEQ ID NO: 2568084 - DNA, 21 bp, Homo sapiens
ctgggaggcaagaggggtgga

SEQ ID NO: 2568085 - DNA, 19 bp, Homo sapiens
ctgggaggcatggccctgg

SEQ ID NO: 2568086 - DNA, 22 bp, Homo sapiens
ctgggaggcggagagtacagtg

SEQ ID NO: 2568087 - DNA, 13 bp, Homo sapiens
ctgggagggcagc

SEQ ID NO: 2568088 - DNA, 17 bp, Homo sapiens
ctgggagggcagcaggg

SEQ ID NO: 2568089 - DNA, 20 bp, Homo sapiens
ctgggagggcagcagggcta

SEQ ID NO: 2568090 - DNA, 15 bp, Homo sapiens
ctgctggcctggatc

SEQ ID NO: 2568091 - DNA, 16 bp, Homo sapiens
ctgctggcctggccgg

SEQ ID NO: 2568092 - DNA, 19 bp, Homo sapiens
ctgctggctcttctgccca

SEQ ID NO: 2568093 - DNA, 19 bp, Homo sapiens
ctgctgggactggccaggt

SEQ ID NO: 2568094 - DNA, 17 bp, Homo sapiens
ctgctgggtgtggcgca

SEQ ID NO: 2568095 - DNA, 17 bp, Homo sapiens
ctgctggtcacagcctc

SEQ ID NO: 2568096 - DNA, 22 bp, Homo sapiens
ctgctggtgcagagctgaagat

SEQ ID NO: 2568097 - DNA, 15 bp, Homo sapiens
ctgctgtccagacag

SEQ ID NO: 2568098 - DNA, 17 bp, Homo sapiens
ctgctgtccagacagcc

SEQ ID NO: 2568099 - DNA, 19 bp, Homo sapiens
ctgctgtgctgtgcccaag

SEQ ID NO: 2568100 - DNA, 14 bp, Homo sapiens
ctgcttaatgaaaa

SEQ ID NO: 2568101 - DNA, 18 bp, Homo sapiens
ctgcttacaattccctgc

SEQ ID NO: 2568102 - DNA, 18 bp, Homo sapiens
ctgcttaggagagaccga

SEQ ID NO: 2568103 - DNA, 21 bp, Homo sapiens
ctgcttcaatacccaaatcct

SEQ ID NO: 2568104 - DNA, 23 bp, Homo sapiens
ctgcttcagcctcccgagtagct

SEQ ID NO: 2568105 - DNA, 12 bp, Homo sapiens
ctgcttcagtgg

SEQ ID NO: 2568106 - DNA, 14 bp, Homo sapiens
ctgcttccagtgag

SEQ ID NO: 2568107 - DNA, 20 bp, Homo sapiens
ctgcttccagtgaggctctg

SEQ ID NO: 2568108 - DNA, 11 bp, Homo sapiens
ctgcttcccat

SEQ ID NO: 2568109 - DNA, 13 bp, Homo sapiens
ctgcttcccatcc

SEQ ID NO: 2568110 - DNA, 14 bp, Homo sapiens
ctgcttcccatcct

SEQ ID NO: 2568111 - DNA, 15 bp, Homo sapiens
ctgcttcccatccta

SEQ ID NO: 2568112 - DNA, 21 bp, Homo sapiens
ctgcttccctctgcctgtccc

SEQ ID NO: 2568113 - DNA, 22 bp, Homo sapiens
ctgcttccctctgcctgtccct

SEQ ID NO: 2568114 - DNA, 13 bp, Homo sapiens
ctgcttgaggcaa

SEQ ID NO: 2568115 - DNA, 20 bp, Homo sapiens
ctgcttgaggcaactcatct

SEQ ID NO: 2568116 - DNA, 22 bp, Homo sapiens
ctgcttgaggcaactcatctta

SEQ ID NO: 2568117 - DNA, 20 bp, Homo sapiens
ctgcttgcttgctttttaat

SEQ ID NO: 2568118 - DNA, 14 bp, Homo sapiens
ctgcttgggtggag

SEQ ID NO: 2568119 - DNA, 18 bp, Homo sapiens
ctgcttgggtggagaagc

SEQ ID NO: 2568120 - DNA, 21 bp, Homo sapiens
ctgcttgggtggagaagccat

SEQ ID NO: 2568121 - DNA, 22 bp, Homo sapiens
ctgcttgggtggagaagccatt

SEQ ID NO: 2568122 - DNA, 15 bp, Homo sapiens
ctgctttcccctgtg

SEQ ID NO: 2568123 - DNA, 19 bp, Homo sapiens
ctgctttcccctgtgggga

SEQ ID NO: 2568124 - DNA, 20 bp, Homo sapiens
ctgctttcccctgtggggat

SEQ ID NO: 2568125 - DNA, 21 bp, Homo sapiens
ctgcttttccttggggcaggc

SEQ ID NO: 2568126 - DNA, 20 bp, Homo sapiens
ctgcttttgtctatgggact

SEQ ID NO: 2568127 - DNA, 21 bp, Homo sapiens
ctgcttttgtctatgggactc

SEQ ID NO: 2568128 - DNA, 22 bp, Homo sapiens
ctgctttttaaagaatgctctt

SEQ ID NO: 2568129 - DNA, 18 bp, Homo sapiens
ctggaaaatgtgacccag

SEQ ID NO: 2568130 - DNA, 15 bp, Homo sapiens
ctggaaaggctcagt

SEQ ID NO: 2568131 - DNA, 20 bp, Homo sapiens
ctcaggtcagggtgaggatg

SEQ ID NO: 2568132 - DNA, 14 bp, Homo sapiens
ctcaggtgagaagc

SEQ ID NO: 2568133 - DNA, 19 bp, Homo sapiens
ctcaggtgagaagcagagg

SEQ ID NO: 2568134 - DNA, 21 bp, Homo sapiens
ctcaggtggggtcactctggc

SEQ ID NO: 2568135 - DNA, 22 bp, Homo sapiens
ctcaggtggggtcactctggca

SEQ ID NO: 2568136 - DNA, 15 bp, Homo sapiens
ctcaggtgtccctgc

SEQ ID NO: 2568137 - DNA, 16 bp, Homo sapiens
ctcaggtgtccctgca

SEQ ID NO: 2568138 - DNA, 12 bp, Homo sapiens
ctcaggttccta

SEQ ID NO: 2568139 - DNA, 22 bp, Homo sapiens
ctcaggttgtagtaaagaaatt

SEQ ID NO: 2568140 - DNA, 16 bp, Homo sapiens
ctcagtaaagcacttg

SEQ ID NO: 2568141 - DNA, 19 bp, Homo sapiens
ctcagtaagacgacaagga

SEQ ID NO: 2568142 - DNA, 21 bp, Homo sapiens
ctcagtaagacgacaaggaaa

SEQ ID NO: 2568143 - DNA, 14 bp, Homo sapiens
ctcagtcatgcata

SEQ ID NO: 2568144 - DNA, 16 bp, Homo sapiens
ctcagtccatgaagat

SEQ ID NO: 2568145 - DNA, 15 bp, Homo sapiens
ctcagtctccctttc

SEQ ID NO: 2568146 - DNA, 13 bp, Homo sapiens
ctcagtctctgag

SEQ ID NO: 2568147 - DNA, 21 bp, Homo sapiens
ctcagtggcttcatctgtcaa

SEQ ID NO: 2568148 - DNA, 18 bp, Homo sapiens
ctcagtgtcatttatgaa

SEQ ID NO: 2568149 - DNA, 15 bp, Homo sapiens
ctcagttcccttggc

SEQ ID NO: 2568150 - DNA, 16 bp, Homo sapiens
ctcagttcccttggcc

SEQ ID NO: 2568151 - DNA, 18 bp, Homo sapiens
ctcagttcccttggcctc

SEQ ID NO: 2568152 - DNA, 22 bp, Homo sapiens
ctcagttccgatttcccaggct

SEQ ID NO: 2568153 - DNA, 15 bp, Homo sapiens
ctcagttctagtctc

SEQ ID NO: 2568154 - DNA, 17 bp, Homo sapiens
ctcagttttatcatttt

SEQ ID NO: 2568155 - DNA, 18 bp, Homo sapiens
ctcagttttatcattttc

SEQ ID NO: 2568156 - DNA, 13 bp, Homo sapiens
ctcagttttcata

SEQ ID NO: 2568157 - DNA, 14 bp, Homo sapiens
ctcagttttcataa

SEQ ID NO: 2568158 - DNA, 18 bp, Homo sapiens
ctcataatagacttccca

SEQ ID NO: 2568159 - DNA, 15 bp, Homo sapiens
ctcatacccaccccc

SEQ ID NO: 2568160 - DNA, 16 bp, Homo sapiens
ctcatacccaccccca

SEQ ID NO: 2568161 - DNA, 19 bp, Homo sapiens
ctcatacccacccccaccc

SEQ ID NO: 2568162 - DNA, 16 bp, Homo sapiens
ctcatacctttaaagg

SEQ ID NO: 2568163 - DNA, 18 bp, Homo sapiens
ctcatacctttaaaggaa

SEQ ID NO: 2568164 - DNA, 12 bp, Homo sapiens
ctcatagcatta

SEQ ID NO: 2568165 - DNA, 18 bp, Homo sapiens
ctcatagcattaactaat

SEQ ID NO: 2568166 - DNA, 15 bp, Homo sapiens
ctcatatcagtttgc

SEQ ID NO: 2568167 - DNA, 13 bp, Homo sapiens
ctcatatggccca

SEQ ID NO: 2568168 - DNA, 18 bp, Homo sapiens
ctcatatggcccagtgtc

SEQ ID NO: 2568169 - DNA, 19 bp, Homo sapiens
ctcatatggcccagtgtca

SEQ ID NO: 2568170 - DNA, 21 bp, Homo sapiens
ctcatattgtgattctgcctt

SEQ ID NO: 2568171 - DNA, 22 bp, Homo sapiens
ctcatcaccaacgtctgtgcca

SEQ ID NO: 2568172 - DNA, 24 bp, Homo sapiens
ctcatcagtgtcctcttgctcaaa

SEQ ID NO: 2568173 - DNA, 12 bp, Homo sapiens
ctcatcataaaa

SEQ ID NO: 2568174 - DNA, 13 bp, Homo sapiens
ctcatcattctct

SEQ ID NO: 2568175 - DNA, 15 bp, Homo sapiens
ctcatcattctctgt

SEQ ID NO: 2568176 - DNA, 13 bp, Homo sapiens
ctcatccacccca

SEQ ID NO: 2568177 - DNA, 19 bp, Homo sapiens
ctcatccatcatcatgtgt

SEQ ID NO: 2568178 - DNA, 19 bp, Homo sapiens
ctcatcccacgcactccat

SEQ ID NO: 2568179 - DNA, 23 bp, Homo sapiens
ctcatccccaggggtcccagcca

SEQ ID NO: 2568180 - DNA, 22 bp, Homo sapiens
ctcatcccgagcacctccacat

SEQ ID NO: 2568181 - DNA, 16 bp, Homo sapiens
ctcatcccgtgttctc

SEQ ID NO: 2568182 - DNA, 21 bp, Homo sapiens
ctcatccctaatgctgcagat

SEQ ID NO: 2568183 - DNA, 16 bp, Homo sapiens
ctcatcgcgtcctcct

SEQ ID NO: 2568184 - DNA, 18 bp, Homo sapiens
ctcatctgtccctccggg

SEQ ID NO: 2568185 - DNA, 23 bp, Homo sapiens
ctcatgatagaaggctatgggga

SEQ ID NO: 2568186 - DNA, 14 bp, Homo sapiens
ctcatgcatctcca

SEQ ID NO: 2568187 - DNA, 18 bp, Homo sapiens
ctcatgcatctccacctg

SEQ ID NO: 2568188 - DNA, 15 bp, Homo sapiens
ctcatgctgaaagcc

SEQ ID NO: 2568189 - DNA, 15 bp, Homo sapiens
ctcatggcccctctg

SEQ ID NO: 2568190 - DNA, 20 bp, Homo sapiens
ctcatggcccctctgacctg

SEQ ID NO: 2568191 - DNA, 16 bp, Homo sapiens
ctcatgtacataccct

SEQ ID NO: 2568192 - DNA, 12 bp, Homo sapiens
ctcatgtgatcc

SEQ ID NO: 2568193 - DNA, 12 bp, Homo sapiens
ctcatgtgtatg

SEQ ID NO: 2568194 - DNA, 19 bp, Homo sapiens
ctcatgtgtgctcttcttc

SEQ ID NO: 2568195 - DNA, 18 bp, Homo sapiens
ctcatgttcttaattctt

SEQ ID NO: 2568196 - DNA, 19 bp, Homo sapiens
ctcatgttcttaattctta

SEQ ID NO: 2568197 - DNA, 18 bp, Homo sapiens
ctcatgttttccattgtt

SEQ ID NO: 2568198 - DNA, 21 bp, Homo sapiens
ctcatgttttccattgtttga

SEQ ID NO: 2568199 - DNA, 21 bp, Homo sapiens
ctcattagcattttgctaaat

SEQ ID NO: 2568200 - DNA, 18 bp, Homo sapiens
ctcattaggatggctagt

SEQ ID NO: 2568201 - DNA, 15 bp, Homo sapiens
ctcattcaaaagttg

SEQ ID NO: 2568202 - DNA, 19 bp, Homo sapiens
ctcattcaaaagttgaaat

SEQ ID NO: 2568203 - DNA, 21 bp, Homo sapiens
ctcattcctccacctgccgtg

SEQ ID NO: 2568204 - DNA, 13 bp, Homo sapiens
ctcattcctgcct

SEQ ID NO: 2568205 - DNA, 17 bp, Homo sapiens
ctcattctgaaggagcc

SEQ ID NO: 2568206 - DNA, 21 bp, Homo sapiens
ctcattgacctgaggcccttc

SEQ ID NO: 2568207 - DNA, 16 bp, Homo sapiens
ctcatttcaggagcag

SEQ ID NO: 2568208 - DNA, 13 bp, Homo sapiens
ctcatttcaggat

SEQ ID NO: 2568209 - DNA, 21 bp, Homo sapiens
ctcatttgtcacacactttgg

SEQ ID NO: 2568210 - DNA, 16 bp, Homo sapiens
ctccaaaagcacttac

SEQ ID NO: 2568211 - DNA, 18 bp, Homo sapiens
ctccaaaataaaactttt

SEQ ID NO: 2568212 - DNA, 18 bp, Homo sapiens
ctccaactggattataaa

SEQ ID NO: 2568213 - DNA, 17 bp, Homo sapiens
ctccaagaatgctgaaa

SEQ ID NO: 2568214 - DNA, 20 bp, Homo sapiens
ctccaagaatgctgaaacca

SEQ ID NO: 2568215 - DNA, 21 bp, Homo sapiens
ctccaagacctgttggttcca

SEQ ID NO: 2568216 - DNA, 17 bp, Homo sapiens
ctccaagaccttctcct

SEQ ID NO: 2568217 - DNA, 14 bp, Homo sapiens
ctccaagcaggaca

SEQ ID NO: 2568218 - DNA, 13 bp, Homo sapiens
ctccaagccagcg

SEQ ID NO: 2568219 - DNA, 14 bp, Homo sapiens
ctccaagctccatc

SEQ ID NO: 2568220 - DNA, 18 bp, Homo sapiens
ctccaagctccatctcca

SEQ ID NO: 2568221 - DNA, 14 bp, Homo sapiens
ctccaagctcccag

SEQ ID NO: 2568222 - DNA, 16 bp, Homo sapiens
ctccaagctcccaggc

SEQ ID NO: 2568223 - DNA, 17 bp, Homo sapiens
ctccaagctcccaggca

SEQ ID NO: 2568224 - DNA, 12 bp, Homo sapiens
ctccaaggacca

SEQ ID NO: 2568225 - DNA, 15 bp, Homo sapiens
ctccaaggaccaggt

SEQ ID NO: 2568226 - DNA, 19 bp, Homo sapiens
ctccaagggcttctgcacc

SEQ ID NO: 2568227 - DNA, 23 bp, Homo sapiens
ctccaagggcttctgcaccctcc

SEQ ID NO: 2568228 - DNA, 17 bp, Homo sapiens
ctccaagtctcagtggc

SEQ ID NO: 2568229 - DNA, 14 bp, Homo sapiens
ctccaagtgccaga

SEQ ID NO: 2568230 - DNA, 15 bp, Homo sapiens
ctccaagtgccagag

SEQ ID NO: 2568231 - DNA, 18 bp, Homo sapiens
ctccaagtgccagaggtg

SEQ ID NO: 2568232 - DNA, 19 bp, Homo sapiens
ctccaagtgccagaggtgg

SEQ ID NO: 2568233 - DNA, 14 bp, Homo sapiens
ctccaatcctgccc

SEQ ID NO: 2568234 - DNA, 15 bp, Homo sapiens
ctccaatcctgcccc

SEQ ID NO: 2568235 - DNA, 20 bp, Homo sapiens
ctccaattaaggattttatg

SEQ ID NO: 2568236 - DNA, 22 bp, Homo sapiens
ctccaattaaggattttatgct

SEQ ID NO: 2568237 - DNA, 21 bp, Homo sapiens
ctccacacacagctgggctgt

SEQ ID NO: 2568238 - DNA, 17 bp, Homo sapiens
ctccacaccctctccca

SEQ ID NO: 2568239 - DNA, 14 bp, Homo sapiens
ctccacagccgcag

SEQ ID NO: 2568240 - DNA, 15 bp, Homo sapiens
ctccacagttcagtg

SEQ ID NO: 2568241 - DNA, 23 bp, Homo sapiens
ctccacagttcagtggcagggct

SEQ ID NO: 2568242 - DNA, 22 bp, Homo sapiens
ctccacagttcgacctgcggct

SEQ ID NO: 2568243 - DNA, 15 bp, Homo sapiens
ctccaccaccactgg

SEQ ID NO: 2568244 - DNA, 17 bp, Homo sapiens
ctccaccaccactggcc

SEQ ID NO: 2568245 - DNA, 14 bp, Homo sapiens
ctccacccatccta

SEQ ID NO: 2568246 - DNA, 15 bp, Homo sapiens
ctccacccccagctg

SEQ ID NO: 2568247 - DNA, 17 bp, Homo sapiens
ctccacccccagctgct

SEQ ID NO: 2568248 - DNA, 18 bp, Homo sapiens
ctccacccccagctgctt

SEQ ID NO: 2568249 - DNA, 16 bp, Homo sapiens
ctccaccccccagaac

SEQ ID NO: 2568250 - DNA, 21 bp, Homo sapiens
ctccaccccccagaacctgtc

SEQ ID NO: 2568251 - DNA, 23 bp, Homo sapiens
ctccaccccccagaacctgtcct

SEQ ID NO: 2568252 - DNA, 11 bp, Homo sapiens
ctccaccctgc

SEQ ID NO: 2568253 - DNA, 17 bp, Homo sapiens
ctccaccctgtccccca

SEQ ID NO: 2568254 - DNA, 18 bp, Homo sapiens
ctccaccctgtcccccag

SEQ ID NO: 2568255 - DNA, 22 bp, Homo sapiens
ctccaccctgtcccccagctct

SEQ ID NO: 2568256 - DNA, 23 bp, Homo sapiens
ctccaccctgtcccccagctctg

SEQ ID NO: 2568257 - DNA, 12 bp, Homo sapiens
ctccacccttgg

SEQ ID NO: 2568258 - DNA, 13 bp, Homo sapiens
ctccacccttggc

SEQ ID NO: 2568259 - DNA, 15 bp, Homo sapiens
ctccacccttggcct

SEQ ID NO: 2568260 - DNA, 15 bp, Homo sapiens
ctccacctagactgt

SEQ ID NO: 2568261 - DNA, 14 bp, Homo sapiens
ctccacctgccagg

SEQ ID NO: 2568262 - DNA, 21 bp, Homo sapiens
ctccacctgccagggacagag

SEQ ID NO: 2568263 - DNA, 18 bp, Homo sapiens
ctccacgttctgctcatc

SEQ ID NO: 2568264 - DNA, 23 bp, Homo sapiens
ctccactggccggagtcagtgcc

SEQ ID NO: 2568265 - DNA, 12 bp, Homo sapiens
ctccactgtcac

SEQ ID NO: 2568266 - DNA, 21 bp, Homo sapiens
ctccacttcttgttccccact

SEQ ID NO: 2568267 - DNA, 19 bp, Homo sapiens
ctccagaaccgcagaagcc

SEQ ID NO: 2568268 - DNA, 14 bp, Homo sapiens
ctccagaagatagc

SEQ ID NO: 2568269 - DNA, 15 bp, Homo sapiens
ctccagaagatagct

SEQ ID NO: 2568270 - DNA, 23 bp, Homo sapiens
ctccagaagatagcttcacccca

SEQ ID NO: 2568271 - DNA, 15 bp, Homo sapiens
ttatgtctcttctga

SEQ ID NO: 2568272 - DNA, 19 bp, Homo sapiens
ttatgtctgctgaataata

SEQ ID NO: 2568273 - DNA, 23 bp, Homo sapiens
ttatgtgaatgatctctctgaat

SEQ ID NO: 2568274 - DNA, 12 bp, Homo sapiens
ttatgtgtgtgt

SEQ ID NO: 2568275 - DNA, 23 bp, Homo sapiens
ttattaaaaatctcaaatttcta

SEQ ID NO: 2568276 - DNA, 17 bp, Homo sapiens
ttattaaagttctgtaa

SEQ ID NO: 2568277 - DNA, 21 bp, Homo sapiens
ttattaaatgcccagcccctt

SEQ ID NO: 2568278 - DNA, 18 bp, Homo sapiens
ttattaacataggtgaaa

SEQ ID NO: 2568279 - DNA, 23 bp, Homo sapiens
ttattaagatggattctcagata

SEQ ID NO: 2568280 - DNA, 11 bp, Homo sapiens
ttattaatgca

SEQ ID NO: 2568281 - DNA, 12 bp, Homo sapiens
ttattacatctt

SEQ ID NO: 2568282 - DNA, 12 bp, Homo sapiens
ttattacctctg

SEQ ID NO: 2568283 - DNA, 21 bp, Homo sapiens
ttattagagattacctcctga

SEQ ID NO: 2568284 - DNA, 20 bp, Homo sapiens
ttattagtaaatgcttatca

SEQ ID NO: 2568285 - DNA, 15 bp, Homo sapiens
ttattagttaatata

SEQ ID NO: 2568286 - DNA, 15 bp, Homo sapiens
ttattagtttacatc

SEQ ID NO: 2568287 - DNA, 18 bp, Homo sapiens
ttattagtttacatcatt

SEQ ID NO: 2568288 - DNA, 12 bp, Homo sapiens
ttattataattg

SEQ ID NO: 2568289 - DNA, 15 bp, Homo sapiens
ttattataattgtat

SEQ ID NO: 2568290 - DNA, 16 bp, Homo sapiens
ttattatctaaagtgt

SEQ ID NO: 2568291 - DNA, 22 bp, Homo sapiens
ttattatctaaagtgtgttgtt

SEQ ID NO: 2568292 - DNA, 13 bp, Homo sapiens
ttattatgcatga

SEQ ID NO: 2568293 - DNA, 22 bp, Homo sapiens
ttattatttgtgttttaattta

SEQ ID NO: 2568294 - DNA, 16 bp, Homo sapiens
ttattattttcacctg

SEQ ID NO: 2568295 - DNA, 20 bp, Homo sapiens
ttattcagcttcatttgtgt

SEQ ID NO: 2568296 - DNA, 12 bp, Homo sapiens
ttattccacatc

SEQ ID NO: 2568297 - DNA, 13 bp, Homo sapiens
ttattccacatct

SEQ ID NO: 2568298 - DNA, 20 bp, Homo sapiens
ttattccatattcatgtaaa

SEQ ID NO: 2568299 - DNA, 20 bp, Homo sapiens
ttattccccattcttcctag

SEQ ID NO: 2568300 - DNA, 16 bp, Homo sapiens
ttattccctgtacaat

SEQ ID NO: 2568301 - DNA, 20 bp, Homo sapiens
ttattcctatatagtttatt

SEQ ID NO: 2568302 - DNA, 16 bp, Homo sapiens
ttattcctcctgctca

SEQ ID NO: 2568303 - DNA, 20 bp, Homo sapiens
ttattcctcctgctcatatt

SEQ ID NO: 2568304 - DNA, 21 bp, Homo sapiens
ttattcctgataataattgat

SEQ ID NO: 2568305 - DNA, 19 bp, Homo sapiens
ttattcctgtatgttgtcc

SEQ ID NO: 2568306 - DNA, 11 bp, Homo sapiens
ttattctgctc

SEQ ID NO: 2568307 - DNA, 13 bp, Homo sapiens
ttattctttttaa

SEQ ID NO: 2568308 - DNA, 20 bp, Homo sapiens
ttattgaatctatttaagta

SEQ ID NO: 2568309 - DNA, 13 bp, Homo sapiens
ttattgagaattt

SEQ ID NO: 2568310 - DNA, 13 bp, Homo sapiens
ttattggaattaa

SEQ ID NO: 2568311 - DNA, 16 bp, Homo sapiens
ttattggaattaacct

SEQ ID NO: 2568312 - DNA, 14 bp, Homo sapiens
ttattggctgagat

SEQ ID NO: 2568313 - DNA, 16 bp, Homo sapiens
ttattggctgagatat

SEQ ID NO: 2568314 - DNA, 19 bp, Homo sapiens
ttattgtacagctgtttaa

SEQ ID NO: 2568315 - DNA, 15 bp, Homo sapiens
ttattgtacctctct

SEQ ID NO: 2568316 - DNA, 21 bp, Homo sapiens
ttattgtataaactatcagtt

SEQ ID NO: 2568317 - DNA, 20 bp, Homo sapiens
ttattgtgtttttaatttat

SEQ ID NO: 2568318 - DNA, 16 bp, Homo sapiens
ttattgttccaagaca

SEQ ID NO: 2568319 - DNA, 17 bp, Homo sapiens
ttattgttccaagacat

SEQ ID NO: 2568320 - DNA, 13 bp, Homo sapiens
ttatttaaaagat

SEQ ID NO: 2568321 - DNA, 14 bp, Homo sapiens
ttatttaaaagatt

SEQ ID NO: 2568322 - DNA, 17 bp, Homo sapiens
ttatttaaaagattcat

SEQ ID NO: 2568323 - DNA, 12 bp, Homo sapiens
ttatttaaatga

SEQ ID NO: 2568324 - DNA, 13 bp, Homo sapiens
ttatttaataaca

SEQ ID NO: 2568325 - DNA, 14 bp, Homo sapiens
ttatttaataacaa

SEQ ID NO: 2568326 - DNA, 19 bp, Homo sapiens
ttatttaataacattacct

SEQ ID NO: 2568327 - DNA, 17 bp, Homo sapiens
ttatttactgagcttct

SEQ ID NO: 2568328 - DNA, 22 bp, Homo sapiens
ttatttactgagcttctctgtg

SEQ ID NO: 2568329 - DNA, 17 bp, Homo sapiens
ttatttagactcatctt

SEQ ID NO: 2568330 - DNA, 23 bp, Homo sapiens
ttatttagactcatcttactgta

SEQ ID NO: 2568331 - DNA, 15 bp, Homo sapiens
ttatttatttatgga

SEQ ID NO: 2568332 - DNA, 20 bp, Homo sapiens
ttatttcactttagatgctg

SEQ ID NO: 2568333 - DNA, 15 bp, Homo sapiens
ttatttcagaaatgt

SEQ ID NO: 2568334 - DNA, 15 bp, Homo sapiens
ttatttcatgaaaat

SEQ ID NO: 2568335 - DNA, 22 bp, Homo sapiens
ttatttgaaaacatataaagca

SEQ ID NO: 2568336 - DNA, 15 bp, Homo sapiens
ttatttgcagagaca

SEQ ID NO: 2568337 - DNA, 13 bp, Homo sapiens
ttatttgcatgtg

SEQ ID NO: 2568338 - DNA, 17 bp, Homo sapiens
ttattttaaacaaaata

SEQ ID NO: 2568339 - DNA, 16 bp, Homo sapiens
ttattttagtttctgt

SEQ ID NO: 2568340 - DNA, 12 bp, Homo sapiens
ttattttcactg

SEQ ID NO: 2568341 - DNA, 15 bp, Homo sapiens
ttattttcctcccca

SEQ ID NO: 2568342 - DNA, 21 bp, Homo sapiens
ttattttctggtagatagaaa

SEQ ID NO: 2568343 - DNA, 23 bp, Homo sapiens
ttattttgccatggatgagagtc

SEQ ID NO: 2568344 - DNA, 20 bp, Homo sapiens
ttcagtgagggtcttcttac

SEQ ID NO: 2568345 - DNA, 13 bp, Homo sapiens
ttcagtgctgtgg

SEQ ID NO: 2568346 - DNA, 14 bp, Homo sapiens
ttcagtggggcagt

SEQ ID NO: 2568347 - DNA, 13 bp, Homo sapiens
ttcagtgtaattt

SEQ ID NO: 2568348 - DNA, 19 bp, Homo sapiens
ttcagtgtaatttctttgc

SEQ ID NO: 2568349 - DNA, 20 bp, Homo sapiens
ttcagtgtaatttctttgcc

SEQ ID NO: 2568350 - DNA, 13 bp, Homo sapiens
ttcagtgtacatg

SEQ ID NO: 2568351 - DNA, 15 bp, Homo sapiens
ttcagttacagaaag

SEQ ID NO: 2568352 - DNA, 19 bp, Homo sapiens
ttcagttggctgacttcca

SEQ ID NO: 2568353 - DNA, 19 bp, Homo sapiens
ttcagttttaccagatgat

SEQ ID NO: 2568354 - DNA, 12 bp, Homo sapiens
ttcagttttcag

SEQ ID NO: 2568355 - DNA, 20 bp, Homo sapiens
ttcataagtattatgtctct

SEQ ID NO: 2568356 - DNA, 19 bp, Homo sapiens
ttcatagctaagaaataaa

SEQ ID NO: 2568357 - DNA, 21 bp, Homo sapiens
ttcatatatgaggacttgtgt

SEQ ID NO: 2568358 - DNA, 20 bp, Homo sapiens
ttcatatgtaccatgtacat

SEQ ID NO: 2568359 - DNA, 16 bp, Homo sapiens
ttcatatgttgctcag

SEQ ID NO: 2568360 - DNA, 14 bp, Homo sapiens
ttcatattgaatat

SEQ ID NO: 2568361 - DNA, 22 bp, Homo sapiens
ttcatattgtgccaatatgtat

SEQ ID NO: 2568362 - DNA, 14 bp, Homo sapiens
ttcatcaagactgg

SEQ ID NO: 2568363 - DNA, 15 bp, Homo sapiens
ttcatcaatgaatga

SEQ ID NO: 2568364 - DNA, 18 bp, Homo sapiens
ttcatcatcctaagctat

SEQ ID NO: 2568365 - DNA, 20 bp, Homo sapiens
ttcatccaatcctcactggg

SEQ ID NO: 2568366 - DNA, 21 bp, Homo sapiens
ttcatccaatcctcactgggt

SEQ ID NO: 2568367 - DNA, 18 bp, Homo sapiens
ttcatcctgactctgccc

SEQ ID NO: 2568368 - DNA, 18 bp, Homo sapiens
ttcatctatttctgagaa

SEQ ID NO: 2568369 - DNA, 15 bp, Homo sapiens
ttcatctccagggag

SEQ ID NO: 2568370 - DNA, 22 bp, Homo sapiens
ttcatctccagggagtcccctc

SEQ ID NO: 2568371 - DNA, 14 bp, Homo sapiens
ttcatctctcagaa

SEQ ID NO: 2568372 - DNA, 22 bp, Homo sapiens
ttcatcttggtcacatacaatt

SEQ ID NO: 2568373 - DNA, 17 bp, Homo sapiens
ttcatgatttcatttca

SEQ ID NO: 2568374 - DNA, 17 bp, Homo sapiens
ttcatgattttgaaatc

SEQ ID NO: 2568375 - DNA, 22 bp, Homo sapiens
ttcatgccaccatggccagcca

SEQ ID NO: 2568376 - DNA, 22 bp, Homo sapiens
ttcatgccagctacttcctcct

SEQ ID NO: 2568377 - DNA, 17 bp, Homo sapiens
ttcatgctatctctgtg

SEQ ID NO: 2568378 - DNA, 22 bp, Homo sapiens
ttcatgtcaacttctggctcct

SEQ ID NO: 2568379 - DNA, 16 bp, Homo sapiens
ttcatgttttgtgact

SEQ ID NO: 2568380 - DNA, 17 bp, Homo sapiens
ttcatgttttgtgacta

SEQ ID NO: 2568381 - DNA, 19 bp, Homo sapiens
ttcattaagccctcttcca

SEQ ID NO: 2568382 - DNA, 21 bp, Homo sapiens
ttcattaccttttttgataaa

SEQ ID NO: 2568383 - DNA, 17 bp, Homo sapiens
ttcattattggaattaa

SEQ ID NO: 2568384 - DNA, 15 bp, Homo sapiens
ttcattctcctgcct

SEQ ID NO: 2568385 - DNA, 16 bp, Homo sapiens
ttcattcttctctagc

SEQ ID NO: 2568386 - DNA, 19 bp, Homo sapiens
ttcattcttgaaagctgtg

SEQ ID NO: 2568387 - DNA, 17 bp, Homo sapiens
ttcattgagagttttgt

SEQ ID NO: 2568388 - DNA, 22 bp, Homo sapiens
ttcattgagagttttgtcttga

SEQ ID NO: 2568389 - DNA, 21 bp, Homo sapiens
ttcattgccttaactggagcc

SEQ ID NO: 2568390 - DNA, 12 bp, Homo sapiens
ttcattgtaaaa

SEQ ID NO: 2568391 - DNA, 17 bp, Homo sapiens
ttcattgtaatgttact

SEQ ID NO: 2568392 - DNA, 13 bp, Homo sapiens
ttcattgtataaa

SEQ ID NO: 2568393 - DNA, 17 bp, Homo sapiens
ttcatttaaaatgatta

SEQ ID NO: 2568394 - DNA, 15 bp, Homo sapiens
ttcatttcaactgtt

SEQ ID NO: 2568395 - DNA, 12 bp, Homo sapiens
ttcatttcattg

SEQ ID NO: 2568396 - DNA, 16 bp, Homo sapiens
ttcatttgatgctaaa

SEQ ID NO: 2568397 - DNA, 19 bp, Homo sapiens
ttcatttggaaataagctg

SEQ ID NO: 2568398 - DNA, 14 bp, Homo sapiens
ttcatttttaatca

SEQ ID NO: 2568399 - DNA, 17 bp, Homo sapiens
ttcatttttaatcatga

SEQ ID NO: 2568400 - DNA, 23 bp, Homo sapiens
ttcatttttttcactggagttac

SEQ ID NO: 2568401 - DNA, 16 bp, Homo sapiens
ttccaaaagtggcctc

SEQ ID NO: 2568402 - DNA, 21 bp, Homo sapiens
ttccaaaagtggcctctttgt

SEQ ID NO: 2568403 - DNA, 20 bp, Homo sapiens
ttccaaagcacattgaaaga

SEQ ID NO: 2568404 - DNA, 17 bp, Homo sapiens
ttccaaatgaatgttgt

SEQ ID NO: 2568405 - DNA, 21 bp, Homo sapiens
ttccaaatgaatgttgtctgt

SEQ ID NO: 2568406 - DNA, 23 bp, Homo sapiens
ttccaacaccacagacacacaca

SEQ ID NO: 2568407 - DNA, 23 bp, Homo sapiens
ttccaacagctcaagtcttccct

SEQ ID NO: 2568408 - DNA, 16 bp, Homo sapiens
ttccaagacattgtca

SEQ ID NO: 2568409 - DNA, 17 bp, Homo sapiens
ttccaagacattgtcaa

SEQ ID NO: 2568410 - DNA, 15 bp, Homo sapiens
ttccaagggtactaa

SEQ ID NO: 2568411 - DNA, 12 bp, Homo sapiens
ttccaagtgtgc

SEQ ID NO: 2568412 - DNA, 18 bp, Homo sapiens
ttccacaaaatctgtcca

SEQ ID NO: 2568413 - DNA, 18 bp, Homo sapiens
ttccacaccaagcagcaa

SEQ ID NO: 2568414 - DNA, 17 bp, Homo sapiens
ttccacacccccacccc

SEQ ID NO: 2568415 - DNA, 21 bp, Homo sapiens
ttccacacctggcactgctgt

SEQ ID NO: 2568416 - DNA, 12 bp, Homo sapiens
ttccaccagcct

SEQ ID NO: 2568417 - DNA, 19 bp, Homo sapiens
ttccaccatcaagccacca

SEQ ID NO: 2568418 - DNA, 13 bp, Homo sapiens
ttccaccccctcc

SEQ ID NO: 2568419 - DNA, 15 bp, Homo sapiens
ttccacctccctccc

SEQ ID NO: 2568420 - DNA, 19 bp, Homo sapiens
ttccacgatgaaaaacttc

SEQ ID NO: 2568421 - DNA, 15 bp, Homo sapiens
ttccacggagccact

SEQ ID NO: 2568422 - DNA, 21 bp, Homo sapiens
ttccacggagccactcctctg

SEQ ID NO: 2568423 - DNA, 24 bp, Homo sapiens
ttccacggagccactcctctgact

SEQ ID NO: 2568424 - DNA, 14 bp, Homo sapiens
ttccactgagctcc

SEQ ID NO: 2568425 - DNA, 22 bp, Homo sapiens
ttccactggacttgagcttggc

SEQ ID NO: 2568426 - DNA, 20 bp, Homo sapiens
ttccagaggctattattttc

SEQ ID NO: 2568427 - DNA, 20 bp, Homo sapiens
ttccagctcaccccccacac

SEQ ID NO: 2568428 - DNA, 17 bp, Homo sapiens
ttccagtacctttgtca

SEQ ID NO: 2568429 - DNA, 18 bp, Homo sapiens
ttccagtacctttgtcac

SEQ ID NO: 2568430 - DNA, 19 bp, Homo sapiens
ttccagtacctttgtcaca

SEQ ID NO: 2568431 - DNA, 15 bp, Homo sapiens
ttccagtgaggctct

SEQ ID NO: 2568432 - DNA, 17 bp, Homo sapiens
ttccagtgaggctctgc

SEQ ID NO: 2568433 - DNA, 19 bp, Homo sapiens
ttccagtgcaacactgaag

SEQ ID NO: 2568434 - DNA, 17 bp, Homo sapiens
ttccataaggaatgtag

SEQ ID NO: 2568435 - DNA, 22 bp, Homo sapiens
ttccataatctggactcctctg

SEQ ID NO: 2568436 - DNA, 16 bp, Homo sapiens
ttccataatgtataaa

SEQ ID NO: 2568437 - DNA, 19 bp, Homo sapiens
ttccataatgtataaagaa

SEQ ID NO: 2568438 - DNA, 16 bp, Homo sapiens
ttccataattatgaca

SEQ ID NO: 2568439 - DNA, 22 bp, Homo sapiens
ttccataattatgacagttata

SEQ ID NO: 2568440 - DNA, 18 bp, Homo sapiens
ttccatatattagcattt

SEQ ID NO: 2568441 - DNA, 15 bp, Homo sapiens
ttccatatgacctca

SEQ ID NO: 2568442 - DNA, 16 bp, Homo sapiens
ttccatcatgtcccca

SEQ ID NO: 2568443 - DNA, 14 bp, Homo sapiens
ttccatcccagagg

SEQ ID NO: 2568444 - DNA, 21 bp, Homo sapiens
ttccatccctaccccctaaga

SEQ ID NO: 2568445 - DNA, 23 bp, Homo sapiens
ttccatctcgccacccctccttc

SEQ ID NO: 2568446 - DNA, 20 bp, Homo sapiens
ttccatgaagtttgaacttc

SEQ ID NO: 2568447 - DNA, 15 bp, Homo sapiens
ttccatgaatcgctt

SEQ ID NO: 2568448 - DNA, 20 bp, Homo sapiens
ttccatgaatgtatcaggaa

SEQ ID NO: 2568449 - DNA, 18 bp, Homo sapiens
ttccatgagaacagcagg

SEQ ID NO: 2568450 - DNA, 13 bp, Homo sapiens
ttccatgcctgag

SEQ ID NO: 2568451 - DNA, 15 bp, Homo sapiens
ttccatgcctgaggg

SEQ ID NO: 2568452 - DNA, 15 bp, Homo sapiens
ttccatggactttgt

SEQ ID NO: 2568453 - DNA, 17 bp, Homo sapiens
ttccatgtcgcctctgc

SEQ ID NO: 2568454 - DNA, 19 bp, Homo sapiens
ttccatgtcgcctctgcat

SEQ ID NO: 2568455 - DNA, 20 bp, Homo sapiens
ttccatgtcgcctctgcatt

SEQ ID NO: 2568456 - DNA, 21 bp, Homo sapiens
ttccatgtcgcctctgcattc

SEQ ID NO: 2568457 - DNA, 14 bp, Homo sapiens
ttccattatgattc

SEQ ID NO: 2568458 - DNA, 17 bp, Homo sapiens
ttccattggatctcatt

SEQ ID NO: 2568459 - DNA, 15 bp, Homo sapiens
ttccattgtttgaaa

SEQ ID NO: 2568460 - DNA, 21 bp, Homo sapiens
ttccattgtttggagacattc

SEQ ID NO: 2568461 - DNA, 19 bp, Homo sapiens
ttccatttatctttctaca

SEQ ID NO: 2568462 - DNA, 16 bp, Homo sapiens
ttcccaaaggactcca

SEQ ID NO: 2568463 - DNA, 19 bp, Homo sapiens
ttcccaaaggactccaccc

SEQ ID NO: 2568464 - DNA, 15 bp, Homo sapiens
ttcccaagctctgct

SEQ ID NO: 2568465 - DNA, 16 bp, Homo sapiens
ttcccaagctctgctc

SEQ ID NO: 2568466 - DNA, 18 bp, Homo sapiens
ttcccaagctctgctcct

SEQ ID NO: 2568467 - DNA, 14 bp, Homo sapiens
ttcccaattcacat

SEQ ID NO: 2568468 - DNA, 18 bp, Homo sapiens
ttcccacaggacatttct

SEQ ID NO: 2568469 - DNA, 15 bp, Homo sapiens
ttcccaccaaggtct

SEQ ID NO: 2568470 - DNA, 18 bp, Homo sapiens
ttcccaccaggctgctca

SEQ ID NO: 2568471 - DNA, 18 bp, Homo sapiens
ttcccactctagggcagt

SEQ ID NO: 2568472 - DNA, 15 bp, Homo sapiens
ttcccactgtttaag

SEQ ID NO: 2568473 - DNA, 13 bp, Homo sapiens
ttcccagaaggca

SEQ ID NO: 2568474 - DNA, 23 bp, Homo sapiens
ttcccagaaggcatatcagtctc

SEQ ID NO: 2568475 - DNA, 12 bp, Homo sapiens
ttcccagaatca

SEQ ID NO: 2568476 - DNA, 23 bp, Homo sapiens
ttcccagaatcaaagcaatgcat

SEQ ID NO: 2568477 - DNA, 14 bp, Homo sapiens
ttcccagatacttc

SEQ ID NO: 2568478 - DNA, 10 bp, Homo sapiens
ttcccagggt

SEQ ID NO: 2568479 - DNA, 20 bp, Homo sapiens
ttcccagggtagcccgcctg

SEQ ID NO: 2568480 - DNA, 23 bp, Homo sapiens
ttcccagggtagcccgcctgcca

SEQ ID NO: 2568481 - DNA, 18 bp, Homo sapiens
ttcccagtggctgctgcc

SEQ ID NO: 2568482 - DNA, 19 bp, Homo sapiens
ttcccagtggctgctgccc

SEQ ID NO: 2568483 - DNA, 13 bp, Homo sapiens
ttcccatcctacc

SEQ ID NO: 2568484 - DNA, 18 bp, Homo sapiens
ttcccatgacccaggctg

SEQ ID NO: 2568485 - DNA, 15 bp, Homo sapiens
ttaccatatgtgctt

SEQ ID NO: 2568486 - DNA, 23 bp, Homo sapiens
ttaccattttggggtacccactg

SEQ ID NO: 2568487 - DNA, 16 bp, Homo sapiens
ttacccacacacagat

SEQ ID NO: 2568488 - DNA, 20 bp, Homo sapiens
ttacccatatcccctctccc

SEQ ID NO: 2568489 - DNA, 16 bp, Homo sapiens
ttaccctcctgtaaat

SEQ ID NO: 2568490 - DNA, 16 bp, Homo sapiens
ttaccctttagactgt

SEQ ID NO: 2568491 - DNA, 17 bp, Homo sapiens
ttacctaaacagatata

SEQ ID NO: 2568492 - DNA, 18 bp, Homo sapiens
ttacctaaacagatataa

SEQ ID NO: 2568493 - DNA, 18 bp, Homo sapiens
ttacctaccacagtgtct

SEQ ID NO: 2568494 - DNA, 11 bp, Homo sapiens
ttacctctgat

SEQ ID NO: 2568495 - DNA, 18 bp, Homo sapiens
ttacctgatcaatgacag

SEQ ID NO: 2568496 - DNA, 14 bp, Homo sapiens
ttaccttcaataaa

SEQ ID NO: 2568497 - DNA, 18 bp, Homo sapiens
ttacctttttatttgcat

SEQ ID NO: 2568498 - DNA, 17 bp, Homo sapiens
ttaccttttttgataaa

SEQ ID NO: 2568499 - DNA, 16 bp, Homo sapiens
ttacggacaccccctc

SEQ ID NO: 2568500 - DNA, 18 bp, Homo sapiens
ttactaagccacaagaaa

SEQ ID NO: 2568501 - DNA, 20 bp, Homo sapiens
ttactaagccacaagaaatt

SEQ ID NO: 2568502 - DNA, 20 bp, Homo sapiens
ttactacaaaatttgaaatt

SEQ ID NO: 2568503 - DNA, 13 bp, Homo sapiens
ttactacagttgt

SEQ ID NO: 2568504 - DNA, 20 bp, Homo sapiens
ttactagggatccctcatct

SEQ ID NO: 2568505 - DNA, 23 bp, Homo sapiens
ttactcagaattctctagtttga

SEQ ID NO: 2568506 - DNA, 21 bp, Homo sapiens
ttactcatttttttaatttat

SEQ ID NO: 2568507 - DNA, 11 bp, Homo sapiens
ttactcccctt

SEQ ID NO: 2568508 - DNA, 23 bp, Homo sapiens
ttactgaacaatcaaagcacttg

SEQ ID NO: 2568509 - DNA, 19 bp, Homo sapiens
ttactgaaggtaaaattga

SEQ ID NO: 2568510 - DNA, 12 bp, Homo sapiens
ttactgaatgca

SEQ ID NO: 2568511 - DNA, 23 bp, Homo sapiens
ttactgaatgcaccatggtcaaa

SEQ ID NO: 2568512 - DNA, 12 bp, Homo sapiens
ttactgaccagc

SEQ ID NO: 2568513 - DNA, 14 bp, Homo sapiens
ttactgatcatgca

SEQ ID NO: 2568514 - DNA, 17 bp, Homo sapiens
ttactgatcatgcattg

SEQ ID NO: 2568515 - DNA, 23 bp, Homo sapiens
ttactgtctggttttaacaattt

SEQ ID NO: 2568516 - DNA, 20 bp, Homo sapiens
ttactgtggaggaaggattg

SEQ ID NO: 2568517 - DNA, 23 bp, Homo sapiens
ttactgttacctgatcaatgaca

SEQ ID NO: 2568518 - DNA, 18 bp, Homo sapiens
ttactgttagtcatttgc

SEQ ID NO: 2568519 - DNA, 14 bp, Homo sapiens
ttactgtttctgtc

SEQ ID NO: 2568520 - DNA, 15 bp, Homo sapiens
ttactgtttctgtca

SEQ ID NO: 2568521 - DNA, 21 bp, Homo sapiens
ttacttaaaccgccaaggctg

SEQ ID NO: 2568522 - DNA, 18 bp, Homo sapiens
ttacttaggtgtggggga

SEQ ID NO: 2568523 - DNA, 12 bp, Homo sapiens
ttacttctgcta

SEQ ID NO: 2568524 - DNA, 19 bp, Homo sapiens
ttacttgcattgaatatat

SEQ ID NO: 2568525 - DNA, 14 bp, Homo sapiens
ttacttttaaactg

SEQ ID NO: 2568526 - DNA, 21 bp, Homo sapiens
ttagaaaacataatcttctgc

SEQ ID NO: 2568527 - DNA, 22 bp, Homo sapiens
ttagaaagaagcccaatattat

SEQ ID NO: 2568528 - DNA, 18 bp, Homo sapiens
ttagaaggttctctcctc

SEQ ID NO: 2568529 - DNA, 16 bp, Homo sapiens
ttagaagtcacacagt

SEQ ID NO: 2568530 - DNA, 13 bp, Homo sapiens
ttagaagtgttaa

SEQ ID NO: 2568531 - DNA, 16 bp, Homo sapiens
ttagaattaaaagttg

SEQ ID NO: 2568532 - DNA, 13 bp, Homo sapiens
ttagaattattta

SEQ ID NO: 2568533 - DNA, 20 bp, Homo sapiens
ttagacaaatactcatgtgt

SEQ ID NO: 2568534 - DNA, 23 bp, Homo sapiens
ttagacaaatactcatgtgtatg

SEQ ID NO: 2568535 - DNA, 13 bp, Homo sapiens
ttagacagagtct

SEQ ID NO: 2568536 - DNA, 14 bp, Homo sapiens
ttagacagtccctg

SEQ ID NO: 2568537 - DNA, 13 bp, Homo sapiens
ttagacataacaa

SEQ ID NO: 2568538 - DNA, 13 bp, Homo sapiens
ttagacctcagcc

SEQ ID NO: 2568539 - DNA, 15 bp, Homo sapiens
ttagacctcagcctg

SEQ ID NO: 2568540 - DNA, 14 bp, Homo sapiens
ttagactacattta

SEQ ID NO: 2568541 - DNA, 14 bp, Homo sapiens
ttagactgtagcct

SEQ ID NO: 2568542 - DNA, 20 bp, Homo sapiens
ttagactgtagcctggatat

SEQ ID NO: 2568543 - DNA, 13 bp, Homo sapiens
ttagagatgaatt

SEQ ID NO: 2568544 - DNA, 18 bp, Homo sapiens
ttagaggaaaaaaatgac
